United States Patent 12,569,549 (FLAVIVIRUS VACCINE) - sequence listing, part 66

SEQ ID NO: 22860 - RNA, 9876 nt, synthetic construct
  misc_feature 1..9876: note = derived and/or modified CDS sequence (opt6) from DENV-2__KC762677__SS-prME
  source 1..9876: mol_type = other RNA
acagcaggaatcataataatgatgataccaaccgtgatggcctttcatctcaccacaaggaacggagagccacacatgatagtatcaagacaagaaaaagggaaaagtttgttgtttaaaaccgaaaatggcgttaacatgtgcactttaatggcaatggacctcggagaactgtgtgaagatacaattacttataattgtcccctcctaaggcaaaatgaaccagaagatatagactgctggtgtaatagtacatccacatgggtgacgtatggaacttgtacagctacgggagaacatcgaagagagaaaagatctgtagctctagtaccccatgttggaatgggactggagaccagaacggagacgtggatgagttcggagggagcatggaaacacgcacagagaatagaaacttgggttcttcgacaccctggatttacaataatggcggcgattctagcatatactatagggacaacccacttccaacgagttctaattttcatattgttaactgctgtcgcccccagtatgacaatgcgatgcatcggtatttcaaaccgtgactttgtagaaggtgtgtctggaggatcctgggtggacatagtcctggaacatggaagttgcgttacaactatggcgaaaaataaaccaacccttgactttgaactgataaaaacagaggcaaaacaccccgctaccctaaggaaatattgtatagaagctaagttaacaaatacaactaccgcttctcgatgtcccacgcaaggagaaccttctttaaatgaagaacaagataaacgtttcgtttgcaaacatagtatggttgatagaggctggggaaacggttgcggattattcggtaaaggaggaattgtgacgtgtgccatgttcacatgcaaaaaaaacatggaagggaaaatagtgcaacctgaaaatctggaatacacgattgtgattacaccgcacagcggagaagaaaatgcggtaggtaatgatacaggcaaacacggaaaggaaatcaaagtcacaccccaaagttcaataacggaagctgaattaactggatatggcaccgttaccatggagtgttcacctagaacaggtctcgactttaacgagatggttctcttacaaatggaaaataaagcttggttggtccaccgccagtggttcctcgacctaccattaccatggcttccaggagcggacacccaaggatctaattggatacaaaaagaaacgctcgtaacgttcaaaaatcctcacgcaaagaaacaggacgttgtagtattaggttcccaggaaggtgcaatgcatactgctctcacaggtgccacggagatacaaatgtcctccggaaaccttctcttcacgggacacttaaaatgtcgattaagaatggacaaattacaactcaaaggaatgagctacagtatgtgcacaggaaaatttaaagtagtaaaggaaattgcagagactcaacacgggactatcgttataagagtccaatatgagggagatggatctccttgcaaaataccatttgaaatcatggacctggaaaaacgtcatgtgctaggacgtctaataacggtcaaccctattgttaccgaaaaggatagccctgtgaacatcgaagcagaacctcccttcggtgacagctacataatcataggggtcgaacccggacagctcaagctctcatggtttaagaagggatcctccattggccaaatgtttgaaacaacaatgaggggcgcaaaaaggatggcgattttgggcgatactgcctgggattttgggtcgctcggtggagtattcacttctatcggtaaagctctgcaccaagtgtttggagcgatatacggggcggcatttagtggtgtatcatggacaatgaaaatcttaataggggtagttataacatggatcggtatgaattcacgaagcacaagcttgtcggtatcgttggttctcgtgggggtagtaacactttatctaggagtcatggttcaagcagattcaggttgtgtagttagttggaaaaataaggagttaaaatgtggatcaggaatatttatcactgataatgtacatacatggacagaacaatacaaatttcaaccagaatctccatcaaaattagcatcagcaatacaaaaggctcacgaggaaggcatctgtggtataagaagtgttacgagactggagaaccttatgtggaaacaaattactccggagttgaatcacatactcagcgaaaatgaggtaaaactaacaatcatgacaggtgacattaaaggtataatgcaagccggtaaaagatcgctaagaccacagccaactgagctaaaatacagttggaaaacttggggaaaagcaaaaatgttaagcacggaattacataaccacacattcttaatagacggaccagaaactgcagagtgccccaatactaacagagcgtggaacagtttagaagttgaagattatgggtttggagtattcacaacgaatatatggctaaaactaaaagagcgacaggatgtttattgtgacagtaaacttatgagcgcagcaataaaagataatcgtgcagttcatgccgacatgggctattggatcgagagcgccctgaacgatacctggaaaattgaaaaagcctcatttattgaagtaaagtcctgttactggccaaaaagtcacacactatggtcaaacggtgtcctggaaagcgaaatgatcatacctaaaaacttcgcaggaccagttagtcagcacaattacagaccaggatatcacacacaaaccgcgggaccctggcacctaggaaggctggagatggactttgacttctgtgaaggtactacagtagtcgtcactgaagattgtggtaatagaggacccagtttgcggacgacaacggcttcaggaaaacttataacagaatggtgctgccgatcatgcactctacctccacttagataccgaggggaggatggttgctggtatggaatggaaattagacctatgaaagagaaggaagaaaatctagttaatagcctggtaacagccggacatggacaaatagataatttctccttgggcgtgttaggcatggcgttgttcctagaagagatgctccgtacaagagtaggaaccaaacatgctatactactagtcgccgtatctttcgtaactctcatcacaggcaacatgagttttcgtgacttaggtcgagtaatggtcatggttggagctactatgactgatgatatcggtatgggagtaacgtacctagctcttctagccgcgtttaaagtaaggccaacatttgcggcgggacttctattaagaaagctgacatcgaaagaattaatgatgaccactattggtatagtgttactatcccagagcaccattcctgagacaatattagaattaacagacgctctagcactgggaatgatggcgctaaagatcgtaagaaatatggaaaagtatcaattagcagttactataatggcaattctatgtgtacctaatgcagtaatccttcaaaatgcatggaaagtaagttgcactactttagccgtcgtaagtgttagtcctttactactgacgtcatcacaacaaaaggctgattggattccactagctttaactataaaagggctcaatccgaccgcaatctttctaactacgttaagtcgcacttccaaaaagcgtagttggcctcttaatgaggcaattatggctgttggtatggttagtatcttggcaagttctttgttaaaaaatgatattcccatgactgggcctctagttgctgggggcttgctgaccgtgtgttacgttctaacaggacgctcagcagatctcgaactagaaagagccgcagacgtcaggtgggaggaacaagctgaaatcagtggatcatcgccaatattatcaataaccatttccgaggatgggagcatgagcataaaaaatgaggaggaggaacaaaccttaactatactgataaggaccggtttacttgttattagtggactttttcctgtatcaataccgatcacagcagcagcttggtatttatgggaggtaaaaaaacaacgtgctggggttttgtgggacgtaccatcgccgccaccagtaggcaaagctgagctagaagacggagcctatcgcataaagcagaagggaattttgggttactctcagataggtgcgggagtatacaaagagggcacttttcacacaatgtggcatgtaacgaggggagctgttttaatgcataaaggcaagcgaattgaacctagctgggcagacgtcaaaaaagatctaataagttatggtggcgggtggaaattggaaggggagtggaaggagggcgaagaagttcaagtgctggccctcgaaccagggaaaaaccctcgagctgtacagactaaacctggattatttaaaacgaacacaggcacaattggagccgtttcactagatttttcacccgggactagtggttcgcctattgtagacaaaaagggaaaagttgtcggcttatatggtaatggggttgtaacacgatccggaacttatgtaagtgccatagctcaaacagaaaagtctatagaagataacccagaaatagaagatgacattttccgaaaaaagagactcacaatcatggacttacacccaggggctggaaaaacaaaaaggtacttaccagcaatagtgagggaagctatcaaaagaggtttacgcacattaatattagctcctactagagtagtagccgctgagatggaagaagctttaaggggcctaccaattagataccagacaccggctataagagcggagcatacaggtagggaaatcgtagacctgatgtgccacgcaacatttactatgcgacttttgtctccaatccgtgtaccaaattataatttgatcataatggacgaagcgcacttcacagaccctgcatcaatagcagcacgaggttatatatcaacgagggtagagatgggtgaggcagcaggcatattcatgacagcaacgccgcctggctctcgcgacccatttccacaatcaaacgcgccaataatggatgaagaaagagaaattcctgaacgatcgtggaacagcggtcacgaatgggtcactgacttcaaagggaaaacggtatggtttgtgccttccattaaggccggtaatgacatagctgcatgtctacgaaaaaatggtaaaaaagtaatacagttatcacgaaaaacgttcgactttgaatacattaaaacaagaacaaatgattgggattttgtagtgaccactgacataagtgaaatgggtgcaaacttcaaagctgaaagagttatagacccaagacggtgtatgaaacccgtgatattaactgacggtgaagaaagagtaattcttgcaggacctatgccagtaacccacagttctgcagcacaaagaagaggcagggttggtagaaatccgaaaaatgagaatgatcaatatatctacatgggtgaacccttggaaaatgacgaagattgcgctcattggaaagaagcaaaaatgcttttagataacataaacactcctgaagggataatcccaagcatgttcgagccagaaagagaaaaagtagatgcgatcgatggagaatatagactgagaggtgaagcacgtaaaacttttgtggatttgatgcgacgcggtgatctacctgtatggctagcatatcgagtagctgctgagggtattaactacgccgacagacgttggtgtttcgatggtgtaaagaacaatcaaatattagaggaaaacgtcgaggttgaaatttggacaaaagagggagaacgcaaaaagttaaaaccccgatggttagacgcacgtatatactcagacccgctcgctttaaaagaatttaaggaattcgcagctggaagaaagtcacttacgctcaacctaatcactgaaatgggaagacttcctacattcatgacgcaaaaagctaggaatgcattagacaacctagcggtattacatactgctgaagcaggaggaagagcttataatcatgccctatcagaactaccagaaacattagaaactctacttctgctgacccttctagccaccgttaccggtggaatatttcttttccttatgtctggtaaaggtataggcaaaatgacccttgggatgtgttgtatcataacagccagtattttgttatggtatgctcagatacaaccacactggatagcggcgagtataattctcgagttctttttaattgttctcttaatacctgagccggagaaacaacgtaccccacaagataatcaacttacttatgttgttatagctatcctcacagtagtagcagctacaatggccaatgaaatgggatttttggaaaaaacaaagaaagactttgggctaggtagtattacaacccaacagccagaaagcaatatattggatattgacctccggccggccagtgcatggacgctttatgctgtagccactacatttattacgccgatgctcaggcatagcatagaaaatagtagtgttaatgtaagtttgacagctatagcgaatcaggcaacagtcctcatgggactaggaaagggttggccactaagcaagatggacattggagtacctctactggccataggttgttattctcaagtaaacccgataacgttgacagcagccttattgttgctggtagcgcactatgctataataggaccgggattgcaagctaaagcaacccgagaggcccaaaaacgagcggcagcgggcatcatgaaaaaccctactgttgatggtatcacagttatagaccttgaccccataccgtatgatccgaaattcgaaaaacaactagggcaagtaatgctcttagtgttgtgcgtaacacaggtgcttatgatgcgtaccacttgggcgctatgtgaggcactaactctagctacgggaccaatatcaacactctgggaaggaaacccaggcagattttggaacaccacaatcgcagttagcatggctaatatattcagagggagttatctggccggtgcagggttattattttcaatcatgaagaatactgcaaatacaaggagagggaccggaaatacgggtgaaactctaggagaaaaatggaagaatcgcttaaacgcgctcggaaaatctgagtttcagatttataaaaaatctggtatacaagaagtagatcgaacattggccaaggaaggaataaaaaggggggaaactgaccatcatgcggtatctcgaggaagtgcgaaactgagatggtttgtagaaaggaatttggtaacaccagaaggcaaggtagtcgaccttggttgcggacgtgggggatggtcttattattgcggtggtctaaagaacgtaaaagaagtgaaaggtttaactaaagggggacctgggcacgaagaacccatacccatgagtacatacggttggaatctcgttcgtcttcaaagcggagtcgatgtattttttaccccacctgaaaaatgcgatacgttattatgtgatataggggaatcctcacctaatccaacagttgaagctggtcgcactcttcgggtactaaatcttgtggagaactggttaaacaacaatacacaattttgcataaaagtgctaaatccctacatgccgagcgttatagagaagatggaagcattgcagcgaaaatatggaggagcattagtgagaaatcctctctcccgaaacagtacacacgaaatgtactgggtatcgaatgcaagtggtaacatcgtttcctcagtgaatatgatatctcgcatgctaattaaccggtttactatgcgacataagaaagctacatatgaaccggatgtagatttggggtctggcaccagaaatataggtattgaaagtgaaataccaaacttagatattataggcaagagaatagaaaaaataaaacaagaacatgaaactagttggcattatgatcaagaccacccatataggacctgggcctatcatgggtcatatgaaaacaaacagacaggaagcgcgtcaagtatggttaatggagtagtaagattgctaaccaaaccttgggacgtaattccaatggtcacccaaatggcgatgacagatacgacaccgttcggacaacaaagggtctttaaagagaaggtcgacaccaggacgcaggagccaaaagaggggacgaagaagctaatgaaaattacagccgagtggttatggaaagaattaggaaaaaaaaaaacacctcgtatgtgtacaaggaaggagtttacaaggaaggtcagatcaaatgcagccctaggcgccatatttacggacgaaaacaaatggaagagtgctagggaggcagtcgaagattctggcttctgggaacttgtggataaagaacggaatttacatctggaggggaagtgtgaaacgtgcgtatacaacatgatgggcaaaagagaaaaaaaactaggcgaatttggtaaagccaaaggcagccgtgcaatatggtacatgtggttgggtgcaagattcctagaattcgaagctctcggtttccttaatgaggaccactggttctcacgagaaaacagcctttcaggggttgaaggagaagggctacacaaattgggctatattttaagagacgtatcaaaaaaggaaggaggcgcaatgtacgcggacgataccgcagggtgggatactaggattactctggaggatctaaaaaacgaggaaatggtcactaatcatatggaaggcgaacataaaaaactagctgaagcgatatttaaactaacatatcaaaataaggtagtacgcgttcaacggcccaccccacgtggcacagttatggatataatatctcgacgggatcaaagaggaagcggacaagtagtcacttatggccttaacacttttactaacatggaagctcagcttattcgacaaatggaaggcgaaggtgtgttcaaatcaattcagcaattaacagtcacggaagagatagccgttaagaattggttagtgagagtgggcagagaaagactgagtaggatggcgatctcaggcgacgattgtgtagtaaaaccattggatgataggtttgccagtgcattaacagcactcaatgacatggggaaagtacggaaagatatacaacaatgggaaccgagcaggggttggaatgattggactcaagttccgttttgttcacaccatttccatgaattaattatgaaggacggacgagtgttggtagtcccatgtaggaatcaggatgaactgattgggagagcacgcataagccaaggagcaggatggtcattacgggaaacggcttgcttgggtaaaagctatgcccaaatgtggtctctaatgtacttccatcgaagagacttacgattagcagctaacgcaatatgttccgcagtgccatctcattgggtaccaacatctagaactacatggtcaatacacgctactcatgagtggatgaccaccgaagacatgctgacagtttggaatagagtgtggatacaagaaaatccgtggatggaagacaaaacaccagtggaaagctgggaagaaataccttacttaggaaaaagagaagaccaatggtgtgggtcccttatcggtctaacgagtagagctacttgggcaaaaaatatacaaacagcaataaatcaggtcaggtcgctaattggtaatgaagaatatactgattatatgccttcaatgaaaaggtttagaagggaagaagaagaagctggtgttttgtggtag

SEQ ID NO: 22861 - RNA, 9876 nt, synthetic construct
  misc_feature 1..9876: note = derived and/or modified CDS sequence (opt6) from DENV-2__KC762668__SS-prME
  source 1..9876: mol_type = other RNA
acagccggcataataatcatggtgataccaactgtaatggcgtttcacctaacaactcgaaatggggaacctcatatgattgtatctagacaagaaaaagggaaatcattgttattcaaaacagaaaatggtgttaatatgtgtacactaatggctatggatctaggcgaactatgcgaagacacaataacttacaattgtcctttgttaagacagaatgaaccggaagatatagattgctggtgtaattcaacatcaacttgggtaacatatggaacatgtacagccacgggagagcatcgtcgagaaaaacgcagtgtagcacttgttccgcatgtaggcatgggtctggaaacacgtacagaaacatggatgtcttctgaaggagcttggaaacatgctcaaagaatagaaacgtgggtacttaggcaccctggatttacgataatggcagccatccttgcttacactattgggacaacatatttccaaagagtcttaatattcattttacttactgcagtagcaccatccatgacaatgcgctgcataggaatatccaatcgagacttcgtcgaaggagtatctggaggttcatgggtcgatatagtacttgagcacggttcatgtgtaacgacgatggcgaaaaacaaacctactctggatttcgaattaattaaaacagaagccaaacatccagctacactaagaaaatattgcatcgaggctaaactaacaaatacaacaacagcatctagatgccctactcaaggagagcctagcttgaatgaggaacaagacaaaaggttcgtctgcaaacattcaatggtagacagaggttggggtaatgggtgcgggctatttggcaaaggaggtatcgtcacatgtgcgatgtttacttgtaagaaaaacatggagggaaaaattgtccagcctgagaatctagaatacacaatagtaattacacctcatagtggtgaggaaaacgcagtcggaaacgatactgggaaacacggtaaagaaataaaaatcacacctcaatcctccattacagaagccgaattaacaggttatggtactgtcacgatggaatgttcaccccgcactggattggactttaatgaaatggttttgcttcaaatggagaataaagcgtggttagtacataggcaatggtttctagatcttcccttaccgtggcttcccggtgctgatacacaaggatcaaattggatacaaaaagaaacattagtaacattcaaaaatccacatgcgaagaaacaagatgtcgtagtactaggatcacaagaaggtgcaatgcatacagccttgactggtgcaactgaaatacaaatgtcttctggaaacttattatttactgggcacctcaaatgtagactaagaatggacaaactacaactaaaaggtatgagctacagcatgtgcacagggaaattcaaagtcgtcaaagagattgcagaaacgcaacatggtacaatagtaatcagagtacaatacgaaggcgatggatcaccttgcaaaatcccttttgaaattatggatctagaaaaacgtcacgttcttggaagactaattacagtgaatcctatagtaactgagaaagattccccagtaaacatagaggcagaaccaccgtttggagattcatacatcataataggagttgaaccgggacaactcaaactctcgtggtttaagaaaggctcaagtataggtcaaatgtttgaaacaactatgagaggcgcgaagagaatggcaatactaggggacacagcgtgggactttggctctctagggggagttttcaccagcatcgggaaggctttgcatcaagtatttggggccatctatggtgctgcattttcaggggtaagctggaccatgaaaattcttatcggagtggttataacgtggataggaatgaactccagatctacaagcctatccgtatcgttagttcttgttggagtcgtgaccctatatcttggggtcatggtacaagctgattctggatgtgttgtctcatggaagaataaagaacttaaatgtggtagtggaatctttataacagacaatgtacacacatggactgaacaatacaaatttcaacctgaatcaccatcaaaactagcaagtgcaatacaaaaggcacatgaagaaggaatctgtggaatccgctcagttactagattagaaaatttaatgtggaagcaaataacccctgaactcaaccacattctaagtgaaaatgaagtcaaactaaccataatgacgggtgatataaaaggcataatgcaagcaggaaaaaggtctctcaggccccaacctactgaattgaagtactcatggaaagcgtgggggaaggcaaaaatgctgagcacagaattacataaccacacatttttaattgatgggcctgagacggccgaatgtcccaatactaaccgagcatggaatagcttagaagttgaagattacggctttggggtttttacgacaaacatttggctaaagttaaaagaaaggcaagatgtgttttgcgattcaaagctaatgagtgccgcgataaaagataatcgcgcagttcacgcggacatgggatactggatagagagtgccttaaacgatacatggaaaattgaaaaagcatcgtttattgaagtcaagagctgccactggccaaagagtcacacactttggtcaaatggagtattggaatcagagatgatcatcccaaagaatttcgcaggacctgtaagccaacataactatcgtccagggtaccacacccaaaccgcaggcccatggcacttgggacgtctggagatggactttgacttctgtgaaggtacaacagtcgtcgttaccgaggattgcggaaatagaggcccatcattacggacaaccactgcgagcggaaaattgataacagagtggtgttgccgatcttgtacattaccacccctacgatatcgaggagaagatggatgttggtatggcatggagattcgacctctaaaagaaaaggaagaaaacttggttaactcgcttgtcacagccggccatggacaaatagataattttagcttaggagtactcggaatggcgttattcctagaggagatgctaagaacacgtgttgggacaaaacacgctatactcctagtagcagtgtcttttgttactctaattacgggaaatatgtccttcagagatctaggtagagttatggtgatggtaggggcaacaatgacagacgatataggaatgggtgtgacttacctggcactactcgctgccttcaaagtccgtcccacatttgcagcagggttattattaagaaaattaacctcaaaagaactcatgatgaccacgataggaatcgtactgctatcacaatcaacaataccggagacaattttggaacttacagacgcattagccttggggatgatggtactaaaaatcgtacggaacatggaaaagtatcaactagctgtaacaattatggccatactctgcgtccccaatgccgtcatattacaaaacgcttggaaagtttcttgtaccacactcgcagtcgtttctgtaagtccacttttattaacgtcgagccaacaaaaagccgattggatacccttggctctcactataaaaggattaaatcctacggcaatttttcttacaactcttagcagaactagcaagaaaaggtcgtggcctcttaacgaggcaatcatggcagtaggtatggtaagtattttggcaagtagtctgcttaagaatgatataccaatgaccggtccactggttgctggagggcttttaacggtgtgctatgtactaacgggtagatccgcagacctagaactagagagagcagcagacgttcggtgggaagaacaagcagaaatttcaggatcttcaccgatattatcaatcactatctctgaggatggctctatgtcgataaagaatgaagaggaagaacaaacccttacaatcctgataagaacaggactcctagttatttctgggctttttccggtttctattcctataacagctgctgcatggtacctctgggaagtgaagaaacaacgcgctggagtactctgggacgtcccttctccacctccagtgggaaaagctgaattagaggacggggcatacagaataaaacaaaaaggcatactcgggtactcacaaattggtgctggagtctacaaggaaggcactttccatacaatgtggcacgtaacacgtggtgcggttctcatgcataaaggaaaaaggattgagcctagttgggctgatgtaaagaaagatttaatatcctacggtgggggatggaaactcgaaggcgagtggaaggaaggagaagaagtacaagtcttagcgctggaaccgggtaagaacccccgggcagtacagaccaaacccggtcttttcaaaaccaacacaggaatcataggcgccgtatccctagattttagcccaggtacatcaggatcgccgattgtcgacaagaaaggtaaagttgtgggtctctacggaaatggcgtagtaactagaagcggcacttacgttagcgccatagctcaaaccgaaaaatctatcgaagacaatccagagattgaagatgacatttttagaaagaagaggcttactataatggatctgcacccgggtgccggaaaaaccaaaagatacctcccagcaattgtccgagaggctataaagaggggattgcgaactttgatactcgctccaaccagagtcgtggcagcggagatggaagaagcactaagaggcttacctatacgctatcaaacaccagcaattagagcggaacacacaggaagagaaatagttgacttgatgtgtcatgcaacatttactatgaggctgctttcaccaataagagtacctaactacaatttaataattatggacgaagcgcatttcacagaccccgcttccatagcagcaagaggttacatctcaacaagggtagagatgggggaagctgcaggcatctttatgactgccaccccacccggatcacgggacccattcccacagtcaaatgcacctatcatggatgaagaaagagaaattcctgagcgatcatggaactcagggcatgagtgggtaactgattttaaaggaaaaacagtttggtttgtgcctagtattaaagcggggaacgatattgctgcatgtctacgtaaaaatgggaagaaagtgatacaattatcacgtaaaacttttgattttgagtacattaagacgcggaccaacgattgggactttgtagtcactaccgatattagcgaaatgggtgctaattttaaagcagagagagtcattgaccctcgaagatgtatgaaacctgtgatattaacggatggcgaagaaagagttatacttgctggtccgatgccggtcacccatagctctgcagctcagcgacgaggacgagttggaagaaatcctaaaaacgagaatgatcagtatatctatatgggcgaaccactcgaaaacgatgaagattgtgctcattggaaggaagccaagatgctgttagacaacataaatactcctgaaggaataataccttccatgtttgaaccagagcgtgagaaagtagatgccatagatggggaataccgactcagaggggaagcaaggaaaacattcgtcgatctgatgagacgcggagatctgccagtatggctagcgtaccgagtagccgccgaaggaataaattatgcagacagacgatggtgctttgatggagtgaaaaacaaccaaattctggaagaaaatgtagaggtggaaatatggacgaaagagggagaaaggaagaaattaaaaccaagatggctagacgcaagaatctatagtgaccctttggcattaaaagaatttaaagagttcgctgcagggaggaaaagtttgacattgaatttaataactgaaatgggcagactaccaacttttatgacgcaaaaagcacggaacgctctcgacaacttagctgttttacatacagcggaagctggaggacgcgcctataatcatgcgctctcagaattaccagaaaccctagagacactgttacttctaaccttgttagcaactgtaacaggcggcatatttttatttctaatgagtggtaaaggaattgggaagatgacgttaggaatgtgttgtataatcactgcttcgattttgctctggtacgcccaaatacaaccacattggatagcagcgagcattattctagagttctttttaatagtactattaatcccagaacctgaaaaacaacgtacgccacaagataatcaactaacatatgttgtcattgccatattaactgtggttgcggctacgatggcgaatgaaatggggtttctcgagaaaaccaagaaagacttcggtttggggtcaatcaccactcaacaattagagagcaatatcttagatatcgacctaagaccggcgtctgcttggaccttatacgcagttgctacaacgtttatcacacccatgctaagacattcgatagaaaatagcagtgtcaatgtatctctaactgctattgcaaatcaagctacggttctaatgggtctcggtaaaggctggcccctaagcaaaatggacattggcgtgcctttactagccattggatgttactcccaagttaatccaattacgttgacagcagcactcttattactggtcgctcattatgccataataggacccgggcttcaggcaaaagcaacgagagaagcacaaaaacgcgctgcagcagggattatgaaaaatccaacagtagacggaatcaccgtcattgatctcgacccaataccatacgacccaaagttcgaaaagcaactagggcaagtaatgctcttagtactatgtgttacacaagtcttgatgatgcgaacaacatgggccttatgtgaagcacttacattagcaactggacctattagtacgctctgggaaggcaacccaggtaggttctggaacaccacaatagcagtatcaatggcaaacatctttagggggtcatacttagcaggcgcaggcctattatttagtatcatgaagaacaccgcaaatacacgtcggggtactggaaacacaggtgaaactttaggagaaaagtggaaaaacagacttaatgccttaggtaaatccgaatttcaaatttataagaaatcaggtatacaagaagttgacaggacactagcgaaggagggaataaaaagaggagaaacagatcatcatgcagttagtcgaggtagcgccaaattacgatggttcgtggaacggaatttggtgactcctgaaggaaaggttgttgatcttggatgtggacgaggaggttggagttactactgtggaggacttaaaaatgtaaaggaagttaaaggcttgactaaaggtggtcccggtcacgaagaacctataccgatgagtacatatggttggaacttagtaaggttacaaagcggagtggatgtatttttcacgccacctgaaaaatgtgacacactcctgtgtgatattggagaatcttcgccaaatcctacagtggaagcaggtaggactctacgagtcttaaatctcgtggaaaattggttgaataataatacgcaattttgcatcaaggtccttaatccatacatgcccagtgtcatagagaaaatggaagctctacagagaaaatatggaggagctcttgtgagaaatcccctaagcagaaattccactcacgaaatgtattgggttagtaatgcatccggcaatatagtaagttcagtaaatatgataagcagaatgctcattaaccggtttacaatgagacacaagaaagcaacatacgaaccggatgtagatctcggaagtgggacacgcaatataggcatagaaagtgagacccctaatctagacataataggaaaaaggatagagaaaataaagcaggaacatgaaacatcatggcattatgatcaagatcatccctataagacatgggcttatcatgggagctacgagacaaaacagacgggctccgcaagcagtatggttaatggagttgtaagactgttaacgaaaccatgggatgtaatccctatggtgacccaaatggcaatgacagatactacgcctttcggacaacaaagggttttcaaagaaaaagtagatacccgcactcaagaaccaaaagaaggtaccaagaaacttatgaaaataaccgccgaatggctttggaaagaattaggcaagaagaaaacgccccggatgtgtacacgcgaagagtttactagaaaagtacgcagtaatgccgctttgggagcgattttcactgacgaaaataaatggaaatcagctagagaagcagtggaagatagtggcttttgggagctagttgataaggagcggaaccttcacttggaaggtaaatgcgaaacatgtgtatacaacatgatgggcaaaagggagaagaaattgggggagttcgggaaggcgaaagggtcaagggcgatttggtatatgtggttaggagcgcgatttttagaatttgaagccttagggttcctcaatgaagaccactggtttagtcgcgaaaattctctctcaggcgtagaaggtgagggactacacaagctagggtacatccttcgtgacgtaagtaagaaagagggcggagcaatgtacgcagatgatacggcagggtgggacactaggataacacttgaagatcttaaaaacgaagaaatggtaacaaatcacatggaaggggaacataaacgattggcggaagcaatctttcgcctgacataccagaataaagttgtgcgggtacaacgcccaacaccgcgtggaaccgtcatggatataatttctcgaagagatcaaagggggagtggacaggttgtaacatacggactaaacacttttaccaatatggaagcacaattaatcagacaaatggaaggcgaaggtgttttcaaatctatacagcacttaacagtaactgaagagattgcagtcaaaaattggttagcgcgtgtaggccgtgaaaggttatcaagaatggctatatcaggagacgactgtgtagtaaagcccctcgacgatagatttgcatctgctttaaccgcactcaatgatatgggaaaagtgcgaaaagatatacaacaatgggaaccaagtcggggttggaacgattggactcaggtacccttctgctcacatcattttcatgaattaatcatgaaagatggacgtgttctcgtcgttccatgtagaaatcaagacgaattaataggcagggcccgcatatcccagggcgcaggttggtcgcttagagaaacagcatgcttaggaaaatcgtacgcgcaaatgtggtcccttatgtacttccatagaagagacttaaggctagcagccaacgcaatctgtagtgcagtcccaagccattgggtacctacatctcgtaccacttggtcaatacatgccactcacgagtggatgactacagaagatatgcttactgtgtggaatcgggtatggattcaggaaaatccatggatggaagataaaaccccagtagaatcctgggaagaaataccatatctagggaaacgtgaagatcaatggtgtggaagtctcataggcctaactagccgcgctacttgggcgaaaaatatccaaacggccatcaatcaagttcgtagtctgataggcaacgaagaatatactgactatatgccatctatgaaaagattcagacgagaagaggaagaggctggagttctttggtag

SEQ ID NO: 22862 - RNA, 9876 nt, synthetic construct
  misc_feature 1..9876: note = derived and/or modified CDS sequence (opt6) from DENV-2__KC762678__SS-prME
  source 1..9876: mol_type = other RNA
accgctggtatcatcataatgatgatccctactgtcatggcattccatctaacaacaaggaacggggagccacatatgattgtgagcagacaagaaaaaggtaaaagtctactatttaaaaccgagaatggggttaatatgtgcacattaatggcgatggacctaggtgagttatgtgaagacactattacatacaattgcccgctattaagacagaacgagccggaagacattgactgttggtgtaatagcacgtcaacgtgggtgacgtatggcacatgcacggctactggtgagcatcgacgtgagaaaaggagcgtagctttagtaccacacgtaggtatgggtttggagacgcgaacagaaacatggatgtcatcagaaggggcctggaaacatgcacagaggatagaaacctgggtcctgaggcaccctggattcacgatcatggcagccattttagcatataccataggaactacctactttcaaagaattctaatctttatcttacttactgcagttacaccaagtatgaccatgagatgcataggaatatcaaaccgggatttcgttgagggagttagcggcggatcatgggtagatatcgtcctcgaacatggttcgtgtgtaactaccatggcaaagaacaaacccacattggactttgaactaataaaaacagaagccaaacacccagctacgttgagaaaatattgcatcgaagcgaagctcaccaacacgactacggcaagcagatgtccaacacaaggagaacccagtttaaatgaagaacaagacaaaagatttgtgtgtaaacactcaatggtagatagaggctggggcaacggttgcggattattcggaaaagggggaatagttacctgtgctatgttcacctgcaaaaaaaacatggaaggcaaaattgtccagccagaaaatttagaatacacgatagttataactccacactcgggcgaagaaaacgccgtgggaaacgatacaggtaaacacggaaaagaaatcaaagtgacaccacaatcgtctattacggaagcagaattgacgggttatggaacagtcaccatggaatgttcccccagaacaggcctagattttaacgaaatggtcctcttacagatggaaaataaagcatggttagttcatcgacaatggtttttagatttgcccctaccttggttgccaggagctgatacacaaggaagcaactggattcaaaaggaaacattagttaccttcaagaacccacatgcaaaaaagcaagacgtcgtagtcttaggaagccaagagggcgctatgcataccgcacttacgggggcgaccgaaatccaaatgtcatctggaaatttattgtttacgggccacctgaaatgtcgtctaaggatggacaagttacaacttaaaggtatgtcctattcgatgtgtacaggcaaattcaaggtcgtgaaagaaatagcagaaacgcaacatggtactatagtaatacgagtacaatatgaaggagatggatctccttgtaagatacccttcgaaataatggatttagaaaaaagacatgtactagggagattaataacagtaaatccaatcgtaacagagaaagactctcctgttaatatagaggctgaaccaccatttggcgatagctatattataataggagttgagccgggacagttaaaattatcatggtttaaaaaaggttcatcgataggccagatgtttgagacgaccatgcgtggtgcaaaaagaatggctatattaggagataccgcttgggatttcgggagtttaggtggagttttcacaagtattgggaaagcgctgcatcaagtatttggggcaatttatggggcagcattcagtggagtttcgtggaccatgaaaattctaataggagtggtcataacatggataggtatgaactcaagaagtacgtcacttagtgtctctctggtcttagtcggagttgtaacgctttatctcggggtgatggtgcaagcggactccggctgtgtagtgagttggaaaaataaggaattaaaatgtggctcaggaattttcatcacggacaatgtacatacctggacagaacaatataaattccaacccgaatctccaagcaaattagcttccgccatccaaaaagctcacgaagaaggaatctgtggtatccgctctgtgacaaggctagaaaacttgatgtggaaacaaataacaccagaattgaaccatatactcagtgaaaatgaagtaaaattgacgataatgactggagatataaaaggcataatgcaggcgggaaagagaagccttagacctcaaccaaccgaactaaaatatagttggaaaacatggggaaaagctaaaatgctatctacagaactgcataaccatactttcttaatagacgggccagaaacagcagagtgccccaatgcgaacagagcctggaactcattagaagtagaagattacggattcggcgtattcacgaccaacatttggttaaaattaaaagaaaggcaagacgctttctgcgacagtaaacttatgtccgctgccataaaggataaccgagctgtacatgcggacatgggttactggatagaatccgcactcaacgacacatggaagattgaaaaggcctcctttatcgaagttaagtcatgtcattggccgaaatcccacacgttatggtcaaatggtgtattagagagtgagatgataattccaaaaaattttgcaggtccagtatctcaacacaattaccgtccaggttaccacactcaaacagcaggcccatggcatctaggtagattggaaatggattttgatttttgcgaaggtacaacagtagtagttacagaagattgcggcaatagaggtccatctttaagaaccactacagcctcaggaaagttaattactgaatggtgttgccgtagttgcacattaccaccgttaagatacaggggggaagacgggtgttggtatggaatggaaataaggcctttaaaggaaaaagaggaaaacctcgtaaattcgttggttacggcaggtcacggacaaattgacaactttagtctaggcgtactaggaatggctctctttctcgaagaaatgcttcgaacgagggttggtacaaaacacgcgatcctcctagtagcagtgtcctttgtaactttgattaccggtaacatgtcttttcgtgacttaggacgagtcatggttatggtaggcgcgaccatgacagacgacattggtataggcgtgacctatctagcacttttagcagcatttaaagtaagaccaacatttgcggcaggcctgctgttgaggaaattgacttcgaaagagttgatgatgactactataggtataacgttactttcacagtcaacaatacctgaaacgattttagaattaaccgatgctctggcacttggcatgatggtactcaaaatagtacgcaatatggaaaagtaccagttagcagttactataatggcaatcctctgtgtaccaaatgcagtcatcctacaaaacgcatggaaagtatcctgcaccactttagctgtggttagcgtttctccactattactcaccagcagccagcaaaaagccgattggatccctttagcacttaccatcaaagggctgaatcctacagctattttcctcacaactctatctagaacttccaaaaaaaggagttggcccctaaatgaagcgattatggcagtagggatggtaagcatattagcgagctcgctactaaaaaacgacatcccaatgactgggcctctagtagcaggcggtctattaactgtgtgttatgtgttaacaggtagaagtgctgatcttgaattggaaagagcagcggatgtgcggtgggaagaacaagcggaaatttcagggtcttcaccaatcctgtcgattactatttcagaagatgggagcatgagcataaagaatgaagaagaggaacaaacactaacaatcctaataaggacaggacttcttgtaattagcggattgtttccagttagtattccgataaccgcagcagcatggtatttgtgggaagtcaaaaaacaaagagctggagtcttgtgggatgtcccaagtcccccaccagtaggtaaagctgagttagaggatggcgcgtacagaataaaacagaaaggcatactgggttacagtcagataggcgctggggtctataaagaaggaacgtttcataccatgtggcatgtcacaaggggtgctgtactaatgcacaagggcaaaaggattgaaccatcttgggccgacgtaaaaaaagatttgatttcttacggcggcggatggaaattagaaggagagtggaaagagggagaggaagtgcaagttttggcattagaaccaggcaaaaatccccgagcggtacagactaaacccggtctcttcaaaactagtactggcacaataggggcggttagcttagacttctcaccgggaacatcaggtagcccaattgtcgataagaaggggaaagtcgtaggcttatatggtaacggggttgtgaccaggagtggtacatacgtaagcgccattgctcaaacggaaaaatctatagaggataacccagagattgaggacgatatatttagaaaaaaacggcttacaatcatggatctacatcccggagctggaaagaccaaacgatatttaccagctatagtccgtgaagcaataaaaagaggattaagaacattaatacttgcaccaacgagggtagttgctgctgaaatggaagaagcactacgcggcctgccaattagatatcaaacacctgctataagagctgaacatacaggtagagaaatagtagatttaatgtgccacgcaacatttacaatgcgattactgtcacccataagagtcccaaattacaatttaattataatggacgaggctcactttactgaccctgcttcaattgcagctcgtggttatatttccacgcgagttgaaatgggtgaagctgcgggcatatttatgaccgctacacctcccggttcaagagatccatttccacaatccaatgctccaataatggacgaggaacgtgaaataccggaaagaagttggaactcaggacacgagtgggtgactgacttcaaaggaaagacagtgtggtttgtcccctcaataaaggccgggaatgacatcgcagcttgcctaaggaaaaacggaaagaaagtcattcaactgtctagaaaaacattcgatagtgaatacatcaaaacaagaaccaatgactgggactttgttgtaactacagatatatcagaaatgggggctaacttcaaggcagaaagagtcattgatccaagaagatgcatgaagccagtaattttgaccgacggtgaagaaagagtaatccttgcgggaccgatgccagtgacgcattcgtccgcggcacagagacgaggacgggtagggcgcaacccaaaaaatgagaacgatcaatacatctatatgggagaaccactagagaacgacgaagactgtgcgcattggaaagaagcgaaaatgttactcgacaatataaacacaccagaaggtataatcccctccatgttcgaacctgagcgagaaaaagtcgacgcaatcgatggcgaataccggttaagaggagaagcaaggaaaacatttgtagacttaatgagacgaggtgacttacccgtctggcttgcttacagggtggccgcggaaggtataaattacgcagacagaagatggtgtttcgacggcgtaaaaaacaatcaaattctggaagaaaacgtagaagtagagatttggacaaaggagggcgaaagaaaaaaattgaaaccccggtggctggatgcacggatttattctgatcctctggcgctcaaggaattcaaagaatttgctgcgggtcgaaaaagtttaactcttaacctaataaccgaaatgggtcggttaccaaccttcatgacacaaaaggtaagaaacgcgctagataacctcgcagttctgcatacagcggaagcgggagggcgagcctataatcatgcgcttagcgaacttcctgaaacactagagacccttctattacttacattactcgccacggttacaggaggaatctttttgtttctcatgtcgggaaaaggagtaggaaagatgacgcttggaatgtgttgcataatcactgcatctatactactctggtatgcccaaatccaacctcattggattgcggcgagcattatcttagaattctttttaatagtactgttgatccctgaaccagaaaaacaacggacaccacaagacaatcaattaacctatgtggtcattgcaatcctaacagttgtcgcggctacaatggctaatgagatgggttttttagaaaaaactaaaaaagattttggacttgggtccatcacaactcaacagcctgaatctaatatactggacatagatcttcgacctgccagcgcatggacgctatatgcggttgcgactacatttataacgcccatgttgaggcatagtatcgagaattctagtgtcaacgtatcgttaacggctatagcgaaccaggcaactgttttgatgggtttgggaaaaggatggcctctctcaaagatggacataggagttcccctgttggctataggttgctattctcaagttaacccaataacattaacagctgcattattattacttgtggcacactatgcgataataggaccaggtctacaggcgaaagctaccagagaagcccaaaaacgaacagcggcagggataatgaagaatccaaccgtcgatggtatcactgtgatagacttagacccaatcccttatgatcccaaatttgaaaaacaattgggccaagtcatgttactcgtgctatgtgtaacacaagtactaatgatgcgtacaacttgggctttatgcgaggcactaactcttgcaactggaccaatatctacgctatgggagggaaatccagggcgattttggaatacaaccatagctgtttccatggcaaacattttccgtggttcatacttagctggagccggtttacttttttcaataatgaaaaatacggctaatacaagaagaggtactggtaacaccggagaaacattgggcgaaaagtggaagaatcgattaaatgctttaggcaaaagcgaattccagatatacaagaagtctggcatccaagaggttgaccgaacattagcaaaagagggaattaaacgcggggaaacagatcaccacgctgtatcaaggggcagtgcgaaactgaggtggttcgtagaaaggaacttggtaactccagaaggaaaagtagtggatttaggctgtgggagaggcgggtggagttattactgcggaggattaaaaaacgtcaaagaagtgaaaggattaactaaggggggaccaggtcatgaagaaccaatacctatgtcgacttatggttggaacttagtaaggcttcaatctggcgtagacgtctttttcacccccccagagaaatgtgacaccttgctatgtgatattggagagagctcaccaaacccaactgtcgaggcaggacgaactttaagagtacttaatctggtcgaaaattggttaaataacaatacacaattttgcatcaaagtcttgagtccttacatgccaagcgtaatcgagaaaatggaagcactacagagaaaatatggaggtgcactagtacgtaatccactcagccggaacagcacacacgaaatgtattgggtcagtaacgcatcgggtaacatagtctcaagtgtcaacatgatttcgagaatgcttataaacagattcactatgagacataaaaaagcaacttacgaaccagatgtggatctgggaagtgggaccaggaacatcggaattgaatcggaaacgcctaacttagacataattgggaagagaatagaaaaaataaagcaggaacatgaaacatcttggcattacgaccaagaccatccatataaaacatgggcataccatgggtcctatgagacaaagcagacaggatccgcttcttcgatggtgaatggcgtggtaagattactaacaaagccttgggacgtcatcccaatggtaacacagatggcaatgacggatacaacgccatttggacagcaacgagtattcaaggagaaggtggatacacggactcaagaaccaaaggaaggaaccaaaaaactaatgaaaatcacagctgagtggttatggaaagaactaggtaaaaaaaaaacacctaggatgtgcactagagaggagttcaccaggaaggtaagatcaaatgccgctttaggtgcaatatttactgatgaaaataaatggaagagcgcgcgtgaagcagtggaagattccggattttgggaattagtggataaagaacgaaacctacacctagaaggtaaatgcgaaacctgcgtctacaatatgatgggaaaacgagaaaaaaaattaggagaatttgggaaagcgaagggatcgcgggctatatggtacatgtggttaggagcgcgattcctagaattcgaagcattaggatttttaaacgaggatcactggttttcacgcgaaaacagcctctccggcgtagaaggtgaaggattgcacaaactcggttatatactaagagacgtcagcaaaaaagaaggaggcgcaatgtatgctgacgatacggctggttgggatacccgaattacgttagaggacttgaagaacgaagaaatggtcactaatcatatggaaggcgagcacaaaaaattggcggaagctatattcaaactgacctatcaaaacaaggtagtacgagttcaacgaccgaccccgcgcggaaccgttatggacataataagtaggagagatcaaagagggagcggccaagtagtcacttacggtcttaatactttcactaatatggaagcacagctgatacgtcaaatggagggagaaggtgtgtttaagtctatacaacaattaactgttacagaagaaatagcagtcaaaaactggttagtcacggtaggacgagagaggttgtctcgtatggccatatctggagatgactgtgtggtaaagccgttagatgataggtttgcaagcgccctaacagcactaaatgacatggggaaagtgcggaaggacatacaacaatgggaaccatctagaggatggaacgactggacacaagtacccttttgctcgcatcatttccatgaattaataatgaaagatggccgtgtgcttgtagtaccgtgtcgtaaccaagacgaattgattggccgcgcgcgcataagtcaaggagcaggttggtcactgcgcgaaaccgcatgcttaggtaagtcatatgctcaaatgtggagtctaatgtacttccatcgtagagaccttagactagcagcaaacgctatatgtagcgcagttccttcgcactgggtacccacaagtagaacaacttggtccatacacgcaactcatgaatggatgactacagaagatatgttaactgtttggaatagggtctggatccaagagaacccttggatggaagacaaaactccagttgaatcatgggaagaaataccctaccttggcaaacgagaagatcaatggtgtggatcattaataggcttaacctcacgggcaacatgggcaaaaaacatacaaacggcaattaatcaggttagatcattgataggcaacgaggaatacaccgactatatgccgagtatgaaaagattcagaagagaagaagaagaagcaggagtactttggtaa

SEQ ID NO: 22863 - RNA, 9876 nt, synthetic construct
  misc_feature 1..9876: note = derived and/or modified CDS sequence (opt6) from DENV-2__KC762679__SS-prME
  source 1..9876: mol_type = other RNA
accgcaggaattataataatgatgatacctacagtaatggctttccacttaactacgagaaatggggaaccacatatgatagttagcagacaagaaaaaggaaaaagtttactatttaaaaccgaaaatggagttaacatgtgtacattaatggccatggacttaggagaattgtgtgaagacacgataacatacaactgcccacttctcaggcaaaatgaaccagaagacattgattgttggtgcaattcaacgagtacttgggtaacttatggaacatgtacagcaacgggagaacacagacgagagaaacgaagcgttgccttagttcctcatgtaggaatgggtttagaaacacgaacagaaacctggatgtcttcagaaggagcatggaaacacgcacaacgaatagaaacttgggtacttaggcaccctgggttcaccattatggcggctatcctggcatatacaatcggaacgacttatttccagagagtactcatctttatactcctaaccgcagtagcaccgtcgatgacgatgagatgcataggaattagcaatagagatttcgtagaaggggtgtccggtggtagctgggtggatatagtccttgaacatggaagctgcgtaacgacgatggctaaaaataaaccaacattggatttcgaattaattaaaacggaggccaaacatccggccaccttacgaaaatattgtatagaagcaaagttaacaaacactacaaccgcgtctagatgtccgactcagggtgagccatctctgaatgaagaacaagacaaaagatttgtatgtaaacattcaatggtagatcgggggtggggaaatgggtgtggactatttggaaagggaggtatagtaacatgcgctatgtttacatgcaagaaaaatatggaaggaaagatagtccaacctgagaatctagaatataccatagtcatcactccccatagcggtgaagagaatgcagtaggaaatgacactgggaaacatggcaaagaaattaaagtgactccacaatcatcaattacagaggcagaattaacaggatacggaacagttactatggagtgctcaccacgtacagggctagattttaatgaaatggtattgttgcaaatggagaataaagcatggttggttcatcgtcagtggtttctcgacctcccattgccatggctaccaggagcagacactcagggaagcaactggattcaaaaagaaaccctagtaacttttaaaaatccgcatgccaagaaacaggacgtcgtggtcctaggatcgcaagaaggtgccatgcatactgcgttgacaggtgcaaccgagatccaaatgagctctgggaacttactatttaccgggcaccttaaatgcagactgagaatggacaaattacaattaaaaggaatgtcttatagtatgtgcaccggaaaattcaaggtagtgaaagaaatcgctgagacacagcatggaacgattgtaatccgtgtacaatacgagggtgatggttcaccatgcaaaatcccattcgaaatcatggatctagagaagagatacgttttgggacgtcttattaccgttaatccgattgtgaccgaaaaggattcacccgtaaacatagaggcagaaccaccttttggcgactcatatatcatcataggcgtagaacctggacaattaaaactaaactggtttaagaaaggcagcagtatcggacagatgtttgaaaccacaatgagaggagctaaaagaatggcaatacttggagataccgcctgggactttggatcgttaggcggcgttttcacatctataggaaaggcactacatcaagtgttcggtgcaatttatggagccgcgttctctggagtttcttggactatgaaaattctgataggtgttgtaatcacgtggatcggaatgaactcgcgatccacaagcctctcagtctcattagtcctagtaggagtagtgacactatacctaggcgtcatggtacaggcggacagcggttgcgttgtgtcgtggaaaaacaaagaattgaaatgtggttccggcatattcataacagacaacgttcatacatggacggagcaatataagtttcaacccgaatctccaagcaaactggcctctgcaattcagaaagcacacgaagaaggtatatgtggtataagaagtgtaacaaggttagaaaacctaatgtggaaacaaattacgcccgaactaaatcacatattatcagaaaacgaagtaaagttgacaattatgactggagatataaaaggcatcatgcaagccggcaaacgctccttaaggccacaaccaacagaattaaaatattcttggaaggcatggggcaaagcgaaaatgttaagtacagaattacacaaccataccttcttgatagatggacctgaaactgcagaatgccccaacacgaatagagcatggaactctttagaagttgaagattacgggttcggggtgttcactactaacatatggctaaaactcaaagaacgacaagatgtgttctgtgactcgaaacttatgagtgccgcaataaaagatagccgcgcagtacatgcagacatgggctattggatagaaagcgcactcaatgacacttggaaaatagaaaaagcaagttttatagaagtaaagagttgtcattggccgaaatcacatactctctggtcaaatggagttttagaatcagaaatgataataccgaaaaattttgcaggacccgtgtcacaacataactacaggcccggataccatacacagacagcaggcccatggcatctaggtcgattagaaatggattttgatttttgtgaaggtactacagtagtcgtgacagaagattgcggaaatagagggccgagtcttagaacaactaccgcgagtggaaagctgataacggaatggtgctgtagatcatgcacactcccaccattaagatatcgtggggaagatggatgttggtacggcatggaaattagaccattaaaagaaaaagaagaaaatcttgttaatagtctagtaacagcgggtcacggacagattgacaacttttcactcggtgttttagggatggctctgtttttagaagaaatgctacggactagggtaggaacaaaacatgccattctgttagtagctgtttcatttgttacactaataactggtaacatgagtttccgtgaccttggaagggttatggtaatggttggcgcaactatgacagacgatatcgggatgggagtaacttatttagccttgctagcagcttttaaagtacgacctacattcgcagcaggcctcctcttaagaaagctaactagcaaagaactaatgatgacaactatagggatcgtgcttttatcccaggctaccataccagagacgattcttgaactgacagatgcgctagcactaggcatgatggtcctaaaaatagtaagaaatatggaaaaataccaattggcagtcacgattatggcgatcctttgtgttcctaatgcggtaatactccagaatgcatggaaggtcagctgtacaacattggctgtagtatcagtttcaccgctactactaacatcgagccaacaaaaagcggactggattcctctagcattaacgataaaaggattaaatccaacagcaattttcctgacaacgctcagtcgtacatccaaaaagagatcctggccactcaatgaggccatcatggccgttggaatggtatccatcctagcgagctcattattgaagaacgacattccaatgacaggtcctttagtcgcagggggtttgctgacggtgtgctacgttctgacaggacggagtgcagacctagaattggagagagctgcggatgtacgatgggaagaacaggctgaaattagtgggtcgtcaccaatactcagcataacaatcagtgaagatggatcgatgagtattaaaaacgaagaagaggaacaaacgctcacgatactaatcaggacgggtctccttgttatctctggactatttcctgtctcgattccaattacagccgccgcttggtatttatgggaggtaaagaaacagagagcaggcgtactgtgggatgttccaagtccgccaccagtaggcaaagctgaacttgaagacggcgcgtacagaataaaacaaaaaggcatcttaggttactcccaaatcggagccggagtctacaaagaaggcactttccacacaatgtggcatgtaactaggggagccgtgttaatgcataaagggaaacgaatcgaaccaagctgggcagatgttaagaaagacttaattagttacggaggaggctggaaacttgagggtgaatggaaagagggtgaagaagtacaggtgcttgcgttagaaccagggaaaaacccacgagccgttcagacaaaaccaggactatttaagaccaatacgggaaccatcggggcggtctctctagatttttcacctggaacaagtggctccccaatcgtggacaagaaaggcaaagtagttggattatatggaaatggtgtggtaacgagatctgggacatatgtctccgccatagctcaaaccgagaaaagcattgaagacaatccagaaatcgaggacgacatattccgaaagaaacgattgacaataatggaccttcaccctggagcaggtaaaacaaaaaggtatctacctgcaatagtacgggaagcaataaaaaggggtctaagaacgcttatactggcgccgacaagagttgttgcagcggaaatggaagaggccctaaggggactccctatccgatatcaaactccggcaatacgtgcagagcacacaggaagagaaattgtagatttgatgtgccacgcgactttcaccatgagactcttatctcccataagagtgcctaattataatctaataatcatggatgaagcacattttacggatccagcttcaattgcagcaagaggctatatcagcactcgtgtggaaatgggcgaggcggcaggtatcttcatgacagccacaccaccagggtcccgtgacccgttccctcagagcaacgcaccaataatggatgaggaaagagaaatacctgaaagatcttggaactcaggtcacgaatgggtcactgatttcaagggaaaaacagtctggtttgtaccatcaattaaagctggaaatgatatagcagcctgtttgaggaaaaatgggaagaaagtaatacagctatcaagaaaaacattcgattcagaatatataaaaacacgcacgaatgactgggactttgtcgtgacaacagacatatcagaaatgggcgctaactttaaagctgaaagggtcatagatccaaggagatgtatgaaacctgtcatattaacagatggagaagaacgagttatcttggctggccctatgcctgttacacactcatctgcagcacaaaggagaggacgtgtaggacggaaccctaaaaacgaaaatgatcaatatatatacatgggagagccccttgaaaatgatgaagactgcgcccattggaaagaggctaaaatgttattggacaatataaacacaccagaaggtattatcccctctatgttcgaaccagaaagagaaaaagtggatgccatagacggcgaatatagactaagaggtgaggcaagaaaaacttttgtggacctcatgcggaggggtgacttgcctgtttggttagcatatagagttgcggcagaaggaatcaactacgccgaccgcagatggtgttttgacggtgtgaaaaacaaccaaatattggaagagaatgtagaagtagaaatatggactaaagaaggagagcgaaagaaactcaagccaagatggttggatgcaaggatctacagtgacccactagcactgaaggagttcaaggagtttgccgctggaaggaaatcattaacattgaatctaataactgagatgggtagattaccaacttttatgacccaaaaggcgcgaaatgcactggataatctggcagtattacataccgcagaggcgggaggccgagcgtacaatcatgcacttagcgaactcccagaaacactcgaaacattgctgttgctaacactacttgcaacggttacaggaggtatatttctatttctcatgtccggaaaagggattggcaaaatgaccttgggaatgtgttgtataataactgcatcaatactgttatggtatgctcaaatacaaccgcactggatcgcggcatcaatcatattagagtttttcctgatcgttcttctcatacctgaacccgagaaacaaaggacacctcaggataatcaacttacttatgtagtaatagccatactgaccgtggtagcagcaaccatggccaatgaaatgggatttttggagaaaacgaagaaagacttcggcttaggaagtataacaacccaacaaccagaatctaacattttagatatagatctaagacctgcctcagcctggacgctatatgccgttgcgacgacattcataacgccgatgctgagacatagtattgaaaacagttcggtaaatgtatcactaacggcaattgcaaatcaagctaccgtattaatggggttaggaaaaggatggccgttaagcaagatggacatcggtgtacctcttctcgctataggctgctacagtcaagtgaatccaataacattaacagctgccttgctgctattagtagcgcattatgccatcataggtccaggtctccaagcgaaagcaaccagagaagcgcaaaaacgagcagctgcaggcatcatgaaaaatcctaccgtagacggtataacggtgatagacttggatcctatcccatacgatccaaagtttgaaaaacagttaggccaagttatgctccttgttctttgtgttacccaggtgctgatgatgaggacaacatgggcactatgcgaagcgttaaccctagcaaccggaccaattagtaccttgtgggaaggcaatcctggaagattttggaacacgacaatagccgtgtcaatggcgaatatctttcgaggatcttatctagctggggctggcttattattctcgataatgaaaaatacagccaacacccggcggggaactggtaatactggcgaaacacttggagaaaagtggaaaaacagacttaatgctctggggaaatcagagtttcagatatacaaaaagtcaggcattcaagaagtggataggacgttagcaaaggaagggattaaacgaggagaaacggatcaccatgctgtgtcaagaggatctgccaaacttaggtggtttgtagaaaggaatttggtcactccagagggaaaagtcgtcgacttgggctgtggtcgaggaggctggagctactattgtggcggacttaagaacgtaaaagaggtaaaaggactaacgaaaggaggacccgggcacgaagaaccgattcccatgtccacttatggttggaacctagtacgcttgcaaagtggggtagacgttttctttacaccacccgaaaaatgcgatacattattgtgtgatataggtgaatcatcccccaatccaaccgtagaagcaggcagaacattacgagtcttaaatctagtcgagaactggcttaacaataacacacagttttgtattaaagtacttaacccatacatgccatccgttattgaaaagatggaagccctacaaagaaaatacggcggtgctctagttcgaaacccattaagtaggaactctactcatgagatgtactgggttagcaatgcaagtggaaatatagttagctcagttaacatgatatcaaggatgttgataaatagatttactatgcggcacaagaaagctacgtacgaaccagacgtggatttaggcagcggaacgagaaatataggaatcgaatccgagacgcccaatttagatatcatcggaaagcgtatagagaaaattaaacaagaacacgaaactagctggcattatgatcaagaccacccatataaaacgtgggcctaccacggaagctatgaaacaaaacaaactggaagtgcaagctcaatggtcaatggagtagtaagattgttaacgaagccatgggacgttataccaatggtaacgcaaatggctatgactgatacaactcccttcggccaacaacgagtctttaaggaaaaagtggatactcgaacccaggaaccgaaagaaggtactaagaaattaatgaaaataacagcagaatggctgtggaaagaacttggcaagaagaaaactcctagaatgtgcacccgagaagaatttacccgaaaagtacggagcaatgcagctctaggtgctatatttactgatgaaaataaatggaaatccgcgagagaggcagttgaagacagcgggttttgggagctagtagataaggagaggaatttacatttagaaggtaaatgtgaaacctgtgtttataacatgatgggaaaacgagagaagaaattaggagaatttggcaaagcaaaaggttcccgcgctatttggtacatgtggctcggtgcaagatttttagagtttgaagcacttgggtttttgaatgaagatcattggttctctagagaaaattcactatcgggagtagaaggtgaaggactccataaactgggatacatattacgggacgtcagtatgaaagagggaggagccatgtatgccgatgatacggcaggatgggatacacgtattacactagaagatttaaagaatgaagagatggtaaccaatcatatggaaggagaacataagaaattggcagaagcaattttcaagttgacatatcaaaataaagtagtacgtgtacaaaggccaacgccacgtggtacagttatggatattatatcacgccgtgatcagcgtggcagtggccaagttgtaacctatgggctaaatacttttacaaatatggaagcgcaattaattaggcaaatggagggagaaggagttttcaagtcgatccaacagttaacagtcacggaggaaattgctgtgaagaattggttagtcagagtaggaagggaacgattaagtcggatggcaattagtggcgatgattgtgttgtaaagccacttgatgatcgatttgctagtgcactaacagcgctcaacgatatgggaaaagtccgtaaggacatacaacaatgggaacctagtcgaggttggaatgactggacacaggtacccttctgctctcatcattttcacgaattaattatgaaagatggaagagtactggtagtaccatgcagaaatcaagatgagctcatcggcagagcaagaatctctcagggagctggttggtcactaagagagacggcatgtctaggaaaatcctatgctcaaatgtggagtcttatgtacttccaccgtagagatttacgattagcagcaaatgcaatatgcagcgcggttccttcacattgggtgcctacgtcacgaacgacatggtcgattcacgcaacccacgaatggatgacgactgaagatatgctaacagtctggaatagagtttggattcaagagaatccgtggatggaagataaaacaccagtagaatcatgggaagaaatcccatatttaggcaaacgtgaggatcaatggtgtgggagtcttataggcttaacaagccgagccacatgggcgaagaatattcaaacggcaataaaccaagttaggagtctaattgggaatgaagaatacaccgactacatgccaagtatgaaaaggtttcgacgggaagaagaagaagctggtgttttatggtaa

SEQ ID NO: 22864 - RNA, 9876 nt, synthetic construct
  misc_feature 1..9876: note = derived and/or modified CDS sequence (opt6) from DENV-2__KC762680__SS-prME
  source 1..9876: mol_type = other RNA
acagcaggcataataattatgatgattcctacggtgatggcattccatctaacgactcgaaacggggaaccgcatatgatagtttcaagacaagaaaaaggaaaatcattgttgtttaaaacagaaaatggggtaaacatgtgcacactaatggcaatggacttaggcgaactttgcgaagatacaattacttataactgtccactactaagacagaatgaacctgaagacatagactgttggtgtaattctacaagtacctgggtaacctatggaacgtgtacggctacaggagaacatagaagggagaaacgatcagtagccctagttccgcatgttggtatgggattagaaacccgaacagaaacatggatgtcttctgaaggggcatggaaacacgctcagaggatagaaacatgggttctacgacaccctggatttacaattatggcagcaatactagcatacactattgggacaacatattttcagagagtacttatatttatattattgactgctgtagcaccttcgatgactatgaggtgcattggaatttcgaatagggactttgtagagggggtaagtgggggcagttgggtagacatagtgctcgaacatggttcatgtgtaactactatggccaaaaataaacctacacttgattttgaattgataaaaacagaggctaaacacccagcgaccctaagaaaatattgtatagaagcaaaactaacaaatacaacaacagcatcaaggtgtcctacacaaggggaacccagtttaaacgaagaacaggataaaagatttgtgtgtaaacacagtatggtcgatcgaggatggggaaacggatgcggcttatttgggaaaggagggatcgtaacatgtgcaatgttcacttgtaagaaaaatatggaaggaaaaatcgtacaacccgagaaccttgaatatacaatagttatcacacctcacagcggagaagaaaatgctgtaggaaatgatacaggaaaacatggtaaagaaataaaagtaaccccgcaatcatccatcacggaagctgaactcacgggatatgggacagtaaccatggagtgcagtcctcgaactggtttagatttcaatgagatggtcctgttgcagatggaaaacaaagcatggttggtacatagacaatggttcttagatttaccattaccatggctccccggagcagatacccaggggagtaactggattcagaaagaaaccctagtaacttttaaaaacccgcatgctaagaaacaagatgtagtagtattggggagccaagaaggagctatgcatacagcactaacgggagcgactgaaattcagatgagttctggaaacttattattcacaggtcatctcaaatgtcgactccgtatggataaacttcaattaaaaggaatgtcttattcaatgtgtacagggaaatttaaagttgtgaaagagatagcggaaacgcaacatggcaccatagttattcgcgtacaatatgaaggtgacggaagtccatgcaaaattccattcgagatcatggatttagaaaagcgatacgtcctgggacgtctaatcacagtaaatccaatagtcactgaaaaagattcccccgtgaatatagaagcagaaccaccttttggagacagttacattattataggtgtagaacccggccaattaaaattaaattggttcaagaaaggtagctctattggacagatgtttgaaacaaccatgagaggagctaaaagaatggcaatactaggtgatacagcgtgggacttcggtagcttaggaggggtcttcacaagcataggtaaagcattacatcaagtctttggggcgatatacggtgcagcattcagcggagtatcttggaccatgaaaattctaatcggagtcgtaataacatggatagggatgaatagccggtctactagcctatcagtttcacttgtactcgtaggtgtagtaacactgtatctaggtgtgatggtacaagcagatagcggttgtgtagtatcttggaaaaataaagaacttaaatgtggcagtggaatatttataacagacaacgtccatacttggactgagcaatataaattccaaccggagtcccccagcaagttagcatctgctatacaaaaagctcatgaagaggggatatgtgggataagaagcgtgaccagactagaaaatttgatgtggaaacaaataactccggaattgaatcacatcctatcagagaacgaagtcaagctcaccataatgacaggagacataaaggggataatgcaggcgggtaagcggtccctacgaccacaaccaaccgagcttaagtattcttggaaggcttggggaaaagcaaagatgctaagtacggagctacacaatcacaccttccttattgacggaccagagactgcagagtgtccaaacacgaatcgagcttggaatagtttggaggtagaggactatggtttcggtgtctttacaaccaacatttggttgaaattaaaggaacgtcaggacgtattctgcgattccaaacttatgtcagcagcgatcaaagattccagagctgtacatgcagatatggggtattggattgaatccgctcttaacgatacatggaaaatcgagaaggcaagtttcattgaagtcaaatcctgtcactggccaaaatcacatacattatggtcaaacggagtactagaatcggagatgattatcccgaagaattttgctggtcctgtttcgcaacataactataggccagggtatcatacccagacagctggaccatggcaccttggaagactagaaatggatttcgatttttgtgagggaactaccgttgtagtaacagaagactgcggcaatcgaggcccctctttacgtactactacagcgtcaggaaaattgataactgagtggtgctgtcggagttgtactttgcccccattgagatatagaggggaggatgggtgctggtatggaatggaaattagaccactgaaagaaaaagaagaaaacttagtcaattcattagtaacggcaggacacggacaaattgataacttctcacttggagtgttgggtatggcactttttcttgaagaaatgttaaggacacgagtgggcacaaagcatgcgatacttttagtagcagtaagtttcgtgaccctcataacaggaaatatgtcattccgagacttaggaagagtaatggtcatggtaggagcaactatgacggatgacattgggatgggggtaacctatctggctctattggctgcgtttaaagtaagaccgacatttgcggctggtcttttattgaggaaactaacatcaaaagaactgatgatgacgacgattggtatagttttgttgtcacaagcaactatcccagagactatcttagaattaacagacgccttggccttaggaatgatggtgttaaagattgtacgaaacatggagaaataccaactcgcagttactataatggctatcctgtgtgtacctaatgccgttattctacagaacgcttggaaggtaagctgcaccacattagcagttgtttctgtatccccattgctactaacaagctcacaacaaaaagcagattggattcccctagcactaaccataaagggactgaacccaacggcgatatttttaactactttgagcagaacttccaagaaaagatcatggccacttaatgaagcaatcatggcagttggaatggtatccatattagcttcgtccctgcttaagaatgacattccgatgactggtcccttagttgctggtggactacttacagtatgctatgtactaacaggtaggtcggcagacctcgaactggagagggcagccgatgtacgatgggaggaacaagcggagatatctgggtcatcaccgatattaagtataacaataagcgaagatgggtctatgagtatcaaaaatgaagaggaagaacaaacgttaacaatcctaattcgaactggtttgctggtaataagtgggttatttccggtctcaatacctataacagcagcggcctggtatctctgggaagttaaaaagcaaagagccggtgtcctatgggacgttccttcaccccctcctgtagggaaagcagagctggaagatggtgcatataggatcaaacaaaaaggcattctaggatatagccaaattggagcaggagtttacaaagaaggtactttccatacgatgtggcatgtaacaagaggagctgtgttaatgcacaagggcaaaagaatagaacccagctgggcggacgttaagaaagacctaatttcttatggaggtgggtggaaactagaaggtgagtggaaagaaggtgaagaggtacaagttctcgctctagaacctggcaaaaacccaagagccgtccaaacaaaacccgggctatttaaaactaatacgggcactataggagccgtttcattagacttttcacccggaacgagcggaagtcctatcgtagacaaaaaggggaaggtagttggattgtacggcaatggtgttgttacacgctcaggaacgtatgtctctgcaatagctcagaccgagaaaagtatagaagataatccggaaatagaggacgatattttcagaaagaaaaggctaaccataatggacctacacccaggagctggaaaaacaaaaagatatctgccagcgatagttagggaagcgataaagcgcgggcttcgaacacttatcttggcaccaacaagagttgttgcggcagaaatggaggaagcattaaggggtctccccatcaggtatcaaacaccagctattcgggctgaacacaccggcagagagattgtggatttgatgtgccacgcgacatttacaatgagattactatcaccgatacgggttcccaattataatcttatcataatggatgaagcccatttcactgatccggcaagcatagcagcacgaggctatatcagtactcgcgtggagatgggagaggcggcggggatatttatgacagcaaccccgccaggttcaagagacccattcccgcaaagtaatgcaccaataatggacgaagaacgcgaaatacctgaaagatcatggaactcaggccatgaatgggtcacagatttcaaagggaaaactgtatggttcgtaccatctattaaagctgggaatgatatagcagcatgtttaagaaagaacgggaagaaagtcatacaattaagtcgaaaaacattcgatttcgagtacataaaaactcgaacaaatgattgggatttcgtggtaactactgatattagcgaaatgggtgctaattttaaagcagagagagtaatagaccctcgaaggtgtatgaaacccgtaatactaaccgatggcgaggagcgagtcatcttggctggtcctatgccggtaactcattctagtgctgcccaaaggcgtgggagggtgggaaggaacccgaaaaacgaaaatgatcaatatatatatatgggagaacctctggagaacgatgaagactgtgcacactggaaagaagcgaaaatgcttttagacaatataaataccccagaaggaattataccatctatgttcgaacccgaacgggaaaaagtcgatgcaatagacggagaatatcgcctcagaggggaagcaagaaaaacttttgtagacttaatgcgacgtggagacttgcctgtatggctagcgtacagagttgcagccgaaggcataaattatgcagatagaaggtggtgtttcgatggagtaaagaataatcaaatattagaggaaaatgttgaagtcgaaatctggacaaaggagggtgaacgaaagaaactaaaaccaagatggctagatgctagaatatacagtgatccactagccttaaaggagttcaaagaatttgcagcagggagaaaatctttaacactaaacctcataactgaaatggggagacttccgacattcatgactcaaaaagcaagaaacgcattagacaacttagcagtacttcacacggctgaagccggtggccgcgcgtacaatcatgcgctttcggaactaccggaaacgctcgaaacattgctacttttaaccttactagcaactgtaaccgggggtatatttttatttctgatgagtggtaaaggaatcggaaaaatgacacttggtatgtgttgcatcataactgcaagtatattactttggtatgcacaaatacaaccacattggatagcggcatcaattatacttgagttctttctaattgtacttctaattcctgaaccggaaaaacagagaacaccacaggacaaccagctaacatacgtagtaatcgctattttgacggtagtggcagcaacaatggccaatgaaatggggtttctagagaaaaccaagaaagactttgggctcggaagtataacgacgcaacagcccgaaagcaatattttagatatagatttgcgccctgccagcgcctggacattatatgctgtcgcaacgacattcatcacccccatgcttcgacattcaatagaaaactcttcagtaaacgtaagtctcaccgctatagctaaccaagccactgtattaatggggttaggaaaaggctggcctctatccaaaatggatataggcgttccattattagctattgggtgctactctcaagttaatcctataaccctgacagctgcgttgctcctgttagtagcacactatgcaatcatcgggccgggtttacaggctaaagcaactcgcgaagctcagaagcgtgcggctgctggcatcatgaaaaacccgacggtagacggtattactgtcatcgacctcgacccgataccttatgatcctaaatttgaaaaacaattaggtcaggtaatgcttctagtcttatgtgttactcaggtgctgatgatgcgaacaacatgggctttatgcgaggcgctaacactagccaccggacccatttcaacactatgggaaggaaatcctggaagattctggaacaccaccattgccgtaagtatggcgaatatattcagaggctcatatttagctggtgccggacttctctttagtatcatgaaaaatactgcaaataccagacgtgggacaggtaataccggagagacgttaggtgagaaatggaaaaaccgcttgaacgctctaggtaaatcagagttccaaatttacaagaagagtggaatacaagaagtcgatcgtacattagcaaaagaaggaataaaacgaggcgaaacggaccatcatgcagtaagtagagggagcgccaaactacgttggtttgttgagagaaatctagtgacacctgagggaaaagttgtcgacctaggatgcggacgaggcggttggtcatactactgcggcggcctgaaaaacgtaaaggaagtaaaaggtttaacgaagggaggtccaggacacgaagaacccatacctatgagtacttacggctggaatctagtcagactacagtccggtgttgatgtattcttcacaccccctgagaaatgcgataccttactatgtgatataggtgaaagttcgccaaatcctacggttgaagcaggcaggacgcttagagtcttaaacttggtagagaattggttaaataacaacacacagttctgtatcaaagtattgaatccttacatgccaagtgttattgagaaaatggaagcgctacagagaaaatatggaggggctctagttaggaatccactgtcaagaaacagtactcatgaaatgtattgggtatctaatgcgagtggcaatatagtaagcagcgtcaatatgatatcaagaatgcttataaatcgttttacaatgagacataagaaagctacatacgaaccagacgtcgacttaggtagcggcacaagaaatataggaatagaaagtgaaactccaaacctagatatcattggaaaacgaatagagaaaatcaagcaagagcacgagacatcttggcactatgaccaagatcatccatacaaaacctgggcgtaccatgggtcctatgaaaccaaacagacaggatcagcatcatcaatggtaaatggtgttgtcaggcttctgacaaaaccatgggacgtaataccaatggtaacacaaatggcaatgacagacaccacaccttttgggcaacagagagttttcaaagaaaaagtggacacacgaactcaagaaccgaaagaaggcactaagaaactaatgaagataacagctgaatggctatggaaggagttaggtaaaaagaaaacacccagaatgtgcactagggaagaatttaccaggaaagtaaggtctaacgcagccttgggagctatttttacggatgaaaataaatggaaaagtgcaagagaagcggtagaggattccggattctgggaactcgtagacaaggagaggaatttgcacttggagggtaaatgtgaaacatgtgtatataacatgatgggcaagagagagaagaaactcggtgaatttggaaaagctaagggttctcgcgctatatggtatatgtggctgggagcgaggtttttagaatttgaagcgctaggattcctaaacgaagatcattggtttagcagggaaaactccctatctggcgttgaaggtgaaggtctacacaagctaggatatattctacgcgatgtttcaatgaaggaagggggtgcaatgtacgctgacgacacagccggatgggacactagaataacattagaggatcttaaaaacgaggaaatggtaacaaatcatatggaaggcgagcacaagaaacttgcagaagctatattcaaattaacttaccagaataaagtagtccgtgtacaaaggccgaccccacgtggtacagtgatggatattatatcacgccgagatcaaagaggaagcggccaagttgtgacctatggacttaatacttttaccaatatggaagcgcaattaataagacaaatggaaggagaaggggttttcaaatcaatacaacagctcactgtaacagaggagattgccgtcaaaaactggttggtcagagtaggcagagaacgacttagccgcatggccatcagtggagacgactgcgttgtgaaaccattagacgataggttcgcttcagcactaacagctctaaatgatatgggaaaggtgcgaaaggatattcaacaatgggaacccagtaggggctggaacgattggacacaagttcccttttgctcccaccactttcacgaattaataatgaaggacggtcgagtattagtagtaccttgccggaatcaggatgaattaattggtagggcaagaatttcacagggcgcgggatggagtcttagagagaccgcatgtcttggaaagtcatacgcgcaaatgtggagtcttatgtattttcatcggcgggacttaagactggccgcaaacgccatctgctcagcggtcccttcacactgggtaccaacaagcagaaccacatggagcatacacgccactcacgaatggatgacaacggaagatatgctgactgtgtggaaccgcgtctggatacaggaaaatccttggatggaagataaaactccagtcgaaagctgggaagaaatcccttatctcggaaaacgagaggaccagtggtgtggaagcctaataggcttaacgtccagagcaacttgggcgaagaatatacaaacagcgataaaccaagtacgcagtctcaaaggtaatgaagaatacactgactatatgcccagcatgaagagatttcgcagagaagaaggggaagctggggtactatggtga

SEQ ID NO: 22865 - RNA, 9876 nt, synthetic construct
  misc_feature 1..9876: note = derived and/or modified CDS sequence (opt6) from DENV-2__JQ955624__SS-prME
  source 1..9876: mol_type = other RNA
acggcaggggtgattatcatgttaatccctactgccatggcctttcatctgaccacccgtaatggagaaccacatatgattgtttctagacaagaaaaaggaaaatctctattgttcaaaactgaagatggagttaatatgtgtaccctaatggcaatggacttgggagaactatgcgaagatactataacctataattgtccactacttagacaaaacgaaccggaagatattgactgttggtgtaatagcacctccacttgggttacatatggcacatgtactgcgacaggtgaacaccgccgggagaaaagaagcgtagccctagtcccacacgtgggaatgggattagaaaccagaactgaaacatggatgtcttctgaaggagcatggaagcacgcgcaacggatagaaacatggatcttgagacacccagggttcgcaatcatggctgctattctagcctatactattggtacaacccacttccaaagagtactgatatttatattattaaccgctgtagccccgagtatgaccatgagatgcataggtatatcaaatagagactttgtagaaggcgtgagcggcggttcatgggtcgacattgttttagaacatgggagctgcgtcactacaatggcgaaaaataaaccaacactcgactttgaactaatcaaaacagaagcaaaacagccggcaacattaagaaagtactgcatagaagcaaagttgacaaatactaccacagcatctagatgcccgacacagggggaaccatcacttaatgaggaacaagataaaaggtttgtgtgcaaacactctatggtggacagaggttggggaaacgggtgcggactcttcggcaaaggagggatagttacgtgcgcaatgtttacctgcaaaaagaacatggaaggaaaaatagtccaacccgaaaatttagaatacactattgtggtaacaccacattcgggagaagaaaacgcagttggcaacgataccggcaaacatggaaaagagataaaagtaacacctcaatctagtataactgaggcagaactcacaggatacggtactgttacgatggagtgcagtccacgaacggggcttgatttcaatgaaatggtcttgttacaaatggaaaacaaagcatggcttgtccatcggcagtggtttcttgacctaccattgccatggttacctggtgccgacacacaagggtcgaattggatccagaaagaaacattagttacatttaagaatccacacgcgaagaaacaggacgtagtagtcctaggaagtcaagaaggcgcaatgcacactgctttaactggggccacggaaatccaaatgtcgtcaggaaacttgctatttacaggtcatcttaaatgcagactacgtatggacaaattacaactcaaaggtatgtcttattctatgtgcacaggtaaattcaaggtcgtgaaagaaatcgccgagactcaacacggcacaattgtagtccgtgtacaatatgagggggatgggtccccatgtaagataccatttgaaataatggacttagaaaagcgtcatgtactaggaaggctgataaccgtaaaccctatagttactgaaaaggattctccggtaaatatagaagcagagccgccctttggggatagttacattatcataggcgttgaaccaggccagctaaaattaagctggtttaagaaaggttcctcgataggccaaatgtttgaaactacaatgaggggtgcaaaaagaatggcaatattaggggacacagcatgggacttcggctcattaggtggcgtctttacaagcataggaaaggctttacatcaagtatttggcgcgatatatggagcggcattctctggagtctcttggaccatgaagatactcataggtgtggtcataacttggataggaatgaactctaggtccacatcactatcagtatcacttgttttagtaggcgtggtcacactttacctaggagtaatggtgcaagctgattctggttgtgttgtttcttggaaaaataaggaattgaaatgtggatccgggatattcataaccgataatgttcatacttggactgaacaatataaatttcagccagaaagcccatcgaaattagcctccgcaatacaaaaagcacacgaagaaggtatatgcggcatcagatctgtaacgagacttgaaaacttaatgtggaaacagataactcccgaattaaatcatattttaagtgaaaacgaagtaaaactaacgataatgacgggagacattaaaggaataatgcaagcggggaaaagatcactgcgtccacaacccacagaactgaaatatagttggaaaacgtggggaaaagccaaaatgttaagtactgagtcgcataatcaaacttttctcatcgacggtcctgaaacaacagaatgcccaaataccaaccgagcgtggaactccctagaagtagaagactacggttttggggtgttcacgacaaacatctggctaaaactaaaagaaagacaagacgtattctgcgactcaaaattaatgtctgcagccgtaaaggataatcgtgcagttcatgcagatatgggttattggattgaatcagctctaaatgatacctggaagatagagaaagccagcttcatcgaagttaaatcctgccactggccaaaatcccacacactatggagtaacggggtattagaatcggaaatgataatacctaaaaactttgctggccccgtctcacaacataactatagaccaggataccatacacaaactgcaggaccatggcaccttgggaaactcgagatggattttgatttttgtgagggaacaacagtggtagtgactgaagattgcggcaatagaggccctagcttacgtacaacaacagcctccggaaaacttattactgaatggtgttgcagaagttgtacgctgcctccgctcagatatagaggggaagatgggtgttggtacggtatggaaattagaccactaaaggaaaaagaagaaaatttggtcaatagtctagttactgccggtcacggacaaatagacaacttctcactaggcattctaggtatggcattgtttctagaggagatgctgcgtacacgagtcggtacaaaacatgcagtacttctggtcgcggtgtcttttatgacgctcataacaggaaacatgagttttagagatttgggaagagtaatggtcatggtcggagcagcaatgacagacgatattggaatgggtgtcacttatttggcattacttgcagcgttcaaagtcagaccaacatttgccgctgggttgctacttagaaaactgacctccaaggagttaatgatgaccaccattggtatagtccttttgagtcaatcaacaatcccggaaactattcttgaattaacggatgccttagcactagggatgatggtactaaaaattgtaagaaacatggaaaaatatcaactggctgtgacaataatggcaattctctgcgttcctaacgctgttattctacagaacgcctggaaggttagttgcacgatattagcagtggtatctgtatcaccacttttactcacctcatcacaacaaaaagcggactggatacccttagctttaaccatcaaaggcctcaatcctactgccattttcttgacaaccctatcacgcactaacaagaaaagaagttggcctctcaacgaagcaattatggctgtcgggatggtctctatattagcatcctcgttactcaaaaatgacattccaatgaccggcccattagtagctgggggcttgctaacagtatgttatgtattaacaggacgaagtgctgatctggaactggaacgtgccgccgatgtaagatgggaagatcaggcggaaatatccggatcaagccctatattatcaatcacgatatcagaagatggaagtatgagcatcaaaaacgaagaagaagaacaaacgttaaccatactaatcagaacaggattgttggtaatttccggcttattccctgtctccatcccaataaccgccgcagcatggtacttgtgggaagtgaagaagcaacgagcaggagtattgtgggatgtgccgtcaccaccacccgtaggcaaagcagaattggaagacggcgcatatagaatcaaacaaaagggcatcctgggatatagccaaataggtgcaggcgtatataaagaaggtacatttcacaccatgtggcacgttactaggggagcggttctgatgcacaagggtaagcgaatagagccctcatgggcggacgtacgaaaagatctaatatcatacgggggtggctggaaacttgaaggtgagtggaaagagggtgaagaggtgcaagtattggcgttagaacctggtaaaaatcctagagctgttcagaccaagcctgggttattcaaaacaaatacaggaactataggagctgtgagcttggatttttcaccaggtactagcggatcgccgattgttgacaagaaaggcaaagttgtaggattatatgggaatggcgtagtcactcggtcaggtacttacgtgagtgcaattgcacaaagtgagaaaagtatcgaagataacccggaaatagaagacgacatctttcgtaaaaagcgcttaaccataatggatctccaccccggagcaggtaaaacaaaacgttacttaccggccatagttcgtgaagccatcaaacggggcttgagaacattaatactagcaccaacaagggtagtcgcagcagaaatggaagaagcgctccggggattacctatcagataccagactccggccattcgtgctgaacacaccggacgtgaaatagtggatctgatgtgtcatgccactttcacaatgagactactgtcaccagtacgggtgccaaattataacctgatcataatggatgaagcgcatttcaccgatccagcatctatagcagctaggggatacatttcaacacgagtagaaatgggtgaagcggctggaatctttatgacggccacacccccaggctctagggaccccttcccccagtcaaacgccccaataatggatgaggagcgagaaattccagaaagatcatggaactcaggtcacgagtgggtaacagactttaagggaaaaacagtctggttcgtaccaagtatcaaggccgggaatgatatcgctgcttgtctaaggaaaaatggcaagaaagttattcaactgagtcgaaaaacatttgactctgaatatattaaaactcgaacaaatgactgggatttcgttgtaacgacagacattagcgaaatgggcgcaaattttaaggctgaaagagttatagaccccagacgctgtatgaaacccgtgatactcacagatggtgaggaaagggtcatacttgctggaccgatgccagtaacgcactcttctgcagctcagcgtcgtggaagaataggtcgcaatcccaaaaacgaaaatgatcagtacatttatatgggagaacccttagaaaatgacgaagattgcgcgcattggaaagaggccaaaatgttgttggataatattaacacacctgaagggattattccctctatgtttgaacctgagagagaaaaagtcgatgcaatagacggggaatatagactacgaggagaggccaggaagacgtttgtggaactaatgagaaggggtgacctaccagtatggctcgcttaccgtgtagctgctgaaggtatcaattacgcagatagacgatggtgctttgacggaatcaaaaacaaccagatattggaagaaaacgtcgaggtggaaatctggacgaaggaaggcgagaggaaaaagctgaaacctaggtggctagacgctcgcatttactctgacccgttggcccttaaagaatttaaagagttcgcagcaggcaggaaatcactaacgctgaatctcataaccgaaatgggacgtctccctaccttcatgacacaaaaagcacgaaacgcgttagataatcttgctgttcttcatacagctgaagcaggagggcgggcatataaccacgcattgagtgaattaccagagactttagagactcttcttctcctcaccttattggcgacggtaaccggtggcatatttttattcttgatgtctgggaagggtataggtaaaatgacactaggaatgtgttgcattataacagcaagcatcctattatggtatgcccaaattcagccacactggatcgcagcctcaataatattagagtttttcctaatagtactacttatcccggaaccagaaaaacaaagaacaccccaggataaccaattgacctacgtcgttatagctatattaaccgtcgtggcagccacaatggcaaacgagatgggttttctagagaaaacaaagaaagacttcggtttcggcagtatagctacccaacaaccagaatccaatatactggacatagacctacgtcccgcttccgcatggacattatatgcagttgcgactacatttataacgccaatgttgcgacattcgattgaaaactcgagtgttaatgtaagtctcacagctatagcgaaccaagctactgtcttaatgggattaggtaaaggatggcctttaagtaaaatggatataggagtaccgttactagcaatcggatgttatagtcaggtcaatcctataactctgactgcagcactacttctattggtggcgcattacgcaataataggtccgggattgcaagcaaaagccacaagagaagctcagaaaagagcagcagcaggaatcatgaaaaacccaacggtagatggcataactgttattgatcttgatccaattccctacgatcccaagttcgagaaacaattaggacaggttatgctacttgtgctttgcgtaactcaagtacttatgatgagaacaacttgggcactttgcgaagctctgacattagcaacaggtccaatatcgacactatgggagggtaatccgggacgcttttggaatactacaatagctgtctcaatggccaatatattcaggggttcctacctagcgggggctggcttattattttctattatgaaaaacacgaccaatacacgaagaggaactggtaatacaggagaaacactgggagaaaagtggaaaaataggctcaattccctgggaaaatcagaatttcaaatttacaagagaagcgggattcaagaggtcgatcgaacgttagcaaaagaaggaattaaacgcggcgaaacggaccaccatgctgtatcacgtggaagtgcaaaactacgctggtttgtggagagaaatttagtaacccccgaagggaaagtgatggacctaggatgtggacgaggaggatggtcatattattgcggtggtcttaaaaatgtccgtgaagttaaaggtcttaccaaaggaggtccaggacatgaagaaccaataccaatgtcaacttatggctggaatttagtaagactccaatcaggggtcgacgtgtttttcacaccgccagaaaaatgtgacacattactctgtgatataggtgaatccagcccgaatcctacagtagaggcaggccggactctacgagtattaaatcttgtggaaaattggctaaacaacaacacacaattctgtatcaaagtacttaacccatacatgccctcagtcatcgagaaaatggaaaccttacaaagaaagtatggcggtgccctagttaggaatcccctctcgagaaattctacccatgaaatgtattgggtctctaacgcatcaggaaatattgttagctctgtaaacatgatatctagaatgttaataaacaggttcacaatgcgtcataaaaaggctacatacgaacccgacgttgacctcggaagtggaacccggaatataggtatcgaaagtgaaacccctaacctagatattataggtaaacgaatagagaaaataaaacaggaacatgaaacaagttggcattacgatcaagaccatccatataaaacttgggcttatcacggatcgtacgaaacaaaacaaaccggatcggcatcatctatggtgaacggagtggtaagattgttaacgaaaccgtgggatgtaattcctatggtaacacaaatggccatgaccgatacaacaccatttggtcaacagcgagtatttaaagagaaggtagatacaagaactcaagagccaaaagaaggaacaaagaaactaatgaaaatcacagcggaatggctatggaaagagctaggcaaaaagaaaacaccaagaatgtgtacccgagaagagtttactcgtaaagtgagatctaatgcagctctaggagcaatatttactgacgagaacaaatggaaatcggccagagaagctgtagaagattcaaggttctgggaattagttgacaaagaaagaaatctacacctagaggggaaatgtgaaacttgcgtatacaacatgatgggcaaacgagagaagaaaatgggagagttcgggaaagccaaaggaagtcgtgcgatttggtacatgtggctaggagctagatttttagagttcgaggctcttggatttttaaatgaagatcattggttttcgagggaaaattctttaagcggagtagaaggagaaggattacataaactaggatatatacttagagaagtgtctaagaaagaaggaggagcaatgtacgcagatgatactgcggggtgggatacaaggataacattggaagacctgaaaaacgaagaaatggtaacaaaccacatggaaggagagcacaagaaattagccgaagcgatctttaaactaacttaccaaaataaagtcgtaagagttcaaagaccaacaccacgtggtacggtaatggatattatatcgagaagggaccaaagaggatcaggacaagttggaacgtatggacttaatacatttactaatatgggagcccaattgataagacaaatggagggtgaaggtgtttttaaatccatccagcacttgacaaccacggaagaagtagcagttcaggactggctcgcaagagtcggtcgagaacgactatccagaatggcgatatcaggggatgattgtgtagtaaaaccacttgatgaccgatttgcatctgctttaacagcacttaacgatatgggtaaggttaggaaagatatacagcaatgggaaccatcacggggatggaatgactggacccaagtgcccttctgcagccaccactttcacgaactaataatgaaagacgggagagttcttgttgttccttgtcgaaaccaagatgaactaataggtagggcgagaattagtcaaggagcaggatggtcacttagagaaacagcgtgtcttggaaaatcctacgctcagatgtggtccctgatgtatttccataggagggacctccggttagcagctaatgcaatatgtagtgcagtaccatcacattgggtaccaacaagcagaactacttggagtatccatgcaagacatgaatggatgacgactgaagacatgctgacagtttggaatagagtgtggatacaagaaaatccatggatggaggataaaaccccggtggaaagttgggaggaaataccatacttaggtaaaagagaggatcaatggtgtggatcgttaatcggcttaacttcccgtgcaacttgggctaaaaacatacaaacagctataaaccaagttagatctcttatcggaagtgaagagtatacagactatatgccttctatgaagagatttagaagggaagaagaagaagcgggagtattatggtga

SEQ ID NO: 22866 - RNA, 9876 nt, synthetic construct
  misc_feature 1..9876: note = derived and/or modified CDS sequence (opt6) from DENV-2__KJ918750__SS-prME
  source 1..9876: mol_type = other RNA
acggcgggaatgatcatcatgttaatcccaactgtaatggcatttcatctaactacccgaaatggagaaccacacatgatagtaagtcgtcaagaaaaaggaaaaagtctactatttaaaacaaaagatggtaccaatatgtgcactctaatggcaatggacctaggtgaactttgcgaagacaccattacttacaaatgtccgttccttcgacagaacgagccggaagatattgattgctggtgtaactctacatcaacctgggtaacgtatggaacgtgtacaacaaccggtgaacatcgacgggaaaaacgatcggtagcattagtaccacacgtaggtatgggtcttgaaactagaactgaaacctggatgagcagtgaaggagcttggaaacatgctcagcgaatagaaatatggattctaaggcatccaggtttcacaatcatggcagcgattttggcatatactataggaactacccattttcaacgtgttctaatttttattctactaaccgctatagcacctagtatgacaatgaggtgtataggcatctctaatcgcgactttgtcgaaggagtaagtggaggaagctgggtagacatcgtattagaacatggcagctgcgtaacaacaatggccaaaaataaaccaacattggatttcgagttaattaaaacggaagcaaaacagccagcaacactcagaaaatattgcattgaagccaaacttacaaacacgacaacggactcacgatgcccgacacaaggagaaccaaccttaaatgaagaacaagacaaaagatttgtatgtaaacattcaatggttgaccgtggatggggaaacggatgcggcttattcggcaaaggaggtatagttacatgtgcaatgtttacatgcaagaaaataatgaaagggaaaattgttcagccagaaaacttagaatatacggtagtgataacgcctcattcaggtgaagaacatgccgtaggcaacgacacagggaaacatggtaaagaggttaaaattacaccacagagtagcataacagaagcggaattgactggctacggcacagtaacaatggagtgttcgcccaggacgggcctagattttaatgaaatggtattactgcagatggaagacaaggcctggctcgtacatagacaatggttcctcgatctgccattaccgtggctcccgggcgcagacacacaaggatcaaactggattcaaaaagaaaccttagttacattcaaaaacccccatgccaagaaacaagacgtagtagttctaggtagccaggaaggggcgatgcatacagcactaacaggggctacggagattcaaatgagtagtggtaatcttttattcactggtcatctgaaatgcagacttagaatggacaaacttcaactcaaaggaatgtcctattctatgtgtactggaaaatttaaggttgtaaaagagattgcagaaacacagcacggaacaatcgtaataagagtacaatatgaaggcgacggaagtccatgtaaaataccatttgaaataatggatttagagaaaagacatgtacttggtcgactaattactgttaatcccatagttactgaaaaggatagccccgtcaatatagaagctgaaccaccttttggagacagttatatcataatcggtgtagaacctggccaactcaaattgaattggtttaagaaaggaagctctatcggccaaatgctagaaacaacaatgagaggggccaagcgaatggcaatactaggagataccgcgtgggattttggatcactaggaggagtatttacgtcaatcggaaaagctctccatcaagtttttggagctatctatggtgccgcttttagtggagtatcatggacgatgaagatattgactggagttataattacatggatagggatgaactctagatccacctccctctccgtatccctagtcttagtaggcattgtcactctgtatttgggcgttatggtacaagcggatagcggatgcgtggtaagttggaaaaataaagagctaaaatgcggaagcggcatttttgttacagacaatgtacatacatggactgaacaatacaagttccaacctgaaagccctagtaaactagcctcagctattcagaaggcacacgaggaaggtatctgcggcattcgaagtgtaacaaggttagagaacctgatgtggaaacagataacgccggaattgaatcatatcttgagtgagaatgaagtaaaactaacaataatgactggagatataaagggtattatgcaagtaggtaaaagatcacttaggccgcagccaacagaattaaggtatagttggaaaacatggggtaaggctaaaatgctaagtactgaattacacaatcaaacatttttaattgatggccctgagacagcagaatgcccaaatacgaaccgtgcgtggaacagcttagaagttgaagattatgggttcggtgtatttacaacgaatatttggttaagattacgtgagaaacaagacgtattctgtgactcgaaactaatgtcagccgccatcaaagacaatcgtgcggtacatgcagacatgggctattggatagagagtgcactcaatgatacttggaaaatagaaaaagcaagttttatcgaagtaaaatcatgtcactggcctaaaagccacactttgtggtccgatggggttctcgaatccgaaatggtgattcctaaaaatttcgcgggaccggtatctcaacataataacagacctgggtatcatacacaaacagctggaccttggcacctgggtaaattggaaatggactttgacttttgtgagggtactacagttgtggtaaccgaagactgcggaaatagaggacccagtctaagaacgactacagcaagcggaaaacttataacagaatggtgttgtagatcctgcacgttacctccactacgttatcgcggagaagacggatgttggtatggaatggagatacgaccgttaaaagaaaaagaggagaatttggtctcatctttagtaacggctggccatggacaaatagataatttttcccttggcatactcggaatggctctattcctagaagaaatgctacggacaagagttgggacaaaacatgcgatacttctggtcgctgtgtcatttgtcacgcttataacgggaaatatgagttttagggatctcggacgcgtcatggttatggtcggagcaacaatgacagatgatataggcatgggcgtaacatacttggctttacttgctgcgtttaaagtaaggcctacgttcgcagcgggcctactgcttcgtaaactgacttcaaaagaactaatgatgacaacaattggcattgtgctgctatctcagagttcaattcctgaaacgatattagaactaactgacgctctggcacttggaatgatggtgctaaaaatggtgaggaatatggagaagtatcaactagccgttactataatggctatactatgtgtcccaaacgccgtcattctgcaaaacgcctggaaagtatcatgcacaatcctagcattggtcagtgtttcaccgttattcttaacatcatcgcaacaaaaggctgattggataccattagcattaaccataaagggattgaatccaaccgcgatttttcttaccacattaagcagaacatcgaagaagagatcatggccactaaatgaagctatcatggctgtaggtatggtatccatattagcatcatcactactcaaaaacgatattcctatgactggacctttagtagcaggaggcctgcttacggtatgttatgtactaactggtagatctgccgatttagaattagagagagctgctgacgtcaaatgggacgaccaggcagagatctcagggtcatcgccaatacttagtataaccatcagcgaagatgggagcatgtccatcaaaaatgaagaagaagaacagactttgaccattctgatcagaacgggtctccttgtaatctcggggttatttcccgtatccataccaatcaccgcagcagcctggtatttatgggaagttaagaaacagagggccggagtgctttgggatgttccctctcctccaccggtgggtaaagcggagttggaagacggagcatacagaataaaacaaaagggcatacttggatactcacaaattggggctggagtgtacaaagagggtacattccataccatgtggcacgtaacaagaggagcagttctcatgcataagggaaaaagaatagaaccatcatgggcagacgtaaagaaagatttaatctcttatggtggagggtggaaactggagggggaatggaaagagggcgaagaagtccaagtactcgccctagaaccgggcaaaaaccctagggcagtccaaaccaagccaggcctattcaaaactaacacagggactataggagcggtttccttagacttcagccccgggacatcagggtcacctatagtcgacaagaaagggaaagtcgttggattatacggcaacggtgtagtgacacgatctggtgcgtacgtttcagcgatagcccaaacagagaaatcgattgaagacaatccagaaatagaagacgatatttttcggaagcggagactcacgattatggatcttcacccgggtgccggcaagacaaaaaggtatttgcctgctatcgtcagagaagcaataaaaagaggtttaaggaccttaattctagcaccaacgagagttgttgcggccgaaatggaagaagcacttagaggactacctattagatatcaaacacccgccatcagagcggagcacacgggtagggagattgttgatttgatgtgccacgcaacgtttactatgagattgcttagcccaattagggtcccgaattacaacctaatcattatggatgaagcacatttcacagatcctgcctcaatagcggcgcgaggctatataagtacgcgagtagaaatgggcgaagcagcaggtatcttcatgacagccacgcctcccggtagccgcgacccctttcctcaatcgaacgctccaataatggacgaagaaagagaaatccccgaaaggagttggaatagcggccacgagtgggtaacagacttcaaaggcaaaacagtttggttcgttccttcaataaaaaccggaaacgacatagcagcctgtttgcggaaaaatggtaagagagtcatacaactcagtcgaaaaacttttgattcggaatatgtcaaaacacgtacaaatgattgggactttgttgtaaccactgatatatcagaaatgggtgccaatttcaaagcagaaagagtcatagatcctagaagatgcatgaagccggtaatattgactgatggggaagaacgtgtaatccttgctggacctatgccagttacccacagcagcgcagcacaacggcgtggtcggataggtcgaaatcccaaaaatgaaaatgatcagtatatttatatgggagaacccttagaaaatgacgaagactgtgcacattggaaagaggctaaaatgttactggataacattaacacaccagagggcatcattccttcaatgttcgaaccggaacgtgaaaaagtagatgcaattgatggggagtacagattacgaggagaagctcgcaaaacatttgtagatcttatgcgacgcggtgaccttccggtgtggttagcttacaaagtagctgccgaaggtattaattatgcagataggagatggtgttttgatggtacaagaaataatcaaatattagaagaaaatgtcgaagttgaaatctggacaaaggagggcgaaagaaagaaactaaagccaagatggttagatgctcggatatactcagatccactggcactaaaagaatttaaagaatttgcggcaggaaggaaaagcctgacactcaacttaatcacagaaatgggacgcctcccaacatttatgactcaaaaggcccgcgatgcattagataacttagcggtactacatacggcggaagcaggaggtaaggcctataatcacgcgttgagtgaattaccggaaacattagagacccttttactactaacccttctggctactgtaaccggtggaatatttttatttttgatgtcgggcagggggataggaaaaatgaccctaggtatgtgctgtattataacagctagcattttactatggtgcgcccaaatccaaccacactggatagcggccagcataatcttagagttctttctaattgtgctattgataccagaaccggagaagcaaaggacaccacaagacaaccaattaacctacgttatcatcgcgatcttaacggtagttgcagcaactatggctaatgagatgggatttctagagaaaaccaagaaagatctaggtctaggaaacattgtcacacaacaacctgaatcgaatatattagacatagaccttcggccagcatctgcctggacattatacgccgtcgcaacgacgtttattacacctatgctccgtcatagtatagagaatagttcagtcaatatgagtttgaccgcaatcgcgaaccaggccacagtactaatgggacttgggaaaggctggccgctctcgaagatggacattggggtcccccttctggctatagggtgttgctcgcaagttaatcctatcactttgacagcggcgttatttctgttagtagcccattatgcaataataggacccggtttacaagcaaaggccacaagagaagcacagaaaagggctgcagccgggataatgaaaaaccccacggtagatggaattacagtaatagacttagatccgatcccctatgacccaaaattcgaaaaacaacttggacaagtgatgctgttagtattgtgtgtgacccaggtgcttattatgcgtacaacctgggctttatgtgaagcattaactctggcaactggaccagttagcacgctatgggagggaaatcctggacggttttggaacacgacaatagctgtatctatggcaaatatattccgcggtagttatttggccggtgcaggcctactattttgtataatgaacaacactacacgcttgagaagaggaactggccacttacgtaaaactctaggagataaatgtaaatcaagactaaatactctaggcaaaagcgagttccaaatatataagaaatccggaatacaggaagtggataggaccctagcaaaagaaggtataaaacgaggcgaaactgaccatcatgcagttagcagaggtagcgcaaaacttcgttggttcgttgaaagaaatttggttacacccgagggaaaagtagtagacctaggttgcggacgtgggggctggtcatactattgtggtggactcaaaaacgtgagagaggtgaaaggcctaactaaaggcggaccaggacacgaagaacccattccaatgagtacttatggttggaacttagtaagactacaatccggagtagatgtattcttcatacctcctgaaaagtgtgacacactactgtgcgacattggcgaatcatctccaaatccgacggtcgaagctggtcgaacattacgagtacttaatctcgtggaaaattggcttaataataatacgcaattttgcattaaagtacttaacccttatatgccaagtgtgattgagaaaatggaaaccttacaacgcaaatacggcggtgcacttgtaagaaacccactctcacgtaacagcacacacgaaatgtactgggtatcaaatgcctcagggaatatagtatcaagtgttaatatgatatcaagaatgctgataaacagatttacaatgagacacaagaaagcgacctatgaacctgatgtcgatttaggttccggcacaagaaatataggcattgaaagcgaaacacctaatctcgatataatcggaaaacgaatcgagaaaataaagcaggaacatgaaacctcctggcactatgaccaagatcatccgtataagacgtgggcttatcacggttcctatgaaacaaagcagacggggtcagcatccagtatggtaaatggagttgtaagactgttaacaaaaccgtgggatgtagtacccatggttacacagatggccatgacagatacaaccccatttggccaacaacgtgtctttaaagagaaggtagatactagaacacaggaaccaaaagaaggtacgaagaaactcatgaaaattacagctgaatggctctggaaagaattgggcaagaagaaaacgccaagaatgtgtaccagagaagagttcacgaaaaaggtgcgaagtaatgctgcattgggtgccatattcactgacgaaaataaatggaaatcagcacgagaagcagtggaagatggacgtttctgggaattagtcgataaagaaagaaacctacatttagaaggaaagtgcgaaacatgcgtgtacaatatgatgggaaaaagggagaagaaacttggtgagtttggtaaagcaaagggttcacgggccatctggtatatgtggctaggagcaagatttttggaatttgaagcgttaggattcctcaacgaggatcactggttcagcagggagaatagcttatcaggggtagaaggcgaaggtctacacaaactgggatatatactgagagaagtatctaagaaggaagggggtgcaatgtacgcggatgacactgcagggtgggatactcgtataacaattgaagatttgaagaatgaggaaatgatcaccaaccatatggccggagaacataagaaacttgcagaggcgatctttaaattaacttatcaaaataaagtagttagagtacaaagaccaactccacgcgggacggtaatggatattatatcccgaagagaccaacgaggatcaggacaagtaggaacatacggtttaaacacattcacaaacatggaagcgcaattaatacgacagatggaaggagaaggtatatttaaaagtattcaacatctgacagcaacggaagaaatcgcggtccaagactggttggccagagtaggaagggaaagactctcccgaatggctatcagtggggatgattgcgtagtaaagccacttgacgatagatttgctagggcattgacggcattgaatgacatggggaaagtacgaaaagatattcaacaatgggaaccaagtagagggtggaatgattggacccaagtcccgttttgttcacatcatttccatgagctaattatgaaagatggacgcactctagttgtaccctgtcgaaatcaagatgaacttataggtagagctagaatctcacaaggagccgggtggtctttaagagaaacagcatgtttaggtaaatcgtacgcgcaaatgtggtcattaatgtactttcatcgacgagatttacgcctcgcagcaaatgccatatgctcagctgttccgtcgcattgggttcctacatctcgaacaacttggtccatacatgcaagtcacgaatggatgacaacggaagacatgcttactgtatggaaccgtgtttggatacaagaaaacccgtggatggaagataaaacccccgtagagtcttgggaggagataccatacttaggtaaaagggaagaccaatggtgtggaagcctaatcggtcttacaagcagagccacatgggctaaaaacatacaaacagcaatcaaccaagtaaggtcattaattggcaacgaagaatatacagattatatgcccagcatgaaacgattccgacgcgaagaagaagaagcgggagtcctttggtaa

SEQ ID NO: 22867 - RNA, 9876 nt, synthetic construct
  misc_feature 1..9876: note = derived and/or modified CDS sequence (opt6) from DENV-2__KU517845__SS-prME
  source 1..9876: mol_type = other RNA
acagcaggaataattattatgatgatccccactgtaattgcattccacctgacaactcgcaatggcgaaccgcacatgatagtgtcgaggcaagaaaaagggaaaagtcttttatttaaaacagaaaatggtgtcaatatgtgcacattaatggctatggatttgggcgaactttgtgaagacacaataacatataattgtcccctgttaagacaaaatgaaccggaagatatagattgctggtgtaatagtacttcagcttgggttacctatgggacttgtacagcaactggtgaacatagaagggagaaaagatcagttgccttagtaccacatgtcggcatggggttagaaacacgaaccgaaacatggatgtctagtgaaggagcgtggaaacacgctcagcggattgaaacatgggtgctccgccatcctgggttcaccataatggcggccattctcgcatatacgataggaacaacatactttcaacgtgtactaatattcattctacttacagctgtaacaccgtcaatgacgatgcgttgcatcgggatatcaaatcgtgatttcgttgaaggggtcagcggagggagctgggtagacatagttctagaacacggcagttgtgtcactaccatggcgaaaaacaaacctacactagattttgaattaataaaaacagaagcaaaacatccagcaacgttacgaaaatattgtatagaagcgaaattaacaaataccactactgcatcgcggtgccctactcaaggagaaccaagcctcaatgaagaacaagacaaacgctttgtatgtaaacacagcatggtagatcgaggatggggaaatggatgtggtctattcggaaaaggaggaatagtcacttgtgcaatgtttacatgtaagaagaatatggaaggtaaaatagtacaaccggagaatctagaatatacaatagttataacaccacatagtggagaagaaaatgctgtaggcaatgatacaggaaaacacgggaaagaaattaaagtaacaccgcaatcatctattacggaagctgaactgaccggctacgggacagttactatggaatgtagcccccgcacaggtctcgatttcaatgagatggtacttcttcagatggaaaataaagcatggttggtacaccgacaatggtttctcgatctccccctgccctggttaccaggtgcagatactcagggttcaaattggatacaaaaagaaacattagtgacatttaaaaatccccatgctaagaaacaagacgtggtcgtcctaggatcacaagaaggagcgatgcatacagcattaactggagctacagagatacagatgtcttctggaaaccttttatttaccggccacctcaaatgtaggctccgaatggacaaactccaactaaaaggtatgtcatactcaatgtgcacgggaaaatttaaagttgtaaaagaaatagccgaaacccaacatggaacaatagtcataagggtccaatatgaaggagacggaagcccatgcaaaatcccatttgaaataatggacctagagaaaaggcacgttctcggccggttaatcacggttaatccgatagttactgaaaaagactcaccggtaaacattgaggcggaaccaccgttcggagatagctacataattattggtgtggaacctggccaacttaaattatcttggttcaagaagggctcaagtataggacaaatgtttgaaacaacgatgagaggagccaaaagaatggcaatcttaggagacacagcgtgggacttcggatctctaggtggggtattcacgtccataggtaaggctttacatcaagtattcggggcaatatacggtgcagcattttcgggggtatcatggacaatgaaaattctcataggagtcgtaataacatggataggtatgaacagcagaagcaccagtctgtctgtaagcctcgtcctagtaggcgtggtaacattatacctaggggtaatggtacaagctgacagtggttgcgtagtaagctggaagaacaaagagctaaaatgcggaagcggaatcttcataacagacaacgtccacacatggacagaacagtataaatttcagcccgaaagcccttctaaactcgcatcagcaattcaaaaagcacatgaagaaggaatatgcggaattagaagtgtaacacgccttgagaatttaatgtggaaacaaattacgcctgaactgaaccatatcctatcggaaaacgaagtgaaactcaccattatggctggagatataaaaggcataatgcaggcaggaaaacggagtttgcgaccccaaccaacagaactaaaatattcatggaaggcttgggggaaagccaagatgttatcaaccgaactacataaccacacatttttgattgatggtcctgaaaccgcagaatgtccgaatacaaatagagcgtggaactccttagaagtagaagattatggttttggcgtttttacaaccaatatatggctaaaattaaaagagcggcaggacgccttctgtgactcaaaactgatgtcggcagcaataaaagataacagggccattcacgcagacatgggctactggatagaatcagctttaaatgacacttggaaaattgaaaaggcgagttttatcgaagtaaagagctgccactggcccaaatcacacacactatggtccaacggcgtgttggagagtgaaatgattatacctaaaaactttgccgggccagtgtctcagcataactataggccaggataccatactcaaactgcaggcccgtggcatctaggtaggctcgaaatggattttgatttttgtgaggggacaacagtagtggtaactgaagattgcggaaatcggggtccctcgctgcggactacaaccgctagcggtaagttaataacggaatggtgttgtagatcatgcaccctaccaccgctgcgctatagaggcgaggacggctgctggtacggaatggaaatcaggccgttaaaggaaaaggaggaaaatctagtaaattctttagtaacagcagggcacggccaaatcgataacttttcattaggtgtgctggggatggcattatttttggaggaaatgctaagaacacgagttggcacaaaacatgccattttgcttgttgccgtttctttcgtaaccttaatcacggggaacatgagtttcagagacttaggtagggtaatggtgatggtaggcgctacgatgaccgatgatataggaatgggcgtgacgtatctagctttgctagcggctttcaaagtcaggccaactttcgcagcgggtttgttactgcgaaaactcacttctaaagagctaatgatgacaacaataggaatagtccttctaagtcaatcgacaatccccgaaacaattctagagttaacagatgcgctagctcttggaatgatggtactaaaaatcgttcgaaatatggaaaaataccaactcgctgtcaccatcatggcaattttatgtgtacccaacgcagtgatattgcaaaatgcatggaaagtaagctgcacaacattagccgtagtaagtgtatcaccattactattaacatcaagccaacaaaaagctgattggatacctttagtattgacaatcaaaggtcttaaccccacagcaatattccttactacattgtccagaacgtcgaagaaaaggtcctggcccttaaatgaagcaatcatggcagtcggaatggtatctatccttgcatcgtctctactcaaaaatgatataccaatgactggaccgctagtagccggtggattattgactgtctgctatgtattaacaggacgctctgcagacttagaactagaaagagcagccgatgtcagatgggaagaacaggcagaaatcagtggatcatccccaatcctttctataactgtgtcagaagacggttcaatgagtatcaaaaatgaagaggaagaacaaactttaacaatactaatcaggaccggcctgctagtaatttcaggcctttttcccgtatctataccaatcactgctgcagcctggtatctttgggaagtcaagaaacaaagagccggagtgctatgggatgtaccgtctccgccgcctgtaggaaaggccgagctagaagatggagcctataggatcaagcaaaaaggaatcctcggttactctcaaatcggtgctggcgtctataaagaaggaacgttccacacaatgtggcatgtcacaagaggcgctgtactgatgcataaaggaaagcgaatagaaccatcttgggctgatgtcaaaaaggacctgatctcatatggtggtggctggaagttagagggagaatggaaggagggcgaagaggtacaggtcctagcactagaaccaggtaagaatccgagggccgtgcagactaaaccgggattatttaaaaccaatacaggaacgatcggagctgtcagtctagatttttcacctggaacatcaggttcacccatcgtggataagaaaggtaaagttgtaggattatacggtaatggggttgtaacgaggtcgggtacctacgttagcgctatcgcacaaacagaaaagtctatcgaggacaatccagaaatcgaagatgacatcttcaggaagaaacggctgaccataatggacctacatcccggcgccggaaaaacgaaaaggtatctccctgcgatcgtccgggaggccataaaaagagggttaaggacactaattttagcgcctactcgggttgttgcagctgaaatggaggaagcactaaggggattacccatacgttatcaaacgcccgcaatacgggcagaacatacaggcagagaaattgtagatttaatgtgtcatgcgactttcactatgaggcttctaagcccaattcgtgtacctaattacaatttaataattatggatgaagcacactttacagatccagcttcaatagccgcaagaggatatataagtaccagagtggaaatgggagaagcagccggtatatttatgaccgcgactccgcctggaagccgcgacccctttccacaaagtaatgcaccgatcatggacgaagaacgcgaaattccagagcgtagttggaacagtggtcatgaatgggtgacagactttaagggaaaaacggtgtggttcgtaccgtctatcaaggccgggaatgacatagcagcatgtttaaggaagaacggcaagaaagtaatacaactcagcagaaaaacatttgatagcgaatatattaaaacgagaacaaacgactgggactttgttgttactacagatatttcagaaatgggggcgaacttcaaagcggaacgagtcatcgacccaagacggtgtatgaagccagttattctaacggacggagaagaacgggtaatactggctggaccaatgcccgttacacattcgtcagcggcacaacgacgaggacgtgttggaaggaatcccaaaaatgaaaatgatcaatatatatacatgggagaacccctcgaaaatgatgaggactgcgcacattggaaggaagctaaaatgttacttgacaatataaatacaccggaaggtataattccctcgatgtttgaacctgaaagagaaaaagtggacgctatagatggagagtaccggttaagaggcgaagcacgaaaaacatttgtagacctgatgagacgtggcgacctgcctgtctggttagcatacagggtagccgcggaagggatcaactacgcagaccgccgctggtgtttcgacggggtcaagaacaaccaaattttagaagaaaatgtcgaagtagaaatatggacaaaagaaggggagagaaagaaattaaaaccaaggtggctagatgcccgtatatattcagatcctttggcgttaaaagagttcaaagaatttgcagccggacgaaagagcttgacactaaacctaattactgaaatgggaagattaccgacatttatgacacaaaaagcaagaaacgcactggataatttagccgtcctacatacagcagaagcaggaggtagagcttataatcacgcgttatcggaattaccagagacattggagacattacttttattaaccttactagctactgtcacaggcggaatatttttgttcttgatgagtgggaagggaatcggaaaaatgacactgggaatgtgttgtataattacagcctctatactattatggtacgcccaaatccagccgcattggatagctgcatcgatcattttggaatttttccttattgttttattaataccggagccagaaaaacaacgtacaccacaagataatcaactaacgtatgtagtgatcgcaatattaacagtagttgcagcaacgatggcaaatgaaatgggatttttagaaaagacgaagaaagactttggactaggcagcattgccaaccaacagcctgaaagcaacatattggatatagacttaagacctgcatctgcttggacactgtatgctgtcgctaccacgttcataacgcctatgttacgacactcaatagaaaactcctcagtcaatgtttcacttacggcgattgctaaccaggcaaccgtactcatgggtttaggcaaaggatggccgttaagtaagatggatataggcgtacccttactcgcaatagggtgttactcacaagtaaatcccataacactaacagcagccttgctacttttagtagcacattacgcgataatcggtccaggattacaagctaaggcaacgagagaagcacaaaagagagcagctgcgggcatcatgaagaacccaacggttgatggcatcaccgtaatagacttagatcctataccttacgatccgaaatttgagaaacaactaggacaggtgatgctactggttctctgtgtaacacaagtgctgatgatgaggacgacatgggcactatgtgaagcgctaacacttgccacgggaccaatatcgactctatgggaaggtaacccagggcgattttggaatacaacaatcgctgtaagtatggctaatatatttcgaggatcgtacttggccggagcaggcctattattttctataatgaaaaacacagcgaacacacgacgagggacaggaaacactggcgagacactaggggagaagtggaaaaatagattaaatgccttagggaagtctgagttccaaatttacaagaaatcaggcatacaagaagttgatcgaaccctagccaaagagggcattaaacgtggcgaaacagatcaccatgcagtttctagaggcagcgcaaaactaaggtggttcgttgagcgaaatttagtaacgcccgaaggaaaagtcgtggacctagggtgcggacgtgggggttggtcatattattgcggaggactaaagaatgttaaagaagtcaaagggttaactaaaggaggaccgggccatgaagaacccatccctatgtcaacatacggatggaaccttgtacggcttcaaagcggtgtcgacgttttcttcactcctccagaaaaatgcgacacattactatgtgatatcggagaatcgtcgccaaatccaacagtcgaagcaggtagaacacttcgagtgttaaatctagtagaaaactggctcaacaataacacccagttctgcatcaaagtgttaaacccttatatgccttctgttatagagaaaatggaagcattgcaaaggaaatatggcggcgcgctagtaaggaatccactatcaagaaattcaacacatgagatgtactgggtctcaaatgcaagtggaaatattgtaagctctgtaaacatgatatcaaggatgttgattaacagattcaccatgcgacacaagaaggctacatacgagcctgacgttgatcttggaagtggtacaaggaacattggaatagaatcggaaactcccaatttagatattataggaaagagaatcgagaagatcaaacaagaacacgaaaccagttggcattacgaccaagaccacccttataaaacctgggcataccatgggagttatgaaaccaaacagactgggagcgcgagcagcatggtgaacggtgttgtacggttactcacaaagccttgggatgtaattcctatggtcacccaaatggctatgacagatactactccttttgggcagcaaagagtatttaaagaaaaagttgatacaagaacacaagagcctaaagaagggaccaagaaaattatgaaaattactgcagaatggttgtggaaagaactaggtaagaagaaaactccaagaatgtgtacgcgagaggagttcacaaggaaagtaagaagtaatgccgccttaggagcaatctttacagatgaaaataaatggaaaagtgcacgtgaagcggtagaagattcaggtttctgggagttagtagacaaagagcgtaatctccatctagaaggaaagtgtgaaacctgtgtttataacatgatgggtaaacgtgagaagaaattaggagaatttggaaaggctaaaggtagtcgagcgatttggtacatgtggctgggagctcgattcttggagttcgaagccttaggatttttaaacgaagatcattggttctctcgtgaaaacagtttgtcaggagtggaaggagagggccttcacaaactaggatatatcctacgagatgtatcaaagaaagaaggaggagcaatgtacgctgatgatacagcgggatgggatactagaataactttggaggatttaaagaatgaggaaatggttacatcacacatgaaaggcgagcacaggaaactagctgaagccattttcaaactaacataccagaacaaagtagtgagagtacaacggccaacgccccgaggcactgttatggacataatctcaaggcgagatcagagaggttcaggacaagtagtcacctatggtctaaacactttcacgaatatggaagcacagttaattcgtcagatggaaggagaaggcgtattcaaatcaatccaacagcttaccgtaacagaagaaatcgcagtgaaaaattggctggtccgagttggcagggaaagattatcaaggatggcaatatctggcgatgattgcgttgtaaaaccgttagatgatcgcttcgccagtgctttaaccgccttgaacgatatgggcaaagtacgaaaagacatacaacaatgggaaccgtcaagaggctggaacgattggacccaagtaccattttgctcacatcattttcacgaactaattatgaaagatggcagagtcctggtagtcccatgccgtaaccaagacgaactaattggtcgcgcacgtataagtcaaggtgcaggatggagtctgagggaaaccgcatgcttaggcaaatcttacgcccaaatgtggtcacttatgtatttccaccgaagagatctcagactagcagcaaatgcaatatgttctgcagtcccttcacattgggtaccaacctcaagaacaacatggtcaatacacgcgacccatgagtggatgacgactgaggatatgttaactgtatggaacagagtatggatacaagaaaatccctggatggaagacaaaacaccagtcgaatcgtgggaggagattccatacttaggtaaaagagaagaccaatggtgcggctccctaataggtcttacttcacgagctacgtgggctaagaacatacaaacagctattaatcaagtacggagtctaataggcaacgaagagtacacagattacatgccgagcatgaaaagatttagacgcgaagaggaagaagcaggagtgctctggtga

SEQ ID NO: 22868 - RNA, 9876 nt, synthetic construct
  misc_feature 1..9876: note = derived and/or modified CDS sequence (opt6) from DENV-2__KU517847__SS-prME
  source 1..9876: mol_type = other RNA
acggcaggaattataatcatgatgataccaactgttatggcgtttcatttaacaacaaggaatggagaacctcatatgatagtatcaagacaggaaaaaggaaaatcacttttgtttaaaacagaaaacggtgtaaatatgtgtactctaatggcgatggacttaggagaattatgcgaagatacaataacttataactgcccattattaagacagaacgaaccagaagatatagactgctggtgcaacagtacaagtacttgggtaacatatggaacttgtaccgctactggtgaacataggagagagaaaagaagcgtggcacttgtgccacacgtaggtatgggattagaaaccaggacggagacttggatgagcagtgagggagcatggaaacatgcacaacggatcgaaacatgggtactaagacatccgggttttacaattatggcagctattcttgcttacactataggcacgacatactttcaacgggtcttgatatttatcctacttactgctgtcgctccaagtatgacaatgagatgcataggaatctcaaatagggacttcgtagagggggtgagtggcggttcttgggtagatatcgtcctggagcatgggagctgcgtgacaacgatggcgaaaaacaaacctaccctagacttcgaattaataaaaacagaagctaaacatccggcaacgctaagaaaatactgtattgaagctaaattaaccaatactacaacggcttctcgatgtcccacacaaggtgaaccttctttaaacgaagaacaagacaaaagattcgtttgcaaacacagcatggttgacaggggttggggaaatggatgcggcctattcgggaaaggaggaattgttacatgcgcgatgtttacttgtaagaagaatatggaagggaaaatagttcaacccgaaaacctagaatacacaatagttattactccgcattcaggagaagaaaatgcagtggggaatgacaccggcaaacatggcaaagaaataaaagtaacaccacaatcctctataactgaggctgaattaaccggatacggtactgtaacaatggaatgctcaccgcgtacaggactagactttaacgaaatggttttattacagatggagaacaaagcatggctagtccatagacagtggttcctagatttaccacttccttggctacccggagcagatacacaaggctcaaattggattcaaaaagaaactttagttacatttaaaaatcctcatgcgaagaaacaagacgtcgtagtcctggggtcacaagaaggtgcgatgcatactgctttgacgggcgctaccgaaatacaaatgagttccggaaatctattatttacaggccatttaaaatgtagattaaggatggataaactacaacttaaaggaatgtcctatagcatgtgcaccggtaaatttaaagtagttaaagaaatagccgaaactcaacacgggactatagtaataagagttcagtatgaaggcgacggtagcccgtgtaaaataccctttgaaatcatggatcttgagaaaaggcatgtactaggtcgattgatcacagtgaaccctatagtaacggagaaagactcacctgtaaatatagaggcagaaccgccttttggtgattcatatatcataataggagttgaacctggccagttaaaactaagttggttcaagaaagggagttcaataggccagatgtttgaaacaactatgagaggagcaaaacgcatggcgatactaggggacactgcgtgggattttggctccctaggaggcgtttttacatcaatagggaaagccctacatcaggtattcggtgccatatatggagctgcgttttcaggagtatcctggacaatgaaaattctaatcggagttgtcatcacttggataggtatgaactccagatcaaccagcctttcagttagtttggtgttagtcggcgtagtgacactatacttgggtgtaatggtacaggctgacagtggttgcgtagtttcctggaaaaataaagagctaaaatgtggatcaggaatatttataacggataatgtacatacttggaccgagcaatataaatttcaaccagaatctccatcgaaactagcaagtgctattcaaaaagcacacgaagaagggatatgtggaataaggtcagtaacacgcctagaaaacctgatgtggaaacaaattacaccggaactgaatcatattcttactgagaatgaggttaaactaactatcatgaccggagatataaaaggaataatgcaagcaggtaaaagaagcctgcgtccccaaccgactgaactaaaatattcttggaaagcatggggaaaagctaaagtactctcgaccgaattacataaccacacatttcttatagatggacctgagaccgcggaatgtcccaatacaaatcgagcatggaacagtctggaagtcgaagattatggatttggagtattcaccacaaacatctggcttaaattaaaagagcgccaggacgtttcctgcgattcaaaattaatgtcagcagcgataaaagataacagagcagttcatgctgatatgggttattggatagaaagtgccttaaatgatacctggaaaatcgagaaagcctctttcatcgaagtcaaatcatgtcactggcctaagtcacacacgttgtggagtaatggggttctagaatctgaaatgataataccaaagaattttgcaggtccagtaagccagcacaattatcgcccaggctatcacacacagacagcaggcccatggcatctgggacgattggagatggattttgacttttgtgaagggactaccgtagttgtcactgagaactgcggcaatcgcggaccgtctctacgaactaccacggcatcaggcaaactaataacggagtggtgttgtagatcctgtacattaccaccgcttagatatcgaggggaagatggatgttggtatgggatggagattagaccattaaaggaaaaagaagaaaacctagtcaactcgttagtaaccgcgggtcacggtcagattgacaatttctcgttaggagttctaggaatggcactattcttagaagaaatgctccgtacaagggttggtacaaagcacgccatactactggtcgcggtttcatttgttactctaataacaggcaatatgagttttcgggaccttggtcgtgttatggtcatggtaggagcgactatgacagacgatatagggatgggcgttacgtatttagcattgctggcagcattcaaggttagaccgacatttgctgcaggactccttctaagaaaactaacttcaaaagagctcatgatgaccactatagggatagtactactaagtcaaagcacaataccggagacaatactagaactgactgacgccctagcattaggaatgatggtgctcaaaatcgtaaggaatatggagaagtatcagttagcagtaaccatcatggccatcttatgtgtcccaaatgcagttattctacaaaacgcatggaaggtatcatgcaccgcgctggcagtagtctcagtcagcccactcttactcacaagttcccaacagaagaccgactggataccccttgcattgactatcaaagggttgaatcctaccgccatctttctaaccacactttcaagaactagcaagaaacgatcctggcctctaaatgaggctattatggccgtcggaatggttagtatcctcgcctcatcatttctcaaaaatgacatacctatgacggggcccctagttgctggtgggctcttaactgtctgttatgttctaacgggaagaagtgcggacctcgaactcgaacgggccgcagatattaggtgggaagaacaagcggaaattagtggtagttctccaattctctcaattactataagtgaagatggatccatgagcataaagaatgaagaagaggagcaaaccctcacaatcctgataaggactggccttttagttatctcaggactatttcctgcttcgatccctattacagcagccgcgtggtatctatgggaagttaagaaacaacgagctggagtactgtgggatgtgccatcgccgcctcctgtaggtcgagcagaattagaagatggagcatatagaattaaacagaaaggaatactaggatattcacagataggagcaggggtatacaaagaaggcacgttccatacaatgtggcatgttactcgcggtgcagtactaatgcacaaagggaagagaatagaaccaagctgggccgacgtaaagaaagatctcatctcatacggtggagggtggaaacttgagggggaatggaaagaaggagaagaagtgcaagtacttgcccttgaaccagggaaaaatccaagagctgttcaaacaaaaccgggcctgttcaaaacgaacactggaactatcggggccgtaagtttagacttctcaccaggtacaagtggatctcctatagttgacaagaagggtaaagtagttggtctatacggtaatggggttgtaacccgtagtggaacatacgtttctgctattgctcaaactgagaagagtatcgaagataacccggaaatagaagatgacattttcaggaagaaaaggttaacaattatggacttacaccccggtgcaggtaaaactaaaaggtacttaccagcaatagttagggaggccataaaaagagggttaagaacgttaatccttgcacccaccagagtagttgccgcggaaatggaagaagcacttaggggattaccaataaggtatcaaacgccggccatcagagcagagcatacagggagggaaatcgtcgatctcatgtgtcacgcaacctttacaatgcgactactatcaccgatcagagtacccaattacaacctgattatcatggatgaggcacactttactgatccagcaagtattgcagcgcgaggttacattagcacgagggtagagatgggggaagcagccggtatcttcatgaccgctacaccacctggtagtagagacccttttccacaaagtaatgcacctataatggacgaagaaagggaaatcccggaaaggagttggaactcgggacacgaatgggtaacagacttcaaaggaaaaacagtttggtttgttccatcaattaaagctggcaatgatatagctgcgtgtctaagaaagaacgggaagaaagtcatacaactttcaagaaagaccttcgattcggagtatattaaaactaggactaacgattgggacttcgttgtaacaacagatatatctgagatgggggcgaattttaaagcggaacgtgttattgacccgagacggtgcatgaaaccggtaatcctaactgatggagaagaaagggtaatattggcaggacctatgccagtaacccattcaagcgcagcacaaagaaggggaagagtcggaaggaatcccaaaaatgagaacgatcagtatatttatatgggtgaacccttagagaacgatgaagactgcgcgcattggaaagaagcaaaaatgctattagataatataaatacaccagaaggaatcataccaagtatgttcgaaccggaaagggaaaaagtcgacgccattgacggagaatataggttaagaggagaagcgaggaaaacgttcgtagatttaatgagaaggggcgatctccctgtctggctagcatacagagtggcggctgaaggcataaactacgctgatcgaagatggtgttttgacggtgtaaagaataaccagattctcgaagaaaacgttgaagttgagatatggacgaaagagggcgagaggaagaaactaaaaccgcgttggttagacgccaggatctattccgatccgctggctttaaaagagtttaaagaatttgcggctggcagaaagtcacttactttgaacttgataacagaaatgggtaggttgccaaccttcatgactcagaaggcgcgtaacgcgttggataacctcgcagttcttcataccgcagaggcgggaggcagagcatataatcacgctcttagcgaactaccggaaaccctagaaacgcttcttttattaactttgcttgctactgtgaccggcggcatattcttgttcttaatgagtgggaaaggaatcggaaaaatgaccttaggtatgtgttgcatagtaaccgcttccatattactctggtacgcacaaatccaaccccactggatagctgcaagtataattttagagttctttttaatcgtgttgctaataccagagcctgagaaacaaagaacaccacaagataatcagttaacatatgtcgtaatagccatcctgacagttgtagctgcaacaatggcaaacgaaatggggtttttagagaaaaccaagaaagactttggtctaggtagcataaccacacaacagcctgaatcgaatattttagatatcgatttaaggcctgcatctgcatggacactgtatgcggttgcaacaacatttattacgccaatgttgcgacactctatagaaaatagttctgtcaacgtgagccttacagcgatagcaaaccaggcaacagtactgatggggttaggcaaaggttggccgttgagcaagatggacatcggggtaccattattagctataggatgctattctcaagtgaatcctatcacccttaccgccgcattattgctcctagttgcgcattacgctattataggacctggtctacaagcaaaggctacacgtgaagcccagaaacgagcagctgcgggtattatgaagaatcctacggtggatggtataactgtgatcgatttagacccaataccctatgatccaaagttcgagaaacaactaggccaagtcatgcttctcgttttatgtgtgacccaggtattaatgatgagaacaacatgggcgctctgtgaagcattaacgctagcgactggaccaatctccaccttatgggaagggaatccggggagattttggaacacaactatcgccgttagtatggcgaatatatttcgagggagttatttggcgggcgctggtctcctcttctcaataatgaagaatactgcaaatactagaagaggaactgggaatactggagaaacacttggggaaaagtggaaaaacagactgaatgccctgggaaagtctgaatttcaaatttataagaaaagtggcattcaagaggttgatagaactctagctaaagaaggaattaaacggggtgaaacagaccatcatgccgtgtcaagaggatctgcaaaactacgatggttcgtagaacgcaaccttgttacgcccgaagggaaagtcgtagatctgggttgtggtcggggcggttggtcttactattgtggtggtctcaaaaacgtcaaagaagtaaaaggcttaacaaaaggcgggccaggacatgaagaaccaattcctatgagtacatacggttggaaccttgtacgcttacagtccggtgtagatgtatttttcaccccgccggaaaaatgtgatacccttctttgcgatataggcgaatcttcgcctaatcctacagttgaagcgggccggacgttaagagttctaaatttagtggaaaactggctaaacaacaatacacaattttgcatcaaagtgctcaacccgtacatgccgtctgtgatagaaaagatggaagctctacagaggagatacggcggtgcattggtccggaaccctccatctaggaactctacccatgaaatgtattgggtatccaacgcaagtggcaatatagtatcatcggttaacatgattagtagaatgctaattaatagattcacgatgcgacataagaaagcaacatatgaaccggatgtcgatttaggaagtgggactcgaaacattggaatcgagagtgaagtaccaaatctagacatcataggcaaacgaatcgagaaaataaaacaagaacatgaaacaagttggcattatgatcaagatcatccatacaaaacatgggcgtatcatggcagttacgaaacaaagcaaacaggcagcgcaagctcgatggtgaatggcgttgttaggttactaacgaagccatgggatgttataccgatggtgacccagatggcaatgacagatacaacaccattcggtcaacagcgagtgtttaaagaaaaggtagatacccgaacacaagaaccaaaagaaggaactaagaaattaatgaaaatcaccgcagagtggctatggaaagaactgggcaagaagaaaacacctaggatgtgtacgcgcgaagagttcacaagaaaagtacgatcaaatgctgccctcggagcgatcttcactgatgaaaacaaatggaaaagtgccagagaagcagtagaagatagtgggttctgggaattggtagacaaagaacgaaatctccatttagaaggtaaatgtgaaacttgcgtatataacatgatgggcaaacgtgagaagaaactgggagagtttggtaaggcaaaagggtcacgagccatatggtacatgtggctaggagcacgattcctagaatttgaagcattgggtttcctaaacgaggatcactggttcagtagagaaaattcattgtccggagttgaaggggaaggactccacaagttaggttacatactaagggatgttagtaagaaagaagggggtgcgatgtatgctgacgatacagccggttgggataccaggataaccctcgaagatctcaaaaacgaagaaatggtaactaatcatatggaaggtgagcataagaaactagcagaagcgatctttagactaacttatcaaaacaaagtagtacgagtgcagcggccaactccgcgaggaactgtcatggacattatatctaggcgtgatcagagaggatccggacaagttgtaacatacggcctaaacacatttactaatatggaagcgcaattaatacggcagatggaaggtgagggtgtgtttaagagtattcaacatctaacggcgacagaagaaattgcagttaaaaattggcttgtccgagtaggacgcgaaagattgagtaggatggcgatatcaggggatgactgcgtcgtcaaaccttttgacgacagattcgcaaatgctttgacagctttaaatgatatggggaaagtaagaaaagatatacaacaatgggaaccgagtagaggatggaatgactggactcaagtgccattttgcagtcaccatttccatgaactcatcatgaaagatgggcgcgttctagtagtcccgtgccgaaaccaggacgaattaataggccgagcacgaatatcacaaggagcaggttggtcgcttagagaaacagcttgcttaggaaaaagttatgctcagatgtggtctctgatgtatttccatcgaagggatcttagactcgcagcaaacgcgatttgttcagctgtgccttcgcattgggtacctacatcccgtacaacttggagtattcacgccacacatgaatggatgactactgaagatatgctaacagtgtggaatagagtttggatccaagagaatccatggatggaggataagacaccagtggagtcatgggaggaaatcccctatctcgggaagcgagaagaccaatggtgtggctcattgatcggtctgacatcaagggcaacatgggccaaaaacatccagacagccataaaccaagtaagatcgttaataggtaatgaagagtacaccgactatatgccctccatgaaaaggttccgcagagaggaagaagaggctggtgtcctgtggtaa

SEQ ID NO: 22869 - RNA, 9876 nt, synthetic construct
  misc_feature 1..9876: note = derived and/or modified CDS sequence (opt6) from DENV-2__JQ955623__SS-prME
  source 1..9876: mol_type = other RNA
acggcagggatgatcataatgttaattccaaccgcaatggcctttcatctaacaacgaggaatggagagccacatatgatagtttcgcgacaggaaaagggaaagtctctgctcttcaaaacagaagacggagtcaacatgtgcacacttatggccatggacctaggagaattatgtgaagataccataacgtataattgtccactactacgacaaaacgaaccagaagatatcgattgctggtgtaattcaacatctacatgggtcacttatggaacatgcacagctactggggaacatcggcgagaaaaacggtcggtagcactagtgcctcatgtaggaatgggtctggaaactagaacagagacgtggatgtcatcagagggagcctggaaacacgcacagaggattgaaacttggatcttgcgacacccgggcttcaccataatggcggctattttagcatatacaattggaactacacactttcagcgagttctcatcttcatcctgttaacagcagtagcaccttccatgacaatgcgctgtatagggatcagtaaccgagacttcgttgagggcgtcagtggggggtcttgggtagatatcgtgttggagcacggctcatgtgtaacgactatggcaaaaaacaaacccactttagactttgagctgatcaaaacagaagctaaacaaccagcaactctaagaaaatattgcattgaggccaaattgactaatacaacaacagcctccagatgccccacacaaggagaaccgagtcttaatgaagagcaagataaaaggttcgtttgtaaacatagcatggtagatagaggctggggtaatggctgtggcctgttcgggaaaggagggattgtaacatgtgctatgtttacttgtaaaaagaatatggaaggtaaaatcgtacaaccagagaatctggaatacaccattgtcgtaacacctcactcaggggaagagaacgccgtcggtaacgacacaggcaaacacggaaaagaaataaaagttactccacaatcttccataaccgaagcagaattgactggttatggtacggtaactatggaatgtagcccaagaacaggattagatttcaatgaaatggttctccttcagatggaaaacaaagcatggctggtacataggcaatggtttttagatttaccacttccttggttgccaggggcagatacacaaggaagtaattggatccaaaaagaaacattagtaacatttaaaaaccctcacgcaaaaaagcaagacgtagttgtattggggtcacaagaaggagcaatgcacaccgcactaactggggctacagaaatccaaatgagttctggcaatctattattcacgggacatttaaaatgccgactccgtatggataaattacaattgaagggaatgtcatactcaatgtgcacagggaagtttaaagttgtcaaagagattgcggaaactcaacacggtacgatagtcataagagtgcaatatgaaggagatggctcgccctgcaaaattcctttcgaaataatggatttggaaaagaggcacgtcctaggaagattaataactgtcaacccgattgtaaccgaaaaggactctcccgtcaatatagaggctgaaccaccattcggagactcatatattattgtgggcgtggagcccgggcagttaaaattgtcatggttcaagaaggggagctcaataggtcaaatgtttgaaacaacaatgaggggggctaagcgtatggcaattttaggtgatactgcgtgggactttggttcattgggtggagtttttacgtcaattgggaaagcgctgcatcaagtgtttggcgctatatacggtgccgcatttagtggtgtttcttggactatgaaaatattaattggtgtcgtaataacttggataggaatgaattcaaggagcacttcattgagcgtaagtctcgttcttgtaggtatagttacactgtatttgggagtaatggtccaggcagactcaggttgtgtcgtgtcatggaaaaataaagaactaaagtgcggctcaggtatattcatcacagataatgtgcatacgtggacagaacaatacaaatttcaaccagaatctcctagtaaattagcttccgctatccaaaaagcacatgaagaaggtatatgcggtatacgttcagtaactagattagaaaatttgatgtggaaacaaattactccggagttaaatcatatcttgagtgagaacgaggttaaactaacgataatgacaggagatataaaggggatcatgcaagcaggtaaacggagtctaaggccacagccaacagaactaaaatattcttggaagacatgggggaaggcgaagatgctttccactgagccacataaccaaaccttcctgattgacggaccagaaaccgcagaatgtccaaataccaatagagcgtggaattcgctagaagtagaggattacgggtttggtgtctttaccaccaacatatggctcaaattaaaagaaagacaagacgtattctgtgattctaaattaatgagcgccgcaataaaggataatagggccgtacatgcagatatgggatattggattgaaagcgcactcaatgatacatggaaaattgagaaagcctcgttcatcgaggtcaagagctgccattggcccaaatcccatacattatggtcaaacggtgtcctggaatcagaaatgataattcctaaaaattttgcaggacctgtatcacaacacaattataggcctggctatcacactcaaacagctggtccctggcatttagggaaactggaaatggatttcgatttttgtgaaggaacaactgtcgtagtcactgaagactgcggcaataggggaccctccttgagaactactacagcgtccggaaagttgatcacagaatggtgttgtcgttcctgtactctaccccctcttagatatagaggagaggacggatgttggtatggcatggaaatacgaccactaaaagaaaaggaggagaatttagtaaattcattggttacggcagggcatgggcaaatagataattttagtctaggagtactaggaatggcactattcctagaagaaatgttaagaactagagtcggtacaaaacacgctgttttactcgtagcagtgtcttttatgaccttgataactggaaacatgtcatttagggatctagggagagtaatggtaatggtcggagctgcaatgaccgatgacatcggaatgggagtaacctatttagcattactcgccgctttcaaagttagaccaacgttcgcagcaggcttattacttagaaaacttacatctaaggaattaatgatgacgacaattggaatcgtattattgtcgcagtctacgatcccggaaaccatcctagagcttacagatgcacttgcactcggtatgatgatcttaaaaattgtaagaaacatggaaaagtatcagcttgcggtaactataatggccatcttatgcgtacccaatgccgttatcctacagaatgcgtggaaagtctcgtgcactatacttgctgtagtttcagtaagcccattacttttaacatcctcgcagcagaaagctgattggatcccattagcgctgaccataaaaggattaaacccaacagcaatttttttgaccaccctcagtcgaacaaacaaaaaaagatcctggccacttaacgaagcaataatggcagtagggatggtttcgatactagcatcaagtcttctgaagaacgacataccaatgacaggaccattggttgcaggagggttgctaaccgtatgctatgtattaacaggtagaagtgctgatcttgaattggaaagggctgctgatgttagatgggaggatcaggctgagatttcgggttcgagtcctattctgtccatcacaatatcggaagacggctccatgagcatcaaaaacgaggaggaagagcagactttaactatattaataagaacgggattgctggtaatttcaggcctatttccggtctctataccaataacagcagctgcttggtatctatgggaagttaagaagcaacgggcgggcgtgctctgggatgtaccatccccccctcctgtgggtaaagcagaactggaagacggagcgtacagaataaaacaaaaaggtatattggggtactcacaaataggagcaggagtttataaagaaggaacttttcatactatgtggcatgtaacacgtggggctgtattaatgcacaaaggcaaacgaatagagccctcgtgggctgacgtaaggaaagatttgatttcttatggtggtggctggaagctcgagggagaatggaaggagggcgaggaggtccaggtactagctttggagccagggaaaaatcccagagcagtccagacgaaacctggcctattcaaaactaatacgggaacaataggagctgtaagtttagatttctcgccaggaacctctggatcgccaatagtggataaaaaaggaaaagtggtgggtctatatggaaacggagtcgtaacccgttccggtacgtatgtctcagccatcgcccaaactgaaaaatctatagaggacaaccccgaaatagaagatgacatatttcgcaaaaaacgacttacaataatggatctgcacccgggcgcgggaaaaaccaaacgttacttaccagcaattgtaagagaggccattaaaagaggacttagaactctaattctagctcctactagagttgtagcagcagaaatggaagaagcgttacggggtcttcctatacgatatcaaaccccagcaatacgggccgagcataccggtagagagattgtagatctaatgtgtcatgcgacatttacaatgaggttacttagccctgttcgtgtaccaaattataatctcataataatggacgaagcgcactttacagatcccgctagtatagctgctcggggatatatatcgacgagagtagagatgggagaagcggcaggtatatttatgactgccacaccaccggggtctagagacccgtttccccaaagtaacgcgccaataatggatgaggagcgagaaatacccgaaagatcctggaattcagggcacgagtgggttacagactttaaggggaaaactgtttggtttgtccccagcatcaaggcggggaatgacatagctgcctgtcttaggaaaaacggtaaaaaagttatccaattatcgagaaagacatttgatagtgaatatattaagacaagaactaacgactgggattttgttgtaacaacagatattagcgaaatgggtgccaattttaaagctgagagagtaatcgaccctaggaggtgtatgaaacctgtaattctcacagatggagaagaacgtgtaatcctagctggtccaatgccggttacacattcttcagctgctcagcgtagaggaagaattggtcgaaatccaaaaaatgaaaatgatcaatatatatatatgggagaaccattggaaaacgacgaagattgtgctcactggaaagaagcaaaaatgcttctagacaacataaatacaccagaaggaataatcccatctatgtttgagcccgaaagagaaaaagtagatgctattgacggggaatatagattaaggggtgaggcaagaaaaaccttcgtagatttgatgcgcaggggagatttacctgtctggctagcatacagggtagcagcagaagggataaattacgcggataggcgatggtgttttgacggaatcaaaaataatcaaattttagaagaaaacgtggaagttgaaatctggacgaaggaaggtgaaagaaaaaaacttaaaccgcgatggttagatgccagaatttactcagatccgttagcccttaaagaattcaaagagtttgcggccggacgtaaatcattaacactaaatctgattacagaaatgggaagattacctacatttatgacacaaaaagctcgcaacgcactagataatttagctgtgttacacaccgcagaggcgggtggacgcgcatataaccatgcactttcggaattaccagagacactagagacactcctacttctaacacttttagccacagtgacaggaggaattttcttattcctaatgagtgggaagggcattggaaagatgaccttggggatgtgctgcattataactgctagcatacttctatggtacgcgcaaatacaaccacattggatcgcagcaagcataattcttgaattctttttaatagtgttactaatacctgagcctgaaaaacaacgcacgcctcaagacaaccaattaacctatgtcgtgattgcaatacttacagtagttgcagctactatggcgaacgaaatggggtttttagagaagactaaaaaagattttggactcggaagcatagctacgcaacaactcgaaagtaatatactagacattgatttacgtccagcaagtgcatggacactttacgcagtagcgactacatttataacgccaatgttacgacacagtatagaaaactccagtgtaaatgtgtcactcacagccatagctaatcaggcaactgtattaatggggctaggaaaaggttggcccctaagcaaaatggacataggcgttccattactagccattggttgctactcacaagttaacccaataacgttaactgctgccttgctgctacttgtagcccattatgctataataggccccgggttacaggcgaaagctacccgagaagcacaaaaaagggctgcagcaggtatcatgaaaaatccaactgtagatgggataaccgtaatcgatttagaccccataccttatgatcccaaattcgagaaacaactagggcaagtaatgttactggtattatgcgtaacgcaagtactaatgatgcgtacaacgtgggctttatgtgaggcgttgacacttgcgacaggacctataagcaccctttgggaaggcaaccccggtcgattttggaatactacgatcgctgtgtcgatggccaatatattccgaggcagttacctcgcaggagcaggcttacttttctccattatgaaaaacactactaacacaagacgtggtacagggaacacaggtgagactctaggggaaaaatggaaaaatcgcctgaattctctagggaaaagtgaattccagatttataagagaagtggaattcaagaagtagatagaacactcgctaaagaagggattaagcgaggtgaaacagatcatcacgcggtaagtaggggaagcgccaaactaagatggtttgtcgaacggaatctagtgacacccgagggtaaagtagttgaccttggttgtgggcgaggaggatggtcttactactgtggaggccttaaaaatgtaagagaagtaaaaggtcttacaaaaggagggcctggtcatgaagaacctatcccgatgagtacgtatggatggaatttagtaagactccaatccggcgttgacgtattttttactcccccagagaaatgcgacactttattgtgcgatattggtgagagttccccaaacccaacggtcgaagctgggagaaccctacgagtattaaatttggttgaaaattggttgaataatgacacccagttctgtatcaaagtactaaatccgtatatgccttcagtaatagaaaaaatggaagcgttacagaggaaatatggtggtgcactagtaagaaatccactaagtaggaattcaacacatgaaatgtattgggtatcaaacgctagcggcaatatagtaagttccgtcaatatgattagtcgtatgttaattaacagatttacaatgaggcacaaaaaagcaacatatgaaccagacgtggatctaggatcgggaactcgtaatataggtatagaaagtgaaacaccaaacctagatataattggcaaaagaatagaaaaaattaaacaagaacacgagacaagttggcactacgaccaggaccatccatataaaacttgggcttaccatggttcatacgaaaccaaacagacgggctctgcgagctcaatggtgaacggagtagtacgactactcacaaaaccgtgggatgtaatacccatggtgacacagatggctatgacagatacaacaccctttggccagcagagagtattcaaagaaaaggtcgacacacggacgcaagaacctaaagaaggaaccaagaaactaatgaagataaccgccgaatggttatggaaagagttaggcaaaaaaaagactcctcgaatgtgtacaagggaagagtttactagaaaagtaaggtcgaacgcagcattaggagcaatctttaccgatgagaataagtggaaaagtgccagggaagctgtagaggattctcgattttgggaacttgtgaacaaagaacgaaatctacaccttgaagggaaatgcgagacttgtgtatataatatgatgggtaagagagaaaaaaagataggtgaatttgggaaagctaaaggttcaagggcaatatggtacatgtggttaggtgcaagattcttagaattcgaggcattaggatttttaaatgaagaccattggtttagtcgagaaaatagtcttagcggagtagaaggagaaggccttcacaaattagggtatatattgagggaggtgtcaaaaaaagaaggtggtgctatgtacgctgatgataccgcagggtgggataccaggattactcttgaggatttaaaaaatgaagaaatggtcactaaccatatggaaggcgaacataagaagttagcagaagctatatttaaacttacttatcagaataaagtagtcagagttcaacgtccaactccgagggggaccgtgatggatataataagcagacgcgatcaaagaggttctggtcaggtcgggacctacggtctaaacacttttacaaatatgggagcacaactaattcgccaaatggagggcgagggagtattcaaaggaatccaacatctaacagcaactgaagaaacggccgtacatgattggttggcaagggtaggacgtgaaagattatcgagaatggcaatatcaggggatgactgcgttgtaaaaccgttggatgataggtttgccagcgcacttactgccctgaatgacatgggaaaagttcggaaagacatacaacaatgggaaccgtcaagaggctggaatgactggacacaagtaccgttttgtagccatcacttccacgaattaataatgaaagatggacgggttctggtagttccatgcagaaaccaggatgaattaataggcagggcacgaatatcacaaggagccggatggagtctgagagaaacagcgtgtcttggaaaatcctatgctcaaatgtggtcccttatgtatttccatcgtagagatttgcgactagcggctaatgccatttgttcagcggtaccttctcattgggtccccacttcaagaaccacatggtccatccacgcaaggcatgagtggatgaccacggaagacatgctgactgtgtggaatcgcgtatggatacaagaaaatccgtggatggaagacaaaactcctgtagagagttgggaagaaatcccctatctagggaagagagaagatcaatggtgcggaagcttaatcggcctcacttcaagagcaacttgggcgaagaatattcagacagccattaaccaggtacgctcactcataggttcagaggaatatacagactacatgccaagtatgaaaagattcagacgggaggaagaagaagcaggtgtattatggtga

SEQ ID NO: 22870 - RNA, 9876 nt, synthetic construct
  misc_feature 1..9876: note = derived and/or modified CDS sequence (opt6) from DENV-2__KR779782__SS-prME
  source 1..9876: mol_type = other RNA
accgcaggtatcataataatgatgattccaaccgtaatggcatttcatctaacgactcggaatggagaacctcacatgatagtgtcaagacaggaaaaaggaaaatccttattattcaaaaccgaaaatggggtaaatatgtgcacgctcatggcgatggacttgggtgaactgtgcgaagacactattacttataactgtcctcttttacgtcaaaacgaacctgaagacattgactgttggtgcaacagtacttccacgtgggtaacatacggaacatgtacggcaactggagaacatagaagagaaaaacgttcagttgcgctagtgccacacgtcggtatggggttagaaacacgcacagaaacctggatgtcctccgagggtgcatggaaacatgcacaaagaattgagacctggatattaagacacccaggatttacaataatggctgctatactagcatacacgataggaacaacctactttcagagagtacttatatttattcttcttacggccgtcacaccatccatggctatgagatgcatcgggatttcaaatagagatttcgttgaaggtgtatctggaggcagttgggttgatatagtattggagcatggcagctgcgtgaccactatggccaaaaacaaacctacactagacttcgaattaatcaaaactgaagcaaaacacccagccacattgagaaaatattgcgtggaagctaaactaactaatactacgacagccagccgatgtccaacacaaggagaaccctcattgaacgaagaacaagataaaaggtttgtctgcaaacactccatggttgacagagggtggggaaacggatgcggcctattcggaaaagggggaatagttacatgtgctatgttcacatgcaagaaaaatatggaaggtaaagtggtacaaccggagaatttagagtatacaatagtaataacaccgcattccggtgaggaaaatgcagttgggaatgatacaggaaaacatggcaaagagattaaagtcactccacaaagttcaatcactgaggccgaattaacagggtatggtactgtaactatggagtgttctccgagaaccggactagattttaatgaaatggtccttctacaaatggaaaacaaagcatggttagtgcaccgacaatggtttttagatttgcctctcccatggttgccgggtgcggacacgcaggggagtaactggattcaaaaagaaacacttgtaacgtttaaaaacccacatgccaagaaacaagatgtggtggtactcggtagccaagagggagctatgcacactgcattaactggtgccacagaaatacaaatgtcatctggaaatctgctgttcactggacacctgaaatgtagactcaggatggacaaactacaactaaaaggaatgagctatagcatgtgcaccgggaaatttaaagtagttaaagagatagcagaaactcaacatggtacaatagtgataagagtacaatatgaaggagatggctccccttgcaaaatcccatttgaaataatggatctagaaaaacgacatgtattgggtagactaataactgtcaatcctatagttactgaaaaggatagtcccgttaacatagaggccgaacctcctttcggagatagttatataataataggtgtagaacctgggcagttaaaactctcttggttcaagaaaggaagtagcataggccaaatgttcgagaccaccatgagaggcgcaaagaggatggcaatattgggggatacagcatgggattttggaagtctagggggagtattcacaagtattggtaaagcactacatcaagtatttggcgcaatatatggtgctgcattttctggtgtaagttggacgatgaagatattgataggagtggtaataacatggataggtatgaactcacggtcaaccagcttgtcagttagtctggtattggtcggtgttgttaccttgtatttaggagtcatggttcaggctgacagtggatgcgtcgtgtcctggaaaaacaaagaattaaaatgtggctctggaatattcataaccgataatgtccatacgtggactgaacaatataagtttcaacctgaatctccaagtaagttagccagtgcaatacaaaaggctcacgaacaaggcatttgcggaataagatccgtcactaggctcgaaaacttaatgtggaaacaaataacgccagaattaaaccacatattgacggaaaatgaagtaaaactaacgataatgaccggtgacataaaaggcatcatgcaagcaggtaaacgctccttacgaccacaacctaccgaactaaaatactcatggaaggcgtggggcaaggctaaaatgttgtctacagaactccacaaccatacattcttgatcgatggacctgaaacagcagaatgccccaacaccaatagagcatggaatagcttagaggttgaggattacggattcggtgttttcacgactaatatctggttaaaattgaaagaaagacaggatgtattctgcgactctaaactaatgtcagcagccattaaagacaatagagcagtgcatgcagacatgggttattggatagaatctgcactaaatgacacatggaaaatagaaaaagcaagtttcattgaagtaaagtcatgccattggcctaaatcgcatacattatggagcaacggggtcttagaaagtgaaatgattattcccaaaaattttgccggtccggtctcacagcataactaccggccagggtaccatactcagacagccggaccttggcacttaggtcgcttagaaatggactttgatttttgcgaaggaacaacagtggtagtaacagaggattgtggaaatagagggccgagtctgcgtactacgacggcatcaggaaaattaataacagagtggtgttgtcggagttgcacgctcccaccactccgataccgtggcgaagatgggtgttggtatggtatggaaattagacctctaaaagaaaaagaagagaatttagtgaacagcttagtaactgcaggacatggtcaaatcgataacttcagcttaggggttctcggaatggccctatttttagaggaaatgctaagaacgcgggtgggtacgaagcatgctattctattagtagcagtttctttcgtgactttaataacaggtaatatgtcattccgtgatttaggcagggtcatggtaatggtaggagcgacaatgactgatgatataggtatgggcgttacctatctagcactacttgcagcctttaaggttagaccgacttttgctgctggactacttttgaggaaattaacgagtaaagaactcatgatgacgacaattggtatagtactcctatcgcaatcaacaataccagaaagtattttggagctgaccgatgcattagcccttggaatgatggtactaaaaattgtaagaaatatggaaaaatatcaattggcggttacaataatggcaatcttatgtgtccctaacgcagtaatactacaaaacgcatggaaagtgtcgtgcacaacattggcagtagtctctgtctctcctttacttctcacaagttcacaacagaaagcagattggataccgttagctttaacaattaaaggtctgaatcccacggcgatctttttgactactttatcgagaacatccaagaaacgtagctggccactaaatgaggcaattatggcagtaggaatggtttcaatactagcgagttctctgctcaaaaacgacataccaatgacaggacccctagtagcgggtggcttattaacagtttgctatgtgctaactggaagaagtgcagacttagaattagagcgcgcagctgatgttagatgggaggagcaagcagaaatttcaggctcaagtccaatcttatctattactatttcagaagatggctcaatgtcaattaaaaacgaagaagaagaacaaacactaacaatactcattaggacaggtcttctcgtaatttccggtctatttcccgtatcaatacctattacggccgccgcctggtacttatgggaggttaagaaacaacgagcaggagtattatgggatgttccaagcccacctccagtggggaaggcagaacttgaggatggagcatacagaataaaacaaaaaggcattctcggctatagccaaatcggtgcaggagtatacaaagaagggacattccacacaatgtggcacgttacccgcggggcagtattgatgcataagggcaagcgaattgagccttcatgggctgatgttaagaaagatctcataagctatgggggtggatggaaactagaaggtgaatggaaagaaggagaggaagtacaagttttagcgcttgagccaggcaaaaatccaagagctgttcaaaccaagccaggtctattcaagactaatactggcacaataggagcggtatctctagatttctcacctggaacaagcgggagccctattgtagataagaaagggaaagtagttggactatacggaaatggagtcgtgacacgttcaggcacttatgtgtcagccatagctcaaacagaaaaatctatagaagataatccagaaatcgaagatgacatctttaggaagaaaagactaacaattatggaccttcatcccggtgccggtaaaacgaaaagatatctgccggcgatagtccgagaggcaattaaacgcggtcttagaacccttattctcgcaccaacacgagtggtcgcggcagagatggaagaggctttacgaggacttcccataagatatcaaactcctgcaatacgagccgaacacacgggtagagagattgtagatctgatgtgccatgcaacctttacaatgcgactattatcaccaatcagagtaccgaactataaccttatcataatggatgaggcacactttacggacccagcatccattgcagcacgaggttatatcagtacaagggtagaaatgggtgaagcagcaggaatttttatgaccgctacgccacctgggagtagggatccttttccgcagtctaacgcaccaataatggatgaagagagggaaattccagaacgatcttggaactcgggacacgaatgggtaacagattttaaaggtaaaacagtatggtttgtcccctcaatcaaagccggaaatgacatcgcagcctgcttaagaaagaacggaaagaaagtaattcaactaagtaggaaaacattcgatagtgaatacataaaaactaggacgaacgattgggacttcgtagtaactacggacatatcggaaatgggcgcgaactttaaagccgaacgtgtaatagatccgcgcagatgtatgaagccggtaatccttacagatggagaggagagggtaatactagcaggaccaatgccggttactcactctagcgctgcacaaagacgaggcagagtcggccgaaatccgaaaaatgaaaacgatcaatacatatatatgggcgagccattagaaaatgacgaggattgtgcacattggaaagaagcaaagatgctactggacaatatcaacactccagaaggaatcatcccatcaatgtttgagccagagagggaaaaagtagacgcaatagatggggaatatagattacggggtgaggcaaggaaaacgttcgttgatctaatgagaagaggcgatcttcctgtatggttagcctatcgggtagcagctgaagggataaactatgcagacaggcgatggtgcttcgatggagtcaaaaataatcaaatattagaggagaacgtagaagtggaaatctggactaaagaaggagaaagaaagaaattaaaaccgcggtggctagacgcaaggatctattcagatccactagccttaaaggaatttaaagaatttgcggcaggacgcaaatcactcacgctcaatttaatcacagaaatggggagattaccaacttttatgacacagaaagctaagaacgcactagacaacctagccgtattacacacggcagaagctggaggtagagcatataaccacgcgctttctgaattaccagagactttagaaacgcttctactacttactttactcgcaacagtaacaggaggcatatttctattcttaatgagtggaaaagggataggaaaaatgacattggggatgtgttgtatcataacagccagcatcctgttgtggtatgcacaaattcaacctcactggattgcagcctctatcatcttggagttctttttaatagttttattaatacccgaaccagagaagcaaagaacaccacaagataatcaattgacttatgtagtgatcgcaatacttactgttgtggcggcgactatggcaaacgaaatgggattcttggagaaaacgaaaaaggatttcggtttaggcagcataacgacacagcaaccagagtccaacattctcgacatagacctgagaccagcatctgcgtggacactctatgcagtagcaactacgttcataaccccaatgctacgtcacagtatagaaaactcgtcagtgaacgttagcttaacagcgattgccaatcaagctactgttctaatgggtcttggcaaaggatggcccctttcaaagatggatataggcgtaccattactagcaataggctgctactcccaggtaaatccaattacgcttaccgccgcattgttactcctggtagcgcactatgcaataataggacccggactacaggcaaaagcgacaagagaagcacagaaaagggcggcagctggaataatgaagaacccgactgtcgatggaatgacagtaatagatttagatccaataccgtacgatcctaaattcgaaaagcaattgggtcaggtaatgttgctagtactatgcgtaacccaagtactaatgatgagaacaacatgggcactctgcgaagcacttacattggcaacaggtccaatttccacactttgggaggggaatcctggaagattttggaacactaccatcgccgtgagcatggctaacatatttagaggtagctacttagccggcgccggtttgttattctcaattatgaagaatacagcaaacacacgtagaggcactggtaatacaggcgaaactttgggcgaaaaatggaaaaaccgactgaatgcacttggcaagtccgaatttcagatatataagaaatccggcatccaggaagtagatcgaacacttgccaaagaaggtataaaaaggggtgaaacggaccaccacgcagtttcaagaggtagcgcaaaattacgctggttcgtggaacgaaatctagtgacgccggaaggaaaagtagttgatttaggttgtggcagagggggttggagctactactgtggcggcctcaaaaacgtgaaagaggttaaaggccttacaaaaggtggtcctggacatgaagaaccgataccaatgagtacctatggatggaacttagtcagactacaaagcggcgtagatgttttctttacaccaccagagaaatgcgatacactcctctgcgacataggtgaatccagcccaaaccccactgtcgaagctggtcgtacattgagagtcctgaatttagttgaaaattggttgaataataacactcagttttgcattaaagttttgaatccctatatgccatcggtgatcgagaaaatggaagcgttacagagaaaatatgggggtgccctagtgcgcaatcctctatcacgaaattctacgcacgaaatgtactgggtatcgaacgcgagtggtaatatagtaagttcagtaaatatgattagtcgaatgttgattaatcgatttacaatgaggcacaagaaagcgacctacgaacctgatgtagacctagggagtggaaccagaaatatagggatagaatctgagaccccaaatttagatattattggcaaaaggattgagaaaataaaacaagaacacgagactagctggcactacgaccaagatcacccatacaaaacgtgggcatatcacggatcctacgaaaccaagcaaaccggaagtgcttcatcaatggtaaatggagtcgtgaggcttttaacgaaaccatgggatgttattccaatggtaacccaaatggccatgaccgatacaacacctttcggacaacaacgagtattcaaagaaaaagtggataccaggactcaagaacctaaagagggtacaaagaaattgatgaaaatcactgctgaatggttgtggaaagagctgggcaaaaagaaaactccaagaatgtgtactagagaagaatttacacgtaaagttagaagcaatgcagcattaggggcaatatttaccgacgagaataaatggaaatctgctcgtgaagcagtggaagattccggattctgggaactcgtcgacaaggaaagaaatctacatctagaaggcaaatgcgagacttgcgtctataatatgatgggaaaacgagagaagaaacttggggagttcgggaaagccaaaggtagtcgagccatatggtatatgtggcttggagcaagatttttagaatttgaagcactgggatttctgaatgaagatcattggttttcgagagagaactcattatcaggcgttgagggggaaggactacacaaacttgggtacatccttagagacgtatctaagaaagaaggcggtgcaatgtacgctgacgacacggccggttgggacactcgtataactttagaagatcttaaaaacgaagaaatggtcacaaaccatatggagggggaacataagaaactagctgaagccatcttcaaattaacctatcaaaacaaggttgtccgtgtacagaggcccactccacgagggaccgtaatggatataatctcaagaagggaccagcggggttcaggccaagtagtaacttacggtttaaatacattcacaaatatggaggcacaattaattagacaaatggaaggcgaaggagtcttcaaatctatccaacaacttacagttaaagaagaaattgctgttaaaaattggctaatcagagtaggacgagaacgattatcacgaatggcgatatcgggcgacgattgcgtcgtgaaaccacttgatgacaggttcgcgtcggcactcacagctctaaatgatatgggtaaagtaagaaaagatatacaacagtgggaaccctcccgagggtggaacgattggacgcaagtgcccttttgttcccaccactttcatgagttgataatgaaagatggacgcgtactcgtagttccctgtcgcaaccaggatgaactgataggcagagctcgcataagccagggagccggatggagcttaagggaaaccgcatgcttaggtaaatcatatgctcaaatgtggagtctgatgtatttccaccgaagggatttgcgactagctgcaaatgcaatatgctccgctgttccatctcactgggtgcctaccagtcgaactacgtggagcatacacgcaacacacgaatggatgactacagaagacatgctcacagtgtggaacagagtgtggatacaagagaacccgtggatggaagataagactcctgttgagtcgtgggaagaaataccctaccttggaaaaagggaagaccagtggtgtggttcattgattggtctaacaagtagagcaacatgggcgaaaaatatacaaactgctataaatcaggtaagatctctgattggtaatgaggaatacacagattacatgccatcaatgaagagatttagacgagaagaagaggaggcaggggtgctatggtaa

SEQ ID NO: 22871 - RNA, 9876 nt, synthetic construct
  misc_feature 1..9876: note = derived and/or modified CDS sequence (opt6) from DENV-2__KM279608__SS-prME
  source 1..9876: mol_type = other RNA
acagctggtatcattattatgatgataccgacagttatggcattccacttgactacaaggaatggagaaccacacatgatagtaagtcgacaagagaaaggaaaatcattactttttaaaacagaaaatggagtaaatatgtgtacattaatggcgatggatctaggtgaattatgcgaggatacaataacatacaactgtccattgttaagacaaaatgagccagaagatattgattgttggtgtaattcgactagtacatgggtaacctatggcacgtgcacagtgacaggagagcaccgtcgcgaaaaacgcagtgtagcgttggtacctcatgtaggaatgggtcttgagacgagaacagaaacatggatgagttctgagggggcatggaaacatgctcaacgaattgaaacttggatattgcgtcatccagggttcacgataatggctgccatccttgcgtatacaatagggaccacatatctgcagcgagttcttatctttatactcttaacagcagtaacgcccagcatggcaatgcgatgtataggcattagtaatcgggattttgtcgagggtgtcagcggtggttcatgggtagatatagttttggaacacggttcctgtgtaaccacaatggcgaaaaacaagccaacattggactttgaactcattaaaacagaagcaaaacacccagctacattaagaaagtattgtgtagaagcgaaacttacaaataccactacagcgagcagatgtccaactcaaggagaaccatctctaaacgaagagcaggataaaagattcgtatgtaaacattcaatggtagatagaggttggggaaatggatgcggtcttttcggaaaaggcggcatagttacttgtgcaatgttcacatgtaaaaaaaatatggaggggaaagtggtacaaccagagaatttagaatatacaatcgtaataacaccgcattcaggagaagaaaatgcagtaggtaacgataccggtaaacacggaaaagaaattaaggttacgccccaaagcagcataacggaagctgaattaacagggtacggaacagtaaccatggaatgctcgccaaggacagggctcgacttcaatgaaatggtacttttacaaatggaaaataaggcctggttagtgcaccgtcagtggtttctggatctaccattgccgtggcttccaggagcagatacacagggatccaattggatccaaaaggagaccctcgtcactttcaaaaatccacatgcaaaaaagcaggatgttgttgtactggggtcgcaagagggggccatgcacacagccttgaccggagcaactgagatccaaatgagtagcggaaatttattattcaccggtcatctaaagtgccggctacggatggacaaattacagcttaaaggaatgagttattctatgtgcacaggcaaattcaaagtagtcaaagaaattgcagagacacaacatggaaccattgtaatacgggtacaatatgaaggggacggctcaccatgtaaaatcccctttgaaattatggacttagaaaaaagacatgtgctcggccgattgataacggtcaacccaattgtgacagaaaaagataacccagtgaatatagaggcagaaccgccattcggagattcctatataataataggagttgaacccggacaactaaaactttcgtggtacaaaaaagggtcatcgataggacaaatgttcgagacaacaatgagaggagcaaaaagaatggcaatacttggagatacggcgtgggactttggaagtctggggggggtatttactagcataggtaaagcgctacatcaggtatttggtgctatttacggggcggccttttcgggagtctcctggacaatgaaaatactaatcggagttgtgataacatggataggaatgaactccagaagtacttcattatcagtaagcctagtactcgttggagttgttactctatatttgggggtgatggtacaggcggacagtggttgcgttgttagctggcgaaacaaagaactaaaatgtggttctgggatctttattacagataatgtgcacacatggactgagcagtacaaattccaaccagaatctcctagcaagctggcatcagcaattcaaaaggcgcacgaagagggcatctgcggtataagatcagtgacacgactagaaaacctgatgtggaaacaaataacgccagagctaaatcacatcttaacagaaaacgaagttaaattgactataatgacaggggatattaaaggtatcatgcaggcgggtaaacgaagccttcgcccgcagccaaccgaactgaaatacagttggaaagcttggggaaaggcaaaaatgttgtcaacagaacttcataatcatacctttctcattgatggcccagaaacggcagagtgtcctaacactaatcgagcatggaattccctagaagtagaggactacggttttggtgtgttcacaacgaacatatggctcaaactaaaggaacgacaagatgttttttgcgatagtaagttaatgtctgcagcaattaaagataatcgggcagtacatgccgacatgggatattggattgaatcggcattaaacgacacatggaaaatcgaaaaagcaagctttatagaagtaaaatcgtgccactggcctaaatcacacactctttggagcaatggagtactggaatctgaaatgataattccaaaaaattttgccggtcctgtctcccagcataattaccgtcctgggtaccatacccaaactgccggaccttggcatttaggtcgattggaaatggacttcgatttctgcgaagggacaaccgtagtagttactgaggactgcggtaatcggggtccaagcctaagaacgaccacagcgtctggaaaacttattacagaatggtgctgcagatcatgcacactgccgccgttaagatatcggggcgaggatggatgctggtacgggatggagattcgacctttgaaagagaaagaagagaatctagtaaattcactcgtaaccgccggacatggccaaatagataacttctcattgggtgtactcggtatggcattgtttctggaagagatgctacgcacgagagtcggaacaaaacatgcgatattgttggtggctgtatcattcgtgactttaataacgggtaatatgtcattcagagatttaggaagggtcatggttatggtaggtgctactatgacagacgacataggaatgggagtaacatatctcgccctacttgcagcattcaaggtccgtcctacatttgcagccggcttgcttcttcgaaaactaacgagtaaagaattaatgatgacaaccatcggtatagtattactgtcacaaagtacgataccagaatccattctcgagcttacagacgcactggcattggggatgatggtactcaaaatcgttagaaacatggaaaagtatcaattagcggtgactataatggctatattatgtgttccgaacgctgttatactcgaaaacgcttggaaagtctcctgtactacgctcgcagttgttagtgtaagtcctcttttactaacgtctagtcaacagaaagccgactggatcccgcttgcacttacaataaaaggcctgaatccaacagctatttttttaactactttgagtagaacctccaaaaaacggagttggccactaaatgaagcaattatggcagtaggcatggtgagcatactagcatcatctctactgaagaacgacataccgatgacaggtcctttagtcgctggaggactactaacggtctgctatgtcttaacaggtcgtagtgcagaccttgaacttgaaagggcagccgacgtacggtgggaagaacaagccgaaatatctggttcaagcccgatattgagtataacaatttcagaagatgggtcaatgagtataaaaaatgaagaagaagaacagacattgactatactaatacgaacgggactcctcgtgatcagcggtttatttccagtaagtatcccaataacggctgccgcctggtacttatgggaagtcaaaaaacagagagcgggagtcttgtgggatgtaccctccccgccgccggtcggaaaggccgagctcgaagacggggcataccgaataaaacaaaaagggatattaggttatagccaaataggagcgggagtgtacaaggagggcacgtttcatacgatgtggcatgttacgagaggagctgttttaatgcataaaggaaagagaatagaaccttcttgggctgatgtaaaaaaagacctcataagctacggcggcggctggaaactcgaaggagaatggaaagaaggtgaagaagtacaagtactagctttggagccgggtaaaaatcctcgggcggtccaaacgaaaccaggtctttttaaaacaaatacaggcaccattggagcagtctctctagatttttctcctggaacttccggaagtcctatagtggataaaaaagggaaggtagttggtttatatggtaatggagtggtaactagatcagggacatacgtatctgcaatagctcaaacggaaaagtcaattgaggataacccggaaatcgaagatgatatattccgaaaaaaacgactaacaataatggatcttcatccaggtgctggaaagacgaaaagatatttacctgcaattgtacgagaagcgataaaacgtggactgaggacattaatactagcgccaacaagagttgttgcagcggaaatggaagaggcgttgcgtggactgcctataagatatcagaccccagccattcgggccgaacatacaggtagagaaattgtcgatttgatgtgccatgcaaccttcactatgagattattaagtcctattcgagtcccaaactacaatcttataataatggacgaggctcacttcacagatccagcctccatcgccgcacgaggttacattagcactagggtagaaatgggagaagcagcaggaatttttatgacagccacaccacctggatcacgggaccctttcccccaatcaaacgcgcccatcatggatgaggaacgagaaataccagaacgcagttggaattctggccatgagtgggtaacggatttcaaaggaaaaaccgtctggttcgtcccaagtataaaagcgggtaatgacatcgcagcatgcttacggaaaaacggtaaaaaagtaatacaattgtcacgtaaaacgtttgactccgagtatattaaaactcgaactaacgactgggattttgtagtaacaacagacatatctgaaatgggagccaattttaaagcagaaagagtgatagacccaagacgctgtatgaaacccgttattctgaccgacggagaagaaagagtgatcttagcaggcccaatgccagtaactcatagctctgctgcccagcgcagaggacgtgtcggcagaaacccgaagaacgaaaatgatcaatacatctacatgggagaacctctcgagaacgacgaagattgcgcacactggaaagaagcaaaaatgctcttggataacattaatacacctgaaggaattattccaagtatgtttgaacccgaacgagaaaaagtagatgctattgatggggaatataggttaaggggtgaggccagaaagacgttcgtagatctcatgcgtagaggagacctcccagtgtggttggcttataaagtagctgcggaaggcataaattacgctgaccgccggtggtgctttgatggtgtgaaaaataaccaaattttagaagaaaatgttgaagtcgaaatatggaccaaagaaggagagcgaaaaaaattaaagcctagatggttagatgcgcgcatttatagcgacccattagcgctcaaggagttcaaggaatttgcagcaggaagaaaatcattaactctcaatctcatcacagaaatgggcagattaccaacattcatgactcagaaggctaagaatgcactagataatctagcagtactccatacagcagaagcaggaggtagagcatataatcatgcacttagtgaacttccagaaacactcgaaaccctcttattactaacattattagccacagtaactggtggaatatttctatttcttatgagcgggaaagggattggaaagatgactctaggtatgtgttgcataataactgcctctatattactatggtacgcacagatacagccccattggatcgctgcatcaattatcttggaattctttctaattgtgctacttattccagaaccagagaagcagagaacaccccaagacaatcaattaacatacgtggttatagccatattaactgtagtggctgcaactatggcaaacgagatgggatttctcgaaaaaacaaaaaaagattttggtctgggttccataacaactcagcaaccagaatcaaatatcttggatatagacctgagacctgcatctgcatggaccttatacgctgtagcaacgacgtttataaccccaatgttgagacactctatagaaaatagttccgtaaatgtttcattaacggcaattgccaaccaagcaacagtcttgatgggcttaggaaagggctggcccctctctaagatggacattggagttccgttacttgcaataggttgctacagtcaagtaaatccaattacattaacagccgcattacttttgttggttgctcattacgcaataatcggtcctggtttacaagctaaagctacaagggaggcgcagaagagggctgcagctggtatcatgaaaaatccaacagtggacggtataacagtcattgatctggatccaataccatatgatcctaaatttgagaaacaacttggtcaagtaatgttattagtgttatgtgtgactcaagtattaatgatgaggacaacatgggcactctgtgaggctcttactctagcgacaggccccatttccactttgtgggaaggaaaccctggccgtttttggaatactactatcgcagtaagtatggccaacatatttagaggttcgtatttagcaggtgcagggttactatttagcataatgaaaaatacggccaacacgagaaggggcactggtaacacgggcgaaactttaggcgaaaaatggaaaaatcgactgaatgctttgggaaaatccgagtttcagatctataagaagtcaggaattcaggaggttgataggactctggcaaaagaaggaattaagagaggcgaaacagaccaccatgccgttagtagggggtcagccaagcttagatggtttgtagaacgaaacctggttactccggaaggtaaggttgtggatttaggatgtggtagaggaggatggtcttattattgtggaggactgaagaatgtcaaagaagtcaaaggtttaacgaagggaggacccggacatgaagaaccaataccaatgtctacatatggatggaatcttgttagacttcaatcgggcgtagatgtatttttcactccaccagagaagtgtgacacattattatgtgatatcggggaatccagtccgaacccaacagttgaggccgggcggactttaagagtcttaaatctagtagaaaactggcttaataacaacacgcagttctgtataaaagttctgaatccttacatgccaagcgttatcgaaaaaatggaagctttgcaaagaaaatatggaggtgcacttgtgagaaatccattgagccgtaactctacccatgaaatgtattgggtatctaacgcttcaggaaacatagtatctagtgttaatatgatatcaagaatgctaattaaccgttttacaatgcgccacaaaaaagctacttacgaacctgatgttgatctgggaagtggtacacgaaatataggtatcgaatcagagacaccaaatttagacatcatagggaagagaatcaaaaaaataaagcaagaacatgaaacatcatggcattacgaccaagatcatccctacaagacgtgggcatatcatggatcatatgaaacaaaacaaacaggatcggcatcttcgatggtaaatggcgtagttcgtcttcttacaaaaccctgggatgtaataccaatggttactcaaatggctatgacagatacgacgccctttggtcaacaacgcgtatttaaagaaaaagtagatacacgaacacaagaacctaaggagggcacgaaaaaattaatgaaaataacagctgaatggctttggaaagaactaggaaaaaagaagacgcctagaatgtgcacacgagaagaatttacccggaaggttcgttctaatgcggctttgggagcaatatttacagatgaaaacaaatggaaaagcgcacgcgaagccgtggaggatagcggtttttgggaattagtggataaggagagaaatttacatttagaaggaaagtgtgaaacctgcgtgtacaatatgatgggaaaaagagagaaaaaattaggtgaatttggtaaagccaaagggtctagggcaatctggtatatgtggctcggtgcaagattcctagagtttgaagcattaggctttttaaacgaagaccattggttctcgagagaaaacagcttaagtggggtggaaggggagggactccataagctagggtatatcctcagggacgtaagcaaaaaggagggaggagcaatgtacgctgacgacactgcaggatgggacacacgtataacattagaagacttaaaaaatgaagaaatggtaactaaccatatggaaggcgaacacaaaaaattagccgaggcaatattcaaattaacataccaaaacaaagtagtgcgtgtacaaagacctacaccgcgcgggactgtaatggatatcatttctagacgcgaccaacgaggtagtggccaagtagtgacttacggattgaacacttttacgaatatggaggcacaactcatccgtcaaatggaaggtgagggggtatttaaatcaattcaacagctaacggtaaaggaagaaatagcagttaaaaattggctaatacgggtcggtagagaaagattatctcggatggcgatttccggagacgattgcgttgttaagcctttagatgatcgatttgctagcgcattaacagccctcaacgatatgggaaaagttcgcaaagatatacaacaatgggaaccatctcgaggatggaacgattggacccaagtgccattctgttcgcatcatttccatgaactaattatgaaagacgggagagtgctagtagttccatgtagaaaccaagacgaacttatagggagagctagaattagccagggcgccggatggagtttgcgggaaacagcttgcttaggaaaatcatatgctcaaatgtggtccttaatgtatttccatcgtagagacttgagactagcggctaatgcaatatgcagtgcagttccatcacattgggttcccacaagcagaaccacatggtccatacacgcaactcacgagtggatgacgactgaggacatgttaacagtttggaatcgtgtctggatacaggaaaacccttggatggaagataagacaccggtagagtcgtgggaagaaataccatatttgggaaaacgagaggatcaatggtgcgggagcctaataggtttaacatctagagcaacatgggcaaaaaatattcagacagcaataaatcaagtcaggtctctaataggtaatgaagaatatacggattacatgccatcaatgaagcgattcagaagggaagaggaagaggctggtgttctctggtaa

SEQ ID NO: 22872 - RNA, 9876 nt, synthetic construct
  misc_feature 1..9876: note = derived and/or modified CDS sequence (opt6) from DENV-2__KM279605__SS-prME
  source 1..9876: mol_type = other RNA
actgcagggattataataatgatgataccaacagtcatggcctttcacttaacgacccgaaatggtgaaccacatatgattgtctcaaggcaggaaaaaggcaaatctctcctattcaagaccgagaacggcgtcaacatgtgtactttgatggccatggacttaggagagttgtgtgaagatactattacatataactgtccgctattaagacaaaatgagccagaagatatagattgttggtgcaactctacaagtacatgggtaacatatggcacttgtacagctacgggagaacatcgaagggaaaaacgcagtgtagccttggttcctcatgtagggatgggcctggaaacaagaacagagacttggatgagtagtgagggagcctggaaacacgcccaaaggatagagacatggatactaagacacccgggtttcactattatggcagcaatattggcatacaccataggtacaacgtactttcaaagggtcttaatctttattctccttacagcggtaacaccttctatggccatgagatgcattgggatatcaaaccgcgatttcgttgaaggtgtaagtggtggatcgtgggtagatatagtactagaacacggtagctgtgtcacaaccatggcaaaaaataaacctacactagacttcgagctgattaaaaccgaggccaaacatccagcaacacttagaaaatactgtgtagaagctaagttaacaaatacaacaacagcatcaagatgtcctacacaaggtgaacccagcttgaatgaagagcaggataaacggtttgtttgcaaacattcaatggtggatagagggtggggaaacggctgtgggctattcgggaaaggaggaatagtaacctgtgcaatgttcacttgcaaaaaaaatatggaaggaaaagtagtccaaccggaaaacttagaatatacgattgtcatcacaccacactcaggcgaggagaacgctgttggaaacgataccggtaaacatggtaaagaaatcaaggtaacgccacagagttcaattacagaagcggaattaacggggtacggaacagtcacaatggaatgcagtcctcgcactggattagatttcaatgaaatggttctcctgcaaatggaaaataaagcatggctagtacaccgtcaatggttcctagacctccctctgccgtggttaccgggagctgacacgcaaggttctaactggattcaaaaagaaactcttgtaacatttaaaaatcctcatgcaaagaaacaagatgtcgtcgtgctaggtagtcaagaaggtgcaatgcatacagcactgacaggagccaccgagattcagatgtctagcgggaatctactctttacaggccatctaaagtgtcgactgcgcatggataaactccaattaaaaggcatgagctacagtatgtgtaccggcaagtttaaagttgtaaaagaaattgcagaaacacaacacggcacaattgtaataagagtccaatatgaaggagatgggtccccatgtaaaataccttttgaaattatggatttagagaaacgacatgtactggggaggttgataaccgtcaatccaatagtgacagagaaagataatcctgtcaatatagaagcggaaccaccgtttggtgatagttacattataataggagtcgaacccggacaacttaaattaagttggtttaaaaaaggcagttcaatagggcaaatgttcgaaaccaccatgcggggcgctaaacgtatggctatattgggtgataccgcatgggattttggctcactaggaggcgtatttacgtctataggaaaagccttgcatcaggtatttggtgcaatctacggcgctgcgtttagtggagtcagctggaccatgaagattctcataggagtagttataacatggattggaatgaacagtagatccacgtcattgagcgtgagcttagttctagtaggtgttgtgacactatatttaggggtaatggttcaagccgactccggatgtgttgtgagctggaagaacaaagagctaaagtgtggaagtggcatcttcattactgataacgtgcatacttggactgaacaatataaatttcagccagagagcccgtctaaattggcttcggcgatacaaaaagctcacgaagagggaatatgtggaatacggagcgtaacaaggcttgaaaacctcatgtggaaacaaatcaccccagaactaaatcatatcttaacggaaaatgaagtaaaattaacaataatgactggcgacataaaaggaattatgcaagctggtaaaagatccctaagacctcagcctactgagctaaagtacagttggaaggcgtggggtaaagcaaaaatgttaagtacagagctccataaccacacctttttaatagatggcccggagacagccgaatgccctaatactaatcgtgcatggaactccctagaagtagaagattacgggttcggtgttttcactacaaacatctggctaaagcttaaagaacgacaagacgtattttgtgactctaagctaatgtcagcagctattaaagataatagagccgttcatgctgatatgggctactggatagaaagtgctctaaatgacacatggaaaatagaaaaagcctcattcattgaagtgaagagttgccattggcctaaaagtcatacattatggagcaatggagtattagaaagcgaaatgataataccaaaaaatttcgcaggccccgtaagtcagcataattaccgaccgggttaccatacacaaaccgctgggccgtggcacctgggtcgcttggaaatggacttcgatttttgcgaggggactactgtagtcgtcacggaggattgtggaaatcgaggaccaagtcttcggacaacgacagcttcgggaaaattgattactgaatggtgctgccggtcttgcactttacccccactacgctaccgaggtgaagatggatgttggtatggtatggaaattcgaccactcaaggagaaagaggaaaacttagtgaattctctcgttacagcaggacatggtcaaatagataatttctctcttggtgttttaggcatggcattatttctagaagagatgcttagaaccagggtcggaacaaagcatgccatactattagttgccgtatcatttgtaacactgattacaggcaacatgtcattcagggatcttggcagagtcatggtaatggtgggagcaacaatgaccgatgatataggcatgggtgtaacttaccttgcacttctagcagcctttaaagtacgacccacatttgcagccgggctgctactaagaaaattaacaagtaaagaattaatgatgaccactatcggcattgttctattatcacaatcaaccatacctgaatcgatacttgagctcactgatgcactagcactaggcatgatggtcctaaaaatagtaagaaatatggaaaaatatcaactagccgttaccatcatggccattctttgtgttccaaatgctgtaattttagaaaacgcatggaaagtcagctgtacgactctggccgttgttagtgtctcgcctcttcttctcacatcttctcaacaaaaagcggactggattccgctagctctaacaatcaaaggtttaaaccccacggcgatattcctgacaactctatcacgtactagcaaaaaaagaagctggccattgaacgaggcaataatggcagtaggaatggtaagcatcttagcatcctccttattgaaaaatgacatcccaatgacaggaccactagtagcaggcggactattgacagtatgctatgttctaacgggaaggtctgcagacttagaattagaaagagcagctgacgtacgatgggaggaacaagcggagatctccggatctagtccgattctgtcgataacgataagcgaagacggctcgatgtccataaagaatgaagaagaagaacaaaccctaaccatattaataaggacaggtttattagttataagtggattattccccgtatccatacctattacagccgcagcgtggtacctatgggaagtcaagaaacaaagagcaggagttctatgggacgtacccagtccacctcctgtcggcaaagcagagctggaagatggggcgtatcgtattaaacaaaaaggcattttgggctactcccagataggagcaggggtctataaagagggaacctttcacacgatgtggcatgttacaagaggcgcagttctaatgcataaaggtaaacggatcgaaccatcctgggcggatgttaaaaaagatctaatttcctacgggggaggatggaaattggaaggagagtggaaagaaggcgaagaggtacaagtattagcccttgaacccggaaaaaatccccgtgctgtacaaactaaaccgggcttgtttaaaacaaatacaggcacaataggtgctgttagtttggatttttccccaggtacatctgggagtccaatcgtagataaaaagggaaaggtagtaggcttatatggaaacggtgttgttacaagaagtgggacctatgtttccgctattgctcaaactgaaaaatcaattgaagataatcccgaaatcgaagacgatatatttcgaaaaaaacgcttaacgataatggacttgcacccaggagccggaaagacgaaacgatatttacccgcaatcgtgcgtgaggcaattaaaagaggcctacgtaccctaatcttggcaccaacaagagtagttgcagccgaaatggaagaagcattgcgtgggttgccgatacgttaccaaactccagcaataagagccgagcatacaggtagggaaattgtagacctaatgtgtcatgcaacattcacaatgcgtctactaagtccaatacgtgtgcctaattacaacctcatcatcatggatgaagcgcacttcacagatcccgctagcatagccgcaagaggttacatatctacaagggtagaaatgggcgaagccgcgggaatttttatgacggctacaccacctggcagtcgagacccttttccgcaaagtaatgctcctattatggatgaagagagagaaataccagaaagaagttggaattcgggacatgaatgggtcacagattttaaaggaaaaacagtatggtttgtcccctccataaaagctggaaatgatatagctgcttgcctacgaaaaaacggcaaaaaagtaattcagctctcacgaaagaccttcgatagtgaatatataaaaacaagaaccaatgattgggactttgtcgtaactacagacatttcagaaatgggggcgaatttcaaagctgaacgcgttatagatccccgtcgctgtatgaaaccagttatcttgactgatggagaagaacgagttatactagcaggaccgatgccagttacccatagcagtgcggctcagagacgaggccgcgtgggaaggaatccaaagaatgaaaatgatcaatacatatatatgggtgaacctttggagaatgatgaagattgtgcacactggaaagaggctaaaatgttattagataatattaatacaccagaagggataattccatctatgtttgaacccgagcgtgagaaagtagacgctatagacggagagtatagattgagaggagaagctagaaaaacattcgtcgaccttatgagaagaggagatctcccagtttggttagcgtacaaagtagcagcagaagggattaattatgcagacaggcgttggtgcttcgacggagtcaaaaataaccaaatactagaagaaaacgttgaagtcgagatctggactaaagaaggggaaagaaagaagttgaagcctaggtggttagatgcacgaatctattccgatccgctcgccttaaaagaatttaaagaattcgccgcaggtcgaaagtctctgacactaaatcttataactgaaatgggaaggcttccaacgttcatgacacagaaagcgaaaaatgcacttgataacttagcagtgttgcacacagcagaggcaggtggacgagcctacaaccatgcacttagtgaattgccggagactttggagacattactattgttaacgttattagccactgtcacggggggtattttcctctttttgatgagcggtaaaggtatagggaaaatgacgctaggaatgtgctgcatcataacggcatcaatactattatggtacgcgcagattcaaccacactggattgctgctagtataatactagaattctttctgattgtattactaataccagaaccggaaaagcagcgtacaccccaagataaccaactaacatatgtggtcattgcaattctcactgtagtagcagcaactatggcgaatgaaatgggttttttagaaaaaactaagaaggatttcggactaggttcaatcaccacacaacaaccggagagcaacatccttgatatagaccttagaccggcaagtgcgtggacactgtatgcagtagctacaacattcattactcctatgcttagacactcaattgaaaactcatccgttaatgtatcactaacagcaattgctaaccaagctaccgtactaatgggattaggaaaagggtggccactaagcaagatggatattggcgttccattactagctataggatgttactcgcaagttaacccaattacgctaactgccgcacttttactattagtcgctcactatgccatcatcggtccaggtctccaggcaaaagccacgagagaagcacagaaaagagccgcagctggaattatgaagaatcctactgtcgatgggattacagttatcgatctagatccaattccttatgacccaaaatttgagaaacaactaggacaggtcatgttattagtactttgtgtcacccaggtactgatgatgaggacaacgtgggctctatgtgaggcactgacactagccacaggacctattagcacattgtgggaaggtaatcccggcagattttggaatacaacaattgccgtttccatggccaacatttttcgtggttcatacttagcgggtgcaggattgctattctcaataatgaaaaacactgcgaataccagaagaggaaccggtaacaccggtgaaacactaggcgaaaagtggaaaaatagattaaatgcattaggaaagtctgaattccagatttataaaaaatcaggaatccaagaagtggacaggactttagcgaaagaaggtataaaacgaggagaaaccgatcatcacgctgtatcacgaggttcagctaaattgcgctggtttgtagaacgcaatcttgtaacccctgaagggaaggtagtcgatttaggatgtggaagaggaggttggagctattattgtgggggtctaaaaaacgtgaaagaagtaaagggattgactaaaggtgggcctggacacgaggagccaatacctatgtcaacatatgggtggaatctagtgcgattacaaagtggagtagacgtttttttcactccccctgaaaagtgcgataccttgctatgtgatatcggggagagttctccgaatccgaccgtcgaagctggaagaactttgagagttctaaatctcgttgaaaactggttaaataacaatacacaattctgcataaaagtgctgaatccttacatgccgtcagtaatagaaaaaatggaggctctccaaagaaagtacgggggtgctctagtacgtaaccctttaagcagaaattcaactcatgagatgtactgggttagtaatgcctctggaaatattgtatcatcggtaaatatgattagtagaatgttaataaaccgattcactatgaggcacaaaaaagccacatatgagccggatgttgatcttgggtccggtactagaaatataggcatcgagtcggagaccccaaacttagatattattggaaaaagaatagaaaaaattaagcaggaacatgaaaccagttggcattatgatcaagatcacccctataagacgtgggcttatcacggtagctatgaaacaaaacagacagggtctgcctcctccatggttaatggggtagtaagactgctaaccaaaccctgggatgtcatacccatggtgacccaaatggcaatgacggatacaactccatttggtcagcaaagggtatttaaggaaaaagtggatacacgaactcaagaaccgaaagaaggaaccaaaaagttaatgaaaattactgcggagtggttatggaaagagcttgggaagaaaaagacgccacgaatgtgtacccgcgaagaatttactcgaaaagtgcggtcaaatgcggcattaggtgcaatatttacagacgaaaataagtggaaatctgcacgagaggccgtagaggattccggattctgggaactagtagacaaagaacgcaatctacatttagagggaaagtgcgaaacatgcgtctataatatgatgggcaaaagggagaaaaagctaggagaatttgggaaagctaagggttctcgagcaatatggtacatgtggttaggagcaagatttttagaattcgaagccctgggatttctcaatgaagaccactggtttagccgagaaaactccttaagcggtgttgagggcgagggactgcacaaattaggttacatcttaagagatgtcagcaaaaaagaaggaggagccatgtatgcggatgatactgccggctgggacacacgcatcaccctggaagatttaaaaaatgaggaaatggtgactaatcatatggaaggagaacataagaaactagcagaagctatctttaaattgacctatcaaaataaggtagtccgtgtccagcggcctacgccgagaggtacggtaatggatattataagcagaagagatcagagggggagcggtcaagtagttacatacggacttaacacttttacgaatatggaggcacaactcattcggcaaatggagggagagggagtattcaagtcaattcagcaattaacggtaaaagaagaaatagcggtaaagaattggcttatacgggtgggcagagaaagactttcacgaatggcaattagtggagatgattgtgtagtaaaaccactagatgaccgattcgctagtgcactgacagcacttaacgatatgggtaaagtaagaaaagatatacaacaatgggagccaagcaggggttggaatgactggacacaagtaccgttctgttcgcatcacttccatgaactaattatgaaggatggcagagtacttgttgttccatgtaggaaccaagatgaattaattggcagggcgcgaatatcacaaggtgctggatggtcactgagagaaaccgcatgcttaggaaagagttatgcccaaatgtggtcgttaatgtactttcatcgaagggatttaagactggctgctaatgcgatttgcagcgcagttccgtctcattgggtaccaactagtaggacaacgtggagtatacacgcaacgcatgaatggatgacaacagaagacatgcttaccgtatggaatcgcgtatggatacaagaaaatccctggatggaagacaaaactcctgttgaatcctgggaagaaataccctatttaggaaagagggaggaccaatggtgtggttctttaattggtctaacttcaagagcgacgtgggcaaaaaatattcagacagccataaatcaggtcagatcacttataggtaatgaagagtataccgactacatgccatctatgaaacgctttaggcgtgaagaagaagaagcaggtgtgctatggtaa

SEQ ID NO: 22873 - RNA, 9876 nt, synthetic construct
  misc_feature 1..9876: note = derived and/or modified CDS sequence (opt6) from DENV-2__KM279609__SS-prME
  source 1..9876: mol_type = other RNA
acggcaggaattattataatgatgatacctaccgtgatggcttttcaccttacaaccagaaatggagaaccccatatgattgttagtcgacaagaaaaaggaaaatccttactgtttaaaaccgaaaatggagtaaatatgtgtacattaatggcaatggacctaggtgaactatgtgaggacaccataacctacaactgccctttattgcgacaaaatgaaccagaagatatagactgctggtgcaatagcaccagtacatgggtaacctatggaacatgtaccgcaacgggggaacacagacgagaaaaacgaagtgtagcactggtcccgcatgtaggtatgggacttgagacaagaacggaaacttggatgtcttcagaaggagcatggaaacatgcacaacgcatcgaaacctggattctaaggcatcccggatttacaataatggccgccattctagcctacactataggtactacttactttcagagagttctaatctttattttacttacggcagtaacgccttcgatggctatgcgatgtattggaatatcaaatcgcgattttgttgaaggtgttagtggagggtcctgggtagatatagtcctagaacatgggtcttgtgtaacaactatggccaaaaataaacctaccttagacttcgagctaatcaaaacagaagctaaacacttagcgacactacgaaaatattgcgttgaagcaaaactgaccaatacaacaacagcgtcgagatgtccaacccagggagaaccgtccttaaacgaagaacaggacaaacgatttgtttgcaaacatagtatggtagatcgaggatggggtaatggatgtggattatttggtaaaggaggaatcgttacgtgtgccatgtttacatgtaagaaaaatatggagggaaaagtagtgcagcctgaaaacttagaatacactattgtaataacaccccactcaggagaagaaaatgcagtaggtaacgatacaggtaagcatggtaaagagataaaagtcacgcctcaatcgagtatcacggaagcggagctcacaggttacgggactgtgacaatggaatgttctccgcgaactggcttggatttcaacgaaatggtgttacttcaaatggagaataaggcatggcttgttcatagacaatggtttttagatttgcctttaccctggttacctggagccgacacgcagggatcaaattggattcagaaagaaactctagtaacgttcaaaaacccacacgcaaagaaacaagatgttgtagtactcggatcacaagagggggccatgcacacggcacttactggtgccacagaaatacaaatgtcgtcaggcaatctgttatttacaggccatttaaaatgtagattgaggatggacaaattacaacttaaaggaatgtcctatagcatgtgcactggcaaatttaaagtagtaaaggaaatagctgaaacacagcacggcaccatagtcatacgggtacaatatgaaggcgatggatccccatgcaaaattccattcgaaataatggatttagagaaaagacatgtactcggcagactaataaccgttaacccgatagttacagaaaaggattcgccagttaatatagaagccgaacccccttttggagacagctacataataatcggggtcgaaccagggcagcttaaattgtcgtggttcaaaaagggttccagtataggccaaatgtttgagacgactatgagaggagctaaaagaatggccatactaggagataccgcctgggactttggatcactaggaggagttttcacttctataggaaaggcactacatcaagtctttggagcaatttatggagctgccttcagcggagtgtcctggacaatgaaaatactgatcggagttgtcatcacatggatcggtatgaatagtcggagcacaagtctctctgttagcttagtgttagtaggagttgtaactctatatttaggcgtaatggtacaagcagatagcggatgtgtagtctcctggaagaataaagaattaaaatgcggttccgggatatttattactgataatgtacacacgtggacagaacaatataaattccagccagagtcaccaagtaaattagcaagtgctattcagaaggcgcacgaggagggtatctgtggcattcggtcagttactcgcctagaaaatttgatgtggaaacaaatcacgccagaactaaatcacatattaacagagaacgaagtaaaacttaccataatgacaggagatataaagggaatcatgcaagctgggaagcggtcattaagaccacaacctacagaattgaaatatagttggaaggcttggggaaaagcaaaaatgctatccactgaactgcataatcacacttttctaatagatgggccggaaaccgccgaatgtccgaatacaaatagggcatggaactctttagaagtagaggactacggatttggggtatttacgacaaatatatggttgaaattgaaagaacgacaagatgtattttgtgatagtaagctcatgagcgcagcaatcaaagataatcgcgcggttcacgcagacatgggttactggatcgaatcggcactaaatgatacgtggaaaatagagaaagcaagtttcatagaagtcaaatcatgccattggcccaaatcacatacattatggagtaatggagtattagaaagcgagatgataatcccgaagaacttcgcaggacctgtatcacaacacaattataggcccggttaccatacacaaacggcaggtccatggcatcttggacgattagagatggattttgatttttgtgaaggtactactgttgttgtgacagaggattgtggaaatagggggccaagtttgagaaccacaacagcgtcaggtaagttgataacagaatggtgttgtaggagctgcacgttgccgccattgagatataggggcgaagacggctgttggtatggaatggagataagacccctaaaagaaaaagaagagaacttagttaactcgctagtaactgcaggacatggacaaatagacaactttagcctgggagtattagggatggcattgtttcttgaagaaatgctccgtacccgagtaggaacaaaacatgctattttgctagtcgcagtgtcatttgtaacactcataacgggcaatatgtcattccgagatctcggacgggtaatggtcatggtgggcgcgacgatgactgatgatataggcatgggtgtaacatatctggccttactagcagcttttaaagtaagacctacttttgcagctggcttgttattgagaaagctcacaagtaaagagcttatgatgacaactattgggatagtcctattaagtcagtccactataccagagtctatattagagctaacagacgcgcttgctttaggtatgatggtattaaaaattgtaaggaatatggaaaaataccagttagcagttacaattatggcaatattatgtgtgcctaacgcagttatattgcaaaatgcatggaaagtttcatgcacaaccctagctgtcgtatctgtttcaccattattgctgacaagttcccaacaaaaagcagactggattccattagccttaacaataaaggggttaaacccaacggctatattcttgacaaccctctcgagaacaagcaagaaaagaagttggcctcttaatgaagcaataatggccgttggtatggtctcaattcttgcctcttctttactgaagaacgatataccaatgacaggccctctggttgctggcgggcttcttacagtctgttacgtattaacggggagaagtgcagatctagaattagaaagagctgcagacgtaaggtgggaagaacaagcggaaatttcaggtagctctccgatactatcaatcacaatatcagaggacggtagtatgtcaatcaaaaacgaagaagaagaacaaactttaacaatattaatcagaacgggacttttagtaatctctggtctctttccagtctctataccaatcactgctgctgcctggtacctgtgggaggttaagaaacaacgagcaggagttctatgggatgtaccatcaccgccgccagtaggaaaggcagaactggaagacggagcatacagaataaagcaaaaaggcattcttggctacagccaaatcggggcgggtgtctacaaagaaggtacttttcacaccatgtggcacgttactagaggcgcagtactaatgcacaaaggtaaacgcattgaaccttcttgggctgatgtgaagaaagaccttatttcgtacggaggaggatggaagctggaaggggaatggaaagaaggagaggaagtgcaagtattagcgctagagccgggcaaaaatcctagagcagttcaaacaaaacctggtttgtttaaaacaaacactggaaccattggagcggttagtctagatttcagtccaggaacctctggatcacctattgtcgacaagaaaggtaaagtagtcggactttacggcaatggtgtagtaacacgttcgggaacctatgtatccgctatagcgcaaacagagaaaagtatagaagacaatcctgaaatagaagatgatatctttcgtaagaaacgacttactataatggatcttcatccgggagctggtaaaacaaaaagatatttgccggccatagttagagaagcaataaaacgaggcctacgaacgttaatccttgcaccaacaagagttgtggcagcagagatggaagaagctctacgggggcttcctatcagataccagacaccagcaataagagctgaacacacaggacgtgaaatagtggatctcatgtgccacgctacctttacaatgagattactaagtccaatccgtgtgcccaactataacttaattataatggacgaagcccacttcacagacccagcttcaatcgcagctcggggttacatcagtactagggttgaaatgggagaagcagcggggatctttatgactgcgacaccacctggatccagagacccatttccacaaagcaatgcacccatcatggatgaagagagagaaataccagaacgctcatggaatagtggccatgaatgggtgactgattttaagggtaaaaccgtatggtttgttcctagtattaaagccggtaatgatattgcggcatgccttaggaaaaacggcaagaaagtaatacaattgtctaggaaaacattcgatagtgaatatattaaaacgaggactaacgactgggatttcgtggtaaccacagacattagtgagatgggtgcaaatttcaaagcagaaagagtcatagatccgaggagatgtatgaagccggtaatacttacagatggcgaagaaagagtaatattagccggtcctatgcctgtaacccactcgtcagcagctcaacgaagaggtagggtggggagaaatcctaaaaacgaaaacgatcaatacatttatatgggcgaaccactggaaaacgatgaagattgcgctcattggaaagaagcaaaaatgctacttgataatatcaacacacctgagggcatcatcccttcaatgtttgaaccagagagagagaaagtagatgccatcgacggtgaatataggttacggggcgaggccaggaagacatttgttgatctaatgagaagaggtgatttaccagtatggttggcgtaccgtgtagcagccgaaggaataaactacgcggacagaagatggtgttttgatggtgtcaaaaataatcaaatattagaagaaaatgtagaagtagaaatttggactaaagaaggagaaagaaagaaactaaaaccacgttggctagatgctagaatctattcagaccctttggccctaaaagaatttaaagagtttgctgcgggccgaaaatctctgactttaaatctaataacagaaatggggcgcttaccgacgtttatgacacagaaagccaaaaatgcgcttgataatctagccgttctgcataccgcagaagcgggaggacgtgcctacaatcatgcattatcggagctacccgaaacattggaaacattattgctactaaccctgttggcgacggtcacaggcggcatatttctatttttaatgagcgggaaaggtataggaaaaatgaccttagggatgtgctgcataataacggcttctatattgttatggtacgcacaaattcagccccactggatagctgcttcaataattctagagttctttttgatagtattacttataccagaaccggagaaacaaagaactccgcaagataatcaactaacatatgtcgtaattgcaatattaactgttgtagcggcaacgatggcaaacgaaatgggtttcttagagaaaactaagaaagactttggccttggatccataactacacagcaaccagaatcaaatatactggatatagatttaagacctgcctccgcatggacattatatgccgtggcaactacatttattacaccaatgctaagacacagtatagaaaattcctcagtgaatgttagtctaacagccattgccaatcaagcaaccgtacttatgggacttggaaaagggtggcctctgagcaaaatggacataggtgtaccgctattagcgatcggatgctacagtcaagttaatccaataacactcaccgctgcactattactactcgttgcgcattacgcgattatagggccaggcttacaagccaaggcaacaagggaagcgcagaaaagagcagccgcaggtatcatgaagaaccccacagtggacggaatgactgtaattgacttagacccgataccatatgatccaaaattcgaaaaacaactcgggcaagtaatgttattggtattatgcgttacacaagtcttgatgatgcgaacaacatgggctttatgtgaagcgttaacactggccactggacccattagcacgttatgggaaggaaaccctggacggttttggaatacaacgattgcagttagtatggctaatatcttccgcgggagttatttagctggagcgggcttattgttttcaataatgaagaacactgcaaacacacgacgtgggactggaaacacgggagagacattaggtgagaagtggaaaaacagactaaatgcccttggaaaatcggagttccaaatatataagaaatcaggtatacaagaagttgaccgaactctagccaaagaaggtattaaaagaggggaaacagaccatcatgctgtctcgagaggatcagccaaattgagatggtttgttgagagaaatctagtaacccccgaaggcaaagtagtagatctaggctgtggaagaggtggttggagttattattgtggtggactaaagaacgtgaaagaggtaaaaggtctaacaaaaggtggtccgggacacgaagaaccaatccctatgagtacctatggctggaacttagtccgactccaaagcggcgtagatgtcttctttacaccaccagagaaatgcgatacattgctgtgtgatattggagagtcttcacctaatccgactgtcgaggctggaagaactctacgagtactgaatttagtagaaaactggctaaataacaacacacaattttgtataaaggtgttaaatccgtacatgccaagtgtaatagaaaagatggaggctctccaaagaaaatatggaggtgcattagtcagaaaccctctatcgaggaatagtacacatgaaatgtactgggtatcgaacgcttccggaaatattgtttcaagtgttaacatgataagcagaatgctaataaatcgctttacgatgagacataagaaagctacttatgaaccggatgttgacctaggaagcggtactaggaacataggaattgagagtgaaaccccaaacctagacattataggaaaacgaattgaaaagattaaacaggaacatgaaacatcatggcattacgatcaagatcatccctacaagacctgggcgtaccatggatcatacgaaactaagcaaactggtagtgcatcttccatggtaaatggagttgtacgtttactaacaaagccttgggacgtaattcctatggtaacccagatggcaatgaccgatactaccccctttgggcaacagagggttttcaaagaaaaagtagatactcgaactcaggaaccaaaagaagggaccaagaaacttatgaaaataaccgcagaatggctgtggaaagagttaggaaagaagaaaacgccaagaatgtgtacaagagaagaatttacaagaaaagttaggagtaacgcggctttaggagctatttttacagatgaaaataagtggaaaagcgctagagaggctgttgaggattctggattttgggaattagtcgataaagaacggaatttacatttagaaggtaaatgcgagacttgcgtttacaatatgatgggtaaacgagaaaagaaattaggagagtttgggaaggccaaaggctcacgcgcaatatggtacatgtggctcggcgctcggttcttggaatttgaggcgctaggtttcctaaacgaagatcactggttttcacgtgagaatagtttatccggggttgaaggtgaaggattacataaacttgggtacattttgagggatgtttctaaaaaggaaggtggagcaatgtacgcagacgacacagcaggttgggatactagaataactcttgaggacctcaaaaacgaggagatggtaacgaatcatatggagggtgaacacaagaagttagcagaagcaatttttaaattgacatatcaaaacaaagtggtaagagttcaaagaccaacgccgagagggaccgtgatggatattatctcaagacgtgatcaaagaggcagcggccaagtagtaacttatggtttaaacaccttcacaaatatggaagctcaattaattaggcaaatggaaggggagggggtatttaaaagtattcaacaattaacggtcaaagaagaaattgcagttaaaaattggttaatcagagtagggagagagaggttgtcaagaatggcgatatcgggtgacgattgcgtagtcaaaccacttgatgatcgctttgcgtctgcgttgacagcactgaatgatatggggaaagtacgaaaggatatccaacaatgggagcctagccgcggatggaatgattggacacaagtaccattttgctcacaccatttccatgaactgataatgaaagatggccgagtcttggttgtaccatgtagaaatcaggatgaactaattggtagagctcgtatatcacaaggtgctgggtggtcactgcgcgagactgcttgccttggaaaaagttatgcgcaaatgtggagtctaatgtattttcacagacgtgatctaagactggcagcaaacgctatttgctcagcagtcccatcacattggatccccacatcacgaacgacatggtctatccacgcaacacacgagtggatgacgacagaagacatgctaacagtatggaacagagtttggatacaagaaaacccttggatggaagataagactccggttgaatcgtgggaagaaattccgtatctagggaaaagagaagaccagtggtgcggcagcctcatcggcctaactagccgagcaacttgggctaagaacattcaaactgctatcaaccaagtaagaagtttaattggtaatgaggaatatactgattatatgccgtccatgaaacgatttcgtagagaagaagaagaagccggtgtactatggtaa

SEQ ID NO: 22874 - RNA, 9876 nt, synthetic construct
  misc_feature 1..9876: note = derived and/or modified CDS sequence (opt6) from DENV-2__KM279607__SS-prME
  source 1..9876: mol_type = other RNA
actgcaggaattatcataatgatgatccctacagttatggcttttcatcttacaacaagaaacggtgaaccacatatgattgtatcgaggcaagaaaaaggaaaatcacttctcttcaaaactgaaaatggagtaaacatgtgtacattaatggcaatggacttaggggaactgtgcgaagataccataacctacaattgtcctttgttaagacaaaacgaaccagaagatattgactgttggtgtaactctacttctacatgggtgacatatgggacatgcacagcaacgggagaacatagacgtgagaaacggtcagtagcattagtaccacacgtgggaatgggattggaaacccgaacagaaacttggatgagttcagaaggagcatggaaacatgctcaacggattgagacctggattttaagacatccaggattcacgataatggccgcaattcttgcttatactataggtacgacttatttacaacgagtattaattttcattcttcttaccgctgtaacaccgtcaatggccatgaggtgtattggtatttcaaatcgggattttgtagaaggtgtatcaggaggatcctgggtagacattgtactagaacatgggtcatgcgttactaccatggccaaaaacaaaccaacactagattttgaattgataaaaacagaagcaaaacatccagctacgctaagaaaatattgcgtggaagcaaaattaacgaatactaccacagcctctagatgcccaacgcagggtgaaccttcactaaatgaagaacaggataaaaggttcgtatgtaaacattcaatggtcgatagagggtggggcaacggatgtggactatttggaaaaggaggtatagtcacatgtgcaatgtttacatgcaagaaaaacatggaggggaaagttgtacaaccagagaacttggaatacacaatcgtgattactccccattcaggagaagaaaacgctgtgggaaacgataccggcaaacacgggaaagaaataaaggttacaccacaatcatcaattaccgaagctgaacttacaggttacggaactgttacaatggaatgctcacccaggacgggcttagatttcaatgagatggttctattacaaatggaaaacaaagcgtggttagtgcatagacagtggtttttggacctccctttaccctggctccctggagcagatacacagggatctaactggatacagaaggaaacacttgttacttttaagaatccacatgccaagaaacaagacgttgtggtcttgggttcacaggaaggtgccatgcatactgccttaacgggggcaactgaaatccaaatgagctcaggaaatttgctctttactgggcacttaaaatgtcgactgcgaatggataaactacaactgaaaggtatgtcttactctatgtgtacaggtaaattcaaagtggtgaaggaaattgccgaaactcaacacggcactattgtgattagagttcagtatgaaggtgacggtagcccctgtaaaattccattcgaaatcatggacttagagaaaagacacgtacttggacgactaataacagttaatccaatcgtgacagaaaaggataatcccgttaatatagaagctgagcctcccttcggcgacagttatataatcattggcgtagagccagggcaactaaaactttcatggtataagaaagggagtagcataggtcaaatgtttgaaacaactatgcgaggagcaaaaagaatggcaatacttggggatactgcatgggattttggttcactaggtggagtatttacttcaatcggtaaagccctacaccaagtgtttggtgcaatttatggagcagctttctcaggagtgtcttggacaatgaaaatattaatcggagttgttattacatggattggaatgaactcccgttcaacgtcattgagtgttagcttagtcttggtcggagttgtgacattatacttgggcgtaatggttcaagcagacagtggttgtgtcgtgagttggaaaaataaagaattaaaatgcggttccggaatcttcattacggataacgttcatacgtggacagaacaatacaaattccaaccagaatccccttcaaaacttgcatcagcaatccaaaaggcacatgaagaagggatatgtggaataagatccgtaacacgattagaaaaccttatgtggaaacaaatcacaccggaactaaaccacattctaactgagaacgaagtcaaactaactataatgacaggcgacataaaaggaatcatgcaggcagggaagagatctcttcgacctcagccaacagaattgaaatattcgtggaaagcgtgggggaaagcgaaaatgctaagtacggagttacataaccatacatttttaatagacggtccagaaaccgcagaatgcccaaatacaaatcgggcctggaactctctggaagttgaagattatggattcggagtatttacaacaaacatatggctcaaactaaaagagcgtcaagacgtattttgtgatagcaaactaatgtcagcggcaataaaagacaatcgagcagtacatgccgacatgggttattggattgagagcgctttaaatgacacttggaagatagagaaagcgtcattcatcgaggtgaaaagttgtcattggcctaaaagccacactttatggtccaacggggtcttggaaagtgaaatgataatacccaaaaattttgcagggccagtttcacaacacaactacagaccggggtatcatacccaaactgcaggaccttggcaccttggtcgcctagagatggatttcgatttttgtgaagggactaccgttgtcgtaacggaagactgtggtaaccgcggaccaagccttcgaacaaccacagcgtcggggaagctcattacggaatggtgttgtcggagctgcacgttaccccctcttaggtacaggggtgaagatggatgttggtatggtatggaaatacggcccctaaaagaaaaggaagaaaaccttgtgaacagcctcgtaacagcaggccacggccaaatagataattttagtcttggcgttttagggatggcactgttcttggaagaaatgttaagaacaagagtcggaacgaaacacgcgattttgctagttgctgtgagctttgtaacacttattacaggtaatatgagttttcgagacttagggagagtaatggtaatggtgggagcgaccatgacagacgacataggaatgggagtcacctacttagcattactagctgcttttaaagtaagaccaactttcgcggccggactgttgcttcgtaaattgacatccaaagagttgatgatgactaccatcggtatagtattactcagccaaagcacaataccagaatcaatactagaactaacggatgctcttgctttgggaatgatggtactaaaaatagttcggaatatggagaagtatcaattagctgtaacaattatggctatattatgcgtcccaaacgctgttattttagaaaatgcttggaaggtatcttgtacaacactggctgtagttagtgtaagccctctacttttgacatcatcccaacagaaagccgactggataccacttgccttaacgataaagggattgaaccctacggcaattttcttaacaactttgtcgagaacctctaagaaacgttcatggcctttaaatgaagctataatggcggtgggcatggtatctattttagccagttctttgctgaaaaatgatataccaatgacggggccacttgtcgcaggaggtttgctcacagtgtgttacgttctaacaggaagatctgcagatttagaattagaacgagctgctgatgttagatgggaagaacaagcagagattagtggaagtagtccaatcctaagtattacaataagcgaagatggatcaatgtcaatcaaaaacgaagaagaagaacaaactttaacaatcttaatccggacagggctattagtaatttcaggcctatttcccgtatctattccgattacagcagcggcatggtatctctgggaagtgaagaaacaaagagctggcgttttatgggatgtgccgagcccacctccagtgggaaaagccgaattagaagacggcgcatatagaataaagcagaaaggaatattaggatacagtcaaatcggggcaggagtttacaaggaaggaaccttccatacaatgtggcatgtaacccggggtgctgtcttgatgcataaagggaaaaggattgagcctagctgggctgacgtcaagaaagatctgatatcatacgggggaggctggaaacttgagggcgaatggaaggaaggagaagaagttcaagtcctggctctagagcctgggaaaaacccaagagctgtgcaaacgaaacccggattattcaaaactaatacagggacaataggggcagtatccttagatttcagtccaggtacttctggatctccaattgtagataagaaaggaaaagtagtaggcttatatggtaacggtgtagtaacgagaagtggcacatatgtttcagcaatagcacaaacggagaaaagcattgaagacaatccagaaatagaagatgatatatttcgcaaaaagcggctgacaattatggatctccatcccggagctggaaaaacaaaaagatacttaccagcgatagtacgcgaggctataaaacgagggttaaggacgttaatactcgcaccaacgagagtagtcgcagctgaaatggaggaggcacttagaggattgcccattcgataccaaacgcctgcgatacgggctgaacataccggaagggaaatagtagaccttatgtgccatgccacattcaccatgagattactatcgccaataagggtgccgaattataatttgattataatggacgaagcccattttactgacccggcatccatagcggcaagaggatacatttcaacaagggtcgaaatgggagaggcagcgggaatatttatgacagcgactccaccaggtagtagagacccatttcctcagtcgaatgctccaattatggatgaggaaagagagataccagagaggagttggaactctggacatgagtgggtcactgacttcaaaggcaaaacagtttggtttgtaccatcaattaaggctggtaatgacattgcagcatgtttacgaaagaacggaaagaaggtcatacagttaagtagaaaaacattcgactcggagtacattaaaactcgaacgaacgactgggattttgtagtaacaactgacatatccgaaatgggtgcaaatttcaaggcggagcgggtgatagaccccagaaggtgcatgaaaccggtaatattgacagatggggaagaacgagtaatattggctgggccaatgccagtcacacatagctctgcggcacagcgtagaggtagagtggggcgcaatccgaaaaatgagaatgatcaatatatttatatgggtgaacccctagaaaatgatgaggattgtgcacattggaaagaagccaaaatgctgttagataatattaatacgcccgaagggataatcccaagtatgtttgaaccagaaagagaaaaagtagacgcaattgatggagaataccgactacgcggagaagcgaggaagacatttgtcgacttgatgcgtaggggagacttacccgtatggctggcatacaaagtcgccgcagaaggtattaactacgccgatagacgatggtgtttcgacggggtgaaaaacaatcagatccttgaggagaatgtagaagtagaaatatggaccaaggagggagaaaggaaaaagctgaaaccgagatggttagacgcaagaatatattcagatccactagctttgaaagaatttaaagagtttgcagcaggaagaaaatcattaactttaaatttaatcactgaaatgggacgtctaccaacatttatgacccaaaaagctaagaatgcattagataatctagcagtgttgcacacggcagaagcgggaggtcgagcatacaatcacgcattgagtgaactaccggaaacattggaaacgttactactattaactttgttagcaactgtaaccggcggtatttttctttttcttatgagtgggaaaggcataggaaaaatgacgctaggtatgtgttgcataataacagcgtctatcctcctatggtacgcacagatacaaccacattggatagctgccagcattattttggagttctttctaatagtattactcatacctgagcctgagaaacaacgaacgccacaggacaatcaactcacttatgtcgtaattgctatactaactgtggtagcagccacaatggctaatgaaatgggattcctcgaaaagactaagaaggacttcggactaggctcaattacgactcagcaaccagaaagtaacatattggacatagatttaagacccgcaagcgcatggaccttatatgctgtagccacaactttcataacaccgatgttacgtcattctattgagaactcaagtgtaaatgtaagtcttaccgcaatagctaatcaagcaactgttctcatgggcctaggtaaggggtggccactatcaaagatggatatcggcgtgcctctattagccataggttgttatagccaagtcaatcctataaccttgaccgctgcattactactgctagtagcacactacgcgataattggtccaggtctccaggcaaaggcaacaagggaagcacaaaagcgagctgcagcgggcataatgaaaaatcctactgtggacggaataacggttatcgatcttgacccaataccatatgatccaaaatttgagaaacaattagggcaagtgatgttacttgtactatgcgtaacgcaagtattaatgatgcgtacaacctgggctttatgtgaggcactcacattagccacaggtcccatatcaacactgtgggaggggaaccccgggcgtttttggaatacaacaatcgcagtctcgatggccaatatctttcgtggatcgtacttagccggagcaggcttgctattttctataatgaaaaatacggctaatacccgaagaggtaccgggaatacaggggaaacactaggagaaaagtggaagaatagattaaacgcacttggaaaatcagaatttcagatatataaaaagtctggaatacaagaggtagacagaacattagcgaaggaaggcattaaacgaggcgaaacagatcatcacgctgtctcacgaggatctgcgaaactaaggtggtttgtagaaagaaatttagtaacacccgagggaaaagttgttgacctaggatgcggacgaggaggatggagctactactgtggtggccttaaaaacgtaaaggaagtaaaagggctaaccaaaggtggcccgggccatgaggaaccaatcccaatgtccacctatggatggaatttagtaagattacaaagtggagtggatgtattctttactcctcccgaaaaatgtgatacattactatgcgatattggagaatcaagtcccaatcccacagtagaagccggccggacgttaagagtcttgaaccttgtagaaaattggttaaataataacacacaattttgtattaaagttcttaacccatacatgccctcggtcatagagaaaatggaggctttacaacgcaaatatggaggcgcacttgtaagaaacccactgtctagaaatagtacgcacgaaatgtactgggtaagcaacgcatccggtaatatagtatcatcagttaacatgattagtcgcatgctaataaatagatttactatgcgacacaagaaagctacttatgaacccgacgtagacttgggatcgggcactcgtaacataggcatcgaaagcgaaacgccaaacttagatataatcggcaaaagaattgaaaagataaaacaagaacatgagacctcgtggcactacgatcaagatcatccatataagacgtgggcatatcatggaagctatgagactaaacagaccggaagcgctagttcgatggtaaacggtgttgtgaaattactgacaaagccatgggacgtgataccgatggtaacacaaatggcgatgaccgatactactccatttggccaacaaagagtgtttaaagaaaaagtagatactagaacacaagagccaaaggagggtactaagaaactgatgaaaataaccgcagagtggctctggaaagaacttggcaagaagaaaacgcctagaatgtgtactcgagaagagtttacacgtaaagtgcgaagcaatgcagcgttaggtgctatattcacagatgaaaataaatggaaatctgcaagagaagctgttgaggattctggattctgggaattagtggataaggaacgaaatttacatttggagggtaaatgcgaaacatgtgtttacaacatgatgggtaagcgtgagaagaaattaggcgaatttggcaaagcaaagggaagcagagcaatctggtatatgtggctgggagcgaggtttttagaatttgaagctctaggtttcttgaatgaagatcattggttctcacgagaaaactcactgtcaggggtagaaggtgaagggttacacaagctcgggtatatcctaagagatgtgagcaagaaggaaggaggcgcaatgtatgcagatgatacagctggatgggatacaagaatcactctggaagatctaaagaacgaagaaatggttacgaatcatatggagggtgaacataagaaattagctgaggcaatttttaaactcacgtaccaaaacaaagtagtaagggttcaaagacccacacctcggggtacagttatggacattataagtaggagagaccaaaggggaagtggtcaggttgtcacatacggtttaaacacttttacgaacatggaagcacagctcatcagacagatggagggagaaggagtattcaagagtatccagcagttaaccgttaaggaagaaatcgccgtcaaaaactggttaatcagagttggccgcgaacgcttaagtagaatggccataagtggggacgactgcgtagtgaaacccttagatgaccgatttgcctctgcgctgacggccttgaacgacatgggaaaagtaagaaaagatatacaacagtgggaaccctcaagaggatggaacgactggacccaagtcccattttgcagtcatcatttccatgagttgataatgaaggatggaagagttttggtcgtcccctgtagaaatcaggacgaactaataggcagagctaggatatcccaaggcgcaggatggagtttaagggaaacagcgtgtctaggcaaatcatacgcacaaatgtggtccctcatgtattttcacagacgcgacttgagattagcggcaaatgctatttgctcagccgtcccatcccactgggtaccaacgagtagaacaacctggtctattcacgcgacacacgaatggatgaccaccgaagatatgttaacggtatggaatagggtatggatacaagagaacccatggatggaagataaaacaccagtagagtcatgggaagaaattccgtatttagggaaaagggaagatcagtggtgtggcagcttgattggactaacttcaagagcgacttgggccaagaatatacagaccgcaattaaccaagtacgaagtctaataggtaatgaagaatacacagactacatgccctcaatgaaaagattcagacgggaggaagaagaagcgggagtattatggtag

SEQ ID NO: 22875 - RNA, 9876 nt, synthetic construct
  misc_feature 1..9876: note = derived and/or modified CDS sequence (opt6) from DENV-2__KM279606__SS-prME
  source 1..9876: mol_type = other RNA
actgctggtatcatcataatgatgattcccacagtaatggcgttccacttgacgacaaggaatggcgaaccacatatgatagtgtcgcgacaagaaaaagggaagtcactactattcaaaacagaaaacggagtgaatatgtgcaccctaatggctatggacctaggggaattatgcgaagatactatcacttacaactgcccattactaagacaaaacgaacccgaagacatagattgttggtgcaacagtacaagtacatgggtaacatatggtacatgtaccgcaacgggagaacacagaagagaaaaaagaagtgtggcattagtcccgcatgtaggaatgggcctcgagacaagaacagagacatggatgtcatcagaaggagcttggaaacatgcccaacgcatcgaaacctggatactgcgacacccgggattcacgataatggcggcaatattagcgtatactatcggcacaacatattttcagagagtgttaatcttcatcctattaaccgctgttactccatccatggctatgcgatgtataggtataagtaacagagattttgtcgaaggagtgtcaggaggaagctgggtagatatcgtattagaacatggaagttgcgttaccacgatggcaaaaaataaaccaaccctggacttcgagttgataaaaactgaagcaaagcatccagctactttaagaaagtattgtgtagaggctaagttgacgaacaccaccacagcatcgagatgccccacacagggtgaaccaagcctcaacgaggaacaagataaaagattcgtatgtaaacattcaatggtggacagaggatggggtaatgggtgtggactatttggaaaaggcggcatcgtaacctgtgctatgttcacatgtaaaaaaaacatggaaggaaaagtcgtgcaaccagaaaatctagaatatacaattgttataacgccacatagtggcgaggagaatgcagttgggaatgataccggtaaacatggtaaagagatcaaagttacaccacaatctagtatcactgaagccgaattaactggatatggcaccgtaaccatggagtgttcaccaagaactggtctcgattttaacgaaatggttctcctacaaatggaaaataaagcatggcttgttcatcggcagtggttccttgacttacccttgccttggctccctggcgctgacacacaagggagtaattggattcagaaggagacgctagttacctttaaaaatcctcacgcaaaaaaacaggacgtagtagtactaggaagccaggaaggggcgatgcataccgcactcacaggggccacagaaatacaaatgtcatctggtaaccttctttttaccggacatctaaagtgccgattaagaatggacaaattacagctaaaaggaatgagttactccatgtgcacaggaaagtttaaggtagtaaaagaaatcgcggaaactcaacacgggacgatagtgataagagtacaatatgagggtgacggttcaccttgcaagattcctttcgaaataatggacctcgaaaaaagacatgtgttaggccgcctgataacggtgaatcccatagttacggaaaaagataatcccgtgaatatagaagctgaacctcccttcggggacagctatatcatcatcggtgttgaacccggtcaacttaagctatcgtggtacaagaaaggaagctcaataggacagatgtttgagacgactatgagaggcgcgaaaagaatggctattctaggagacacagcatgggattttgggtcactagggggcgtattcacaagcatcggcaaagctttacatcaagtattcggcgccatttatggagcagccttctctggtgtttcatggacgatgaaaattctaattggtgtcgttataacctggataggtatgaacagtagatcaacctcactctctgtaagcctagtcctcgtaggggtagtaacattatatttgggtgtaatggtgcaagcagactctggatgtgtagtgagctggaaaaataaagaactgaaatgcggaagcgggattttcattactgataacgtccacacatggaccgagcaatataagtttcagcctgagagtccgtcaaaacttgccagtgccattcaaaaagcccacgaggagggaatttgcggcatacgtagtgtaactcgcttggaaaacctaatgtggaagcaaataacgccagaactgaatcatattctcactgaaaacgaagtaaaactcacaataatgacaggtgatattaaaggaataatgcaagcagggaaacgttcactaagaccccaaccaacagaactgaaatactcttggaaagcatggggtaaagcaaaaatgttatcaactgaactacacaatcatacctttctaatcgacggacccgaaacagccgaatgtccaaatacaaaccgggcatggaacagtttggaagtagaggattacgggttcggcgtcttcacgacaaacatatggctaaagctaaaagaaagacaagacgtattttgcgatagtaaattgatgagcgccgcgattaaagataacagggctgtacatgctgatatgggttattggattgaatccgcactgaatgatacctggaaaatagaaaaagcttcgtttatagaagttaaatcatgtcactggcccaagagccacactctgtggtcaaatggagtgcttgaaagcgaaatgataatacctaaaaattttgcgggacccgtcagtcagcacaattacagaccgggatatcatactcaaactgccgggccatggcatctaggtaggcttgaaatggactttgatttctgcgaggggacaacagtagtggtaacagaagattgcgggaaccgtgggcctagcctcaggaccacaacagcatcgggtaaattaattacagaatggtgctgtcggagctgcactttaccccctctgcgatatcgcggagaagatggctgctggtacggcatggagattcggcccctaaaggaaaaagaagagaatttagtaaattcgttagttacagctggacatggtcaaattgataatttttccttaggcgtccttggtatggccctattcttagaggaaatgctaaggacaagggtaggaacgaaacacgcaatactactggtggctgtatcatttgtgactctaattacgggaaatatgtcatttagggatcttgggcgggtaatggtgatggtgggtgcgacaatgactgacgacataggtatgggagtaacatatctggcactgctcgcagcgttcaaggtacgccctacattcgcagcaggactattattaaggaaacttacatcaaaagagcttatgatgacaactataggaatagtacttttgtcacagtcaacaataccagaaagcatactagaattaacggatgcacttgcgcttggtatgatggtactaaaaatcgttaggaacatggaaaaatatcaattggcagtcacaatcatggcgattctctgtgtcccaaatgctgtaattcttgaaaacgcatggaaagtcagctgtaccacactcgccgtcgtcagtgttagtcccttgctgctaacctcttcacaacaaaaggcagactggatcccgttagcactgacaattaaaggtttaaatcctaccgcaatattcctaaccactctatctcgcacgagtaaaaaacggagctggcccctaaacgaggctataatggcggtaggaatggtatccatattggccagtagcctgctaaaaaacgacatacctatgacaggaccgttagtagcgggaggcctattgactgtctgttatgtgttaacaggaaggagtgctgacttagaattggaaagagctgctgatgtcaggtgggaagaacaagcagaaatctccggcagctcgcctattttgtctataactatatcagaggacggctctatgtcaatcaaaaacgaagaagaagaacaaacgttaaccatacttatacggacgggattgttagtcataagcgggctatttcctgtatccatcccgataacagcagccgcgtggtacctatgggaagtaaaaaaacaaagagccggtgtattatgggacgttccatctccacccccagtgggtaaagctgaactcgaagacggagcgtacagaatcaaacaaaaaggaattttggggtactcgcaaatcggagcaggtgtatataaagagggtacctttcacacaatgtggcatgtcacacgaggagcggttctgatgcataaaggtaaacgaatagagccctcttgggctgatgtaaaaaaagatttaattagctatggaggcgggtggaaattagaaggtgagtggaaagagggtgaggaagttcaagttttagccctagaacctggcaaaaaccctagggccgtccagactaagccaggactattcaaaactaacacaggtacgattggtgccgtatcattggactttagccccggaacctctggtagtcccatagtagataaaaaaggaaaggttgtaggattatatggtaacggagtggtgactagatcaggcacttacgtatcagccattgcccagacggaaaagtccatcgaagataatcctgaaatagaagatgatatttttagaaaaaaaagactaacgattatggatctgcacccaggagcgggcaagacaaaacgttacttaccggcgatcgttagagaagcaattaagagaggtttacgaacactgattctggctccaacaagagtcgtagccgcggaaatggaagaagctctaagaggactaccaatccgctatcaaactccagctatcagagcagagcacacaggacgagagatcgtggatttgatgtgtcacgcaacttttactatgaggttactatccccaattagggtcccgaattataatctgatcataatggatgaagcacattttacggatcccgcatccatcgcggcaagaggatatatatcgacgagagtggagatgggtgaagctgcgggaatattcatgacagctacccctccaggctcgcgtgacccgtttccacagtcgaatgcgcccataatggacgaagaacgagaaattcctgaaaggtcatggaactctggacatgaatgggtgacggatttcaaaggaaaaacagtttggtttgtaccatcaattaaagccggaaacgacatcgctgcctgtctgcggaaaaatggtaaaaaagtcatacaattatctagaaagacgtttgactcggaatatatcaaaactaggacgaatgattgggatttcgttgtcacgacagatattagtgagatgggagccaacttcaaggcagaaagagtaatcgatccaagacgatgtatgaaacctgtaatactaacagatggcgaagaaagggttattctagcaggtcctatgccggtaacacatagcagtgcggctcaacgaagaggcagagtaggaagaaacccaaaaaacgagaacgaccaatatatatatatgggagaaccactggagaacgatgaagactgcgctcattggaaagaagccaagatgcttttggacaacatcaatacgccagagggaataatacctagtatgtttgaacccgagagagaaaaagtcgacgcgatcgatggtgagtatagattaagaggggaggcacggaaaaccttcgtagatcttatgcgaagaggcgatcttcccgtttggttagcgtacaaagttgctgcagaagggattaattacgcagacagacgctggtgctttgatggggtcaagaacaatcaaatattagaagaaaacgtagaggttgaaatatggacgaaagaaggagaaagaaaaaaactaaagcccagatggttagacgcaaggatctattctgaccctttagcattaaaagaatttaaagaatttgctgcaggaaggaaatcgcttacccttaatctcataaccgaaatgggaagattacctaccttcatgacacaaaaggctaaaaatgctttagataatctagccgtgctgcacaccgcagaagctggtggaagagcatacaaccatgcactatctgaattaccggaaacactagagactttactcctgctaactttattagcaactgtgaccggaggaatattcctcttcttaatgtcgggcaaaggtataggaaagatgacgcttgggatgtgctgtatcataacggcctcaatattgctatggtacgcacagatacagccccactggatagcagcttccataattttagaattcttccttatagtgttgctaataccggaacctgaaaaacagagaactccgcaagataatcagttaacatatgttgtaattgcaatcttaaccgtagtcgctgcgacaatggcaaatgaaatgggttttttggaaaaaacgaaaaaagatttcggcttaggcagcattacgacccaacagcctgaatctaacatattagatatagacttacgtcctgcaagcgcgtggacattatacgctgtggcaacaacatttatcactcccatgttaaggcactctatagaaaatagcagtgttaatgtatcgcttacagctatagccaatcaagctacagtgctgatgggacttggtaaaggatggcccctctctaaaatggacataggagtgccattacttgcaatcggatgttattctcaagttaatccaataactcttaccgctgcgctacttctattagtcgcacattatgctataataggccctggacttcaagccaaagctacacgtgaggctcaaaaaagggcagcagccggtattatgaaaaacccgaccgtagatggaatcactgtgatagatttggatccaatcccatatgatcctaaatttgaaaagcaacttggacaagtaatgttacttgtcttatgtgtaacacaagtattaatgatgcgcactacatgggcgttatgcgaggcattaactctagctacggggcccatttcgacgctatgggaaggcaatccaggcagattttggaacaccacaattgcagtatcaatggcaaatatattcagaggaagctatctcgcaggcgccgggttacttttttccattatgaaaaatacagcgaatactagacgaggtactggtaatacgggagaaaccctcggagaaaaatggaaaaatagactcaacgctctaggaaagagcgaattccaaatatataaaaaaagtgggatacaagaggtagacagaactttagcaaaagaaggtattaagcgcggcgagacagatcaccatgcagtctcacgcggatcggccaagttgagatggttcgtagaaagaaacttagtaaccccggagggcaaagttgtcgacctcggctgcggaagaggtgggtggtcttattattgtggcggactaaagaacgtaaaggaagtaaaaggcctcacaaaaggtggaccaggtcacgaagaaccaataccgatgtcaacttacggatggaacctggtaagattacaaagtggagtcgatgtattcttcaccccacctgaaaaatgcgatacacttctatgtgatattggggagagcagtccaaatccaacagttgaagccggaagaacacttcgcgtactaaacctcgcggaaaattggctaaataataacactcaattctgtataaaagtattgaacccttacatgccctctgtaatagagaaaatggaagcgttacagagaaagtatggcggcgctctcgtaaggaatccactatcaagaaacagcacacacgaaatgtattgggtttctaacgcctctgggaatattgtgtccagtgtcaatatgatatctagaatgttgattaatagattcacaatgagacacaagaaagcaacgtatgaaccagacgtggatttgggatcgggaacaagaaatataggtatagaatctgagacacccaacctcgacatcatcggcaaaagaatagaaaaaattaaacaagaacatgagaccagttggcattatgaccaggaccatccgtataaaacctgggcataccatggatcatacgagaccaaacaaacaggttcagccagctccatggtaaatggagtcgtacgcctcttaacaaaaccatgggacgtaataccaatggttacacaaatggccatgacggacactacgccatttggacagcaaagagtgtttaaagagaaagtggacacacgaacacaagaacctaaagaaggaacgaagaaactaatgaaaataaccgcagaatggctatggaaagagctagggaagaaaaaaacgccacgcatgtgtactagagaagaatttacccgcaaagtcagaagtaacgcagcactcggagcaatctttacagacgagaataagtggaaatcagcacgggaggcagtagaagatagtggtttttgggaattagtagacaaagaacgtaatcttcacctagaaggtaaatgtgaaacatgcgtttataatatgatgggtaaaagggaaaaaaaactaggagaattcggaaaagcaaaaggttcgagagctatttggtacatgtggctaggagctcgcttcttagaatttgaagccctaggattcttaaatgaggaccactggtttagtagggaaaatagtttgagcggagtagaaggggaaggcctccacaaactgggatatatactcagggacgtatcgaaaaaggagggtggcgcaatgtatgctgacgatactgcaggatgggacactagaataacactggaagacttaaaaaatgaagaaatggtcacgaatcatatggaaggggaacacaagaaattagcagaagcaatttttaaattaacatatcaaaacaaagttgttagagtacaacgcccaactccacggggcactgtaatggacataatctcaagaagagaccaacgtggatcggggcaagtcgttacctatggtctaaacacttttactaatatggaagcgcagctcataagacaaatggaaggagagggagtatttaaatcaattcaacaactgacggtgaaggaggaaatagcggtaaagaactggttaataagggtaggtagagaacgtcttagcagaatggccatctccggagatgactgtgtcgtaaaaccactcgatgatagattcgcttcagctctaacggcgttgaacgatatgggtaaggtaagaaaagatattcagcagtgggaaccttctaggggatggaatgattggacccaagttccattttgcagtcatcattttcatgagctaataatgaaagatggcagagtgttagttgtcccctgtcgcaaccaagacgagcttattggcagagcgcgaattagccaaggagctggctggagccttagagaaactgcttgtttagggaaatcgtatgcacagatgtggtcgcttatgtatttccaccgacgggatctaagactagcagctaacgcaatatgtagcgcagtgcctagtcactgggtaccaacatcacgtactacctggagcatccatgcaactcacgaatggatgacaacggaggatatgttgaccgtttggaacagagtctggatccaagagaacccatggatggaggataaaacgccagtggaatcatgggaagaaattccttatcttggaaagcgtgaagaccagtggtgtggatccctaattggattgacatcgagggcgacatgggcaaagaatatacaaactgctataaatcaagttcgctcacttattggtaatgaagaatatacagactacatgccaagtatgaaaaggtttagaagggaagaagaagaagctggagtgctatggtga

SEQ ID NO: 22876 - RNA, 9876 nt, synthetic construct
  misc_feature 1..9876: note = derived and/or modified CDS sequence (opt6) from DENV-2__JN851113__SS-prME
  source 1..9876: mol_type = other RNA
actgctgggataataataatgatgatacctactgtaatggcatttcatttaactacaaggaatggtgaaccacatatgatagtttccagacaagaaaaaggcaaatctttattgttcaaaaccgaaaacggtgtaaatatgtgtacattaatggcaatggatttaggcgaactctgcgaagatacaataacatataactgtccattactgagacaaaacgaaccagaagacattgactgttggtgtaattctacatccacgtgggtaacctacgggacctgcacagcaaccggtgaacataggagagaaaaacgttctgtagcattagtaccacacgttgggatggggctagaaacaagaacagaaacctggatgagttcagaaggagcatggaaacatgcgcaacgaattgagacttggatactgagacacccaggtttcacaattatggccgcaatacttgcatatactattggtaccacctactttcaaagggttctgatattcattcttctaactgctgtcaccccttcaatggctatgagatgtataggaatctcaaaccgtgacttcgttgaaggtgtaagcgggggatcgtgggttgacattgttttagaacatggctcctgcgtcactacaatggctaaaaataaaccaaccctggacttcgaattaataaaaactgaagcaaaacatccagcaaccctacgaaaatattgcgtagaagccaaattaacgaatactacaacagcgtcacgatgtcctactcaaggggagccaagtctcaatgaggaacaagacaaacgcttcgtttgcaaacacagtatggtggaccgcggttggggtaatggttgcggactatttgggaaaggagggatcgtaacctgcgcaatgttcacatgtaagaaaaatatggaaggaaaagtagttcaaccagaaaacctagaatatacaattgttataacacctcattcaggagaggaaaatgcagttggaaatgacacgggaaaacatggtaaagaaattaaagttaccccacagtcttcgattacagaagcagagttgactggatatggtacagtaacaatggaatgttcaccacgtacgggactagactttaatgaaatggttcttctacagatggaaaataaagcatggttagtacaccgtcaatggtttctcgaccttcctctaccatggttaccaggcgcagatacgcaaggtagcaattggattcaaaaagaaacattggtgacctttaaaaacccgcatgccaagaaacaagacgtagtggtcttggggtcacaagaaggtgcaatgcacacagcgttgactggggcaacagagatacagatgtctagtggtaacttactatttacaggtcacctgaaatgcagacttagaatggataaactacaattgaaaggcatgagctactctatgtgtactgggaaattcaaagtagttaaagaaattgcagagactcagcacggaacgatagtgatacgagttcaatatgaaggagatggcagcccatgcaaaatacctttcgagatcatggatctagagaagcgacatgtcctcggacgactaataactgtgaatccaatagtcacggagaaagatagccccgtcaatatcgaagcagaacccccatttggtgatagctacattattataggtgtagagcctggccaactaaaactatcttggttcaagaaaggttcgtccataggacaaatgttcgagacgacaatgcgtggggctaagaggatggctattttaggagataccgcctgggattttggatcattaggcggagtattcacgagcattggaaaagctctacatcaggtattcggagcaatatatggtgcagcatttagtggcgtatcatggacgatgaaaatattaattggtgtcgtaatcacgtggattgggatgaactctaggagtacctcactgagcgtatcgttagtacttgtgggagtagtcaccctttatcttggtgtgatggtccaagcggatagcggttgtgtagtctcttggaaaaacaaagaacttaaatgtggatcgggtatcttcattactgataatgtccatacctggaccgaacagtataaattccagcccgaaagcccttcaaaattagcaagtgcaatacaaaaggcacatgaagaagggatctgtggtattagaagtgtaacgcgactggaaaaccttatgtggaaacaaataactcccgagcttaatcatatcttaactgaaaatgaagttaagctaacaataatgactggcgatataaaaggtataatgcaggcagggaaaagaagtctaaggccgcagcccactgaattaaaatattcatggaaagcatggggaaaagccaaaatgctatcgacggagcttcacaaccacacgttcttaattgatgggccagaaacagcagaatgtccaaatacaaatagagcatggaacagtcttgaagtagaagattatggttttggcgtgtttactaccaatatatggttaaagctaaaagaacgtcaagacgtcttctgtgatagtaaacttatgagtgccgccattaaggacaatagagccgtacatgctgatatgggttactggatcgaaagtgcattaaatgatacttggaagatagagaaggcatcattcatcgaagtgaaatcgtgccattggccgaaaagtcacacgctatggtccaacggcgtacttgaaagcgaaatgataattcccaaaaattttgcaggtcctgtctcacaacataattataggccaggataccatacgcaaactgctggaccgtggcatctcggaagactagaaatggactttgatttctgcgaaggaacaacagtagtagttactgaagactgtggaaatagaggaccgtcacttcgcactacaaccgcttccggtaagttaattactgagtggtgctgcagaagctgtacactaccgccactaagatatagaggcgaagatggttgctggtatgggatggagataagacctctgaaggagaaagaagagaacttagttaatagcttagttactgcaggacatggtcaaattgacaacttctcactcggggtattaggtatggcactcttcttagaagaaatgctccgaaccagagtaggaacaaagcacgccatactgctcgttgctgttagttttgttactctaataacaggtaatatgagttttagagatttaggacgggtaatggttatggtaggagccacaatgaccgatgatattggaatgggagtcacatacttagcattattagcagcgtttaaagtaagacctactttcgccgcagggttattgttaaggaagttaacttcaaaagagcttatgatgacgactataggcattgttttattgtcacaatccactatacccgaatcaatcctggagttaactgacgcactcgcgcttggtatgatggtgttaaaaatagtaaggaatatggagaaatatcagttggccgttacaataatggcaattctctgcgtacctaatgctgtgatcctccaaaacgcgtggaaggtaagctgcaccaccttagctgttgttagcgtaagtccactattgttaacatctagtcaacaaaaagcagattggattcccctcgctctaactataaaaggcctaaaccccactgcgatatttttaacaactctgtctcgaacgtcgaagaagagatcgtggccactaaatgaagcaattatggcagttggtatggtgagtatactcgctagctccctactgaaaaatgacattccaatgacgggaccgctagtagccggtggactattgacggtatgttacgtgttaaccgggcgaagtgcggacctagaactcgaacgagcagctgacgtgaggtgggaagaacaagctgaaattagtggatcatcaccaatcctaagcataacaatcagtgaagatggttctatgtccatcaaaaatgaagaggaagaacagaccttaacaattctaatacgtaccggcttgcttgtaatctcaggcctatttcctgtgtcaattcccataactgcagcagcttggtacttatgggaagtcaagaaacaacgcgctggagtcttatgggatgtgcccagcccgcccccggttggaaaagctgagctagaagacggagcatatagaatcaaacagaaaggaatccttggctactcccaaatcggagccggtgtatataaagaaggaacgttccatacaatgtggcatgttacaagaggagctgtcctaatgcacaaaggaaagagaattgagccctcatgggctgatgtcaagaaagacctaataagctacggaggaggatggaaactcgaaggggaatggaaggaaggcgaagaagttcaagtactagccttagaacctggaaagaacccaagggctgtccagacaaaacctggtctatttaagacaaataccggtactatcggagcagtaagtttagatttcagcccgggcacttcaggaagcccaatcgttgataagaaaggaaaggtagtaggtttgtacggaaacggagtggttactcgatccggaacgtacgtctcagcgatagcacaaaccgaaaaatcaattgaggataatccagaaatagaggatgacatattccgtaagaaaagactaacaatcatggacctacatcctggggcaggcaaaactaaaaggtatttgccagcaattgtacgtgaagccattaaaagaggactcagaactctaattctagcccctacacgggtagtggctgcagaaatggaagaagctctaagaggtttacccatcagatatcaaacgccagcgatccgagccgaacacactggtagagagatagtagatttaatgtgccacgcaacctttacaatgcgcctcctttcgccaattcgtgtaccaaactacaatctaattataatggacgaggctcatttcaccgacccagcatctatagcagcccgagggtacatatcaacaagagtggaaatgggggaagcggccgggatttttatgacagccacaccacctgggtctagggatccattcccccagagtaacgcacccataatggatgaggaaagagaaattcccgagagaagttggaactctggccatgaatgggtcacagacttcaaaggaaaaacagtatggttcgtacccagtataaaagcaggtaatgacatcgcagcatgtcttcgtaaaaacggtaagaaagttatccaactctctcggaaaacctttgacagcgaatatataaaaactcgtaccaatgattgggattttgtagtaaccacagatatttcggaaatgggagcgaacttcaaagcagaacgagtaattgaccctcgtcgatgtatgaaacctgtgatacttaccgacggtgaagaaagggtgattttagctggacccatgcctgttacacacagctctgccgcccagagaagaggcagggtaggcagaaaccctaaaaatgaaaatgaccaatatatctacatgggtgaaccgctagagaatgatgaagattgcgctcattggaaagaagcgaaaatgttgctcgacaatataaatactccggaaggaataataccttccatgttcgaaccagaacgtgaaaaggtagatgctatcgacggagaatacaggctgagaggtgaggctagaaagacgtttgtagatttaatgagacggggtgatctacccgtttggcttgcctatcgtgtagccgctgaaggtataaattacgcggatagacgatggtgctttgacggagtcaaaaataatcaaattcttgaagaaaatgtagaagtggagatatggacgaaggaaggggaaaggaagaaactaaagcctagatggttggatgcaagaatctatagcgacccccttgctttgaaagaatttaaggaatttgcagcaggcaggaaaagccttacacttaatttaataacagaaatgggacgtctgccgacatttatgacgcaaaaagccaaaaacgctctagataatctagcagtcttgcatacggcggaagcaggaggtagagcatacaaccatgctctctctgaattacccgagactctagaaacactcctacttttaacgttattggcaacagtaacaggaggtatatttctctttttaatgagcggcaagggtatcggtaaaatgacattagggatgtgttgcatcattaccgccagtatactcttatggtacgctcaaatccaaccacattggatagcggccagcattattttagagttctttctcattgttttactaataccggagccagaaaaacaacgaaccccgcaggacaatcaactcacctacgtagtcatagcaatattaactgttgtcgctgcaactatggctaatgaaatggggtttttggagaaaaccaagaaagattttggattgggttccataacgactcaacaacccgaaagtaacatcttggacatcgatttgagacccgcgtcagcatggacgttatatgccgttgcaacgacttttatcacgcccatgttacgacacagtatagaaaacagttcggtaaatgtatcgctaaccgctattgcaaatcaagctacagtactgatgggattgggaaaaggatggccactctcaaagatggatataggcgtacccctgttagctataggttgttacagtcaagtcaatccgatcactttaacagcagccctgcttctccttgttgcccattatgcaatcataggaccaggcttacaagcaaaagcaactcgtgaagctcagaaaagagcagcagcgggaatcatgaaaaatcccacggtagacggaatgacagtaattgatttagacccaatcccatacgaccccaagttcgaaaaacaactgggacaggttatgttattagtcctatgtgttacacaagttttgatgatgaggacaacttgggccttgtgcgaggcgcttacacttgcgactggaccgatctcaacattatgggagggaaatccaggacggttttggaatactactatcgccgtaagtatggccaatatttttcgcggaagttatctagcaggcgccggattactcttttcaatcatgaaaaacacagctaatacgcgaagaggaacaggtaatacaggggaaacacttggggagaaatggaagaatcgtctcaatgcgcttggaaagtcagaatttcagatatacaagaaatcaggaatccaagaagttgaccgaactctagctaaagaaggaattaagaggggtgagaccgatcatcatgctgtttcacgaggttccgcaaaactacgatggtttgtcgaacgcaatctagttactccagagggaaaagtcgtagaccttggctgtggacggggtggttggtcttactattgcggaggtttaaagaatgttaaggaggttaaaggattgactaaaggcggcccgggacatgaggaaccaatacccatgtctacatacggatggaatttagtgagactgcaaagcggtgttgacgttttcttcactccgccggaaaaatgtgatacattattatgtgatataggggaatcctcacctaacccaacagtagaagctggaaggaccttacgcgtgttaaatcttgtggagaattggttaaacaacaacactcaattctgtattaaggttcttaacccatatatgccttcagtaattgagaaaatggaagcacttcaaagaaagtacggcggtgcgcttgttaggaaccctttatcccgtaattcaacccatgaaatgtactgggtaagcaacgcaagtggaaatatagtttcttctgtcaatatgataagcaggatgctcatcaatagatttacaatgagacataagaaagcaacatacgagccagacgtcgacctagggagcggcactcgaaacatagggattgaatcagaaacacctaatttagacatcatagggaaaaggattgagaaaattaaacaagaacatgaaacaagttggcattacgatcaagatcacccttataaaacgtgggcatatcatggcagttacgaaactaagcagaccggcagcgcctcctcaatggtaaacggggtagttcgacttttgacaaaaccttgggacgtaataccgatggttacgcaaatggccatgaccgacacaacccctttcggtcaacaacgtgtgtttaaagaaaaagttgatacacggacgcaagaaccaaaagaaggaacaaagaaattgatgaaaataactgcagaatggctttggaaagaacttggtaaaaagaaaaccccaaggatgtgcactcgtgaagagtttacgaggaaagtccggtcaaatgcggccctaggtgcaatttttactgatgaaaacaaatggaaatcagcacgtgaagcagtagaggacagtggtttctgggaattagtagacaaagaaaggaatcttcaccttgaggggaaatgtgaaacgtgcgtatacaatatgatgggaaagagagaaaagaaactaggagagttcggtaaagctaaaggttcacgcgccatttggtacatgtggttgggtgctagatttttagaatttgaagcgttggggtttctaaatgaggatcattggttcagcagagaaaattcattgtcaggagtagaaggtgagggacttcataaattaggttatatactacgggatgtcagcaagaaagaaggtggagcgatgtatgccgatgacactgctggttgggacactaggataacattagaggatctgaaaaacgaggaaatggttactaaccatatggagggtgagcacaaaaagttagctgaagcgattttcaagttaacataccagaataaggttgtaagagtccaacgaccaacaccacgaggcacagtaatggatatcatttcacgcagggatcagcgaggaagcgggcaagttgtgacgtacggcttaaatacgttcaccaatatggaagcgcagctaatacgacaaatggaaggagaaggagtctttaaatcaatacaacaacttactgtcaaggaagaaatagcggtcaagaactggttaatcagagtcggacgagaaagactatcccgaatggcgatcagtggagacgattgcgttgtaaaaccactcgatgataggtttgcctcagcactgacagccttaaacgatatgggtaaggtaagaaaagatattcagcaatgggagccatcacgaggctggaatgattggacacaagttccattttgtagccatcatttccatgaattaattatgaaggacggtcgcgtattagtggtaccttgcagaaaccaggatgaactaataggacgcgcaagaattagtcagggagctggatggtccctaagagaaaccgcatgtttgggaaaaagctacgcacagatgtggtcactcatgtactttcatcgaagagatttaagattagcggcaaacgcaatttgtagtgccgttccctcgcactgggtgccaacgagtcgtacaacctggagtattcatgcaacacacgaatggatgactacagaggacatgctaactgtatggaatcgcgtatggatccaagaaaatccctggatggaagacaaaacgccagtggaatcttgggaagaaatcccatatttaggaaagagagaagatcagtggtgtggatccttaattggactaacatctcgagccacgtgggccaaaaacatacaaaccgcaatcaatcaagtgcggtcattaatcggtaacgaagagtatactgattacatgccttctatgaaaaggtttcgccgtgaggaagaggaagcaggggtactctggtga

SEQ ID NO: 22877 - RNA, 9876 nt, synthetic construct
  misc_feature 1..9876: note = derived and/or modified CDS sequence (opt6) from DENV-2__GU370050__SS-prME
  source 1..9876: mol_type = other RNA
acagcagggatcattataatgatgattccaactgtaatggcatttcaccttacaacacgaaatggagaacctcacatgattgtttcaagacaggaaaaaggtaaatcgcttttatttaaaacagaaaatggagtaaacatgtgcactttaatggctatggacttgggagaattatgtgaagacactataacctataactgtcctttactcagacaaaatgaacccgaagacatagattgttggtgcaattcaacatcaacttgggtgacatacggaacatgtacagcaacgggagaacaccgacgtgagaaaagatctgttgctttggttccccacgttggaatgggcctggaaacaagaactgaaacctggatgagctctgaaggggcttggaaacatgcacaacgcatcgaaacatggatcttgaggcaccctggttttacaatcatggcagcaattctagcgtatacgataggaacgacctacttccagcgggtattaatttttattttattaaccgcagtcaccccaagtatggccatgagatgtatagggatcagcaatcgcgactttgttgaaggagtatctggaggaagttgggtagatatagtgttggaacatgggtcgtgtgtaaccactatggctaaaaataaacctacactcgacttcgaacttattaaaacggaagctaaacacccagcgaccctcagaaaatactgtgtagaagcgaaactgacaaacactacaacggcaagccgatgccccacgcaaggggaaccgagcttaaacgaagaacaagataagcgctttgtatgtaaacattctatggtagacaggggttggggtaacggatgtggtcttttcggaaaaggaggaatagtaacctgtgctatgttcacctgtaagaaaaatatggaaggtaaggttgtgcaacctgaaaacttagaatataccatagtaataacaccacactcgggagaagaaaatgcagtcggaaacgatactggaaaacacggaaaagaaataaaggttactccacaatcaagtataactgaagcagaactaacaggatatggaacagtaactatggagtgcagccctaggactgggctcgactttaacgaaatggtactcttacaaatggaaaataaggcatggttagttcacaggcaatggtttcttgatcttcccttaccgtggctaccaggagccgacacgcagggtagcaattggatacaaaaagagacattagttacatttaaaaatccacacgcaaagaaacaggatgtagtggtgctaggaagtcaagaaggagccatgcacacagcacttacgggcgctacagaaatacaaatgagtagtggcaatttgttattcacaggtcatttgaaatgccgcctgcgaatggacaaactacaattgaagggcatgtcatactcaatgtgtacggggaaatttaaagtggtaaaagagatcgcagaaactcaacatggcacaatagttatccgagttcaatatgaaggagatggctcgccatgtaagataccattcgaaataatggacctagagaaaagacatgtgcttggtaggttaataaccgttaatccaatcgtaacggaaaaagattctccggtcaacatagaggcagagccaccattcggagacagttatattataatcggagttgaacccggtcagttaaaattaagttggtttaaaaagggatcatctatcggccaaatgttcgaaactacaatgcgaggtgccaaacgaatggctattttaggcgacaccgcatgggatttcggaagccttggcggcgtattcacgtcaataggaaaagcattgcaccaagtattcggagcaatatatggagcagcatttagcggagtatcgtggactatgaaaattctaattggggtagtcattacatggatcggtatgaacagtagaagcactagcttaagtgtgagcctggtacttgtcggagtggtaacattatatttaggtgtgatggtccaggcggacagtggatgcgtggtatcatggaaaaacaaggagctcaaatgtggaagtgggatcttcataacagataatgttcatacctggactgaacaatataaatttcaacctgaaagtccttcaaaacttgcgtccgcaatacagaaagctcacgaggaaggcatttgtggaattagaagtgttacacgattagaaaacctaatgtggaaacaaattacacctgaactgaatcatattttaacagaaaacgaagtaaagctcactataatgacaggagatataaaaggaatcatgcaagcgggcaaacgaagtttacgaccacaaccgaccgaactcaaatatagttggaaagcatggggaaaggctaagatgctatcaactgaattacacaaccatactttcttgatcgatggtccagagactgcagaatgtccaaacacgaatagagcatggaactcattagaagtagaagactacggatttggagtctttacgactaacatatggcttaaacttaaagagaggcaagatgtattttgtgattctaaattgatgtcggcagcgattaaagataatagagccgtacatgctgatatgggatattggatagaatccgctctgaacgacacgtggaaaattgaaaaggcatcatttatagaagttaaaagttgccattggcccaagtcccacacactatggtctaatggtgtcttagaaagtgaaatgataataccgaaaaatttcgcaggaccagtgagtcaacacaattatcgcccagggtaccatactcaaactgcaggtccttggcatctaggaagattagaaatggatttcgacttttgtgaagggacgacagtcgttgtaacagaagattgtggaaatagaggacccagtttaagaacaactaccgcaagcggtaagctaataaccgaatggtgttgtagatcatgtactttaccgcctctacgataccgcggagaggacggttgctggtatgggatggaaatacggccacttaaagagaaagaagagaacttagtaaacagcctagttactgcgggacatgggcaaatcgataatttctctttaggtgttctaggaatggcactgtttctggaagaaatgctacgaacaagagtgggaacgaaacatgcaattttattggtagcagtttcattcgttacattaattacgggaaatatgtccttcagggacttaggaagggtgatggtaatggttggagccacaatgacggacgacatcggcatgggtgtcacctatttagctttgttagcagcatttaaagtaagacccacatttgcggccggtcttctgttacggaaactaacttccaaggagctaatgatgaccacaataggaatagtactcttgtctcagtctactatcccagaaagcatcctagagcttacagatgcgttagcacttggaatgatggtacttaagattgtgaggaacatggaaaaataccaattggcagttacaattatggcaattctttgtgtccccaatgcagtcattctacagaatgcttggaaagtctcatgtaccacacttgcggttgtttcagtttctccccttttgttaacgagcagtcaacaaaaagcagactggattcccttggcacttaccattaaggggctgaatccaacagcgatttttctgacaaccttaagcaggacgtctaaaaagcgctcctggccattaaatgaagccattatggcggttggcatggtctcaatattagcatcatcgctcttgaaaaacgacattccaatgacagggccactggttgcgggtggacttttaactgtatgctatgtcttaaccggacgtagtgcagacctagaactggaacgagcagcggatgtgcgatgggaggaacaagctgaaatctcaggatcatcacccattttatcaatcacaataagtgaagatggaagcatgagtatcaaaaacgaggaagaagaacaaacattgacaatcctaatcagaactggactgttggttatctcagggctattccctgtatcgattcctattaccgcagcggcatggtatctttgggaggtaaagaaacaacgcgccggggtactatgggatgtaccaagccctcctccagtcgggaaggcggaattagaagatggagcatacagaataaaacaaaaaggtattttggggtatagtcaaatcggggccggagtctataaagaagggacgttccatacgatgtggcacgtcacccgtggagcagtgcttatgcataaaggtaaaaggattgaaccgtcatgggccgacgtcaagaaagatctaataagctatggtggaggctggaaactagagggggaatggaaggagggagaagaagtccaagtactagcgttggaaccaggcaaaaatcctcgagccgtgcaaacgaaaccaggtctcttcaagaccaacacgggcacgataggagctgtctcgctggacttttccccagggaccagtggatcgcctatagtagacaagaaaggcaaggtagtgggtttgtatggaaacggagtagtaactagatcagggacttatgtgtcagctatagcacaaacggaaaaatccatagaagacaatccagaaatagaagatgatattttcaggaagaaacgtctgacaataatggacttacatcccggcgctgggaaaacaaaacgatatttaccagctatagttagggaagcgataaaacgaggattaaggacccttattttagcacctacaagagtcgtagctgcagaaatggaagaagccctgagaggtctaccaatcagatatcaaacgccagcaatcagagcagaacatacaggaagagagattgtggatctcatgtgccatgctacatttactatgagattgttatcccctattagagttcctaattacaatttgataattatggatgaggctcactttacagatcccgctagcatagccgcaagaggttatataagtactagagtagaaatgggtgaggcagcaggtatatttatgactgctacgccgcctggaagtcgtgatccattcccccaaagcaatgcacctattatggatgaagaacgggaaatcccagagagatcatggaactcaggtcacgaatgggttactgacttcaaaggaaaaactgtttggtttgtaccttcgatcaaagctggaaacgatatagctgcttgtcttaggaaaaatggcaagaaagtaatacaactcagccgtaagaccttcgactctgagtacattaaaactagaacgaacgattgggactttgtagttactacggatataagtgaaatgggtgcgaatttcaaagctgaaagggtaatcgatccaaggcgatgcatgaagccagtaatattaaccgatggggaagaaagggttatacttgctggtccaatgcccgtaacacattcgtcagcggcacaaagacggggtagagtagggcgaaaccctaaaaatgaaaatgatcaatatatttatatgggtgagcctttggagaatgacgaagattgtgctcactggaaagaagcaaaaatgttacttgacaatatcaataccccagaaggcataattccttccatgttcgaacccgaacgagaaaaagtggacgccatagatggcgaatacaggttacggggtgaagcaaggaaaaccttcgtggacctaatgagacgaggagacttaccggtttggctcgcttatcgggtagctgccgaaggaattaattacgcggacaggagatggtgtttcgatggagtcaaaaataaccaaatactcgaagaaaatgtagaggtagaaatatggacaaaagaaggagaaagaaagaaacttaaacctagatggctagatgctcgaatatattcggatccacttgcacttaaagagttcaaagagttcgctgctggacgcaaatcattgaccttaaatctaattaccgagatgggtagactaccaacgtttatgactcaaaaggccaaaaacgccctcgacaatctagcagtactacatacagcagaggccggaggacgagcgtataatcatgctctgagcgaactaccagaaacgctcgagacactactactactaacacttttggcaacagtcaccggaggtatcttcctctttcttatgagcggaaagggaatcggtaaaatgaccttaggtatgtgttgcattattacagcaagcatactcctttggtatgcacaaatccaacctcactggatcgccgcgtcaattattctagagttcttcttaatagtcctgttgataccggagcctgaaaaacaaagaacaccacaggataaccaactcacatacgtagtcattgctatacttactgtagtagcggctactatggccaatgaaatgggatttcttgagaaaacaaagaaagactttggactcggaagcataacaacacaacagccagaatcaaatattctcgacatcgatctaagacctgctagcgcatggacattgtacgcggtagctactacgttcattacgcctattttaagacactcaattgaaaattcttctgtaaacgtttcactaaccgcgatagctaatcaagcgacggttttgatgggactaggaaaaggatggcctctatcaaaaatggacattggagtaccattattggcgatcggctgttattctcaagtcaatcctataactttaacagcggctttacttctattagtagctcattatgcaattataggacccggattacaagcaaaggcaacccgagaagctcagaaaagagcagcggctgggataatgaagaatcccacggtcgatggaatgacagtcatagacttggatccgatcccatatgatcctaaatttgaaaaacagctaggccaagtcatgctattagttctttgtgttactcaagtactcatgatgcgtacaacgtgggctctatgtgaggccttaacattggcaactgggccaatttcaactctatgggagggcaatccaggccgtttttggaacactactatagcggtttcaatggctaacatattccgcggatcatatcttgctggggcaggactgttgttttctatcatgaaaaacacggctaatacgagaagaggtactggaaacacaggagaaactcttggagaaaaatggaaaaataggctaaatgcattgggcaaatctgaatttcagatatataaaaagagtggaatccaagaggttgatagaaccctggccaaagaaggtattaaaaggggagaaacagatcaccacgcagtttctcgaggtagtgcaaaactcagatggttcgttgaaaggaatcttgtaactccagaggggaaagttgtcgatctgggttgcggcaggggaggatggtcgtactattgcggagggttgaaaaatgtaaaggaagtgaaaggattaacaaaaggaggtccgggtcatgaggaaccaatacccatgtcaacttacgggtggaatttggtcagattgcaatcgggtgttgatgtcttctttacacccccggaaaagtgcgatacccttctatgtgatataggtgaaagttctccaaaccctactgtagaagccggacgaactttgagagttcttaatctggtcgaaaattggctaaataacaacacacaattttgtatcaaagtcttaaatccatatatgccatcggtgattgagaagatggaggcgttacaaagaaagtatggaggtgcattagtccgtaacccactgtcaagaaattccacgcatgaaatgtattgggtcagtaacgccagtggcaatatagtttcatctgtgaatatgataagtagaatgctgataaatagattcactatgcgtcataaaaaggcgacttacgaaccagatgtagacctcgggagcggtactaggaacataggcatagaatctgagacgcccaatttggatatcattggaaaacggattgagaaaattaaacaagaacacaaaacctcttggcattatgatcaagatcacccttataaaacatgggcgtaccacgggtcttacgaaactaagcagacagggtccgcaagcagtatggttaacggggttgtccgactacttacaaagccttgggatgtaatacccatggtgactcaaatggcgatgacggacactacgccatttggacaacaaagagtattcaaagaaaaggttgatactcggacacaagagccaaaggagggaaccaagaaactaatgaagataacagcagaatggctgtggaaagaattaggtaagaagaaaactcccagaatgtgtaccagagaagagttcaccagaaaagtgagatccaatgcagctttgggagcgatatttacagacgaaaataaatggaagtcggcccgtgaggccgttgaagattccggattttgggagttagtagacaaggagagaaatctacacttagaagggaagtgcgaaacttgcgtatataacatgatgggaaaaagagagaagaaactaggagagttcggaaaagcaaaggggtctcgggcaatatggtacatgtggcttggagctagattcttagaatttgaggcattaggattcctaaatgaggatcattggtttagcagggaaaactctttaagtggcgtcgaaggagagggcctacataaattaggttatatattgagagacgtgtcgaagaaagaaggaggggcgatgtacgcagacgatacagctggctgggatacaagaataacccttgaggatctcaaaaatgaagagatggtaactaaccacatggaaggtgaacataaaaagttagcagaggcgatctttaggctgacttatcagaacaaagtagttcgtgtacaaagaccaacccccagaggaaccgtaatggatataatcagtaggcgagatcaacgcgggagtggtcaagtggtaacatatggattaaatacttttaccaatatggaagcgcaactgataaggcaaatggagggtgaaggtgtttttaaatctatacaacaactcaccgtcaaagaagaaatagcagtcaaaaactggctaataagagtagggagagaaagattatcacgtatggcaatctcaggagatgattgtgtagtgaaaccgttggatgatagatttgcgtcggcactaacagccttaaatgacatgggtaaagtgagaaaagatattcaacaatgggagccatcgagggggtggaatgattggacacaagtaccattttgctctcaccatttccatgaactcataatgaaagatggacgtgttttagtagttccttgccgaaaccaagatgagctaattggacgagctagaatttcccaaggtgctggctggagcttaagagagacagcatgtctaggtaaatcatatgcgcagatgtggagccttatgtacttccatcgacgggacctacgtttagcagccaatgcaatttgttccgcagttccgagccactgggtaccgacttcaagaaccacttggagcatccacgctacccacgaatggatgacaacagaggacatgttgactgtatggaatagagtatggatccaagaaaatccctggatggaggacaaaacgccagtggaatcatgggaggagataccttatctaggcaagcgagaggatcaatggtgtggatccttaatcggtttaacatccagagctacctgggccaaaaatatacaaacagctattaatcaggtaagatcactaattggaaacgaagaatatactgattatatgcccagtatgaagcggtttcggagggaggaagaggaggcaggcgtactatggtaa

SEQ ID NO: 22878 - RNA, 9876 nt, synthetic construct
  misc_feature 1..9876: note = derived and/or modified CDS sequence (opt6) from DENV-2__JN851129__SS-prME
  source 1..9876: mol_type = other RNA
acagcaggaattattataatgatgataccaacagtcatggcattccatctaacaacaagaaacggggaaccccatatgatagtatcaaggcaagaaaaaggaaaaagtttactcttcaaaacagaaaatggagttaatatgtgtacattgatggctatggacttgggagaactatgtgaagatacaataacgtacaattgcccgctgctccgccaaaacgaacccgaagacatagactgctggtgtaactcgacgtctacatgggtaacatatggaacgtgtacggcaacaggagaacaccgacgcgagaaacgaagtgtcgcactcgttcctcacgtaggaatgggattagaaaccagaacagaaacgtggatgtcaagcgagggggcatggaaacatgcacagcgcatcgaaacatgggttttaagacacccaggattcacaattatggctgcaatacttgcatatacaatcggaaccacatatttccaaagggtattaatattcatcttactaacggcagtagcaccaagtatgaccatgcgctgcatcggaatcagtaaccgggactttgtagaaggtgtatctggaggctcatgggtagacattgtcctagaacacggaagttgtgttaccacaatggccaaaaataaaccaaccttagatttcgagttaattaaaacagaagcaaaacaccctgcaactctacggaaatattgcattgaggctaaattaacaaataccacaactgcttctagatgtccgacccagggtgaaccatccctgtccgaggagcaagataaacgttttgtatgcaaacattcaatggttgacaggggatggggaaacgggtgtggcttgtttgggaaaggaggtattgtaacatgtgcaatgtttacatgtaagaaaaatatggaaggaaaagtggtacaaccagaaaatcttgaatatacaattgtgatcacaccgcactcgggagaagaaaatgcagtcggtaatgatactggtaaacacggtaaagagatcaaagttactcctcagtccagcataaccgaagctgaattgactggatacggcacagttactatggaatgttcaccccgcactggtttggattttaatgagatggttctcttacaaatggaaaacaaagcatggttagtacatagacaatggtttctggatttaccattaccatggctaccaggtgccgatacccaaggttcaaattggatacaaaaagaaacactggtcacgtttaaaaatccccatgcaaagaaacaagatgttgttgtcttgggcagtcaagagggagctatgcatacagccctcacgggcgcaactgagattcagatgagtagtgggaatttgctgttcactgggcatctaaaatgcagattacggatggataaactacaactaaaaggaatgagttattccatgtgtacaggtaaattcaaagttgtaaaagaaattgcagaaacacaacatggaacaattgttattcgagtacaatacgagggggatggctcaccttgcaaaatcccctttgaaataatggatttagagaaacgtcatgttcttggcagactcattaccgtgaatcccatagttacagagaaagattcacctgttaatatagaggcagaaccgccctttggtgattcatacataattataggcgtggagccgggccaactaaaactatcttggtttaaaaagggctcatccattggacaaatgtttgagaccacaatgagaggagcaaagagaatggcaattctcggggatacagcctgggatttcggaagtctgggaggagtctttacgtcgattgggaaagcacttcatcaagtcttcggagctatttacggtgctgctttctcgggtgtctcttggaccatgaaaatcctcataggtgtagtcatcacatggataggaatgaatagtcgtagtacaagtctgagcgttagcctagtattagttggtgtagtgaccttgtaccttggtgtcatggttcaggctgattcaggatgcgttgtatcatggaaaaacaaagagcttaaatgtggatcaggtatttttatcaccgacaacgtccatacttggacagagcaatataagttccaacctgaatcaccatcaaaactagcgagcgctatacaaaaagcacacgaagagggcatatgtggcattcgttcagttacccgcttggagaatttgatgtggaaacaaataacacctgaattaaatcacatactatcagaaaacgaagttaaactgacaattatgacgggtgacatcaaaggaattatgcaagcgggtaaaaggagtctcaggccccaacctacggagctaaaatatagttggaaggcttggggtaaagctaaaatgttgtcaaccgaactacacaatcatacgtttctcattgatggaccagaaacggcagaatgtcctaatactaaccgggcatggaactcattagaagtagaagactatggtttcggagtttttacaacaaatttatggcttaagctgaaggaaaggcaagacgtattttgcgatagtaaattaatgtcggcagctataaaagataaccgggccgttcacgcagatatggggtactggatcgaaagtgctttaaatgatacctggaagattgagaaagcaagtttcatagaagtaaaatcttgtcattggccaaaaagccacacattgtggtcgaacggggtattggagtccgaaatgataatacccaaatcttttgcaggcccagtatcccaacataactaccgaccgggatatcatactcaaaccgcggggccttggcacctaggtagactagagatggatttcgacttctgtgagggaactaccgtcgttgttacagaagattgcggcaatagaggcccatcactgagaacaactacggcttcgggtaaactaattacagaatggtgctgtagatcttgcacgttgcctccactaagatatagaggggaagacggatgttggtacggcatggaaatacgcccgttaaaagaaaaagaggaaaacctagttaatagtctagttacggccgggcatggacaaatcgataatttttccttgggagtgttaggaatggctttattcctagaagaaatgctcagaactagagtgggaactaagcatgctatacttctagtagcagtctctttcgttacgttaataacaggaaacatgtcatttagagatctaggaagagtaatggttatggtcggtgctacaatgactgacgatataggcatgggggttacgtatctagccttgttggctgcttttaaagttagacctaccttcgcagcaggcttattactaagaaaactcacatcaaaagaacttatgatgacaactataggcatagtcttactttcccaaagcacgatacctgaaacaatattagaactgactgatgccctagcacttggaatgatggtactcaaaatcgtaaggaatatggagaaatatcaattagctgtaacgattatggctatactatgtgtaccaaatgccgttatattacaaaacgcgtggaaggtttcatgtaccacccttgccgtcgtatccgtgtcaccattgctattgacatccagtcagcagaaagccgattggataccgttggctctaacaataaaaggtcttaatccaacagcaatctttctaactacactatctcgcacaagtaagaaaagaagctggccacttaatgaggctataatggcggtaggcatggtgagtattcttgcatcaagtcttcttaagaacgatattcccatgacaggacccttagtagccggagggctactaacagtctgctacgtactgacaggaagatctgcagacctagagctagagcgtgccgctgatgtcagatgggaggaacaagccgaaatatccggatcatcacctatcttgagcatcacaataagcgaagacggatccatgagtatcaaaaatgaagaagaggaacaaacattaacaatattaattaggacaggcctgctggttattagcggtttattccccgtctctataccgataacggcagctgcatggtatttatgggaagtcaagaaacaacgagcaggagtattatgggatgtaccatcaccgcccccggtaggaaaagccgaattggaagacggtgcctatagaataaaacagaaaggcatattgggatactcccaaatcggagcaggagtttacaaagaaggaacattccatacaatgtggcacgtaactaggggagctgtattgatgcataaaggaaaaaggatcgagccgtcatgggcggacgtaaagaaagatttgatctcatacggtgggggatggaaacttgagggggaatggaaggaaggggaggaagtacaagttcttgccctagaaccgggtaaaaaccctagagctgtacaaactaagccaggattatttaaaaccaacaccggaaccattggagctgtcagtctggactttagccccggaacatcagggtcacccatagtggataagaaaggcaaggtcgtcggcctctatgggaacggagtagtcactagatcaggaacgtatgtatccgcaatcgctcaaactgagaaaagtatagaagacaatccagagatagaagatgatatttttagaaagaagagacttacgattatggatctgcacccaggagcaggtaaaactaaaagataccttccagctatagtacgagaagcaataaaaagaggattaagaacactaatcttagcccccacacgtgttgtagctgccgagatggaagaggcattaaggggtctgcctatacgttaccaaacaccagccataagggcagaacacacgggaagagaaatagtagatttaatgtgccatgcaacctttacaatgagactgttaagtccaatccgagtaccaaactacaacttaataataatggacgaagcacactttactgatccagcttcaatagcagctcgaggatacatcagcacaagagtagaaatgggtgaagccgctggtatattcatgactgcgacgccacctggttcaagggacccattccctcagagtaacgcccctattatggacgaagaacgggaaataccagaacgcagttggaacagtggtcatgaatgggtaacagattttaaaggaaaaactgtctggttcgtaccgtcaatcaaagcaggtaatgacattgcagcgtgtttgaggaaaaacggcaagaaagtaatccagctgtcgaggaaaacattcgattctgaatacataaagactaggactaacgactgggattttgtagtaacaacggacatttccgaaatgggagcaaattttaaggcagaacgggtaatagatcctagaaggtgcatgaaaccagttatactaaccgatggcgaagaacgcgtgattctcgctggacctatgcctgttactcatagtagtgctgctcaaagacgaggaagggtaggtcgtaatcccaaaaatgaaaatgatcaatacatttacatgggtgaacccttggagaacgacgaggactgtgcccactggaaagaggcgaaaatgctattagataacatcaacactccagaaggcataataccttcaatgtttgaaccggagcgtgagaaggtagatgcgatagatggagagtacagactacgtggtgaagctagaaagacattcgtagatttaatgagaaggggtgatctacctgtatggctagcttatcgagtagcagcggaaggaattaattatgcagatagaagatggtgctttgatggaataaagaataatcaaatattagaagagaatgtcgaggttgaaatatggactaaagaaggtgagagaaagaaactaaaacctcgatggctggatgcgcgaatttattctgatccattggcactaaaagaatttaaagagtttgctgcgggcaggaaatccttgacactgaacctaataaccgagatgggtagattgccaacgtttatgacacaaaaagcccgtaatgcgctagataatctagcggtattacataccgcggaggcgggaggcagagcatacaatcacgccctatcagaacttccagaaacactagaaacccttttattacttacattacttgcaacggtgactggaggaatcttcctgtttttaatgagtggcaaaggaatagggaaaatgaccttgggtatgtgctgtatcataacagcatctatacttctatggtacgcacaaatacaaccccattggattgcggcaagtataatacttgagttctttctaatagtattactgattccggagccagaaaaacaaagaacaccacaagataatcaactgacgtacgtagtcatagccattttaacagtagtagctgctacaatggctaatgagatgggattccttgagaaaactaagaaagactttggactgggatctattacaactcaacagcccgaatcaaatatactagatatagacttaagaccggccagtgcctggactctgtacgctgtagctactacctttataacgcccatgttacgacatagtatagaaaacagttcagtaaacgtctcgctaacggctatagccaaccaagcaaccgtcttaatgggtttagggaagggctggccgttaagtaagatggatataggagttccattactggcgatagggtgttattcacaggtaaatcctataacattaacggctgcacttcttctcctagttgcacattatgcaatcataggacctggactacaagcgaaggcgacccgagaagcacaaaaacgggccgcggctggcatcatgaagaacccgaccgtcgatgggataaccgtaattgatctagatccgattccgtacgatccgaagtttgaaaaacaacttggacaagttatgttacttgtgctttgtgttacacaagtccttatgatgcggactacatgggcgttatgtgaagcgctaaccctagctaccggaccgataagtacattgtgggagggaaatccagggagattctggaatacaacaatagctgtatccatggcgaacatattcagaggcagctacctggctggtgcaggcctcctctttagtattatgaaaaacaccgcgaacacgaggcgaggtaccggtaacactggagagaccttaggtgaaaagtggaagaacaggctgaatgcattaggtaaatctgagttccaaatttataagaaatcaggcatacaagaagtcgaccgaactctggctaaggaaggaattaaacgcggagaaacagatcatcacgctgtgtcgcgaggttcagcaaagctgcggtggttcgtagaaagaaatttagtcacaccggagggaaaagtagtagacttagggtgtggtagaggaggttggtcatactactgtggaggcctaaagaatgtaaaagaagtaaagggattaacgaaaggaggcccaggacatgaagaacccatacccatgagcacgtatggttggaatttagttcgcctccaatccggtgtagatgtatttttcacaccccctgagaagtgtgacactctattatgtgatataggggaatcatcaccaaatccaacagtcgaagcaggaagaacactacgagtcctcaacttagtggaaaattggttaaacaacaacactcaattttgcatcaaagttcttaacccgtatatgccctcagtgatagagaaaatggaggctttacaacgtaaatacggaggagccttggtacgcaatccgttgtcacgtaacagcactcacgaaatgtactgggttagtaatgcgtcaggcaatatagtaagctcagtcaatatgatatcaagaatgcttatcaacaggttcactatgcgccataaaaaggcgacatatgagccagatgtagacctaggatcgggaacccgaaacatcggaatcgagtccgaaacaccaaacctggatattatagggaagaggattgagaaaattaaacaagagcacgagacctcatggcattatgaccaggatcatccatacaagacttgggcttaccacggctcatatgaaacaaaacaaacaggatctgcttcctcaatggtaaatggagtcgtaagattgctaactaagccttgggatataatacctatggtaactcaaatggccatgacggatacaacccctttcggacaacaacgagtattcaaagaaaaagtagacacaaggacccaggaacctaaagaagggaccaagaaactaatgaaaattacagcggaatggttatggaaagaacttggcaagaagaaaactcctagaatgtgcacacgtgaggaatttacacgcaaagtacgttctaatgcagcattaggtgcaatattcaccgacgaaaacaagtggaagagtgcaagagaagcagtcgaagatagtggattctgggaactggtagataaagaaagaaatctacatctggaaggcaagtgtgaaacatgcgtctataacatgatgggaaaaagagagaagaaattaggagagttcggcaaggctaaaggaagccgagctatttggtatatgtggctaggagcgcgatttttagagttcgaagcactcggatttctaaacgaagatcactggtttagccgggagaatagtttatcaggagtagaaggagagggactgcataaactcggatatatattgagagatgtaagcaagaaggaaggcggcgcaatgtacgcagatgatacagccggttgggatacacgaataacgttagaagatttgaaaaacgaggaaatggtgacaaatcatatggaaggagagcacaagaaactggcagaagcgatatttaaactaacgtatcaaaataaagtagtacgagtacaaaggcccactccgagaggtacagtcatggatatcattagtagaagggatcaaaggggttcaggacaagtagtaacatatggactaaatacgtttactaatatggaggctcagttgatacgccaaatggaaggcgagggtgtgtttaaaagtatacaacagctaaccgtcactgaagaaatcgcggtaaagaattggctagtacgagtgggacgtgaaagactcagtagaatggccatatcaggtgacgattgtgtagtgaaaccacttgacgaccgttttgcgagtgctttaaccgctttaaatgatatgggcaaagtaagaaaagacattcaacaatgggaaccatctcggggatggaatgattggacccaggtaccattctgctcgcatcactttcatgagctaattatgaaggatggtagagtattagttgtaccatgtaggaaccaagacgagttgataggacgcgcaagaattagtcaaggagcgggttggtctctacgcgaaactgcttgcttgggtaaaagttatgcccaaatgtggagcctgatgtacttccatagacgagatttacgtctagcagcaaacgcaatatgtagcgcagtaccaagccactgggtacccacatcacggaccacatggtccatccatgccacacacgaatggatgacgacagaagacatgttgactgtatggaatagagtctggattcaagaaaacccttggatggaagataagaccctagtggaatcctgggaagaaattccatatcttggaaaacgtgaagatcagtggtgcggatcgttgattggactaacaagtcgtgctacgtgggccaaaaatatccaaacagcaataaatcaggtaagatcactaatcggaaatgaagaatatactgattacatgccaagcatgaaaaggttcaggcgtgaagaagaagaagccggagtcttgtggtga

SEQ ID NO: 22879 - RNA, 9876 nt, synthetic construct
  misc_feature 1..9876: note = derived and/or modified CDS sequence (opt6) from DENV-2__JN851128__SS-prME
  source 1..9876: mol_type = other RNA
acagctggtattattataatgatgattcccactgttatggcttttcatttaacaactagaaatggagaaccccacatgattgtgtcaagacaagaaaaaggcaaatcattgctatttaaaactgaaaatggcgtaaatatgtgcaccttgatggcgatggacctcggtgaattgtgcgaagatacaattacctacaattgcccattactaagacagaatgaaccggaagacatcgactgctggtgtaattccacaagtacatgggtgacttacggaacctgcactgcgacaggtgaacataggagagagaaaaggtcagtggcgctggtaccgcatgtgggtatgggactagaaactaggacagaaacttggatgagctccgaaggcgcctggaaacacgcccagagaattgaaacctgggtgttaagacaccctggttttacaattatggctgctattctagcatatactataggcaccacatatttccaaagagtactcatttttatattgcttacagcagtagccccgtcaatgacaatgagatgcattggcataagtaatcgagatttcgttgaaggagtatccggtgggtcttgggtagacatagtcttagaacatggaagctgtgtgacaactatggcgaaaaacaaacctaccctcgatttcgaactgatcaaaacagaagccaatcacccggctacgttaagaaaatattgcatcgaagccaaacttacaaacactaccacagcatcacggtgcccgacacaaggcgaaccgagcctgagtgaagaacaagataaaagattcgtatgtaaacactccatggtcgacagaggatggggaaacgggtgcggactattcggtaaaggcggaatagtcacatgtgcaatgtttacatgtaagaaaaatatggaaggaaaagtcgtgcaacccgaaaacctagaatacaccattgttatcacacctcattcaggagaggaaaatgcagttggtaatgacactggaaaacatggtaaagaaataaaagtaacacctcaaagttctatcactgaggcagaactaaccgggtacggcacagtaaccatggaatgtagtccacgtacagggttggacttcaatgaaatggttcttcttcaaatggaaaataaagcctggttggttcacaggcaatggttcctagatttaccactaccctggttgcctggagcagatacgcaaggctctaattggatacagaaagagactctggtaacgttcaaaaatccacatgcgaagaaacaggatgtggtagtattaggtagccaggaaggcgccatgcatacggcacttaccggtgccactgagatacaaatgtctagcggaaatttactatttacaggtcaccttaaatgtagactgaggatggataaactacaactaaaagggatgagttattcaatgtgtacaggaaaattcaaagtagttaaagaaatcgctgaaacacagcacggtacgatagttatacgagtacaatatgaaggagatggaagtccctgtaaaataccattcgaaataatggacttagagaaaagacatgtgctaggacgattgataacagtgaatccaatagtgacagagaaagatagtcccgtgaatattgaagctgaaccacctttcggtgattcatatataataataggcgtagaacctggacaactaaaactatcttggttcaagaaaggatcgtcaatagggcaaatgtttgaaacaactatgagaggagcgaaaagaatggcgatactaggcgacacagcatgggactttggtagtttagggggcgtttttacatccattggtaaagcccttcaccaagtattcggagccatatacggagctgcgttctccggtgttagttggaccatgaaaatattaattggagtagtgatcacctggattggtatgaactcgagatcaacaagtctatccgtgagcctagtgttggtaggtgtggtaacattatatctgggcgtaatggtccaagctgactcagggtgcgttgtatcatggaaaaacaaagaacttaagtgcggtagcggaattttcattacagataatgtacatacatggacggaacagtataaatttcaaccagaatcacccagtaaattagcgagtgccatacaaaaagcacatgaagaagggatatgtggtattagaagtgtgacaagattagaaaatctaatgtggaaacaaataacacctgaactaaatcacatactttctgagaacgaagtaaaattaacaattatgacaggcgacattaaaggcataatgcaggccggaaaacgttctcttagaccgcaaccaacagagctaaaatactcttggaaagcatgggggaaagctaagatgcttagcacagaattacacaaccatacatttctcatagatgggcctgagactgctgaatgtccaaacacaaatcgagcttggaatagcctagaagtagaagattacggatttggggtgttcactacaaacctgtggctaaaacttaaagaacgacaagacgtattttgtgactcaaagctcatgagtgcagcaataaaggataacagagcagtacatgcagacatgggttattggattgagtcagcaatcaacgatacatggaaaatagaaaaagccagttttatcgaggtcaaaagctgtcattggccaaagtcacatacactatggtcaaacggggtattagaatcggagatgataattccgaaaaactttgccggaccggtatcgcaacataattacagaccaggttaccatactcagactgccggtccatggcatttaggaaggttggaaatggattttgacttttgcgaaggtacaacggttgtagtcaccgaggactgcggaaacagaggaccctccttacgaactacaaccgcaagtgggaaactcataactgagtggtgctgccggagttgtaccctaccacccctgagatacaggggtgaagacggctgctggtatggtatggaaattcgacctctaaaagaaaaggaagaaaacctagtcaacagtctagtaacagcaggacacggccaaattgacaatttttcacttggcgtattaggcatggcgttatttctcgaagaaatgctaaggacccgagtcggaacgaaacatgctattcttttagtagcagtttcttttgtcacacttattaccggcaatatgtctttccgagacctagggagggttatggttatggtaggggctaccatgaccgatgacattggaatgggagtcacttatctagctcttttggcagcatttaaagtaaggcctacgtttgcagctggattactactaagaaaattaacatcaaaagaattaatgatgactacaataggtatagtccttctatcacaaagtaccataccggagacaatacttgaattgacagacgcactagccttaggaatgatgatcctcaaaattgtacgcaatatggaaaaatatcaactagctgtaacaatcatggctattttgtgtgttccgaacgctgtaatactacaaaatgcttggaaggtctcatgtacgactcttgccgtcgtatctgtatcacccttattattaacatcgtcacaacaaaaggctgattggataccgctagctctaactataaaaggtttaaatcccaccgcaatttttctaacaacgttaagcagaacaagtaagaaaaggagttggccactaaatgaagcaatcatggctgtaggtatggttagcatccttgcctcaagcctcctgaaaaatgacattccgatgacaggacccctagtggctggtggcctccttactgtatgttacgtcctcacaggaagaagtgctgatctcgaattagaaagagcagccgatgtacggtgggaagaacaagctgagataagtgggtcatctcctatcctaagcataaccataagcgaagacggttcaatgtcaattaaaaatgaggaggaggaacagacactaactatacttatcaggactggactcttagtaattagtgggcttttccccgtaagtattccaataaccgcagcggcctggtacttatgggaagtcaagaaacaaagggctggcgtcctatgggacgtgccctcgcccccaccggtagggaaagccgaattagaagatggagcctatagaataaaacaaaaaggaatactaggatattcgcaaattggtgcaggcgtctataaagagggaacatttcatacgatgtggcatgtgactagaggtgcagtactaatgcacaaaggtaaacgaatagaaccttcatgggcagacgtgaagaaagatctgatcagctatgggggcggatggaaactcgagggggaatggaaagaaggagaggaggtgcaagtgctggctttagaaccaggtaaaaatccccgtgctgtacaaactaaacctggactcttcaagaccaatacggggactatcggagcagtcagcttagacttttcaccggggacaagtggatcacctattgttgataagaaaggtaaagtagttgggctatatggaaacggggtagttactagatcaggtacttatgtttctgctatagcccaaacagagaaaagtatagaagataacccagaaatagaggatgacatattccgtaaaaagagattaactatcatggatttacatccaggagcagggaaaaccaagaggtaccttccggctatcgtcagagaagcaataaaacgtggactaagaacactgattttggctcctacaagagtagtggcggccgaaatggaagaggcgttaagaggattaccaataagataccagacaccagcaatcagagctgagcacacaggtagagagatagttgacttaatgtgccatgcaacatttactatgcgccttcttagtccaataagagttcctaactataatttgattataatggatgaagctcacttcaccgatcccgcatctatcgcggctcgcggttatatatcgacaagagtagaaatgggggaagctgccggtattttcatgacagcaactcccccaggaagcagagacccgtttccccaatcaaacgcgcccattatggatgaggaaagagaaatccccgaaaggagttggaactctggtcatgaatgggtcaccgattttaaaggtaaaacggtctggttcgtaccctccataaaagcggggaacgatattgcagcgtgtttaagaaagaatggcaagaaagttatccaactatcaaggaaaacttttgacagtgaatatattaaaacccgaactaatgattgggattttgtggtaacaacggatattagcgagatgggcgctaacttcaaggctgaaagagttatcgacccaagacgatgcatgaaacctgtcatactaactgatggtgaagaaagggttatcttggcgggacccatgccggtaacccatagcagcgccgcacagagacgtggaagagtaggacgcaaccctaaaaatgaaaacgatcaatatatctatatgggcgagccacttgaaaacgatgaagattgtgctcattggaaggaagctaaaatgttacttgacaatatcaacacaccagagggaataataccgtcaatgttcgaaccggaaagagagaaggtagatgcaattgatggtgaatatagactcagaggagaggcaaggaaaacatttgtagatctaatgagacgcggcgatcttcctgtttggctagcttatcgggtggcggccgaaggtattaattacgccgatcgcagatggtgttttgacggagtcaaaaataatcagatcctcgaagaaaacgtggaggtagagatatggactaaagaaggagaacgaaagaaattaaagcctcgatggcttgacgcaagaatctattcggacccactcgctctaaaagaatttaaagaatttgcggctggccgaaaatctttaacattaaatctaataaccgaaatggggagactaccaacattcatgacacaaaaagcacgaaacgctctggataacctcgctgttctacatactgcagaggccggtggacgtgcttataatcatgctcttagcgaactaccggaaaccttagaaaccctattactcctgacactattggctactgtaacagggggaatattcttattcctaatgtcaggaaagggtataggaaaaatgactttaggtatgtgctgcataataacagcttcaatacttctttggtatgctcagatccagcctcattggatagcggccagtataattttagagttctttctgattgtactattaataccagaacctgaaaagcagcgaacgccacaagataatcaattaacatacgtagttatagcgatactcacagtcgtagccgcaaccatggcgaatgaaatggggttcttagagaaaactaagaaggacttcggattaggctccattaccacacaacaaccggaaagcaacatcttagatatcgatctaagacctgccagcgcctggacattatatgcagtcgcgactacatttattacacctatgctcagacacagtatcgaaaactcaagcgtcaacgtttctttgacagcaatagcaaatcaagcaactgtactaatgggcttaggtaaaggatggccactttcgaaaatggatataggcgtacctctcttggcaataggatgttatagtcaggtaaacccaatcacattaacagcagcattgttactattagtagcgcattacgccattattggcccaggtttacaagcgaaagcaacaagagaagcgcaaaaacgtgcagctgcagggatcatgaagaacccaaccgtagacggaataactgttattgatcttgatcccattccttatgatccaaagtttgaaaagcagttaggccaagtgatgttacttgtactatgtgtcacccaagtgttaatgatgcggacaacttgggcactttgcgaagcactgactttagcaactggtcccatttcaacattatgggaaggcaacccaggtcgcttctggaatacaaccatagcagtttcaatggccaacattttccgagggagctacttagccggtgcaggtttattattctctataatgaagaatacggcaaacacgcgacgaggtacgggaaacacaggtgagactcttggagaaaaatggaaaaatagattgaatgctctcggaaaatcagaatttcaaatatacaagaaatccggaatacaagaggtggaccgaactttggccaaagaaggaataaaaagaggagaaactgaccaccatgcagtaagtagaggaagtgcgaaattacgctggtttgtagaaagaaacctagtgacccccgagggaaaggtggttgatttaggctgtgggagaggcggttggtcttattactgtggaggtctgaaaaatgtcaaagaagtaaagggcttgacgaagggcggtccaggccacgaggaacccatacctatgtctacttacgggtggaatctcgttcgactacaatcgggagtggacgtattcttcactcctccagaaaaatgtgacactctactatgtgacataggggaatcaagtccaaatccaaccgtcgaagccggcagaacactcagagtcctaaatcttgtagaaaattggctaaataacaatacgcagttctgcataaaggtgttgaatccgtatatgccttcagttatagagaaaatggaagcccttcagagaaagtatggtggagcacttgttcgaaacccgttatctaggaatagtacacatgaaatgtactgggtatctaacgcctcaggaaacatagtttcatccgtaaatatgatatctaggatgttaataaacaggttcaccatgcggcataagaaagctacatatgagccggacgtggaccttggaagtggtacacgcaatataggcatagaaagcgaaacacctaacttggatataatagggaagaggatagagaaaataaaacaggagcatgagactagctggcactatgatcaggatcatccttacaaaacatgggcatatcacggaagttatgaaacaaagcaaacaggaagtgcaagcagtatggtaaatggtgtcgtacgattgctaactaaaccatgggatataattccaatggtaacgcagatggcgatgaccgataccacgccatttggtcaacaacgtgtatttaaagaaaaggtcgatactagaacgcaagaacccaaagagggtactaagaaattgatgaaaatcacagccgagtggctttggaaagagctaggtaagaagaaaacgcctagaatgtgtacacgagaagagtttacaagaaaagttaggagtaacgccgcattgggagctatattcacagacgaaaacaaatggaaatcagcacgcgaagcagtagaagatagtggtttctgggaactggtcgacaaagaacgaaatttacatcttgaagggaagtgtgagacatgtgtatataacatgatgggaaagagagagaagaaactaggtgaatttggaaaagcgaaaggatctagagcgatttggtatatgtggctaggagctcgctttttagagttcgaggcactggggtttctgaatgaagatcattggttcagtagagagaactctctcagtggagttgagggtgaaggcctgcataaacttgggtacatattacgagatgtgagcaagaaagaagggggagctatgtatgcagacgacaccgccggatgggatactaggattacacttgaagatttgaagaacgaggagatggttacgaaccatatggaaggagagcataagaaattagccgaggctatatttaagctgacataccagaataaagttgttcgcgtccaacgtccaactccaagaggaactgttatggacataatatctcgtagagaccaaagaggatcaggacaagtagttacatacgggctcaatacatttacgaatatggaagcacaattaatacgacaaatggaaggagagggtgtattcaaatccatacagcaactaaccgtaacagaagagatagcagtcaaaaattggctcgtgcgggtgggaagagaaagattaagtcgaatggccatctcaggtgatgactgtgtcgtcaagcctttagacgataggttcgcgtcagccctaacggcgctaaatgacatgggcaaagtaagaaaagatattcaacaatgggagccatccagaggttggaatgattggacccaagttccattctgctctcatcactttcatgaattaatcatgaaagatggaagagtcttggtcgttccttgcagaaatcaagatgaattgataggtagagctagaataagccaaggcgctgggtggtccttacgggagacagcttgcttaggcaagtcatacgcccagatgtggagcctgatgtactttcaccggagagaccttaggttggctgcaaatgcaatatgtagtgcagtaccaagccattgggtaccgacttcgcgtactacatggtctattcatgccacccacgaatggatgacgactgaagatatgctaactgtgtggaatcgagtgtggattcaggaaaatccttggatggaggataaaaccttggtcgaatcatgggaagaaatcccatatttgggaaaaagggaggaccaatggtgcggttctctaattggtctaactagccgggctacttgggcgaaaaacatacagactgcaatcaaccaagtcaggtcattaattggaaacgaagagtacactgactacatgccctcaatgaaacgtttccgaagagaagaagaagaagccggtgtcctatggtaa

SEQ ID NO: 22880 - RNA, 9876 nt, synthetic construct
  misc_feature 1..9876: note = derived and/or modified CDS sequence (opt6) from DENV-2__JN851130__SS-prME
  source 1..9876: mol_type = other RNA
acggcaggtataataataatgatgatcccaacggtaatggcatttcatttaacgacacgaaatggcgaacctcacatgatagtgtcacgccaagaaaaaggcaaatcattattgttcaaaaccgaaaacggcgttaacatgtgtacattaatggcaatggacctgggagaactttgtgaagacaccataacatataattgtcctttattgcgacagaacgaaccggaagacattgactgctggtgtaacagcaccagcacttgggttacatatggaacttgtaccgcaacaggggaacaccggcgcgagaaaagatcagtggccctagtaccacacgttggaatgggtctagaaacaagaacagaaacatggatgagcagcgaaggagcatggaaacatgcacaaaggatagaaacgtgggtgctacgacacccgggttttacgatcatggcagctattttagcatacacgataggaacaacatattttcagagagtgctaatatttatcttacttacagcagtagcaccgagtatgacgatgcggtgtataggaatatccaatagagactttgtagaaggagttagtggaggctcatgggtggatatagtcttagaacacggttcctgtgttacaactatggctaaaaataaaccaacactcgatttcgaacttataaaaaccgaagcaaaacacccagctactctaagaaaatactgtatagaagccaaattaacaaatacgacgacagccagcagatgtccaacacaaggagaaccgtcgttgaatgaagaacaagataaaagattcgtctgtaaacattcgatggtagatagaggttggggtaacggttgtggcctgtttggaaaagggggaattgttacctgcgcaatgtttacatgtaagaaaaatatggaaggtaaaattgtgcaacctgaaaatctcgagtacacaattgtcatcacccctcattctggtgaagaaaatgcagtaggtaatgacacaggcaaacatggcaaagagatcaaagtaacacctcaatcatcaattacagaagccgaattaaccggttatggtacggtgacaatggaatgctcgcctaggacgggattggacttcaatgaaatggttctcctgcagatggaaaataaggcttggttggttcacagacagtggttcctagacctaccactcccttggttgcctggagcagatacacaaggatctaattggatacaaaaagaaactctggtaacatttaagaatccacacgcgaagaagcaagatgtagttgtattaggatcgcaggaaggagcgatgcatacagccctaacaggcgcaacggaaatacaaatgtcatctggaaatctattgtttactggacatctgaaatgtagattgaggatggacaagttacagttgaaaggtatgtcctatagcatgtgtactgggaaatttaaagtagttaaggaaatcgcagaaactcaacatggtaccatagtcataagggtacaatacgagggtgacggaagtccgtgtaagattccattcgaaataatggatttagagaaaagacatgtactggggcgactgatcacagtaaatccaatagtgacagaaaaagatagccccgtcaatatcgaagcagaaccaccattcggagacagttatattataattggtgttgaaccaggacagttaaaactatcgtggtttaaaaagggttcctccattggacaaatgtttgagacaacgatgcgaggtgccaagaggatggcaatcttaggtgacactgcctgggactttgggagcttaggaggagttttcacgtccatagggaaagcattgcaccaggtttttggagccatatacggagctgcattttctggtgtatcatggactatgaaaattctgataggagtcgtaattacatggataggaatgaatagcaggagcacctctttgtctgtgagcttggtacttgtaggagtagtaaccctatacctaggtgtaatggtacaagccgactcaggttgtgtcgtcagctggaaaaataaagagctgaaatgtggttctggtatttttatcacagataacgtgcacacgtggaccgagcaatataagtttcaacccgaaagcccttcgaaacttgcgtcagcaatacaaaaggcgcatgaggaaggtatctgcggaattaggagtgttacgagactagagaacttaatgtggaaacaaattacaccggaacttaatcacattctctcagaaaacgaagtaaaactaacaatcatgacaggagacattaaagggataatgcaggctggaaaaaggtcattgaggcctcaacccactgagctaaaatacagttggaaaacatggggaaaagctaaaatgctttctactgaactacacaaccatacctttttgatagacggacctgaaactgcagagtgtccaaataccaatagagcttggaactcgctagaagtagaagactacggtttcggagtattcaccacgaatatatggttaaaactcaaagagagacaagatgtgttttgtgatagtaaattaatgagtgctgctattaaagacaatagagcagtacacgcagacatgggatactggattgaaagcgccctaaacgatacatggaaaatagaaaaggccagctttatagaagttaaaagttgttactggcctaaatcccatacactatggtcaaatggagtattagaatcagagatgattatacccaaaaactttgccggtcccgtgagtcaacataactacaggccaggataccatacccaaaccgcagggccgtggcacctcggaagactcgagatggatttcgatttctgcgaaggtacaacagtggtggtaaccgaagattgtgggaacagaggcccctcactaagaacaactacggcctctgggaagttaattaccgaatggtgctgccgttcatgtactctaccacctcttcgatacagaggagaggatggatgttggtacggaatggagattagaccacttaaagagaaggaggaaaatttagttaattccttagtaactgcaggccatggtcaaatcgataattttagtctaggggtcttagggatggccctatttctggaagaaatgcttaggactcgagtaggtacaaaacacgcaattctattagttgctgtttcttttgttactctgattacgggcaatatgagctttagagatcttggtagggtaatggtaatggttggcgcaactatgactgatgacattgggatgggggtcacttatttggccttattagcagcttttaaagttaggcccacattcgcagcaggattattgctaagaaagttaacgtctaaggaactcatgatgacaaccattggtatagtccttctatcccagtcgacaatcccggaaacgatcttagaattaacagatgccctggcgttagggatgatggctttgaaaatcgttagaaatatggaaaaataccagctagccgtaaccataatggcaatattatgtgttcctaatgcggtcatactacagaatgcgtggaaggtctcttgcactaccctagcagttgttagcgtcagtccactactgttgacaagtagtcaacaaaaagctgattggatcccgttggcattaactataaaaggactaaacccaaccgccattttcttgactacattatcaagaacatctaagaaaagatcttggccactaaatgaagcaataatggctgtaggaatggtgtccattttagccagcagcctattgaagaacgacatacccatgactggtccgctggtcgctggaggactgttaacagtgtgttatgttttgacagggaggagcgccgatctagagctggagcgagctgcagatgtcagatgggaagaacaagctgaaataagtggctctagtccaatactttcgataacaatatctgaagacggctcaatgtcaatcaaaaatgaagaagaggaacaaacattaaccatcttaatccgtactgggctcctagttataagtggattgtttcctgtttctataccaataactgcggccgcatggtacttatgggaagtaaagaaacaaagagcgggagtgctttgggatgtcccttccccaccaccagtaggaaaagccgaactagaagatggcgcgtataggataaaacagaagggcatattaggatacagtcaaattggagctggtgtatataaggaaggcacttttcatacaatgtggcacgtaacacggggcgctgtattgatgcataagggtaaacgtattgaaccatcctgggccgatgtcaagaaagacctaattagttacggaggaggttggaaactggagggcgaatggaaggaaggagaagaagttcaagttctggccctagaacctggtaagaatcccagagccgtgcaaacaaaaccaggcttattcaagacaaacacagggacaatcggtgctgtatcacttgattttagtcccggcacctcaggaagccctattgtcgacaagaaaggaaaagtagttggcctgtatggaaatggggtcgtaactaggtctggaacatatgtatcggcaatcgcgcaaacggaaaagtctattgaagataacccagagattgaggacgatatatttaggaagaaaagactaacaattatggatttgcacccaggagcagggaaaaccaaacgctatcttccagcgatagtgagggaagcgataaaaaggggactaagaacactaatattggctccaactagagtcgtagccgcagaaatggaggaggctttaaggggcttaccaataagatatcaaactccggctattcgggctgaacatacggggagagaaatagttgatctaatgtgccatgctacttttacaatgagactattatcgccaataagggtacccaactacaacctaataattatggatgaagctcattttacggacccggccagtatcgctgccaggggatacatttcaacgagagttgaaatgggcgaagcagcaggcatcttcatgacagcaaccccacccggcagcagagacccgtttcctcaatcaaatgccccaattatggacgaggaacgggaaattcctgaaaggtcatggaatagcggacacgagtgggttacggatttcaaaggtaaaacagtttggtttgtcccgtccataaaagccggcaatgacatagcggcctgcctacgtaaaaatggtaaaaaggtaatccaattaagccgcaaaacattcgacagcgagtatataaaaacacgaactaatgactgggactttgtcgtaacgacagacatatcagaaatgggagcaaacttcaaagcggaacgagttatcgaccctcggcgttgtatgaaaccagtgatacttacagatggagaggaaagagtaatcctcgcggggcctatgcccgttactcattcatccgcggcacaacggcggggtagggttgggcgtaaccccaaaaatgaaaacgatcagtatatatacatgggtgagcccctagaaaatgacgaagattgtgctcattggaaagaggctaaaatgttactagataacattaatacccccgaaggaattataccaagtatgtttgaacccgaacgcgagaaagtagatgctatagatggggagtatagactccgaggagaagctcgaaaaacatttgttgacttgatgaggagaggagatttgcctgtatggttggcctatcgtgtagctgcagaaggtataaattacgccgaccgacgatggtgttttgacggcgtaaagaataatcagatccttgaagaaaatgttgaggtagagatctggactaaagaaggtgaaaggaagaaactcaaaccacgatggcttgatgctagaatatacagtgatccattagcattaaaggagtttaaagaatttgcagcagggagaaaatctctaacgttaaacctaataactgaaatgggaagattaccaacgttcatgacccaaaaggcacggaatgcacttgacaatcttgcagttttgcacactgctgaagccggtggtagagcttataatcatgcattaagcgaattaccagagacactagaaacactcctgcttttaacattattagctaccgtaacgggaggaatattccttttcctgatgtctggaaaaggcattggaaaaatgacgctaggcatgtgctgcattataactgcgtcaatcctcctttggtacgcacagatccaacctcactggatagcagcatcaataattctggaatttttcttgatcgtcctgttgattccagaaccagaaaagcaacggaccccacaggataaccaattaacatatgtggtaatagctatcttgactgttgtggccgcgacgatggctaacgaaatggggtttctagagaaaaccaaaaaggatttcgggctagggtcgattacaacccagcaaccggaaagcaatatccttgacatagatcttagacctgcgagcgcctggacactttatgctgttgctacaacttttataacacctatgttgaggcattcgatagaaaattcaagtgtcaacgtatccttaaccgctatagcaaatcaagcaacggtacttatgggattgggtaaaggttggccattgtcgaaaatggatataggcgtaccgctattagcaatcggatgttactctcaagtaaatcccataacactcactgcagcgctgttacttttggtggcacattatgcaataatagggccaggattgcaagcaaaagcgacaagggaggcccagaaacgtgctgcggctggaattatgaaaaatccaaccgtagacggcataaccgtaattgacctagatccaataccgtatgatcctaagttcgaaaaacaactaggccaagtaatgcttctagtcttatgtgtaacgcaagtattaatgatgcgtacgacatgggcactatgtgaagccttaaccttagcaacaggaccaattagtactctttgggaaggtaatccaggaagattttggaatacgactatagccgtaagtatggcaaacattttcagaggaagttatctggcaggagcgggtctactcttctcaataatgaaaaacacggccaatacaagaaggggcacaggcaatacgggcgaaacgctcggagagaagtggaagaaccgtttaaatgcactagggaaatcagagttccaaatatacaagaaaagcgggatccaagaagtagatcgcacactcgctaaagaagggattaaaagaggggaaacggaccatcatgcagttagcagggggagcgcaaaattacgctggttcgtggaacgtaacttagtgaccccagaaggaaaagtcgtagatctaggttgcggccggggtgggtggagttactactgcggagggcttaaaaatgtaaaagaagtaaaaggactaactaagggtggaccaggccatgaagaaccaataccaatgagtacctacggttggaacctagttagattacaaagtggagtagatgtatttttcacaccgccggaaaaatgtgatactttgctttgcgatattggcgaaagttcacctaacccaactgtggaggccggaaggacattaagagtcttaaacttagttgaaaactggctaaacaacaacacacagttttgtataaaggtattaaacccatacatgcctagcgtaatcgagaaaatggaagctctacaaagaaaatacggcggagcgcttgttcggaatcctctgagcagaaattcaactcatgaaatgtactgggtcagcaatgcaagcggaaacatagtaagcagtgtgaatatgataagtcgtatgctaataaataggttcactatgaggcacaagaaggcaacttacgaacctgatgtggatttagggagtggtactcgcaatataggaatcgaaagtgaaattcctaatcttgatataataggtaagcgtatcgagaaaattaagcaagaacatgaaacgtcctggcactacgatcaggatcatccgtataaaacatgggcataccacggaagctatgagacaaaacaaacaggctctgcaagctcaatggtcaatggggtggtacgcttactcacgaaaccatgggacgtaattcccatggtgacccaaatggcgatgacagatacaactccctttggtcaacaaagagtgttcaaagagaaagtagatacacgaacacaagaaccaaaagagggcacgaagaaattaatgaaaataactgcagagtggctttggaaggaactaggtaaaaagaagacaccccgaatgtgtacaagagaagagtttactcgaaaggtaagaagtaacgcagccctaggagctatattcacggatgaaaacaagtggaaatctgcccgtgaagccgtggaggatagtggattttgggaattagtagacaaagaacgtaatcttcatctagagggaaaatgcgaaacgtgcgtatacaatatgatgggaaaacgggagaagaaactaggtgagttcggtaaggcaaagggaagtagagccatctggtacatgtggctaggcgcaaggtttttagagttcgaggctttgggatttctgaacgaagatcactggttctcacgggaaaatagtttgtctggagtagagggagagggattacacaaattgggatatattttgcgggatgtttcgaagaaagaaggtggcgcaatgtatgcagacgacacagcgggttgggatacaagaataaccctagaagatctaaagaacgaggagatggtaactaaccatatggaaggggaacataagaaactcgcagaagcaatatttaaactcacctaccaaaataaagtagttagggtacagagaccaacaccgagaggaaccgtaatggatattattagcagacgagatcaaagaggaagcgggcaggtagtaacttatggcctcaatactttcacaaatatggaagctcagttaatacgtcaaatggagggagaaggcgtttttaaatctatacagcaactaacagtgacagaagaaatagctgtcaaaaattggttagtacgtgttggtagagaacgactgagccgtatggccatctccggagacgactgtgtcgttaaacctttagacgaccgctttgcctctgctctaaccgccctaaacgatatggggaaggtacgcaaagatattcagcaatgggaacctagcagaggttggaatgattggactcaagtacccttctgttcacaccattttcatgaattaataatgaaagacggaagagttcttgtagttccctgtagaaatcaggatgaactgattggacgagcaagaatctcacaaggtgccggctggtcgcttagagaaaccgcctgcttagggaaaagctacgctcaaatgtggagcttaatgtattttcaccgtcgcgatctaagattggccgccaatgctatatgcagtgcggtaccatcccactgggtaccaaccagtagaacaacatggtcgatacacgcaacgcatgagtggatgactacagaagatatgctaacagtgtggaaccgtgtctggatacaggaaaatccctggatggaagataaaacaccggtagagtcttgggaggaaataccatatttaggtaaaagggaagatcagtggtgtggttcattgataggattaacttcaagagctacttgggctaaaaatattcaaacagcaataaatcaagtaagatcattgataggtaacgaagaatatactgattatatgccatccatgaagaggttccgaagagaagaagaagaagccggtgtattatggtaa

SEQ ID NO: 22881 - RNA, 9876 nt, synthetic construct
  misc_feature 1..9876: note = derived and/or modified CDS sequence (opt6) from DENV-2__JN851125__SS-prME
  source 1..9876: mol_type = other RNA
acggcagggataattataatgatgatacccacagttatggcgttccatctcacgacgagaaatggggaaccacatatgatagtatcacgtcaagaaaaagggaaatcattattattcaaaaccgaaaatggggtaaatatgtgcacattaatggccatggacttaggggaactttgtgaagatacaatcacatacaattgtccactcctgaaacaaaatgaaccagaagacattgactgttggtgcaactcaacaagtacctgggtaacgtatggaacctgcacagcaacaggagaacataggagagaaaaacgatctgtagcattagtaccccacgtaggtatgggattagaaacacgaactgaaacctggatgtcgtcagaaggagcgtggaaacatgcacagaggattgaaacctgggttttaagacatccaggcttcactgtaatggcagctatattagcatatacgattggaacgacatattttcaaagagtacttatctttatcttattaactgctgtagcaccaagtatgacgatgagatgtattggtatatccaatcgcgattttgtagaaggagtcagtggaggctcatgggtagacatcgttcttgaacatggtagttgcgtgacaacgatggccaaaaataaacctaccttagacttcgaactaataaaaactgaagcgaaacaccccgctactctcagaaaatactgcattgaagcgaaacttactaatacaactaccgcttcacggtgtccgacacagggcgaacccagtcttaacgaagaacaagataaaagatttgtttgcaaacactctatggtagatagaggatggggtaacggatgtggcctatttggcaaaggagggatagtaacatgtgcaatgttcacttgtaagaaaaatatggaagggaaagtagtgcagccggaaaacctagaatacacgatagtcataactccacatagtggggaagaaaatgcggtggggaatgacacagggaaacatggaaaagaaataaaagtaacaccacaaagcagtatcacggaggccgaacttacaggttatggtactgtcacgatggagtgtagcccacgaacagggctggactttaatgaaatggttctattgcaaatggagaataaagcatggctcgtacatagacaatggtttttagaccttccgctcccgtggctaccaggagctgatacccaaggttcgaactggattcaaaaagaaactttggtgacttttaaaaatccacatgccaagaaacaggacgtggttgtactcggcagtcaggaaggagctatgcataccgctttaacaggtgctaccgaaatacaaatgtcatcagggaacctattatttacaggtcatttaaaatgtcggctaagaatggacaaattacagctaaaaggtatgtcatacagtatgtgcacaggcaaatttaaagttgttaaagagatagctgaaacgcagcatggtactattgtgataagggttcaatatgaaggtgatggatcgccgtgtaaaattcctttcgaaataatggatttagaaaaacggcatgtccttggacgactaatcacggtaaatccaatagtaacggagaaagactctcccgtgaatattgaagcagagccaccattcggggattcatatataatcattggagtggaaccaggccaactgaaactctcatggttcaagaaaggaagtagcattggtcagatgttcgaaacaaccatgagaggagcaaaacgtatggctatattaggagacactgcttgggactttggttccctaggtggtgtcttcacatctattggtaaagctctccaccaagttttcggagccatatacggagctgccttctcaggggtcagctggaccatgaaaatactaatcggtgtagtaatcacctggattggaatgaactctcgtagtacatcgctatcggtatccctagtactcgtcggcgtagtcacgctgtatcttggagttatggtccaagcagactcaggatgtgtggttagttggaaaaacaaagaattgaaatgtggaagtggaatttttataacagataacgtacatacttggacagaacaatataaatttcagcctgaaagtccgagtaaacttgcttctgccattcaaaaagcacacgaagaaggcatttgtggaatcagatctgtgacaagattagagaatttaatgtggaaacagataacaccagaattaaaccacattttgtcagaaaacgaagtaaaaatgacaataatgacaggagacattaaaggtattatgcaagcaggtaaacggtcgctaagaccgcaaccaacggaattaaaatactcatggaaggcttggggtaaagcgaaaatgctttcaaccgaattgcacaatcatacctttttgattgatggaccagaaaccgcagaatgtccaaataccaacagagcatggaactctctggaagtagaagattacggattcggcgtttttactacaaatatatggttaaaacttaaagaaaggcaagatgtgagctgcgattcgaaactaatgtctgccgcaatcaaagataacagagcagttcatgccgacatgggctactggattgaatcagctttaaatgatacctggaagatcgaaaaagcgtcattcatagaagtaaaatcatgtcattggccaaaaagtcatactctgtggagcaacggcgtgctcgaaagtgaaatgataattccgaaaaattttgccggtccagtaagtcaacataattacagacctggatatcacacccagacagctggtccatggcatctagggagattagaaatggacttcgatttctgtgaaggcactactgtagtggtaactgaagattgtggtaacagaggcccgtctctaagaacaacgacagcttccggtaaattaatcacagagtggtgttgtcggtcatgtactttacccccattgcggtacagaggagaagacggatgttggtatggaatggaaatacgacccttaaaagaaaaagaagagaatttggtaaatagcctagtaactgcaggtcatggacaaatagacaactttagtctaggcgtcctaggaatggctctatttttagaagagatgttaaggactagagttggaacaaaacatgcaatacttttagtagcagtctcttttgtcactttaataactggtaatatgtcatttcgcgatctaggtcgggtcatggtaatggtaggtgcaactatgacagacgatataggcatgggagtgacctatcttgccctcttagccgctttcaaggtaagaccaacgtttgcagctggcttgttactaagaaaactaacttccaaagaactaatgatgaccaccattggaatagttttattatcccaatccacaattccggaaactatactagaacttacagacgctcttgcattagggatgatggtgctaaaagtagtcagaaatatggaaaaatatcaactcgctgttacaataatggcaatactatgtgtaccaaacgctgttatcttgcaaaatgcttggaaggtatcctgcactactctagcagtcgtttctgtctttcctctactattaacatcatcccaacagaaagccgattggatacctttagccctgactatcaagggattaaacccaactgccatattcctcacaactttaagtcgaacaagcaagaaaaggagctggcctctcaatgaggcgataatggctgttggaatggtatcaattctagcgtcatctctgctgaaaaacgacataccaatgactggacctttagtagccggtggactgttgactgtctgctacgtactaacagggcgctctgcagacctagaactagaacgagcggcagacgttcgttgggaagaacaagcagaaatcagcggatcaagtcctatcctatcgatcactatatcggaagatgggtccatgtcaataaagaatgaagaggaagaacaaacacttacaatactcatacgaacagggttgcttgtaatttctggtctatttcctgtttcaataccaataacggcagcagcatggtatttatgggaagtcaagaaacaaagggccggcgtcctgtgggacgtaccttcacctcctccagtagggaaagcagagctagaagacggtgcttatcgtataaaacaaaaagggatccttggctacagtcaaatcggtgctggcgtctataaagaaggcacttttcataccatgtggcacgtgacaagaggtgccgtactaatgcataaaggtaaaagaattgagcccagctgggcagacgtcaagaaagatcttatctcttatggaggaggctggaagttagaaggtgaatggaaagaaggcgaagaggtccaagttcttgccttagaaccaggtaagaaccctcgggcagtacaaacaaaaccgggtctcttcaagacaaatacaggaactataggtgcagtttcattggatttttcacctggaacatcagggtctccaatagtggataagaaaggaaaagtggttggtctctacggaaacggcgtcgtcactagatcagggacgtatgtatctgcaattgcacaaaccgaaaaatcaattgaagacaacccagaaattgaggatgacatatttcgaaagaaaagattgactattatggatttacatcctggagccggaaaaactaaacgttacctaccagcgatagtacgagaggcaattaaacgtggcctacgaacgctaatcctagcccccacgcgggtagtagctgccgagatggaagaagcattaagaggactacccataagatatcaaacccctgctatacgagctgaacacactgggcgcgaaattgttgatttgatgtgccatgcgacatttacgatgcgattattatcacctatacgggtaccgaactacaatcttataataatggacgaagcacattttacagacccagcttcaattgcagctcgaggttacatatcaacacgtgtagaaatgggagaagcggccgggatattcatgacggctacacctcccggtagtagagatccctttccgcaatctaatgcaccaatcatggacgaagaacgagaaattcctgaacgatcctggaactctggacatgagtgggtgactgatttcaaaggaaagacagtatggtttgtgccaagcattaaagccggaaatgatatagcagcatgtttacgtaaaaatgggaagaaagtcatacaattatcaagaaaaacattcgattcggaatacattaaaacacgtacaaatgactgggactttgtcgttaccactgatataagcgaaatgggagcgaatttcaaagctgaacgagtaattgatccacggcgctgcatgaaacctgtaatccttactgatggagaagaacgagtcatcctggcaggaccaatgcccgtaactcactcatccgcagcgcagcgaagaggacgtgtaggccgaaatcctaagaatgaaagcgaccaatacatttatatgggggagccacttgaaaacgatgaagactgcgcgcattggaaggaagctaaaatgctattggataatattaatacgccagagggtataataccttcaatgtttgaaccagaaagagaaaaagtagacgcaatcgatggcgaatacagattacgaggagaagcaagaaaaacctttgtcgatctaatgagaagaggagatttacccgtctggttagcatacagagttgcggctgaaggtattaactacgcagacagacgttggtgcttcgacggtgtcaagaataatcagatattagaggagaacgttgaagttgaaatttggactaaagagggtgaaagaaagaaactaaaaccacggtggttggatgcgagaatctactccgatccattagcattaaaagagttcaaggagttcgcagctggaaggaaatcattaacacttaatctaatcacggaaatgggaagactccccacattcatgacacaaaaggccagaaatgcacttgacaatttagccgtactacataccgcggaagccggtggtcgagcttacaatcatgcactttcagagttacctgaaacgttggaaactttactgttactaacattactagcgaccgtaactggaggcatcttcctgttccttatgtctggtaaaggtattgggaaaatgacgctcgggatgtgctgtatcattactgcaagcatactattatggtatgcccaaatacaaccccactggatagcagcgagcataatactggagttcttcctgattgtcttactaataccagaacctgaaaaacagcgcacacctcaagataatcaattgacgtatgtggtaatagcaattttaacggtagtagctgctaccatggcaaatgaaatgggttttctcgagaaaaccaagaaagattttggcttgggatctagtactacccaacaacacgaaagtaacattcttgacatagatttaagacctgctagcgcttggacgctatatgctgtggccacaacattcattacccctatgttaagacatagcatagaaaattcaagcgtgaatgttagcctcacggccatagcaaaccaagctaccgttttgatgggtctaggtaaagggtggccgctcagtaagatggatataggagtcccactgctcgctataggttgttactcgcaagtaaatccaataaccctaacagcagctttattatcgctggtcgcacattacgccataatcggtcccggcctgcaggccaaagcaacaagggaagctcaaaaacgagcagcagccggaattatgaagaatcccacagttgacggtataactgtaatcgatctagatcctataccttatgaccccaaattcgaaaagcaattaggtcaggtaatgttattggtcctatgtgtaacacaagtattgatgatgagaacaacttgggctttatgcgaagcattgacgttggcaacgggtccaatatcgactctttgggaaggtaacccaggaaggttctggaacacaaccatagcggtctccatggctaacatcttccgagggtcatacttagccggagccggattattattcagtataatgaagaacactgcaaacacacggagagggactggaaacaccggcgaaacattgggtgaaaaatggaaaaataggcttaacgcactgggcaaaagcgagttccaaatttataagaaatcgggcattcaggaagttgatagaacattagctaaagagggtatcaagagaggagaaactgatcatcatgcagtatctagaggatcagcgaaattacggtggtttgttgaacgcaatctagtaactccagaggggaaagtagtagacttaggctgcggtagaggtggttggagttattattgtggagggttaaagaatgttaaagaagtaaaaggtttgaccaaaggaggtccaggtcacgaagaacctatacctatgtcaacgtacggttggaacttagtaagattacagagcggagtagatgtctttttcacaccgcccgaaaaatgcgatacattattatgtgacatcggtgaatcatcgccaaatcctacggttgaagccggccgaaccctacgcgtactaaatttggtcgaaaactggttaaacaataatactcaattctgcatcaaagtacttaacccatacatgcccagtgtaattgagaaaatggaagcattgcagcgtaaatatggaggggctctagtgcgtaaccctttatctagaaacagcacccatgagatgtactgggtgtccaatgcatcagggaacatcgtttcttcggtcaacatgatttcgcgtatgttaataaacaggtttaccatgagacataagaaagcaacctacgaaccagatgtcgatttggggtcgggtaccagaaatataggaatagaaagtgagacacctaatttagacattattgggaaaagaattgaaaagataaaacaagaacacgaaacaagttggcattacgaccaggaccacccctacaaaacgtgggcttatcatggctcatacgaaacaaaacagaccggctccgcgagcagtatggtcaatggcgtagtaagattacttactaaaccatgggatgtaattccgatggtaacccagatggccatgaccgacactacacctttcggacaacaacgcgtcttcaaagagaaagttgacacacgaactcaagaacctaaggaaggcacgaagaaactcatgaaaataacagcagagtggttatggaaggagctaggtaagaagaaaacaccccgaatgtgtacacgagaggagtttacacgaaaagtacgatccaatgcagcccttggtgccatcttcacagatgaaaataaatggaagagtgcgagggaggctgttgaagactctggattttgggaactcgttgataaagaacgtaacctccatcttgaagggaagtgcgagacgtgcgtgtataatatgatgggtaagagagagaagaaattaggagagttcggaaaagcgaaaggctcaagggctatttggtatatgtggcttggtgctagatttcttgagttcgaagcgttaggatttttgaatgaggatcactggttttcgcgtgaaaactcactcagtggcgtagaaggcgaaggactacacaaactaggctacatattaagggatgtaagtaagaaagaagggggagctatgtatgctgacgatacggctggttgggacacgagaatcacacttgaagacctgaagaatgaggaaatggtcacaaaccatatggagggagaacataagaaattagcagaagctattttcaaacttacatatcaaaataaagtagtgagagtccagcgaccaacacctcgtggtaccgttatggacattataagtagacgtgaccagcgcggatctggccaagttgttacctacggactaaacacatttacgaatatggaagctcaattaattcgacaaatggaaggtgaaggggtctttaaatctatccaacaattgacagccacagaagaaatagccgtcaaaaattggttagttagggtaggtagagaaagattgtcgaggatggctatatcgggagatgattgtgtggtgaagcccttagatgatagatttgccagtgcattaactgcactcaacgacatgggcaaggtacgtaaagacatacaacagtgggagccttcaagagggtggaacgattggactcaggtacccttttgcagtcaccattttcacgaacttattatgaaagatggtagagtcctagttgtcccatgcaggaatcaggatgagctaattggtagagcacggatctcccagggtgccggttggagtctgagagaaacagcttgtttaggaaaatcttatgctcagatgtggtcgttgatgtactttcacaggagggatttgagattagcggcaaatgcaatatgttcagctgtaccatcccactgggtacccacctcacggacgacgtggagtatacacgccactcatgagtggatgacaacggaggacatgttaacagtatggaaccgagtctggatacaagagaatccttggatggaagataaaacaccagtagagagctgggaagaaattccctatttgggaaaacgagaggaccaatggtgcggcagtttaataggtttgacaagcagagctacatgggcaaagaacatccaaaccgctataaatcaagtgaggtcacttataggaaatgaggaatacacagattacatgccaagtatgaaacggttccgtcgtgaagaagaagaggcaggcgtgctttggtaa

SEQ ID NO: 22882 - RNA, 9876 nt, synthetic construct
  misc_feature 1..9876: note = derived and/or modified CDS sequence (opt6) from DENV-2__JN851123__SS-prME
  source 1..9876: mol_type = other RNA
acagcagggatcatcattatgatgatacccaccgtaatggcatttcatttaactactagaaatggagaaccgcacatgatcgtatcccgtcaagaaaaaggaaaatctcttctgtttaaaaccgaaaacggcgtaaatatgtgtactttaatggcgatggatctcggcgaactatgtgaagatacaataacttataattgtccactactaaaacaaaatgaaccggaagatattgattgctggtgcaacagtacgtcgacatgggtaacatacgggacttgtacagcaacgggtgaacaccgtagagagaaaagatcagtagcattagttcctcatgtcggaatgggattagaaacacgaaccgaaacgtggatgagctccgaaggtgcctggaaacatgctcaaagaatagagacgtgggttctccgccatcctggcttcacaattatggcagctatattggcatatacgatagggacgacatatttccaacgagtgctaatattcatattattaactgcagtagctccatcaatgacaatgagatgtattggcatttccaaccgtgacttcgtagaaggagttagcggagggagttgggtagatatagttttggaacatggaagttgtgtaacaacgatggctaaaaacaaaccaactctggattttgagttgataaaaactgaagcaaaacatcctgctacactaaggaaatactgtatagaagcaaaattaacaaatacaaccacagcatcgcggtgtcccacacagggtgaaccatcactaaatgaggaacaagacaaacgcttcgtgtgtaaacattctatggtagataggggatggggaaatggatgcggattgttcggaaaaggagggattgtaacatgtgccatgtttacatgtaagaaaaatatggaaggaaagattgtccagccagaaaatcttgaatacacaatcgtaataacaccacactccggagaagaaaatgctgtagggaacgatacaggcaaacacggaaaagaaataaaagtcacccctcaaagttctataacagaagctgagttaactggttatggaactgttactatggaatgttcaccaaggacgggcctcgacttcaacgaaatggtattacttcagatggaaaataaagcctggttagttcacaggcagtggtttctagacttgccgttaccatggttgccgggagcggatacacaaggtagtaactggatccaaaaagagacattagtcacatttaaaaacccgcatgccaagaaacaagatgtagtagtcctgggctcccaggagggtgcaatgcatactgcgttgacgggagcgacagagatccaaatgtcttcaggaaacttgctctttacagggcacttaaaatgtagattaagaatggataaactacagctaaaaggaatgtcatactcaatgtgcacaggaaaatttaaagttgtgaaagaaatagctgaaacccaacatggtactatcgtaatcagagtgcaatatgagggagatggttccccatgcaaaataccttttgaaataatggatttagagaaaagacatgtgttgggacgtttgattactgttaatccaatagtaacagagaaagatagtcctgtaaatattgaagcagagccaccgtttggagatagctatatcattataggggtagagccaggccaattgaaattatcttggttcaagaaaggtagcagtataggacagatgtttgagaccacaatgcgaggcgcaaaaagaatggccattttaggggataccgcatgggactttggtagcctaggaggtgtttttacttcaatagggaaagcactgcatcaagtattcggggcgatctacggtgcggcattcagcggtgtatcatggactatgaaaatcttaattggagtagtgataacgtggatcggaatgaactctcggagcacttccttgagcgtcagtctagtgttggtcggtgttgtgaccctatatttgggtgtaatggtacaagctgatagcggatgcgttgtctcatggaaaaacaaagaattaaagtgcggaagcggaattttcataacggataatgttcatacctggacagagcagtataaattccaaccggaaagtcctagtaaactcgcatcagccatacaaaaagcccatgaggaaggaatatgcggaatacggagcgtaaccagattagaaaacttaatgtggaaacaaataactccagagctaaatcatatcttaagtgaaaacgaaatcaaattgacaattatgacaggagatataaaaggaataatgcaagcagggaaaagaagtctaagaccgcagcctacggaattaaaatactcctggaaggcatgggggaaggctaaaatgctctccactgaactccacaatcacacgtttttgattgatggtcctgaaacggcagaatgtcctaatacgaatagggcgtggaactcgctagaggttgaagattacggttttggagtttttacaactaacatatggttaaagttaaaagaaagacaggacgtcttttgtgactcgaaattgatgagcgctgcaataaaagacaacagagctgtgcatgctgatatgggatattggatcgaatccgcattaaatgatacgtggaaaatcgaaaaagcatcgttcatcgaagtaaaatcttgccactggccaaaatctcacaccttgtggagcaatggagtattagaatctgaaatgataattccgaaaaatttcgctggacccgtcagccagcataactataggccaggctaccatacacaaaccgcgggaccgtggcatttaggaaggttagaaatggatttcgatttttgtgagggtacgacggtagttgttacagaagattgtggaaatcgaggcccgtccttaagaacaaccaccgcatctggtaaactcatcacagagtggtgttgcaggtcctgtacactaccccctttgaggtacaggggcgaagatggatgctggtatggtatggaaattcgtccgttaaaagaaaaagaggagaatttggtaaactccttagttaccgcgggacatggacaaatagacaattttagtctgggcgtattgggtatggcattatttcttgaagaaatgctacgtacccgggtcggtacaaaacacgctatactgctggtggctgtgtcatttgttacgctcataacaggtaacatgtcttttcgtgatctagggcgggtaatggttatggttggtgctacgatgacagacgacatcggcatgggagtgacatatcttgcacttctagcagcctttaaagtaaggccgaccttcgcagccggacttttgttgcgcaaattaacctcaaaagaactcatgatgacaacgataggaatcgttcttctatcccaaagtactatacctgagaccatacttgaactaactgatgcattagcactcggaatgatggtccttaagatagtgagaaacatggagaagtatcagttagcagtcacaattatggcaatcctttgtgtcccgaacgcagtaatcctgcaaaatgcatggaaagtttcttgtacaacgctcgcagtcgtgagtgttagccccttgttactgacctcgagccaacagaaagcagattggattccccttgccttaaccataaaaggattaaatccaacagctattttcctaacgacgctaagcagaacaagtaagaaacgtagctggcccttgaacgaggctattatggctgtcggcatggtaagtattctcgcctcatcgttattaaagaatgacattccaatgaccggccccctcgtcgccggtggactactaaccgtctgctatgtactcaccgggagatcagcagatttagaactagaacgagcagcggatgtacgttgggaagaacaagcggagatttcaggttcgtcaccaattttatccataactataagtgaagacggcagcatgtcgataaagaatgaagaagaagaacagaccctcacaatactaattagaacaggcctgctcgtgatttcagggttattcccagtgtctataccaatcacagcagcggcttggtatttatgggaagtgaagaagcagagggctggagttttgtgggatgtaccgagcccgcccccagtgggcaaagcagaattagaggacggagcgtaccgtattaagcagaaaggtattctcgggtactcccagataggcgcgggggtatacaaagagggaacatttcacacaatgtggcacgtaacacgaggagctgtacttatgcataaagggaaacggattgagccatcatgggcggacgtcaagaaagacttgatatcatacggcggcggttggaaactggagggcgagtggaaagaaggagaggaagtacaagtacttgcactagaaccggggaagaacccacgtgccgtgcaaactaaacctggcttatttaaaacgaatactggcacaataggcgcagtatcattagactttagccccggtacaagtggtagccctatagttgacaaaaagggaaaagtagttggactgtatggtaacggagtagtgacaagatctggtacatatgtttcagctattgcacaaaccgagaaaagcatagaagataaccccgaaatagaggatgatatattcaggaagaaaagactcacaataatggatctacatcctggggcggggaaaactaaaaggtatttaccagctatagttagggaggcaattaaacgtggattaagaaccctgatactagcccctacgcgtgttgttgcagctgaaatggaagaagctctcagagggctaccaatacgatatcaaacaccagcgatacgagcagaacatacaggcagagagatcgtagatttgatgtgtcacgcgacgtttaccatgaggctacttagtccaatcagagttccaaattataacttgatcataatggacgaggcgcattttactgatcctgcgtcaatagcagcaagaggatacataagcacaagagtcgaaatgggagaagcagccgggatatttatgaccgcgacaccgccaggctctagggatccatttcctcaatctaatgctcctataatggacgaagaacgtgaaattccggaaagatcatggaactcaggacacgaatgggtaactgactttaaagggaaaactgtatggttcgtcccaagcataaaggcggggaatgacattgcagcatgtttgaggaaaaatggtaagaaagtaattcagctatcccgaaaaacctttgacagcgagtatatcaaaacaaggactaatgattgggatttcgtagtgacaaccgacatatccgaaatgggagccaattttaaagcagagagagtaatagacccaagacggtgcatgaaaccagtgatcctgactgatggagaagaacgagttatcctagctggcccgatgccggtcacccactcgtcggccgcacaaaggaggggtcgcgtaggtagaaatcccaaaaatgagaacgaccaatacatatacatgggagaaccgcttgaaaacgatgaagactgcgcgcactggaaggaagccaaaatgttgctagataacataaatacacccgaaggaattataccatccatgtttgagcctgaacgagaaaaagtggatgcaatagacggagaatatcgactaagaggggaagcaagaaaaacgtttgtagatttaatgcgcagaggagatctacctgtatggttagcatatcgtgttgctgcagaaggtataaattacgcagatagaaggtggtgtttcgatggagttaaaaataatcaaatattagaggaaaacgtagaggtagaaatatggacaaaagaaggagaaaggaagaaattaaagcccagatggctagatgcaagaatatattcagatccactagcgcttaaagagttcaaagagtttgcagccggcagaaagtccctgaccttaaacttaatcaccgaaatggggaggctacccacatttatgacacaaaaagcgagaaatgccttagacaatttggccgtgctacatacagcggaagcgggaggtcgagcttataatcacgcactaagtgaacttcctgaaacgttagaaacactgcttcttttgacattattagcaacggtgacaggaggtatattcctttttctaatgtcaggaaaagggatcgggaaaatgacacttggaatgtgttgtataataacggcttcgatactattgtggtatgcacaaattcaacctcattggatagctgcaagtattatcctggagttctttctaattgttttgcttattccagaaccggaaaaacagagaacaccacaagacaatcaactaacctacgtagtgatcgcgatattaactgtagtagcagccacaatggctaatgagatgggatttctcgagaaaactaagaaagattttggactaggtagtataacaactcaacagcctgaatcaaacattcttgatattgacctgaggccagcatcagcctggactctatacgcagtagcgacaacttttataactcccatgctcaggcatagcatagaaaattcatctgtgaatgtaagtcttacagcaattgcgaatcaagctacagttctaatgggtttaggaaaaggatggcctctctccaagatggatatcggtgttccattattagctataggatgctattcacaggtcaacccgataacattaacagctgcgttgttattacttgttgcccactacgccatcataggtcctggcttacaggcgaaagcaacgagagaagctcagaaaagagcagccgctggaattatgaaaaatccaactgttgacggaattacagttatagatttagatcccataccctacgatccgaaatttgaaaaacaattaggtcaggtaatgctattagttttatgtgtaacgcaagtgctaatgatgagaacaacgtgggcactatgcgaagcgttaactttagctacaggaccaatcagcacactatgggaagggaatccaggtaggttctggaacaccaccatagcagttagtatggccaatatttttagagggagctacctagcgggcgctggactcctgttttcgataatgaaaaataccgcgaacacaaggagagggactgggaatacgggagaaacattaggcgaaaagtggaaaaatcgccttaacgcgctaggaaaatccgaatttcagatttataagaaaagcggtatccaagaagttgatcggacgttggccaaagaaggtataaaacgcggagaaacagaccatcacgcagtgtcacgaggtagtgccaaattgagatggttcatagagagaaatttagtaacacctgaaggaaaagtagtagatttgggatgtggacgaggaggctggagttactactgcggaggacttaaaaatgttaaagaagtcaaaggtctaaccaagggtggtcctggacatgaagaaccaattccgatgtctacttatggatggaatctagtacggttgcaatcgggtgtcgacgtattctttacgccgccagaaaaatgcgatactttattgtgtgatattggtgagtctagtccgaaccctaccgttgaggctgggagaacattgagggttctcaacctggtggagaactggttaaataacaatacacaattttgtatcaaagtactaaatccttatatgccaagtgttattgagaaaatggaggctttacaaagaaaatacggaggagctctagttagaaacccattatctaggaacagtacacatgaaatgtattgggtttctaacgcttctggaaatattgttagttctgtaaatatgatatcaagaatgttaataaaccgatttactatgagacacaagaaagcaacgtatgagccagatgtggacctgggatccggaacacgtaacataggtattgagagcgaaactccaaacctagatataataggtaagcgtatagaaaagataaaacaagaacatgaaacgtcatggcattatgaccaagatcatccgtacaaaacgtgggcctaccatgggtcatacgaaactaaacagacaggctccgcatcatcgatggtcaacggtgtggtgcgtttactaacaaaaccttgggatgtcattccgatggttacccaaatggcaatgacggataccactccattcgggcaacaacgagtattcaaagaaaaggtcgacacgagaacacaagagccaaaggaaggaaccaaaaagctaatgaagatcactgctgagtggctttggaaagaactaggtaagaagaaaaccccgcgtatgtgtacccgagaggagttcacacgaaaagtaaggtccaacgcagccttaggcgctatattcactgacgaaaataaatggaagtctgcaagagaagcagtagaagatagtggattttgggaacttgtggataaagaaaggaacctacatctagagggcaaatgtgaaacatgcgtctataacatgatgggaaagagagagaagaaactaggagaatttggcaaagcaaaaggtagtcgagcaatttggtacatgtggctaggagcacgttttctagagttcgaggcactaggatttctaaacgaagaccattggttctcaagagaaaattcacttagtggtgtagaaggtgagggactccataaattaggatatattctacgggatgtgtcgaagaaggaaggaggagctatgtatgcagacgacacggccggttgggatactaggataacattagaagacctgaagaatgaagaaatggtaacaaaccatatggaaggcgaacataagaaactagcagaagccatcttcagactaacatatcaaaataaagtagtaagagtgcaaagaccaactccaagaggaacagttatggacataatttcaaggagagatcaaaggggttcaggacaagtagtgacttacggattaaatacattcactaacatggaggcccaattaatccgacaaatggaaggtgagggtgtatttaaaagtatacaacatctcacggtaactgaagaaatagctgtgaaaaactggttggtacgagtaggcagagaacgattatcccgaatggcaattagtggggatgattgcgtagtaaaacccttagatgaccgcttcgcatcagctttaacagcgctaaatgatatgggaaaggtacgtaaagatatacaacaatgggagccgtcacgtggctggaatgactggactcaagtaccattctgctcgcaccattttcatgaactaattatgaaagatgggagagtacttgtcgtaccatgccgaaaccaagatgaattgattggtagagcaaggatttcccaaggcgccggatggtcgctgcgtgaaacagcctgcttgggaaaatcatacgcacagatgtggagcctaatgtatttccatcggagagatctcagattggccgcgaatgcaatttgttcagctgtgccgagccactgggtaccgacaagtcgaactacatggagcatccatgccactcacgagtggatgaccactgaagatatgctgaccgtatggaatagagtttggattcaggaaaacccatggatggaggataaaactccaattgaatcttgggaagaaataccatacttaggaaaaagggaagatcaatggtgcggaagtctgatagggttaacatcaagagcaacttgggcgaaaaacatacaaaccgccataaaccaagtccgatcactaataggaaacgaagagtacaccgactatatgccttcaatgaaaagattcagaagagaagaagaagaggcaggagtattgtggtaa

SEQ ID NO: 22883 - RNA, 9876 nt, synthetic construct
  misc_feature 1..9876: note = derived and/or modified CDS sequence (opt6) from DENV-2__JN851118__SS-prME
  source 1..9876: mol_type = other RNA
acagcgggtattataataatgatgatacctacagtaatggcatttcatctaacaacaagaaacggtgaaccacacatgattgtttccaggcaggaaaaaggaaaaagtcttctattcaaaaccgaaaatggagtcaacatgtgtaccctcatggcaatggacttaggggaattgtgtgaagatactataacctataattgtcccctattaagacaaaacgaacctgaagatatagactgttggtgtaatagcacgtcaacttgggttacttatgggacctgcaccgctacgggagaacataggcgggaaaaacgctcggttgcattagttccacacgtaggaatgggactagaaacccgaactgaaacgtggatgagctctgaaggagcatggaaacacgcccaacgcatagaaacatggatattaagacaccccggattcactataatggccgccatacttgcttatacaattggtacaacatatttccaacgagttctaatctttattttactgacagctgtaactccttcaatggcgatgagatgcataggaatttcgaacagagattttgttgaaggagtgtcaggtggaagttgggttgatatagttttagaacatggtagttgcgtcactacgatggccaaaaacaaacccacgctagactttgaactgataaaaactgaagctaaacaccctgcaacccttagaaaatattgtgtcgaagccaaattaacaaacaccaccacagccagcagatgcccaacccaaggtgaaccctcgctcaacgaagaacaagacaaacgtttcgtatgtaaacattctatggttgatagggggtgggggaatggatgtggcttgttcggcaaaggtggaatagtaacttgtgctatgttcacgtgtaagaaaaatatggaagggaaagtcgtccaacctgaaaatctcgaatatacaatagtaatcaccccacatagtggagaggaaaacgcagtcggcaatgataccgggaaacatgggaaggaaatcaaagttacaccacaaagttcaatcactgaagccgaactaactggatatggaaccgtcaccatggaatgttcaccaagaactggcctcgattttaatgaaatggttttgttacaaatggaaaataaagcatggcttgtacaccggcaatggtttttagatttgccattgccttggctacctggtgccgatacacagggaagcaactggattcagaaagaaacacttgtgacctttaagaatccacatgctaaaaagcaggacgtagtagtgctaggatcccaagaaggcgcaatgcacacagctctgacaggtgcaactgaaattcaaatgagcagcggcaacctactatttacaggtcacctaaagtgcagactaagaatggataaacttcagttaaagggtatgagctacagtatgtgcacaggcaagttcaaagtagtaaaggaaatagcggaaacacaacatgggacaatcgtaataagagttcagtacgaaggagatggcagcccatgtaaaattccttttgaaataatggatctagagaaaagacatgtgttaggacgactcataactgttaatcctatcgttactgagaaagattcgcccgtcaatatagaggcagaacctccgtttggagatagttacatcattatcggtgttgaaccaggacaactaaaattgtcatggttcaagaaaggcagttcaatagggcaaatgttcgagactaccatgcgcggagcgaagaggatggccattcttggtgacacagcatgggattttggcagcctaggcggagtattcacttcaattggaaaagcattacaccaggtgttcggagctatttatggggcagcattttcaggagtttcatggaccatgaagatacttataggagtcgtaataacatggattggcatgaactcgcgtagcacatctctatcagttagcttagttctggtcggagtagtaactttatacctgggagtgatggtccaagcagacagtggttgcgtagtttcatggaagaacaaggaattaaaatgtgggagtggaatatttattacagacaacgtacatacatggacagaacagtataaatttcaaccggagtcaccatccaagttagctagtgcgatacaaaaagctcatgaagagggaatatgtggtattcggtctgtcactcgactagaaaatctcatgtggaaacaaattacgccagagctgaaccatatcctcacagaaaacgaagttaaacttacgattatgacaggtgatatcaaaggaatcatgcaggcaggcaaacgttctttacgaccacaaccgactgaattaaaatactcttggaaggcttgggggaaggctaaaatgttatctacggaactacataaccacacgtttctgatcgacgggcccgaaactgccgaatgccctaacaccaatagagcttggaacagtctagaggtagaagactacggattcggagtttttacaacaaacatttggctgaaattaaaagaacgacaagatgtgttctgcgattccaaattaatgagcgcagctattaaagataacagagcagtacacgcagacatgggatactggatagaatccgcactaaatgatacatggaaaatagaaaaagctagttttattgaggtaaaaagttgtcattggccaaaatctcatacattatggagcaacggagtactggagagcgagatgatcatacctaaaaacttcgcgggccctgtgtcacaacataactatcgaccaggatatcatacccaaacagcaggcccgtggcaccttggaagactagaaatggattttgatttttgtgaaggcaccaccgttgtagtaacagaagactgcggcaacagagggccgagtttaagaacgacaaccgccagcggtaagttaataaccgaatggtgctgtaggtcatgcacactaccacccctcagatacagaggcgaagatggatgttggtacggaatggaaattagaccattaaaggagaaggaagagaacctagtaaatagtctagtaaccgctggacatggacagattgacaatttttctctaggagtacttgggatggcactatttctagaagagatgctaagaactcgagtaggaacaaaacatgcaatattattagtagctgtatcattcgtaaccttaatcactgggaatatgagcttcagagatttagggagggtaatggtaatggtaggcgctactatgaccgacgatattggaatgggtgtgacttacttggcattgttagcagcatttaaggttagaccgacatttgcagcaggattattattaagaaaattgacttccaaggaacttatgatgaccacgataggaatcgtattattaagccaatcaacaatccctgagagcattctagagctcactgatgctctggcactagggatgatggtattaaaaatagtgagaaacatggaaaagtaccaattagctgtaacaataatggcaatcttgtgcgtcccgaatgcagtgatactacagaatgcctggaaagtgagttgtacaacactcgctgttgtaagtgtaagtccattattacttacctcaagtcaacaaaaagccgattggatcccactagctctcactataaaaggcctcaatccaactgcgatattcctcacaacgctaagtcgcacaagtaagaaaaggtcatggccccttaacgaagcaataatggcggtcggaatggtatcaattctagcaagctctcttctaaagaacgatataccgatgactgggcccttagttgcgggaggactgctaacagtgtgttacgtgcttactggaaggtctgccgatttagaactggagcgagcagcggatgtacgatgggaagaacaggcagaaattagcggaagtagccctattctgtcaataactatctcagaagatgggagtatgagcatcaaaaacgaagaagaggaacaaactttaacaattctgatccggacgggtctacttgtgataagtggtctgttccccgtaagtattccaataacagctgccgcatggtacctatgggaagtcaaaaagcaaagggccggtgtcttatgggatgttccttcacctcccccagtgggaaaagccgaacttgaagatggagcttatcgaatcaagcagaagggtatactaggttatagtcaaatcggtgccggtgtatataaagagggcacattccataccatgtggcacgtgaccaggggagccgtacttatgcataaagggaaaagaatagaaccatcctgggcagacgtaaagaaagatttgatatcttatggaggaggatggaaactggaaggagaatggaaagaaggagaagaagtacaggttctggcgctagagccaggaaagaaccctcgggcagtgcaaacaaagcctggccttttcaaaacaaacaccggaactatcggcgcggttagtttagacttctctcctgggaccagcgggagtccgatagtcgacaagaaaggtaaggtagtaggactatatggcaatggcgtagtaactagaagtggtacttatgtatctgcaatcgcgcaaacagagaaatcgatagaagataacccagaaatcgaagacgatatcttccgtaagaaaaggctaacaataatggacctccatccgggcgccgggaaaacaaaacgataccttccggccattgtaagagaagccattaaaaggggcctgcggactctaatattagcaccaacgagagttgtagcggcagaaatggaggaagcattacgcggacttcccatacggtatcaaactcctgcaataagagccgaacataccggtagagaaatagtagatctaatgtgtcacgccacatttacaatgcgccttctttcccccatacgagttccaaactataatctaattattatggacgaggcacatttcacagatccggcatcaattgccgctcgcggatacatatcaacaagagtggaaatgggcgaagcagctggtatctttatgactgcgacacctccaggctccagagatccatttccccaaagtaatgcgccaataatggacgaggaacgtgaaataccggagcgttcttggaactcaggtcacgaatgggtcacagattttaagggcaaaacggtatggtttgtaccatcaataaaggcaggaaatgacattgcagcctgtctaaggaaaaatggtaaaaaggtcatccaattaagtcgaaaaactttcgattctgagtatattaaaaccagaacaaatgactgggactttgtagtaactactgatatatcagaaatgggagccaatttcaaggccgagagagtaatagacccaagaaggtgtatgaaacctgtgatattaacagatggtgaagaacgagtgattctagccggacccatgcctgttacgcattctagcgctgcccaacgcagagggagagtgggacgaaatcccaaaaatgaaaatgatcagtatatttatatgggggaaccgcttgaaaacgatgaagattgtgcgcactggaaagaagctaagatgctacttgacaatattaatacgccagaaggaataatccctagtatgtttgagccggaacgcgaaaaggtggatgcaatcgacggggaatacagactgcgaggggaagcccgtaagacatttgttgatcttatgaggaggggtgatttacctgtgtggttagcataccgagtggctgctgaaggtatcaactacgctgatagaagatggtgttttgacggagttaaaaataaccaaattttagaggagaatgtagaagttgaaatatggacgaaggaaggtgagcggaagaagctaaaacctagatggcttgatgcaaggatttattcagatccactcgctctcaaagagttcaaagaatttgccgcaggccgaaaatccctaaccctaaacctcattacagagatgggtaggttaccaacgtttatgacgcaaaaggctaagaacgcactagacaatctagcagtacttcacactgctgaagcagggggcagagcgtacaatcatgctctatcagaattgcctgaaacactcgaaaccctgctactacttaccctattagccacagtgacaggcgggatatttttatttttaatgtcgggcaaaggaataggaaaaatgacactgggtatgtgttgtatcattaccgcttccatactgttgtggtatgcgcaaattcaacctcactggatagcggcctcaataatattagagttcttcctgatagtactactaataccagaacccgaaaagcaaaggactcctcaagacaatcaattgacatacgtagtgatcgcaatccttactgtggtggcagctactatggcaaacgaaatgggtttccttgagaaaaccaaaaaggattttggattaggatcaatcaccacacaacaaccagagagtaacatactagatatagaccttaggccagcatcagcatggacgctatatgcggtggcaaccacgtttattacacctatgttacgtcattccatagagaatagttccgtaaatgtatctctgacagccattgcaaatcaagccactgttctaatgggactaggaaagggatggcctttatcaaaaatggacataggcgttcctttattggccattgggtgttactctcaggttaatccaataacgttgaccgctgcattattactgctagttgcacactacgcaataataggacccggcttgcaagcaaaagctaccagagaagcacaaaaacgggctgcagctggcataatgaaaaatccaacggtagatgggatgacagtcatagatttagatccaattccgtatgacccgaaattcgaaaaacaactaggccaagtcatgttactggtcttatgtgtcactcaagtcttaatgatgcgtacaacatgggctttgtgtgaagctcttacattagccacaggacctataagtaccttgtgggagggtaatcctggtaggttctggaacaccactatagcagtatcaatggctaacatattccgcggtagctatttggccggtgcaggattactcttcagtataatgaagaatacggcaaacacacgcagaggtaccggtaatacgggagaaacgctcggtgaaaagtggaaaaatagactaaacgcactgggaaaatcggaatttcaaatttataagaaatccggtattcaggaagtcgacagaaccctagcaaaggaaggtatcaaacgaggtgaaacagatcaccacgcggtttccagaggatcagcaaaattacgttggtttgtagaacgtaatcttgtaaccccagagggtaaggttgtcgacctcggatgtggtagagggggatggagttattactgtggaggcttgaaaaatgtcaaagaagtaaaaggcctaacgaaaggtggaccaggccatgaagaacccatacccatgagcacctacggatggaacctagtcagactccaatcgggagtagatgtattctttactccacccgagaaatgtgatactttattatgtgacataggtgaatcctcaccaaatcctaccgtggaagcggggagaactctgcgggtgttaaatctcgtcgaaaattggttgaacaacaacacgcaattttgcataaaagtcttgaacccatatatgcccagtgtaattgagaaaatggaagccttacaaagaaagtacgggggcgcgctagttcgaaacccattatccagaaattctacacacgaaatgtattgggtgtcgaacgccagtggcaatatcgtctcctctgtcaatatgatatctaggatgctgattaatcggtttactatgcgacataagaaagccacttatgaaccggacgtcgatttaggaagcggaacaaggaacatagggatcgagtcagaaaccccgaacttagacataatcggtaaacgtatagagaaaattaaacaagaacacgaaacaagctggcattacgatcaagaccacccttataaaacgtgggcgtatcatggatcatatgaaacaaaacaaacaggttccgcttcttcaatggttaatggggttgttagactgttaacaaagccgtgggatgtgataccaatggtaacccaaatggcaatgacagatactaccccatttggacaacaaagggtcttcaaagaaaaggtcgataccagaactcaagagccaaaagaaggaaccaagaaacttatgaagataacagcggaatggctatggaaagaacttggcaagaagaaaacaccaagaatgtgcacccgagaggagtttacccgaaaagtacgctccaatgcagcgctcggagctatctttactgatgaaaataaatggaaatctgcaagagaggcggttgaagattcaggtttctgggagctcgtagacaaagaaagaaacttacatctagaaggcaaatgcgaaacgtgcgtgtataatatgatgggaaaacgggagaagaaactaggcgagtttgggaaagccaaaggcagcagagccatttggtacatgtggcttggagctcggttcctcgagttcgaagcgttgggctttctgaatgaagatcactggttcagtagggaaaatagtctgtcaggggttgaaggggagggcctacacaaactaggatacatactaagagacgtaagcaaaaaggaaggtggggcaatgtacgcagacgataccgctggctgggatactcgtataactctagaagatctaaagaatgaggaaatggtgacaaatcatatggaaggggaacacaagaaacttgctgaagctattttcaaactcacctatcagaacaaagtagtaagggtccaacggccaacacccagaggaactgttatggatattataagccgaagagatcaacgtggatcaggtcaagtagtaacatatggactaaatacatttaccaatatggaagctcaacttataagacaaatggaaggagaaggtgtattcaagtccatccaacagttaacggtaaaagaagaaattgctgtaaagaactggttgattagggtcggaagagaacgactaagtagaatggcgatatccggggatgattgtgttgttaaacccctagacgatagattcgcgagtgcactaaccgcactaaatgatatgggtaaagtgagaaaagacattcagcagtgggaaccgtcaaggggttggaatgattggacgcaggttccattttgctcacatcattttcacgagctaatcatgaaagatggtagagtactggtagtcccgtgtcgtaatcaagatgaactaataggtcgcgcaagaatcagccaaggcgcaggatggtccctacgagaaactgcatgtttaggaaaaagttatgcacaaatgtggagcttaatgtactttcatcgaagggacctcagattagcagcgaacgcaatatgttcggctgttccttcgcattggataccaacttcaaggacgacatggtcgatccatgcaactcatgagtggatgacgactgaagatatgttgaccgtatggaatcgagtatggatacaagaaaatccttggatggaggacaaaacaccggtagagtcttgggaggaaataccctacttgggaaaacgtgaagaccaatggtgtgggagcttgattggactaacaagtcgcgccacatgggccaagaatatacaaactgccataaatcaagtaagaagtttgattggaaatgaagaatacacagattatatgccatccatgaaacgattcagaagagaagaagaagaggctggagtcttatggtga

SEQ ID NO: 22884 - RNA, 9876 nt, synthetic construct
  misc_feature 1..9876: note = derived and/or modified CDS sequence (opt6) from DENV-2__JN851124__SS-prME
  source 1..9876: mol_type = other RNA
actgctggtattataatcatgatgataccgacggtcatggcattccacttgactactagaaacggagaaccgcacatgattgttagtcgacaagaaaaaggaaaatccctcctatttaaaactgaaaacggtgtgaatatgtgtacattaatggcaatggatttgggagaattatgtgaagacacaataacatataactgtccgttactaaaacaaaacgaacccgaagatatagattgttggtgcaatagcacctccacttgggttacttacgggacctgtacagcaacaggagaacacagaagagagaaaagaagtgtcgcgttggttccccatgtaggaatgggattagaaacaagaacagaaacatggatgagtagtgaaggcgcgtggaaacacgcacaaagaattgaaacttgggtaatgagacaccccggattcaccgtaatggcagctatacttgcatatacgattggtacaacatatttccaaagggttctcatttttatcctcttaacagcagtagcaccaagcatgactatgagatgcattggaatctctaatagagattttgtagaaggtgtatctggaggttcatgggttgatattgtcttggagcacggatcttgtgtgacaactatggccaaaaacaaacccacgctcgattttgaattaatcaaaacagaagcgaaacaccctgcaaccttgcgcaaatactgtatcgaagcaaaattgactaacactaccacagcatcccgatgcccaactcaaggagaacctagtttaaatgaagaacaagataaaagatttgtttgtaaacattcaatggtagatagagggtggggaaacggatgcggactttttggaaaaggaggaatcgtgacgtgtgcaatgttcacatgcaagaaaaatatggaaggaaaagtagtacaaccagaaaacttagaatacacaatcgtgataacgccacattctggcgaagaaaatgcagtaggtaacgatacaggaaaacatggaaaagaaattaaagttacgcctcaatcatcaatcactgaagcagaattgaccggctacggaaccgttaccatggaatgttctccacgaactgggctagactttaacgaaatggtcttactacagatggaaaataaagcctggctcgtacatagacaatggtttctggacttaccccttccgtggctacctggagctgatacacaaggatctaactggatccagaaagaaactttagtgacatttaaaaatccacacgctaagaaacaagatgtcgttgttttgggctcacaggaaggtgcaatgcacactgcactgacaggcgcaacagaaattcagatgtcaagtggaaacctactatttacagggcacctcaaatgtagacttcgtatggacaaactccaattaaaaggcatgagttacagtatgtgcacaggtaaattcaaagttgtaaaagagatcgcagaaacacagcatggcacaattgtcataagagtgcaatacgaaggagacggctccccgtgtaaaatccccttcgagataatggacttggagaaaaggcatgtattaggcagacttattactgtaaatcccatagttactgaaaaagactctccagttaacatagaagcagaaccacccttcggcgacagctacataatcataggcgtcgaaccaggacaattaaaattgtcgtggttcaagaaaggctcatctataggtcaaatgttcgaaacaacaatgaggggtgccaaacgaatggcaatcttgggtgacacagcatgggactttggcagcttaggaggggtattcacttctattggaaaagcactacaccaagtatttggggcgatatacggggcggcatttagcggggtgagctggactatgaaaattctcattggagttgtaattacttggatcggaatgaactcgcggtccacctcactctctgtaagtctagttttagttggagttgtaaccttatatcttggggtcatggtccaagcggacagtggatgtgtagtttcctggaaaaataaagaactgaaatgtggctccggaatctttattacagacaatgttcacacttggactgaacaatataaattccaacctgagtcaccaagtaaactagccagtgctatacaaaaagcacatgaagaaggcatatgtggaatccgaagtgtcacacgtctagagaacctcatgtggaagcaaataacaccagaacttaatcacatcctttcagaaaacgaagtaaagatgacaataatgacaggggatataaaaggtataatgcaagcgggcaagcgttcactaagacctcagccaacagagttaaaatattcatggaaagcatggggaaaagctaaaatgctaagcacggaattgcacaaccacacatttttaatagatgggcccgaaaccgcggaatgcccgaacacaaatagggcctggaacagtcttgaagtagaagattacggattcggagtctttaccacaaatatatggcttaagctaaaggaacgccaagacgtgagttgtgacagcaaattaatgagcgcagcgattaaagataatagggctgtccatgcagatatgggatattggatagagtcggcactcaatgatacttggaagatagaaaaagcatcttttatcgaggttaagtcttgccactggcccaaatcacatacactatggagtaatggggtgttagaatcggaaatgataatacccaaaaactttgctggtcccgtttctcaacataactatagaccaggttatcatacccagaccgcaggaccgtggcacctcggaagacttgaaatggatttcgatttctgcgagggaaccacagttgttgtaactgaagattgtggtaatagaggaccatctttacgaacgacgaccgcttctggaaaactgataactgaatggtgctgcagatcatgcactttacctccattaagatatcgaggagaggacggttgttggtatggtatggaaatacgccccctaaaggaaaaagaggaaaatctagtaaatagtctggtaactgcgggacatggacagatagataattttagcttaggagttctcggaatggcactatttttggaagaaatgttgagaacacgcgtaggtacgaagcacgcaatattgttagttgctgtctcgtttgttaccttaatcacaggaaacatgtcatttcgtgacttgggtagagtaatggtaatggtcggtgcaacaatgacagatgacatcggcatgggagtaacctatctagcactgctggccgcatttaaggttcgcccgacttttgcagcaggattgttactacgaaaactaacaagcaaagaattaatgatgaccacaataggtatagttctattatctcaatcaacaatcccagaaacaatattggagcttacagacgctctagcattgggaatgatggtgttaaaagtagtaagaaacatggaaaaatatcaactggcggtaactattatggctatattatgtgtcccgaacgcagtaatcctccaaaacgcctggaaagttagctgtacaactttagcagttgtttctgttagcccgttactccttacctcatcccaacaaaaggctgattggatcccacttgccttaacaattaaagggctcaaccctaccgcaatatttttaacaacactctcaagaacaagtaagaaacgatcctggcctctaaacgaggctatcatggcagtaggtatggtctcgatactagcttcatcattactgaaaaatgatatacctatgaccgggcctttagtcgctgggggacttttaacagtatgctatgttttaacaggacgctcagccgatctcgaactagaaagggcggctgatgtacgctgggaagaacaagccgaaatatctggttcttctccgatactaagtataacaattagcgaggatgggagcatgagcattaagaacgaagaagaagaacaaactttaaccattcttattcgaactggattgctcgttatttcagggctctttccagtcagtatccccataacagcagccgcttggtatctttgggaagtgaagaaacaacgggcaggcgtcctctgggatgtcccttctccaccaccagttgggaaagctgaattagaggatggcgcatatcgaatcaaacaaaaaggaatattgggttatagccagataggcgcaggcgtttacaaggaaggaactttccatactatgtggcacgtgacacggggtgcggtattaatgcataaagggaaaaggatagaacctagctgggcggatgtgaagaaagatttaatcagttacggtggtggatggaaattagaaggtgaatggaaagaaggagaagaagtacaagtactggcgcttgaacctggcaaaaatccccgggctgtccagacaaagccaggactcttcaaaactaacaccggaacaatcggagcagtctcattagatttttcaccaggaacgtctggttcacctatagtagataagaagggtaaagttgtagggctatatggcaacggtgtagtaactagatctggaacctacgtatcagcaatcgcacagactgaaaaatctatagaagataatccggaaatcgaagatgatatattcagaaagaaacgcctaacaataatggacctccacccgggggcgggcaagactaaacgatacttacccgcaatagttagagaagccatcaaacgagggctgcggactttaatattagcgccgactcgtgtggtcgcagcagagatggaagaagcattacgcggattgccgatacgataccagacaccggcaattagagccgagcacactgggcgagaaattgtagatctcatgtgccatgctacgttcacaatgcgcctcttatccccgatccgagttccaaattataatctgattatcatggatgaagcacactttacggatcctgcaagtatagcggcgcgggggtatatcagtactcgagtggaaatgggagaagctgcaggaatattcatgacagccaccccaccaggatcacgagatccattccctcaaagtaatgcaccaattatggacgaagaacgagaaataccagagcgatcgtggaatagtgggcatgaatgggtaactgacttcaagggaaaaactgtctggtttgttccatccataaaagcaggcaatgacatagcagcctgcctaaggaaaaacggcaagaaagtaatacaattatcgcgtaaaacctttgattcagaatacattaaaactagaacgaacgattgggattttgtagtaaccactgatatatcagaaatgggagccaattttaaagctgaaagagtaatagacccgagacgttgtatgaaaccagtcatattgactgatggagaagagagagtcatactagcaggtcccatgcccgtaactcattctagtgcagcacaacgacgaggacgcgtaggccggaatcccaaaaacgaaagtgatcaatacatatatatgggagaacccctggaaaacgacgaggattgtgcacactggaaagaagcaaaaatgctactagataacatcaacacccccgaaggtataattccttctatgttcgagccagaaagagaaaaagtcgatgcaattgacggagaatacagattgagaggagaagcacgaaagacatttgttgatctaatgagaagaggggatttaccggtatggttagcttaccgagtcgcagcagaaggtatcaattacgctgacaggcgctggtgttttgatggcgtgaaaaataaccagatattagaggaaaatgtagaggtagaaatatggacaaaggagggagaacgcaagaaattaaagcctagatggctcgatgcccgcatatattctgacccgttggctctaaaagaatttaaagaatttgccgcaggtcgaaaatctctcaccctgaatctgatcacagaaatgggtaggctccccacatttatgacccaaaaggcgagaaatgcattagacaatttagctgtcctacatactgcagaagctggcggacgagcgtataatcatgcattaagcgagctacctgaaacccttgaaacattgttactacttacactgttagcgacagtaacaggtggaatattcttattcttgatgagcggcaaaggaatcggtaaaatgacattaggaatgtgctgcatcataactgcttctattctgctatggtatgcccaaatacaaccccattggatcgctgcaagtataatactagaatttttcctcatagtattgctaatccctgaacccgagaagcaaagaacacctcaagacaaccagctaacgtacgtcgttatcgcaatcttaactgtagtagctgcaacaatggcaaatgagatgggcttcctagagaaaactaagaaagatttcgggctaggaagctcaaccacacaacaacacgagagtaatattttggacatagacttgcgtccagcaagcgcgtggactctatatgcggtggcgacaaccttcattacacctatgttaagacacagcatagaaaattcaagcgtaaatgtcagtctcacggccattgccaaccaggcaactgttttaatgggcttagggaaaggatggccactgagtaagatggatataggcgtgcctctactggccatcggatgctactcccaagttaacccgataacactcactgctgcactcctaagcctagtcgcccattatgccatcataggaccaggtttacaggcgaaggcaactagagaagcacagaaaagagcggctgccggtatcatgaagaatccaaccgtggacggaatcacggtaatagacctagatcccattccatatgatcctaaatttgaaaaacaactaggacaagtcatgctattagtactctgcgttactcaggtactgatgatgcgaactacatgggctctatgcgaagccttaactctagcaaccggacccataagtacactctgggagggcaatcccggtagattctggaacacaaccatagcagtcagcatggcaaatatatttcgcggaagttacctcgccggggcgggactgttgttctccataatgaagaatacagctaatacgcgccgaggaacaggcaatactggtgaaactctgggagaaaaatggaagaatcgactaaacgcattaggaaaatcggagttccaaatctacaagaaatcggggatccaggaggtggatcggaccctcgcaaaagaaggcattaaacgaggcgaaactgatcaccatgccgtatcaagaggtagtgctaaattaagatggttcgtggaacgtaatcttgtaacgccggaaggcaaggtagttgacctaggctgtggaaggggcggttggtcatattattgcggcggcctaaagaatgttaaagaagtaaaagggctaacaaaaggtggacctggtcatgaggaaccaatccccatgagcacttatggttggaatttagttaggcttcaatcgggcgttgatgtattctttacgccaccagagaaatgtgacacgttattatgcgacatcggtgaatcatcaccgaatcccactgttgaggcagggagaactttaagagtactgaatttggtcgagaattggcttaataacaatactcaattctgcataaaagtgctaaatccttatatgccaagtgttatcgagaaaatggaagcactgcaacgcaaatacggaggtgcgttagttagaaatccactgagcagaaattcaacacacgagatgtactgggtctcaaacgcgagcggaaatatcgtttcttccgtgaacatgatatcgaggatgctaataaacagatttaccatgagacataagaaagtaacttacgaacccgacgtcgacctaggcagcggaactagaaacatcggaatcgagagtgaaacccccaacttagacataatcggaaagcgtatcgaaaagattaaacaggagcacgaaacgtcttggcattatgaccaggatcacccctataaaacctgggcataccatggctcgtatgagacgaaacagactggttccgcgtcctcgatggtcaatggtgtggtcagacttttaactaaaccatgggacgtaattcccatggttactcagatggcgatgacagacacaacaccatttggtcagcaaagagtattcaaggagaaagtagacacccgaacccaagagcctaaagaagggactaagaaattaatgaaaattaccgccgaatggctttggaaagaacttggcaagaagaaaactcctagaatgtgcacgagggaagaatttactcgaaaggtacgaagcaacgctgctcttggtgccatattcacagacgaaaacaagtggaaaagtgctagagaagctgttgaagattcaggtttttgggagctagtggacaaggaacggaacttacatctagaggggaaatgcgaaacatgcgtatataatatgatgggaaaaagagagaagaaactaggagaatttggtaaagcaaaaggatcccgcgcgatctggtatatgtggttaggagcaagattcttagagttcgaagcattgggctttttaaatgaagaccactggttttcccgggaaaacagcctctctggcgtagaaggtgaagggttacacaagttgggttatatacttcgagatgtatctaaaaaggaaggaggagctatgtatgcagacgacaccgcaggatgggatactcgcatcactctagaagatttaaagaacgaagaaatggtcacaaaccatatggaaggggaacacaagaaattagcagaagccatatttaagctaacgtaccaaaataaagttgtacgagtccaaaggccaacaccaagaggaactgtaatggacataatatcccgaagagaccaacgaggctccggccaagttgtaacatacggtttgaatacttttaccaacatggaagcccaattaataaggcagatggaaggggaaggtgtatttaagtcgatacaacaactgacagctacggaagaaatagcggtcaaaaactggcttgtaagggttggaagagaacgactgtcacgcatggcaataagcggcgatgattgtgttgtcaaaccattagatgacagatttgcgagtgcgttaacagctctaaatgatatgggtaaggtacgaaaagatattcaacaatgggagccatcaagaggttggaatgattggacccaggttcctttctgctcacaccactttcatgaattaataatgaaagatggacgagtacttgtggtaccctgtcgaaatcaagatgaacttatcggtagggctcggattagtcaaggggccggttggtcattgagggaaacagcatgtttgggaaagagctatgcccagatgtggtcattaatgtacttccatagaagggacttaaggctagcggctaacgcaatatgttccgcagttccatcgcattgggttccgacaagccgaactacgtggagtatacatgctacacatgaatggatgactaccgaggatatgctgactgtatggaatcgagtttggatacaagaaaatccttggatggaggataagacacctgtagagtcctgggaggaaatcccatacttgggtaaacgagaagatcaatggtgtggatctctaataggattaacaagtagggcaacctgggccaaaaacatacaaacagcaataaatcaggtcaggagcttaatcggaaacgaagaatacacagattatatgccttctatgaaacgatttagacgagaagaagaagaagccggtgtgttgtggtaa

SEQ ID NO: 22885 - RNA, 9876 nt, synthetic construct
  misc_feature 1..9876: note = derived and/or modified CDS sequence (opt6) from DENV-2__JN851114__SS-prME
  source 1..9876: mol_type = other RNA
acagctgggatcataataatgatgatacccacagtgatggcctttcacctaaccaccagaaatggagaacctcacatgatagtctcaagacaagaaaaagggaaatccttattgttcaaaacagaaaatggagtcaatatgtgcactcttatggctatggacttaggagaattgtgcgaagatactataacatacaattgccctctattaagacaaaacgaaccggaagatatagattgttggtgcaatagcacttcaacctgggtaacatatggcacatgtaccgcaacaggcgaacacagacgcgaaaaacgaagtgtggctcttgttcctcatgtgggaatgggactagaaacgcgaactgaaacatggatgtcaagcgaaggagcctggaaacatgcacaaagaatagaaacctggattctaagacatcctggctttacaataatggcggctatcttagcatatacaatcggaaccacctatttccaacgagtcctaattttcatcttgttgacagcagtaactccaagcatggcaatgagatgtattggcatttccaacagagattttgtcgaaggagtttctggaggctcgtgggttgatatagtactagaacatggcagttgtgtaaccactatggctaaaaataaaccgactctagactttgaacttataaaaactgaagcaaaacatcccgccactttaagaaaatactgcgtcgaagcaaaacttactaacactacaacggcgagtaggtgtccaacccaaggtgaaccttcccttaatgaggagcaagacaaacggttcgtttgcaaacacagcatggtcgaccgtggatggggcaatggttgcgggttattcggaaaagggggtattgtaacctgcgcaatgtttacatgcaagaaaaatatggaaggtaaagttgttcaaccggaaaatctagaatataccattgtgattacaccacacagtggcgaagaaaatgccgtaggaaacgatactggaaaacacggtaaagaaataaaagttactcctcaatcaagtataacagaagctgaactaaccggttacggtactgtaactatggaatgtagtccaagaactggcctggattttaatgaaatggttttattgcaaatggaaaataaagcgtggttggtacaccggcaatggtttttagatcttccattaccttggctaccaggtgcagacacgcaaggttcaaattggatccaaaaagaaacgctagtaaccttcaaaaacccacatgctaagaaacaggatgttgtagttctgggatcacaagaaggagcgatgcacacagcactcactggcgcaactgaaatacaaatgagttctggcaatcttctgtttaccgggcatctaaaatgtagactacgtatggataaattacagctcaaaggcatgtcttactcgatgtgcacgggaaaattcaaagttgtaaaagagatcgccgagactcaacatggtactatcgtaattcgagtgcaatatgaaggagacggctcgccatgcaaaattccgttcgaaataatggacctggagaaaagacatgtcctagggcgattgattactgttaacccgatcgtcacggaaaaagatagtcctgttaacatagaagctgaacccccgttcggggattcttatataattataggtgtggagcctggacagctgaaactatcatggtttaagaaaggaagttctattggacagatgttcgaaacaacgatgcgcggagcaaaaagaatggctatcctcggagacactgcctgggacttcggctctttaggcggggtctttacatccataggtaaagcacttcatcaggtttttggcgcaatatacggagcagcgttctcaggagtcagctggactatgaaaatattaattggtgtggtgataacctggataggaatgaactcacgaagtacgagcctgagcgtgagcctagtattagtcggggtggtcactctgtacctgggtgtaatggttcaagcggactccggttgcgtagtatcatggaaaaacaaagaacttaaatgtggatccggtatattcataacagacaatgtacatacatggacagagcagtataaattccaacctgagtcaccatcaaaactagccagcgccatccaaaaagcacacgaagaaggaatttgcggtatccgaagcgttacgcgattagagaacttgatgtggaagcaaattacgcctgaacttaaccatattctcacagagaacgaagtgaaattaaccataatgaccggggatattaagggaatcatgcaggctggcaaacgatctctacgaccacaaccaacggaattaaagtactcgtggaaggcctggggaaaagctaaaatgctgtcaaccgaactacacaatcacacatttcttatagatgggccggaaacggcagaatgcccaaatactaacagagcctggaactcactggaagtagaagattatggtttcggcgtattcacgaccaacatctggctgaaacttaaagagcgacaggacgtgttctgcgacagcaaactcatgtctgctgcaattaaagataacagagcagttcatgctgacatgggatactggattgaaagtgctcttaatgatacttggaaaattgagaaggcaagtttcatcgaagttaaatcttgtcattggccgaaaagccatacactgtggagtaacggtgtcctggagtcagagatgattataccgaaaaatttcgcggggcctgtctcccaacataattacagaccaggctaccatactcaaactgcaggcccatggcatctaggcagactagaaatggactttgatttttgtgaaggaacaactgttgtagtaactgaagattgcggaaatcgagggccttccttacgaacaactactgcgtctggcaagttgatcacagagtggtgttgtcgaagttgcactttgccccctctacgatacagaggtgaggatggatgctggtatggaatggaaataaggccacttaaggaaaaagaagaaaaccttgtaaatagcctagtaacggcaggtcacggtcagattgacaatttttctctaggtgtattaggcatggctttatttcttgaggaaatgctcagaacacgtgtcggtaccaaacacgctatattacttgtagctgtgtcatttgtaacattaatcacgggaaacatgtcgtttagggatttagggagggttatggtaatggtaggtgcaacaatgacggatgacatagggatgggggttacctacttagctctacttgcagctttcaaagtgcgaccaacatttgcagctggtttattattaagaaaactaacaagtaaagaattgatgatgacaacaatcgggatagtactattgtcacagtccactataccagaaagtatactcgaacttacagatgcgctagcactgggaatgatggtgttgaagatagtcagaaacatggaaaagtaccaacttgcggtgacaattatggcgattctatgcgttcctaacgccgtcatactacaaaacgcatggaaagttagttgcacaactcttgctgtagtaagtgtgagtccactgctactaacaagtagccagcaaaaagcagactggatacctttagcactcacaatcaaagggttaaatccaactgctatcttcctcacaacgctaagtcgcacaagtaagaaacgatcttggcccttgaacgaagctataatggccgtcggaatggtttcaatattagcgtccagtctattaaagaatgacataccaatgactggaccattagtggcaggaggattattaacagtgtgttacgtattgacaggtagatccgcagatctagaactagaacgagcggccgatgtacggtgggaagaacaggccgagattagtgggtcatctcctatattaagtataacaatctccgaagacggaagtatgtctattaagaatgaagaagaggaacaaacattaaccatcttaatacggaccggacttttagtaatatcaggtttatttccagtaagtatcccgatcactgccgcagcatggtatctttgggaagttaagaaacaaagagctggtgtgctatgggatgtcccttctcccccaccggtagagaaagcagaattggaggatggagcataccggataaaacaaaaaggaatcctaggctacagtcaaattggggcgggggtctataaggaaggcacatttcacaccatgtggcacgtaacccgtggagcagttttaatgcataagggtaagcgaattgaacctagctgggccgatgtcaagaaagatctaattagttacggcgggggatggaaactagaaggagaatggaaagaaggcgaagaagtccaagtactggcacttgagccaggtaaaaatcctcgagcagttcagacaaagccagggctattcaaaaccaacaccggaaccattggtgctgtatcccttgacttttctccagggaccagcggatccccaattgtagataaaaaggggaaggttgtaggcctttatggaaacggggtagtaaccagaagcggaacgtatgtctccgctatcgcacaaacggaaaagtctatagaggacaaccccgaaatcgaagacgatattttcaggaagaaacgcctgacaatcatggacctacatccaggtgcgggtaaaactaaaagatacctacccgcaatagtgcgagaagcaatcaaaaggggcctacgaacgcttatattagcaccgacccgggttgttgcagctgaaatggaagaagcacttagaggcctaccaatcaggtaccagacccctgcaataagagcagagcataccggcagagaaattgtagatttgatgtgccatgcaacgtttaccatgagactcctcagcccaatcagagtgccaaactataatcttataattatggatgaagcccactttacagacccagcgtcgatcgcggccaggggatacataagcacacgcgtagaaatgggtgaagcagctggaatttttatgacagccactcccccaggttctagagatcctttcccgcaaagcaatgctcctataatggacgaggaacgggaaataccagaacgttcctggaactcaggccatgaatgggtaacagactttaaaggaaaaacagtatggttcgtaccatccatcaaagcaggtaacgatattgcagcctgtctacgtaaaaacggcaagaaagtaatccaattatcgaggaaaacattcgattctgaatacattaaaactcgtacaaatgattgggatttcgtagtcacaaccgatatatcagaaatgggtgctaattttaaggcagagagagtaatagaccctagaagatgtatgaagcctgtaatcctaaccgacggagaagaaagggtcatactcgccggaccgatgcccgtcacgcacagctcagctgcgcaacgacgaggcagagttggacgaaaccctaaaaatgaaaatgatcagtatatatatatgggagagccattagaaaacgacgaagattgtgcacattggaaagaggcaaagatgttgctagacaacattaatacaccagaaggaatcatacctagtatgtttgaaccggaaagagaaaaagttgatgcaatcgatggcgagtacaggctccgaggggaggcgagaaagacctttgtggatttaatgcgtagaggagatttaccggtgtggctagcatatagggtagcagctgaggggatcaattacgcggacagaaggtggtgtttcgacggcgtaaagaataatcaaatactggaagaaaatgtagaagtagaaatatggacaaaagaaggagaaaggaagaaattaaaacccagatggctcgacgccaggatatactcagacccattggctttaaaagagtttaaagagttcgccgcaggccgtaaatcattaacattaaatttgatcacagaaatgggacgcctacctacatttatgactcagaaagctaagaatgcgttggataatctagctgtactacatacagcggaagctggtggccgagcatataatcatgctctgagtgaattaccagaaacattagaaacattattattattaaccttactagctacagtaacaggcggtatattcttatttttaatgagtggtaaaggcataggtaaaatgacactagggatgtgctgtattattactgcaagtatcctcttatggtacgctcaaatacaaccacattggatagccgcttccattatcttagagttctttttgattgtactcctgataccggaaccagaaaaacaaagaacgccacaagataatcaattaacatacgttgtaatagcgatattaacggtcgttgcagctactatggctaatgaaatgggtttcttagaaaagaccaagaaagattttggtctcggaagcatcaccacgcaacagccagagtctaacatactggatatcgatttaagacctgcaagtgcttggactctatacgcggtagcaacgactttcataacgccaatgttaagacactcgattgaaaattcatcagtaaatgtgagccttacagcaattgctaaccaagcgaccgtacttatggggttaggaaagggttggccactctcaaaaatggatattggagtgccattattagcaataggttgttactcccaagtgaaccctatcacattgactgctgctttacttcttttagtagcccactatgccatcattggaccagggcttcaagctaaagctacaagagaagcgcagaaaagagcagcagctggtatcatgaaaaaccctacagtcgatggaatgaccgtgatagatttggatcccattccttacgatcctaaatttgaaaagcaactaggtcaagtcatgttattagttctgtgcgttacgcaagtactcatgatgcgaacaacttgggctttgtgcgaagccctcacattagctactggaccaataagcacgctttgggaaggaaacccaggacgtttctggaatacaacgatagcagtttctatggcgaacatttttagaggaagctatttagctggcgcaggactactattttcaataatgaaaaatacagccaatacccgaaggggaacaggtaatacaggagaaacgttaggtgagaaatggaaaaacagacttaatgcattaggcaaatctgaatttcaaatctacaagaaatcaggcattcaggaagtggatcggacgctcgccaaagaaggtatcaagagaggggaaacagaccatcatgcagtgtctaggggaagcgcaaagttgagatggtttgtggaacgcaatctagtaacaccagaaggtaaagtcgtagatttaggatgtggtcgtggaggatggagctattattgcggtgggctaaagaatgtaaaagaggttaaaggtttaacaaaaggaggaccaggacatgaggagccaatccctatgtccacttatggatggaatttagtgaggttgcagtctggtgttgacgtatttttcacacctccagaaaaatgcgacacattactatgtgatataggggaaagttctccaaatccaactgtagaagcaggtcgcaccttaagagttttaaatctggtggaaaattggctaaacaacaatactcaattttgtataaaggtgctaaatccttatatgccgtctgtcatagagaaaatggaggctctacagagaaaatacggtggcgctcttgtacgtaacccattgtcaagaaatagtactcatgaaatgtactgggtttcgaatgcgtccgggaatatagtatcaagcgtcaacatgatctcaagaatgctaataaacagatttaccatgcgacacaaaaaggcgacctacgaaccagatgtagatttaggctcgggaacaagaaatatcggaatagaaagtgaaacccccaatttggacattataggaaaaaggatagagaaaatcaaacaagagcatgaaacgagctggcactacgatcaagaccatccctacaagacatgggcttatcacggatcttatgaaacaaaacaaactggatcggcttccagtatggttaatggggtagtaagactactaacaaaaccctgggatgttatcccgatggtaacacaaatggcaatgacggatacgactccatttggccaacaacgagtgttcaaagaaaaggtagacacgagaactcaggaaccaaaagaaggtactaagaaactaatgaaaattacagcagaatggttgtggaaagaactaggcaagaagaaaacgccacgaatgtgcaccagagaagagttcactcggaaagtgagaagtaacgctgcattaggtgccatatttaccgatgaaaataaatggaaaagcgcaagggaggctgttgaagattcaggtttctgggaattagtagataaagagagaaatttgcatttagagggaaaatgcgagacttgtgtatataacatgatgggtaagagagagaagaaactaggagagtttggtaaagcaaagggttcacgtgctatatggtatatgtggcttggtgcacgattcttggagttcgaggctctaggatttctaaacgaagaccattggttttcgagagaaaatagcctaagcggtgtcgagggtgaaggcttacataaactaggctacatcctccgcgatgtatcgaagaaagaaggaggggcaatgtatgctgatgatacagcaggatgggatacacgcataacgcttgaagatttgaagaatgaagaaatggttacaaatcatatggaaggagaacacaagaaattggctgaagccatttttaaacttacttatcagaataaagtagtccgtgtccagcgaccaacaccgcgagggactgtaatggatataatcagccgacgcgaccaaagaggttctggacaagtagtaacttacggcctcaacacttttacgaacatggaagcccaactaataagacaaatggagggagagggtgtttttaaatcgattcaacaactaacagttaaagaagagatcgccgtaaagaattggttaatccgcgtgggaagggaaaggttatcccgaatggcaataagcggtgacgattgcgttgttaaaccactagacgatcgatttgccagcgcattgacagcactaaatgatatgggcaaggttcgaaaagatattcaacaatgggaacctagcagaggctggaatgactggacacaggtaccattctgttcccatcattttcacgagctaataatgaaagatggcagagtgctggtggtaccatgtaggaaccaggacgagctaatcggtagagcaaggatatcacagggagcgggatggtcactcagggaaacagcatgcctaggaaaaagttatgcacagatgtggtcactcatgtattttcacaggagagatctaagactggcggcaaatgcaatatgctctgcagtaccatctcattgggtaccaacttcacgtactacatggagcattcacgcaacacacgaatggatgacaaccgaggacatgctaactgtctggaatcgagtttggatacaagaaaatccatggatggaagataaaactccagtcgaaagctgggaggaaataccttacttggggaaaagagaagatcaatggtgcggaagtctcataggtttaacaagtagagctacatgggccaaaaatatacaaactgcaattaatcaagtaagatccctaataggtaacgaggagtacaccgactacatgcccagtatgaaacgatttcggcgagaagaagaagaagccggagttttatggtga

SEQ ID NO: 22886 - RNA, 9876 nt, synthetic construct
  misc_feature 1..9876: note = derived and/or modified CDS sequence (opt6) from DENV-2__JN851126__SS-prME
  source 1..9876: mol_type = other RNA
accgctgggattatcatcatgatgataccaactgttatggcattccatctaaccactagaaatggggaaccacacatgattgtaagtcggcaagaaaaaggtaaatcactactatttaaaaccgaaaatggggttaatatgtgtactctcatggcaatggatctcggagaactgtgcgaagacactataacgtataattgcccgctacttaaacagaatgaacctgaagacatagattgttggtgtaacagcacctcaacatgggttacatacggaacatgtactgcgacaggagaacacagacgagagaaaaggtcggtagcgttggtaccacacgttggaatgggtctagaaacaaggacagaaacgtggatgtcctcagaaggggcttggaaacatgcacaacgtatcgaaacctgggtattacgacatcctggatttacaataatggcagctatattggcttacacgatagggaccacctacttccaaagagtactaatctttatattattaactgcagtagcaccatcaatgactatgagatgtatcggaattagcaacagagactttgtagaaggtgttagcggtggttcatgggtagacatagttctagaacatgggtcttgtgtaacaactatggccaaaaataaacccacattagattttgaattaatcaaaaccgaagctaaacacccagctactctaaggaaatactgcatagaagcaaaattgactaatacaaccacggcaagtcgatgtcccacgcaaggtgaacctagtttaaatgaagaacaagacaaaaggtttgtatgtaaacatagtatggtagaccggggttggggtaatggatgcggattatttggaaaaggcgggatagtaacatgcgcaatgttcacatgtaagaaaaacatggaaggaaaaattgtacaacccgaaaatcttgaatatactatagtaataacccctcacagtggcgaagaaaacgcggttggaaacgacacaggaaaacacgggaaagaaattaaagtaacgccgcaatccagtatcactgaagctgaactaactggctatggcacggtgacaatggaatgctcaccaagaaccggattggactttaatgagatggtgttactacaaatggaaaacaaagcatggttagttcacagacaatggtttcttgatctaccattaccatggctccccggcgctgacactcaaggaagtaactggatacaaaaagaaacgttagtaacatttaaaaacccacatgctaagaaacaagatgtagttgtcttaggttcacaagaaggagccatgcacaccgcattaacaggagcgacagaaatccaaatgagtagcggtaacttgctattcactgggcacctcaaatgtcgtctgcgaatggataaattacaactaaaagggatgagttatagcatgtgcaccggaaaatttaaagtggtgaaagaaatagccgagacacaacatggaaccatcgtaatacgggtccaatacgagggagatggttccccgtgtaaaattccattcgaaataatggatttagagaaaagacacgtgttaggcagactcataacagtaaatcctattgtaaccgaaaaagactcacccgtaaatatagaagccgaaccaccttttggcgattcatatataatcattggggtggaacctggtcaattgaaactcagttggttcaagaaaggaagttctataggacaaatgtttgagacaacaatgagaggagctaaaaggatggcaatcctaggggatactgcatgggactttgggagtcttgggggagtctttacttcaatagggaaagcactgcaccaagtctttggtgcgatttatggagcagcattttcaggcgtatcgtggaccatgaaaattttaatcggggttgtaataacatggataggtatgaacagtagatcgacgagtctgtcagtatcacttgtacttgtgggcgttgtcacactatacttaggcgtaatggttcaagctgacagcgggtgcgtggtatcatggaaaaacaaagaactcaaatgtggctccggtattttcataacagataatgtacatacatggactgaacagtacaagttccagcccgaatccccgagtaaattagcatcagctatacaaaaagcacacgaagaaggaatatgtggcatcagatcagtaacacgattagagaatttaatgtggaaacaaataacgccagaattaaatcatatattatctgagaacgaaataaaattgactatcatgacaggggatataaaaggaataatgcaagccgggaagagaagccttcgaccacaaccaactgaattaaaatactcctggaaagcatggggtaaagctaaaatgcttagtactgaattacataaccatacatttttaatcgatggacccgaaactgcagaatgccccaacacgaaccgggcatggaactccctagaagtagaagactacggattcggggtatttactacaaatatctggttaaaattgaaagaaaggcaggacgtattctgcgattcaaaacttatgtctgcagctattaaggataatcgagcagtacatgcagatatgggttattggatagaaagtgcactaaatgatacatggaaaattgaaaaagcctcctttatagaagtaaaatcttgtcattggcctaaatcacatacgttgtggtcaaatggagttctagaatcagagatgattataccgaaaaatttcgcaggaccagtatcccaacacaattatcggcctggatatcatacacaaaccgcaggaccgtggcatttaggaaggctggagatggactttgatttctgcgaaggaacaacagtagtagtcactgaggactgcggtaaccgtggacccagtctgcgaacgacgacagccagtggaaaacttattactgaatggtgttgccgaagctgtaccttaccaccgttaagatacagaggtgaggatgggtgctggtatggtatggaaattagacctttaaaggaaaaagaagagaatttggttaatagtctagtgactgccgggcatggccagatagataatttctcgctcggagttttaggcatggcactatttttagaagagatgctccgcacaagggtggggacaaaacacactatccttctagtggcagtaagttttgtaaccctaattactggaaatatgtcctttcgagatttaggacgggtggtagtaatggtgggggcaacaatgacggacgatataggaatgggggttacgtacttagcattacttgcagcgttcaaagtaagacctacttttgcagcaggtttattgttgagaaaattaacgagcaaagaattaatgatgacgactatagggatcgttttgctgtctcaatccaccatcccagaaacgatattagaactcactgatgcattggccctaggtatgatggtgcttaaaatagtcaggaatatggaaaagtatcaattagctgtaactattatggcaattttgtgtgtaccaaatgcggtcatactccagaacgcatggaaagtgtcgtgtaccgcacttgccgtggtttccgtgtcaccactattattaacatcatcacaacaaaaagcggactggatcccacttgcactaacaattaagggcttaaatccaactgctatatttttaacaactctaagtagaacttctaaaaagagaagttggcctttgaatgaggcaattatggcagtgggcatggtatctatactagcatcttcactcctcaaaaatgacatcccaatgactggaccgttagtggcagggggattactaacggtatgctacgtacttactggtcgaagtgcggacttagaactggaaagagcagcagatgtccggtgggaggaacaagcagaaataagcgggagctcacctattctatcaataactatatcagaggatggatctatgtctataaagaacgaagaggaagaacaaaccttaaccatattaataagaacaggtctattagtaatcagtggtctgtttcctgtcagtattcccataacagctgccgcttggtacctttgggaagtgaagaaacaaagagcgggagtattatgggatgtacctagcccaccaccagttggaaaagcagaacttgaagacggggcttaccgaataaagcaaaaaggtatacttggctatagccagattggcgcaggggtatataaagaaggaacttttcacacaatgtggcatgttacaagaggtgcagtactaatgcataaagggaaaagaatagagccatcttgggctgacgttaagaaagatctaatttcatacggaggagggtggaagctcgagggggaatggaaagaaggcgaggaagtacaagtcctagcactagaacccggcaaaaatccacgggcggtgcaaacgaaaccagggctatttaaaacaaatacaggaactattggagctgtcagcttagattttagcccaggaacatcaggaagtccaatagtagataagaaaggaaaagtagtgggtctatatggcaacggagtagtgacaagaagcggcacctacgtcagcgccattgctcaaaccgagaagtctatagaggataatcccgaaatagaagatgacatattcaggaagaaaagactcacaataatggacctacacccaggagcaggcaagactaaaagatacttacccgcaatagtgagggaggccattaaacgcgggttaagaactttaattttagccccgacacgagtcgtggcagcagagatggaggaagccctaagaggtctaccgatacgatatcagaccccggcgataagggctgaacatactggtagagaaattgtagatctaatgtgtcatgcaacatttaccatgagactattatcccctattcgtgtccccaactacaacttaatcatcatggacgaggcacacttcacagatccagcaagtatcgccgcgagaggctacatcagtactagagttgaaatgggtgaagctgccggcatcttcatgactgctacacccccggggtccagagacccattcccacaatccaatgcgcctataatggacgaagaaaaggaaatacccgaacgatcttggaatagtggacacgaatgggttacagatttcaaaggcaagacagtgtggtttgtaccgtctataaaagccggcaatgatatcgctgcatgtttaaggaaaaatggcaagaaagtcatacaattaagcagaaaaacttttgactccgaatatattaaaaccaggacaaatgattgggattttgtagtcacaactgatatttctgaaatgggtgcgaatttcaaggctgaacgagtaatcgatccacgacgatgtgtcaaaccagtaattcttacagacggagaagagagagttatattggcagggccgatgccagtaacacatagttctgcagcgcagcggagagggagggttggtcgaaatcccaaaaacgaaaacgatcagtatatttacatgggagagcctctagaaaatgacgaggactgtgcccattggaaagaagcaaaaatgctcctcgacaatattaacacacccgaagggataataccaagcatgtttgaaccggaacgagagaaagtagacgcgatagatggcgaatataggctgcgtggtgaagcgagaaaaacatttgtggatctcatgcggcgcggagacctccccgtgtggctggcttacagggtcgcagctgaaggaataaattatgctgaccgtaggtggtgcttcgatggagtcaaaaataatcagatactcgaagaaaatgtagaggtggaaatatggactaaagaaggtgagcggaaaaagctaaaacctcgttggttagacgctagaatttatagcgaccctctggccctaaaagagttcaaggaatttgccgctggtagaaaatcactaaccctcaacctcattacggagatgggaagattaccgaccttcatgactcaaaaagcgcgaaatgccctggataacttagcagttctacacactgccgaggcaggcggccgtgcctataaccacgctttaagcgaactgccagaaaccttagaaaccctattattgttaacacttctagcaaccgtcactggtggaatctttttatttctgatgtctggaaaaggtattgggaaaatgacactaggtatgtgttgcataataaccgcttcaatattactatggtacgcacaaatacagccacattggattgccgctagcattattttagaatttttcctgatagtcttgctaattccggaaccagaaaaacagcggacccctcaagataaccaactaacttacgtcgttatcgctatacttacagttgtagcggcgactatggcaaatgagatgggctttctcgagaaaacaaagaaagacttcggattaggttcaataacaacgcagcaaccagagagtaacatcttagatatcgatctgaggcccgcgtccgcttggacgctttatgcggttgccacaactttcataaccccaatgctccgacattctatcgaaaactcatctgtgaatgtatcccttactgcaatagcgaaccaggccaccgtacttatgggattggggaaaggatggccgttgagtaaaatggatattggagtaccactactagcgattggatgctattcgcaagttaacccaataactttaactgctgccctgctacttttggtagctcattacgcaataataggcccaggcttacaagctaaagcaactcgagaggctcagaaacgagcagcggcaggaataatgaaaaatccaacagtagacggcattacggtgattgacctagaccctattccatacgaccctaaatttgagaaacaattaggccaggtaatgctgctggtattatgtgtgactcaggttctaatgatgagaacaacttgggcattatgtgaagccttaactcttgctacagggcctatatcgactttatgggaaggtaaccctggcaggttttggaacactacaatagcagttagtatggcaaatatatttcgtgggagctatcttgccggtgcaggactattatttagcattatgaaaaataccgctaataccaggcgaggtaccggaaatacaggtgaaacattgggagagaagtggaagaatagattaaacgctttgggcaaatcagagtttcaaacatataagaaatccggaatccaagaggtagatagaacccttgcaaaagaaggtattaaacgcggagaaactgatcaccatgcagtcagtcgcggttcagccaaactaagatggtttgtcgaaaggaatctggtaactcctgaaggaaaagtagtcgatcttggttgcggtcgcggaggatggagctactactgtggaggacttaaaaacgttaaggaagtaaaaggtctgaccaagggcggtcccggacatgaggaaccaataccaatgtcaacgtacggatggaatttagttcgcttacaatccggggtagatgtctttttcacgccccctgagaaatgcgacacacttctttgtgacattggagaaagcagccccaaccccacagtcgaagcgggaagaactctgcgcgtactaaacctagttgagaattggttgaataataatacccaattctgtatcaaagttctgaatccatatatgcccagcgttattgagaaaatggaaaccttacaaaggaaacatgggggagctttagtaagaaatccactttcaaggaactcaacacatgagatgtattgggttagcaacgcttctgggaacatcgtaagcagcgttaatatgatcagtaggatgctgataaatcgatttacaatgaggcacaagaaagcaacgtacgaacctgatgtcgatcttggttccggaactagaaatataggaattgagtcagaaactcctaacttagacattattggaaaacgaatcgaaaagattaaacaagaacacgaaacaagttggcattatgaccaggaccacccatacaagacatgggcctatcacggctcatatgaaaccaaacaaaccggctcagcgagctctatggtcaatggagtagtaaggctattgacaaaaccttgggatgtaattccaatggtcacccaaatggcaatgaccgatacaacaccgttcggacaacaaagagtattcaaagaaaaagttgacaccagaactcaagaacctaaagagggtaccaagaaactgatgaaaataaccgccgaatggttatggaaggaattgggtaaaaagaaaaccccacgaatgtgtactagagaagagtttacacggaaagtacgttctaatgctgccttaggggcaatatttactgatgaaaacaagtggaagtcagcaagagaagccgtagaagattcaaggttttgggaactggtagacaaagaacgcaacctacatttggaaggaaagtgtgagacttgtgtatacaacatgatgggcaagagagagaagaaacttggcgaatttggaaaagcaaaaggatccagggcgatttggtacatgtggttaggcgctaggtttctagagttcgaagcactagggttcttgaatgaggatcattggttctccagagaaaacagtctcagtggagtggaaggggaggggctacacaaattgggttatatcctacgggatgtaagtaagaaagaaggcggtgccatgtacgccgatgatactgcaggatgggatactcggataacattagaagaccttaagaatgaggagatggtaactaatcacatggaaggggaacataagaaattggcagaggcaatttttagactaacttatcaaaacaaagttgttagggtacaacgaccgactcctaggggcactgtaatggacataatttcaaggcgcgaccaaagaggtagtggccaagtagtaacatatgggttaaatacatttaccaatatggaagcgcaactaatacgtcaaatggagggagaaggagtatttaaaagtatccaacatcttacagtgaccgaggagattgcagttaaaaattggttagtccgtgtcggccgggaacgacttagtagaatggccataagcggggatgattgcgttgtaaagccactcgacgacagatttgccagtgcgctcactgcgttgaatgatatggggaaagtaagaaaagatattcaacagtgggaacccagccgcggatggaatgattggactcaagtcccgttttgttcccaccactttcatgaattgattatgaaggacggacgggttttagtagtaccgtgtcgaaatcaagatgaactaatcggaagggctagaatatcacaaggtgccggatggtctctacgcgaaacggcatgtcttggaaaatcatatgcacaaatgtggagtctaatgtactttcataggagagatcttaggttggcagctaacgcaatatgctcagcagtgccgtcacactgggttcccacttcccgaacaacatggtcaatccacgccacgcatgaatggatgacaactgaagatatgttaactgtttggaacagagtatggatccaagaaaacccatggatggaagacaaaacgccagttgaatcctgggaagagatcccctatttgggtaaaagagaggatcagtggtgtggttctctaataggactgacaagtcgagcaacctgggcaaagaacattcaaacagcgattaatcaagtcaggtcacttatcggtaacgaagaatatacagactacatgcccagtatgaaaagatttaggcgcgaagaagaggaggcaggggttctgtggtaa

SEQ ID NO: 22887 - RNA, 9876 nt, synthetic construct
  misc_feature 1..9876: note = derived and/or modified CDS sequence (opt6) from DENV-2__JN851121__SS-prME
  source 1..9876: mol_type = other RNA
accgctggtattattattatgatgatcccaactgttatggcattccatttaactactagaaacggtgaaccccatatgatcgtgagtcgacaagaaaaaggaaaaagtttactgttcaaaacagaaaatggggttaatatgtgtacgctaatggctatggatttgggggaattatgtgaagatactatcacgtacaattgtccactactacgccaaaacgaacccgaagacatagactgttggtgcaatagcaccagcacctgggtaacatatggaacctgtacagcaaccggggaacacagaagagagaaacgaagtgtggccttggttccccatgtaggaatgggactagaaacgagaacggagacgtggatgagctcagaaggagcttggaaacatgcacagagaattgaaacgtggattcttagacatccgggctttacgattatggcggctattttggcatacactattggaacgacatattttcagagagtactaatctttatactattgacagcagtaacacctagcatggcaatgagatgtataggtataagcaacagggacttcgttgaaggagtatctggaggtagttgggttgatatagtacttgaacatggatcttgtgtaactactatggccaaaaacaaacctacattagactttgagcttataaaaactgaagcaaaacatccagcaacgctacgaaaatattgcgtagaggcaaaattaactaatactacaacagcatcacgatgtcctactcaaggcgagccttccttgaatgaagaacaggataaaagattcgtatgcaaacattctatggttgacagaggatggggcaatggatgtggcctttttgggaaaggtgggattgtcacatgtgccatgtttacgtgtaagaaaaacatggaaggaaaagtagtccaacctgagaacctagagtatacaatagtcatcacgccacattctggcgaagaaaatgcagttggaaatgataccggaaaacacggaaaagaaataaaagtaaccccgcagtcaagcataaccgaagcggagctcacaggctacggaacagtcacgatggaatgttccccaaggacaggattagattttaacgagatggtacttctacagatggagaataaagcgtggttagtccatagacagtggttcttggatcttcctcttccatggttaccgggcgctgatacacaaggttctaattggattcagaaagaaacattagtaacttttaaaaatcctcatgctaagaaacaagatgttgtagtcctgggatcacaagaaggggcaatgcatactgcgttgactggtgcaacggaaatacagatgtcgtccggtaatttattatttaccggccatcttaaatgtagacttcgaatggataaactacaattaaaagggatgagctatagtatgtgtactggtaaatttaaagtagtcaaagaaattgcagaaacacagcatggcacgatcgtgatacgtgtacaatacgaaggagacggtagcccatgtaaaataccgtttgaaattatggatcttgagaaacggcacgtgttggggcgattaataactgtcaacccgatagtaactgaaaaagatagcccagtcaatattgaggcggaacccccttttggagattcgtacataattattggcgtagagccaggacaactgaaactatcttggttcaagaaaggaagttcaattggacaaatgtttgagacaacaatgagaggagcaaaacgaatggccattctcggagacacggcgtgggacttcggtagccttggtggtgtatttacaagtatcggtaaagcattacatcaggtcttcggggcaatctatggtgcagcattctcaggcgtctcatggacaatgaaaattctaataggcgtcgtaatcacttggattggaatgaacagccggagcacttccctctcagtcagtttagtactcgtaggagtggtcacattatatcttggggctatggtccaagccgactcaggttgcgttgtatcatggaaaaataaagaactcaaatgcggtagtggcatttttataacagacaacgttcatacatggactgaacaatataaatttcagccggaatcaccgagcaaactagcgtctgccatccaaaaagcccatgaagaagggatatgtgggattcgcagtgtaacgagattagaaaaccttatgtggaaacaaataacaccagaattaaatcatatacttacagagaacgaagtaaaattgacaataatgacaggcgatataaaaggtataatgcaggctggtaaaaggagcttgagaccgcaacccacggaactaaaatatagctggaaggcttggggaaaagcgaaaatgctatcgaccgagcttcacaaccatacattcctaatagacggaccagaaacagccgagtgcccgaatacaaatagagcatggaactctctcgaggttgaagattatggatttggcgtatttaccaccaatatttggctaaaattaaaagaacgccaagatgtattttgtgatagcaaactaatgtcagcagctataaaagacaatagagcggttcatgccgacatgggctattggattgagagcgcattaaatgacacttggaaaatcgagaaagcatcgtttatagaagtaaagagctgtcactggcctaaatcgcatactctttggtctaatggagtattggaatcggaaatgataatacccaaaaactttgccggtccagtttctcagcataattatcgaccggggtaccacactcaaacggccgggccgtggcatttagggagactagaaatggatttcgacttttgtgagggtacgaccgtcgtggtaacagaagactgtggaaataggggcccttcactaagaacgacaactgctagcggtaaacttataacagagtggtgttgccgtagctgtacgttacctccattaagatataggggtgaagatggctgctggtatggcatggaaattcgtccccttaaagaaaaggaagagaatcttgtaaatagtctagtaacggcaggccatggtcaaattgataatttctcactaggcgtattagggatggcactattcttggaagagatgttgcgcactagggtcgggacaaaacatgcaattttgctagttgcagtgtcttttgtaaccctaataacaggtaacatgtcattcagggatctagggagggttatggttatggttggggccacaatgacggacgatataggaatgggggtaacttatctggctctcttagcagcattcaaggttcgcccaacatttgcagctggcctcctgcttagaaaattaacatcgaaggaattaatgatgacgacgatcggcatcgtactgctatcccagtcaacaataccggagagcatactcgaattaacggacgcgttagctttaggtatgatggtattgaaaatcgttcgcaacatggaaaaataccaactagctgttactatcatggccatattatgtgtcccaaatgcagtaatattgcagaacgcctggaaggttagttgcactaccctggcggttgtgagtgttagtccattactactcacatcatctcaacaaaaggctgattggatacctcttgcactcactataaaaggattaaacccaactgcaatatttctgactacacttagtcgtaccagtaagaaaagaagctggccactaaacgaagcaataatggcagtcggaatggtcagcatattagcctccagtttgctgaaaaacgatatcccaatgacaggccccctagtagcaggcgggctactaacggtttgttatgtattaacagggagatcggcagacctagagctagagcgtgcagcggacgttcgatgggaagaacaagccgaaataagcgggagctcgccaattttatcgataaccatttcggaagacgggagcatgtctattaaaaacgaagaggaagaacaaacattaactattttgattcgaacaggcctgttagtgataagtggtctatttccggtatcgattccaattacagccgcagcgtggtatctatgggaggtaaagaagcaacgggccggagttttatgggatgtaccatctcctccaccagtagggaaagcagaactcgaagacggtgcttatcgaattaaacagaaaggtatcctgggttatagccaaataggggcaggagtgtataaagaaggcacatttcacaccatgtggcatgtaacacgtggggcggtcttaatgcataaagggaaacgtatcgaacctagctgggctgatgtgaagaaagacctcataagttatggaggtggatggaaattagaaggtgagtggaaggaaggtgaagaggtacaggtgttagcattagaacctgggaaaaacccacgtgccgtgcagacaaaacccggcctatttaaaacgaacactgggacaataggtgccgtatccttagatttttcccctggaactagcggatcaccaatagtcgataagaaaggaaaagtagtaggtctttatggaaacggagtggtaacacggtcaggaacatacgtatcagcgattgctcaaactgagaaatcaatcgaagacaacccagagattgaagacgacatatttaggaagaaacggcttacaataatggatttacatccgggagctggaaaaactaaaagatacttaccagcaatagtgagagaggcaattaaacgaggattgagaacactaattctagcaccaacacgagtcgtggctgctgaaatggaagaagctctacgcggtttaccgataagatatcaaactccagcaattcgagcggaacacactggtcgagagattgtcgatttgatgtgccatgctacctttactatgcgattgctatccccaattagggtaccaaactataatctcattataatggacgaagcacattttacggacccggcgtccatagcggcaagaggctatatatctacaagagtggaaatgggcgaggccgcaggaattttcatgaccgccaccccacccggaagccgtgatccttttccccaatctaacgcccctataatggatgaggagcgcgagattccggagagatcctggaatagcggacatgaatgggtcacagacttcaagggaaagactgtatggtttgttccctcgattaaggccggaaacgacattgcggcgtgcctcaggaaaaacggcaagaaagtcatacaactttctagaaagacattcgactcagaatatatcaaaacaagaacaaatgactgggattttgtcgtaacaacggatataagcgaaatgggagcaaatttcaaggcagagagagtcatagatccaagacgatgtatgaagcccgttatactcacagatggggaagaacgcgtaattttagcagggcccatgcccgtaacgcattcctcagcagcccagagacggggaagagtgggacgtaatccaaagaatgagaacgatcaatacatatatatgggtgaacccttagaaaatgacgaagattgcgcacattggaaggaagctaaaatgcttctagataatatcaacacacccgagggtataataccgtctatgttcgaacccgagagagagaaagtcgatgctattgacggcgagtacaggctacgaggagaagcacgcaaaaccttcgttgacctaatgagaagaggggatttgccagtgtggcttgcataccgcgtcgctgctgaaggaataaattatgccgatcgaaggtggtgttttgatggggtaaagaataatcaaattcttgaggaaaatgtagaagtcgaaatctggaccaaagaaggagagaggaagaaacttaagcctagatggctcgatgctaggatatattccgatcccctcgcattaaaagaatttaaagagttcgccgccgggcgcaagagcttgactttaaacttaattacagaaatgggacggcttccaacatttatgacgcagaaagctaaaaatgcattagacaatctcgctgttttgcacaccgcagaggcaggagggcgagcgtacaatcacgcgcttagtgagctaccagaaaccttagaaactctacttttattgacactattagcaaccgttacaggagggatttttctgtttctcatgagtgggaaaggaattggaaaaatgactttgggaatgtgttgtattataacggcaagcatccttttatggtatgcgcaaattcagcctcactggatagcagctagtataattctcgagttctttttaatcgtcctgttgatacctgagccggaaaaacaacggacgccgcaggacaaccagttaacctatgtcgtaattgcaatattgacggttgtcgcagcaacaatggctaacgaaatgggatttttagagaaaacgaagaaagatttcggtctgggaagcataacaaatcaacaacctgaatcaaacatattagacatagatctaagacccgcgtccgcgtggacactctatgcagtcgcaacgactttcataactcccatgttacgccattccatagaaaattcatcagtaaatgtcagcttaacggcaatagctaaccaagcaacagtattaatgggcctagggaaaggatggcccttatctaaaatggatattggcgtgcccttgcttgcaatcggttgttactcacaagtaaaccctatcacactaacagctgccttacttctacttgttgcacattacgcgatcatagggccaggattacaagctaaagccacccgtgaagcccaaaaacgggctgcagctggtataatgaaaaacccgacagtagatggcatgactgttatagacttagatcctataccatatgatcctaaattcgaaaaacaattgggacaggtaatgttattagtcctttgcgtaacacaggtactaatgatgagaacaacatgggcattatgtgaagcactaacattagcaactggaccaatatctaccctctgggaaggaaatccgggcagattctggaatacaacaatagccgtatcaatggccaacatatttagaggttcatatcttgctggtgcaggattgttgttcagcatcatgaaaaacacggcaaatactaggcgtggaacagggaatactggtgaaacactgggggaaaaatggaaaaataggttaaatgcacttggaaagtcagaatttcaaatatataagaaaagtggcattcaggaagtcgatagaactcttgcaaaagagggaatcaaacgtggagaaacagatcatcacgccgtgtcaagagggtcagctaaattacgttggttcgtggagcgaaacttagtgacaccagagggtaaagtggttgaccttggatgcggacgcggcggttggagctactactgtggtggtttgaaaaatgtaaaggaggttaaaggactaactaaaggtggtccaggtcatgaggaaccaatacctatgagcacatatggatggaatttggtacgactacagtccggagttgatgtattctttacccctccagagaaatgtgatactctcctttgtgacataggcgagagctcgcccaatccaactgtagaagcgggacgaaccttgagggtgttaaatcttgtcgaaaattggctcaacaacaacactcagttttgcataaaagttttaaacccatacatgccttctgtaattgagaaaatggaagcacttcaacgcaagtacgggggtgctcttgtcagaaacccattaagcagaaattccacacatgagatgtactgggtcagcaatgcttctggtaatattgtaagttcagttaatatgataagtagaatgttaataaatcgatttaccatgagacataagaaagcaacgtatgaacctgacgttgacttaggaagcggaaccagaaatataggaatcgagtcagaaacacccaatctagacatcataggtaaacgaattgagaaaattaaacaagagcacgaaacttcttggcactacgaccaagaccacccatataaaacatgggcatatcatggttcttacgagacgaaacagacaggttcggcatcctctatggtaaacggagtagttagattgttaacaaaaccatgggacgtcataccaatggtaacacaaatggccatgacagatactacacctttcggacaacagagggttttcaaagaaaaagtcgatactagaactcaagaacctaaagaaggtacaaagaaactaatgaaaatcacagcagaatggttatggaaagagctcggcaaaaagaaaaccccaagaatgtgtacacgggaagagttcactaggaaggtacggagtaatgcagcactaggtgccattttcacagatgagaacaaatggaaaagtgctcgggaagcagttgaggactcaggtttctgggagttagtggataaagaaagaaacctacatttagaaggcaaatgcgaaacatgcgtatataatatgatgggaaaacgggagaagaaactgggtgagtttggtaaagcaaaaggcagtcgagccatatggtacatgtggctgggcgctagatttctcgaatttgaagctcttggatttctcaatgaggatcactggttttcccgagaaaattcgttgagcggagtggagggtgaagggcttcacaagctaggatacattctaagggatgttagtaagaaagaaggaggggcaatgtatgcagatgatacggcaggttgggatacaagaataacactcgaggacttaaagaatgaagaaatggttacaaaccatatggaaggagaacataagaaattagctgaagcaatattcaaactaacttatcaaaacaaagtagtgagagttcaaagaccgactccgcgaggtactgttatggacattataagtagaagagatcaacgaggctcaggacaggtggtaacatacgggcttaacacttttacaaatatggaggctcaactaataagacaaatggagggtgaaggtgtttttaaatctatacaacaattaacagtgaaagaggaaattgcagtcaaaaattggttaataagagtaggtcgggagcgcctgtctcggatggcgatctccggagatgattgcgtagttaaacctctcgatgacagatttgcttcggcattgaccgcgttgaacgacatggggaaagtccgaaaagatatacaacaatgggaaccaagcagaggctggaacgactggacacaagtgccgttctgcagtcatcacttccatgaactaataatgaaagacggacgtgttctagtggtaccatgtagaaaccaggatgaactaatcgggcgcgctcgtatatctcaaggcgcaggctggagtttaagagagactgcatgccttggtaaatcttatgcacaaatgtggtcactgatgtactttcatagaagagacttacgacttgcagcaaatgcaatatgcagcgctgtaccatctcattgggtgccaacctcgaggaccacgtggtccatacatgcaactcatgaatggatgactacagaggatatgctcactgtttggaatagggtctggatacaggaaaatccttggatggaggacaaaactccagtagagagttgggaagaaattccttacttggggaaacgggaggaccaatggtgtggttccttaattgggctaactagcagagcaacttgggctaaaaatatccaaacagccataaatcaagtgaggtctttgattggaaatgaagaatacaccgattatatgcctagcatgaagaggtttcggcgagaagaagaagaagcaggcgtactgtggtaa

SEQ ID NO: 22888 - RNA, 9876 nt, synthetic construct
  misc_feature 1..9876: note = derived and/or modified CDS sequence (opt6) from DENV-2__JN851115__SS-prME
  source 1..9876: mol_type = other RNA
actgcaggtataattattatgatgatacctactgttatggcattccatttgactactagaaacggcgaaccacacatgattgtaagtagacaggaaaaagggaaatccttattatttaaaacagagaatggtgttaatatgtgtacattgatggctatggaccttggggaattatgcgaagatacgataacatacaactgcccacttttaagacaaaatgagccagaagacattgactgttggtgtaattctacaagtacctgggtaacgtacggaacatgcaccgctacaggggaacatagacgagagaaaagatcggtagctctggttcctcatgtcggaatgggtttagaaacaagaactgaaacttggatgtcttctgaaggggcttggaaacatgcacagcgtatagagacatggatattgagacatccaggattcacaataatggcagcaattctggcatatactattgggaccacatatttccaacgtgtattgatttttattctcctcacagcagttactccaagcatggcaatgagatgcataggaatctcaaatcgagatttcgttgaaggggtatcgggcggatcatgggtagacattgtgcttgagcatggttcatgtgtcacgactatggctaaaaataaacctactctggacttcgaactaattaaaacagaagcaaaacacccggccacactccgcaaatactgtgtggaagcaaaactaacaaatactactaccgcatcaaggtgccccactcaaggtgaaccctcattgaatgaagaacaggataaaaggttcgtttgcaaacattctatggtagatcgcggctggggaaatggatgtgggctatttggcaaaggtggaattgttacttgtgcaatgtttacctgtaaaaagaacatggaaggtaaagtcgtacaaccagaaaatttggagtatactatcgttatcacgccacactcaggcgaagaaaatgccgtaggcaatgacacaggcaaacacgggaaagagataaaagtaacgccacaatcatctataacagaagccgaactgacaggatatgggacagtcacaatggagtgttctccaaggactggcctggactttaatgagatggttctgttacagatggaaaacaaagcgtggctggttcatagacaatggctgttagatttaccccttccgtggctcccaggcgctgatacacaagggtcaaactggatacagaaagaaactttggttacttttaaaaacccccatgccaagaaacaagacgttgtagtcttaggttcccaagaaggagcgatgcacaccgcgctaacaggagctactgaaatacagatgtcatctggaaatctcctcttcaccggtcatttgaaatgtcgcttgagaatggacaaattacaacttaaaggtatgtcgtattccatgtgtaccggaaaatttaaagtagtaaaagaaattgcggaaacacagcacggaaccatagtaatacgagtacagtacgaaggtgacggttcaccatgcaaaatacctttcgagataatggacttagaaaaacgtcacgtactaggaagactgataacagtaaacccaatagtaaccgagaaagattcaccagtgaacatagaagcggagcccccttttggagattcatacataataattggagttgaaccaggtcaacttaaattaagctggtttaaaaaggggtcctcgataggacagatgtttgagacgacaatgcgtggggctaaaagaatggcaatcctaggagatacagcatgggattttggctccctcggtggtgtatttacatcaataggcaaagcgttgcatcaggtcttcggagcgatttatggtgctgccttcagtggagtttcgtggacaatgaaaatactcataggagtagtcataacgtggataggaatgaactcgaggagtacatctctatccgtttcattagtgttagtaggagtcgttacgctatacctaggtgttatggtgcaagccgatagtggctgcgtggtttcatggaaaaacaaagaacttaaatgcggttctggaatatttatcacagacaatgtccatacttggaccgaacaatataaatttcagccagaatcaccaagtaaattagcaagtgcaattcagaaggcccacgaggaaggcatatgtggtattcgcagtgtaacacgattagaaaacctgatgtggaaacaaataacaccagaactaaatcatatacttaccgagaacgaggtcaaactgactattatgacgggcgacatcaaaggcatcatgcaagcaggcaagagaagtctaagaccgcaaccaacagaattaaaatattcgtggaaagcatggggaaaagcaaagatgctatcaacagaactacataatcatactttcctaatagatgggccagaaaccgcggaatgcccaaacactaatagagcctggaacagtttggaagtagaagattacgggttcggagttttcacaaccaatatttggctaaagttaaaagaacggcaagatgtattttgcgattcaaagttaatgagcgccgccattaaagataaccgagcagtccatgcagacatgggttattggatagaatcagcacttaatgatacttggaaaattgaaaaagcatcattcatagaagtcaagagctgccattggccaaaaagtcatacgctttggtctaatggtgtactcgaaagcgaaatgatcatacctaaaaacttcgcaggtccagtaagccaacacaattatcgaccaggttatcatacacagacagccggaccgtggcacctgggaagattagagatggacttcgacttttgtgaaggtactacagtagtggttactgaggactgcggaaatcggggaccgagtttgagaacgaccacagcaagtgggaaattgattacagaatggtgctgcaggtcgtgtacgttgccacccctcagatatagaggtgaagacggctgctggtacgggatggaaatcaggccactcaaggaaaaagaggaaaacctggtaaattcattggttactgcgggccatggacagatagacaattttagtttgggcgtgctcgggatggcactatttttagaagaaatgctccgtaccagagtgggaacaaaacatgctatactcttagtagcggtctcgttcgttactttaattacaggcaacatgtcctttagagatttaggtcgagtgatggtaatggtgggagcaacaatgacagatgacatcggaatgggtgtaacctatctagcactacttgctgcatttaaagtgagacccacatttgcggcgggcctcttattaagaaaactaaccagtaaagaactaatgatgacgactataggaattgtactgttaagtcaaagtacgataccagagtcaatattggaattaacagacgcattagcacttggtatgatggtcctgaaaatagttagaaatatggaaaaataccaactagccgtcacaataatggctatcctatgcgttcctaatgcagtaatattacaaagtgcttggaaagtatcatgcacaacgctagcagttgtatctgtatcacccctacttcttaccagttcacaacagaaagctgattggattcccttggcattaactataaagggtctaaatcctacagctatattcttaaccacactttcgcgcacttccaagaaaagatcttggccacttaatgaggccatcatggcggtagggatggtctctattctcgcttcatcgctcctgaaaaacgatataccaatgacaggccctctagtagcagggggtctcctaactgtgtgttatgtacttacagggcgtagcgcagacctcgagctagagagagcggcagatgttagatgggaagaacaagcagaaatatcaggtagctcacctatattaagcatcacaataagcgaagatgggagtatgtcgatcaaaaatgaggaggaagaacaaacattaaccatcctcataagaaccggtctattagtaatatcagggttgtttccagtttccatacctataaccgcagcagcatggtatctttgggaagttaagaaacagagagctggcgtcctatgggacgtaccaagtcccccacctgttggtaaagcagaactagaggacggagcttatagaatcaaacaaaaaggaatacttggatactcacaaatcggcgccggtgtgtacaaagaaggaacgtttcatacaatgtggcatgtcacgagaggggcggtacttatgcataaaggaaaacgaattgagccatcttgggcagacgtcaagaaagacctaatatcctacggtggaggctggaaattagagggggaatggaaagagggcgaagaggtgcaagtactggctttggaacccggtaaaaatccgcgggcagttcaaacaaaacccggactatttaaaactaatacaggaacgataggagccgttagcctagacttttcgccgggtacctcgggttcccccattgtagacaagaaaggaaaggtagtcgggttatatggaaatggagtggtcacacgtagtggcacctacgtttccgctatagcgcaaactgaaaagtccatagaggacaatcctgaaattgaagacgatatatttaggaagaaaagattgaccattatggaccttcaccctggagctgggaaaaccaaaaggtacttgcccgcaattgttcgagaggcaattaaaagaggactgaggacccttatattggcaccaacacgagtagtagctgcagaaatggaggaggcgctacgagggcttccaataagatatcaaacaccggcaatcagagcagaacacaccggccgtgaaatagtagacctaatgtgtcatgcgacctttactatgaggcttctttctccaatacgagtaccaaattacaatttaataatcatggatgaggctcattttaccgatccggcatcaatagcagcaagagggtatataagcacacgcgtagaaatgggcgaggctgcaggcatttttatgactgcaacgcctcccggttctcgggacccatttcctcagtccaatgcacctattatggacgaagaaagagaaattccagaaaggagttggaactcaggacacgaatgggtcacagactttaaaggaaagactgtgtggtttgtaccgtcaataaaagctgggaacgacatagcagcatgccttcgcaaaaacggcaagaaagttatccaactaagtcgaaaaacattcgattccgaatatataaaaacaaggacaaatgattgggattttgtcgtcacaaccgacatttcggagatgggagccaacttcaaggcagaaagagtgatagatcccagaagatgtatgaaacctgtaattcttacagacggagaagaacgggtgatactcgcaggacccatgccagtcacacactcttcagcggctcaaagaaggggtagagtgggaagaaaccccaaaaatgaaaatgaccagtatatatacatgggagaaccgcttgagaatgacgaggactgcgcacactggaaagaagcaaagatgctactcgataatataaacactcctgagggaatcattccgagtatgttcgagccagaaagagaaaaagttgatgcaattgacggcgaataccgattaagaggcgaggcacgaaaaacttttgtggatctaatgaggcgtggagacctcccagtttggctagcctacagagtggctgcagagggaataaactatgccgataggcgttggtgttttgacggcgtcaaaaacaaccaaattcttgaagaaaacgtagaggtagaaatttggacaaaggaaggggagaggaagaaactaaaacctcgttggctggacgccaggatttattcagatcctctagcactgaaggaatttaaagaatttgcagcaggcagaaaatcacttactttgaatctaatcacagaaatgggtagattacccaccttcatgacccaaaaggcaaagaatgctttagataacttggcggtactccatacagctgaagcaggcggccgcgcttacaaccatgctctttcggaactcccagagacattagagactctattactacttaccctcttggctaccgtaacaggaggtatttttcttttcctaatgtcaggtaaaggtataggtaaaatgacgttaggaatgtgctgcataataacagcgtccatattgctctggtacgcccagatacagccacattggatagcagcttcaataatattagagttctttttaatagtcctactcataccggaaccagaaaagcaaagaactccgcaggataatcaacttacgtatgtggtaattgccatcctaactgtggtagcagctacaatggccaacgaaatgggtttcctagaaaagaccaaaaaggactttggattaggaagcataaccactcaacaaccagaatcaaatatattggatattgatttaaggcccgcaagtgcatggacactatatgcagttgctacaacgtttatcacaccaatgctgagacatagcattgaaaatagctcagtaaatgtatcattgacagcgatagcaaatcaggccacagttttaatgggtttgggcaagggatggcccctctctaaaatggacattggcgtaccacttttagcaatcggctgttatagccaagtcaacccgataaccttaacagcggctctacttttattagtcgcacactacgctatcatagggccagggttacaagcaaaagccacgagagaggctcaaaagcgtgccgcggccggaataatgaaaaatccaacggtggacggtatgactgttatcgatctagatcctattccctacgacccgaagtttgaaaaacagcttggtcaagttatgctattagtattatgcgtaacgcaagtcctgatgatgagaacaacctgggccctatgtgaagcactgactctagcaactggtcctatctctactttatgggaagggaacccaggcagattctggaatacaactatagcagttagtatggcgaatatttttcgtggtagttacctcgcaggagccggcctcctcttctcgataatgaaaaacacggcaaacactagacgtggtacaggcaatactggagaaacgttgggtgaaaaatggaaaaatagactgaatgctctaggtaagagcgaatttcaaatttacaagaaatccggcatccaagaagtcgaccgaaccttagccaaagaaggaattaagcgaggggaaacagatcatcacgcagtatccagagggtcggctaaattacgttggttcgtagaacgaaaccttgtcactcctgaaggaaaggtcgtagatttgggatgtggaagagggggatggtcttactattgtggcggccttaaaaatgtgaaagaagtaaaagggctaacgaaaggagggccaggacatgaggagcctataccaatgtctacgtatggatggaatcttgttcgattacaatctggcgtggacgtgtttttcaccccacctgaaaaatgcgatacactactctgtgatataggcgaatcaagtccaaaccccacggtcgaagcaggtcgtactctaagagtattaaaccttgtggaaaactggctaaataataacacacaattttgtattaaggttctaaatccgtacatgccgtcagttattgagaaaatggaggcattgcaaagaaaatatggtggtgcacttgtacggaatccactgtctagaaatagtacgcacgagatgtattgggtatcaaatgcaagcggaaatatagtctcatctgtaaatatgattagtcggatgttaatcaatcggttcacaatgcggcataaaaaggctacgtacgaacccgatgtagatctaggctcaggcactagaaatataggtatagaatcagaaacaccaaacctagacataatagggaaaagaatagagaaaataaagcaagaacacgaaacgtcatggcattacgatcaagaccatccatataagacttgggcataccatggctcgtacgaaactaaacaaaccggtagtgcgtcatcaatggtaaatggagttgtacgtctattaacaaaaccctgggatgtaataccaatggtaactcaaatggctatgacggataccacgcccttcggtcagcagagagtattcaaagaaaaggttgatactcgaacccaggaaccgaaagaaggtaccaagaaattaatgaaaattacagcagaatggctctggaaggagttaggcaaaaagaagacaccacgaatgtgcacaagagaagaatttactaggaaggtacggagtaacgcggcactaggagctatatttacagatgagaataagtggaaaagcgcgcgagaggccgtcgaagactctggattttgggaattagtagataaagagagaaatctccatttagagggaaaatgtgaaacatgtgtctataatatgatgggaaaaagggagaagaaattaggagaatttggaaaggccaaaggcagtagggcaatctggtatatgtggctaggcgccaggttcttagagttcgaagcacttgggtttttaaatgaagaccattggttttctcgggagaatagtttgagtggagtagaaggggaaggactacataaattaggctacatattaagggatgttagtaagaaggaaggcggagcgatgtatgctgatgacactgcaggttgggacaccaggatcacgttagaagatttgaaaaatgaagaaatggtgaccaaccacatggaaggagaacacaagaaactagccgaggcaatattcaaactaacttatcaaaataaggtggtaagagtacagagaccaactccacggggtacagtaatggatataatctcgcgacgagaccaacgaggatcaggtcaagttgttacttatggactcaacacattcactaacatggaagctcaattaataaggcaaatggaaggagaaggggtattcaagagtatacagcaactaacagtcaaagaggaaatagcagtcaaaaattggttaattcgtgttggtagggaacgattaagccggatggcaatatcgggcgacgattgcgtggtcaaaccgctagacgatagatttgcatctgctctcacagccttaaacgatatgggtaaagttagaaaagatattcaacaatgggaaccatctagagggtggaacgactggacacaggtgccattttgtagccatcactttcatgaactaatcatgaaagacggaagagtactggtcgtaccttgcagaaaccaagacgaactaatcggtagagctagaatatctcaaggggcaggatggagtctgcgagaaacagcatgtttaggcaaatcgtatgcccaaatgtggtcattaatgtactttcatcgacgcgacctacgtttagcagccaatgcgatttgctcagcggttccaagccattgggtcccaacatcccggaccacctggtctattcatgcaacccatgaatggatgacaacggaagatatgttgacggtttggaatagagtatggatacaggaaaacccatggatggaagataagaccccagtcgagtcatgggaggaaataccttatttgggtaaacgagaagatcaatggtgtggcagcttgataggacttacaagccgagcaacatgggccaaaaatatccagacagcgataaaccaagtgaggagtctaataggatacgaggaatatacggactatatgccatccatgaaaagatttagacgagaggaggaagaagccggcgtactttggtag

SEQ ID NO: 22889 - RNA, 9876 nt, synthetic construct
  misc_feature 1..9876: note = derived and/or modified CDS sequence (opt6) from DENV-2__JN851127__SS-prME
  source 1..9876: mol_type = other RNA
accgcaggtattattattatgatgatcccaacagttatggcattccacctaacaacacgtaacggcgagccccatatgatagtatcacgacaggagaaagggaaaagccttttattcaaaactgaaaatggcgtgaatatgtgtactctcatggcaatggacctgggagaactttgtgaagatacaattacatataattgcccattattaaagcaaaatgaacctgaggacatagactgttggtgcaacagtacatcaacgtgggtaacatacggaacgtgtacagcaactggtgagcatcgtcgagaaaagagatccgttgcactcgtaccacacgttggtatgggactagaaacacgcacagaaacgtggatgtcaagtgagggcgcatggaaacatgctcaacgaattgaaacatgggtattacgacatcccgggttcactatcatggcagcaatccttgcctatacaataggaactacttattttcagagagtactaatatttattcttctaacggccgtcgctcccagcatgacaatgcgttgcatagggatttccaatagagactttgtagaaggagtaagcggcggaagctgggttgatatagttcttgaacatggtagttgtgtgacaaccatggctaaaaacaaaccgacgcttgattttgaattgataaaaaccgaggctaagcatccagcaacactaagaaagtactgtatagaagcgaagctcaccaatactaccaccgcgtcgcggtgtccgactcaaggagaaccttcactcagcgaagagcaggacaaaagatttgtttgcaaacattcaatggtcgaccgaggctggggtaatggttgtggcctctttggaaaaggaggcatagttacctgcgcgatgttcacatgtaaaaaaaatatggaaggaaagatagtacaaccagaaaacttagaatacacaatagtcataacccctcacagtggtgaagagaatgctgtaggtaatgatacaggcaaacatggtaaagagataaaagttacgccgcaatcatcaattaccgaagcagagttgactggctatgggacagttactatggaatgttctccacggaccgggttagatttcaacgaaatggttctacttcaaatggaaaataaagcatggctagtacacagacaatggtttctcgacttacccctaccctggcttcctggagcggacacccaaggctcgaattggatacaaaaagaaaccttagtcacatttaaaaacccacatgctaaaaagcaggacgtagttgtactaggatcacaagagggtgcaatgcatacagcactaacaggagctacagaaatccaaatgtcatcaggcaacttactatttacgggtcatttaaagtgccgtttaagaatggacaaattgcaactaaagggaatgagttactcaatgtgcactgggaaatttaaagtagtaaaggagatagcagaaactcaacacggaaccattgtaatacgcgtacaatatgaaggagatggatcgccatgcaaaataccatttgagataatggacctagaaaagcgtcatgtgctcgggaggttaataactgtgaacccaatcgtgacagaaaaagacagtcccgtaaatatagaggcagagcccccgttcggagattcatatattattataggggtcgagccaggacaactgaaattatcatggtttaagaaaggtagttctataggtcagatgttcgagaccactatgagaggcgctaaacgaatggccatattaggggatacagcttgggactttggttctctgggcggcgtctttacaagtataggtaaggcacttcaccaagtatttggagcaatatacggcgcagcatttagcggtgtatcatggactatgaaaattctaatcggggtagtcataacttggatcggtatgaattcaagatcaacgagccttagtgtgtcactagtattagtaggagtagttactttatatctaggtgtaatggttcaagcagacagcggctgcgttgtaagttggaaaaacaaagagctgaaatgtggtagtggtatatttattactgacaatgtacatacttggactgaacagtataaatttcaacctgaaagtcctagtaaattggccagtgcaatacaaaaggcccacgaagaaggaatttgtggtataaggtcggtaacacgtctcgaaaacctaatgtggaaacagatcacaccagaactaaatcatatcctatctgaaaatgaaataaagctcactatcatgactggtgatatcaagggtataatgcaagctgggaaaagaagtcttcgacctcaaccaatagaattaaaatactcatggaaagcatggggaaaagcgaaaatgctaagcacggagttacacaaccatacattccttatcgacggacctgaaacagcagaatgtccgaatacgaatcgagcttggaattcacttgaagtagaggattacggctttggcgttttcactactaatatatggttaaaactaaaagagaggcaggacgtgttttgtgactctaaacttatgtccgcagtcataaaagataaccgggccgtccacgccgatatgggttactggattgaatccgcgctaaacgacacatggaaaattgaaaaagcatcattcatagaggtgaaatcttgtcattggccgaaaagccacacattatggtcaaacggagtactagagagtgaaatgataatacctaaaaactttgcgggtccagtgtctcagcacaattaccgacccggataccatacacaaacagctggcccatggcatttgggcagacttgaaatggatttcgatttctgcgagggaacaacagtagtggtaacagaagattgcggaaatagaggtccgagcctacgcacgacaacggccagtggaaaactaatcacagaatggtgttgtcgatcttgcactctacccccactgagataccgcggggaagatggctgctggtacggtatggaaataagacctctcaaggaaaaagaagagaacctagtcaactcactggttaccgcaggtcacggccaaatagataatttctcccttggagttttagggatggcgttatttctagaagaaatgttacgtacaagagttgggacgaaacacgccatcttactcgtagcggtatccttcgtgacgctcatcactggaaacatgtcattcagagatttagggagagttatggtaatggtaggggctactatgactgatgatataggtatgggagttacgtatctagcattactggcagctttcaaagtaagaccgacatttgcggctgggttattactgagaaaactcacaagtaaagaacttatgatgactacaataggaattgtcctcttatctcaaagcaccatcccagaaacaatcttagaattaacagacgcactcgctctaggtatgatggttctaaaaatagtccgtaatatggaaaagtatcaactcgccgtcactattatggcaattctatgtgttccaaatgccgtgatattacaaaatgcttggaaagtaagctgcacaacgctcgctgtggtatctgtgagtcctttactcttaacctcatcacgtcaaaaagcagattggattcctctagcattgacaataaaaggacttaacccaacagcgattttcctaactacattaagcagaacatccaagaagaggagttggccgctgaatgaagctataatggcagttggcatggtgagtattttagcgtccagtctcctgaaaaatgacataccgatgacgggaccactagtcgcggggggtctcctaacagtttgctacgtattaacaggccgatcagcagatttggaattagaacgagcagcagacgtaaggtgggaagaacaagcagaaataagtgggagtagtccgatcttgtctattacaatatcagaagatggtagcatgagcattaaaaatgaggaagaagaacaaactctgaccatactcattcgtaccggtctcttagttatatcagggttattccccgtaagcatcccaataacggccgctgcatggtacctctgggaagtgaaaaaacaacgcgcaggagtcctgtgggatgtcccttcccccccacctgtaggaaaagcagaattagaagacggggcctatcggataaagcagaaaggcattttaggatactcacaaataggcgccggcgtctataaagaaggaacttttcatacgatgtggcatgtaaccagaggagccgtattaatgcataaaggaaaacggatcgaaccctcgtgggcggatgtaaagaaagacttgatatcctatggagggggttggaaactcgaaggagaatggaaagaaggtgaagaagttcaggtcttagctctcgaacctggaaaaaacccaagggccgtacaaacaaaaccgggcttatttaaaactaatacggggacaatcggggcagtgtcactagatttctctccagggacaagcgggtctccaattgtagacaaaaaaggaaaagtagtgggcttatatggaaatggagtcgtaacgcgaagcggaacttacgtaagtgcaatagcacaaacagaaaaatcgattgaagataaccccgaaatagaggatgacatctttcgaaagaaaagactgacgatcatggaccttcatccaggtgccggtaaaactaagcgatatcttcctgccattgtcagggaagcgataaaacgcggcttaagaacattaatcctagctccgacaagagttgtagcagccgaaatggaagaagcacttaggggtctaccgatacgatatcaaactcctgcaatacgagcggaacataccggtagagaaattgtagatttgatgtgtcatgctacattcactatgagattactgagcccaattagagtgccgaactacaatctaataattatggacgaagcacatttcaccgaccctgcaagcatagctgcgagaggttatatttcgacacgagttgaaatgggcgaagcagcgggtattttcatgacggctactccgcctggtagtagggatccgtttccacaaagtaatgcccctataatggatgaggaacgcgagattccggaacgcagctggaactcaggccatgaatgggttacagatttcaagggtaagacagtatggttcgtcccaagtattaaggcaggaaacgatatagctgcatgccttagaaaaaacggaaagaaggtaatacaattgtctaggaaaacttttgactcagagtatattaagactcggacaaacgattgggactttgtagtgaccacagacatatcggaaatgggcgccaattttaaggcagaacgggtaatagatcctcgaagatgcatgaaaccagttattctcacagatggggaagagcgtgtgattctagcgggtccgatgccagttacacactccagcgcagcacaacgaaggggaagggttggaagaaaccctaaaaacgaaaacgaccaatatatctacatgggagaaccattagaaaacgacgaagattgtgcgcattggaaggaagccaaaatgctactagataacataaatactccagagggtataataccaagtatgtttgaaccagaaagggaaaaagtcgacgcgatagatggggaatataggttaaggggagaagcacggaaaaccttcgtagaccttatgaggagaggcgatcttccagtttggcttgcatatagagtagctgcagaaggtatcaactatgctgatagacgatggtgctttgatggagtaaagaataaccagatccttgaagagaatgtggaagtagaaatatggacgaaggaaggtgagcgaaaaaaattaaaaccaaggtggctagatgcgcggatttacagcgatcctcttgctttgaaagaatttaaagagtttgcagctggacgaaagtcactaacattaaatctgataacagaaatggggagacttccaaccttcatgacccaaaaagctcgtaatgcactggacaatttagcagtcttgcataccgctgaagctggtgggagagcgtacaaccacgcactgtccgagcttcccgagactttagaaaccttattattattaacattattagccacggttaccggcggaatatttctttttctaatgtctggaaaaggaataggtaagatgactttaggtatgtgttgtattatcactgcatccatattactgtggtatgcacaaatacaacctcattggatcgcggcatcaataatactcgagttctttctcattgtattattgatccctgaacccgagaaacaacgaacaccacaagataatcaacttacttatgtggttatcgccatccttactgtcgtagcggccacaatggcaaatgaaatgggttttttagaaaagactaaaaaggacttcggtctcggctccattacgacacaacaaccagaatcaaatattttggatattgatttaagaccagcctctgcgtggaccttatacgcagtcgcgactacatttataacacctatgcttcgtcattctattgaaaattcatcagtaaatgtctcgttaactgcaatcgctaaccaggcgactgttttaatgggcttgggtaaaggatggcccttaagcaaaatggacatcggtgttccgcttctagcgataggctgttatagtcaagtgaatccaattacactaacagcggcactacttttgttagtggctcattacgctatcattgggccaggacttcaagcaaaggcaacaagagaagctcaaaaacgagctgctgctggaatcatgaaaaacccgacagtagatggaataacggtgattgatttagatccgatcccttatgatcccaaattcgaaaaacaattaggtcaagtaatgttactagtactatgcgtgacacaggttttaatgatgagaacaacgtgggcattgtgcgaagctctcacattggctacaggacccataagtacgttatgggaaggaaaccctggtcgattttggaatactactatagctgtttccatggctaacatatttaggggatcatatttagcaggagcgggactattattttcaataatgaagaatacagcgaacacgaggagagggaccggaaatacgggtgaaacactgggggaaaaatggaaaaataggttaaatgcgttagggaaaagtgaattccaaatttacaaaaaatctggtatacaagaagttgataggacactagcaaaagaaggaataaaacgcggagaaacagaccaccatgccgtttccaggggatctgcaaaattaagatggttcatagaaagaaaccttgtgacaccagagggaaaagtagtggatttaggctgtgggcggggcggttggagctactattgtggcggactaaaaaatgtaaaagaggtgaaaggtttaactaagggagggccaggccacgaagaaccaatacctatgtcaacttatgggtggaatttagtacgtttacagtcaggtgtcgatgtgttttttacacctcctgaaaaatgtgatacgctcctatgtgacataggggagagttcaccgaacccaactgtggaagcaggcagaacgttgcgcgtgcttaacctagtcgaaaactggctaaacaacaatacacagttttgtattaaagtcttgaacccttatatgccatcagttattgaaaaaatggaggctttacaaaggaaatatgggggggctctagtaagaaatcctctatcccgaaactctacacacgaaatgtactgggtatcaaacgcctcgggaaacattgtgtcgtcagtcaatatgatcagtagaatgcttataaaccgctttacaatgcgccataaaaaagccacctacgagccggatgtagatttaggctctggaacgagaaatattggcattgaaagcgagactccaaacctcgatataattggcaaaagaatcgagaaaatcaaacaagaacatgaaacaagctggcattacgatcaggatcacccttataaaacttgggcttatcatggtagctatgagactaaacaaactggatcagccagctcaatggtaaacggcgtcgtccgtctcctgacgaaaccttgggatgtcataccaatggtaactcaaatggctatgacggatactaccccattcggacagcaaagggtcttcaaggaaaaagtagatactaggacacaggagccaaaagagggtacaaagaaactaatgaagatcacagcagaatggttatggaaggaattaggtaaacgaaagactccaagaatgtgcacacgtgaagaattcacaagaaaggtacgttccaacgcagcgttaggcgctatattcacagacgaaaataaatggaaatcagcaagggaagcggtcgaggattctggtttctgggaattagtggataaagaacgtaacttgcacttagaaggaaagtgtgagacgtgtgtgtataatatgatgggaaagagagaaaaaaaactgggagaatttggcaaggcaaaaggaagccgcgcaatctggtacatgtggttgggagcccgatttctcgaatttgaagctttgggatttctaaacgaagatcactggttcagcagagaaaattcactatcaggagtggagggagagggattacataagttagggtacattctcagggatgtaagtaagaaagaaggcggagcgatgtatgcagatgatactgcgggatgggatactagaataacattagaagatttaaaaaatgaggaaatggtaacaaatcatatggaaggggttcacaaaaaattagcagaagctatattcagattaacataccaaaataaagttgtacgagttcaacgtccgaccccacgtggcacggtaatggatataattagtagacgagatcaaagaggaagcggacaagttgtgacgtacggactaaatacttttactaatatggaggcccaacttatacgtcaaatggaaggagaaggagtatttaaatccattcaacatttaacagttactgaagaaatcgcggtcaaaaattggctcgttagggtcggtcgcgaaagattaagtcgaatggccatatccggcgatgattgtgtggtaaagcctctagatgaccgattcgcctccgcgcttacggcgctgaatgacatgggaaaagtgagaaaagacatacaacaatgggagcctagtagagggtggaatgattggacacaagtgcctttttgcagccaccactttcatgaacttatcatgaaagacggacgggtattagtggtcccttgcagaaaccaggatgaactcataggcagagccagaatctcgcagggcgctggatggtcgctaagagaaactgcctgtttgggaaaaagttacgctcagatgtggagtttaatgtactttcatcgccgtgatttacgcttagcagctaacgctatctgttcagcagttcccagtcattgggttcctacatctcgtacgacgtggtcgattcatgcaactcatgagtggatgactacagaagatatgctaacagtatggaatagagtgtggatccaagaaaatccgtggatggaagataaaaccccgatagagtcgtgggaggaaataccttatttgggaaaacgagaagaccaatggtgtggtagtttaatcggtctgacttccagagccacatgggcaaaaaacatccaaactgctataaatcaagtgaggtcccttataggtaatgaagagtatactgactacatgccgtcaatgaagagatttcgccgagaggaagaagaagcaggagtactatggtaa

SEQ ID NO: 22890 - RNA, 9876 nt, synthetic construct
  misc_feature 1..9876: note = derived and/or modified CDS sequence (opt6) from DENV-2__JN851120__SS-prME
  source 1..9876: mol_type = other RNA
acagctggaataattattatgatgatacctacagttatggccttccatcttacaacgcgaaacggagaaccacatatgattgtttcaaggcaggaaaaaggaaaatctctccttttcaaaacggaaaacggtgtaaatatgtgcacgctaatggcgatggatcttggagaactttgtgaagacactataacttataattgtccattattacgtcagaacgaacctgaagacatagattgttggtgtaattcaacaagtacttgggttacctatggaacttgcacggccacaggagaacatcgacgtgagaaaagaagcgtagcgttagtaccacacgtgggtatgggtttagaaacccgtacagaaacttggatgagttcagaaggtgcatggaaacatgcacaaagaattgaaacatggatactgagacaccctggttttactatcatggctgcgattctggcttatactgttggcactacatatttccaaagagttttaatctttatactgctgacggctgtaacaccaagtatggctatgcgatgcatcgggatatcgaatagggatttcgtggaaggagtttctgggggcagctgggtggatatcgttctcgaacatggcagttgtgtcactacaatggccaaaaataaaccaactttggattttgaactaataaaaacggaagctaaacatcctgcaacgcttaggaaatactgcgtggaagcgaaattaactaatacaacgacagcaagccgctgtccgacacaaggagagcctagtttaaatgaagaacaagataaaaggtttgtttgtaaacactccatggtcgaccgaggatggggtaatgggtgtggattattcggtaaaggtggaattgtaacatgcgcaatgtttacgtgtaaaaagaacatggaaggtaaagttgttcaaccagaaaatttagagtatactatagttattacaccacatagcggtgaagaaaatgcagttggaaacgatacgggcaaacatgggaaggagattaaagtaactcctcagtcaagtattacggaagcagagttaactggatacgggacagtaacaatggaatgttcgccccgaaccggccttgatttcaatgaaatggtcttgttacaaatggaaaataaagcctggttagttcaccgtcagtggtttctagatttgcccttaccctggttaccaggagcagatacacagggtagtaattggatacagaaagagactcttgtcactttcaagaatcctcatgcaaagaagcaggacgtcgtagtactgggtagccaagagggtgctatgcacacagcgctaacaggggcaactgaaatacaaatgtcctctgggaacttattattcacgggacatctaaaatgtagattacgtatggacaaattacaacttaagggaatgagttacagtatgtgtactggtaaattcaaagtagtcaaagagatagcagaaacgcaacatggaacaatagtaattagagtacaatatgaaggcgacggctccccctgcaagataccgtttgagatcatggaccttgagaaaagacacgttctaggtagactaatcactgttaatccaatcgtaactgaaaaagattcgcccgtcaatatcgaagctgaaccaccttttggagattcttacataattataggggttgaaccaggacaacttaaattaagttggtttaaaaagggatcctctattggacaaatgtttgagactacaatgcgtggtgccaaacgaatggctatattaggggatactgcatgggatttcggtagccttggaggcgtgttcacaagtataggaaaagccttgcaccaagtatttggagcaatttacggagcagcctttagtggcgtaagttggacaatgaagatcttaattggagtagttataacgtggattgggatgaactctcgaagtaccagcctctcagtgtcgttagtacttgtaggagtagtgacattgtatcttggtgtcatggtccaagcagattcaggatgtgtagtatcatggaaaaacaaagaacttaaatgtggatcgggcatattcattactgataatgtccatacatggaccgaacaatataagttccaaccggagagtccttcgaaattagcgtctgctatacagaaagcacatgaagaaggcatatgtggcattagaagtgtaacgagattggaaaaccttatgtggaaacaaatcacaccagaactaaatcatattctgacagaaaacgaagtaaagttgactataatgacgggcgacattaaaggcattatgcaagctggtaagcgtagtcttcgaccgcagcccacagaattgaaatactcatggaaagcatggggcaaagcaaaaatgttgtcaacagaattacataaccatactttcttaatagatggtcctgaaacggccgagtgccctaatacgaacagggcatggaacagtttagaagtagaggactacgggtttggtgtttttacaacaaatatatggctaaagttaaaggaacggcaagatgttttctgtgattctaaacttatgtcggccgcgattaaagacaatcgtgctgttcatgcagatatgggttactggattgaatctgctcttaatgatacatggaagatagagaaagcgtccttcatagaagtgaaatcatgtcattggcccaaatcacatactctctggagtaatggagtgcttgaatccgaaatgattattcctaaaaacttcgccgggccagtatcacaacataattaccgtcccggctatcatactcagaccgctgggccatggcatctaggaaggttagaaatggatttcgatttttgtgaaggcactaccgtggtagtcactgaagattgcggtaatcgaggtcccagcctaaggactactaccgcttcgggaaagctgatcacagaatggtgttgtcgaagttgcaccttaccaccgttacgctacagaggcgaagatggatgttggtacgggatggaaataaggcccctaaaggaaaaagaagagaatctagttaacagcttagtaacagccggacacggccagatcgataattttagtttaggtgtattagggatggccctattcttggaggaaatgttaagaactagggtaggaacgaaacatgcaatactattagtagctgtttctttcgtaacacttatcacagggaacatgtcctttagagacctaggacgcgtaatggtcatggtcggtgctacaatgacggacgatataggtatgggagtaacatacctcgcattactggcagcatttaaagtaagacccacgtttgcagccggattactgctaaggaaattgacttcaaaagaattaatgatgacaaccatagggatagtcttactatcacagtcaactatacccgaaagtattctagaattaacagatgcattggcattaggaatgatggtcctgaaaatagtccgcaacatggaaaagtatcagctagccgtcactataatggcaatactgtgcgttccaaatgcagtgatattacagaacgcgtggaaggtatcttgtacaacattggctgtggtgtccgtttccccattactactgacctcatctcaacagaaagctgattggatcccattagccttgacgattaaagggcttaatccgacggccatatttttaacaacactatcgcgcacatcaaagaagcgatcttggcctttaaatgaagcgataatggcagtcggaatggtctctatattggcaagttcactcctgaagaatgacataccaatgacaggccccctagtagcgggtggacttttgacagtatgttatgtactcacaggacggtcagccgatcttgaacttgaaagagcagctgatgtaagatgggaagaacaggcagaaatctcgggaagttcacccatactatcgataacaatatctgaagatggatcaatgagcatcaaaaatgaggaggaagaacaaacgttgacgatacttatcaggaccggactgctagtcataagtgggctatttcccgttagcattcccataacagcggcggcttggtatttatgggaagtaaagaaacaaagagcaggcgtcctctgggacgttccttcgccacctcctgtgggaaaagcagagttagaagatggcgcttatagaattaaacaaaaagggatcctaggttattcacaaataggtgcaggagtgtacaaagaagggacatttcacaccatgtggcatgtcacacgtggggcagtcttaatgcacaaaggcaaacgaatagaaccgagttgggctgatgtcaagaaagacttgatttcgtacggtggaggttggaaattggagggtgaatggaaggaaggggaagaagtccaggttttggcattagaaccaggcaaaaatccacgcgctgtccagactaaaccaggattatttaaaacgaatacaggaactataggtgccgtcagtctagatttttcgcctggtacgtcaggctctcccatagttgataaaaagggaaaagtcgtcggtctgtatggcaatggggtcgtaacacgctctggtacttatgtaagcgcaattgcccagaccgagaaatcaatagaagacaatcccgaaatcgaagacgatatttttagaaagaaaagactgaccattatggacctacatccaggtgcagggaaaactaaaagatatttaccagcaattgtacgtgaagcgattaaacgaggattaaggacattaatactggcacccactcgtgtagtagcggctgaaatggaagaagcactcagaggtctaccgattcgatatcaaaccccagccataagagccgaacatacaggtagagaaatagtagatttaatgtgccacgctacattcacaatgaggctattatctccgattcgagtgcccaattataaccttataataatggatgaagcacattttaccgatccggcatcaattgcagctagaggatatatatctacaagagtagaaatgggggaagcggcaggaatctttatgactgcaacgccacctggcagtcgggacccatttccccaaagtaacgcgccaataatggacgaggaacgagaaataccagaaaggagttggaacagcgggcatgagtgggttacagattttaaagggaaaacagtatggttcgtcccgagtataaaagcaggaaacgatatcgcggcctgtctacggaagaatggcaagaaagtaatccaactaagccgaaaaacatttgattcagaatatataaaaaccagaactaacgactgggatttcgtagtgacaacggatatatccgaaatgggtgccaattttaaagctgagcgcgtgattgacccccgccgatgcatgaaacctgtaattcttacagacggagaggagagagtaattctcgctggacccatgccagtaactcattctagtgctgctcagagacgaggtcgagtgggaagaaatcccaaaaatgaaaatgatcaatacatatacatgggtgaacctctagagaacgatgaagactgtgcccactggaaagaagctaagatgcttctagacaacatcaacaccccggaaggtattataccatcgatgttcgaaccagaaagagaaaaagtggatgcgatagacggcgaataccgactaagaggtgaggcccgcaaaacttttgtagatctgatgcgaagaggcgatttaccagtttggctcgcatatcgagttgcagcagagggcataaactacgccgatagacgatggtgcttcgatggagtgaaaaataaccaaatccttgaagaaaatgtagaggtagagatatggacgaaggaaggggaacgtaagaaactaaaaccacgatggttagatgcgcgaatatatagtgatccattagcactaaaagagttcaaggagttcgcagcaggcagaaaatccttgaccctaaatttaattacagagatgggtagactgccgaccttcatgacacaaaaagctaaaaatgctctagacaacttagcagtactccatacagctgaagcaggaggacgagcgtacaaccacgctctctctgagttgcctgaaacgttggagacactcctattattgactttgctagctacggtgacgggaggtatttttctattcctaatgtcaggtaagggaataggaaaaatgaccttaggcatgtgctgtataataactgcctcaatacttctttggtacgcgcaaatacagcctcattggattgcagcaagtattattctagagttctttttaatagtcctcttgataccggaaccagaaaagcagcggacacctcaggacaatcagcttacgtacgtagtcattgcaatactaaccgtagtggccgcgacaatggcaaacgaaatgggtttcttggagaaaactaagaaagattttggtctaggtagcataaccacacaacaacctgaaagcaacattttggacatcgatttgcgccctgcttctgcgtggactctctatgctgtggcaaccacttttattactcccatgttacgtcattcaatagagaacagtagcgttaatgtctctttaacagctatcgctaatcaagcaacagtattaatgggactcggtaaaggatggcccctctcaaaaatggatattggagtgcctttattagccataggctgttattcacaagtaaaccctataaccttgacagccgctttactattattagttgcgcactatgcgataattggtccaggtctacaagcaaaagcaacccgcgaagcccagaagagggcagcagcgggtattatgaaaaatccgacggttgatgggatgacagtaatagatctagatcccataccttatgatccgaaattcgaaaaacagttaggacaggtaatgttattagttctctgtgtaacacaggttctgatgatgcgtacaacgtgggcactatgcgaagccttaacattggcaacaggccccatttcaaccctttgggaaggcaatcctgggagattttggaatacaactatagcggtgagtatggctaacatatttagaggctcttatctagcaggcgcaggattactttttagcataatgaaaaatactgcaaatactaggagagggacgggaaatacaggtgaaactttaggcgaaaaatggaaaaatagacttaatgcacttggcaaatcggaatttcaaatctataaaaagagtgggatacaagaggtggacagaacgctcgctaaagaaggcattaagaggggagaaaccgatcaccatgctgtgtctcgtggctctgcgaaacttagatggtttgtagaacgaaacctggtgaccccagaaggcaaggtagtggatctcggatgcggtcgaggaggatggagttattattgtggtggcctaaagaatgtaaaagaggtaaaaggattaacaaaaggcggtccaggacacgaggaacctattccaatgagtacttatggatggaatctagtacgtttacaatcaggtgttgatgtcttcttcacaccaccggagaaatgcgatacccttctgtgtgatatcggtgaaagttctcctaaccctactgtggaagcaggaagaacgctgcgagtattaaatctcgtcgaaaactggctaaataacaacacccaattctgtataaaagtgctaaacccctacatgccatcggttatagagaaaatggaagcattacaaagaaaatacggaggagcactcgtaagaaacccgctatcaagaaactcgacacacgaaatgtactgggtaagtaatgcatcaggtaatatagtatcgtcagtaaatatgatcagtaggatgctcataaatcgttttaccatgcgacataagaaagccacatatgagccggacgtagaccttgggagtggcacaagaaatatcgggattgaaagcgagactccaaacctggacataataggcaaaagaattgaaaagataaaacaggaacatgaaacaagttggcactacgatcaggaccacccatacaaaacatgggcttaccacgggtcatatgagaccaagcaaacaggtagtgcttcttcaatggtaaatggcgtggtaaggttattaacaaagccttgggatgttataccgatggtaacccagatggccatgactgatactacaccatttggtcagcaaagagtatttaaggaaaaagtggatacaagaacacaagaaccaaaagaaggaaccaagaaattaatgaagataacggcagaatggctctggaaagaattaggcaagaagaaaacaccaaggatgtgcacccgtgaggaatttacaagaaaggtacgtagcaacgcagcactcggggccatcttcacagatgaaaataagtggaaaagtgcaagggaagcagttgaagattcaggtttctgggaattagtcgacaaagaacgcaatttacacttagaaggaaaatgtgagacgtgtgtttacaatatgatgggtaaaagagaaaagaaactaggtgaatttgggaaagcaaaggggagcagagcaatctggtacatgtggttaggagcacgatttctagagtttgaagcattagggtttctaaacgaagatcactggttctcgagagagaactcacttagtggcgtagaaggtgaaggactacataaactcggctatattctgcgagatgtttcaaagaaggaaggcggagcaatgtatgcagatgatacagcgggctgggatacaaggataacactcgaagacttgaaaaacgaggaaatggtaacaaatcacatggaaggagaacataaaaagttagccgaggcaatattcaaactgacatatcaaaataaggttgttcgcgttcaaagaccaactcccagaggaacagtaatggacataatatcacgacgggaccaaagaggatctggtcaggttgtaacttatggattaaatacttttacaaatatggaggcccaattaatacgccagatggaaggtgaaggagtcttcaaatctattcagcaattaacagtcaaggaagaaatagcagtcaaaaattggcttataagagttggccgagaaagattatctaggatggcgattagcggagacgattgtgtagtgaaaccactagacgatcgatttgcaagtgcattaacagcgttaaatgatatgggtaaagtacgcaaggacatccaacagtgggaaccgagccgagggtggaacgattggacgcaagtaccattctgttctcaccactttcacgaacttattatgaaagacggacgagtacttgtagtcccatgcaggaatcaggatgaattgataggtcgagcacggatttcgcaaggagcgggatggtctctaagagaaaccgcatgcctaggtaagagctatgcgcaaatgtggtcgttaatgtattttcatagaagagatctccgactagcggcaaatgcaatatgcagcgcagttccgagtcactgggtgccaacaagtagaactacatggtctatccacgccacacacgaatggatgacaaccgaagacatgctaacagtatggaacagggtctggattcaagaaaatccgtggatggaagacaaaaccccagtcgaatcctgggaagaaataccgtatctgggcaaaagagaggatcaatggtgcgggagtttgataggattaaccagccgagccacatgggcgaagaatatccagaccgcaataaaccaagttagatcattaattggtaacgaagagtatacagattatatgccttcaatgaagcgtttccgaattgaagaggaagaagcaggagtcctatggtga

SEQ ID NO: 22891 - RNA, 9876 nt, synthetic construct
  misc_feature 1..9876: note = derived and/or modified CDS sequence (opt6) from DENV-2__JN851131__SS-prME
  source 1..9876: mol_type = other RNA
actgcgggtgttataataatgatgataccaacggttatggcttttcatctgacaactcgcaatggagaaccacacatgattgtatcaagacaagaaaaagggaaatcattactgtttaaaaccgaaaatggtgttaacatgtgtacactaatggctatagacttaggtgaattgtgcgaagataccataacctacaactgccccctactaaggcagaatgaacctgaagacatcgattgttggtgcaacagtacatcgacttgggtaacgtatggtacatgtacggcaacaggagaacatagacgagagaaaagaagcgttgctttagtaccccacgtgggtatgggtttagaaactaggacagaaacttggatgagcagtgaaggcgcttggaaacacgcacaaaggatcgaaacgtgggtcctaaggcatccaggattcacaatcatggctgcaatattagcatacactatcggcacgacatactttcaaagagtacttatatttattttacttacagcagtagcaccgtcaatgactatgcgctgtataggaatttcaaacagagatttcgtagaaggagttagtggtggaagttgggtcgacatagtattagaacacggatcttgtgttacgacaatggccaaaaataaacccacattggactttgaattaataaaaacggaagcgaaacatcccgcaacactacgaaaatactgcattgaagcaaaactaacaaatactacaaccgctagcagatgtccaacgcaaggtgaaccaagcctaaaagaagaacaagataaaagattcgtatgtaaacactccatggtagatcggggatgggggaacggatgtggtcttttcggaaaaggtggaattgttacttgcgctatgtttacatgtaagaaaaatatggaaggtaaagtcgttcaacccgaaaacttggaatatacaatcgtgatcactccacattctggagaagaaaacgctgtaggaaacgataccggaaaacatggaaaagaaataaaagtaaccccgcagtcatcaataacagaagcagaacttaccgggtatgggacggttaccatggaatgctctcccagaaccgggttagatttcaatgaaatggttctattacagatggaagataaagcgtggttagtacataggcaatggttccttgacctccctctcccatggttaccaggagcagatactcaaggatctaattggatccaaaaagaaacccttgtgacttttaaaaatccccatgccaagaaacaggacgtcgtggtactcggtagccaagaaggagcaatgcacacagcacttacgggtgcgactgaaatccagatgagttcaggtaacttactgttcacgggacacttaaaatgtagactcagaatggacaaactccaactgaaaggcatgtcctattctatgtgcacgggcaaatttaaagtagttaaagaaatcgcagaaacacaacatggcacgattgtcataagggtacaatacgagggagatggttctccatgtaaaataccgttcgagataatggatttagagaaacgacatgtactcggacgtttaattacagttaaccctatcgtcacagaaaaagattcgccagtgaatattgaggctgaaccaccttttggagattcttacataattataggcgtggaacccggtcagctaaaactttcatggtttaagaaaggctcgtcgattggtcaaatgtttgagacaactatgagaggagcaaaaagaatggctatattgggagacaccgcttgggactttgggtcgctcgggggcgtatttacgtcaattggcaaagcattacatcaagttttcggcgcaatatacggtgcagcgttttcaggggtttcttggacaatgaaaatcttgattggcgtagtgatcacgtggatcggaatgaatagtcgatctacgagtcttagcgtaagcctagttcttgtaggagttgttacattatatctaggagtaatggttcaggctgacagtgggtgcgtagtgagctggaaaaataaagaactgaaatgtggcagcggaatcttcatcacggacaacgtacacacgtggacagaacagtacaaattccaacctgaaagtccatccaagctcgcatcagcgattcagaaggcacatgaggaaggcatatgtggaatcagatcagtgacaaggctagaaaatctaatgtggaaacaaattacccctgaacttaatcatatattaagtgaaaatgaagtcaaactcacgataatgaccggcgatatcaaaggaataatgcaagcaggtaagcgatccttacgtccacagcccacggaattaaaatattcctggaaaacatgggggaaagcaaaaatgttatcgacagaacttcacaatcatacatttttaatagatggaccagaaacagcagaatgtccgaatactaatagagcgtggaacagtcttgaagtggaagactatggttttggtgtatttacaaccaatatatggcttaaactaaaggagcgacaagaggtgttttgtgatagtaaattgatgagcgcggccatcaaagacaatagagcagtccacgcagatatgggttactggattgaaagtgcattgaacgacacatggaaaatagaaaaggcatcattcatcgaagtaaagagttgtcactggcccaaaagtcacacattatggagcaacggagtgctggaatccgagatgattatacctaaaaatttcgcgggccccgtgtcgcaacataactacagacctggctatcatacacaaaccgctggaccttggcatttggggaagctagagatggacttcgatttctgtgagggcacaaccgtagtcgtcacagaagattgcggaaacagaggacccagcttgcgtactactacggcaagtggaaagctcattactgagtggtgctgtagatcttgcactctacctccattgagatatcgaggcgaagatggatgctggtatggaatggaaattaggccgagtaaagaaaaggaggagaatttggtaaattcattggtcacggctggccacggccaaattgataactttagtcttggagtattaggaatggctttgtttctagaggaaatgttaaggacaagggttggcactaaacacgcaatactattagtagcggtaagttttgttacactcattacaggaaatatgagtttccgtgatcttggtagagttatggtaatggtaggggccacgatgacagacgacataggaatgggtgtaacctacttagcgctcttagctgccttcaaagtaagaccaacctttgcagctggattattgctccggaaattaactagcaaggaacttatgatgaccactataggtattgtcttgttatcgcaatcaacaatacctgaaaccattttggagctaacagatgcactggctttagggatgatggtattaaaaattgtgcgtaatatggagaaataccaactagctgtaactataatggcaattctgtgcgttcctaacgcggtaattctacaaaatgcatggaaggttagctgtaccactcttgcggtcgtcagtgtatcacctctactgttaacatcctcacaacaaaaagcagattggataccactagcacttacaataaagggtctaaatcctacggctatatttctgacgacattaagtcgtacaagtaaaaagagaagctggcccttaaatgaggcaattatggccgttggcatggtatcaatacttgcaagtagccttctgaaaaatgatataccaatgactggaccgctagtagcaggaggcctgctcaccgtgtgttatgttctaactggaagaagcgctgacttagaactcgagagagccgccgacgttcgctgggaagaacaagctgaaatatcgggctcgtcaccgatcctaagtataacaatatcagaggatggctcaatgtcaattaaaaacgaggaagaagaacaaactcttactattctgatcagaactggactcctagtgattagtggtctattcccagtttctattccaattacggcagctgcgtggtatttgtgggaagtgaaaaagcagagagcaggggtgttgtgggacgtgccatcgcccccacctgttggcaaagcagaacttgaagatggggcatatagaataaaacaaaaaggtatcctgggctactcccaaattggcgcgggcgtttataaagaaggaacctttcacacaatgtggcacgtcaccagaggggctgttctcatgcataagggaaaaagaatagaaccttcgtgggctgacgtcaagaaagatctcataagctacggtggaggatggaaattagaaggagaatggaaggaaggagaagaagtacaagtattagcattagagcccggcaaaaatccacgagcggtccaaacgaaaccaggcctatttaaaacaaacactggaacaataggtgcagttagtctagatttttcacccggaaccagcgggagcccaatcgtcgataagaaaggcaaagtggtcgggctttatggcaacggtgttgtgactcgcagtggtacatacgtaagtgcaattgcacaaacagaaaaatcaattgaagataatccagaaatcgaggatgacatttttcgtaagaaaagactaacaattatggatttacaccccggagcaggcaaaacaaaaagatatttacctgcaatagtgagagaagcgatcaaacgcggtctaagaacactaatattagcgcctacgcgagttgtggctgccgaaatggaagaggcattacgaggcctacccattcgttaccagacacccgcaatacgtgtcgaacatacaggacgagagatagtagaccttatgtgtcacgctactttcaccatgcgtctacttagccctatcagggtaccgaattacaatcttataattatggatgaagcacatttcacagatcccgcaagtattgcggctagaggatacataagtacgagggtagagatgggggaagcagcggggatttttatgaccgcaacaccacctggctcaagagacccattccctcaatctaatgccccaattatggatgaagaacgagaaataccagaacgctcatggaactccggacacgagtggattacggattttaagggcaagactgtttggtttgttcctagtataaaggccggaaatgacattgcggcctgccttcggaaaaatggtaagaaagtcatccaactcagtagaaagactttcgattcagaatatatcaaaacaagaacaaacgattgggatttcgtagtcaccacagatatatcagaaatgggtgcaaatttcaaagctgaaagagtaatagatcccaggcgatgcatgaagcccgtaatattaactgatggagaggaaagggttatattagccggtcccatgcccgtcacacacagttctgcagctcagagaaggggccgagtgggtagaaacccgaagaacgaaaacgaccaatacatatacatgggcgaaccactagagaacgacgaagattgtgcacattggaaagaagcaaaaatgctattagacaacattaatacaccggaaggaatcataccctctatgttcgagccggaaagagaaaaagtggatgccattgatggagaatacaggctcagaggggaagctagaaaaaccttcgtagatctaatgagacgaggcgacctacccgtgtggctggcttatagggttgcagctgagggaataaattacgcagacagacgttggtgtttcgatggcgtgaaaaataatcaaatattggaggaaaacgttgaggttgaaatatggacaaaggaaggtgaaaggaagaaacttaaaccgagatggctggatgccagaatatattcggatccgctggctttaaaagagtttaaagagttcgctgcgggacgaaaatctcttacgctaaatttgataacggaaatgggaagactaccaacgtttatgactcaaaaagccagaaacgctctcgataatctcgcagtgttacacacagcagaagcaggagggcgagcgtataatcacgctctatccgaactaccagagactttggaaacacttcttcttcttaccctacttgcgacagtaacaggaggcatatttctctttctcatgtcgggcaagggaatcggaaaaatgaccttaggtatgtgctgtatcattacagcgtcagtcttattatggtacgcacaaattcagccacattggattgccgcatccatcatactagagttctttctaatagtactacttattcctgaaccagaaaaacaaagaacaccacaggacaaccagctaacctatgtagtaatagcaattttaactgtagttgctgcgacaatggcgaacgagatgggcttcctagagaagacaaagaaggattttggattaggttcaatagccatacaacaaccagagtcgaacatattggatattgatcttcgacctgcctcagcctggactttatacgcggttgccacaaccttcatcactcctatgctgagacattcgattgagaatagcagtgtcaatgtgtccttaacggcaatagctaatcaagcaactgtactaatgggtctaggcaaaggttggcctttatccaaaatggatattggagtaccattgctagcaataggatgctacagtcaagtgaacccaataacattaacagcggctctactccttttggttgcgcactatgcaataatcggtccaggccttcaagccaaagccacgagggaagctcagaaacgtgctgcggcgggaataatgaagaatccaactgttgacggtataacagtaatagatctagacccaataccgtacgatccaaagtttgaaaaacaattgggccaggttatgctgttagtcctttgcgtaacacaagtattaatgatgaggacaacgtgggcattatgcgaggcactaacattagccacaggacctatatcaacactatgggagggcaatccagggagattctggaatacaacaatagcggtgtcaatggctaatatttttaggggatcttatctagccggtgcgggcctattattctcaataatgaaaaatacggcaaatacccgtcgtggaacgggaaacacgggtgaaactttgggagagaaatggaagaatcgattaaacgcattgggtaaaagcgagtttcaaatctataaaaagtccggtatacaagaagtggacaggactctggcaaaagaggggattaagagaggagaaacagatcatcatgcagtatctagaggtagcgcaaagttacgatggtttgttgaaagaaatctcgttacaccagaaggaaaggtggtagatctaggttgcgggaggggtggctggtcgtattattgtggcggactcaaaaatgtaaaagaagtaaaaggtctgactaaagggggaccaggccatgaagaaccgatacctatgagcacgtatggatggaacttagtaaggcttcaatccggagtagatgtattcttcacaccaccagagaagtgtgatacacttttatgtgacataggcgaatcctcgcccaatccaaccgtagaggcgggtagaacactccgtgtattaaacttggttgagaattggctaaacaataatactcaattttgcattaaggtgctaaacccttacatgccaagcgtcatcgagaaaatggaagcactacaacgtaaatatggaggtgccctagtaagaaatccattatcgagaaattctacacacgaaatgtattgggtctctaatgcaagcggaaatatagtatcgagcgtaaacatgatttcacgcatgttaattaatagattcactatgagacataagaaagctacatatgaaccagacgttgacttaggatcgggtacaaggaacatcggcatagaatctgaaaaaccaaacctcgatataataggtaagcgaatcgagaaaattaaacaggaacacgagacgagttggcattacgaccaagaccatccgtacaagacttgggcttaccacggatcatatgaaactaagcaaacaggaagtgctagcagcatggtaaatggagtagtgcgacttctcactaaaccttgggacgttattccaatggttacccagatggcgatgactgacacaacaccttttgggcaacaaagagtatttaaggaaaaggttgacactcgaacacaagaaccgaaagagggtacgaagaaacttatgaagataacagcggaatggttatggaaggaattaggcaagaagaaaaccccaagaatgtgtacacgggaggaatttaccagaaaagtaagaagcaacgccgccctcggagctatctttaccgatgaaaataaatggaaaagtgcacgcgaagctgtggaagatagtggattctgggaattagttaataaagagaggaatctccacctagaagggaagtgtgagacatgcgtatataacatgatggggaaacgtgagaagaaattaggagagttcggaaaagcaaaagggtcaagggctatatggtatatgtggttaggcgcaagatttttagagttcgaggctttaggatttttaaatgaagaccactggttttcaagagaaaattcgctatctggtgttgagggagaaggcttacataaacttgggtatatcctgcgagacgtatctaaaaaggaaggaggtgccatgtatgcggatgatacagcggggtgggatacaagaataactctagaagacctcaaaaatgaagaaatggttacgaaccacatggaaggtgaacataagaaactcgcagaggccatatttaaattaacgtaccaaaataaagtagtaagggtacaaagaccaacaccccgaggaaccgttatggatataatcagtcgaagggatcaaagaggcagcggccaagtggtgacttatggactaaacaccttcacaaatatggaagcacaacttattcggcaaatggaaggagaaggtgttttcaaatctatccaacatttaactgttacagaagaaatagctgttaaaaactggttggtcagagtggggcgggaaaggctaagtagaatggctattagtggggacgactgtgttgtcaaacctttagatgatcgattcgcatccgctttaacagcactaaatgatatgggcaaggtcagaaaagatatccaacagtgggagccatccagggggtggaatgattggacccaagtaccattttgttcgcaccattttcatgagttgataatgaaagatggaagagttctggtggttccatgtagaaaccaagacgaactcattgggagagctagaataagtcaaggtgctggatggtcactacgagaaacagcatgtttgggaaagagctacgcacaaatgtggtccttaatgtattttcacagaagggatttaagactagcagcaaatgcgatatgtagtgctgtaccatctcactgggtaccgacctcgcggacaacatggtcaatccacgcaacgcatgaatggatgacaacggaagacatgctcacagtatggaacagagtctggatccaagaaaacccgtggatggaagataaaacacctgtcgagtcgtgggaagagatcccgtacctgggtaaaagagaggaccagtggtgcggatctttgattgggttgacgtctcgagctacatgggctaagaatatacaaacagcaataaatcaagttagaagcctaattggaaacgaagaatatactgattatatgcctagtatgaaaagattccgaagagaagaagaggaagcaggggtgctatggtga

SEQ ID NO: 22892 - RNA, 9876 nt, synthetic construct
  misc_feature 1..9876: note = derived and/or modified CDS sequence (opt6) from DENV-2__JN851122__SS-prME
  source 1..9876: mol_type = other RNA
accgcaggtataataataatgatgatacctacagttatggctttccacctaacaactagaaatggagaaccccacatgattgtgtccagacaagaaaaagggaaaagtctgctatttaaaactgaaaatggtgtgaatatgtgtacacttatggccatggatttgggcgaactatgtgaagatactattacttataactgcccactactacgacaaaatgagcccgaagatatcgattgctggtgtaactctaccagtacgtgggtcacgtacggaacgtgcactgctacgggggaacatagacgagagaaacgatctgttgccttagttcctcatgtcggtatgggcttggagacaagaaccgaaacatggatgtcatctgaaggtgcttggaaacacgcccaacgtatagaaacttggattttgagacacccaggctttacgataatggccgcaattctagcttacactataggaacaacatattttcagagggtattaatcttcatacttttaacggctgtgactccttcgatggcgatgcgttgtattgggatttccaatagagacttcgtagaaggcgtaagtggagggtcatgggttgacatcgtattggaacacggatcttgcgtgactacaatggccaaaaataaaccgacgctagatttcgaactaataaagacagaagccaaacatccagccacactacgaaaatattgcgtagaagcaaaactaacaaataccactacggcatcaagatgcccgacacaaggagaaccgtcattaaacgaggaacaggacaaaaggttcgtctgcaagcacagcatggtcgacagaggctggggaaatggctgtggattgttcggtaaaggaggaatagtgacgtgtgctatgtttacatgtaaaaaaaatatggagggtaaagttgtccaaccagagaacttagagtacacaatcgtgattacacctcattcgggggaggagaatgcagtagggaatgacacagggaaacatggtaaagaaataaaagtgacgcctcaatcatcgatcacagaggcagaactgacaggctacggaactgttacaatggaatgtagtccaagaacaggattagatttcaatgagatggtcttactacaaatggagaacaaagcctggctagtgcatcgtcagtggtttctagatcttcctctaccgtggttaccgggtgcagacacacaaggctcaaattggattcaaaaagagacactggtcacattcaagaacccgcatgcaaaaaagcaagatgttgtagtactaggatcacaagagggtgccatgcacacagcattaacaggagcaactgaaatccaaatgtcgagtggcaatctattattcactggccatctaaaatgcagacttcgaatggacaaacttcaacttaaaggtatgagctacagcatgtgtactggaaagtttaaagtggtaaaagaaatcgcagaaacacaacatggtacgattgtcattagggtgcagtatgagggtgatggatccccgtgtaagattccttttgaaataatggatttagaaaaacgacacgttctagggagactaataacagtcaatccaatagtcacggaaaaagatagcccagtaaacatagaagctgaaccacctttcggagattcgtacatcatcattggtgttgaacctgggcaattgaaactatcttggttcaaaaaaggctcaagtatagggcaaatgttcgaaaccacaatgagaggagcgaaaagaatggcaatattaggagatacggcctgggactttgggagcctaggcggagtttttacaagtattggtaaagccctccaccaagttttcggtgccatctatggagcagcatttagtggagtatcgtggaccatgaaaatcttaataggtgttgtaataacctggattggaatgaatagtcgatccacaagtctcagcgtaagccttgtactggtcggggttgtcacattgtatcttggagtaatggtacaagctgacagtggttgtgtagtaagttggaagaataaagaactaaagtgcggttctggtattttcatcacggacaatgtacatacctggacagagcaatataaatttcaacctgaatcaccaagcaaacttgcaagtgcaatccagaaagcacatgaagaggggatttgcggcataaggtcagttacgaggctagaaaatttgatgtggaaacaaattacaccagagttgaatcatattttgacagaaaatgaagtcaaattgactattatgacaggtgacataaagggtattatgcaagcaggaaagagaagtcttagaccgcaaccaacagaactcaaatattcgtggaaagcttggggtaaagcaaagatgttatcgacagaactacacaatcatacatttttaatagatggcccagagacagcagaatgccctaataccaatagagcttggaatagtctcgaggtggaagactatggattcggggtgttcacaactaatatatggttaaaacttaaagaaaggcaagatgtattttgcgatagtaaattaatgtctgcggcaataaaagataacagggcagtccatgctgatatgggttactggatagaaagtgcattgaacgacacatggaagatagaaaaggcatcattcattgaagtgaaaagctgtcattggcctaaatcgcacacactctggtcgaacggcgtcctcgaatcagagatgatcataccaaaaaattttgcaggacctgtctctcaacacaactatcgacctggatatcatactcagaccgctggaccgtggcatttaggtaggcttgaaatggacttcgacttctgtgagggtaccacggtagtagttacagaggattgtggtaacagaggtccttccctgaggactacaactgcaagtggtaagttaataactgaatggtgctgcagatcgtgtacattaccacctttgagatatcggggtgaggatggttgctggtatggaatggaaatacgacctttaaaagagaaagaggagaatttagtcaacagcctagtaacagcaggtcacgggcaaattgataatttttctttaggtgttttaggaatggccctgttcttagaggagatgttaagaactcgcgtaggcacaaaacacgctattcttctggtagctgtaagcttcgtaactttgatcacgggaaatatgtcatttcgtgatctgggcagagtcatggtcatggtcggagcaacaatgacagatgatattgggatgggagtaacttacctagctctcctagcagcgtttaaggttcgcccgacgtttgccgcgggtcttttactaaggaaactaacaagtaaagagcttatgatgactactatagggatagtactgctgtcacaaagtacaatacccgaatccatccttgaacttacagatgctttagccttagggatgatggtactgaaaattgtacgaaatatggagaaatatcaactagcagtcacgataatggcaatactgtgcgtaccaaacgccgtaatactacagaatgcatggaaagtaagctgcacaacactagcagttgttagtgtatcaccgttgttactaacatcatctcaacaaaaagccgactggattcccttggcattaacaataaaaggactaaacccaactgcaatatttctaaccacattatcacgaacaagtaaaaaaagaagttggccattgaacgaagctataatggcagtaggcatggtatctattctcgcctcgtctttactaaaaaatgacattcctatgacaggaccgttagttgcaggaggactattgacagtatgctacgtactaactggtagatcggcagacttagaacttgagcgagcagccgatgtacgatgggaggaacaagcagagatatccggatcatcccccatcttatccataacaatatctgaggacggcagtatgagcattaaaaatgaagaagaagagcaaacactgaccatactaataaggactggtttactagtgatttcagggttattccctgtaagtattccgataaccgctgctgcttggtatctctgggaagtgaagaagcaacgtgcaggcgtattatgggatgtaccaagtcctccaccggtaggaaaagccgaactagaagacggtgcatataggatcaaacaaaaaggcattctaggttatagccaaataggtgccggagtatacaaggaaggaaccttccacacaatgtggcatgtaactagaggagctgtactaatgcataaaggtaagcgaatcgaaccctcatgggctgatgtcaaaaaagatctgatctcatatggaggtggttggaaactagaaggcgaatggaaagaaggggaggaagtgcaggtactggccctagagccagggaaaaatccaagagcagtccaaacaaaacccggtctattcaagacgaacactggtacaattggcgcagtctccttagacttctcacccggaacctctggatcaccaatcgtggataaaaaaggcaaagttgttggattatatggtaatggtgtagtaacccgaagtggcacttatgtttcggctatagcacaaacagaaaaatccatagaagacaatcctgaaatagaggatgatatctttagaaaaaaaagacttacgatcatggacctacatcccggcgcaggaaaaactaaacgatatcttcccgcgatcgttcgagaggcgataaagagaggtttgagaacactgatcttggctccaacacgtgtagtcgccgcggagatggaagaggcactacgagggctccctataagatatcaaactccagcaatacgggccgaacatactgggagggaaattgttgacctcatgtgccatgcaacattcaccatgaggctattatccccaataagagtacctaactataacctgataataatggacgaagcccattttaccgatccagcgagcatcgctgccagagggtatatttccactagagtcgaaatgggcgaagcagccggaatattcatgactgcaaccccaccagggtccagggatccctttccgcagtcaaatgctcctattatggacgaagaacgagaaatcccggaaagatcctggaattctggccatgaatgggtaactgacttcaaaggtaaaaccgtctggtttgtaccatcaataaaaacaggtaatgatatcgcggcatgtctacggaagaatggaaagaaagtaatacaactttcgagaaagacattcgatagtgagtacataaaaactcggaccaacgattgggatttcgttgtcacaacggacatttcagaaatgggagctaatttcaaagctgaacgagtcattgatccaaggaggtgtatgaagccggtgatattgacagatggagaggaacgagttatactagccggaccaatgccggtaacccatagtagtgctgcccagcgtagagggcgggttggaagaaatcccaaaaatgagaatgaccaatacatatatatgggtgaacctctagaaaacgatgaggattgcgcacattggaaggaggcgaaaatgctactagataatataaatacacctgaaggtatcattcctagcatgtttgaacccgaacgggaaaaagtggacgcaatcgacggagaatataggttacgaggcgaggcaagaaaaacatttgttgatttaatgcgacgtggagaccttcctgtctggttagcttacagagtcgccgcggaggggatcaattacgctgaccgacgatggtgctttgatggcgttaagaataaccaaatcttggaagaaaatgtagaggtggagatatggacaaaagagggagaaagaaagaagttaaaaccccgttggctggatgctcgaatttatagtgatccattagcactaaaagaattcaaggaatttgcagcaggcaggaaaagcctaaccttaaatttgatcacagagatgggtaggcttccgacgttcatgactcagaaagcgaaaaacgcactagataatttggcagttctacacacggcagaagccggaggtcgagcatacaaccacgcactatctgaactaccggaaacgctagagacactacttttacttaccctactcgcaaccgtgacaggcggaatctttttatttttaatgtcgggcaaaggtataggtaaaatgacactaggcatgtgttgtataattacggctagtatattactctggtatgcgcaaatccagccgcattggattgccgcttcgattatcctagaatttttcttaatagtacttttgatacctgaaccggagaaacaacgaactccccaggataatcagttaacttatgtggttattgcgatccttacggttgtggcagcaactatggcaaacgaaatgggtttcttggaaaaaacaaaaaaagatttcggattaggctccattacaacgcagcaacctgaatctaacatactagacattgaccttagaccagcctcagcttggactctctatgcagtagcaacaacgttcataacaccaatgttacgacattctatcgaaaattcgagtgttaatgtttcactaaccgcaatagccaaccaggctactgttctcatggggttgggtaaaggttggccactgagtaaaatggatataggtgttcccttactcgcaataggatgttattcgcaagtaaatccaattaccttaactgccgcattgttactattagtcacacattatgcgattattggacccggtctacaggctaaagcaacacgcgaagcacagaaacgagcagcagcagggattatgaagaacccaacagtcgatggtatgacagttattgaccttgaccccataccctacgatccaaaattcgagaaacaacttggacaagttatgctgcttgttttatgtgtgacacaggtactaatgatgcgcacgacctgggccttatgtgaggcattaaccttagccacaggtcccatatctacactatgggaggggaaccccggaagattttggaatacgacgatagcagtatcaatggcgaacatatttagaggatcctatttagctggagctggacttctttttagtataatgaaaaatacagctaatacgagaagaggaacgggaaacattggcgaaacacttggagaaaagtggaaaaaccgcttaaatgcgctcggaaagagtgagtttcagatatataaaaaatccgggatacaagaagttgataggacactagcaaaggaagggataaaacgtggagaaaccgaccatcatgccgttagtagaggaagcgcaaaacttaggtggtttgtcgaaaggaatcttgtaacccctgaaggcaaagtcgttgatttaggctgcggaaggggaggctggagttattattgcggcgggctgaaaaacgttaaagaagttaaagggctgactaaagggggacccggacacgaagaacctataccaatgagcacatacggatggaatttagtgagattacagtccggagtggatgtattctttacgcctcctgaaaagtgtgatacactactgtgtgatataggcgaatcgtcacctaaccctactgtagaggccgggaggacattaagagttctcaacttagtagaaaattggctaaataacaatactcaattctgcataaaagtgctcaacccatatatgccaagcgtcattgaaaagatggaagcattacaaagaaaatacggcggggctttagttagaaatcctttgtcacgaaacagtacccatgaaatgtactgggtctcaaacgccagcggaaacatcgtttccagcgtaaatatgatatcacgtatgttaattaatagattcacaatgcgacataaaaaagcaacatacgaaccagacgtagatttgggatccggaacacgcaacatagggattgaatcagagacaccgaatctagacatcataggcaaacgcattgaaaagataaagcaagagcatgaaacctcttggcactacgatcaagatcatccatacaaaacatgggcgtatcatgggtcatatgaaacaaagcaaactggatcggcctcgtcaatggtcaatggagtcgtgcgacttttgaccaaaccgtgggatgtgatacctatggttactcaaatggctatgacggacacaactccattcggccaacagagagttttcaaggaaaaagttgacacccgtactcaagaacctaaagaaggtaccaagaagttaatgaagataactgctgaatggctatggaaagaacttggtaaaaaaaaaacgcctagaatgtgcactagagaggaattcacgaggaaagtacgcagtaatgctgcattgggagctatatttacagatgaaaataagtggaaatctgcgagagaagctgtagaagacagtggtttttgggagctggtagataaagaacgtaacttacatttggaaggaaaatgcgaaacgtgtgtatacaatatgatggggaagcgcgaaaagaaattgggagaatttgggaaagccaagggttcccgagcgatttggtacatgtggctcggtgccagattcctcgaatttgaagcattaggatttttaaatgaggaccattggttcagcagggaaaattcactttccggagtagaaggagaaggtctacataagcttggctatattttgagagatgtaagtaaaaaagagggcggggcgatgtatgcggacgatacggctggatgggacaccagaataactcttgaagatttaaaaaatgaagaaatggtgacaaatcacatggaaggtgaacataaaaaattagctgaagcaatattcaaactgacatatcaaaataaagtagttagagttcaacgaccgactccacgtggaactgtaatggacatcatatctagaagagaccaacggggtagtggacaagtagtaacctatggcttaaacacattcacaaatatggaagcacagttgataagacaaatggaaggcgaaggcgtatttaagagtatacaacaactcacggtaaaggaagagatcgcagtaaaaaactggcttatacgagtcggaagagaaaggctctcaaggatggctatttctggagatgattgtgtcgtaaagccgctagatgataggtttgcctcagcgcttacagcgctaaatgatatggggaaagtccgaaaagacatacaacaatgggaacctagtagggggtggaatgattggactcaagtcccattttgcagtcatcacttccacgagttaataatgaaagacggaagagtattggttgtgccgtgcagaaaccaggatgaactaatagggagagcacggataagtcaaggcgccggttggtctctgagagaaacagcttgtttaggtaaaagctacgctcagatgtggtccttaatgtatttccatcgacgtgatcttagattagcggccaatgctatctgctcagctgttccgtcacactgggtaccaacgagtcgtaccacatggagtatccatgcaacacatgaatggatgaccacagaagatatgctaactgtgtggaacagggtttggatacaggaaaatccgtggatggaagacaagacgccagttgaatcatgggaagaaataccgtacttaggcaagagagaagatcaatggtgtggatcacttatcggattgacctcacgagcgacatgggctaaaaacatacaaacagcaattaatcaagttcggtcattaataggaaatgaagagtatactgattatatgccaagcatgaaacgcttcagaagagaagaagaggaggcaggagtattatggtaa

SEQ ID NO: 22893 - RNA, 9876 nt, synthetic construct
  misc_feature 1..9876: note = derived and/or modified CDS sequence (opt6) from DENV-2__JN851116__SS-prME
  source 1..9876: mol_type = other RNA
actgctgggataattatcatgatgattccgacggtaatggcttttcatttaactacccgtaacggagaaccgcacatgatcgtcagtagacaagaaaaaggaaaaagtttgctatttaaaacggaaaatggagtaaacatgtgcaccctaatggctatggatttgggagaactgtgcgaagatacgataacttataactgtcccttattaagacaaaatgaacccgaagacatagactgctggtgcaatagcacttctacatgggtaacatatggaacatgcacagctaccggggaacatagaagggaaaaacgaagtgtcgcattggtacctcacgtaggaatgggattggaaactagaactgaaacatggatgagctccgaaggtgcatggaaacacgcccaacgtatagaaacatggattttaagacatccaggattcacaataatggcagcaattttggcctatacaataggcacgacctacttccaaagagttctaatttttattcttctcactgcagtaacgccaagtatggcaatgagatgtatcggaatatcgaatagagacttcgtggaaggtgtcagcggtggcagttgggttgacattgtcctggaacatggttcatgtgtaacaacaatggccaaaaataaaccaacgctagatttcgagttaataaaaacggaggcaaaacatccggcaacactccgtaaatattgcgtggaagcaaaactcacgaatacgactacagcctccagatgccctacacaaggagagccttcattgaacgaagaacaagataaaagattcgtttgcaaacactcaatggtagacaggggatggggcaatggctgcggattatttgggaagggcggcattgtaacatgcgcaatgtttacatgcaaaaagaatatggaaggtaaggtagtacaacccgaaaatctagaatatacaattgtcataacaccacatagcggagaagagaacgccgtcggtaatgatacaggaaagcacggcaaagagattaaggtgaccccgcaatcgagcataaccgaagcggaattaacgggctatggaacagtaacgatggaatgcagcccacgtacaggtttagattttaatgaaatggtactattacagatggaaaacaaggcttggctggtgcatcgccagtggttcctagatctcccccttccgtggttacccggagcagatacacaagggagtaattggatacaaaaagaaacattggtaacgttcaaaaacccgcatgcaaagaaacaggacgtggttgtattaggcagccaagaaggtgcgatgcataccgcccttacaggagctactgaaattcagatgagctctggtaatctattgttcacaggacatttaaaatgcagactcagaatggacaaattacagctcaaaggcatgagctactcgatgtgcacaggtaagtttaaagttgtgaaagagattgcagagacacaacacggtacaatagtcattagagttcagtatgagggtgacggttccccatgtaaaataccatttgaaatcatggaccttgaaaaacgtcacgtacttgggcggctaattacagtaaacccgattgtaacggagaaggatagccctgtcaatatagaagccgagccaccctttggcgattcttacattattattggtgtggagcccggacaattaaagctatcttggtttaagaaggggtcatccatcgggcaaatgttcgaaacaacaatgcgtggagccaagagaatggccattctaggtgacacggcgtgggactttggatcgctcggaggggtgtttacatcgataggtaaggctctccaccaagtattcggtgcgatatatggagcagcattttccggtgtatcatggactatgaagattcttataggtgtcgtcataacctggataggcatgaactcacgcagtacgagcttatcggtgagtctggttctagttggcgttgttaccttatacctaggagtaatggtccaagcagattcaggctgtgtagtatcttggaaaaataaagaactgaaatgtggaagcggaatcttcatcacagacaatgtgcatacttggactgagcaatataaattccaacctgaatcgccatcaaaattagcctcagctatccaaaaagctcatgaagaaggtatctgcggtataaggagcgtaacgagactagaaaatttaatgtggaaacaaatcacacccgaactaaatcacattcttacggaaaatgaggtgaaactaacaataatgactggcgatattaagggaataatgcaggcaggaaaaagatcgctacgtccgcaaccgaccgagttaaaatatagctggaaagcatggggtaaagcaaaaatgttgtccacagaattacacaatcacacgtttttaattgacggacccgagacagctgaatgccctaatacgaacagagcctggaactcactagaagtagaagactatggatttggagttttcactacaaacatttggttaaaactaaaggagcgtcaagacgtgttctgtgactcaaaacttatgtctgcagctataaaagataaccgggccgtacatgcagatatgggctattggatagaaagtgccttaaatgatacttggaaaatagaaaaagcatcatttattgaagtaaaatcttgtcattggcctaaatctcatactctatggtcaaacggtgtactcgaaagcgaaatgataatacccaagaacttcgccggaccagtgtcacaacataattacagaccgggatatcatacacaaacagcaggaccttggcatctgggcaggctagaaatggactttgacttttgtgaaggcacgacagttgtagtaactgaagactgtggcaaccgaggcccatcattaaggactactactgcatccggtaagctaataaccgaatggtgctgtcgctcatgtactctaccaccgcttaggtataggggagaagatggatgttggtatggtatggagatacggccactgaaagaaaaagaggaaaacctagtaaatagcttagtgactgccggtcatggtcaaatagacaatttctctttaggggttctagggatggctctatttctggaggagatgctaagaacaagagtgggaactaaacatgctatattactcgttgccgtctcttttgtcactctaataactggaaacatgagtttcagagacttgggcagagttatggtaatggtaggggcaacaatgacagacgacataggtatgggcgtcacctatctggcactattagctgcatttaaagtaaggcctactttcgcagccggtctgttattgcgtaaattaacctccaaagaactaatgatgactacaataggcattgtattattgtcacaatcaacaataccagaatctattttagaattaactgatgcactagccttaggaatgatggttttgaaaattgtacgtaacatggaaaaatatcaattagctgttaccataatggctattctgtgtgtgcctaacgcagtgattctacaaaacgcatggaaagtgagttgtaccatattagcagtggttagtgtttctcctcttctcttgacttcttcacaacaaaaggcagattggattcctttggcccttactatcaaaggattaaacccgactgcgattttcttaacgacgcttagcagaacaagcaagaaaagatcgtggccattgaacgaagcaataatggcggtagggatggtttcgatcttagcctcatcattactcaaaaacgatattccaatgactggaccgttagtagcgggaggtctcctgacagtttgttatgtcctgaccggtagaagtgcagatttagaattagaaagggcagcagacgttcgttgggaagaacaagcggagatatccggatcatctcccattttgagtatcaccatatcagaagacggctcaatgtcaatcaaaaatgaagaggaggaacaaactcttactatactaatacggacaggtttattagtgattagtgggttgtttccggtatctatcccgataacggcagcagcatggtatttatgggaagtcaagaaacaaagggccggcgtactatgggatgtaccttcaccaccgcccgtaggaaaagctgaactcgaggacggcgcatatcgcattaaacaaaaaggaattttaggttattcacagattggtgctggcgtttacaaggagggaacattccacacgatgtggcatgtaacccgtggagccgtgctaatgcacaaaggaaaaaggattgaaccgtcgtgggcagatgtgaagaaggatctaataagctatggcggtggctggaagctcgaaggagaatggaaagaaggtgaagaagttcaagtcttagcattggaaccaggcaaaaacccgcgagcggtacagacaaaacctggcctatttaagaccaatacaggaacaataggagcagtatctttggatttcagtcccgggacttctggtagccccattgtagataaaaagggaaaagtcgtggggttatacggtaatggagtggtgacacggtcaggaacctacgtgtcagcaatcgctcaaacagagaaaagcatagaagataaccccgagattgaagacgacatatttcgtaagaaaagattgaccataatggatttacacccaggagcgggcaaaacgaaacgttatttgccggcaatcgttcgggaagccataaaaagaggactcaggacattgatattagctccaactcgggtagtggctgcagaaatggaagaagccctcaggggattacctataagatatcagacccctgcgattagagctgaacatacaggaagagagatcgttgacttgatgtgtcatgctacttttacaatgcgtttgctatcgcctataagagttcctaattacaatctcattataatggatgaagctcactttacggaccccgcaagtatcgcagctaggggatatatctcaactagagttgaaatgggcgaagcagccggaatctttatgaccgccactccaccaggctcgagggatccttttcctcagagcaatgctccgataatggatgaggaacgcgagattcctgaacgcagttggaactctggccatgagtgggttacggattttaaaggaaaaacagtatggtttgtacctagtattaaagcagggaatgatatcgctgcttgtctaagaaagaatgggaagaaagtcatacaattatcgagaaaaacattcgacagtgagtatataaaaacacgaacaaacgactgggactttgttgtaacaacagacataagtgagatgggagctaattttaaagcagaaagagttattgatccgagacggtgtatgaaaccagtcatattaacagatggagaggaacgggtaatactcgcaggtccaatgcctgtaactcatagcagtgcagcacagagacgaggaagagtcgggaggaaccctaaaaatgagaacgatcaatatatttatatgggtgagcctctggaaaatgatgaggattgcgcacactggaaagaagccaagatgctcttagataacatcaatacaccagagggaattataccgtcaatgtttgaacccgagagggaaaaagtggatgcgattgatggagagtatcggcttcggggtgaggccagaaagacatttgtggatctgatgagaagaggagatcttccagtctggttagcctacagggttgcagctgaaggaataaactatgctgatagaagatggtgctttgatggcgtcaaaaataaccaaattctagaagaaaatgtagaggtagaaatctggaccaaagaaggtgaacgcaagaaattaaaaccacgatggctggatgcgcgaatatactcagatccgttagcactaaaagagtttaaagaatttgcagccggccgcaagtcgctgacattgaatctaataacagaaatgggaaggttacctaccttcatgacacaaaaagcgaaaaacgcactcgataacttggcagtattgcatacagcggaagccgggggcagagcatataaccacgcactttcagaactaccggaaacattagaaacgttactactactaactctcctagcaaccgtaaccggagggatctttctgtttttaatgagtggcaaaggcattggcaaaatgacattaggaatgtgctgcattataactgcctccatccttctatggtacgcacaaattcaacctcattggatagcagccagcataatactagaatttttccttatcgtgttacttattccagaacctgaaaagcagcgcacaccccaagacaatcagttaacatatgtcgtaatagcaatacttacagttgtggccgcaacaatggcgaacgagatggggttcctagagaaaaccaagaaagactttggtttgggatcgataacaacacaacaaccagaatccaatatcttggacatcgacctaagaccagcgtcagcttggactttgtatgcagttgcaacaacatttattactcctatgctcaggcactcaattgaaaactcgagcgttaacgtgtctcttacggcaattgccaaccaagctacagtcttgatgggtctagggaaagggtggcctttatcaaaaatggatataggagtcccattgctagcaataggttgttactcacaagtaaatcctataactttaactgccgcattactcttacttgtagcgcattacgctattataggtccagggttacaagccaaagcaactagagaagcacagaaaagggcagcagccggaataatgaaaaacccgacagtcgatggaatgacggtaatagatcttgaccccataccgtacgatccaaagtttgagaagcagcttgggcaggtaatgctcttagttctctgtgtgacacaagttcttatgatgcgtacgacttgggcactgtgtgaggctttaacattggctaccggtccaatatcgaccttgtgggaaggcaaccctggccgcttttggaacacgaccatagccgtaagtatggctaacatcttcaggggtagctatctcgctggagctggactattattttcaataatgaaaaatactgcaaacactcgaagaggaacaggaaatacgggtgaaacgttgggcgaaaaatggaagaatcgcttaaatgcattgggaaaaagtgagtttcaaatttacaagaaaagcgggatacaagaagtagaccgaactctagcaaaagaaggtattaaaagaggtgagacagatcatcatgcagttagcagaggttccgcaaaattaaggtggtttgtagaaagaaatctggtcacgccggaagggaaagtagtggatttaggctgcggtagaggaggttggagttactattgtggaggcctgaaaaacgttaaggaagtaaagggcttaacaaagggtggacctggccatgaggaaccaattccaatgtctacctatggttggaacttagttcgtctgcagtctggagtggatgtattctttactccaccagaaaaatgcgacacgttactatgcgatattggcgagagctcgccaaaccctacggttgaagcaggaagaacactacgggttttgaatctagttgaaaattggttaaacaataacactcaattttgcataaaagtcttaaatccatatatgcctagcgttatcgagaaaatggaagcactccaacgaaaatacggcggagcattagttagaaatccattatctagaaatagtactcatgagatgtattgggtatcaaatgccagcggaaacatagtaagtagtgtaaatatgatctctcgaatgctaattaataggttcacaatgaggcacaagaaagccacttacgaacccgatgtcgatcttggatctggtaccagaaacatagggatagaatcagaaacaccaaatttagacataattggtaaacgaatcgagaaaatcaaacaagaacatgagactagctggcattacgatcaggaccatccatataaaacatgggcatatcatggatcgtatgagacaaaacaaacaggatccgcaagctcaatggtgaatggcgtcgtgcgcttacttacaaagccctgggacgttataccaatggtgacacaaatggctatgacagatacaacaccatttggtcaacaacgtgtattcaaagaaaaagtcgatactagaactcaagaacctaaagaaggaactaaaaagctaatgaaaataactgcagaatggctttggaaagaactgggaaagaagaaaacacctcggatgtgcacacgggaagaatttacccgcaaagtccgtagtaatgccgccttaggagccatttttacagacgaaaataaatggaaatctgcccgagaagccgtagaagatagcggtttttgggaactggtcgacaaggaaaggaatctgcatctagaggggaagtgtgagacatgtgtctacaatatgatgggaaaaagggagaagaaactaggggaatttggaaaagctaaaggtagccgtgcaatttggtatatgtggttgggtgcaagattcttagagtttgaggctctcggtttcctcaatgaggaccattggttttccagagagaactcactatccggggttgaaggggaaggattacacaaacttggatatatcctccgagatgtatctaagaaagagggaggagcaatgtatgctgatgacactgcaggatgggacacacgtatcacgcttgaagatctgaaaaatgaggaaatggtgaccaaccacatggaaggagagcacaaaaagctagccgaagcaatcttcaaattaacctaccaaaataaggtcgtaagagtacagaggccaacaccccgaggcacagttatggacatcatatcacggcgtgaccaacgcggaagtggacaagtagtcacatatggattgaacacatttacaaatatggaagcgcaactaataagacagatggagggagaaggagttttcaaaagtattcaacaattaacggtgaaagaagaaatcgctgtcaaaaactggctaatcagggtagggcgggagagattaagcaggatggcaatatccggtgacgactgcgtagtcaaaccgttagacgaccgcttcgcttcagcgctaacagcattaaatgatatgggaaaagttcgaaaggatatacaacagtgggaaccctcccgtggttggaacgattggacacaagttcccttttgctctcatcatttccatgaattgattatgaaagatgggagggtattggtagtaccatgcagaaaccaagatgaactgataggcagagcacggatttcacaaggagcaggatggtcccttcgtgaaactgcttgcttaggaaaatcgtatgcccaaatgtggtctctgatgtatttccatcggcgcgatttgagactggcagcaaatgccatttgcagtgctgtaccaagccactgggtacccacatcacgaacaacatggagcattcatgctacacacgaatggatgacaacagaagacatgttaaccgtctggaacagggtatggatacaagaaaatccctggatggaagataagaccccagtagaaagttgggaggaaataccatatctaggaaaaagagaagaccaatggtgcggatctttaattggattaacgtctagagcgacatgggcgaaaaacatacagaccgcaataaatcaagtgagaagtttgattggaaatgaagaatatacagattacatgccaagtatgaaacgtttcaggcgagaagaagaagaagcgggagtattatggtga

SEQ ID NO: 22894 - RNA, 9876 nt, synthetic construct
  misc_feature 1..9876: note = derived and/or modified CDS sequence (opt6) from DENV-2__GU370051__SS-prME
  source 1..9876: mol_type = other RNA
accgcaggtattataataatgatgatacctacggtcatggctttccacctcacgacacgaaacggtgaaccgcacatgattgttagtcgtcaggaaaaaggtaaatccctactattcaaaactgaaaatggtgtaaatatgtgtacactaatggctatggatctaggagaactctgcgaagatacaataacctacaattgtcctttacttcgtcaaaatgaacctgaagacattgattgttggtgcaactccacttcaacctgggttacttacgggacgtgcacagcgaccggggaacatcgtcgggaaaaacgctcagtagcgttagtgcctcatgtaggaatgggattagaaacaagaacggaaacttggatgtcaagcgaaggtgcttggaaacatgcacagagaattgaaacatggattttaagacatcccggatttactataatggcggcaatactcgcgtacacaattggaaccacatacttccaaagggtattaatatttatactattaacggcggtaacaccatcaatggcaatgcgatgcattggtataagcaacagagactttgtcgaaggagtcagcggaggatcatgggtggatatagtattagagcatggttcatgtgtaacaaccatggccaaaaataaaccaactcttgactttgagttaattaaaaccgaggcaaaacaccccgcaacattgagaaaatactgcgtcgaagcaaaattaaccaataccacaacagcaagccgttgccctacgcaaggtgaacccagtttaaacgaagaacaagataaaagatttgtctgcaaacattcaatggtggaccgaggttgggggaatggatgcgggttgttcggaaaaggagggatagtgacctgtgcaatgtttacgtgcaagaaaaacatggaaggtaaagtagtacaacctgagaatttagaatatacaattgtaattacaccccatagcggtgaggagaacgctgtcggcaatgacactgggaaacatggaaaggaaattaaggttacacctcagagttcgataacagaagcagaactcactggatatggaactgttactatggaatgtagcccccgtacaggcctagattttaatgaaatggttttattacaaatggaaaataaggcctggctggtacatagacaatggtttttggatctcccgcttccgtggctacctggagctgatacccaaggaagcaattggattcaaaaagagacactcgttacgtttaaaaatccacacgctaaaaagcaagatgttgtcgtgttaggttcacaagagggcgcaatgcacaccgcgttaactggggcaacggagatacagatgtcaagcggcaacctattattcaccggccatttaaaatgtaggttacgcatggataagctacaactgaaggggatgtcatattcaatgtgcactggcaaatttaaggtagtaaaggaaatagcagaaacacaacacggtacaattgtaataagagttcaatatgagggagatggctctccctgtaaaatccctttcgaaataatggatctcgagaaacgacacgttttaggaaggttaattactgtaaaccccattgttacagaaaaagactcgccagtaaatatagaagccgaaccacctttcggtgactcatatattattattggcgtagagccaggtcaattaaaattatcatggttcaagaaaggaagcagcataggacagatgtttgaaactacaatgcgtggtgcaaagcgaatggccatcctcggagacacagcctgggattttggttctctaggaggagtatttacttctattggaaaagcattacaccaagtattcggtgcaatttatggcgcggccttttccggagtttcatggactatgaaaatactaataggagttgtgatcacatggataggtatgaactccaggtcaacttctttatctgtatcgttagtcttagtaggtgtagttactttataccttggagtgatggtgcaagctgatagcggttgtgtagtaagttggaaaaacaaggaactgaaatgtggctccgggatattcattaccgataacgtgcatacgtggacggaacaatataaatttcagcctgaatctcctagtaaattagccagtgccatccaaaaagcccacgaagaaggcatttgtggaatcaggtctgtaacccgtcttgaaaatctaatgtggaaacaaatcactccagaattaaatcacattttaactgaaaatgaagtaaaacttactattatgacaggcgatataaaagggattatgcaagccggtaagagatctctgcgcccccaaccgacggagttaaaatattcgtggaaggcctgggggaaggccaagatgctaagcacggaactacataaccatacgtttctaatagatggcccagaaaccgccgagtgccccaacacaaatagagcttggaactctctcgaggtagaggattacggttttggcgtcttcacgactaacatatggttaaaattaaaagaaagacaggatgtattttgcgattcaaagctcatgtctgcagcaatcaaggataatcgagcagtgcacgcagacatggggtattggatcgaaagtgcattgaacgatacatggaaaatcgaaaaagcgtcattcatcgaagtaaaatcatgccattggccaaagagtcataccttatggtcgaacggggtactagaatctgagatgataatacctaaaaattttgccgggcctgtttcgcaacataattacagaccaggctatcacacacaaactgcaggtccctggcatttgggtcggctggaaatggactttgacttctgtgaaggcaccactgtcgtagttacagaagactgtggtaatcgtgggcccagccttcgcactactacggcttcgggtaaactaataaccgaatggtgttgtcgcagttgcacattaccacccttaaggtacagaggagaggacgggtgttggtacggtatggaaattagacctttaaaagaaaaagaggaaaatttagtaaacagcttggtaacagctgggcatggccaaatagataattttagtctaggagttttaggcatggctctatttctagaagaaatgttgagaacacgcgtcggcacaaaacacgctatcttacttgtagcggtatcttttgttacgcttatcacaggtaacatgtcatttcgcgacttagggcgtgtaatggtgatggtaggagctaccatgacagatgatattggtatgggtgttacttacttagcattattagccgcatttaaagtcagacctacatttgcagctggactgctattgagaaaactaacaagtaaagaactaatgatgacaacaattggtattgtattactaagtcagtccacaatcccagaaagcatactggaactcacagatgctctcgcgttaggcatgatggtgttgaaaatagtaagaaatatggaaaaatatcaattggcggttacaataatggctatcttatgtgtacctaacgctgtaatcttagaaaatgcgtggaaagtatcttgtaccacacttgctgtagtaagtgtaagtcccttgttattaacaagttcacaacaaaaggcagactggattccattagctctgacaataaaaggtcttaatcctacagcgatattcttaacaaccctaagtcggacatcaaagaaaagaagttggccattgaacgaagcaatcatggcagttggaatggtgagcatactggcaagctctttattgaaaaatgatataccaatgactggaccactggtagctggcggattgctcacagtctgctatgtactgactggtagatccgcagatttggaattggaaagggcggcagatgtacgctgggaagaacaggctgaaataagtgggagtagcccaattctcagtataacaatatcagaagacggttccatgagcatcaaaaatgaagaggaagaacaaactttaacaatcttaataagaactggcttgttagttattagcgggctgtttccggtgagtatacctattacagcagctgcgtggtacctctgggaggtcaagaaacagcgtgccggcgttctatgggatgtgcccagtccgccaccggttggaaaagcagaactagaagatggtgcttacagaataaaacaaaaaggtatccttggatatagtcaaataggagccggagtatataaggaaggaaccttccatacaatgtggcacgttacaagaggcgctgttctaatgcataaaggaaagagaattgagccgtcatgggcggatgtcaagaaagacctcatctcatacggaggaggttggaagttagaaggagaatggaaagaaggggaagaggttcaagtgcttgcattagaacctggcaaaaatccaagagcggttcaaactaaacccggcttgtttaaaacaaatacaggcacaataggagcagtcagtcttgatttttcacccgggacgtctggaagcccaatagttgataagaaaggaaaagtagtaggtctttacggtaacggggttgttaccaggtcagggacgtatgtgtcagcgattgctcaaactgaaaaatctattgaggacaatccggatatagaagatgacattttcagaaagaaaagattgacaattatggatctacatccgggcgctggcaaaacgaagagatacctccctgcaatcgtacgagaggcaattaaaagagggctacggacactaatactagccccgaccagagtcgtagcagcggaaatggaagaagccttacgaggactgcctattcgatatcagacaccagcgataagagctgaacacacaggaagggaaattgtcgaccttatgtgtcacgcaacattcacaatgagactattaagcccaatcagggtccctaactacaatctaataatcatggacgaagcccattttacagatccggcatccatcgccgccagaggatacatatctacaagagtggaaatgggggaagctgctgggatattcatgacagctacaccacccggaagtcgtgacccatttcctcagagcaatgcgccaattatggatgaagaacgagaaatacctgagagatcatggaacagtggacatgaatgggtaactgattttaaagggaaaactgtatggttcgtaccctcaattaaagcagggaacgatatagcggcatgcttgcgtaaaaatggaaagaaagtaatacaactatcacgtaagaccttcgattccgagtatattaaaactcgtactaacgattgggattttgtagtaactactgacatttcagaaatgggtgccaacttcaaagcagaaagagtgatagacccacgaagatgtatgaaaccggtgattttaacggacggtgaagagagagttattttagcaggccctatgccggttacacactcatccgcggctcagcgcaggggcagagttggcagaaatcctaaaaacgacaatgatcagtatatctatatgggcgaaccattggagaatgatgaggactgcgcgcactggaaagaagcaaaaatgttacttgacaatattaacacaccagaaggcatcattcccagtatgtttgagcccgaacgagaaaaagtagatgcgatagatggcgaatatagactaaggggtgaagcgcgtaaaacattcgtcgacttaatgaggcgcggagacctcccggtatggctggcctatagagtggccgccgagggtataaattatgcggatcggcggtggtgtttcgatggggtcaaaaataatcaaattttggaagaaaatgtagaagtcgaaatatggactaaagaaggagagaggaagaaactcaaaccgcgctggttagacgcaaggatatattctgatccacttgcactgaaggagttcaaagaatttgctgcagggcgaaaatcattgaccttaaatcttattactgaaatgggaagactccctacatttatgacccaaaaagcaaagaatgcattagacaacttagctgttttgcatacagcagaagcagggggtagagcttataaccatgctctatctgaattacccgaaacattagaaacattacttcttctgacgcttcttgctacagtaaccggtggcatatttttgtttctaatgagtggtaaaggaatcggcaaaatgacgttaggaatgtgctgcatcataactgctagtattctcctatggtacgcacagatacaaccacactggatcgcagcatcgatcatcttagaatttttcttgattgttctactaatcccagaaccagaaaaacaacgaactccgcaagacaatcagttaacatacgttgtgatagcaattttgacagttgtagcagcaacaatggcgaatgaaatgggcttcctcgagaaaactaagaaagatttcggtttagggagtataacaacgcaacaaccagaatcgaatattttagacatagacctaagacccgcttctgcttggacattatacgcggttgccactacatttataacgccgatgctacgccacagtatagagaatagctcagtgaatgtcagtttaacagcaattgcgaaccaagccacagttctcatgggactagggaaagggtggcctctcagtaaaatggacataggtgtgcctctactggctataggttgttactcacaggttaatcccattacactaacagccgcacttctattgctagtcgcgcactatgcgattatcggtccaggcctacaagccaaggccacacgtgaagcacaaaagagggccgctgcaggcatcatgaagaatccgactgtagatggtatcaccgtaattgatctagatccgattccatatgatccaaaatttgaaaaacaactaggccaagtaatgctacttgtactctgtgtaacgcaagtattaatgatgaggacaacctgggctctatgtgaggcactaacactagcaactggtccaatatctacactatgggaagggaatcctggaaggttttggaacacaacaatcgcggtgagcatggctaatatttttagaggttcttacttggcaggagcaggtttactgtttagcataatgaaaaataccgcaaacaccaggcgtggtacgggaaacaccggagaaaccttgggtgaaaaatggaaaaatagactcaacgctttaggaaaaagtgagttccaaatctacaagaaaagcggtattcaagaggtggataggacactagccaaagagggaattaaacgaggtgaaacagaccatcatgcagtttcaagagggtcagcgaaacttcgttggtttgtcgaaagaaatttggtcactcccgagggaaaggttgtagatttaggctgcggtaggggaggctggtcatactattgcggaggattaaagaatgtaaaagaagttaaaggactaacaaaaggagggcccggacacgaagaacccattccaatgtctacatacggatggaatttggtaagactacaaagtggtgtggacgtattctttactcctccagaaaagtgtgatacacttctctgcgacattggagagagcagccctaaccccacggtagaagcaggaagaactctcagggtattaaatcttgtcgaaaattggcttaacaataatacacaattctgcattaaagtactcacaccgtatatgccatcagtgatagaaaagatggaagcgttacaaagaaagtatggaggagcacttgtacgaaatcccctaagtaggaacagtacgcatgaaatgtattgggtctcgaacgcatcaggaaatatcgtctcatctgtaaatatgatcagtagaatgttaataaaccgttttacgatgaggcacaaaaaggcgacttatgaaccagatgtagacctagggagtggaacgcggaatataggtatagaatcagagacaccaaatttagacattataggtaaaaggataggtaaaataaaacaagagcatgagacaagttggcattatgaccaagatcatccttacaaaacttgggcgtatcatggctcatatgaaactaaacaaactggatcagcctcatctatggttaatggagtcgtaagattactgacgaagccatgggatgtcatccctatggttacacaaatggcaatgactgataccactcccttcggacaacagcgcgtgtttaaagaaaaggttgatactcgaacgcaagagccaaaagaaggtactaagaaattaatgaaaatcacggccgaatggctatggaaagaattaggcaagaagaaaaccccacgtatgtgcacgagggaggagttcacacgaaaagtacgatctaatgctgcgctcggagctatctttacggatgaaaacaaatggaaatcagctagagaagccgtagaagatagtggattttgggaattggtagataaagaacgaaatctgcatctggaaggtaagtgtgagacatgtgtatacaatatgatgggaaaacgagagaagaaattgggtgagttcggaaaagctaaaggaagcagggcgatatggtacatgtggttgggagcaagatttttagagttcgaagctcttggattcttaaacgaagatcactggtttagcagggaaaattctttaagtggcgttgaaggggaaggattacataagttagggtatatactacgagatgtttcaaagaaggaaggaggggcaatgtatgccgatgacacggcagggtgggacacgcgcatcacactggaagatctaaagaatgaagaaatggtaacgaaccatatggaaggagagcataagaaactagcagaagcgatattcaaactcacataccagaacaaagtggtgcgagttcaaaggccaacgccaagaggaacagttatggatataatatctaggagggatcaacgcggtagcggtcaagtcgtaacatacggcttaaatacctttactaacatggaagcccaattaatacgacagatggaaggggaaggagtatttaaatcgattcagcagttaactgtaaaggaagaaatagccgttgaaaactggttgatgcgcgttggaagggaacgtttaagtaggatggctatatcaggagatgactgcgttgtaaaacctctagatgacaggttcgcttctgcacttacagcccttaatgacatgggtaaagttaggaaagatattcagcagtgggaacctagtaggggatggaatgattggacgcaggttccattttgctcccaccatttccatgaactaataatgaaggatggtcgagtcctggttgtaccctgtcgtaatcaggacgagctaataggacgagcacgcatctcccaaggagcaggttggtccttgagagaaacagcatgcctcgggaagtcttatgcacagatgtggagcctaatgtattttcataggagagacctacgtctagcggccaacgcaatttgctctgcagtgcccagccattgggtcccaacttctagaactacctggtcaatacacgctacacacgaatggatgacgactgaggatatgttaaccgtgtggaatagagtatggattcaagaaaacccatggatggaagataaaacccctgtagagagttgggaagaaattccatatttaggaaaaagggaagatcaatggtgcggatcactaatcggattgacaagccgagcgacatgggccaaaaatattcaaactgcaataaatcaagtcagatctcttatcggaaatgaagagtacactgattatatgccatcaatgaaaaggtttagaagagaggaagaggaagccggtgtattatggtag

SEQ ID NO: 22895 - RNA, 9876 nt, synthetic construct
  misc_feature 1..9876: note = derived and/or modified CDS sequence (opt6) from DENV-2__EU359009__SS-prME
  source 1..9876: mol_type = other RNA
acagctggtattataataatgatgatacctactgtaatggcgtttcacctaacaactagaaatggagaaccgcacatgattgtatctagacaggaaaaaggtaaatcacttttgttcaaaaccgaaaatggagtaaatatgtgtacgctaatggcgatggatttaggagaattgtgcgaagatactatcacatacaactgccctttattacgacaaaacgaaccagaagacatagactgttggtgcaattcaacgagtacatgggtcacttacggtacctgtacagcaacgggggaacatcgaagagagaaaagaagtgtggcattagtacctcatgtaggtatgggattagaaacaagaacagaaacttggatgtcgagtgaaggagcatggaaacatgctcaaaggatagaaacttgggtgttgcggcatccgggatttaccataatggcagcaattttagcatatactatcggtactacttactttcaacgcgttctaatatttatcctattaactgctatagccccatcgatgactatgagatgtataggtatatcaaacagagacttcgttgaaggggtctcgggaggatcatgggtggacattgtccttgaacatgggtcctgtgtgacgacgatggcgaaaaacaaaccaacgctcgattttgaacttattaaaacagaagcaaaacaccctgcaacgctgaggaaatactgtatagaagcaaaattaacgaatactacaacagcatcacgttgtccaactcaaggagaaccatcattaaatgaagaacaagataaacgatttgtatgtaaacacagtatggtcgacagaggatggggaaatggttgcggtctattcggcaaaggaggaatcgtaacatgcgctatgtttacatgtaagaaaaatatggaagggaaaatagtacaaccggaaaatttagaatacaccatagttattacgcctcattcaggggaagaaaatgccgtagggaatgacacaggtaaacatggtaaagaaataaaagtaactccacaatcctccataactgaagcggaactcacgggatatggcacagtaacaatggaatgttcaccacgaacagggttagatttcaacgaaatggtacttttacaaatggaaaataaggcttggttagttcatcgacagtggttcttagatttaccatttccatggctaccaggagcagacacacaaggaagcaattggatacagaaggaaaccctcgtgacatttaaaaatccacatgccaagaaacaggatgtcgtcgtcttggggagtcaagaaggcgcaatgcatacagcactaaccggcgctacagaaatccaaatgagttcaggaaatcttttatttacaggtcatctgaaatgccgtttaagaatggataaattgcagttaaaaggaatgtcttatagtatgtgcacgggaaagtttaaagtggtcaaggaaatagcagagacccaacatggcactatagtaattcgtgtacaatatgagggtgatgggtccccctgcaagatcccatttgaaataatggatttagagaaaagacatgttctgggtagacttataaccgtaaatcccatcgtgacagagaaggatagtcctgtgaatatagaagcagaaccacccttcggtgattcttacattataatcggggtagagccaggacaattaaaattgtcatggtttaagaagggttcatctattgggcagatgtttgaaaccacaatgcgtggagctaaaagaatggcaatactcggagacacagcttgggattttggatcattaggtggagtcttcacgtcaatcggaaaggctctacatcaagtctttggagcaatatacggggcagccttcagtggcgtgtcttggacaatgaaaatactgatcggagtagttataacgtggattggtatgaactcaagaagcacatctttaagcgtctccctcgtgctagtaggtgtagtaaccctttacctgggtgtaatggtacaggctgattcaggttgtgtagtaagttggaaaaacaaagaactgaaatgcggaagcgggatatttataacagataatgtccacacatggaccgaacaatataaattccagccagaatccccctccaaacttgcatcagcgatacaaaaggctcacgaggaaggaatctgtgggatccgatcagtaaccagactggaaaatctgatgtggaaacaaataacaccggaattaaatcacatactaagcgagaatgaagttaaactcactataatgacaggagatattaaaggcataatgcaagctggaaaacgttcgctcaggccacagcctacagagttaaaatacagttggaaagcgtgggggaaggcgaagatgctatcaacagagctacataatcatacatttctaatagacgggcctgaaacagcagagtgcccaaatactaaccgagcatggaactctttagaggtggaagactacggctttggagtattcactacgaatatttggttgaaacttaaagagaggcaagatgtattctgtgactccaaacttatgtcagctgcaataaaagacaatagagcagtacatgctgacatgggttattggatagaaagcgctttgaacgatacttggaaaatcgaaaaagcatctttcattgaagttaaatcctgccactggccaaagtctcatacactatggtcaaatggggtattggaaagtgagatgatcattcccaaaaattttgcaggaccagtatcgcaacacaattatcgtcctggataccatactcagacagctgggccgtggcatttgggacgccttgagatggacttcgatttctgcgaggggacaacggtcgtagtaactgaagactgtggtaacagaggacctagcctaagaacaacgaccgctagtggaaaacttataacagaatggtgttgtaggagctgtacattacccccgctgcgatatcgcggagaggacggatgttggtacggcatggaaattaggccgctaaaagaaaaggaagaaaatttagtcaattcattagtaactgctggccatggtcaaatcgacaatttttctctgggcgttttaggaatggctttatttttagaagagatgcttaggacacgagttgggactaaacatgcaattttacttgtcgcggtcagcttcgtcacattaatcacagggaatatgagctttagggaccttggaagagttatggtaatggttggtgctacaatgactgatgatatcggtatgggcgttacttatcttgcgttattggccgcatttaaagtacgcccaacatttgcggccggactcctattaagaaaactaacatcaaaggaactcatgatgaccactattggaatagttctcttaagtcaaagtactataccagaaaccatactggagttaacggatgcattagccttagggatgatggtgctaaaaattgttagaaatatggaaaaataccaattagcagtaacaataatggctattctatgcgtaccaaacgccgtcatattacaaaacgcttggaaagttagttgcaccacattagctgttgtatcagtatcgccattactattaacaagctcacaacaaaaagcggattggatacccttagctcttactattaaaggactcaatccaacagctatatttttgacaacactttcacgaacaagcaagaaacgatcatggcccctgaacgaagccatcatggctgtaggaatggtttcgatactagccagttctttacttaaaaacgacatccccatgactgggcctctagtagcaggaggactactgacggtctgttacgtattaaccggaaggagcgcagatttggagttagagagagccgcagacgttcgatgggaggaacaagcggaaatcagtggtagcagcccaatcttgtcaattacgatctccgaagatggatcaatgagtattaaaaacgaagaggaagaacaaacattaactatcttgatcagaacagggctattagtaatatcaggactcttcccagtatcaataccaataaccgcggctgcatggtatctatgggaggttaagaaacaacgtgcaggcgtcctttgggatgtgccgagtcccccacccgtaggtaaagcagaattagaggatggagcctaccggataaaacaaaagggtatacttggatactctcaaataggagccggagtttataaagaaggcaccttccatacaatgtggcatgttacaaggggcgcagttttgatgcataagggcaaaagaatagaaccatcatgggccgatgtcaagaaagatcttatttcatatggtgggggctggaagctggaaggggagtggaaagagggggaagaagtacaagtcttagcattagagccaggaaagaatccgcgagcagtacagacaaaaccggggctattcaaaacaaatacaggaacaatcggcgcagttagtttagacttttctcctggaacaagcggatcacccatagttgataagaaaggaaaagttgttggcttatatggcaatggggttgttaccaggtcaggtacttacgtatcggccatagctcaaactgaaaaatcaatcgaggataatccggagattgaagatgatatcttccgtaagaaaagactaactataatggatcttcaccctggagcaggaaaaacaaaaagatatctaccagcaatagtacgagaggcaattaaacgcgggttacgtaccctcatacttgctcctacccgagtagtagctgcagaaatggaagaagctctaaggggacttcctattagatatcagactcccgccattagagcagaacatacggggagagaaattgttgacctcatgtgtcacgcaacatttaccatgagactcttatctccaatacgagtaccaaattataacttaataattatggatgaagcacactttacagaccctgcttcaattgccgccaggggatatatatcaacccgggtcgaaatgggtgaagccgccggcatatttatgactgcaacgcccccgggatcaagagatcctttcccacaatctaatgcacccatcatggatgaggagcgagagattccagaaagaagttggaactcaggacatgagtgggtaacagattttaaagggaaaacagtgtggtttgtgccttcgattaaggccggaaatgacatagcagcatgccttaggaaaaatggtaagaaagtgatacaactatccaggaaaacattcgacaccgagtatatcaaaacgagaacaaacgactgggatttcgtagttacaacggatatctccgaaatgggagccaattttaaagcagaacgggttatagacccacgtaggtgtatgaaaccagttatattaacagacggagaagaacgagtgatcctagcaggaccaatgccagttacacattcatcagctgcgcagcgaagggggcgagtaggaagaaatccgaagaacgaaaatgaccaatatatctatatgggagaaccattagaaaacgatgaggactgcgcacattggaaggaggcaaagatgttgctagataatataaacaccccagaaggcataattccttccatgtttgaacctgagagggaaaaagtagacgctatagatggggaatatcgattacgaggtgaagcacgaaagacgttcgttgacttgatgagacgcggagatttaccggtctggctcgcatatagagttgcggcagaagggatcaattacgccgatcgaagatggtgctttgacggagtcaaaaataaccaaatattagaagaaaacgtggaggtcgaaatctggaccaaagaaggagaacgaaagaaacttaaacccagatggcttgatgcgaggatttacagtgacccgttagcactaaaagagttcaaagagttcgcggcaggccgtaaaagtttgaccctgaacttaattaccgaaatgggccggttacccacattcatgacgcaaaaagcccgaaatgcattagacaacctcgccgttttacatactgcagaagccggtggcagagcatataatcatgctctcagcgaattacccgagactctagaaaccctcttattattaactctattagctacagtaactggaggaatttttctatttctgatgagcggaaagggaatagggaaaatgacgctgggtatgtgctgtataattactgcgtcaatactattatggtatgcacagatacagccacactggatagccgcgagtataatactagagttctttctgatcgtattactcatcccagaaccagaaaaacaaagaacccctcaagataatcaacttacatacgtcgtaattgcgatacttacggtcgtagctgcaactatggcaaatgaaatgggtttcttagaaaagacaaagaaggatttcggcctcggatccataacgacccaacaaccagagagtaacatattagatatagacttacggccggcttctgcatggactctatatgcggtggcaacgacgtttataaccccaatgctaagacatagtattgaaaacagtagcgttaatgtatctcttaccgccatcgccaatcaagctacagtgcttatgggcttaggaaagggatggcccctaagcaaaatggacataggagtaccattacttgctataggttgctattcacaagtaaaccccataaccttaacagctgcgttgttactattagtagcacattacgcaatcatcggtcctggattgcaagcaaaagcaaccagagaagcccaaaaacgtgctgccgcgggcataatgaaaaatccaacggtcgacgggataactgtaatagacctagatcccataccttacgacccaaaattcgaaaaacagcttgggcaagtaatgctccttgtattatgtgttactcaagtgctgatgatgcgcactacatgggcgttatgtgaagctctaacactagcaacaggtccgatatcaacactatgggaaggaaatcctgggcgtttttggaacacaaccatagcggtctcaatggcaaacatcttcaggggaagctacctcgcgggagccggtttactattttcaatcatgaaaaacactgctaataccagaagaggaactggtaatactggcgaaactctaggtgaaaaatggaaaaacaggctaaatgctttgggaaaaagcgagtttcagatttacaagaaaagtggaatacaagaagtagatagaacgttagcaaaagaaggcataaagagaggggaaacagaccaccatgcggttagcagaggttccgctaaactgcgctggttcgtggaacgcaacttggtaacaccagaaggcaaagttgtcgacctcggatgcggcaggggtggatggtcatactactgtggaggattaaagaacgttaaggaagttaaaggactaacaaaaggaggtccaggacatgaggaacctatacccatgtccacgtatggatggaacttagtgagactgcaatcaggtgttgatgtatttttcacacctcccgagaaatgtgacacgttgctctgtgacataggcgagagttcgccaaatcccactgtagaagcagggagaacacttagagtcttgaatctagttgaaaactggctaaacaacaatactcaattttgcataaaagttctcaatccctacatgccatcggttatcgagaaaatggaggccctacaaagaaaatacggaggagcacttgttagaaatcctttaagtaggaactcaacacacgagatgtactgggtaagcaacgcttccgggaacatcgtcagttcagtcaacatgatatcacgaatgctcataaatagatttactatgagacataagaaggctacatacgaacctgatgtcgatttaggatctggcactagaaatataggtattgagagtgaaacaccaaacttagacataattggaaaacgaatcgagaaaattaaacaagaacacgaaacgagttggcattacgaccaagaccacccatacaagacttgggcatatcacggttcttacgaaacaaagcaaacaggaagtgcaagttccatggtaaacggagtggtgcgattgttaacaaagccatgggatgtaatacccatggttacgcaaatggctatgaccgacacaacaccatttgggcaacaacgtgtcttcaaagaaaaagttgacactagaacccaagaacccaaagaagggaccaaaaagctaatgaagataacagctgaatggttatggaaagagttgggtaagaagaaaacgccaagaatgtgtaccagagaagagttcacaagaaaagttcgatctaacgcggctctcggagcaatctttacagatgaaaacaaatggaaatctgcgcgcgaagctgtggaggactcgggtttttgggaattagtagataaagagaggaatttgcacctggagggaaaatgtgaaacctgtgtttacaatatgatgggaaagagggagaagaaactcggggaatttggtaaagcgaaagggagtagggccatatggtatatgtggttaggagcaagattccttgagtttgaggctcttgggttcttgaatgaggaccattggtttagcagggaaaatagcctctcaggtgtcgagggggagggtctacacaaactcggatatatactacgtgacgtaagcaagaaagaaggaggggcaatgtacgcagatgataccgcaggatgggacacccgtattacattagaagatcttaaaaacgaagaaatggtcaccaatcatatggagggagaacacaagaaattagcagaagctattttcagattgacatatcagaataaagtggtacgtgttcaaagacctacgccaagaggcactgttatggatatcatcagcagaagggaccagcgaggaagcggacaagtggttacatacggcctaaacacatttacaaatatggaagcacaattaataagacaaatggaaggcgaaggagtcttcaaatccattcaacatctaaccgttacagaagaaatagccgtcaaaaattggttagtaagggtgggaagagaacgattaagtagaatggcgatttcaggagatgattgtgtagttaaaccgctggatgatcggttcgcaagtgcgctaactgcacttaatgacatgggaaaagtccggaaagacattcaacaatgggagccatccaggggatggaacgactggacacaggtacctttctgttctcaccacttccatgagctaataatgaaagatggacgtgttctggtcgtgccgtgtaggaaccaagatgagttaattggacgagcccgcataagtcaaggagctggttggagcctccgtgaaacagcctgtctggggaaatcatatgctcagatgtggtcattaatgtactttcatcgacgagacctgcgattagcagcaaacgctatctgctctgcagtgccgagccactgggtgcctacttcacgaaccacttggagtatacatgctacacatgaatggatgacaacagaagacatgctcactgtatggaacagggtatggatacaagaaaacccttggatggaagataaaacaccggtcgaatcatgggaagagattccctatttaggaaaacgtgaagatcaatggtgcggcagtcttattgggttaaccagccgagctacgtgggccaaaaatattcaaacagcaattaaccaagttcgaagtttaatcggaaatgaagaatatacggattacatgccaagtatgaagagatttcgcagagaagaagaagaagccggtgtattatggtag

SEQ ID NO: 22896 - RNA, 9876 nt, synthetic construct
  misc_feature 1..9876: note = derived and/or modified CDS sequence (opt6) from DENV-2__KC131142__SS-prME
  source 1..9876: mol_type = other RNA
actgcagggataattatcatggtaattccgacagtaatggcatttcacttaacaacgcgaaatggagaacctcatatgattgtatcacgccaggaaaaaggaaaaagtttattgtttaaaacagaaaatggactaaacatgtgtactctaatggctatggaccttggagaattatgcgaagacacaatcacttataactgtccattactaagacaaaatgaaccagaagatatagattgttggtgcaattccacaagtacttgggttacctacggaacttgcacagcgactggcgaacacagaagagagaaaagatctgttgcattagtacctcatgttggaatgggattagaaacccgtacagaaacctggatgtcatctgaaggtgcttggaaacatgcacaacgaattgaaacatgggttcttagacaccctggcttcaccataatggcagcgatacttgcgtacacaatcggaacaacatactttcagagggtgcttatattcatcttgttaactgcaatagcacctagcatgaccatgcgatgcataggaatttctaatcgagactttgttgaaggcgttagtggaggaagttgggtagatattgtgttagaacatggctcgtgtgtaacaacgatggcgaaaaacaaaccaaccttagattttgaactcattaaaacagaagcaaaacatccagcgacgttgcgaaaatattgtatagaagcaaaattaacaaatacgactacggcgtcccgttgcccaactcaaggagaacctagtcttaatgaagaacaagataaaaggtttgtatgtaaacactcaatggtggatagaggttggggcaatggatgcggactattcggaaaagggggaatcgtaacctgtgcgatgtttacatgcaagaaaaatatggagggtaaaatagttcaaccagagaacttagaatacacaatagtaatcactccacacagcggcgaagagaatgctgtagggaacgacacgggaaaacacggaaaggagataaaagtcactccacagagttcaataactgaggcagaacttactggttacggtactgtcactatggaatgctctcctagaaccggattagattttaacgaaatggttttattacagatggaaaataaggcttggctagttcataggcaatggttcttagacttaccattgccctggcttcctggagccgatacacaaggatccaactggattcaaaaggaaacactggttacatttaaaaatccccatgccaagaaacaagatgtcgtagtactgggatcccaagagggcgcgatgcatactgcattaacaggcgcaaccgaaattcaaatgtccagcggtaatttactttttacaggtcaccttaagtgtagattgcgaatggacaaacttcagctaaagggaatgtcatatagcatgtgcacaggaaaattcaaggtagtaaaagaaatagccgagactcaacatggtacaatcgtgataagagtacaatacgagggagacggcagcccatgtaagattccctttgaaataatggatttggagaaaagacacgttcttgggagactaataacagttaacccaattgtcaccgaaaaggattccccagtgaatattgaagcagaacctccgttcggtgatagttacatcataataggagttgaacctggtcaattaaaactaagttggttcaagaaaggctcatcaatagggcagatgtttgaaacaacaatgagaggtgcgaaacgaatggcgattctaggagatactgcttgggattttgggagcctgggaggagtgttcacaagtatagggaaagccctacatcaagtgttcggagcaatttacggcgcggccttctcaggggtcagctggacaatgaagattttaataggagtggtaatcacatggatagggatgaactcgagatctacaagcctctcagtaagtctcgtattagtcggagttgttacactttatctaggagttatggtgcaggccgattctggctgtgtagtatcatggaaaaataaagaactaaaatgtggttcaggaatttttatcacggataacgtccatacctggactgaacagtacaaatttcagccggagtcacccagtaaacttgcaagtgctatacaaaaggcgcatgaagaaggaatctgtggaattaggagtgtaactcggctagaaaatttaatgtggaagcaaatcaccccagagctcaaccatatactctcggaaaacgaagttaaactaactattatgacgggcgatatcaaggggataatgcaagcaggtaaacgctcactaagaccccaaccaacagagttaaaatacagttggaaggcttggggcaaggcaaaaatgttaagcacagaacttcataatcacacattcctcatagacggaccggaaactgcagaatgtcccaacacaaatcgtgcatggaactcactggaggtagaagattacggtttcggcgtatttaccactaacatatggcttaagttgaaagaaagacaagatgtattttgtgatagcaaactaatgtcagccgccataaaagacaatagagccgttcatgcagacatgggttactggattgaatcagccttgaatgatacctggaaaatagaaaaagcgagcttcatcgaggtcaaatcgtgtcactggccaaaatctcacacactttggagtaacggtgtactggaatcggagatgataatacccaaaaattttgcaggacctgtatcacaacataattacagaccggggtaccatactcaaaccgccgggccttggcatttaggtcgtttagagatggactttgatttctgcgaagggactactgtagtagtgacggaagattgcgggaaccggggaccttcactcagaacaacaacggcttcaggaaagttaataacggaatggtgctgtagatcatgtacactacccccactgcgttatagaggggaagatggctgttggtacgggatggaaattagaccactaaaagagaaagaagaaaacctggttaacagtttagtcactgccggacatggccaaatagacaattttagtctaggggtgctaggaatggcattgtttctggaggaaatgttaagaacgcgagtaggaacgaagcatgcgattttattggtagcagtaagtttcgtaactctaattacgggaaacatgagcttccgtgacctaggtagagtaatggttatggtcggtgcaactatgaccgatgatataggtatgggcgtaacctacctagccttactagctgcatttaaggtccgccctacctttgccgctggtttgctattgagaaaattaacttccaaggaactgatgatgacaacgataggtattgtattattaagtcagtcaacaattccagaaacaatcttagaactaacggacgctcttgccttgggaatgatggtattaaaaatagtcaggaacatggagaaatatcaactcgcggtaacgataatggccatattatgcgtgccgaatgcggtcattctacaaaatgcgtggaaagttagttgtaccacgctcgccgtggtatcagtgagccccttattattgacatcgtcgcagcaaaaagccgattggatacctctagcacttactataaaaggtctaaatccaaccgctatattcctaacgacattaagtcgcacgagcaaaaagcgaagttggccattaaatgaagccatcatggcagtaggaatggtaagcatattagcatctagcttactaaagaatgatatcccaatgacaggtcccttggtggcgggcggcctcctaacagtatgctacgtactaaccggaagatcggcagacctagagttagaaagagcagcagatgttagatgggaagaacaggcagagatttcaggatcaagcccaatactgagtataacaatcagcgaagatggaagtatgagtattaagaacgaagaggaagaacagaccttgactatacttataagaacaggcctattagtgattagtggcttatttccggtatctataccaataaccgcggccgcctggtacttatgggaagtcaagaaacaaagggccggggttttatgggatgttccttcaccccctcctgtcggaaaagctgaattggaggatggtgcatatcgaattaaacaaaaaggaatactaggatattcacaaataggtgcaggagtgtacaaggaaggaacctttcacacaatgtggcacgtaactagaggggcagttctcatgcacaagggcaaacgtatagaaccatcttgggcagatgtgaagaaagatctcatatcctacggaggaggttggaaattagaaggtgaatggaaggaaggagaagaagtacaagtactagcgcttgagccgggaaagaacccaagagcagttcaaaccaagccaggactatttaaaaccaatacaggcacaataggtgcagtgtcgttagattttagtccaggcacatccggaagtcctatcgttgataaaaagggtaaagttgtaggattgtatgggaacggtgttgtcacgaggagtggaacatacgttagtgcgatagcccaaactgaaaaatcaatcgaagacaacctagaaatagaagacgacatatttaggaagaaacgtctcactgtaatggacctacacccaggtgcaggtaaaacaaaacgttacttacccgcaatagtgagagaggctataaaacggggactgagaacactaattttggcaccgactcgagtggttgctgctgaaatggaggaagctcttaggggtttgcccataaggtaccaaacgccggcaatccgagcagagcatacgggcagagagatagttgacctaatgtgccatgcaacttttacaatgaggcttttatcccccattagagtacctaattataatctgattataatggacgaagctcacttcactgatccagccagtatagcagctagaggatacatatctacaagggtagaaatgggggaggcagccggcatcttcatgacggcaacgccacctggatcacgagacccttttccacaatctaatgctcccatcatggatgaagaaagagagatccccgaacgaagttggaactcaggtcacgaatgggtgacagattttaaaggcaagaccgtctggttcgtgcctagtataaaagctggaaacgacatagcagcatgcttacgcaaaaatggcaagaaagtgatacagttatcgcgcaaaacttttgatacagagtacattaaaacccgaacgaatgattgggattttgtggtaaccaccgatatatcagaaatgggcgcgaatttcaaggcagaaagagtaattgatccaagacgatgtatgaaacctgttatattgacagacggtgaggaaagagtaatattagcaggaccgatgcctgttacccacagctctgcagctcagaggaggggacgagttgggagaaatcccaaaaatgaaaatgaccagtatatatatatgggtgaacctcttgaaaacgacgaagattgcgctcactggaaggaagccaaaatgttgttagacaatatcaacacgccagaaggcatcatccccagcatgtttgagcccgaacgagaaaaagtagacgccatagacggagaataccggctacggggagaagctagaaaaacatttgtggatcttatgcgcagaggagacttacctgtatggttggcataccgagtagctgcggaagggattaattatgcagaccggcgttggtgctttgacggggtgaaaaataaccaaatactagaggaaaatgttgaagttgagatttggactaaagaaggagaacgaaagaaactcaaaccccggtggttagacgcgcgcatctatagcgacccattagctttaaaagagttcaaagagttcgcagccgggagaaagagcttaaccttgaatctgataaccgaaatgggacgactacccacgtttatgacacaaaaagcacgaaatgctttagacaacttagctgttttacatacggcagaagctggaggacgtgcttataatcatgcattatctgagcttcccgaaacgctcgagacactcctcctcttgaccctactagcgacagtaacaggaggaatctttttgttcttgatgagcggtaaagggattggaaaaatgacgctaggaatgtgctgcataataacagcttcaatactcttatggtacgcacagatacaacctcactggatcgctgcatcaatcatattggaatttttcttaattgttttgttaatcccagagccggaaaaacagaggactccgcaagataatcaattaacctatgtcgtcatagccatactaacggtcgtcgcggcaacaatggccaatgaaatgggattcctagagaaaactaagaaagattttggattaggaagtatcaccacccaacagcctgaaagcaatattttagacatcgacttaaggccagcatccgcctggacactgtatgcagtagccaccacttttatcacgccgatgctgagacattctattgaaaattcgagtgtaaatgtcagtttaacagcaattgccaatcaagcaactgttctgatgggattaggaaaagggtggccactttccaaaatggatattggagtaccgctgctagccataggttgttactcacaagtcaacccaattaccttaacagcagcactcttattattagtagctcattatgccataataggaccaggcttgcaagcaaaagcgactagagaagcacagaaacgagctgcagcaggtataatgaaaaaccctacggtcgacggtattaccgtcatagatctagatccaatcccatatgatcctaaatttgaaaagcaattagggcaggtaatgttattagtgctttgcgtaactcaagtactaatgatgagaactacatgggcactgtgcgaagcattaacactggctacaggtcctatcagtactctatgggagggcaatccaggaagattttggaatacaaccatagccgtttcaatggctaacatattcaggggttcatatctagctggagctggtcttctattcagcattatgaaaaacacagcaaataccagaagaggtactggtaacacgggagagacacttggggaaaaatggaagaaccgcttgaatgcactcggcaagagcgaatttcagatttacaagaaatcgggcattcaagaagtagacagaactctagctaaggaagggattaaaagaggggagacagatcatcacgccgtgagtagagggtcggcaaaattacgatggttcgttgaaagaaatcttgttacaccagaaggcaaagtagtggacctaggttgcgggcgaggcggatggagctactattgtggaggactcaaaaacgtcaaagaagtaaaaggcttaactaaaggaggcccaggtcatgaggaaccaataccaatgtctacgtatggatggaatcttgtaagattacaaagtggagtagacgtattcttcacaccgcctgaaaagtgcgatactcttctatgcgacataggtgaatcatcacccaatcctacagtcgaagcaggacgaaccttaagagtattaaacttagtcgaaaattggctcaacaacaacacacaattttgcataaaagtcctaaatccttatatgccatcagtgatagagaaaatggaagccttacaaagaaaatacggaggcgcattagtaagaaatccattatcgagaaattcaacccacgaaatgtattgggtgtcaaacgcgtccggaaacatagtttcttcggtaaacatgatctcacgtatgttgataaatagattcacaatgcgacataaaaaggcaacctacgaaccagacgttgatctaggaagtgggacaagaaatattggaatagaaagtgaaactccaaatttagacataatcggaaagcgaatagagaaaataaaacaagagcatgaaacaagctggcattatgaccaggatcacccatacaaaacatgggcataccatggatcatacgaaacaaaacagacgggatcagcgtcaagtatggtaaatggtgtagtaaaactgttgaccaaaccttgggacgttatccccatggttacacaaatggcgatgacagacacaacaccatttggacagcaaagagtttttaaggaaaaggtcgatactagaactcaagaacctaaagaaggaaccaaaaagttaatgaaaataacggctgaatggttatggaaagaattaggcaagaagaaaactccacgtatgtgtactagagaagaatttacccgtaaagtaagatcgaatgcagcactgggagcaatatttacggatgagaacaaatggaaatcagcccgaggtgccgtggaggactccggtttttgggaattagtggataaagaacgtaacctacacttggaaggtaaatgcgaaacatgcgtatacaacatgatgggaaaacgagaaaagaaactcggagaatttggaaaggctaaagggtcaagagcaatttggtacatgtggctgggcgcccgatttttagagttcgaggctttgggatttcttaacgaggatcactggttctccagagaaaacagtctttcaggggtcgaaggcgaaggattgcacaaattaggttatatcctacgagatgtatcgaagaaagaaggaggtgcaatgtatgcagatgacacggcaggatgggatacgcgaattacattggaagatttgaagaacgaagaaatggtaaccaatcacatggaaggagtacacaagaaactagcagaagccatatttcgactcacataccagaataaagtagttagagtacaacggccaacgccccgaggtacggtcatggatatcatatcacgcagagatcaaagaggaagtggtcaggtagtaacctacggtttaaataccttcaccaatatggaagcacaacttatacgtcaaatggaaggcgaaggagttttcaagtctatacagcatctaacagtaacggaagagatagctgtcaaaaactggttagtcagagtcggaagagagcgtcttagtagaatggcgataagcggagatgactgcgtggtgaaaccactcgacgaccgatttgcaagtgctctcaccgcattaaatgatatggggaaagtccgaaaagacatacaacaatgggagccctcccgtggttggaatgattggactcaagtccctttttgctctcaccattttcacgagctcattatgaaagatgggagggtcctcgtagttccttgtcgaaaccaagatgaactaatagggagagcccgaataagtcaaggtgccggctggagtttgcgagaaactgcttgtctaggcaagtcctatgctcaaatgtggtcattaatgtattttcatagacgcgacctaaggctcgcggcaaacgcgatatgctcagctgtaccttctcattgggtgcctacatcacgtacgacatggagcatacatgctacccacgagtggatgactacggaagatatgttaacagtctggaacagagtgtggatacaagaaaacccttggatggaagataaaactcctgtagaatcgtgggaggaaataccctatttaggcaaaagagaagaccaatggtgcggctcgttaatagggttgaccagtcgagcaacctgggccaaaaatatacaaactgcgatcaatcaggtaagaagtttaataggaaacgaagaatatacagattatatgccgtcaatgaaaagattccggagagaggaggaagaagcaggagtattatggtaa

SEQ ID NO: 22897 - RNA, 9876 nt, synthetic construct
  misc_feature 1..9876: note = derived and/or modified CDS sequence (opt6) from DENV-2__AY858035__SS-prME
  source 1..9876: mol_type = other RNA
acagctgggattatcataatgatgatcccgacagtgatggcatttcatttaacgacacgaaacggtgaacctcacatgatagtatcgcgtcaagaaaagggaaaaagccttctttttaagacagagaacggcgtaaacatgtgtacgctaatggctatggatctcggggagctatgcgaagacactatcacgtataactgtcctcttcttaggcaaaatgaacctgaagatatagattgttggtgtaatagtaccagcacatgggtaacatatggaacgtgtactgctacaggggaacatagaagagaaaaacgctcagttgcattagtcccgcatgtcggaatgggtctggaaacacgtacagaaacgtggatgtcgagtgagggcgcttggaaacatgcgcaaagaatcgagacttgggtactacggcaccctggtttcacgataatggcagccattttggcgtacacaataggaacgacatattttcagagagtattaattttcatccttttgactgcagtagcaccatctatgacaatgagatgcataggcatatcaaatagagattttgtagaaggtgtttccggcggttcatgggttgacatcgtattagaacatggtagctgtgtaactactatggctaaaaacaaaccaacattagacttcgagttgataaaaacagaagcaaagcatcccgccaccctcagaaaatactgtatcgaagctaaactcaccaacacaacaacagcaagtcgttgcccgactcagggcgaaccctcactaaacgaagaacaagataaaagattcgtgtgtaaacatagtatggtagatagggggtgggggaacggatgtggattgtttggcaaaggtggaatcgttacatgtgcaatgtttacctgcaaaaagaacatggaaggtaaaatagttcaacccgaaaaccttgaatatacaatagttataacgccacacagtggggaagaaaatgcagttgggaacgatacaggcaaacatggaaaggaaataaaggtcacaccacaatcctcgattacggaagcagaactaacaggatatggaactgtaacaatggaatgctcaccaagaacaggtcttgattttaacgaaatggtgctattacagatggaaaacaaagcttggttagtacaccgacaatggtttctagatctgcctctcccctggttaccaggagctgatactcaaggatccaattggatccaaaaggagacactagtgacatttaagaaccctcacgcgaagaagcaagacgtagtagttttgggcagccaagaaggagcaatgcatacagccctgaccggagcaacggagatacaaatgagttctggaaatctactcttcaccggtcacttgaaatgtcggttaagaatggataaactacaactgaagggcatgagttattcaatgtgtactggaaaattcaaagttgttaaggaaatcgccgaaactcaacacggcacaatagtcatacgcgtgcagtacgagggggatggcagcccgtgcaaaataccatttgagatcatggacctggaaaaacgacacgtactcggaagacttattacagttaatccaattgttacggaaaaagacagcccagtcaatattgaagctgaacctccgtttggcgactcatacataattataggggtcgaaccaggacagcttaaattgtcttggtttaaaaaaggatcaagtatagggcaaatgttcgaaacgactatgagaggggccaaacgaatggcgattttaggagatactgcatgggacttcggatcactcggcggggtatttacgtctatcggaaaagccttgcatcaagtcttcggagcaatatatggtgcggctttttcaggtgtctcctggacaatgaagatccttataggagtagttataacatggataggtatgaattctcgctcaacttctctatcagtatccttggtactagtaggagtggtcactttgtaccttggagtcatggttcaagcagatagcggatgcgtggtcagctggaaaaataaggaactcaaatgtggatccggtatcttcataacagataatgtccacacgtggacagaacaatataaatttcaaccagaatcaccctcaaaactagcatccgcgatacaaaaagctcacgaagaaggaatttgtggtataagaagcgtaactagactagaaaacttgatgtggaagcaaatcacaccagaattgaaccacattttatcagaaaatgaggtaaaactaacgataatgacaggggatatcaaaggtatcatgcaagcaggcaagcggtctctacgaccacaaccaaccgaactaaaatactcatggaaaacctggggaaaggcaaaaatgttatcaactgaattacacaatcacactttcctcatagatggtccggagaccgcagaatgtccaaatactaatcgtgcatggaattcattggaagtcgaagattacggtttcggggtctttactacaaatatatggcttaaactcaaagaaagacaagacgtattctgtgactcaaagctcatgtcggctgccataaaagataacagagcagtccatgcagacatgggttattggatagagtcagcactcaatgacacatggaaaatagaaaaagcatcatttatcgaagtgaaatcctgccattggcctaagtcacacacactctggtcaaacggcgtactcgaatcagaaatgattatacctaaaaactttgcaggtcccgtctcgcagcataactatcgtcccggttaccatacccagacagcaggaccatggcatttgggacgactggagatggacttcgacttttgtgaaggaacgaccgtggttgttaccgaagattgtgggaaccgaggacccagcttgagaacaactacggctagtggaaaactcataactgaatggtgctgcaggtcctgcacgctcccaccattaagatatcgtggggaggatggctgttggtacggcatggagattcggcctctaaaagaaaaggaagaaaacctagttaactcattagttacggccggacacggtcaaattgacaacttttcactcggtgtgctaggtatggcgttattcctagaagaaatgctccgtacccgtgtggggacaaaacatgcgatactgttggtagccgtatcatttgtcacactgataactggtaatatgtcttttagagatctcggaagagttatggtaatggttggagcaacgatgaccgatgacataggtatgggagtcacatatttggccttactagccgcttttaaggtacggccaacatttgcagctggccttttattacgaaaactcacttcgaaagaactaatgatgacaacaatagggatagtcctactatcacaatccaccattccagaaacgatcctagaactgacagacgcactcgccttaggaatgatggtattaaagatagttagaaatatggaaaaatatcaactagcagtcactattatggcaattttatgtgtacctaatgctgttatattacaaaatgcctggaaagttagctgcaccacacttgcagtcgtgtctgtctcacccctgttattgaccagttcccagcaaaaagcagattggattccgctagctcttaccataaaaggactaaacccgacagccatatttttaactacattatcaagaacgtctaaaaaacgaagttggcctctaaatgaagctattatggctgttggaatggtctctatacttgcctcgtctttgctaaagaatgatataccaatgacaggtccgttagtggcgggtggtctattgacagtctgttatgtgttaactggaagatctgctgatctggagttggaacgtgcagcggatgttaggtgggaagaacaagcagaaattagtggatcctccccgatcttgtccataaccatatctgaagatggaagcatgtcaataaaaaatgaggaagaagaacagacgctaaccattcttatacgaacaggtttattggtagttagtgggctattcccagtaagcataccaatcactgctgcagcatggtatttatgggaagtcaagaaacaaagagcaggagtcctatgggacgtcccctctccaccgccggtcggcaaagcagaattagaagacggtgcgtaccgaattaaacaaaaaggtatacttggttacagtcagattggagctggagtttataaagaaggaacttttcataccatgtggcatgtgacaaggggtgcagtcttaatgcacaaaggtaagcgcatagagccgtcttgggctgatgttaaaaaggacttaatatcatatggaggaggttggaagctcgaaggcgagtggaaagagggagaagaagtccaggtcttagctctagaaccaggaaaaaatccacgggcagtacaaacaaagccgggactcttcaaaacgaacactgggacgataggagctgtaagtttagattttagccctgggacctctggcagtcccatcgttgataaaaaaggtaaagttgtaggtttatatggtaacggtgttgttacacgaagtggcacttatgtaagcgcaatagctcaaacagaaaagtcaatcgaggataacccggagattgaagacgatatattcaggaagaaacgcttaacaatcatggaccttcatccgggagctggaaagacgaaacgttatttaccagcaatagttagggaagcaattaaaagaggtctaagaacgcttatactcgcaccaactcgagtggttgctgcagaaatggaggaagcactcaggggactaccgataaggtaccaaaccccagctattagagcagaacacaccggacgcgaaatagtagatttaatgtgccatgcgacattcactatgagactattgagtcccataagagtaccaaattataatctaatcatcatggatgaagcacactttacagatcccgctagtatcgcagcgcggggatacatatcaacaagagttgaaatgggggaagcggctggtattttcatgacagcaactccgcctggcagtcgcgacccatttcctcaatcaaatgcgcctattatggacgaagaaagagaaatccccgaacgctcatggaatagcggccatgaatgggtcactgattttaaaggtaaaacggtttggttcgtaccaagtataaaagcagggaacgacatcgcagcttgtttaagaaaaaatggcaaaaaggtcatacagctgagcagaaagactttcgactcggaatatataaagactagaacaaatgattgggattttgtagtaacgacggacatatccgagatgggtgcgaattttaaagcagaacgcgtaatcgatcctcgacgttgcatgaaaccagtaatactaaccgacggagaagaaagagtcatcctagcaggtccgatgcccgtcacgcatagttccgctgcacaacgtcgtggcagggtaggaagaaatccaaagaatgaaaatgatcaatatatttatatgggtgaacccctggagaatgatgaagattgtgcacattggaaagaagctaaaatgttgctcgataatattaatacaccagaaggtataataccctccatgttcgaaccagagcgagagaaagttgatgcgattgatggggagtaccgccttcggggtgaggctagaaaaacgtttgtcgatcttatgagaaggggcgaccttcctgtatggttagcctacaaggtggcagctgaaggaataaactacgccgacagacgttggtgctttgacggagtaaaaaataatcaaatcctagaagaaaacgttgaagtagaaatatggactaaagaaggggaaagaaagaaattaaaacctagatggctggacgcacggatatattctgatcccttagcactaaaagagtttaaagaattcgcagctggcagaaaaagtctaacccttaatctaattaccgaaatgggacgactaccaacatttatgactcaaaaggcaagaaacgccttggataacttagcagtcttacatactgctgaagcggggggaagggcatacaatcatgcattgagtgagcttccagagacgcttgaaacactattgctactgacactgctggctactgtgacaggcggcatctttctatttttgatgagtgggaaagggatcggtaagatgaccctaggtatgtgctgtatcattacagcatcaatcctactatggtacgcgcagattcaaccccactggatagctgctagtatcattttggaattcttccttattgttctccttatacctgagcctgaaaaacagcgaacaccgcaagataaccaattaacttatgttgtgattgctattttgacagtagttgcagccacgatggctaacgaaatgggttttcttgagaaaactaaaaaagactttggccttggttcgataaccacacaacaaccagaatcaaatatactggatatagacctcaggccagcctcagcatggaccctatatgcagttgcaacaacattcattactccaatgttaagacattcaatagaaaattcttctgtgaacgtgtccttaaccgcaattgcaaatcaagcaacagtcttaatgggactcggaaaagggtggccactgtcaaagatggatataggagtacctttattagcaattggatgttactcacaggtcaatccaataactcttactgccgcactgcttcttttagtagcacattatgctatcatcgggccaggactacaagcaaaagctacacgtgaagcacagaaacgagcagctgccgggataatgaagaaccctacagttgatggcataaccgttattgacttagaccctataccatatgatccgaaattcgaaaaacaattaggccaggtaatgttgctcgtattgtgtgttacccaagtcctgatgatgaggacgacttgggctctttgcgaagcattaacgttagcaacaggaccaatttctaccctctgggaaggaaaccccggaagattctggaatacaaccatagcagtgtctatggcaaatatatttcgaggttcatatctagccggggcgggactactgttttctattatgaagaacacagctaatacaaggagggggactgggaatactggtgaaacacttggcgagaaatggaaaaacagactcaacaccctagggaaatcagagttccaaatatataaaaaaagcggtatccaggaagtagatagaacattggctaaagaaggcatcaaaagaggtgagactgatcaccatgcagtaagtagaggctctgcaaaactacgctggtttgttgaaagaaatctagtaacacctgaaggtaaagttgtcgatctaggatgcggaagagggggatggagttattattgtggtggactgaaaaatgtgaaagaggtaaaaggactgacgaaaggcggacctggacatgaagaacctataccgatgagcacatatggctggaacttggttcgactacagagcggagtagatgtattcttcaccccacccgaaaaatgcgatacattactttgcgatataggagaaagcagccccaacccaacagtagaagctggccgcacacttagagtgcttaatctcgtagagaactggctaaacaacaacactcagttttgcataaaagtgttaaatccatacatgccctcagttatagaaaaaatggaagcgttacaaagaaaatatggtggagcactcgtacggaacccgttgagccgtaattctacacacgaaatgtattgggtatccaatgcctctggaaatatcgtatctagtgtcaatatgatcagtaggatgcttattaacagatttaccatgagacacaaaaaagcaacatatgaacctgacgtggatcttgggtctggtacccgcaacatcggtattgaatcagaaattccaaatttagatattataggtaaaaggatcgagaagataaagcaagaacatgaaacctcatggcactacgatcaagaccatccatataagacttgggcttatcacggctcatacgaaaccaaacaaacaggttccgccagtagtatggtgaatggagtagtcagattattaacaaaaccctgggatgtaattcccatggttacacaaatggcaatgacagatacaactccctttggacaacaaagagttttcaaagaaaaagtcgatacacggacgcaagagccaaaggagggaactaagaaattaatgaaaataacggcggagtggctttggaaggaactggggaagaaaaagactagaagaatgtgtacaagagaagaatttacaagaaaagtacgcagtaacgctgccctaggcgcgattttcacagacgaaaacaaatggaagtctgcgcgagaagccgtagaagactctggcttttgggaattggtggacaaagagcggaatttacatcttgagggaaaatgcgagacatgtgtgtataacatgatgggcaaaagagaaaagaaacttggagagtttgggaaagcaaagggatcacgagctatctggtatatgtggcttggagcacgattccttgaattcgaggctttaggctttttaaatgaagatcattggtttagtagagaaaacagtttaagtggagtcgagggtgaaggtctgcataaactaggatatatactccgagacgttagcaaaaaggagggaggtgcaatgtatgcagacgatactgcaggatgggacacaaggataacattagaagaccttaaaaacgaggaaatggtgacaaaccatatggagggagaacataaaaaattggcagaggctattttcaaattaacctaccaaaacaaagtcgtaagagtccaaaggcctactccaagaggaacagttatggacattatatccaggagagatcaacgaggaagcggacaagtagtcacttatgggcttaacacatttacaaacatggaggcccaattaatacgccaaatggaaggcgaaggagtgtttaaatcaatccaacaactcacagttacggaagaaatagcggtcaaaaactggctcgaacgtgttggtcgcgaacgattgtctagaatggcaatcagtggggatgattgcgtggtaaaaccactagatgacagattcgcctcagccttaactgctttaaacgatatgggaaaagtcagaaaagacatacaacagtgggaaccgagtcgaggatggaatgattggacacaagttccattctgttcgcatcattttcatgaacttatcatgaaagatggccgtgtcttagtagtaccatgcagaaaccaagacgaacttattggtagggcaagaatcagccaaggagctgggtggtcacttcgcgaaacagcttgcctcggaaaaagttacgctcaaatgtggagcctaatgtactttcatcgaagggatctacgattagccgccaatgcaatttgctctgcagttccatcacactgggtaccaacgtccagaactacctggtcgatacatgcaacccacgaatggatgacaaccgaggatatgcttaccgtatggaatagagtatggattcaggaaaatccctggatggaagataaaacccctgtagaatcttgggaggagataccatatttgggaaaacgagaggaccagtggtgtggatcccttattggacttacatcccgagctacttgggcaaaaaatatccaaacagcaattaatcaagtaagatcgctaatcggaaatgaagaatacacagactatatgccttcaatgaaacgatttagaagggaagaagaagaagcaggcgtcctctggtaa

SEQ ID NO: 22898 - RNA, 9873 nt, synthetic construct
  misc_feature 1..9873: note = derived and/or modified CDS sequence (opt6) from DENV-2__JX567951__SS-prME
  source 1..9873: mol_type = other RNA
actgcaggagttatagttatgttgataccaacagcaatggctttccatcttactactcgaaatggagaaccacatatgatagtaggacgacaagaaaaaggaaaaagtttactatttaaaacggaagatggagtaaatatgtgcactctgatggccatagatctaggagaactttgcgaagacactatcacgtataaatgtcctctactacgacagaacgaacctgaagatatagactgctggtgtaattcaacgtcaacttgggtaacatacggtacatgtacaacaacaggcgaacacagacgagaaaaacgaagtgtggccctagttccgcacgtaggcatgggcctcgaaacgcgaactgaaacgtggatgagtagtgaaggagcttggaaacacgtccaaagaatcgaaacttggatacttagacatccaggttttactatcatggctgcgatactcgcatacacaataggtacaacgcatttccaacgcgctttaatctttatacttttaacggcggtagcgccgtccatgacgatgcgatgtataggaatctcaaaccgagactttgtagaaggtgtcagtggaggctcttgggttgacatcgtattggaacatggttcctgtgtgacgacaatggccaaaaataaacctacactcgatttcgaactaataaaaactgaagctaaacagccagcgacgctacgaaaatactgtatagaagcgaaactaactaataccacaaccgaaagtagatgcccaactcaaggagaaccatcattaaacgaagaacaagacaaacggttcatatgtaaacatagtatggtagatcgcggatggggaaatgggtgcggtctcttcggtaaaggtgggatagtgacatgcgctatgttcacttgtaagaaaaatatggaaggaaaaatcgttcaaccagaaaatctggaatacacaatagttattacgccacattcaggagaggaacacgcagtcggcaacgacactgggaaacatggaaaagaaattaaaattacacctcagtcgagcactacggaagcagaactcaccggatacgggactgtaacaatggaatgtagcccgcgcacaggattagacttcaacgaaatggtattgctccaaatggaagacaaagcatggctagtacatagacagtggtttcttgatttaccgctaccatggcttccaggagctgatactcaaggctctaattggatacagaaagaaaccttagtcacatttaaaaatccgcacgccaagaaacaagatgtagtagttttaggctcacaagaaggcgccatgcacacggccttaactggtgccacagaaatccagatgtcgtcaggaaatctgctatttacgggacatctaaaatgcagattaagaatggataaattacaacttaaaggtatgagctatagtatgtgtacagggaaatttaaaatagttaaagaaatagcggaaacccaacatgggaccattgtgattcgagtacaatatgaaggagacggctcaccatgtaagataccattcgaaataactgacttggagaaacgacatgtactaggcagattaatcactgttaacccaattgttacagaaaaagatagtccagtaaatatagaagctgagccccctttcggcgattcatatattattgtaggagtagaaccagggcaactaaagctaaattggtttaaaaagggatcctcaataggtcaaatgtttgaaaccactatgcgcggcgcaaaaagaatggcaattttaggagacaccgcatgggactttggttcattaggcggtgtctttacgagcattggtaaagcactccaccaagtatttggtgcaatctacggtgctgcgttcagtggagtatcctggacaatgaaaatactcataggtgtcataataacgtggatcgggatgaatagtaggtccacgtcactatcagtttcgttagtattagtaggagttgtaacattgtaccttggcgcaatggttcaggctgattcggggtgcatagtatcgtggaagaacaaagaattaaaatgtggtagtggaatttttattaccgacaacgtacacacatggactgaacaatataagttccaaccagagagtccatctaaactagcatcagcaatccaaaaggctcatgaagaaggaatatgcgggatcaggtcggtaacacgcctcgagaatctcatgtggaaacagatcactccagaattaaaccacatattgtcagaaaatgaagtaaaattaactataatgactggtgatatcaaaggaataatgcaagctggaaaaaggagtctgcgaccacagccaacagaactaaagtactcttggaaaacctggggcaaagcaaaaatgctatctacggaatcccataatcaaacttttctaatagatgggcctgaaacagcagaatgccccaacacaaacagggcctggaatagtctagaagtcgaagattacggtttcggagtgtttactacgaatatttggttaaaactacgagaaaaacaagatgtattttgcgatagtaaattgatgagtgcggccattaaagataatcgtgcagtacatgcagatatgggatattggattgagagtgcgttaaacgatacttggaagatggagaaggctagttttatcgaagtcaaatcctgtcactggcctaagtcgcatactctatggtcaaatggagtactagaatcagaaatgattatccccaaaaatttcgcaggcccagtttcacagcacaattaccgacccggttatcatactcagacggcggggccatggcatctaggtaaattggaaatggactttgatttctgcgaaggcaccacagtcgttgtcacggaagattgtggtaatcgaggaccctccttaaggacaacaacggcttcaggcaagttaatcactgaatggtgttgtcgctcatgcacgcttccgcctctgcggtaccgtggtgaagatggatgctggtatggtatggagataagaccacttaaggaaaaagaagagaatctcgtaaattccctcgtcacagccggacatggtcaaatagacaattttagcttaggcgtgctcggtatggctctctttctagaggagatgctacgtactagagttggaacaaaacatgccattttgttggtagccctaagtttcgtaacattgattacaggaaatatgtcattcagagatcttggtcgcgtaatggtaatggttggtgccactatgactgacgatatagggatgggggtaacctatctagcactattggctgccttcaaggttaggcccacgtttgcagcaggactactgcttagaaagttaacatcgaaagaactgatgatggcaacaatcggtatagctttactaagtcaatcaacgctacctgaaacgatcctcgaattaacagatgcgttagcactaggcatgatggcactaaagatcgtaaggaacatggagaagtaccaactagcagtaaccataatggcaataagttgtgtgccaaatgctgtaatattacagaatgcttggaaagtaagctgtacgatattagctgcagtctcagtaagtcctttgctactaaccagctctcagcaaaaggccgactggattccgctagcgctaaccataaaaggtttaaatcctacagctatctttcttacaacgctatccaggactagcaagaaacgttcctggccgttgaacgaagcgataatggcagtagggatggtaagtatactagcctcttccttattaaagaacgacataccaatgacaggcccattagtagccggtggtctcctcactgtatgttatgtactcactggcagaagcgcagacttagaactagagagagcagcggacgtcaaatgggaggaccaagctgaaatatcaggatcgagtccgatattatctataactatctcggaagatggctctatgagtattaaaaacgaggaagaagaacaaacgttaacaattctaataagaaccggactcctagtcatatctggtgtatttcctgtttccatacctatcaccgctgctgcttggtacttatgggaggtcaaaaagcagagggcaggagttctatgggatgttccctcccctcctcctgtgggaaaagctgaattagaagacggcgcttacagaatcaagcaaagaggtatactaggttattcccagattggtgcaggagtttataaagaaggaacatttcatactatgtggcatgttacaaggggagcggtattaatgcatcgtgggaaaagaatagagccctcgtgggcagatgttaagaaagacctgatcagttacggtggaggatggaaacttgaaggggaatggaaggaaggagaagaggtccaagttcttgctctcgaacctggcaaaaatccccgagcagtacagactaaaccaggtatattcaaaacaaatacaggtacgatcggagcggttagtcttgacttcagccccggaacctcaggttcccccattgtagatcgtaagggaaaagtagttggattatacggaaacggcgttgtaactcgatcgggggcttatgtttcagctattgcgcagacagagaaaagtatagaagataacccggaaatagaagacgatatatttaggaaaaagcgactgactataatggatttgcatccaggagccggtaaaaccaaaagatatttacccgcaatagttagagaagccatcaaaagaggattgaggactctcatcttagcaccgacgcgtgtagttgcggctgaaatggaggaagcacttcggggcttgccaattagataccaaacccctgctattagggcagaacacactggacgagaaatcgtggatctaatgtgtcatgccactttcactatgcgacttttgtcacccgtaagagttccgaactataatcttatcataatggatgaagcacactttacggaccccgcaagtatagccgcacgaggatacatatctacgagagtggaaatgggggaggccgcgggaatatttatgactgcaacaccaccaggatctcgagacccttttccccaatcaaatgcgccgattatggatgaagaaagggaaattccagagcggtcttggaactcaggacatgaatgggttactgactttaaaggaaaaactgtatggtttgttcccagtataaaagcgggaaatgatatagctgcctgcctaaggaaaaatggcaagaaagtaatacaactttcaagaaaaacctttgattccgagtatgtaaagaccagggcgaatgattgggatttcgttgtgaccactgacataagtgagatgggtgctaattttaaagcggaacgtgttattgacccccgaagatgtatgaagccggtaatactgaccgatggggaagaacgcgtaattctagcgggtccgatgccagtaacacattcctcagcagcccagcgacggggacgaattggcagaaaccccaaaaatgagaacgaccagtatatttatatgggagaaccgctagaaaatgacgaggattgtgcacattggaaggaagcgaaaatgttgctcgataacatcaatactccagaaggaatcattcctagtatgtttgaacccgaacgcgaaaaggtagatgcgatagatggagaatataggcttcgaggagaagcacgaaagacgttcgtcgatctaatgaggagaggagatttaccggtctggttagcatataaagttgcggcagaaggaattaattatgcagacagaaagtggtgtttcgacggtatcaaaaacaaccaaatacttgaggaaaatgtggaagtggaaatatggactaaagaaggtgaaagaaagaaattaaaaccacgatggttggatgctagaatatatagtgatccattagctctaaaggaatttaaagaatttgccgctggaaggaaaagtttaacattaaacctcataacagagatggggcgacttcccacattcatgacccaaaaagcacgtaacgctctcgataacctggccgtgttacatacagctgaagttgggggcaaagcatacacccacgctctttcggaattgccggaaacccttgaaacactattattgttaaccctgctcgctgcagttactggaggaatcttcttattcctaatgtctggcaaaggtattgggaaaatgacacttgggatgtgttgtataattacagcaagtattctcctatggtatgcacagatacaacctcactggatagcagcatcaatcattttggaatttttcctcatcgtattactaatacccgaaccagaaaaacaacgcacaccccaagacaaccaactgacatatgtagtgatcgccatattaacggttgtagccgctacaatggctaatgaaatgggatttctggagaaaaccaagaaagatctggggtttggtagcataaccacacaggaatctgaatcaaacatattagacatagatcttagaccagcttcagcttggacactttatgccgtagccacaacatttgtaacaccaatgttgagacatagtattgaaaattcctctgtaaacgtatcactaactgccatagctaaccaagcgactgttttaatgggtcttggaaagggttggccactatctaaaatggatatcggggtacctcttctagccataggttgttactcccaagtgaatccaattactctaaccgcagctctactgttgcttgttgcacattatgcaataatagggcctggtctacaggcgaaagcaaccagagaagcacaaaaacgcgcagctgcaggaataatgaaaaatcctacagtggatggaattactgtaattgacctagagcctataccttatgacccgaaatttgaaaaacaattaggtcaagtaatgctattaatcttgtgtgtaacccaggttttaatgatgcgtacgacttgggccctgtgtgaagcactgacacttgccacggggccaatttctacattatgggaagggaacccgggaagattctggaatacaacaatagcagtctcaatggctaatatctttaggggctcatatttagccggtgccgggttgctctttagtataatgaaaaatacgacaaatacaaggcgaggaacaggaaatgttggagagacactgggtgaaaaatggaaaagtcggctgaacgccttgggaaaatctgaatttcaaatctataaaaagtccggaatacaagaagtagatagaacattagctaaagaaggcataaaacgcggagaaacagaccaccatgcggtgtcgagaggaagtgcaaagttacgctggttcgtggaacgaaacatggttacaccagaaggtaaagtggttgaccttgggtgcggcagaggcggctggtcgtattattgcggaggactcaaaaatgttcgcgaggtaaagggtttaacgaaaggaggaccaggacacgaagaaccgatcccaatgtccacatatggctggaacctggttagactgcaaagcggagtagatgtcttcttcacccctcctgagaagtgtgatactttactttgtgatattggagaaagttcaccaaatccgacaatcgaggccggaagaacacttcgagtgttgaacttggttgaaaactggctaaataataatactcaattttgtataaaggtactaaatccctacatgccatcggtaatagagaaaatggaaacattacagcgaaaatatggcggagcactcgttcgaaacccgttaagtagaaacagtacacatgaaatgtattgggtatccaacgccacaggtaacattgtatccagtgtcaatatgatatctcgaatgctcattaatagattcacaatgaagcacaaaaaggccacctatgaaccagatgtcgatttggggagtggtacccgaaacataggaattgagagcgagataccaaatttagatatcattggtaaaagaatagaaaagattaagcaagaacatgaaacttcttggcactacgatcaagaccatccttacaaaacctgggcatatcacgggagttacgaaactaagcaaacaggctctgcatctagcatggtaaatggtgtcgtgaggctactcactaagccatgggacgtcgttccgatggtaacgcagatggctatgacagacacaacaccctttggtcaacaacgagtttttaaagagaaggtcgacaccagaacacaagaacctaaagaaggtacaaagaaattaatgaaaataacagcggaatggttatggaaagaattagggaaagagaaaactccaaggatgtgcacaagagaagaatttactagaaaagtgagaagtaacgccgccctaggcgctgttttcactgacgaaaataaatggaaatctgcacgggaggcagtggaagatggtaggttctgggaattggtagaccgcgagagaaatctccatctagaaggaaaatgcgagacttgcgtatacaatatgatgggaaagcgagagaagaaattgggagagttcggaaaggcaaagggaagtcgtgcaatatggtatatgtggctgggggcgcgatttctcgagtttgaagcactaggtttccttaatgaagatcactggttctcccgaggaaattcgctttctggtgttgagggggaaggcttacatagactaggttatatcttacgggaggttggtaaaaaggaaggcggggctatgtatgccgatgatactgcgggatgggacaccaggattaccctagaagacctgaaaaacgaagaaatggtaacgaaccatatgaaaggagagcataagaaactagctgaagcaatatttaagttaacctatcaaaacaaggtagtaagagtacaacgccccacaccaagaggtaccgtaatggatataatcagcaggaaagatcaaagaggtagcggtcaagtaggcacctatggacttaatacctttacaaacatggaagcccaattaataagacaaatggaaggtgagggtatattcaaatcaatacaacacctcactgcgacagaagagatcgcggttcagaattggctcgcacgcgtaggccgtgagcgactttcaagaatggcgataagtggtgatgactgcgtagttaaaccaatcgatgataggtttgcttcagccctcacagcacttaatgacatgggaaaagtacgtaaggatatacaacaatgggaaccatcccgaggctggaatgattggacgcaagtaccattctgttcacatcatttccacgagctggtaatgaaggatggtagagtgctagtagtcccatgcaggaatcaggatgaattaattggacgagctcggataagtcagggtgctgggtggtcactgaaagaaactgcctgccttgggaaaagctacgcccagatgtggaccttgatgtactttcatagaagagatttgagattagcagctaacgcaatatgtagtgcagtcccaagtcattgggttccaacgagtaggacgacgtggagtatacatgcaaaacatgaatggatgacaactgaagatatgctagcagtgtggaaccgcgtatggatacaagagaacccatggatggaggacaaaacacccgtggaaagctgggaggaagttccatatcttggaaaacgagaagaccaatggtgtggttcccttataggtcttacatcgagagcaacatgggctaaaaacatacaaacggccatcaatcaagtacggtcacttataggaaacgaagggtacaccgactatatgcccagcatgaaaagattcagacgagaagaagaggaagctggagtcctatgg

SEQ ID NO: 22899 - RNA, 9873 nt, synthetic construct
  misc_feature 1..9873: note = derived and/or modified CDS sequence (opt6) from DENV-2__JX567950__SS-prME
  source 1..9873: mol_type = other RNA
accgcaggggtaatagtaatgttaataccaacagcgatggcatttcacttgacaacccgtaatggagaaccgcacatgatcgtagggagacaagaaaaaggaaaaagcctactattcaaaaccgaagacggtgtaaatatgtgtactttaatggcaatagatttgggagaactgtgcgaagacactataacatataaatgcccattattacgtcaaaatgaacccgaagacattgattgttggtgtaattcgacatcgacatgggtaacctatggaacgtgcacgaccacgggggaacacagacgtgaaaaacggtccgtcgccttagtaccacacgtaggaatgggcttggaaacaagaacagaaacgtggatgtcgtccgaaggcgcatggaaacatgttcagagaatagaaacctggatattacgacaccccggattcactataatggctgcaatcttagcatacacaataggaacaactcactttcagcgtgcattgatatttatcttacttacggctgtggcgccgtcgatgactatgaggtgtataggcataagtaacagggacttcgtagaaggcgtgtcaggcggctcctgggtggatattgtgctggaacatggttcatgtgtgactactatggccaaaaataaaccaacattagacttcgaactgataaaaactgaagcgaaacaaccggccacacttcggaaatactgcatagaagcaaaactaacgaacacaacaactgaatcacgctgtccaacgcaaggagaaccttccctaaatgaagaacaagacaaacgtttcatttgtaaacatagcatggtggatcgtggttggggaaacgggtgtggacttttcggaaaaggcggaatagttacatgtgctatgttcacttgcaagaaaaacatggaaggaaaagttgtgttaccagaaaacctggaatacacaattgtaattacgccgcacagtggtgaggaacatgcggtcggcaatgacacagggaaacacggtgaagaaataaaaataacaccccagagttcaattaccgaagcggaattaacaggttatggaactgttacaatggaatgtagtccgcgaactggactagacttcaatgaaatggtcctgcttcaaatggaagataaagcgtggctcgtacacagacagtggttcctagatttacccctaccctggttacctggcgctgacacacagggctcaaattggatacagaaagaaaccctggtaacatttaaaaatccgcacgcgaagaaacaagatgttgttgtactaggatcacaagaaggggctatgcacacagcattaactggggcaaccgaaatacaaatgtcgagtgggaatttgttattcacaggacatcttaaatgccgcctgcgaatggacaaactccaactcaaaggaatgagttattccatgtgtacgggcaaattcaaaatagtaaaagaaattgcggaaacgcaacacggaaccattgtaatacgggtacaatacgaaggtgatggatctccatgcaaaattccattcgaaataaccgatttagagaaacgacatgtgctaggaagattaattacagtcaaccctattgtaacagagaaagactccccggtaaacatcgaagctgaaccaccgttcggcgacagctacataatcgtgggagttgaaccaggacagttaaaactgaattggtttaagaaaggctcctcgattggtcaaatgttcgaaactacaatgagaggggctaaaaggatggctattttaggtgacacagcatgggattttgggtctttagggggagtgtttacatccataggaaaagcgctgcatcaagtcttcggagcaatatacggtgctgcattttccggtgtgagctggactatgaaaatacttattggggtaataatcacatggatcggaatgaacagcaggtcaaccagtttatctgtttcattagttttggttggagttgtcacattataccttggagctatggtacaggcggatagcggatgcatagtaagttggaagaataaagaactaaaatgtggatccggaatttttataactgacaacgtacacacatggacggaacagtataaattccagccggaaagcccgtcgaaattagcttcggcaattcagaaggctcacgaagaagggatatgtggtataagatcagtcactaggttggaaaacttaatgtggaaacagataacacccgagctaaatcacattctatctgaaaacgaagtcaaactcacaattatgaccggtgacattaaggggataatgcaagcgggaaaaagatcacttcgaccacaaccgacagaattaaagtatagttggaaaacttggggaaaagcaaagatgttatcaacagaaagccataaccaaacatttttaatcgatggcccggaaacagcggagtgccctaatactaatagagcatggaactcactggaagtcgaagattatggctttggagtattcactacaaatatttggttgaaacttagagaaaagcaggacgtattctgtgactccaaactcatgagcgcagcaataaaggataatagagcagttcacgcagatatgggatactggattgaaagcgctttaaacgacacctggaaaatggaaaaagcctcattcatcgaagttaaaagttgccattggccgaagtcgcatacattatggtcaaatggcgtactcgaatccgaaatgattatacccaaaaacttcgcaggacctgtatcacagcacaactacagacccggttaccacactcagacagcgggtccatggcacctgggtaagctggaaatggatttcgatttttgcgaaggaacaacagtcgtggtaacagaagattgtggtaataggggcccttcattgagaaccaccactgcatcaggaaaacttataacggaatggtgttgccgatcttgtacactcccaccgctccgatatagaggagaggacggatgttggtatggaatggaaatacgccccctaaaggaaaaagaagaaaacctagtaaactcgctagtaacagcaggtcacggacaaattgataacttttctcttggtgtactaggaatggccctgttcttggaagaaatgctaagaacacgagttggtacgaaacatgctattctactggtagcactgtctttcgttaccctaattactggtaacatgagtttccgggatcttggcagggtaatggttatggtcggtgctactatgaccgacgatattggtatgggcgtcacatatctggccctcctagccgcatttaaggtacgacccacatttgccgccgggctacttctacgcaagttaacaagtaaggaattgatgatggcgactataggtattgccctactgtcccagtccacgctgccagagactatcttagaattaactgatgcactagccttaggcatgatggcactaaagattgtgagaaatatggaaaagtatcaacttgcggttacaatcatggcaatctcatgtgtaccaaacgcagttatactacaaaacgcttggaaagtttcatgtacgatactagcagccgtgtcagtttcaccacttctactaacaagctcgcagcaaaaggctgactggattccgctagccttgacaataaaaggactcaatccaacagctatattcctaaccacgctttcaagaacaagtaagaaacgaagttggccgttaaacgaggctattatggccgtaggaatggtatccatactagctagcagtctgctcaaaaatgatattcctatgacagggccattagttgcaggaggattgttaactgtatgttacgtactaacaggacgatcagctgacttagagctagaaagagctgctgatgtaaaatgggaagatcaagccgaaattagcgggtcgtcaccgatactttccgtaacgatctctgaagatggaagcatgtcaattaaaaatgaagaagaagaacaaacattaacaatattaattaggaccggtctattagtaataagtggcgtctttcccgtaagtatcccaataacggcagcggcatggtatctctgggaagttaagaaacaaagagcaggagttttatgggacgttccgagtcctccaccagttggtaaagcagaattggaagacggcgcgtatagaatcaagcaaagaggtatactaggctattctcaaataggggcgggagtatacaaagaaggtacatttcatactatgtggcacgttacaaggggtgcagtgttaatgcataggggcaaaagaatagagccgtcgtgggcagacgtaaagaaagatttaattagctacggagggggatggaaactagaaggagaatggaaagagggcgaagaggtacaagtcttagcgttagagccaggcaaaaacccaagagcggtacaaacaaaaccaggaatcttcaaaacgaataccggcacgataggtgcagtatcactggatttttcacccggtacgtcaggatcaccgattgttgataggaaaggaaaagtagtcggtttgtatggaaacggagtagttacacgatctggggcatatgtctcagcaattgctcaaactgagaaatcaattgaagataatccggaaatagaagacgacatatttcgtaagaaaaggttaacgatcatggatcttcaccctggcgcaggcaaaacaaaaaggtatttacctgccattgttcgtgaagctataaaacgtgggctcagaacactaatcctagctccaactcgggtggtagccgctgaaatggaagaagcactaaggggactgccgatacgataccagactccggctatacgcgctgaacatactggaagagagattgtcgatttaatgtgtcacgccacatttacaatgaggttactgtcccccgtaagagttcctaactacaacttaataattatggacgaagcgcacttttccgatccagctagtatagcagcgcgagggtatatatcaacaagggtcgagatgggtgaggcggctggtatctttatgacggcaacacccccgggatcgagagatccatttccccaatctaatgcccctataatggacgaagaaagagagataccagaacgttcctggaacagtggacatgaatgggttactgatttcaagggaaaaacggtatggttcgttccaagtattaaggcaggtaacgacattgctgcttgtttgagaaagaatggcaagaaagtgatacaactcagtaggaaaacctttgacagtgaatacgtcaaaactagggcaaatgattgggactttgtcgttactacagatatcagtgaaatgggagcgaattttaaggccgaaagagtcatcgatcctagacgatgtatgaaaccagtgatattaacggacggtgaggagcgagttatactagccggaccaatgccagtaactcattcgagcgcggcgcaacgtagggggagaattgggagaaatcccaaaaatgaaaatgatcaatatatttacatgggtgaacccctagaaaatgatgaggactgtgctcactggaaggaagctaaaatgctactagataacataaacactccagagggaattattccatctatgtttgaaccggaacgcgagaaagtggatgcaatagacggcgaatatagactaagaggcgaagcgagaaagacattcgtggatttaatgcgccgaggagacctcccagtctggcttgcttacaaagtcgcggcagaaggaatcaactatgctgacagaaaatggtgttttgatggaatcaaaaataaccaaatacttgaagaaaatgtagaagttgaaatatggactaaagaaggagaaagaaagaaactgaaacctcgttggttagacgcaagaatctatagcgatccattagcgcttaaagagttcaaagagttcgctgctggacgaaagagtttaaccttaaacctaataacagaaatgggtagattgcctacatttatgactcaaaaggcaaggaacgcgttagataatcttgctgtccttcacacagcagaggtgggtggaaaagcatatacgcatgcattaaacgagctccctgaaactttagagacactcctattacttacactactagcagcagtaaccggcggaatatttctatttttaatgagcggcaaaggtataggaaaaatgactttgggaatgtgttgtataatcacagccagcatattactttggtacgcgcaaatacaaccccactggattgccgcttctataattctcgagttctttctgatagtattactcataccagaaccggaaaaacaaagaactccccaagataaccaactaacatatgtagtcatcgcaatactaactgtagttgccgctactatggccaacgagatgggctttttagagaaaactaagaaatacctaggattaggcagtatcacgactcaagaaagtgaatccaatattcttgacattgatttgagaccagcgtcggcatggacgctttacgcggtagcaacaacatttgtgactccaatgttacgacattctatagtaaacagctctgtaaacgttacactgacggcaatagctaaccaagctactgtacttatgggtctaggtaaaggctggccattatcaaaaatggatataggtgtaccgttgcttgcaattggatgttattcccaagtgaacccaataacacttacggcagcattacttttattagttgcacattatgcaataatagggcccggactacaagctaaagcaacgagagaagcccagaaaagagcggccgcagggattatgaaaaaccctacagtcgatggtattacagtaatcgacttagagcctattccatacgatcccaaattcgaaaaacagctaggacaggtgatgctcttaatactttgcgttacccaagttcttatgatgcgaacaacatgggcattatgcgaggctttgaccttggctacaggacctatttctactctatgggaaggaaatcctggtagattttggaacaccaccatagctgtttcaatggcgaatatattccgggggagttacttagcgggtgcaggcctcttattttcaattatgaagaacaccacgaacacacggcgtggcacagggaatgtaggagaaactttaggagaaaaatggaaatccagactaaacgcgttaggcaaaaacgaatttcaaatctacaagaaatccggaatacaggaagttgatcgaacattagccaaagaaggaatcaaacgaggagaaacagatcatcatgcagtaagtcgaggtagcgcaaaacttaggtggttcgtagaaagaaacatggtaaccccagaaggtaaagtagtcgacttaggttgtggaaggggaggctggtcatactattgcggtggactcaaaaacgtcagagaagtaaaaggattaacaaagggcgggcccggccatgaagaaccaatcccaatgtccacttacggatggaatttagtgagattacaatctggtgttgatgttttctttacaccgcccgaaaaatgtgacacgctgttatgtgatattggagaatcaagtcccaaccccacaatagaagcaggacgcacgttacgggttttaaatttggcggagaactggctaaataataacacccagttttgcataaaggtcttaaatccttatatgccatcggttatcgagaaaatggaaactctgcaaaggaaatatggaggggcattggtgagaaatccattaagtagaaatagtacgcacgagatgtattgggtctcgaatgccactggaaatatagtaagcagtgtcaacatgatatcacgtatgttaattaaccgattcactatgaaacataagaaagcaacctatgagccagacgttgacctaggaagcggaacacggaacatcggaatagaatcagagattccgaatttagacataatcgggaaacgaatcgaaaagataaaacaagaacatgaaaccagttggcattacgatcaagaccacccatataaaacgtgggcatatcatggttcctacgaaaccaaacaaacagggtcagctagctcaatggttaatggcgtcgtgcgactcctaaccaaaccttgggacgttgtgccaatggtaacccaaatggccatgactgatacaaccccattcggacaacaaagagtattcaaggagaaagtcgatacccgtacacaagagccaaaagagggaacgaagaaactaatgaaaatcacggcagaatggttatggaaagaattaggaaaggagaaaacaccgagaatgtgcactcgagaggagttcacgagaaaagtaaggtccaacgcagcgttaggtgcggttttcacagatgagaataaatggaagtcggctcgagaagcagttgaggatggacgcttctgggaattagttgatagggaaaggaacctgcacttagaaggtaaatgtgagacatgtgtttataacatgatgggaaaaagagagaagaaacttggagagtttggtaaagcgaaaggtagtagagcaatatggtacatgtggttaggggctagatttctagaatttgaggcgcttggttttctgaacgaggatcactggttttcgagagaaaattctctatcgggagtagagggtgagggccttcatagactagggtacatattgagagacgtcagcaagaaagaaggaggagcaatgtacgccgatgatacagcagggtgggatacaagaataacattagaggaccttaaaaatgaggaaatggtaacgaatcatatgaaaggggagcacaagaaactagctgaggcaatctttaagctgacctaccaaaataaggtagtgcgcgttcaacgtccgaccccaaggggaacggtcatggatataatctctagacgcgaccaaagaggatccggacaagtaggaacttacggattaaatactttcactaatatggaggcacaattaataagacaaatggagggagaaggaatatttaaatctatacaacatcttactgctacagaggaaattgcggtgcagaattggctagcacgggtcgggcgtgaacgactttctcgaatggcaatttccggagatgattgcgttgtgaaacctatagatgatagattcgcgtcagcattgacggcactgaacgacatgggaaaagttcgcaaagacatacaacaatgggaacctagtagaggatggaatgactggacgcaagtgccattctgctcacatcattttcatgagttagtaatgaaagatggacgcgtcctagtagttccttgtagaaaccaagacgagttaattggacgcgccaggatatctcagggagcaggatggtcactcaaagagactgcatgtttgggaaagtcctacgcccaaatgtggacgttaatgtacttccatcgacgagacctacgcttagcggctaacgcgatttgttcagctgtaccttcacactgggtgcctacgtcacggacaacttggtcaattcacgctaagcatgaatggatgaccacagaagatatgctagctgtatggaaccgagtatggattcaagaaaacccatggatggaagataaaactccagttgaatcctgggaagaaattccatacttaggaaaacgcgaggatcaatggtgcggatcactcataggactaacatcaagagctacttgggccaaaaatatacaaacagcaataaatcaagttcgcagtttgattggtaatgaaggctatacggactatatgccaagtatgaagagattccgaagggaagaagaagaagctggagtattatgg

SEQ ID NO: 22900 - RNA, 9873 nt, synthetic construct
  misc_feature 1..9873: note = derived and/or modified CDS sequence (opt6) from DENV-2__HQ012538__SS-prME
  source 1..9873: mol_type = other RNA
accgctggggttattataatgttaatacccaccgcaatggctttccatttaaccacgagaaacggagaaccgcacatgatagtaggtagacaggaaaaagggaaatcattattattcaaaacagaagacggagtaaatatgtgtactttaatggcaatagatcttggagaactctgtgaagacactataacttataaatgccctttactgagacaaaatgaacctgaagatattgactgttggtgtaattctacttcaacctgggtaacctacggaacgtgcacgaccaccggtgaacatagaagagaaaaacgctcagtagcattagtaccgcatgtgggtatggggttagaaacccgtacagaaacatggatgtcttcagaaggtgcatggaaacacgttcaaagaattgaaacttggatattacggcatcctggcttcgcaatcatggcggcaatccttgcatatactattggaactacgcactttcaaagagcgttgatattcatattgttgactgccgtcgcaccttcaatgacaatgaggtgcatcggtatatcaaatagagactttgtagagggggtcagcggaggtagctgggtagacatcgtattggagcatgggtcttgcgtaaccactatggctaaaaacaaaccgactctagatttcgaactgataaaaactgaggcaaaacaacctgctacgttacgcaaatattgcatagaggcaaaattaactaataccaccacagaatcacgatgccccacacagggcgaaccaagcctaaacgaggaacaagataaaagattcatttgtaaacatagcatggtagataggggatggggaaatggctgtggtctattcggaaaaggcggaattgttacctgtgccatgtttacgtgtaagaaaaatatggaagggaaagtagtcttgccagaaaatctagaatacacaatcgtaattactccacactctggcgaggaacacgcagtgggaaacgatacggggaaacatggagaggaaataaaaatcacgcctcagtcctcaattaccgaagcggaattgacagggtacggcaccgtcacaatggaatgtagtccaagaacgggattggacttcaacgagatggtattacttcaaatggaggaaaaagcctggttagtccatcgacaatggttcctagatttgcccttaccatggttacctggggctgatactcagggatctaactggatacagaaagaaaccttagtgacatttaaaaacccacatgctaagaaacaagacgtagtggtattaggcagtcaggaaggcgctatgcacactgcgctaaccggagcaactgaaatacaaatgtcttctggaaacctcttattcacaggtcatctaaaatgcaggttaaggatggataaactgcaacttaaaggaatgtcatactccatgtgtactggaaaattcaaaatagttaaagagatagctgaaacacaacatggtaccattgtgatacgagtacaatatgaaggagatggcagtccttgcaaaataccttttgaaataatggatttagagaaacgtcatgtcttgggcaggctaataacagtaaacccaatagttacggagaaagactctccggttaacattgaagcggaaccaccgtttggggatagttatataataataggagtagaacctgggcagctaaaactcaattggttcaagaaaggttcgtctataggtcagatgttcgaaacgacaatgagaggagcgaaacggatggcgattttgggagatactgcatgggatttcggaagtctcggaggggtattcacatcaattggaaaagctctacatcaagtctttggcgccatatatggggcagcattttcgggcgtcagttggacaatgaaaatactcatcggggtaataataacatggatcggcatgaatagccgcagcacgtcgttatcagtatcgttggtgttggttggcgtcgtaactttatatctaggagcgatggtgcaagcagacagtggatgtgtggttagttggaaaaacaaagagctaaaatgtggatctggaattttcatcacagataacgtgcatacatggaccgagcaatataagttccaaccagaaagcccatccaagttggcgtcagccatacaaaaggcacatgaagagggtatctgtggaattaggtcagtgacaagattagaaaacttaatgtggaaacaaataacgcctgagcttaaccatattttgtcggagaatgaagttaagttaacaataatgacaggggatataaaaggaataatgcaagccggaaaacgatcactaagaccacaaccaaccgaattaaaatattcatggaaaacttggggaaaggcaaagatgctatcaaccgaatcacataatcaaacatttttaatagatggccctgagaccgcagaatgtccaaacacaaacagagcatggaacagcttagaagttgaagactatggttttggggtattcactactaatatatggttaaagttgcgagaaaaacaggatgtattctgcgactctaagctcatgagcgcagccataaaagataatcgagcagttcatgctgatatgggatactggatagaatctgcgcttaacgatacctggaagatggaaaaagcgtcgttcattgaagtcaaatcatgtcactggccaaagtcacatactctgtggtcgaacggcgtattagaatcagaaatgatcatccccaaaaatttcgcaggaccggtgtcacaacataattataggccaggctatcacactcaaactgcggggccttggcacttgggcaaacttgaaatggattttgatttctgcgaaggcacaactgttgtggtaacagaggactgtggaaacagaggaccaagtctgcgtaccacaacggcatcgggtaaattaataactgaatggtgttgccggagttgtactctcccaccactcaggtatagaggtgaagatgggtgttggtacggcatggaaataagacccctgaaagaaaaagaagaaaatctggttaatagtctagtcacagcaggacatggacagattgacaatttttccttaggagttttaggaatggcattatttcttgaagaaatgttaagaacacgagtcggtactaaacatgcaatacttttggtagcagtaagttttgtgacccttataacaggaaatatgtcgtttcgcgacctagggagagtcatggtgatggtcggcgttactatgacggacgatattggaatgggagtcacatatttagcattactggcggcctttaaagtaagaccaactttcgcggcaggattattactcaggaaactaacttcgaaggaattaatgatggccacaatcggaattgcgctgctctctcaaagcactattcctgagacgatccttgaactcacggatgcacttgcattaggaatgatggtactgaaaatcgtccgaaatatggaaaagtatcagcttgccgtaacgatcatggcaatatcatgtgtaccgaatgcagtgatactattaaacgcatggaaggtttcctgtacaatcctcgcagcagtaagtgtaagtccacttcttcttacaagttcacaacagaaaaccgattggattccgttggcattaacaataaagggattaaatccaacagctatatttttaacaacattgtcaaggacgtctaagaagcgaagttggccgttaaatgaagcagtcatggcggttggaatggtctccattctagcaagtagtctgcttaaaaacgatatacctatgacaggaccattggttgcaggagggttactgactgtctgttacgtattaacgggccggagtgctgatttagaattggaaagggcggcggacgttaaatgggaagaccaagccgagataagcggatcctcaccaatactatcgattactatttcagaagatgggagcatgagcattaaaaatgaagaggaagaacagacgttaactatcttaatacgtacagggttgttagtaatcagcggagtttttccagtaagtatcccaataactgcggcggcctggtatctgtgggaagttaagaaacaaagagctggagtattatgggatgttcctagtccacccccagtagaaaaagcagaattggaagatggcgcttatcgaattaaacagcgtggaattttaggttattcgcaaataggtgcaggagtttataaggagggaacttttcacacaatgtggcatgtaactcgaggagctgttttgatgcacagaggaaaacgtatagaaccgtcttgggcagacgttaagaaagacttaatatcatacggaggaggatggaaactggagggtgaatggaaagaaggggaagaggtacaagtcctcgcgttagaacctgggaaaaatcctcgtgctgttcagacgaagccagggttgtttaaaacaaacacagggacaataggggcagtaagtcttgatttttctcctggaacgagtggttcgccaatagttgatagaaaaggaaaggtcgtcggattatacggaaatggagtggtaactagatcaggagcatatgttagcgcaatcgctcaaactgaaaagtctatcgaagataaccccgagatagaagatgacatctttcgcaagaaaagactaacaataatggatttacacccaggagcaggcaaaactaagaggtacctacctgcaatagtgagggaagccatcaaaagagggctaagaacgttgattctagcgcctacccgagtagtagcagcagaaatggaggaggcgctacgaggcttacctatacgctaccagactccagccattagggcagaacacacagggagggaaatagttgacttgatgtgtcatgcaactttcacaatgcgcttactatcaccagtaagagtgcctaattacaatttgattatcatggatgaagcacattttaccgatccagcctcaattgcagctagaggttacatatcgacgagagtcgaaatgggagaagcagccggcatatttatgacggccacaccccctgggtctcgagatccttttccccaaagtaacgcgcctataatggatgaggaaagagaaatccccgaaaggagctggaatagtggccatgaatgggttaccgatttcaagggcaagactgtttggtttgttccatctataaaagctggtaacgacatcgcagcatgtttgagaaagaatggcaagaaagtgatacaactatcacgtaaaacatttgacagtgaatacgttaaaactagggcaaatgactgggacttcgttgtaacaacagacattagcgaaatgggtgccaattttagagctgaacgagttatagatccacgaagatgtatgaaacctgttatactaaccgacggcgaagaaagagtaatacttgcaggaccgatgccggtaacacattcaagcgcagctcaacggaggggtcgcataggtcgaaaccccaaaaatgaaaacgaccaatacatctacatgggggaaccactggaaaatgacgaagactgtgcacactggaaagaagcaaaaatgctcctcgataacatcaataccccagaaggcatcataccttcgatgttcgaacctgaacgtgaaaaagtagatgctatcgatggtgagtatagattacgtggagaagctaggaaaacattcgtagatctcatgaggcgtggagatttacctgtatggctggcctaccgcgtggcggccgaagggatcaactatgctgatagaagatggtgttttgacgggatcaaaaataaccaaattttggaagaaaatgttgaagtagagatatggacaaaagaaggagaaaggaagaaactcaaaccgagatggctggacgcacgaatctactccgatccattggccttaaaagaatttaaggagttcgctgccggacgtaaatccttaactttgaatttgatcaccgaaatgggacgattacccacctttatgacacagaaagcgcgtgatgccctggataatctagcagttctacacacagctgaggctggtgggagagcatataatcacgcgttgagcgaactcccagaaaccctagaaacactcctacttctaactcttctggcaactgtaacgggaggcatattcctcttcctaatgtctggaaagggtatcggcaaaatgactctggggatgtgttgcatcataaccgcgtctattttgttatggtacgctcaaattcaaccacattggattgcagcatctattatattggagtttttccttatagttctgctgattccagaacctgaaaaacaaagaacaccacaagataatcaattaacatatgtggtaatcgcgatattgacggtagtggccgctacaatggcgaatgaaatgggattcctagagaaaacgaagaaagatttaggtctggggagtattactacccaagagtccgagagcaacatcttagatatagatcttagaccagccagcgcatggacactatacgcagtagcaactacatttgtaaccccgatgttacggcactcaatagaaaatagctctgttaacgtatcattaacagctatagcaaaccaagctaccgtattaatgggactgggcaaaggctggcccttgtcaaaaatggatatcggggtcccattgttagcgattggttgttattcacaagtgaatcctatcactctaacggcagctttattactgctcgtagcgcactatgctattataggtccgggactacaagctaaagctactcgagaagcccaaaaacgagctgcagcggggattatgaaaaatccaaccgttgatggtattactgtaatagatctagaacccataccatatgatccaaaatttgaaaagcaattagggcaagtaatgttgctgatactttgcgtcacacaagttttaatgatgcggacaacgtgggccctatgtgaggctctaacacttgcaacaggaccaattagtaccctatgggaagggaatccaggtcgtttctggaacacaacaatcgcagtatcaatggcgaatatttttaggggatcctatctagccggtgccggattattgtttagtatcatgaaaaataccactaacaccagacgaggaacaggaaatataggcgaaaccttaggcgagaaatggaaaagtcgcttaaatgctttggggaagagtgagtttcaaatatataagaaatcaggcatacaagaggtagacaggacactagctaaagaaggaataaaacggggagaaactgatcatcacgcggtgtcgagaggcagtgcaaagctgagatggtttgtagaacgaaatatggtcactccagaaggaaaagtagttgatttaggatgcgggcgaggcggctggtcttactattgcggaggtctcaaaaacgttcgagaagtaaaaggacttacgaagggtgggcccggtcacgaagaaccaattccaatgagtacttacggttggaatttagtgagattacaaagcggcgtagatgtgttctttaccccgcctgaaaaatgtgacacgcttttatgtgacataggagagtcctcacccaatccgacaattgaagctggtcgtactttacgtgtcctcaacttggtcgaaaactggttaaataataatactcaattttgtatcaaagtacttaacccctatatgcccagcgttatagagaaaatggagactttacaaagaaaatatggaggtgctctagtcagaaaccccttatcacgcaacagcactcacgagatgtactgggtatcaaacgctactggaaatatagtgtcttcagtaaatatgataagccgaatgctgataaacagatttacaatgaaacataagaaggcaacatatgaacccgatgtagacttgggaagtggtaccagaaatataggaattgagagcgaaatccccaatttagacattataggtaaacgtattgagaaaataaaacaagaacatgaaacgtcatggcattacgatcaagatcatccctataaaacgtgggcataccatggatcttacgaaactaaacaaacaggctcagctagctccatggtaaacggcgtagttagactgctaactaagccgtgggatgttgttcccatggtaacccaaatggctatgacagacacaacaccgtttgggcaacaaagggtattcaaagagaaggtagatacaagaactcaagaacctaaagaaggtaccaagaaacttatgagaataacagcagaatggttatggaaggaattgggcaagaagaaaactccgagaatgtgcactagagaggagttcactcgaaaagttagaagcaatgcagcgctgggcgccatttttactgatgagaataaatggaagtcagctagggaagcagtagaagatagtcgtttttgggaattggtagatagagagagaaatttacacctcgaaggtaaatgtgagacctgcgtctataacatgatgggtaaaagagaaaagaaactcggagagttcggcaaagccaagggctcccgtgctatttggtatatgtggcttggggcccgctttcttgagttcgaagctctaggatttctgaatgaggaccattggttctcacgcgggaactctttaagcggagtagaaggtgagggtttacacagattgggatatatactacgagacgttagcaagaaagaaggaggggccatgtatgctgatgatacagctggatgggatacaagaataacattagaagatttaaagaacgaagaaatggttacaaatcatatgaagggcgagcataagaaacttgcggaagcgatttttaaacttacgtatcaaaataaggtggttagggtgcagaggccaacgcctagaggaacagttatggacatcatctctcgaagagatcagcgaggaagcggtcaagtgggcacctatggtttaaataccttcacaaatatggaggcgcaacttattcgtcagatggaaggagagggcatttttaaaagtattcaacacctgaccgttactgaggagatcgctgttcaaaattggcttgcacgcgtgggaagagaaagattgagtagaatggctataagcggcgacgattgtgtcgtaaaacctctcgacgacaggtttgcgagcgcattaacggctttaaatgacatgggtaaggtgaggaaggatatacagcagtgggaaccgtcacgcggatggaacgattggacccaagtccctttttgttctcaccattttcatgaattggtaatgaaagatgggagagtgcttgtcgtaccatgtagaaatcaggacgaattaatcggccgagcaaggatatcccagggggcgggatggtctttaaaggagaccgcttgtttggggaaatcgtatgcacaaatgtggactctcatgtatttccatcgaagagatctgcgtttggctgcaaatgctatatgctcagcagtacctagccactgggttcctaccagtagaaccacatggagcattcatgctaaacatgagtggatgaccacggaagacatgttggcggtatggaatagagtatggatacaagagaatccttggatggaagacaaaactccagtagaaagttgggaagaagtgccctatttaggaaaaagagaagatcaatggtgcggatcattaataggccttacaagtcgagctacgtgggcgaaaaacatacagacggcaatcaaccaggtacgaagtttaataggaaacgaagaatataccgattatatgccctctatgaaaaggttccggcgtgaagaagaagaagcgggagtactttgg

SEQ ID NO: 22901 - RNA, 9873 nt, synthetic construct
  misc_feature 1..9873: note = derived and/or modified CDS sequence (opt6) from DENV-2__HQ012533__SS-prME
  source 1..9873: mol_type = other RNA
acagcaggagtaatcattatgctgataccgaccgctatggcctttcatttgaccacaagaaatggggaaccacatatgatagtaggacgtcaagaaaaaggaaaatctttattattcaaaactgaagatggtgttaatatgtgcacattgatggcaatagacttaggagaactttgcgaagataccataacgtataaatgtccactccttagacaaaatgaaccggaagacatcgattgctggtgtaactcaacaagtacctgggtaacatatggtacttgcacaacgacaggtgaacacagaagagaaaaacgctcagtcgcactggttccacacgtgggaatgggtttggaaactagaactgaaacctggatgtcatcggaaggtgcgtggaaacatgtgcaacggatcgaaacatggatattgcgacatccgggcttcgccataatggctgctattttggcttacacaatcgggaccacccatttccaaagggcattaatcttcattttattaacagcagttgccccgtcaatgaccatgagatgtatcgggatatctaatcgagattttgtcgaaggagtatctggtggttcatgggttgatatagtactggaacacggatcctgcgttacaacaatggccaaaaataaaccaacgcttgactttgaattaattaaaactgaagcgaaacaaccagcgacattaagaaaatattgtatcgaagccaaattaacaaatactacgacggaaagtcgctgcccgacacaaggagaaccatcccttaatgaagaacaagacaaaagatttatttgcaaacattccatggtagatcgaggttggggaaacgggtgcggtttatttggtaaaggaggaatagtaacatgcgcaatgtttacatgtaagaaaaatatggaaggtaaagttgtattacccgaaaatttggaatacacgattgtcattacaccgcattctggagaggaacacgctgtaggtaatgatactggcaaacatggagaagaaataaaaatcactcctcaaagtagcataacagaagcagaactaactggttatgggacagtgaccatggagtgcagtcctcgcactggactagattttaatgagatggtacttctccaaatggaggaaaaagcgtggctcgtacacagacaatggtttctagatcttcctctaccttggcttcctggcgccgatacccaaggtagcaattggatacaaaaagaaacattagtaacattcaaaaatccacatgcgaagaaacaagacgtagttgtccttggaagtcaagaaggggcgatgcatacggcactaacaggagcaactgaaattcaaatgagctccggaaatctgttatttactggtcatctgaaatgcaggctaaggatggataaacttcaactaaaaggaatgtcatatagtatgtgcactggcaaatttaaaatcgtcaaagaaatagcagaaacacaacatggaacgatagttataagggttcaatatgagggggatggctcaccttgtaaaatcccattcgaaattatggacctagaaaaacgtcatgtccttggacgactaataacagtgaatccgatagttacagaaaaagattctccggttaacatagaagccgaaccaccattcggcgatagttatataataataggggttgagcctggacaattaaaattgaattggttcaagaaaggcagttcgatcggtcaaatgttcgaaacgacgatgcgtggtgcaaaacgaatggcaatacttggcgacacagcgtgggactttggaagtttgggtggcgtatttacttccataggcaaggcactgcaccaagtattcggtgcgatatatggcgctgcttttagcggggtctcatggacaatgaaaattttaataggagtaatcataacttggataggaatgaactctagaagtacttccctttcagtatctttagtcctagtcggagtggtaacgttatatttaggggcaatggtgcaggcagattctggatgcgtagtttcatggaagaacaaagaactaaaatgcggctccggtatctttataaccgacaacgtccatacctggaccgaacaatacaaatttcaaccggaaagtccttcaaaattagcctcagctatacaaaaggcacacgaggaagggatctgcggaataaggagcgtgacacgcctggagaatctaatgtggaaacaaattacgcctgaattaaatcatatactcagcgaaaatgaggtaaaacttaccataatgaccggagacataaaaggaattatgcaggcaggtaaacgctccctaagacctcaaccaactgaattaaagtactcgtggaaaacatggggaaaagccaaaatgcttagcacagaatcacataatcaaacatttctaatagacggaccggaaacggcagaatgtccaaacacaaatagagcttggaactcccttgaagtggaagactatgggtttggcgtgtttacaactaatatctggttaaaacttagagaaaagcaggacgtattttgtgacagtaaactcatgagcgcagcaattaaggataatcgagcagtccatgccgacatgggctattggatagaatcggctttaaacgacacctggaaaatggaaaaagcatcgttcatagaagttaagtcatgccactggcccaagtcacacacactatggagcaatggtgtgttagaatccgaaatgattataccaaagaatttcgcaggtcctgtttcacagcacaactataggccaggataccacacgcagactgccggaccctggcacctcggaaaactcgaaatggattttgatttttgtgaagggacaacggtggtagtcacggaagactgcggtaaccgcggcccttctcttcgcacaactaccgctagtggaaaacttataaccgaatggtgctgtcggtcgtgtacgctaccacctcttcgatacagaggcgaagatggttgttggtacggaatggaaataagaccgcttaaagagaaggaagaaaacttggtcaactcgctcgttacagcaggtcacggacaaattgataatttttcattaggcgtattaggcatggccctatttttagaagaaatgttaagaaccagggtaggaacaaagcatgcaatattattggtagctgtatctttcgtcaccctcattacgggcaacatgtcgtttagggacctaggccgggttatggtgatggtaggagtaactatgacagacgatattggtatgggtgtaacctatctggcattgttggcagcatttaaagtgagaccgacatttgcagccggtctattgctgagaaaacttacttccaaagaattaatgatggccacaataggaatagcactcttaagtcaatcaacaataccagaaacgatattggagctaaccgatgctttagctttggggatgatggtccttaaaatagtacggaacatggaaaagtaccagctggctgtcactataatggcaatttcctgcgtccctaacgcagttatacttctaaatgcctggaaggtgagttgtaccatcctagccgctgtttcagtatccccactactgcttacgtcctctcaacagaaaactgactggatacctttagctttaactataaaaggattaaatcctacggcaatttttcttacaaccttatctcgaacaagcaagaaaagaagttggccactgaatgaggcagtcatggcggtcggaatggtcagcatactagcttcaagccttctgaaaaacgacattcctatgactggacctctagttgccggaggtctactaacagtttgttatgttctaactggacgaagtgcagacctcgaattggagagagctgccgacgtaaagtgggaagaccaagcagagatctctggatcaagtccaatcttatcaataacaatatcggaggacggttcaatgagtattaaaaacgaagaagaggaacaaaccttaactattttaataagaacaggattgctggttattagtggcgtttttcctgtgtccatcccgataacggccgctgcttggtatttatgggaagtcaagaaacaaagagctggtgtcctatgggacgttccaagcccaccacctgtaggaaaagccgagctagaagacggagcataccgaataaaacagcgaggaatacttgggtactcgcaaataggtgctggtgtttataaagaaggaactttccacacaatgtggcacgttactaggggcgccgtgttaatgcatcgtggcaagcgtatagaaccttcatgggcagatgtcaagaaagaccttataagctatggaggaggatggaaattagaaggtgaatggaaagaaggggaggaagttcaggtattggctttagaaccgggcaaaaacccacgagcggttcagactaaacctggtttatttaaaactaacactggtacgatcggcgctgtatctctcgatttcagtccaggaactagcggctcacctatagtagatagaaaagggaaagtcgtaggtctatatggaaatggagttgttacccgaagtggtgcctacgtatcagcgatagcacaaacagagaaaagtatagaagacaatccggaaattgaggatgacatctttaggaagaaaaggcttacgataatggatctacatccaggcgccggtaaaacaaaaagatacttacccgcaatcgttagagaagctatcaaaagaggccttcgtacattaatccttgcaccaacgcgtgtagtcgcagcagaaatggaggaagcattacgtggattacctatacgctaccagacaccagccattagagcggaacacacagggagagagattgtggacctgatgtgccatgccacattcacaatgagactgctcagtcctgtacgggtacctaattacaaccttataattatggacgaagctcactttactgatccagcatctatagcggctcgaggatacattagtacacgtgttgaaatgggtgaggcggctggaatctttatgactgcgacaccacctggctcgagggacccattcccgcagtcaaatgcaccaatcatggacgaagaacgggaaattcccgaaagatcctggaactctgggcacgaatgggtaacagacttcaaaggtaagactgtttggttcgtgcccagtatcaaagccggaaatgacattgcggcatgtcttaggaagaatggtaaaaaggtaattcagctctctcgaaaaacattcgattcggaatacgtaaaaacacgagccaatgactgggacttcgtggtcacaacggatatttccgaaatgggcgcgaactttagggcagaacgcgtgatagacccaagacgttgtatgaaacctgttattcttacggacggggaggaacgcgttatccttgcaggaccgatgccagttacgcatagcagtgcagcacaaagaagaggtagaattggtcggaatcccaaaaatgaaaacgatcagtatatttacatgggcgaaccacttgaaaacgatgaggattgtgctcactggaaagaggccaaaatgttacttgataatataaatacacccgagggaataataccttcaatgttcgaaccagaacgggagaaagtcgacgcgatagatggtgagtatagactccgcggagaggcccgaaagacttttgttgatttaatgaggcgaggagacctacctgtctggttagcatacagggtagcagccgaaggtattaactatgccgatagaagatggtgctttgatggaattaaaaataatcaaattttagaggaaaacgtggaagtagaaatttggaccaaagagggtgaaaggaagaaactaaaaccccgttggcttgacgctagaatctactcagatccgcttgccttaaaagaatttaaagaatttgcggcaggccggaaatcattaactcttaatttaataactgaaatgggtaggttgcctaccttcatgacccaaaaagctcgagatgcactagataacttagctgttctccataccgcagaagcaggaggtcgggcatataatcacgcattaagcgaactgcccgaaacactagaaacacttctacttctaacactcttggcaacagttacaggtggaatatttctatttttaatgtctggaaagggaattggcaaaatgacactcggaatgtgttgcatcataactgcttcgattctgctgtggtacgcgcaaatccaaccacattggatagccgcgagtattatactcgaatttttcctgatagtcctactaattcctgaacctgaaaaacaaagaacgccacaagacaatcaattaacctatgtagtcatagccatactcacggtagttgcagcaacaatggccaacgaaatgggatttttggagaaaaccaaaaaggatttgggattgggcagtattactacacaggaatctgaaagtaatattctggacattgacttacgccctgcaagtgcctggactttatatgcggtagccactaccttcgtcacaccaatgctccgtcatagtatagaaaacagtagcgtaaatgtatcgctgaccgctattgcaaatcaagccacggtactgatggggttaggaaaaggctggccacttagtaaaatggacattggcgtacccctactagcgataggttgctatagccaagtaaaccccatcacattgactgcggccctcctgctattagtagcacactatgcaataatagggcctggtttacaggctaaagcgaccagggaagcgcagaaaagagcagcggcaggaattatgaaaaacccaaccgtagatggaataacggtgatagatttagaaccaattccatacgaccctaaattcgaaaagcaactgggccaagtaatgttacttatattgtgtgtaacccaagttctcatgatgcgtacaacatgggccctatgtgaggctttaacactagctacggggcctatctctacactgtgggaaggcaatcctggacgattctggaatactacaattgccgtatcaatggcaaatatctttagaggttcgtacctggctggtgcaggcctgctattttctatcatgaaaaacacaactaatactcgccggggaaccggtaatataggagaaactttgggcgaaaaatggaaatctagacttaatgcactaggaaaatctgaatttcaaatttataagaagagtgggatccaagaagtggacagaacactagccaaagagggaataaaaaggggcgaaaccgatcaccatgccgtttcgagaggtagtgctaaattaagatggttcgtagaaagaaatatggtaacaccggaagggaaagtagttgatttaggatgcggaagaggaggatggagttattactgtgggggtctaaagaacgtgagagaagtcaaaggactgacaaaaggagggcctggccatgaagaaccaatacccatgagcacgtacggatggaatcttgtaagattgcaaagtggcgtcgatgtattctttacaccacccgaaaaatgcgatacgctactttgcgacataggagaatcatcgccaaacccaacaatagaagcaggaagaactctacgggtgcttaacttggtagagaactggttaaacaataatacccaattttgcataaaggtgttaaacccttacatgcccagcgtaatagagaaaatggaaacgttacaaagaaaatatggaggtgcgttggtccgtaatccattatcccgaaacagtacacacgagatgtattgggtatctaatgccacaggcaatatagtttcatcagttaacatgataagccgaatgctcattaataggttcacaatgaaacataagaaggcaacctatgaaccagatgtcgacctaggatcaggcacaagaaatataggcattgaatcagaaataccaaatctcgacataataggaaaaagaattgagaaaatcaaacaagagcatgaaacaagctggcactatgatcaagatcatccatacaaaacttgggcctaccatggttcatatgagacaaagcaaacgggtagtgcctcttctatggtaaatggagttgttcgtctactaactaaaccatgggatgtagtgccaatggtaacacagatggctatgacagacacaaccccatttggccagcaaagggtattcaaagaaaaagtagacacacgaacacaagagccaaaggagggcacgaaaaagctcatgagaataactgccgaatggctatggaaagaacttggaaagaagaaaaccccgagaatgtgcacaagagaagagtttactagaaaagttagaagcaatgcagcattaggggcaatttttacggacgaaaacaaatggaaaagcgccagagaagcagtagaagattctcgtttctgggaattagtggaccgcgaaagaaatctccatttagaaggcaaatgtgaaacctgtgtatataatatgatggggaaaagagaaaagaaactcggagaatttggaaaagcaaaagggtcacgagcaatttggtatatgtggctaggagcgaggttcctagaatttgaagcgctgggatttctaaacgaagatcactggttttctcgtgggaatagtctaagtggggtagaaggggaaggattacatcgtctgggttacattctgcgtgatgtcagcaagaaagaaggaggtgcaatgtatgccgacgataccgccggatgggacacaagaataactctcgaagatcttaaaaacgaagaaatggttacgaatcatatgaaaggagaacacaagaaactagctgaagcgatattcaaactaacgtatcaaaataaagtagtacgtgtgcaacgcccaacgccaaggggaacagtcatggacataataagtagacgagaccaacgagggagtggacaggtaggcacgtacggtttgaatactttcacgaacatggaagctcaattgatacgacaaatggaaggtgaaggaatctttaaatccatacaacatcttacggttacagaagaaatagcagtacaaaactggttagcacgagttggaagagaaagattgagccgaatggcgatatctggggacgattgcgtagtaaaacctctagatgatagatttgcatcagctttgactgccttgaatgacatgggaaaggtgagaaaggatatacagcaatgggaaccctcacgaggatggaatgactggacacaagtacctttttgctcgcaccattttcatgaattggtgatgaaagacgggagagtcttagtagtgccgtgcagaaaccaggatgaattaattggcagagcaagaatatcacaaggagccggatggagtttgaaagaaacagcctgtttaggcaaaagctacgctcagatgtggacattaatgtattttcataggagggatctaagactggctgcaaacgcaatatgcagcgcagtacctagccattgggtacctacgtcgcgaacaacttggagcatccatgctaaacatgaatggatgactactgaagacatgttggctgtttggaacagagtatggatccaagaaaatccctggatggaggacaaaacacccgtagaaagttgggaagaagtgccttatctcggtaagagagaagatcaatggtgtggttcacttataggcttaacaagcagagcaacgtgggcgaaaaatatacagactgccatcaatcaagtaaggagcctcatcggaaatgaagagtacaccgactatatgccgtccatgaagcgattcagaagggaggaggaggaagcaggcgtcctatgg

SEQ ID NO: 22902 - RNA, 9873 nt, synthetic construct
  misc_feature 1..9873: note = derived and/or modified CDS sequence (opt6) from DENV-2__HQ012534__SS-prME
  source 1..9873: mol_type = other RNA
acagcgggtgtgattattatgttaatacctacagcgatggcatttcatcttacgactaggaatggtgaacctcatatgattgtgggtaggcaggagaaaggaaaatcacttctttttaaaacagaggatggtgttaatatgtgcactcttatggcaatagacttaggtgagctttgcgaagacaccattacgtacaaatgtcccttactacgtcaaaatgaacccgaggacatagattgctggtgcaactctacgtccacatgggtaacatacggaacttgtactacaactggggaacacaggagagaaaaacgctcagtagcattggtaccccacgtcggaatgggtttagaaactcgcaccgagacttggatgagttcagaaggagcatggaaacacgtacaacgaatagagacttggattttaaggcatccaggatttgcaataatggcggccatactagcctacacaataggtacaacgcacttccagagggcactaatattcattttgctaactgctgtagcaccgagtatgacaatgagatgtataggaatatccaatagagatttcgttgaaggagtatctgggggatcatgggtagatattgtactagaacacggatcctgtgttacaaccatggctaaaaataaacccactctagactttgagctaataaaaacggaagcaaaacagccagcaactttaagaaaatactgcatcgaggcaaaactaactaacaccacaacggaatctagatgcccaacccaaggcgagcctagtttgaatgaggaacaagacaaacgattcatttgcaaacactcgatggtagatagaggatggggaaatggctgcggtctatttggtaaaggaggaattgtaacctgcgccatgttcacttgtaagaaaaatatggaaggtaaagttgtattaccagaaaaccttgaatatacgatcgtaattacccctcactcaggtgaagaacacgcagtcgggaatgatacaggaaaacatggggaggagataaaaataaccccgcaatcatcgattacagaagcggaattgactggctatggtacagttactatggaatgttctcctcgaaccggacttgactttaatgagatggttttgctacaaatggaagaaaaagcatggctggtacacagacaatggtttctggatcttccattaccatggctgccaggggctgatacacaagggtcaaactggatacaaaaagaaacacttgtcacattcaaaaatccccatgctaagaaacaggatgttgtggtactgggcagtcaagaaggagcaatgcatactgcactgacgggcgcaacggagatacagatgtcttcaggtaatcttctatttacgggacacttaaaatgtagattgcgaatggacaaactacaattaaaaggaatgtcatatagtatgtgcaccggcaaatttaaaatagtgaaagaaatcgcagagacacaacatggtacaattgtgatacgtgttcaatatgaaggagatggctccccatgtaaaataccatttgagattatggatttagagaaacgacacgttttaggcagattaattactgtaaacccgatagtgacagaaaaggacagcccagtcaacatagaagcggaaccaccattcggtgatagttatataataatcggtgtagaaccaggacagcttaaattaaattggttcaagaaaggatcaagcataggtcagatgtttgagacaacaatgagaggggcaaaaagaatggccatactgggggacacagcatgggactttggaagtcttggaggagtttttacatcaataggtaaagcactgcaccaagtatttggcgctatctatggagctgcattcagtggcgtgtcttggaccatgaagattttgataggagttataatcacttggattggcatgaatagtagatctacctcactgtccgtgtcgttggttctagtaggggtagttacattgtacttgggagctatggtacaagctgattcaggatgtgttgtaagctggaaaaataaagaattgaaatgtggctctggaatattcataaccgataatgtccatacgtggacggaacagtacaaatttcaaccagaatctccgagcaaactcgcctcggctatccaaaaagcacatgaagagggaatatgtggaataagatcggtaacacgattagaaaatctaatgtggaagcaaataacaccggaacttaaccatatattatccgaaaacgaagtaaaattaaccataatgaccggagatataaaagggataatgcaagcgggaaaacgctcattgcgtccacaacccactgaattaaaatactcatggaaaacatggggaaaggctaagatgttatcaaccgagagccataatcaaacctttctcattgacggtcccgaaactgccgaatgtccaaatactaatcgagcctggaactcattagaagttgaggactatggtttcggtgtatttaccacaaatatttggttaaaactgagggagaaacaagatgtattctgtgacagtaaattaatgagtgcagccatcaaagacaatagggcagtacatgcagatatgggatattggattgaaagcgctttgaatgacacatggaaaatggagaaggcatcattcatcgaagtaaaatcttgtcactggccaaagagtcatactttgtggtctaatggggttttagaatcggagatgataattcctaagaatttcgcaggcccggtcagccaacacaattaccgacctggttatcatactcaaacggcaggtccttggcatttgggcaaattagagatggactttgacttctgcgaaggtactaccgtggtggtcacagaagattgcggcaatagaggaccctcactacgaacaacaacggcatcagggaaattaattacagagtggtgctgcagaagttgtactttaccacccctaaggtatagaggagaagacggatgttggtatggaatggagatcagacctttaaaggagaaagaggaaaatttggtaaattctttggttacagctggtcatggacagatagataattttagtctcggtgtacttgggatggcattatttctcgaggagatgttacgaacgagagtgggcacaaagcatgcaatactgctggtagccgtttccttcgtaactctaattacggggaacatgagctttcgagatcttggtagggtcatggtaatgctaggcgtgcctatgacagatgatataggtatgggagtgacatatttagcgttattggctgcatttaaggtgagaccgacctttgccgccggtctactactacgcaaacttacttccaaagaattaatgatggcgacgattggcattgcattactatcacaaagcaccataccagagaccatactagaattaacagatgcacttgctttggggatgatggttttaaaaattgtccgaaatatggagaaatatcaattggccgttacgattatggcaatatcatgtgttcctaacgcagttattttacttaatgcatggaaagttagttgtacaatactagccgctgtatctgtatcacctttactattaacatcttcacaacagaaaacagactggattccattagctttgaccataaaaggcttaaatcctacggcgatattccttaccaccttaagcaggacatctaaaaagcggtcgtggcctctaaatgaagccgtaatggctgtcggaatggtgagcattcttgcgtcgtcacttctcaaaaatgatattccgatgactggtcccctggttgcaggcggtcttctaacagtctgttatgtattgaccggaagatcagcagatctggaactagaaagagccgcagacgtaaagtgggaggaccaagccgaaatatcaggatcatcgcctattttatcaataacaatctctgaagacggtagcatgtcaatcaaaaacgaagaagaggaacaaacgttaacaatattaataagaacaggcttactcgttatttcgggagtatttccggtcagcatcccaatcacagccgcggcgtggtatctatgggaggtgaagaaacaaagagccggtgtcttgtgggatgtaccttcacctcctccagtgggtaaagcagaattagaggatggcgcctatcgtattaaacaacgcggaatactcggttactcacaaatcggcgcgggtgtttacaaagaaggaacatttcacacaatgtggcatgtaactagaggagccgtactgatgcaccgaggtaaaagaatagaaccgtcatgggccgacgtcaagaaagacttaatatcatatggaggcggatggaaactagagggtgaatggaaggaaggggaagaagtacaggtgttagccctcgaacctggcaaaaacccaagagccgtgcaaacaaaaccgggcctatttaaaacgaacaccggtacaataggcgcagtatcactcgatttctctccaggtacatcgggttcgcctatcgtcgaccgtaagggaaaagtagttggtttatacggaaatggagtagtcactaggagtggtgcttatgtatccgctattgcacagaccgaaaagtcaatcgaagataatccggagatcgaagacgacatattcagaaagaaaagattaactattatggatttacatccaggagcaggaaaaacaaaaagatacttgccagcaatagtccgagaggctattaaacgaggcttaagaacactgatactggctcctacgagagtggtagcagccgagatggaagaagcactaaggggtctaccgatccgataccaaactccagccatacgagcggagcatactggcagggaaatagttgatctgatgtgtcacgccacctttacgatgaggctactaagcccagtcagagtacctaattataacttaataatcatggatgaagcgcatttcaccgacccagcatcaatcgctgcaaggggatacatttcgacaagagtagaaatgggcgaagccgctggcatattcatgacagctacacctccaggatcacgtgatcctttccctcaatccaatgcaccaataatggatgaagaaagggaaatacccgaaagatcctggaactcaggacacgaatgggtaacagactttaaaggcaaaacagtgtggtttgtaccatctataaaggcagggaacgatatagcggcctgccttaggaaaaacggtaagaaagtaattcagctctcaagaaagacatttgattcagaatatgtaaagacaagggctaacgactgggattttgtagtgactaccgatatttcggagatgggggcaaactttagagccgaacgagtcatcgacccgaggcggtgtatgaagccagttatattaacagatggagaagaacgtgtgatactagccggccctatgcccgtaacgcattctagtgcagcgcaacgaagaggaaggattggtagaaacccgaaaaacgagaatgaccaatatatttatatgggcgaacctttagaaaacgatgaagattgtgcacattggaaagaggccaagatgttgttagataatatcaataccccagaaggtataattcccagcatgtttgagcctgaacgtgaaaaagtggatgcaattgacggtgaatacagactgagaggcgaagcaagaaagacttttgtagacctaatgcgcagaggtgacctcccagtatggttagcgtatagggtagcagctgaaggaataaattacgcagacagaaggtggtgctttgatggtatcaaaaataatcaaatactggaagaaaatgtagaagtggaaatatggactaaagaaggggaacgcaaaaagttaaaaccgagatggctagacgcccgaatatattcggatcctctagcactgaaagaatttaaagagttcgctgcagggcgtaaatccttgacgcttaatctaatcactgaaatggggagattgccaacattcatgactcaaaaagcacgagacgccctagataacttggcagttctgcatactgcggaagcgggaggacgtgcatacaatcatgcactcagtgaattgccagagacactcgaaacccttttgctactaaccctattagcaacggtgacaggaggaattttcttatttttaatgtccgggaagggtataggaaaaatgacgctgggaatgtgttgcataataactgcaagtatattactatggtatgcacaaatccaacctcattggattgcagcgagtatcatattagagttctttttaatagtattgttaattcctgaacctgaaaaacaacggacaccacaggacaatcagctcacctatgtcgtaatagcaatcctaacagttgttgctgccacaatggcaaatgaaatgggcttcctagaaaagactaaaaaggacctggggttaggatcaattacaacccaagaatcagaatccaatatattggacatagacctacggcccgcatctgcttggacgctctatgcagttgcgacaacattcgtgaccccaatgctaagacattcaattgaaaattctagcgttaacgtatcactaactgcaattgctaatcaggccacagttcttatgggacttgggaaaggctggccactatctaaaatggatataggggttcccctcctagcgataggatgctattctcaggtaaacccgataacactaactgcagcattattactcttggtcgcacactacgcaataataggtccaggcttacaagccaaggcaacaagagaagctcagaaacgagcggcggctggcataatgaaaaatccaacagtggacgggataacggtgattgacttggaacccataccatatgatccaaaattcgaaaagcaattaggccaagtgatgctactaattttatgcgtaacacaagttcttatgatgcgcaccacgtgggcactatgcgaagcgttaaccctggcgacaggaccgatatcgaccctgtgggaaggcaatccaggacgattttggaacacaactattgctgtgagtatggcaaatatttttagggggtcctacctcgcgggtgcaggccttctattcagtattatgaaaaacacaaccaacacaagaagggggacgggaaacataggagaaacgctcggcgaaaaatggaaaagcaggctgaatgcacttggaaaatccgagttccagatatataagaagagtggaatacaagaggtcgatagaacattggcgaaagaaggaattaagcgtggtgagacagaccaccatgctgtttcaagaggttcagccaaactccgctggttcgtggaaagaaatatggttactcctgaaggcaaagtagtagatctcggctgtggaaggggagggtggagctactactgcggaggactcaaaaacgtacgagaggtaaaagggcttacaaagggtggacccggacacgaagaaccaataccaatgtctacttatgggtggaatctcgtaaggctacagagcggagttgatgtattctttactccaccagagaaatgtgacacgttgctatgcgacataggtgaaagctcaccaaacccaaccatagaagccggaagaacattaagggtgttgaatctcgtggaaaactggttgaacaacaacactcaattttgtataaaagtattaaacccttacatgccatcggtaattgagaaaatggagacgttacaaagaaaatacggaggagccttagtgcgaaacccgttatccaggaacagtacgcatgaaatgtattgggtcagcaatgcaacgggaaatattgtctcgtccgtcaacatgataagtcgaatgttaattaatagattcaccatgaaacataagaaagccacctatgagcccgatgtagatctaggatcgggaaccaggaacataggaatagaatcagaaattccaaatttagacattatagggaaaagaatagagaaaataaaacaggaacatgaaacttcctggcattacgatcaggatcacccttacaaaacttgggcataccatgggtcatacgaaacaaaacagaccggatctgctagctcaatggtcaatggcgtcgtcagattgttaacaaaaccttgggatgtcgtgccaatggtaacacagatggctatgactgatacaaccccatttggacaacagcgcgtatttaaggaaaaagtagacacaagaacacaagagccaaaggaggggaccaagaaactaatgcgaataacagctgagtggctatggaaagaactgggcaagaagaaaacgcctaggatgtgcaccagagaagaatttacaagaaaagttaggtccaacgctgcgttaggggcgatcttcacagatgaaaataaatggaaaagtgcccgagaagcggttgaggacagtagattttgggagctagtagacagagagagaaacttacacctagagggcaaatgcgagacatgcgtttacaacatgatgggtaagagagagaagaaacttggcgaatttggaaaagcgaaaggtagccgggctatatggtacatgtggcttggtgcacggtttctagagtttgaggcattaggatttttaaacgaagatcactggttttctagaggtaatagtctatcgggtgttgaaggagaaggactacacaggttgggatacatactccgagacgtaagtaagaaagaagggggagcgatgtatgcagatgacactgcagggtgggacacgagaataacattagaagacctaaagaatgaagaaatggttacaaatcacatgaaaggtgaacataaaaagttagctgaggcaatcttcaaactcacatatcaaaacaaagtggtacgagtacagaggcccacaccaagaggcacggtgatggatattatcagcagaagggaccaaaggggcagtggacaagttggtacatacggattaaacacgttcacaaatatggaggcgcaactcattcgtcaaatggagggtgaaggcattttcaaatccatacaacacctgactgttacagaagaaatcgcggtccagaattggctagctagagtaggccgagaaagactgtctcgtatggctattagcggcgacgattgtgtagtaaaaccactcgacgacagatttgcatcggcactaacggccttaaacgacatgggaaaagtaaggaaagatattcaacaatgggaacctagtcgagggtggaacgattggactcaagtgcccttttgttcacaccatttccacgagctcgtaatgaaggacggtcgagttcttgtagttccgtgtagaaatcaggatgagttaatcgggagagcgcgtatcagccagggcgcaggatggtcattgaaggagaccgcatgtctaggaaagtcatatgcccagatgtggaccctgatgtattttcacagaagagacttaagattagcagcaaatgcaatatgtagtgcagtaccgtcacattgggtacctacttcaaggacgacctggtctatacatgcaaaacatgaatggatgactacagaggatatgcttgctgtttggaacagagtttggatacaggagaatccctggatggaagataaaacaccggtagaaagttgggaagaagtgccatatctaggtaagagagaagatcaatggtgcggtagtctcattggacttacgtccagggcaacttgggctaaaaatatccaaacagcgatcaaccaagtaaggagcttaatcggcaacgaggagtatactgattacatgccaagtatgaaaagatttcgaagggaagaagaagaagcgggggtactatgg

SEQ ID NO: 22903 - RNA, 9873 nt, synthetic construct
  misc_feature 1..9873: note = derived and/or modified CDS sequence (opt6) from DENV-2__HQ012535__SS-prME
  source 1..9873: mol_type = other RNA
actgctggtgtcataataatgttaattcccaccgcaatggcattccacttgacaacgaggaacggagaacctcacatgatagtggggcgacaagaaaaaggaaaatcgttactgttcaaaactgaagacggagtcaacatgtgcactctaatggcgatagacctcggtgaattatgtgaggataccattacatataaatgcccactattacgacaaaatgagccggaagatatagactgctggtgtaactccacttcaacctgggttacatatggaacgtgtacaacgacgggtgaacatagaagagagaaacgctcagttgccttagtcccacatgtaggaatgggtctggaaaccagaacggaaacttggatgagcagcgaaggtgcatggaaacacgtccagagaatagaaacatggatattaaggcatccaggtttcgctataatggcagctatattagcatacactataggaactacgcattttcaaagagctctgatattcattttactgacggctgtggcacccagcatgacaatgcggtgcatcgggattagtaacagggattttgtagagggagtatctgggggaagttgggtagatatcgtactagagcatggatcttgtgtaacaacaatggctaaaaacaaaccaacgttagatttcgagctcatcaaaacggaagccaaacagccagcaactctgcgtaaatattgcatagaggctaaattaacgaacaccacgacagagagtagatgtcccactcaaggggaacccagtttaaatgaagaacaagataaaaggtttatatgcaaacattcaatggttgatcgtggatggggaaatggatgtggactatttgggaaaggaggaatagtaacatgcgcgatgttcacatgcaagaaaaacatggagggaaaagtagtacttccagaaaatctagaatacacaatagtaattaccccacatagcggcgaagaacatgctgttgggaacgatactggaaaacatggtgaagaaataaaaataacccctcagagttccataactgaagcggagttgacagggtatgggactgtgaccatggaatgctcaccacggacaggcttagacttcaatgaaatggtattactacaaatggaggagaaagcatggttagtacatcggcaatggtttctcgatcttccattaccttggctaccaggagcagacacgcagggtagcaattggattcaaaaagaaaccctagtaacatttaaaaatccccatgccaagaaacaggatgtcgtcgtcttaggtagccaagaaggtgccatgcatacagcattaacaggagctactgaaatccaaatgtctagcggtaatctgttattcacagggcatttgaaatgtcgcctaagaatggataaactccagttaaaaggaatgtcatattctatgtgtacaggaaaatttaaaattgtaaaagaaatagcagaaacacaacatggcactatagtcatacgagttcaatatgaaggagatggatccccgtgcaaaattccctttgagataatggatttagaaaaacgtcacgttttaggccggttaattacagtaaacccaattgtaactgaaaaagactcaccagtaaatatagaagcagaaccaccatttggtgattcgtacatcataataggcgtagaacctggacaacttaaactgaactggttcaagaaaggatctagcataggacagatgtttgaaacaactatgaggggcgctaaacgaatggcaatactcggcgacacagcctgggactttggatcattgggcggtgtatttaccagtataggaaaagcactacatcaagttttcggcgccatttacggtgcagcatttagcggtgtatcatggacaatgaagatactaatcggcgtaatcataacttggataggtatgaactccagaagcacgtctcttagcgtatcattagtcttagtaggcgtggtaaccctttatttaggtgcaatggttcaagcagattccgggtgtgtagtcagctggaaaaacaaggaactgaaatgcggctcaggtatattcattacagataacgtacacacttggacggaacaatataagttccaaccggaatcaccatcgaaattagcatctgcaatacagaaagcccacgaagaaggtatctgtggcatacggagtgtcacacgacttgagaaccttatgtggaaacaaataacgcctgaacttaaccatatcctgtccgagaatgaagtaaaattaacaattatgactggcgatataaaaggtataatgcaggccgggaaacgttcgctaagacctcagccaactgaactcaaatactcctggaaaacgtggggaaaagccaaaatgttaagtacagaaagtcataaccaaacatttctcatagatggacctgagaccgcagaatgtccaaacactaaccgagcctggaatagtctagaagttgaagattacggttttggcgtatttaccacaaatatttggctaaagctccgagaaaaacaagacgtgttctgcgacagcaaacttatgagcgcggcaataaaggacaatagagcagttcatgcggacatgggatactggattgaatcagcattaaatgatacgtggaaaatggaaaaagctagcttcattgaagtcaaatcctgtcactggcccaaatcacacacattatggtcaaacggtgttttggagagcgaaatgattatacccaaaaattttgcgggacccgttagccagcataattatcgccctggataccacactcagacagccggaccgtggcacttagggaagttagagatggacttcgatttctgtgaaggaacaacggttgtcgtcacggaagactgcggtaatagagggccctcattacgtactacaacagcgtcaggtaagttaatcacggagtggtgctgtagatcatgcacactgcctccgctaagataccgaggagaggatggttgttggtacggtatggaaatacgtccactcaaagaaaaagaagaaaatctagtaaattccttagtaacagcaggacacggacaaatagataatttcagcctaggagtattaggtatggcgttgttcctggaggaaatgctaaggacacgggtaggaacgaaacatgcgattcttttagttgcggtgtcattcgtcactctcataacaggcaacatgtcatttagagacttaggtagggtcatggttatggttggagtaactatgactgatgatatcggaatgggggtaacctatttggcattgctagccgctttcaaagtgcgacccacctttgctgcgggactattactccgtaagctaacatcgaaagaactcatgatggctactattggcattgcattgcttagccaatcaacgatacctgaaacaattctcgagctgactgatgctctagcacttgggatgatggttctgaagatagtccgaaatatggaaaaatatcaattggctgtaacaattatggcgatcagttgcgtcccaaatgccgttatcctgctaaatgcttggaaggtttcttgcacaattttagctgcagtttctgtttcgccgctattactcacttcgtcacaacaaaagacagactggattcccttagctttaaccataaaaggtttgaatccaaccgcaatattcctcactacattatcacgcacatctaagaaacgatcatggccactaaatgaggctgtcatggcagttggaatggtatcaatcttagcaagctcattgctgaaaaatgatattcctatgactgggcctttagtcgctggcggcttattaacagtttgctatgttttaacaggcaggagtgcggacctagaactagagagggcggctgacgttaaatgggaagatcaagcagaaatctctgggagttccccaatactttcaattaccataagcgaggacggtagtatgagtatcaaaaatgaagaagaggaacaaacgctaacaattttgatacggactggtctcctggtaataagcggtgtatttccggtctcaataccgataacagccgcagcatggtacttatgggaagttaagaaacagagggccggagtcttatgggacgtaccctctcctccaccggtcgaaaaagcagaactagaagatggtgcgtatagaataaaacagagaggtattttaggttatagccaaattggggccggcgtatataaagaaggtacatttcatactatgtggcatgttactagaggcgcagtacttatgcatagaggtaaacgaattgagccttcctgggcagatgtcaagaaagatcttatatcatatggtggagggtggaaactcgaaggcgagtggaaagagggagaagaagttcaagtattggcattggaacccggtaaaaacccgcgggcggttcaaacaaaacctgggttatttaaaacaaatacaggtacgatcggtgcagtatctctagattttagccccggaacatcaggaagtccgatagtcgatcgaaagggaaaagtggtagggttatacggaaatggggtagtaaccagaagcggagcatatgtcagtgctatagcacaaacagagaaaagcattgaagataatccggagattgaagatgatatctttaggaaaaagcgattaactatcatggacctccacccaggggcaggaaaaactaaacgttacttgccagcaatagttagggaagccataaagcgagggctaagaacattgatattagctccaaccagagtggtagcggctgaaatggaagaagcattacgcggcttgcccatacgttatcaaacccctgcaatacgagcagaacacactggacgagaaattgttgatctaatgtgccacgctaccttcacaatgagacttctttcaccagtcagagttcctaattataatttgataattatggacgaagcgcactttacagaccccgctagcatcgcggcaaggggatatattagtacaagagtcgaaatgggagaagctgcgggaatattcatgactgctactccaccaggtagtcgtgatccatttccacaatcaaatgctccaattatggatgaagaaagagaaattcccgaacgatcgtggaactctgggcacgaatgggttactgacttcaagggcaaaaccgtgtggtttgtcccaagcattaaagcgggtaacgatatagcagcctgtctgcgcaaaaatggcaagaaagtgatccaattatcgaggaagacttttgactctgaatatgtaaaaacacgtgccaatgactgggacttcgtagtcacaactgatatctcggaaatgggagcgaactttcgggctgaaagggtaatagatccacgcagatgtatgaagccagtaattcttactgatggcgaagaacgtgttatcctggcagggccaatgccagttacccatagctcagcagcacaaagacgaggaagaatcgggcgaaaccccaaaaacgagaatgatcagtacatatacatgggagaacctttagaaaacgacgaggattgcgcgcactggaaagaggcaaaaatgctactagataacattaatacgccagaaggaataattccaagtatgtttgaaccagaacgtgaaaaagtcgatgcgattgatggtgaatatcgattacgaggagaggcgagaaaaacttttgttgacttgatgagacgtggagaccttccagtatggttagcttatagggttgctgcagaaggaattaactacgccgatcgacggtggtgttttgacgggatcaaaaacaaccaaatattagaagagaatgtagaagtggaaatatggacaaaggaaggggagaggaagaaactaaagcctaggtggctggatgcacgaatttactcagatccgttagccttgaaagagttcaaagaatttgctgcgggtagaaagagcttgactttgaacttaataacagaaatgggtagattgccgacattcatgacccaaaaagccagagacgcattagataatttagcagttctacacactgccgaagctggtgggagagcatataaccacgcattaagcgagttaccagaaaccttagaaacattattattactcactcttctagcaactgtcactggtggcatattcctatttttaatgagtggaaaaggcattggcaagatgacactcggaatgtgttgtataattactgcatcgattttactatggtatgcacaaattcagccacattggatcgcagcgagcataatattagagttctttttaatagttttgcttatacccgaacctgagaaacagaggaccccgcaagataatcaactaacttacgtggtcattgcgatccttaccgtagtagcagcgaccatggctaatgaaatgggattcctggaaaagacaaagaaggatttagggttaggctcaataacaacacaggaaagtgaaagcaacatactagatatagaccttaggccagcatcagcatggactctttatgcggtggcaacgacttttgtaacccccatgctcagacattcgattgaaaattcaagcgtcaacgtatccttgactgcgattgccaaccaggcaacagtcttaatgggactcggtaaaggatggccgcttagcaagatggatataggtgtaccattattggcgatcggatgttacagtcaagtaaatcctataactctaacggctgcactgttgttattagtagcccactacgctataataggtccaggtcttcaagccaaagcaactcgagaagcgcagaagcgagctgcagcggggatcatgaaaaatcccacagtcgatggtataactgtaatcgatctagaacctataccgtatgatcctaagttcgaaaaacaattagggcaagttatgcttttaatactctgtgtaacacaggtgctaatgatgcgaacaacatgggcgctatgtgaagctctaactctggctacagggccgattagtaccctatgggaaggcaatcctggaagattttggaatacaactatagccgtcagcatggcaaatatattccgaggtagctatctagcaggagcagggttactattttccataatgaaaaatactacgaatactagaagaggaactggaaacataggagaaacgctcggagagaaatggaagtccaggttgaacgcattaggcaaaagcgaatttcaaatatataagaaaagtggcattcaagaagtagataggacccttgcaaaagaagggatcaaaaggggagaaactgatcaccatgcagtgtctagagggtcggctaaactaagatggtttgtagaaaggaacatggttactccagaaggtaaagttgtcgatctgggctgtggaaggggtggatggagctactattgtggcggactaaagaacgtgagagaagtcaaaggtctcacgaaaggaggaccgggacatgaagaaccgataccaatgtcaacttatggctggaacctcgtaagattgcaatcgggggtagacgtatttttcacaccgccagaaaaatgtgataccttgctctgcgacataggcgaatcttcacccaatccaactatagaagcaggacgcacactaagagtcttgaatctcgccgagaattggcttaacaacaatacgcaattttgtattaaagtattaaacccatacatgccatccgtaattgagaaaatggaaacgttgcaaagaaaatatggtggagcgctcgttcggaacccactttcgagaaattcaactcacgaaatgtactgggtgagtaacgcaactggaaatattgtgtcttcggtaaacatgatatctagaatgttaataaataggtttaccatgaaacataaaaaggcgacttatgaaccagatgtggatctcggtagtggcactagaaatataggaatcgaaagtgaaatacctaacttggacataataggcaagcgaatcgagaaaataaaacaggaacatgaaacaagctggcactacgatcaagatcatccatataaaacatgggcctatcacggaagctacgaaactaaacagaccggctctgcatcatccatggtaaacggagtagtgcggctcctaacgaaaccatgggatgtggtacccatggtaacacagatggcaatgacggatactactccctttggccaacaaagggtatttaaagaaaaagttgatactagaacacaagaaccaaaggaaggaactaagaaactaatgaggatcacagcagaatggctctggaaggaattaggcaagaagaaaaccccacggatgtgtaccagagaggaatttacaaggaaggtaagatcaaatgcggcactaggtgcaatatttacggacgagaacaagtggaaatcggcacgagaggcggtagaggattcaagattctgggagttagtggatagagaaagaaatcttcatctagaaggaaaatgcgagacttgcgtgtacaacatgatgggaaagagagagaagaaactgggggagttcggaaaagcaaaaggatctcgagctatatggtatatgtggttaggtgcaagatttttagaatttgaagcacttggtttcttaaatgaagatcactggttttcgcgtggaaatagtctgagcggtgttgaaggtgaaggcctacatagattaggttatatactcagagatgttagtaagaaagagggaggcgctatgtatgcggacgacacggctggctgggacactagaataacattagaagacttgaagaacgaagaaatggttactaatcacatgaaaggggagcataagaaattggcggaagcaatatttaaattaacataccaaaataaagtcgtacgcgttcagagaccaacaccccgaggtaccgttatggatataataagtcgtagagaccaacgaggaagcgggcaagtaggaacttatggactaaataccttcacaaacatggaggcacaactcataagacaaatggagggcgaaggaatcttcaagagtattcagcacttaaccgttactgaagaaatagccgtacaaaattggttagcacgtgtcggacgtgaaaggttaagtaggatggcaatatcaggagacgactgtgtagtcaaaccattagacgacaggtttgctagcgcactaacggcattaaacgacatggggaaagttcgtaaggatatacaacaatgggaaccatccagaggatggaatgactggacacaagttcccttttgcagtcatcattttcatgaacttgtcatgaaagacggaagagttttggttgtcccttgtaggaatcaagacgagttaatagggcgagcaagaatatcacaaggggctgggtggtcgctcaaagagacagcttgcttggggaaatcatacgctcagatgtggactcttatgtattttcataggcgtgatctacgactagctgcaaatgcaatatgttccgccgtacccagtcactgggttccaacttcccgaacaacttggagcattcatgctaagcacgaatggatgacgacagaagacatgttagcagtatggaacagagtgtggatccaagaaaatccctggatggaagataaaacaccagtagagtcatgggaagaggtaccttacttaggaaagagggaggaccaatggtgtggatcactgattggtctcacgtcgcgcgccacatgggctaaaaatattcaaaccgcaataaaccaagtaagatcgctaataggaaacgaggaatatacagattatatgccaagcatgaaaagattcagacgtgaagaagaagaagcgggagtattatgg

SEQ ID NO: 22904 - RNA, 9873 nt, synthetic construct
  misc_feature 1..9873: note = derived and/or modified CDS sequence (opt6) from DENV-2__HQ012536__SS-prME
  source 1..9873: mol_type = other RNA
acagctggtgttataataatgttaattcctacggcaatggcattccatcttacaacgagaaatggggaaccccatatgatagtaggaagacaagaaaaaggaaaatctttgttatttaaaacggaagacggtgttaacatgtgcacattgatggctattgaccttggggaattatgcgaagatacaataacgtataaatgccccctccttcgccaaaacgaaccagaagacatagactgttggtgcaactcaactagcacgtgggtaacatacggaacatgcacaacaactggtgaacatcgaagggagaaaagatccgtagcactggtgcctcatgttggaatgggtttagaaacgcgtaccgaaacatggatgagctcagaaggtgcgtggaaacacgttcaacgtatagaaacttggattttacgacaccccggattcgcaatcatggcagcaattcttgcttataccatcggaacaacacacttccaacgagctttaatctttatactactcacggcagtggcgcctagcatgacaatgcgatgtattggaatatcaaacagagatttcgttgaaggtgtttcaggaggttcgtgggtagacatagtactggaacacggatcttgcgtaacaacaatggccaaaaacaaaccaacgctagacttcgaacttataaaaacagaagcaaaacagccagctacattaagaaaatattgcatagaagcaaaactaacaaataccactactgaatccagatgtccaacgcagggtgagccaagtttgaatgaggagcaggacaaacgatttatttgcaaacatagtatggtcgataggggttggggcaacggatgtgggttatttggaaaaggcggtattgtaacatgtgcaatgtttacttgcaagaaaaacatggaaggtaaagttgtcttgccagaaaacttagaatacacaatagttattaccccacactcgggtgaagaacacgcagtaggaaatgacacaggaaaacatggcaaagaaataaaaattactcctcaaagcagcataacagaggcggagctcaccggctacggaactgtcactatggaatgttcgccgagaacgggattggatttcaatgaaatggttctactccagatggaggagaaagcatggctagtacatcgacagtggtttttagatttgccgcttccgtggttacccggtgcagatactcagggaagtaattggatacagaaagagacactggttacatttaaaaatccacacgccaagaaacaagacgtagtcgttttaggatcgcaggaaggagcaatgcatacagcacttaccggtgcaacggaaatacagatgtcctctgggaacctgctatttactggacacctgaaatgcagactacgacttgacaaattgcaactcaaaggaatgagttacagtatgtgtactgggaaattcaaaatagtcaaagaaatcgcggagactcaacatggaaccatagttattagagtacagtatgaaggcgacgggtcaccatgcaaaatcccattcgagataatggacctcgagaaaagacacgtactggggcgccttatcactgtaaatcctattgtaacaggtaaagactcgcccgtaaacattgaagcagaaccaccttttggagacagctatattattattggggtagaaccaggacaactcaaattaaattggttcaagaaaggatcgagtattggtcaaatgttcgaaacaacgatgcgaggcgctaaaagaatggcaatcttaggagataccgcatgggactttgggtccttgggaggtgtatttacttcgataggtaaagcacttcaccaagtttttggtgcaatatatggagcggcttttagcggtgtctcatggacaatgaaaattcttattggggtaataattacctggataggcatgaactctagaagtacaagtttatctgtttccctcgtcctggtgggtgttgtaacactatacctgggagcgatggtccaggcagatagtgggtgtgtagtaagctggaaaaacaaagaactaaaatgcgggtcgggaattttcataacagataatgtgcacacttggacagaacaatataagttccaacccgagagcccctcgaagttggcttcagctatccaaaaggctcacgaagaggggatatgtggaataaggagcgtgactagactcgagaatttgatgtggaagcagattactccggaattaaaccatatcctttccgaaaatgaagttaagctaacaataatgactggagacataaaaggaataatgcaagcagggaagcggagcctacgcccacaaccgacagagttaaaatactcatggaaaacctggggtaaagcaaaaatgctaagtacagaatcacacaatcaaactttccttattgatggtccagaaactgctgaatgtcctaatacaaacagggcctggaactctctagaagtcgaggactacggatttggagtattcacaacaaatatttggctcaaactgagagagaagcaagatgtattttgtgacagtaaattaatgagtgcggcaataaaagataacagagcggtacacgccgatatgggatactggatagaatctgcgttaaatgggacgtggaaaatggaaaaagcatcatttatagaagttaaatcttgtcactggccgaaatcgcacaccttatggtcaaacggtgttcttgaatcagagatgatcataccaaagaatttcgctggaccagtctcccaacacaattatagaccaggctatcacacacaaacagccggcccgtggcacctaggtaaattggaaatggattttgatttttgtgaaggaaccactgtagtcgttacagaagactgtgggaaccggggtcctagtttacggacaacaactgccagtgggaagctcatcacagaatggtgttgtagatcctgcaccttaccaccactaaggtatcgtggtgaagacgggtgttggtatggtatggaaataagaccacttaaagaaaaagaagagaatctagttaattccttggtcacggccggacatggacagatcgataactttagtctcggagtactagggatggctctctttctcgaagaaatgcttcgaacacgggtagggacaaaacatgctatcctcttggttgctgttagctttgtaactttaataactgggaacatgagttttaaagaccttgggcgcgttatggtaatggtgggagtggccatgacagacgacataggaatgggcgtaacatatctagcactgttggccgcttttaaagtacgccccacatttgcagcaggactacttctaagaaaattaacatctaaagaattaatgatggcaactattggaataacactactttcacaaagtacaataccagagacaatacttgagttgaccgacgctctggcacttggcatgatggttttaaaaattgtcagaaatatggaaaagtaccaattagctgtaaccattatggcgataagttgcgtacccaatgctgttatacttctaaatgcttggaaagtatcctgcacaatactagctgccgtgagtgtatcgccattactcttaacgtcaagtcaacagaaaactgattggataccccttgcactaacaattaaaggactaaatccaacagcaattttcttgacaacattaagtaggacgagcaagaaaagaagttggccccttaatgaagcggtgatggcagtagggatggttagcatccttgctagcagcttgttgaagaacgatatccctatgactgggccgctagtcgcagggggactcttaacagtatgttacgtacttactggccgttcagcggacttagaattagaaagagcagctgacgttaaatgggaggatcaagcagaaatttcgggttcaagtcccatattaagcattacaatatccgaagacgggagtatgtctatcaaaaacgaggaggaagaacaaaccctgactatcttgattagaacaggacttttagttatatctggtgtctttcctgtaagcataccaatcacggcagccgcctggtatttatgggaagtaaagaagcaaagagcaggagtattgtgggacgtaccttcgcccccgccagtagggaaagctgaactagaagacggggcctatcggataaaacaaagaggaatcctaggatattcccaaattggcgcgggcgtctacaaagaaggtacattccatacgatgtggcatgtcactaggggtgcagtactaatgcacagaggaaaaagaattgaaccgtcatgggcagatgtcaagaaagatcttataagctatggcggaggatggaaacttgaaggagagtggaaagagggcgaagaagtacaagttctcgcattagagccgggtaagaacccgcgagcagtacagactaaacctggcttatttaaaacaaatacgggtacgataggagcagtgtcattggatttcagcccaggaacatccgggtcgccaatagtagatcgaaaagggaaagtcgttggtctctatggaaatggtgttgtaacaagaagtggagcatatgtatctgccattgcccaaactgagaaaagcattgaagataatccagaaatagaggatgatatattcaggaagaaacgattgacgataatggacctacatccaggagctggcaaaaccaaaagatatcttccagcgattgtaagagaggcgataaaaagagggctacgtacgctaatactcgctccaacaagagtcgtagcggcggaaatggaggaagcgctacgtggcctacctatacgttatcagacgcctgcgataagagcggaacatacgggaagggagattgtagacttaatgtgtcacgctacttttacaatgcgcttattgtcaccagtacgagttccaaattacaacctaataataatggatgaagcacattttacagatccagccagcatagcggcaagaggatacatatctacaagagtggaaatgggtgaagcggcaggaattttcatgacggcaacgcctccgggttcaagagatccattccctcaatccaacgctccaattatggatgaggaaagggaaattcccgaaagaagctggaactctggtcatgaatgggtcactgattttaaaggtaagacggtatggtttgtcccgtcaataaaagcagggaatgatatcgcagcctgccttaggaaaaacggcaagaaagtaatccagttgtcacggaaaacattcgactcagaatatgtcaagacaagggcaaatgattgggatttcgtggttaccacagacatcagtgaaatgggggcgaatttcagggctgagcgagtgatagacccgagaagatgcatgaagcccgtgatattaacagacggagaggagcgagtcatactggcagggcctatgccagtaacacactcaagtgctgcccaacgacgaggaagagtaggacgaaaccctaagaacgagaatgatcaatatatatacatgggggagccacttgaaaacgatgaagattgtgcgcactggaaagaagctaaaatgctactagacaatattaatactccggaaggaattattccgtcaatgttcgagcctgaaagggaaaaagttgacgctatagacggtgagtatcgactaaggggcgaagctcgaaagacattcgtggaccttatgaggcgtggtgatttaccggtttggctcgcatatagagtagccgcagaaggaatcaattatgcagatagaagatggtgtttcgacggtattaagaataaccaaattttagaggaaaacgtagaagtcgaaatttggacgaaagaaggagaacgaaagaaacttaaacctagatggcttgacgcacgaatatatagtgaccccctcgcactaaaggaatttaaagaatttgctgccggtagaaaaagtctgacattaaatctcataacagaaatgggtagattaccgacttttatgacgcaaaaggcacgcgacgccttagataaccttgccgtactacacacagcagaggctggaggacgcgcgtataatcatgccttaagtgaattaccagagacactcgaaacattgttgttattaactctcttggctaccgtaacaggtggtattttcctcttcttaatgtccggaaaaggtataggcaaaatgaccctcggtatgtgttgtataataacggcgtccatattattatggtacgcgcaaatacaacctcattggattgcggctagcattattcttgagttctttctcatcgttctactcattcccgaaccagagaaacaaagaactccccaagataatcaactgacgtatgtcgtaatcgctatacttaccgtagtggccgctacaatggcgaatgagatgggctttctggaaaagacgaagaaagaccttggcctgggtagcataacaacacaggaatcagaatcaaatatattagatattgatcttcgcccggcaagtgcttggacgttatatgcagtagcaactacatttgtgacacctatgttacgtcattcaattgaaaactcaagcgtcaatgtcagtttaactgccatagcaaatcaagccaccgtacttatgggactcggaaaaggatggccactgtccaaaatggatattggtgtccctttactggccataggatgttattcacaggttaatccaataacgttaacagcagcgttactactgcttgtggcgcattacgctataataggaccaggtttacaggcgaaagcaactcgagaagcccagaaaagggcggcggcagggattatgaaaaaccccaccgtagatggtataaccgtgattgacttagaaccaataccatatgatcccaagtttgagaaacaactcgggcaagtcatgcttttaatactatgcgtaacccaagtattaatgatgaggacgacttgggcattatgcgaggctttaactttagcaacaggacctatttccaccctttgggaagggaacccaggcaggttttggaacacaacgatagcagtttcaatggcaaacattttcaggggatcctatcttgctggtgcaggacttttgtttagtattatgaagaatacaacaaatacacgtcgtggtaccggtaatatcggagaaacattaggtgagaaatggaaatcacggctaaatgccctggggaagtctgagttccagatatacaagaaatcaggcattcaagaggtagacaggacactagctaaagagggtataaagcgcggtgagacggatcaccacgcggtatccagagggtcagcaaaacttcgctggtttgtagaaaggaacatggttacccctgaaggaaaagtagttgatttaggatgtggaagagggggttggtcttactactgtggaggccttaaaaatgtcagggaggtaaagggtctaaccaaagggggcccaggtcatgaggaaccaatccccatgtctacttatggatggaatttagtacgactacaatctggagttgacgttttctttactccccctgagaaatgtgatacattactttgtgatattggagaatcgagcccaaatcccacaatcgaagcgggacgcactttaagagttttgaatttagtggaaaactggctaaataacaacacacaattttgtataaaggttctcaatccatatatgccctcagtgatagagaaaatggaaacgttacaaaggaaatatgggggagcattggtgagaaatcctttatcaagaaattctactcatgagatgtattgggtttccaatgccaccggaaatattgtgtcttcagttaatatgatctcgaggatgctaataaatcgatttacaatgaaacataagaaagctacgtatgaacctgacgtcgatttgggaagcggaacgagaaacatcggtattgaatcagaaatacccaacctagacataataggaaaacgaatagagaaaattaagcaagaacatgaaacctcctggcactatgatcaagaccatccatataagacatgggcttaccatgggtcatacgaaacaaaacagactggaagtgcatcgtcaatggttaatggagtagtaaggttgttaacgaaaccatgggacgtcgtaccaatggtgacacaaatggccatgaccgatacgaccccttttggacaacagagggtatttaaagaaaaggtcgacacacgcactcaagagccgaaagagggcaccaagaaacttatgagaatcacagcggaatggctgtggaaagagttgggtaaaaagaaaacgccaagaatgtgtactagagaggaatttacaagaaaagtacgatcgaacgctgcgttgggagcaattttcacagacgaaaacaaatggaaatcagcacgagaagcagttgaggattcaagattctgggagcttgtagatcgtgaaagaaatctccacttagaaggaaaatgcgaaacttgtgtatacaatatgatggggaaaagagagaaaaagttaggagaatttgggaaagcaaaaggttcaagagctatttggtatatgtggttaggcgcacgatttttagagtttgaagcacttggcttcctaaatgaagaccattggttctcacggggcaatagtctaagtggagtagaaggtgaaggattacatagattaggatatatattaagggatgtaagcaagaaagaaggaggggccatgtatgcggacgatactgcagggtgggatacacgaataactctcgaagatctcaaaaatgaggaaatggttacaaatcacatgaaaggagaacataagaaactagccgaagcaatattcaaactgacataccaaaacaaagtagtaagagtccaacggcccaccccgaggggaacggtaatggatataatttctagaagagatcagagaggaagtggccaagtaggtacctatggactcaatacattcacaaatatggaagcgcagttaattcggcaaatggaaggagaagggatttttaagtcgatacaacacttaactgttacggaagaaattgcggtacagaattggttggcccgagtcggacgagagcgactctccagaatggctataagcggagacgattgtgtagtaaaacctctggatgaccggttcgcaagcgcactaacagctctaaacgacatgggtaaagtacgaaaagacatacagcaatgggagcctagtagaggctggaatgactggactcaagtacccttttgttcacatcattttcacgagctggtgatgaaagacggtcgagtattagtagtaccatgtagaaaccaagacgaactaatcggacgggcacgtataagccaaggcgctgggtggtccctgaaggaaacagcttgtttgggcaaaagctacgctcaaatgtggaccctcatgtattttcatcgcagggatctacgacttgctgcaaacgctatatgctcagccgtcccctcccattgggtccctacaagcaggacgacttggtcaatacatgctaaacatgaatggatgactactgaagatatgttagcagtatggaatcgagtctggattcaagagaacccttggatgggggacaagacgcctgtggaaagttgggaagaagttccatacttggggaaaagagaagatcaatggtgtggatctctaatcggattaacgtccagagcaacatgggccaaaaacatacaaacagcaataaatcaagtacggtcattgatagggaacgaagagtatacagattacatgccgtctatgaaacgatttaggagagaggaagaagaagccggagtgctttgg

SEQ ID NO: 22905 - RNA, 9873 nt, synthetic construct
  misc_feature 1..9873: note = derived and/or modified CDS sequence (opt6) from DENV-2__HQ012537__SS-prME
  source 1..9873: mol_type = other RNA
acggcgggggttataataatgctaattccaaccgcaatggcatttcacctaactaccagaaacggtgaaccccatatgatagttggcagacaagagaagggaaaatcactattattcaaaactgaggatggcgtgaacatgtgcacattgatggcaatagatttaggtgaattatgtgaggatacaataacatataaatgtccattactgagacaaaacgaacctgaagacatagactgctggtgtaattcaactagcacatgggtcacgtatggtacatgtactactacaggagaacaccgccgagaaaagaggagcgtagccttagtccctcacgtcggcatgggcttagagacacgtacagaaacatggatgagtagtgagggagcatggaaacatgtgcaacgaatagaaacatggatattaagacatccgggattcgcaataatggcggccatcttagcctacactattgggactacccatttccaacgggcattaatttttatattattgacggctgtcgccccttctatgaccatgaggtgcatcggcatatctaacagggatttcgttgaaggagtgagcgggggttcatgggtagacatagttctcgaacatggatcatgcgtaactacaatggccaagaacaagcctaccctagattttgaactaatcaaaacggaagcaaaacaaccagctacacttagaaaatattgtatagaagcaaaactcactaatacaactactgaatccagatgtcccactcaaggcgaaccgtcattaaatgaagagcaggacaaacgttttatctgcaaacatagtatggttgacaggggatggggcaatggatgcggactctttggcaaaggggggatcgttacttgtgcaatgtttacatgtaagaaaaacatggagggtaaagtagtactgccagaaaatcttgaatatacaatcgtaatcaccccacattcaggcgaagagcacgcagtcggtaatgacactggaaaacatggtaaggaaataaaaataacaccacaatcatcgattacagaagctgaactaacaggttatgggactgtaactatggaatgctcgccaaggacggggctagattttaatgaaatggtgctactgcagatggaagaaaaagcttggttggtacatcgacagtggtttctggatctcccattaccatggttacctggagcagacacccaaggttccaattggatccaaaaagaaacattagtaacatttaaaaaccctcatgctaaaaaacaagacgtagttgtacttggatcgcaggaaggggcaatgcatacagctctaactggtgcgacagaaatacaaatgagctctggaaacctgcttttcacgggacatttgaaatgccgacttagaatggacaaactccaactcaaaggtatgtcctactccatgtgtacgggtaaatttaaaatagtaaaagaaatagcagagactcagcatgggactatagttatacgagttcaatatgaaggggacgggtccccatgtaaaataccattcgaaatcatggacttggaaaagagacatgtactcggaaggcttattacggtaaatcccattgtaacagaaaaagattcacctgtaaacatcgaagcagagcctccattcggtgattcctatataattattggagtcgaacccggccaattaaagctgaactggtttaaaaagggatccagtattggccaaatgttcgagactacaatgaggggagcaaaaagaatggcaatattaggcgacactgcgtgggattttggttcattgggaggagtattcacaagcattggaaaagccttacaccaggtctttggtgcaatctatggcgcagcattctctggtgttagttggactatgaaaatacttataggtgttataataacatggatcggcatgaacagtaggtctacaagcttatccgtaagtctcgtacttgttggggtggttacgctatatctaggtgctatggttcaagcagattcagggtgtgtagtgagctggaaaaacaaggagctaaaatgtgggagtggtatttttattacagacaatgtacatacgtggaccgagcaatacaaatttcaacccgaaagcccttctaaattagcttctgcaatacaaaaagcacatgaagaggggatttgtggaattcgctcggtgactcgtcttgaaaatttgatgtggaagcaaataacaccagaacttaatcacatacttagcgaaaacgaggtgaagttgacaataatgactggtgatataaaaggaatcatgcaggcaggcaaaagatcgttaaggcctcagccaacagaattaaaatacagttggaagacatggggaaaggcaaagatgcttagtacagaatcccataaccagacgtttctaatagatggccctgaaacagcagaatgtccaaatactaaccgagcttggaacagcttagaagtggaagactacggatttggcgtatttacgactaacatctggttaaagctccgagaaaaacaggatgtgttttgcgattcaaaactgatgtcagctgccattaaagataaccgagctgttcatgctgatatgggctattggatagaaagcgccttaaatgatacatggaaaatggaaaaagctagtttcattgaagtaaaaagttgccactggccaaagtcacataccctatggagcaacggagtattagaatcagagatgatcatccctaaaaatttcgccggtccagtcagtcaacacaattataggcctggttatcacacccaaacggccggaccctggcatttaggtaaactagaaatggattttgacttttgtgaagggacgacggtagtagttacggaagattgtgggaaccgcggacctagtcttcgaacaacaacggctagcggtaaattaattaccgagtggtgttgtcggagttgtacccttcctccactgcggtaccgaggagaagacggttgttggtacgggatggaaatacggcccttgaaggagaaagaggaaaaccttgtaaattcgttagttactgccgggcatggccaaattgataacttttcactaggtgtattaggaatggctcttttcttagaagaaatgctccggacgcgcgtaggaaccaagcatgcaatactattagtggcagtgtccttcgtaaccctaattactggaaacatgagtttccgtgacttagggagagttatggtgatggtaggtgttacaatgacagacgacattggaatgggagtaacctatcttgccctgttagcagctttcaaagtaagaccaaccttcgcagctggacttttattaagaaaattgactagtaaagaactcatgatggcaactattggaattgccctgctttcacaaagtaccataccagaaacaattctggaactaacggatgcgctagcacttggcatgatggtgttgagaatagtccgtaatatggagaaatatcaattggccgttacgattatggcgatctcatgtgttccaaacgcagtcattctattaaatgcatggaaagtcagttgcaccatcttagcggcggtcagtgtcagtcctctgttactcacctcatcacaacaaaagactgattggattcctttggcactgacaataaaagggctcaatccaacagctatattcttaacaactctaagtcgtacttcgaaaaagagatcctggccattaaatgaagctgttatggccgtgggaatggtatctatccttgcaagttcgttgctaaagaacgacataccaatgacaggacctctagtggcaggaggcctgcttacagtttgctacgtgcttactggtagaagcgccgatttagaattggaaagagctgcagatgtcaaatgggaggatcaagcagaaataagcgggtctagccctattctaagtattacaatttcagaagacggttcaatgtcaattaaaaacgaagaagaggaacaaaccttaacgatactcataagaaccggcctgttagtgatatcaggagtatttcccgtcagcattcctattaccgcagcagcctggtatctgtgggaggtgaaaaagcaaagagcaggagtgttatgggatgtaccctcacctcccccagtcgaaaaagcagaactagaagatggtgcatatcgaataaaacagcgtggaatactcggttacagccagataggagcaggcgtttataaagagggtacattccacacaatgtggcatgtaactcgaggggccgttttaatgcatagaggaaaaagaattgaaccatcatgggcagatgttaaaaaagacttgatatcttacggtggaggatggaaattagaaggggagtggaaagaaggagaagaagtccaggtactcgccctcgaaccaggcaaaaaccccagagctgtgcaaacaaaacctggtctctttaaaacaaataccggaacaattggtgctgtatctctggattttagccctggcacgtctggtagcccgatagtagatagaaaggggaaagtcgtaggactatatggcaacggcgttgtaaccagatcgggtgcgtacgtttcagcaatagcgcaaacagaaaagtccattgaggacaatcccgaaatcgaagatgatatcttcagaaagaagagactgacaattatggacctacatccaggtgctggaaagacaaagagatacttaccggctattgtacgtgaagctataaagaggggactacgaacacttattttagcacctactagagtagtagcggctgaaatggaagaggctcttcgagggcttccaataagataccagactccagctattcgagccgaacacacaggcagagaaattgttgatcttatgtgccatgccactttcactatgcgtctactttcaccggtgagagtcccgaattataacctaatcatcatggacgaagcacactttacagatccagcctccatagccgcgagaggatatatatcgacacgcgtagaaatgggagaagccgcaggtatatttatgaccgcaacaccaccaggctcacgggatccgtttccacaatctaacgctccgataatggatgaagagagggagattccagagcgatcttggaactccgggcacgaatgggttaccgatttcaaaggtaaaacggtatggtttgtaccaagcataaaagccggaaatgacatagccgcatgtttgcgtaagaatggtaaaaaggttatccagcttagtagaaaaactttcgattcagaatatgtaaaaacacgagctaatgattgggattttgtcgtcacaacagatatttcggaaatgggcgccaatttcagagcagaacgagttatagatcccagaaggtgcatgaaacccgtaattttgacagacggtgaagaaagagtaatactcgcgggaccaatgcccgtaacacattcctcagcggcacaaagaagaggaagaataggtcgaaatccaaaaaatgaaaacgatcaatatatttatatgggggaaccactcgaaaatgatgaagattgcgcgcactggaaagaggcaaagatgcttttagacaacattaatacaccagagggtataatcccaagtatgttcgagccagaacgagaaaaagtggatgcaatagatggagaatatagactaagaggagaggcccgcaaaacattcgttgatcttatgaggaggggcgaccttccagtgtggcttgcttatcgtgttgctgctgaaggaataaattacgcagacagacgatggtgcttcgacgggatcaaaaacaatcaaatcctagaagaaaacgtggaagtagaaatatggacaaaagaaggtgaaagaaagaaacttaaaccacggtggttagacgcaagaatctatagcgatccgctagcgttaaaagaattcaaagaatttgcggctggacgaaaatcactcacacttaatcttataactgaaatgggcaggctgccaacatttatgactcagaaagcaagggatgccttggacaatcttgcggtgctacacaccgcagaagccggtggtcgtgcctataaacacgcactaagcgaactccccgaaaccttggaaacattattacttctaactctacttgccactgtaactggagggatctttctattcttaatgtcaggtaaaggaataggcaagatgacactaggaatgtgctgcattatcacagcaagcatactgctgtggtatgcacaaatacagccgcattggatagcagcctctattattttagaattctttttgattgtgttgctaataccagagcctgagaagcaacgcacaccgcaggacaatcaactcacatatgtagtgattgctatccttactgtcgtagcagcaaccatggcaaatgaaatggggtttcttgaaaagactaaaaaagatttaggcctcggtagtatcactacacaggaatcggagagcaatatattagatatagaccttcggcctgcgtccgcatggacgttgtatgccgtcgccacaacctttgttacgccaatgttacgacatagtattgaaaactcatccgtaaacgttagcttaactgccatagcaaaccaagcaactgtcctgatgggcttaggtaaagggtggccattatcaaagatggatataggagtccccctgttagcgataggttgttatagccaagtcaatcctataacattaacagcagcactactattactagtagcacactacgcaataataggtcctggattgcaggcaaaagcgacacgggaagctcaaaaacgcgcggcagcaggaataatgaaaaatccaacagtagatggaattaccgtaattgacctagaaccaataccctacgatcccaaattcgaaaaacaattaggccaagtaatgttgctaattttatgtgtgactcaggtacttatgatgaggacaacatgggcattatgtgaagctcttacacttgctacaggaccgatatcaactttatgggaagggaatcctggtagattctggaacacaaccatagcagtgtcaatggctaacatattcagaggaagctatttggcgggagcaggactgttgttctctattatgaagaatacgacaaatactagacgaggcacaggaaatataggagagacattaggagagaagtggaaatcaagactcaatgctttaggcaaaagcgaatttcaaatttataaaaagtctggaatacaagaagtggatagaacactcgcaaaagaaggaataaaaagaggagagactgatcaccatgcagtttcaaggggtagtgccaaactacggtggtttgtcgagcgaaatatggtaaccccagagggaaaggtagttgacctcggttgcggaaggggtggatggtcatactattgcggaggtttaaaaaacgttcgtgaagtaaagggattaactaaaggagggcctggacatgaagagcccatccctatgtcaacttacgggtggaacctggttcgtctgcaatccggagtagacgtctttttcaccccgcctgaaaagtgtgacacgctattatgcgacattggagagagctcaccaaatccaactatagaagctgggagaacactaagagtattaaatctagctgaaaactggttaaataacaatactcagttttgtatcaaagttctaaacccttacatgccgtctgtaatagaaaaaatggaaaccttgcagagaaaatatggtggagcactcgtacgaaatccactgtccaggaattcaactcatgaaatgtattgggtttctaacgcaacgggcaatatagtatcctctgtaaacatgattagcagaatgttaattaaccgctttacaatgaaacataaaaaagcaacttatgaacctgatgtggatttaggaagtggcacaaggaacattgggattgaatcagaaataccaaatctcgatataataggaaagaggattgaaaagataaaacaagaacatgaaacatcttggcactatgatcaagaccacccatataagacttgggcatatcacggttcctacgaaaccaagcagacagggtcagcatccagcatggtaaacggggtagtaaggctgctgacaaagccttgggacgtagtgcccatggtgacccagatggcgatgacagacaccaccccgtttggacaacaaagagtcttcaaggaaaaggtagacacgaggacccaagaaccaaaagagggaacaaaaaaacttatgagaatcacagctgaatggttatggaaagaactggggaaaaaaaaaacaccgcgaatgtgcacaagggaagaatttactcgaaaagtccgcagcaatgccgcgttaggtgcgatattcaccgacgaaaataaatggaaaagtgcccgtgaagctgtagaagatagccgtttctgggaattagtagatagggaaagaaacctacatcttgagggtaaatgcgagacatgtgtatataacatgatgggcaagcgggaaaaaaaactcggcgagtttgggaaggcaaaaggtagtagagccatttggtatatgtggctcggagctagattcttggaatttgaagcacttggattccttaacgaggatcattggttttcacgaggaaactcactttcaggagtagagggagaagggctccatagattagggtacatattaagagacgtctcaaaaaaagaaggcggagctatgtatgctgatgacacggctggctgggatacacgtatcacattggaagacttaaaaaatgaagaaatggtaacaaatcatatgaaaggcgaacacaaaaaattagccgaagctattttcaaattgacatatcaaaacaaagtagtgcgcgtccaaaggccaactcccagagggactgtaatggacataataagccgaaaagatcagcgtggtagtggtcaggtaggaacgtatggacttaataccttcacaaatatggaggcacaattaattagacaaatggaaggagaaggaatctttaaatcaatacaacatcttacagtgactgaagagatagcggtacaaaattggttagctagggtaggcagagaacgcttaagtcgaatggctatatcaggggacgactgtgtcgttaaaccgttggacgatcgctttgcatcagcccttaccgcactcaacgatatgggaaaggtgcgaaaagacatacaacaatgggaaccatcccgaggatggaatgactggactcaggtacccttttgtagccatcatttccacgaactagttatgaaagatggtagagtcctagttgttccttgccgaaaccaagatgagctaatagggcgcgcacgaatttcacagggagctggatggagcttaaaggaaacagcgtgtctaggtaaaagctatgcgcaaatgtggaccctgatgtactttcacagacgagaccttcgcttagcggcaaacgctatatgcagtgcggtcccatctcactgggtgcctacaagtcgtacaacatggtcaatacatgcgaaacatgaatggatgacaaccgaagacatgctggcagtttggaacagggtatggattcaagaaaatccatggatggaagataaaacaccagtagaatcatgggaagaagttccatacctcggaaaaagagaagaccagtggtgcggatccttaatagggctaacatcacgtgccacatgggcgaaaaacatacaaaccgcaataaatcaagtcagatcattgattggtaatgaagaatatacggactacatgccatcgatgaaaagattccgcagagaagaagaagaagctggagttctgtgg

SEQ ID NO: 22906 - RNA, 9876 nt, synthetic construct
  misc_feature 1..9876: note = derived and/or modified CDS sequence (opt6) from DENV-2__KU365901__SS-prME
  source 1..9876: mol_type = other RNA
acggccggtatcataataatgatgatcccaacggtaatggcatttcacttaacaactcgtaatggagaaccacacatgatagtctcaagacaggaaaaaggaaaatctttgttattcaaaactgaaaatggagtaaatatgtgcaccttaatggccatggatctaggggaactttgtgaagatacgataacttacaattgtccgcttttacgtcagaacgaaccagaagacatagactgttggtgtaatagtacaagtacctgggtaacctacggtacgtgcacagctactggagaacatcggagagagaaacgaagcgtcgcattagtgcctcatgttggaatgggactagaaacccggactgaaacatggatgtcgtcagagggtgcctggaaacacgcgcagcgtatagaaacttgggtattacgtcacccaggattcaccataatggccgccattcttgcatacacgatcggaacaacatattttcaaagagttcttattttcatactcctaactgctgtcgcaccatcaatgactatgagatgcattgggatatccaaccgagacttcgtagaaggagtgagcggaggctcttgggttgatatagtactcgagcacggaagttgcgtcacgactatggccaaaaacaaacctacattagattttgaactaataaaaacagaggctaaacatcctgctacgttacgcaaatattgtattgaggctaaactcacaaatactaccacagcaagtcgctgcccgacgcaaggagaacccagtcttaacgaagaacaagacaaacgattcgtatgtaaacactcaatggtcgaccgtgggtggggtaacgggtgtggactcttcggaaaaggtggaatagtgacttgcgcaatgtttacatgcaagaaaaatatggagggaaaaatcgtccaaccggaaaacctagagtatacgattgtaattactccacacagtggagaagaaaatgccgtaggtaacgatacaggtaaacacgggaaagaaattaaagtaacgccgcaaagtagcataactgaagccgagctaacggggtatggtactgttacaatggaatgttcaccgcgtacaggactagacttcaatgaaatggtgcttttacagatggagaataaagcatggctagtacatagacaatggtttttagatttacctttaccatggcttccaggggctgatacccagggtagcaactggatacagaaagagaccttagtaacatttaaaaatccacatgcgaagaaacaagatgttgtagttctaggcagtcaggaaggagcaatgcataccgctctaaccggtgctactgagatacaaatgtcgtcagggaacctactatttacgggacacctaaaatgtcggttacggatggacaaactgcaattgaaaggaatgtcctattctatgtgtacaggcaaattcaaagtagtcaaagagatcgctgaaactcaacacgggacaatcgtaattagagtgcaatacgaaggtgatggaagtccctgcaaaataccattcgaaataatggatctggaaaagagacacgtccttggaagattgatcacagtgaatccaatagttacagaaaaagacagcccagtaaatatagaggctgagccacccttcggagattcgtacataatcatcggggtagaacccggacagctaaaactatcatggtttaaaaagggaagttccatcggccaaatgtttgaaacaaccatgcgaggagcaaagagaatggcaatactaggcgatacggcgtgggacttcggttcccttggtggtgtattcacatctatcggtaaagcactacatcaagtctttggtgccatatatggcgccgcattctcgggagtaagttggaccatgaaaattctgattggcgtagttataacttggattggaatgaacagccgatctacatctttatccgtatccttagtgctggtaggcgtagttactttgtacttaggcgtaatggtgcaagcggattcagggtgtgtcgtaagctggaagaataaagaattgaaatgcggttcaggcatctttataactgataatgttcatacgtggacggaacaatataaatttcaacccgagagcccttcgaaactggcctcagccatccagaaagcacacgaagaaggaatttgtggcattagatcagtaactagactagaaaatttgatgtggaaacaaattacgcaagaactaaatcacatactatcggaaaatgaagtcaaattaacaataatgacaggagatatcaaagggataatgcaagctggcaaaagaagtttaagaccgcaacctaccgaattaaaatactcgtggaaaacatgggggaaggcgaagatgttaagtacagaactgcataaccacacgtttttaatagacgggccggagacagcagagtgcccaaatacaaatcgagcatggaactcattagaagttgaagactatggatttggtgtatttaccactaacatatggttaaaattaaaggaaaaacaagatgtcttctgtgatagcaaattaatgagtgcagctataaaagacaatcgtgcagttcacgcggatatgggatattggatcgagtctgcattaaatgatacgtggaaaattgaaaaggcttcattcatagaagtaaagagttgtaactggcccaaatcacataccctatggagcaacggtgtccttgaatcggaaatgatcatacccaaaaactttgcaggccccgtttcacaacataattaccgcccaggctatcacactcaaacagctggtccctggcatttaggccgtttggagatggacttcgaattttgcgagggcaccactgtcgtagttaccgaagactgcggaaatagaggaccaagtctacgcaccaccacagcaagtggaaaattaataactgagtggtgttgtcgatcatgtactctacccccattaagataccgaggcgaagacgggtgttggtacggaatggaaatacgacctctaaaagaaaaagaagaaaatctggtaaactctctggtaaccgctggtcatggtcaaatagataatttttcattaggagtactcgggatggctctattcctagaggagatgttacggactagggtaggaacaaaacatgcaattttactcgtagctgttacatttgtcacactaattaccggaaacatgtccttcagggatctaggtcgagtaatggtaatggtgggcgctaccatgacagacgatattggtatgggagttacgtatttggcacttctggcggcattcaaagtacgcccgacgttcgcagctggactccttcttaggaaactgacttctaaggaattgatgatggcgacaataggaattgtattattatcacaatcaacgatccctgaaacaatattagaattaacagatgcactggcactcgggatgatggtattgaaaatagtacgtaacatggaaaaatatcagttagcggttacgataatggctattctatgtgtacctaatgcggttatactccagaatgcttggagggttagctgcacaactctcgctgtagtatcagtctcacctctattattaaccagcagtcaacaaaaagcagattggatacctctcgccttaacgatcaagggattaaatcccacagcaatcttccttactactttaagccgtaccagtaagaaaagatcatggccactaaatgaggcgatcatggcggtcgggatggtatctatactagcgtcgagtttactgaaaaacgatataccaatgacagggccgttggtagctggaggcttactgacagtttgttacgttctaacagggagatcagctgatttagaactagagcgtgcagcagatgttagatgggaagaacaagcagagataagtggcagctcacctatattatctatcacgatctcagaagatggatcaatgagtatcaaaaatgaagaagaggagcaaactctcacaatattaataaggacaggactcctagttattagtgggctttttcctgtctctataccaattacagctgctgcatggtacttatgggaggtcaagaaacaaagagcgggagtattatgggatgttcccagtccgcctccagttggcaaagcagaactagaagacggagcttaccgaataaaacagaaaggtatactagggtactctcaaataggggcaggagtatacaaagaaggaacatttcacacgatgtggcacgtaacaagaggcgcggttctaatgcacaaaggtaaacgtatcgaaccttcgtgggcagacgtgaaaaaggatttaatatcgtatggaggcgggtggaaattagagggcgaatggaaagaaggtgaagaagtacaggtcttagctctagagccaggtaaaaacccacgcgctgtacaaacaaaacccggattgtttaaaacgaataccggaacaataggggcagtcagcctagactttagtcctggaacaagtggttcgccaatagtagacaagaaaggaaaggtagtgggactgtacggaaatggagttgtaactagatcaggtacatacgtatcagcaatagcccaaactgagaaaagtatcgaagataatcctgagatagaagatgatatttttcggaaaaagcgcttgacaatcatggacttgcatccaggagccggtaaaacaaaacgctatttacccgctattgtaagagaagctattaaacgcggtttacgtactcttatacttgcaccgacacgagtagtagctgcggaaatggaggaggcactaagagggttacccataaggtatcagacaccggcgatacgagccgaacatacaggtagggaaattgtggacttaatgtgtcatgcgacattcaccatgcggttgcttagcccaatcagagtacccaactacaaccttatcataatggacgaagcccattttacagatcccgctagtatagctgcaagaggatacatatctactcgggtagaaatgggagaagcagcaggaatctttatgacagcgactccaccaggctcccgcgacccgtttccgcaaagcaacgcacctataatggacgaagaaagagagataccggaaagatcgtggaacagcggtcatgaatgggtaacagactttaaagggaaaactgtctggttcgtaccttctattaaagcaggcaatgatattgcagcctgcttgaggaaaaatggcaagaaagtaattcaactcagccgaaagacgtttgattcagaatatatcaaaacgcgtactaatgattgggactttgtagttactactgatattagcgaaatgggagcaaattttaaggcagaacgagtaatagacccacgcagatgtatgaaaccagtaattcttacggacggtgaagaaagagttatattggcgggtccaatgccagtaactcactcttcagcggcccagaggagaggaagggtaggtcggaatcctaaaaatgaaaatgatcaatatatctacatgggagaaccactagagaacgatgaagattgtgcacactggaaggaggcaaaaatgttgttagacaacattaacacgcctgaagggataatacccagcatgtttgaacctgagcgagaaaaagttgatgccatagatggagaatacagattacgtggagaggcgcgcaaaacattcgtagatttaatgagacgtggggatttacctgtatggttggcatatagagtcgcagccgaaggtattaattatgcggatagacgatggtgtttcgatggagttaaaaataatcaaattttagaggaaaatgtggaggttgagatatggactaaagaaggagaaaggaagaaattaaaaccacggtggttagatgcgcgcatatattctgatccacttgcactaaaagagtttaaggagttcgcagctggcagaaaaagtttaactctaaatttgataacagaaatgggcaggctcccaacatttatgacgcaaaaagcaaggaatgcactagataatctggcggttcttcatacagccgaagcaggcggcagagcatataaccatgcattaagtgaactaccagaaacgttggaaacacttctacttttaaccttactggcaacagtaaccgggggaatcttcctgtttttaatgagtggtaaagggatcggtaaaatgacgttggggatgtgttgcattattaccgcatccatattgctgtggtatgcacaaatacagcctcattggatagccgcaagtataatattggaatttttcctcatcgtcctccttataccagaaccggaaaaacaaagaacaccgcaagataaccaactaacctacgttgttatagcaatattaacagttgtagccgcaacaatggccaatgaaatgggatttttagagaaaacgaagaaagattttggcttaggatccataacaacccaacagccagaatccaatatattggacattgacctacgtcctgcctcggcgtggactttgtacgcggtggcgactacatttataactcctatgttaagacatagtatagaaaattcatccgtaaatgtcagcttaactgcaatcgctaaccaagcgaccgttcttatgggcctgggaaagggttggccactaagtaaaatggatattggcgtccccttattagccatagggtgttacagtcaggtaaatcccataacgttaacagcggccttactgctattagttgcccattatgcaataattggaccaggattacaagcaaaagccaccagagaagcccagaaaagagctgcagcaggcataatgaaaaacccaactgtggacggaattactgttatagacttagatccaataccatacgatcccaaatttgaaaaacagttgggacaagtaatgctgctggtactgtgtgtcacacaagttttaatgatgcgtactacatgggcgttatgcgaagccttaactttagcaacaggcccaatatcgactttatgggaaggtaaccctggccggttctggaacacaacgatagctgttagtatggcaaatattttcagagggagttatctagccggcgctggcttactatttagtataatgaaaaacacagcgaatacgaggaggggtacgggaaataccggcgaaacgctaggggaaaaatggaaaaacagattgaatgctctagggaaatctgagttccaaatatacaagaaaagcggcatacaagaagttgatagaacgttagcaaaagaaggaattaaaagaggtgagaccgaccaccacgcagtttccagaggatcagctaaattaagatggttcgtggagcgtaaccttgtaactcctgaaggaaaagttgtagacttgggttgcggaagaggaggctggtcatattattgcgggggtttgaaaaatgtaaaagaagtaaaaggcttaacgaaaggaggaccaggacatgaagaaccaattccaatgagtacatacggttggaatttagtgcgattacaatctggagtagatgtctttttcaccccacctgaaaagtgcgatacattgctttgtgatataggagaaagctcgccaaaccctactgtcgaagccggaagaacgctcagggtcttgaatctagtggaaaattggctcaataataatacacagttttgcattaaagttctaaatccatacatgccaagcgttatcgagaaaatggaagcattacaacggaaatatgggggtgcgctagtgagaaatccactgtcaaggaactccacacatgaaatgtactgggtatcaaacgcaagcggaaacatagtcagttcagtaaacatgatttctcgaatgttgataaatcgcttcactatgagacataagaaagcaacatatgaacccgatgttgacttagggtcaggtacgcgtaatataggcatagaaagcgaaacgcctaacctcgatatcatagggaaaagaatagaaaagattaaacaagaacacgagacatcctggcattatgatcaagatcatccttataaaacttgggcatatcatggatcatacgaaacaaagcaaaccgggtcagcaagctcaatggttaacggagtggttagattactaacaaaaccctgggacgtgatccccatggtaacacaaatggcaatgactgatacaactccattcggacaacaacgtgtgttcaaagaaaaagtcgatacaaggacgcaggaaccaaaagagggcacaaagaaactgatgaaaatcaccgctgagtggctgtggaaagaacttggtaggaagaaaacaccaagaatgtgtacacgcgaagaatttactcgaaaagtacgaagtaacgctgccctcggggctatatttacagatgaaaataaatggaagtctgcacgagaagcagtagaagatagtggcttttgggaattagtggacaaagaacgaaaccttcatttagaaggcaagtgtgaaacgtgtgtatacaatatgatgggcaaacgtgagaagaaactaggagagttcggaaaggcaaaaggatcaagagcgatatggtacatgtggttaggggcccgattcttggagttcgaagcactcggctttctgaatgaagaccattggttttctagagaaaactctctgagtggagttgaaggtgaaggcttacataaacttggttacatcctgcgagacgtatccaagaaagaaggaggcgctatgtatgcagatgacacagctggctgggatacacgaatcacgctagaagatctgaaaaacgaagaaatggttacgaaccacatggagggagagcacaagaagctagcggaagctatatttaaactcacctatcaaaataaggtagtccgagtacaaagacccacaccaaggggaaccgttatggacataatatcgcgacgggaccaacgtggttcaggtcaagtagtaacatatggactaaacacgttcaccaatatggaagctcaactcatacggcaaatggaaggtgaaggggtatttaaatcaatccaacaactaacagtaactgaggaaatcgccgttaagaattggttggcgcgtgtcgggcgagagagattgagtaggatggctatatcgggtgatgattgtgttgttaagcctttagatgatcgattcgccagcgcattgacggcactaaatgatatgggaaaagtcagaaaagatattcaacagtgggaaccttcccgaggctggaacgattggactcaagtacctttttgcagccatcatttccacgaattgatcatgaaagatggaagagtattggtcgtcccatgtagaaatcaggatgaattgatcggtcgtgcaagaatttcccagggagccggatggagtttgagggaaacagcttgtttaggtaagtcttatgcccaaatgtggtcattgatgtattttcaccgaagggatttacgactcgccgcaaatgctatatgttctgcagtaccatcacattgggtacctaccagcagaaccacatggtctatacatgcgactcacgaatggatgaccacagaagacatgctaacggtatggaatcgagtttggatacaggaaaacccatggatggaggataaaactccggtagaatcatgggaagaaattccgtatcttggcaaaagagaggatcaatggtgcggaagtttgatcgggttgacttcacgcgctacatgggctaagaacatacaaacggccattaatcaagtgcgatccctaatcgggaacgaagaatacacagattatatgccatctatgaaacggtttcgccgagaagaggaagaagcaggcgttctatggtag

SEQ ID NO: 22907 - RNA, 9876 nt, synthetic construct
  misc_feature 1..9876: note = derived and/or modified CDS sequence (opt6) from DENV-2__GQ398258__SS-prME
  source 1..9876: mol_type = other RNA
acggcagggatgatcattatgctgattcccactgtaatggcattccatctcactaccagaaatggagaacctcatatgatagttagtcgtcaagaaaaaggaaaatcgttactattcaaaactgaagacggagtaaacatgtgtacgttaatggctatggatttaggagaactgtgcgaggataccatcacttataattgtcctttgctaagacagaatgaacctgaggacatagattgctggtgcaattctaccagcacttgggtaacttatggaacatgtactgcaacaggtgaacaccgacgagagaaaagaagtgtggcattagttcctcacgttggtatgggcttagaaactagaacagaaacctggatgtcaagtgaaggggcttggaaacatgcccaacgaatagaaacgtggatattaaggcacccaggttttactataatggctgcgatactagcatatacgattggaactacatattttcaacgagtattaatttttattctattaacggctgttgcaccatcaatgacaatgaggtgcatcgggatatctaatagagatttcgtagagggagtgtcagggggatcctgggttgatattgtgctcgaacacggcagctgcgttacgacaatggctaaaaataaaccgacattggatttcgaactcataaaaactgaagccaaacaacccgcgacattacggaaatattgtatagaagcgaagctaactaatacaactacagccagtcgatgcccaacacaaggcgagccaagtctaaatgaagaacaggacaaacggttcgtctgcaaacattcaatggttgaccggggatggggcaacggatgcggccttttcggaaaagggggtatcgtaacatgtgctatgtttacctgcaagaaaaacatggagggtaaagtcgtccaacctgaaaatctagaatatactatagtcataacaccacactcaggagaagagaacgccgtgggcaatgataccgggaaacacggaaaagaaataaaaataacaccacaaagctccatcacagaggcagaactaacagggtacggaactgtgactatggaatgctccccaagaactggacttgactttaatgaaatggtactattacaaatggaaaacaaagcgtggctcgtacacagacaatggttcctagacttaccattaccatggctgccgggagcggatacgcaagggagcaattggatacaaaaagaaacattggtgacatttaaaaatccacacgctaagaaacaagacgtagttgtgcttggatcccaagaaggcgctatgcatactgccttgaccggggctacagaaattcaaatgagcagcggaaacctcctttttacgggtcatctgaaatgccgactacgtatggataaattgcaacttaaaggaatgtcatacagtatgtgtactggaaaatttaaagtagttaaagaaatagcagaaacacaacacggcacaattgttataagagtgcaatatgaaggtgatggatccccttgtaaaatccccttcgaaataatggatctggagaaaagacacgttttaggtagacttataacagtaaaccctatagtaactgagaaagatagtccagttaatatagaagcggaaccaccattcggagattcgtacattatcatcggagtagagcccggccagttaaaactaaattggtttaagaagggatcaagcataggacaaatgtttgagaccacaatgcgaggcgcaaagagaatggccatattaggggataccgcctgggattttggcagcttaggaggagtcttcacgagcataggtaaggcactacatcaagtgtttggcgcgatctacggggccgctttctctggagtctcttggacaatgaaaatattaataggggttgtcatcacctggataggtatgaactcgcgatcaacatcattatcggtctcacttgtcctagttggcgttgtaactctatatttaggcgtaatggtgcaagccgatagcggttgcgtagttagctggaaaaacaaggaactaaaatgtggatcaggaatattcatcactgacaacgtacacacatggactgagcagtataaatttcaacccgaaagcccatctaaacttgccagcgcgattcagaaagcacatgaagaaggtatatgtgggataagaagcgtgacacgcttagaaaatttgatgtggaaacaaattacaccagagctaaaccatatattgagtgaaaatgaagtcaaacttacgatcatgacgggagacataaagggtataatgcaagcaggaaaacggtcactacgcccacagcctactgaacttaaatactcatggaaaacatggggtaaagcaaaaatgctttcgactgaattacacaatcaaacattcttaattgatgggccagaaaccgccgaatgtccaaacactaacagggcctggaactcattagaagtagaagactacggttttggagtgtttacaaccaatatctggctgaaactcaaagaaagacaggacgtattctgcgatccaaaattgatgagtgctgccatcaaagataaccgggctgtacatgccgatatgggctactggatagaatcagcattgaatgacacatggaaaatagaaaaagcatcttttatcgaggtaaaatcttgtcattggcctaaatcacatacactttggtcgaatggtgtattggaatccgaaatgatcatcccgaagaattttgctggacctgtaagccaacataattataggccaggttaccatacgcaaactgcaggaccatggcacttaggaaaacttgaaatggacttcgacttttgtgaaggtacgacagtcgtcgtaaccgaagattgcggaaacaggggaccaagcctacgcacaacaactgcatcgggaaaattaataacggaatggtgttgtaggtcatgtacacttccgcccttaagatataagggtgaagatggttgttggtacggaatggaaatacgaccattaaaggaaaaagaagaaaatctagtaaacagcttagtgactgccgggcacggtcagatagataatttttcgttaggtgtgttaggaatggcactgtttctcgaggagatgttacgtacgagggttggaacaaaacatgccattttattagtggcagtttcgttcgttacactaattaccggtaatatgtcctttcgtgatttaggaagggtaatggtaatggtgggagcaactatgactgatgacataggaatgggggtgacttacttagcattactagcagcattcaaagtgagacctacatttgctgccggccttctactcagaaaattaacttcaaaagaactaatgatgacgaccatcggcatagtgctcctgagccaatcgacgatacctgagacaatcctagaactcacagatgcactcgcactgggtatgatggtattgaaaatagtaaagaacatggagaaataccaacttgcagtaaccattatggcaatactatgtgttcctaacgcagttattctacagaatgcttggaaagttagctgcactattcttgctgttgttagtgtaagtccgctactgcttacatcttctcaacaaaaagctgattggattcctctagccttaactatcaagggtcttaaccccacagcaatatttttgactacgctttcaaggacaagtaagaaaagatcttggccgttaaatgaagccattatggcagtaggaatggtatctattcttgcgagttcccttctgaaaaacgacataccgatgacggggccgctagtcgctggagggctacttacagtttgctatgtgttaaccggccgaagcgcagacttagaactagaaagggccgcggatgtacggtgggaagatcaagctgaaattagcggatcatctccaattctatcaataacaataagtgaggacggatcgatgtctattaagaatgaagaagaagaacaaacgttaacaattctaatacgtactggactcttagtaatatccggactttttccagtaagtattccaataacggcagccgcgtggtatctatgggaagtgaagaagcagagagctggtgtattatgggatgtaccaagtccacctcccgtgggtaaagcagaactagaagatggggcatatagaattaaacaaaagggcatactcgggtactcccagataggggcaggagtatacaaagaaggcacatttcatacaatgtggcatgtcacaaggggagccgtcctaatgcataaaggcaagagaattgagccctcgtgggctgacgttaagaaagacttaatcagctacgggggtgggtggaagctggaaggtgagtggaaagaaggtgaagaagtacaagtactagcactagagccaggcaaaaacccaagggctgttcaaaccaaacctgggctatttaagaccaacacaggcaccataggtgctgtctcactagattttagccctggaacctctggaagtcctatcgttgataagaaagggaaagtcgtcggcctatatggaaatggtgtggtaacccgttcgggtacttacgtgtccgcaatcgcacaaaccgaaaagagtatcgaagacaacccagagatagaggatgatattttccgaaagaaacgacttacaataatggatttacatcctggagcaggtaaaaccaaacgttatctccctgcaatcgttcgagaagcaattaaaaggggattaagaaccctcattcttgcaccgacacgagtagtagcggcagaaatggaagaggcgttaagaggactcccaatacgatatcagaccccggccattcgagcagagcacacaggacgagagatagttgacctcatgtgtcacgcgacattcacaatgagactactctctcccgtaagagttcctaattacaacttaataattatggatgaagcgcactttactgatcctgcgagtatagcggcaaggggttatataagcactagagtcgaaatgggcgaagctgcgggaatcttcatgaccgcaaccccacctggtagcagagatccatttccacagtcaaatgctcctataatggatgaggaacgtgagattccggaacgatcatggaacagcggacacgagtgggtcacagattttaaaggaaaaactgtgtggtttgtgccgtcaattaaggcaggtaatgacatagcagcttgtttaaggaaaaatggcaaaaaggtaatacagctgtcgagaaaaacattcgattcggaatatataaagacgagaactaatgattgggactttgtagtaacaacggacatttcggaaatgggagcgaatttcaaagcggaaagggttatagatcctaggagatgtatgaaacccgtaatattgacagatggagaggaacgcgtaattttagctggtcctatgcccgtaactcactcaagtgcggcacagaggagaggaagaattggaagaaatcccaaaaatgaaaacgaccagtacatttatatgggtgaacccttggaaaatgacgaagactgtgcacattggaaggaagcgaaaatgcttcttgataatattaacacaccagagggaattataccatcgatgtttgaaccggagcgagagaaagttgacgctattgacggagaatacagactcagaggggaagcaaggaagacgttcgtagacttgatgagaaggggcgatttacctgtttggctagcgtatagagtagcagctgaaggaatcaattatgcagatagaagatggtgtttcgatggtatcaaaaataatcaaattttagaagagaatgtggaggtggaaatttggaccaaggaaggagaacgtaagaaactaaaacccagatggcttgatgcaagaatctattcagatcctttagcattgaaagagttcaaagaatttgctgcgggaagaaaaagcctcactttgaatctgataacagaaatgggtagactacccacttttatgacacaaaaagctcggaatgccttagacaatttagcagtattacacaccgctgaagccggtgggcgagcatacaatcatgccctaagtgaactacctgaaactctagaaacattattacttcttacattactggcaaccgtaacaggaggtatatttttattcttaatgagtggaaaagggatagggaaaatgacgctagggatgtgttgtataataacagccagcattctactttggtatgcacagatacaaccacattggattgcagcctctattattctagagttctttttgatagtactgttgatcccagaacccgagaagcaaagaacaccccaagataaccaactaacgtacgtcgttatagctatactaacagtcgtagcagcaactatggccaatgaaatgggatttttagaaaagacaaagaaagattttggtctaggtagcattgctacacaccaaccagaatccaacatactggacatagacctgagacccgcatcagcctggaccctctacgctgtagcaacaacttttataactccgatgttgcgacattccatcgaaaactccagtgttaacgtatcattgacggcaattgctaatcaagcaacggttttgatggggctaggcaaaggatggccgttatctaaaatggacatcggtgttccgctattagctataggctgttatagccaggtgaacccgataaccctgactgcagcattgctgctattagtagcgcattacgcgatcataggaccaggtctccaggcaaaagccacacgtgaagcacagaaaagagcagcagctggtatcatgaaaaatccgacggtagacggaattactgtaattgatttggacccgattccttacgaccccaagtttgaaaaacagctaggacaagtaatgcttttagttctctgtgtgactcaggtactgatgatgaggactacttgggcattatgtgaagcactaacattagctacaggacccatctcgaccctatgggaaggaaatcctggacggttttggaataccaccatagcagtatctatggccaatatttttagaggttcctatctggccggggcaggattactatttagtataatgaaaaataccgcgaacactcgtcgaggtactgggaataccggagagacgttaggtgaaaaatggaagaacaggctaaatgccttaggaaaatcggagttccaaatttacaagaaaagtggcatacaagaagtagatcgtacactggcaaaagaaggcattaaacggggagaaacagaccaccatgctgtatcgagaggaagcgccaaattgcggtggttcgttgaaagaaacctagtgactccggaaggtaaagtagttgatttaggatgtggccgagggggctggtcttactattgcgggggattgaaaaatgtcagggaagtgaaaggacttacgaaagggggacctggacatgaggaaccaattccaatgagtacatatggttggaacttagtaagactccagtccggggtagatgtgttcttcacaccacctgaaaaatgcgatacgctactatgcgacattggagaaagctctccaaatccgactgttgaagctgggagaacactaagggtattaaatttagtagagaattggctaaataacaacacacaattctgtataaaagtattaaacccgtatatgccctcagtaatcgagaaaatggaagcattacaacgaaagtacggcggggcactggtgcgtaatcctctatccagaaacagtacacatgaaatgtattgggtcagcaacgcatccggtaacatcgtgtcttcagtaaacatgattagtaggatgttaatcaacaggttcacaatgagacataaaaaggctacgtatgaaccagacgtagatcttggctcaggtacacgtaatataggcatagaatcagaaactccgaacttagacataatcggaaaacgtatagaaaagattaaacaggagcatgagacaagctggcactatgatcaagaccatccttacaagacttgggcatatcacggaagttacgaaactaaacagacgggaagtgccagtagcatggtaaacggcgtagtgcgcttattaacaaagccttgggatgttatcccaatggtgacccaaatggcgatgactgatacaactccctttggtcaacaaagagtgtttaaagaaaaagtggatacaagaactcaagagcctaaagaaggaacgaagaaattaatgaaaatcactgctgaatggctatggaaagaattagggaaaaagaaaaccccgcgaatgtgtacacgcgaagagtttacacgaaaagtgagatcgaatgcggcgttaggagctatatttaccgatgaaaataaatggaaaagtgcaagagaagccgtagaagattccagattctgggaattggttgataaagaaagaaatttacacctcgaaggaaaatgtgaaacttgtgtttacaatatgatgggaaaacgagaaaagaaactaggtgagtttggtaaagctaaaggatcaagagcaatatggtatatgtggttaggggcacgttttctagagtttgaagcattaggattcctcaatgaggaccactggttctcccgtgaaaatagtttgtcaggtgttgagggcgaaggcttacacaaacttggatacatattacgtgatgttagtaagaaagaaggaggagcaatgtatgcggacgacaccgcagggtgggacacaaggattactttggaggatcttaaaaacgaagagatggttactaaccacatggaaggggaacacaagaaactagccgaggcaatcttcaaactgacctatcaaaacaaggtcgtcagagtacaaagaccaaccccaagaggaaccgtaatggacatcatttctagaagggatcagcgggggtccggccaagttggaacatatggtttaaatacatttacgaatatggaagcccaattgattaggcaaatggaaggtgaaggggtattcaaaagtatacaacatctaacagttactgaagaaatagcagtacaaaattggttggcgagagttggtagagaaagactatctagaatggcaatcagcggcgatgactgcgttgtaaaacccctagacgaccgattcgcatctgccctcactgctttgaatgatatgggtaaagtacgaaaagacattcagcagtgggaaccttcgagaggatggaatgactggacccaagttcccttctgctcgcatcacttccacgaactgataatgaaggacggtcgggtgcttgtagttccatgtaggaatcaagatgaattaataggccgggctaggattagtcagggcgccggttggtcattaagagaaacggcatgcctcggaaaatcatacgcccagatgtggtctttaatgtatttccacaggagagacctcaggctagcagcgaatgctatctgctctgctgttccttcacattgggtaccgacaagtcgcaccacatggagtatacatgcaagacatgaatggatgaccacagaggatatgctaacagtttggaacagagtctgggtccaagaaaacccttggatggaagacaaaactccagtggagtcctgggaagaaatcccgtatcttggtaaacgcgaggatcaatggtgcggatcactaataggtctaacatctagagcaacatgggccaagaacatacaaacggctatcaatcaagttaggagtctaatcggaaacgaggaatatacggactatatgcccagtatgaaaagatttaggcgagaggaagaagaagccggggttctatggtaa

SEQ ID NO: 22908 - RNA, 9876 nt, synthetic construct
  misc_feature 1..9876: note = derived and/or modified CDS sequence (opt6) from DENV-2__GQ398259__SS-prME
  source 1..9876: mol_type = other RNA
actgcaggaatgattataatgttgattccaacagtaatggcattccatctgaccactcggaatggagaacctcatatgattgtaagccggcaagaaaaaggtaaaagtctattgtttaaaacagaagatggtgtaaacatgtgcactctaatggcgatggatttaggtgaactgtgcgaagacacgatcacatacaattgcccgttgctacgacaaaatgaacctgaagatattgactgttggtgtaatagtacatccacctgggttacatacggaacctgtaccgctactggagaacatcgcagagagaaacgaagtgtggcattggtaccacatgtcgggatgggcttggaaactagaaccgaaacttggatgagctcagaaggagcatggaaacacgcgcaacgaatagaaacctggattctacgccatccgggttttacgattatggcggcaatactagcgtataccattggaactacttatttccaaagagtgttaatcttcatattattgactgcagtcgcacctagcatgactatgagatgcattggaatctctaatcgtgactttgtagaaggggttagcggaggatcttgggtggatatagttcttgaacatggaagttgcgtcaccaccatggcgaaaaacaaacccactttagactttgaattgattaaaacagaagcaaaacaaccagctactctgcgcaaatattgcattgaagcgaaactaacaaatactaccacagcaagtagatgccctacccaaggcgaaccctccctcaatgaagaacaagacaaacgattcgtttgtaaacacagtatggttgaccggggatggggaaatgggtgcggtctatttggcaaaggaggaatagtaacatgtgcaatgtttacctgtaaaaagaatatggaagggaaggtagtacaaccggagaacttagaatataccatagtaattacccctcactcgggagaagagaatgctgtcggcaacgatacgggtaaacatggcaaagaaatcaaaattactccacaatcatccattacagaagctgagctcacaggatatggcactgtcacaatggaatgttcaccgagaacaggtcttgactttaatgaaatggttctcttacagatggaaaataaagcctggcttgtccacagacagtggttcttagacttgcccttgccttggttacctggagccgatacacaaggaagtaactggatccaaaaagaaactctagtgaccttcaaaaatccacacgccaagaaacaagatgtcgtggtattaggatcacaggaaggcgctatgcatacagccctgacaggagctaccgagattcaaatgtcatcaggtaatctattgtttaccggtcacttaaaatgccgtttaaggatggacaaactacagttaaaaggtatgagttacagcatgtgcaccggaaaattcaaagtggtcaaagaaatagccgagacacaacatggtactatagtaatacgggtgcagtatgaaggggatggttctccttgcaaaatcccatttgaaatcatggatcttgagaaaaggcatgtactcggaagactaataactgtaaaccctatagtaacagaaaaagacagtcctgtgaatattgaagcggaaccgcctttcggtgactcgtacatcattataggagtagaaccggggcagctaaaactcaactggtttaagaaaggttcttctattggtcaaatgtttgaaactacgatgagaggcgcaaagcgtatggctatcttaggggatacagcttgggactttggttcgctagggggagtgtttacatctatcggtaaggctttgcatcaagttttcggagcaatatatggagcagcatttagtggtgtaagctggaccatgaagatactaataggagttgtaataacctggattggaatgaatagcagatcaacttcattgtccgtttcattggtcctggttggggttgtaacattatacttgggagtaatggttcaagcagactctgggtgcgtcgttagttggaagaataaagaactaaaatgcggtagcggtatattcatcacagacaacgtacacacatggacagaacagtataagtttcaaccagaaagtccatccaaacttgccagcgcgatacaaaaagcccatgaagaaggaatatgcggtataagatctgtaacaaggctagaaaatctaatgtggaaacaaattacccccgagctaaatcacattttaagtgaaaatgaggttaaactcacaattatgactggcgatataaaaggaataatgcaagccggaaaaagatctttgcgtccgcaacccacagagttaaaatacagttggaagacttggggaaaagcaaaaatgttgagcacagaactacacaatcaaacctttttaattgacggtcctgaaacggctgaatgtccaaatactaatagagcgtggaactcgttagaggtagaagattatggatttggggtatttacaacaaatatatggcttaaactgaaagaaagacaggacgtgttctgtgattctaaattaatgtccgcagccatcaaggacaatagggccgtacacgcggacatgggatactggatagaatctgccttgaatgatacatggaaaatcgagaaggcgagtttcatagaagtaaaaagctgtcattggcccaaatcacacacattatggtctaatggagtacttgaaagtgaaatgatcattcccaaaaattttgcaggaccagttagccaacataactaccgacctggctaccacacccagaccgcaggcccttggcacttggggaagctagaaatggattttgacttttgcgaaggaaccacagttgtagttactgaagactgtggtaatcggggaccttcattgaggacgacaaccgcctccggtaaattaattacagaatggtgctgcagatcatgcacattgccaccactgagatacaaaggagaggacggatgttggtatggcatggagattcgaccacttaaagaaaaggaagagaacttagtgaactccttagtaacggctggacatggacaaattgataacttttcactaggagtccttggaatggctctcttcttagaagaaatgctaagaacaagggtcggaactaagcacgctatacttttagtagcggtgtcatttgtcactcttataaccggaaatatgagtttcagggacttaggtagggtaatggtgatggtaggagcaactatgacagatgatatagggatgggggtcacatacttagccttactcgcagcatttaaagtgcgacctacattcgcagctggtttactactacgcaaactaacctcaaaagaattgatgatgaccaccattggcatagttttactgtcacagtcaactatacccgaaaccatactagaattaacagatgcattagcattagggatgatggtcctcaaaatcgttaagaatatggaaaaatatcagctagcagtaactataatggcaatattatgcgtcccaaatgcagtaatattacaaaatgcatggaaggtctcgtgtactatattagctgtggtctcagttagtccactattactaacttcatcacaacaaaaggcagattggatccccttggcgctcacaataaaaggacttaaccctacagcaatatttcttactacgttgagtcgtacctccaagaaaaggagctggccattaaatgaagcgataatggcggtaggaatggtctctattttagcatcttccttgcttaaaaatgatataccgatgactggaccgctagttgcagggggacttttgacagtctgctacgtgcttacggggaggagcgctgacttggaattggaacgagcagcagatgtacgctgggaagatcaagccgagatatccggctcctctcctatattaagcataacgataagtgaagacggtagtatgtcgattaaaaatgaggaggaagaacaaacattaactatcctaatacgaacaggactacttgtaatatcgggtctattccctgtgtcaatcccaataactgcagcagcatggtatctgtgggaggttaagaaacaaagggccggagtactatgggatgttccctcacccccacctgtagggaaagcagaactagaagacggtgcatatagaataaaacaaaaaggtatactcggatacagtcaaataggggctggagtttacaaggaaggaacttttcacacgatgtggcatgtcactaggggtgcggttctaatgcacaaaggaaaacgcattgaaccgtcatgggccgatgtcaagaaagatttgatatcatacggtggaggatggaagctcgaaggagaatggaaagagggcgaagaagtacaggtactggcattggagcctggcaaaaatcctagggcagtccaaacgaaaccaggattattcaaaactaatactggaactataggagcagtcagcttagacttttcgccaggaaccagcggaagccccatagtagataaaaagggtaaagtcgtaggtttatacggtaacggtgtagttacacgaagcggcacatacgtaagtgccatcgcacaaactgaaaagagcattgaagataatcctgagattgaagatgatatattcagaaagaaaagacttacaatcatggacttacatccgggcgcaggaaagaccaaacgctacttgccagccatagtaagagaagcaataaaacgtggacttagaacccttattttagctccgacaagagtggtggccgctgaaatggaagaagcattaagagggttaccaataagatatcaaacacccgcaataagggcagaacatacaggaagggaaatagtagatttaatgtgtcacgctacgtttaccatgcgcttattatcaccagtcagagttcccaactacaacttaataatcatggatgaagcacattttaccgatcctgcatcaatagctgctcgaggatatatcagtacaagagttgaaatgggagaagcggcaggtatattcatgacagcaacaccaccaggaagtcgggacccatttccccaatccaatgctcctataatggacgaggagcgtgaaatacctgaaagaagctggaactccggacacgaatgggtaacagactttaagggtaaaaccgtatggttcgtaccatcgataaaggcaggaaatgacatagctgcttgtttgaggaaaaacggaaagaaagtaatccaactatctagaaaaacgttcgatagcgaatacattaaaacaagaactaacgactgggactttgtagtaactacggatatcagcgaaatgggggcaaactttaaagcagagagagtaatcgatcctcgaaggtgtatgaagccggtgatcctaacagatggagaagaaagggtcattctagcaggccctatgccggtcacccacagcagtgctgctcagcgcagaggaagaataggcaggaatcctaaaaatgaaaacgatcaatacatatatatgggtgagccacttgaaaatgatgaggattgcgcccattggaaggaggcaaaaatgcttctagacaacataaatacaccggaagggataataccatcgatgtttgaacctgaacgcgaaaaggtagacgctatagatggagaatacagactacgcggcgaagcaaggaaaacattcgttgatttaatgcgtagaggagacctcccagtatggctagcctaccgcgtcgcagctgaagggataaattatgcagatcgaagatggtgttttgatgggataaagaacaaccaaatcctcgaagaaaacgttgaagtcgaaatatggaccaaagaaggtgaacggaagaaattaaagccacgatggctagatgctcgcatttactctgatcccttagcgctgaaagagttcaaagaatttgctgcaggaagaaaaagtttgactctcaatttaataactgaaatgggtcggctaccaacgtttatgactcagaaagccagaaatgctttagataacttggctgttctacacactgcggaagcaggaggccgtgcatataaccatgcactctccgagctgccggagacacttgagaccctactactactaacattattagctacagtaacaggcggaatatttttatttctcatgtcaggaaagggtattggcaaaatgacgctaggtatgtgttgcataatcaccgcaagcatactattatggtatgcgcagatccaacctcactggatagcggcttcgatcattctcgagttctttctaattgtactactcatacctgagccagaaaaacaaagaactcctcaagacaatcaattaacttatgtagttatagcaatactaacagtcgtcgccgcaactatggcaaatgaaatggggttcctcgagaaaactaagaaagactttgggctcgggtctatcgcaacccatcaaccagaatctaacatactagatatagatttaagaccagccagtgcatggactctctatgctgtcgcaacgacattcataaccccgatgctgagacattctattgaaaactcctccgtcaatgtcagtctgactgctatcgctaatcaagcaactgtcctaatggggcttggaaaaggttggcctctctccaaaatggacataggggttcccctgcttgccataggatgctatagtcaagtcaatccaataacacttacagccgctttattactcttagtagcccactacgctattataggcccgggtcttcaagctaaagctaccagggaagcgcagaagcgggccgctgccggaatcatgaaaaatccaaccgttgacggcatcacagttattgatctagatcccattccttatgacccgaaattcgaaaaacaactgggtcaagttatgttgttagttttatgtgtgacccaagtactgatgatgcgtacgacttgggccctttgtgaagctctgactctagcaaccggccccatctcgacattatgggagggaaatccaggcagattttggaacacaacgattgcagtaagcatggcaaatatattcagagggtcatacttagccggagcaggactactgttttcgataatgaaaaacaccgctaatacccgtcggggcacaggaaatacaggcgaaacattaggggaaaaatggaaaaatagacttaatgcactaggaaagtcagaatttcaaatttataaaaagtcaggcatccaagaagtcgacagaacactggctaaagaagggataaaacgcggagaaacagatcatcatgcagtatccagaggttccgcaaaattgcgttggttcgtagaaagaaatctggttaccccagagggaaaggttgtagatcttggatgtggaagagggggatggtcctattattgtggtggactcaaaaacgtaagggaagtaaaaggtttaactaaaggcggtcccggacacgaagaaccaattccgatgtcaacgtatggatggaatctcgtaagattgcagtctggggtagacgtgtttttcacccctccagaaaaatgcgacacattactgtgcgatatcggagaaagttctcccaatcccacggtggaggcgggaagaacattacgcgtattgaatcttgtcgaaaactggttaaataataatactcaattttgcattaaagttctcaacccttacatgccatccgtaattgagaaaatggaagccctacaacggaaatatggaggggccttagtaagaaacccactaagtagaaattctactcatgaaatgtattgggtatcaaacgcaagtggcaacatcgtgagtagtgtaaatatgatttcacgaatgttaattaacagatttacaatgcgacataagaaagccacatacgaaccagatgtagatttgggatctgggacaaggaacattgggatcgagtctgaaaccccaaatctagatattatagggaaacgaatagagaaaattaaacaagaacatgaaacttcatggcattatgatcaagatcatccctacaagacctgggcgtaccacggaagttatgagacgaagcaaacaggaagcgcaagctctatggttaatggcgtcgtaagattactaacgaaaccttgggatgtaataccaatggtcacgcaaatggcgatgactgacacaacaccttttggccagcagagagtttttaaggaaaaggtagacactaggacacaggaacccaaagaaggcactaagaaattaatgaagataactgcagaatggctctggaaagaactcgggaagaagaaaactccgagaatgtgtacacgggaagaatttacgagaaaggtaaggtcaaatgcagcattaggagcaatattcactgacgaaaataagtggaaatcagctagagaggccgtagaggattcaagattctgggagctcgttgacaaagagagaaacttgcatctcgagggaaaatgcgaaacatgtgtttataatatgatggggaaaagagaaaagaaattaggggaatttggcaaagcaaagggttcacgggcaatatggtacatgtggttaggcgcacggttcttggaatttgaagccttaggtttcttaaatgaagatcattggttctctagagaaaattccctatcaggtgtagagggtgaagggctccataagttaggatatatattaagagatgtttcgaagaaagaaggaggtgcgatgtacgctgatgacaccgctggttgggatacaagaatcacgctagaagacttaaagaacgaggaaatggtaacaaatcatatggagggcgagcataaaaagttggccgaagcgatattcaaacttacatatcaaaacaaagtagttcgagttcagcggccaacaccacgcggaacggttatggacatcatatcaagacgagatcaaagaggcagtggccaagtgggtacatacggcttaaacacattcacaaatatggaagctcaactgattcgacagatggaaggtgagggtgtttttaagtcaatacaacacttgacagtcacggaagagatagccgtacaaaattggttagcacgagtaggtagagaacgactctcacgtatggcgatatcgggggacgactgcgtggtaaaaccactcgatgataggttcgctagcgccttaaccgcattaaatgacatgggcaaggttagaaaagacatacaacaatgggaaccgagccgtggatggaacgattggacacaagtgccattttgcagtcaccatttccatgaattaataatgaaagatggcagagtcttggtggttccctgcagaaatcaagacgaattaattggaagggcaagaatctcacaaggagcaggatggagtctcagagagacagcatgcttgggaaaatcttatgctcaaatgtggtcactgatgtacttccatcgacgtgatctcagattagccgctaatgcaatctgcagcgcggtaccatctcactgggtgcctacttctagaacaacatggtctatacatgctagacacgagtggatgacgactgaagacatgctaactgtgtggaacagagtctgggtacaagaaaatccctggatggaagataaaacacctgtagaatcatgggaagaaattccatacctaggtaaaagggaagatcaatggtgtggcagcctaatcggcttgacaagtcgcgcaacatgggcgaagaacatacagacagctatcaatcaggtccgaagcctaatagggaatgaggagtacaccgactacatgcctagcatgaaaagattcagacgcgaagaggaagaagcgggcgtgctatggtag

SEQ ID NO: 22909 - RNA, 9876 nt, synthetic construct
  misc_feature 1..9876: note = derived and/or modified CDS sequence (opt6) from DENV-2__GQ398268__SS-prME
  source 1..9876: mol_type = other RNA
actgcaggtatgataattatgttaatacccactgtaatggcatttcatctaacaacacgaaatggagaaccacacatgattgtcagtagacaagaaaaagggaaatctttattgtttaaaactgaagacggagtcaacatgtgcacactaatggcaatggatttaggtgaactatgtgaagatactataacctacaaatgtccattacttcgtcaaaacgaaccggaagatattgattgctggtgcaattctacgtcaacctgggtaacttatggtacgtgtaccactacaggtgaacataggagggagaaaaggtcagtagctctcgtaccacatgtgggtatgggcttagaaacccgcactgaaacttggatgagtagtgagggagcatggaaacacgcacaaagaatagaaacgtggatactaagacacccaggttttacaattatggcagcaatactagcatacactattggtacaactcactttcaacgagctctgattttcatactactaacagccgtagcaccgtcaatgacaatgagatgtataggaatatcaaaccgggactttgtggagggtgtatcagggggatcatgggttgacattgttttagaacatggctcatgcgtgactactatggctaaaaataaaccaacgttagattttgaattaataaaaactgaggcaaaacaaccggcaacccttcgaaaatattgtattgaagcgaaattaacgaacacaaccacggagagtaggtgtccaactcaaggtgaaccttcattaaacgaggagcaagacaaaaggtttgtatgtaaacatagtatggtggacagaggctggggtaatggatgtggtctattcggaaaaggcggaattgtcacttgcgcaatgtttacctgcaagaaaaatatggaaggtaaagttgtacagccggaaaatttggagtatacaatagtcattacaccacattcaggcgaggaacacgcagttgggaacgacaccggcaaacatggtaaagagatcaaaatcactccacaaagttctatcacagaggcagaacttacaggatatgggactgtaacaatggagtgttcgccacgcacggggctagattttaatgagatggtattattacagatggaaaacaaagcctggctggtgcataggcagtggtttctcgaccttccactaccatggttacctggtgcagacacgcaaggtagtaactggatccaaaaagaaacattagtcacattcaaaaatccccacgcgaagaaacaagacgtggtagttttaggatcccaggaaggggccatgcatacagcactcactggggctacagagatccaaatgagcagtggcaacctattatttacagggcatcttaaatgcagactacgcatggataaattacaattgaaaggcatgtcttatagtatgtgcactggtaaatttaaagtagtaaaagaaatcgcagaaacccaacacggaactatcgtaatcagagtacaatacgaaggcgatgggtcgccatgtaaaatacctttcgaaatcatggatctggaaaagagacacgttctaggaagattgatcacagtaaatccaatagtaaccgagaaagatagtcctgtaaacattgaagctgaaccaccattcggagatagttatataataattggagttgaacccggacaactaaagttgaattggtttaaaaagggatcgtcaataggtcaaatgtttgaaacaacgatgaggggcgcgaaaagaatggcaatcttgggcgacacagcgtgggactttggatcactaggaggggtcttcaccagtatcggaaaagcgctacaccaagtctttggggcaatatatggagcggcattttcaggtgtctcctggaccatgaaaatcctcattggtgtaatcattacatggatagggatgaacagtaggagtacaagtcttagtgtgagcctagttctcgtgggagttgtaaccctttatctaggagtaatggtgcaagccgactcaggatgtgtagtatcatggaaaaataaagaattgaagtgcggaagtgggatatttatcactgataacgtacatacctggaccgaacaatacaagttccaaccagaaagcccatcaaaattagccagcgcgatacaaaaagcccacgaagaaggaatttgtgggattcgatcagttactcgtttagaaaacttgatgtggaaacaaatcaccccagaactaaaccatatattaagtgagaacgaagtaaaattgacaatcatgactggagacatcaaagggataatgcaagcagggaaacgctcattgcgcccacaaccaacagaactaaaatatagttggaaaacctggggaaaggcaaagatgttgtcaactgagagtcacaaccaaacctttttaattgatggtcctgaaactgcggaatgtccgaatacgaaccgagcatggaactctcttgaggttgaagactatgggtttggtgtcttcacgaccaatatctggttaaaacttagagaaaaacaagatgtgttctgcgatagcaagttgatgtcagcagctattaaagataaccgagctgtacatgctgatatgggatattggatcgaatctgccttaaatgacacatggaaaatagaaaaagcatcgtttatagaagtaaaaagctgccactggcccaaaagtcataccctatggtctaatggcgtgctggagtcagagatgattatacctaaaaacttcgcagggccagttagtcaacacaactacagaccaggatatcatacccaaacggccggcccctggcatctcggtaaactcgaaatggatttcgatttttgcgagggaacgacagttgtcgtcacggaggattgtggcaacagaggaccctccttaaggacgacaactgcaagcggaaaactaataacagaatggtgctgtcgctcatgcacccttccaccactaaggtatcgtggagaagacgggtgttggtacggaatggaaattagaccattaaaagaaaaagaagaaaacctggtcaactctctagttactgccggacatggtcagatagataacttctctctgggagtgctgggtatggcactatttcttgaggagatgcttcgaactcgtgtaggaacaaaacatgctatattgctcgttgctgttagttttgtaacacttattacgggcaacatgtcattcagagatcttggacgagtgatggtaatggtaggagcaactatgacagatgatataggaatgggcgttacctatttagcactattagctgctttcaaagtaagaccaacttttgcagcaggtctattgctgcgaaaactaacctccaaagaattgatgatgacaacaatcgggatagtcctattatcccagtccaccatacctgaaacaatcctggaattaacagatgcactagctcttggcatgatggtcttaaaaatggtccgaaaaatggaaaagtaccagctagcagtgactataatggctatactgtgcgttcctaacgcagtcatactacaaaatgcgtggaaagttagttgtacgatattagcagtagtatcggtctcacccctactgttaacaagtagtcaacaaaaagccgattggataccattggctctaacgattaaaggactaaatcccacggcaattttccttaccacgttaagcaggactaacaaaaagcgatcatggcctttaaacgaagccattatggctgtgggaatggttagcatcctcgcatccagtctactgaagaacgatatcccgatgactgggccattagtagcaggaggattgttaacggtctgctatgtattaacgggacgatccgctgatctagagttagaaagggccgctgatgttaaatgggaagatcaagcagaaattagcggatcatctccaatattatcgataacgatatctgaagacggatcgatgagcatcaaaaatgaagaagaagaacaaacactaacgatactaattagaacggggttacttgttatatcagggctatttccagttagtataccgatcacagcagcagcctggtacctctgggaagttaagaaacaaagagcaggagttctttgggatgttccaagcccaccgccagtcggaaaagcagaactagaggacggagcctaccggataaaacaaaaaggtattcttggatacagtcaaattggcgcgggggtctacaaagagggaacatttcacacaatgtggcatgtaacacgcggagctgtactgatgcacaagggaaagagaatagaaccaagctgggctgatgttaagaaagatttgatatcctacggaggaggttggaaactagaaggtgaatggaaagagggtgaggaggttcaagtactagcattggaaccaggcaagaatccaagggctgtacaaacaaaaccgggactttttaagacaaatgctggaaccattggtgccgtttcattggattttagccctggtacgagcggtagtccgataatcgacaagaaagggaaggtcgtaggactgtacgggaacggcgtggttaccagatcaggtgcttatgtgagcgcaattgcgcaaacagaaaaatccattgaggacaatcctgaaatcgaggatgatatatttagaaagaggaaacttaccatcatggatttacacccgggagcgggaaagaccaaaagatatcttcctgcaattgtaagagaagctattaagcgaggcttacggactctaattcttgcgcctacaagagtggtggcagcagagatggaagaagccttacgtggcttaccaattagatatcaaacaccggccattagagcagagcatacaggacgcgaaatagtcgacttaatgtgccacgccaccttcacgatgagattactatccccagtgcgtgtacctaattacaacttgataattatggacgaggcacattttaccgacccagcatccattgccgcaagaggctatatttcaactcgcgtcgagatgggagaggcagcgggcatcttcatgacagcgacaccacccggctcaagggacccattcccacaatctaatgcacccattatggatgaagaaagagaaattccagagagatcatggagtagtggtcacgaatgggtcaccgacttcaaagggaagactgtctggttcgtcccctcgataaaagcggggaatgacatagcggcttgtttaaggaaaaacgggaagaaagttattcagcttagccgaaaaactttcgatagtgaatatgtgaaaaccaggaccaacgattgggattttgtagttactactgacatttcagaaatgggagctaattttaaggccgaaagagttatagaccctcgaagatgtatgaagccagttatattaacagatggagaggaaagagtaatccttgcaggaccgatgccggttactcattcatcagctgctcagagaagaggaaggattggtaggaatcccaagaatgaaaacgaccagtacatatatatgggagaaccgttagaaaatgatgaagattgcgcgcattggaaagaagcaaaaatgttactagataatataaatacaccagagggaataataccctcaatgtttgaaccggaacgcgagaaagtggatgccattgatggggagtatcggcttagaggggaagcacgcaagacctttgtagatcttatgcgacgtggagatctcccagtttggcttgcatatagagttgccgcagagggaataaattatgctgatagaagatggtgttttgatggcatcaagaacaatcagattctcgaagaaaacgttgaagtagaaatatggacaaaggaaggtgagcgtaagaaattaaagcccagatggctagatgcacgaatatactctgaccctttggcattaaaggaatttaaagaatttgcggcaggtagaaaatcacttacattaaatctaataacagaaatgggaaggcttcctactttcatgacacaaaaagcaagagacgcactcgataatttagcggtattacacacagcggaagcaggagggagagcttataaccatgctttgagcgaactaccggagacgcttgaaactcttctcctactaacccttctagcgacagtcacagggggaatattcctatttctcatgtccggtagaggcatagggaaaatgacgttaggtatgtgctgtataataacagcgagtatactgttatggtatgcacaaatccaaccacactggattgcggcatcgattatattagaatttttcctcatagtactattgatccccgaaccagaaaaacaacgaacgccgcaagacaaccaactcacatatgtagtaattgctattttgacagtagtcgcagcaacaatggccaacgagatgggctttctggaaaagacaaagaaagatctgggtttgggatcaataacaacgcaacaaccggaaagcaatattttggatatagacttacgtccagcttcagcttggactctatatgcagttgcaaccacatttgtaacaccaatgttaaggcattctatagaaaattcgtcggtaaacgtgagtttaacggcaattgcaaatcaagccacggtacttatggggctaggaaaaggttggcccttatcaaaaatggacataggagtaccattactggcgataggatgttatagccaggtgaatcctataaccttgacagccgcgctgcttcttctagttgcccattacgcaattataggccctggattacaggccaaagcgaccagggaggcgcagaaaagagctgcagctggaatcatgaaaaatcctaccgtggatgggataaccgttattgacttagaccctattccctacgacccaaaatttgagaagcaacttggtcaagtaatgctgttagttctttgtgtgacccaagttctgatgatgagaacaacttgggcgttgtgcgaggcgcttactctagctacaggacccatatccacattatgggaagggaatcccggaagattctggaatacaactatagctgtcagcatggccaatatatttagagggtcttacttggcaggcgcgggtctactcttttcaattatgaaaaacacaaccaatactagaagagggaccggtaatatcggtgaaaccttaggcgagaagtggaaatctcgattaaatgccttgggaaaaagtgaatttcaaatatataagaaaagtggaatccaggaagtagatcgtactcttgcaaaggaaggtataaagagaggagaaacagaccaccatgctgtgtcgcgtgggagcgcaaagctaagatggtttgtagaaagaaacatggttacaccggaaggcaaagttgtcgatcttggatgcggacgcggaggctggtcttattattgcggtggtttaaagaacgttcgtgaagtaaaaggtctcactaaaggtggtcccggacatgaagaacctattcctatgtctacttatggttggaacctcgtacgactgcaaagtggagtagacgtattcttcacaccgccagaaaaatgcgatacattattgtgcgatattggggaatcgtcccctaacccaactgtggaagctggtcgaacacttagagtattgaaccttgtcgaaaattggctcaataataacactcaattctgcattaaggtcttgaatccatatatgcctagtgtcattgaaaagatggaagcattacaaagaaagtacggaggtgccctagtccgcaatccgttgagtaggaactctacacatgaaatgtattgggtctcgaatgcatccggcaatattgtttcatccgttaatatgattagcagaatgctgattaataggtttacaatgagacataagaaagccacatatgaaccagacgtagatctaggtagtggtacgcggaacatcggaatagagagtgaaatacctaatctcgacattatcgggaaaagaattgagaaaataaaacaggagcacgagacaagttggcactacgatcaagatcatccatataaaacctgggcctatcacgggtcatacgaaactaaacaaactggttctgcatcaagcatggtcaatggagtagtaagattattaaccaaaccgtgggacgtcgttccaatggtgactcaaatggcaatgactgatacaacccctttcggtcaacaaagggtatttaaagaaaaggttgatacaagaacccaagagccaaaagagggcaccaagaaattgatgaaaattacggcagaatggctatggaaagagctcggaaagaaaaagacaccccgaatgtgtactagagaagagttcacaagaaaagtaaggtctaacgctgctttgggagctatttttactgacgaaaacaaatggaaaagtgctagagaggccgtcgaagatagtcgattttgggagctagttgacaaggaaaggaacctacatttagaagggaaatgcgaaacatgtgtgtataatatgatgggtaagagagagaagaaacttggagaatttggtaaggctaaaggaagccgtgcaatctggtacatgtggttaggtgctagattcttagagtttgaagcactaggattcttgaatgaggaccattggttttccagggaaaattccctaagtggagttgaaggcgagggtctgcacaaactaggatacattctgagagatgtctcgaagaaagaaggcggagcgatgtatgcagatgacacagccggttgggatacccgcataaccctcgaagacttgaaaaacgaagaaatggtaacaaaccatatggagggagaacataagaaactagccgaagccatattcaagctaacctatcagaataaagtggtccgagtacaacgacctactccgcgaggaacagtaatggatatcatctcaagacgggaccaacgcggaagtggtcaagtgggaacatacggactaaacacttttaccaatatggaagctcagttgattagacaaatggaaggagagggcgtatttaaatcgatacaacatctgaccgtcactgaagagatagcagtacaaaactggcttgcacgtgttggaagagaaagactatccaggatggctattagtggggacgactgcgtcgttaaaccattggatgaccggtttgcatctgcattaacggcactgaatgacatgggaaaagttcgtaaagatatacaacaatgggagccaagcagaggttggaacgattggactcaggtaccattctgttctcatcatttccatgaactaataatgaaagatggacgtgtcctagtagtgccttgtcgtaatcaggatgaattgattggcagagccagaataagccagggagcgggatggtcactaagagaaacggcctgtctaggcaaaagttacgcccaaatgtggtcactaatgtatttccatcgacgtgaccttcgccttgctgcaaacgccatctgttctgcagttccgagccactgggtacctacttcaaggacaacttggagtatacacgccaaacacgaatggatgacgactgaagatatgctaactgtatggaacagagtgtggattcaggaaaatccttggatggaagataaaacccctgtcgaaagctgggaagagataccctatttaggaaagcgggaagaccaatggtgtgggtcattaataggcttaacatctagagctacgtgggctaaaaatatacaaacagcaataaaccaggtacgatcactaatcgggaatgaagagtatacagattatatgccttcaatgaaaagattccgacgtgaagaagaagaagcaggagtcctttggtga

SEQ ID NO: 22910 - RNA, 9876 nt, synthetic construct
  misc_feature 1..9876: note = derived and/or modified CDS sequence (opt6) from DENV-2__GQ398263__SS-prME
  source 1..9876: mol_type = other RNA
actgctggcatgattataatgatgataccaacggtcatggcatttcatttaacgactcgaaacggggaacctcacatgattgtatcacgacaggaaaaaggtaaatctttactttttaaaaccgaagatggggttaatatgtgcacattgatggcaatggacctgggagaattgtgcgaggatacgatcacatataactgcccactattaagacaaaatgaaccagaagacattgactgctggtgtaactccacgtccacatgggtcacatacggtacgtgtaccgcgacaggagaacatagaagagagaaaagaagtgtagccttagtcccccacgtaggaatggggcttgaaacaagaactgaaacatggatgagttcggaaggagcatggaaacatgcacaacgcattgaaacttgggtactgaggcaccccggctttaccataatggcagcaatattggcatatacaatagggaccacttacttccaaagagtactgatatttatcttattgactgcagtagcaccctccatgacaatgcgctgtatcggtatctcgaatcgggacttcgtagaaggcgtcagtggtggtagttgggtagacattgtattagagcatgggagttgtgtaaccactatggctaaaaacaaaccaacactagacttcgaattaatcaaaacagaagcaaaacatccggcgaccttaaggaaatactgtattgaagcaaaattgaccaacacaactaccgcatctcgatgtccaacacaaggcgaacccagtttaaacgaagaacaagacaaaagattcgtatgtaaacatagtatggtggatcgagggtggggtaacggatgtggtttattcggtaaaggcggtatagtgacttgtgctatgttcacatgtaagaaaaacatggagggaaaagtggtacagcctgaaaatctagagtacacaatagttatcacaccccatagtggtgaagaaaacgcagttggaaatgatacaggaaaacacggtaaagaaattaaaataacgccccaaagttcaatcacagaagctgagctgacagggtacggtacagtaacaatggaatgttcgccgcgaacaggattagactttaatgaaatggttctcctccaaatggagaacaaagcctggctggttcatagacaatggttccttgatctaccgctcccatggcttccgggagcagacacgcaagggtctaactggatacaaaaagaaacattagtaactttcaaaaacccacacgcgaagaaacaagacgttgttgtactgggttctcaagagggggccatgcatacagctttaaccggcgctaccgaaatccaaatgtcaagtggaaatttgttgtttacagggcacctaaaatgtcgactgcgcatggataaattacaattaaaaggtatgtcttattcaatgtgcactggaaaatttaaagtcgtaaaagaaattgccgaaactcagcatggcactatagtagtaagggttcaatatgagggtgatggttcaccttgcaaaatcccatttgaaataatggatcttgagaaacgccatgttttaggccgattaataacagtaaatccaatagtcactgaaaaagactcacctgttaatatagaggctgaaccgccttttggagacagttacataatcatcggggtggaacctggccaacttaaactgtcgtggtttaagaaaggttcttcgattggccagatgtttgagaccacgatgagaggcgcaaagcgaatggcgatactgggcgacactgcatgggacttcgggtccctaggaggggtattcacttcaataggtaaagcactccatcaagtatttggcgctatttacggtgcagcattttcgggcgtctcctggactatgaaaatactaatcggagtggtaattacgtggattggaatgaactcaagaagcacttcactgtcggtaagtctagtcctagtcggagtcgtaacactatatttgggcgttatggtgcaagctgatagtggttgcgttgtctcatggaagaataaagagttaaaatgcggatcagggatattcataacagataatgtccacacatggacagagcagtataagttccaacccgaatcaccatctaagctagcaagcgcgatacaaaaagcgcatgaagagggaatatgcggaataagatctgtcacacgattggagaatttaatgtggaaacaaataactcccgaattaaatcatatactcagtgaaaatgaagttaaacttactattatgaccggcgacataaaaggaatcatgcaagccgggaagcggtcactgagaccacaacccaccgaactaaaatattcatggaaaacttggggaaaagccaaaatgctatcgaccgaactacataaccatacctttttgattgatggacctgaaactgccgagtgcccaactaccaatagagcatggaatagcctagaagtcgaagactatggatttggcgttttcacaacaaacatttggttgaaactgaaagagagacaggacgtattatgtgatagtaaattgatgagcgcagctatcaaagacaaccgagccgtacacgccgatatgggatactggatcgaaagtgcactaaatgatacatggaaaatagagaaagccagctttatagaggttaaatcctgccactggccaaagagccatacactttggtctaacggagtccttgaaagtgaaatgatcatacccaaaaatttcgccggtcctgttagtcaacataactatagaccaggatatcatacgcaaaccgctggtccatggcaccttgggaaactcgaaatggattttgatttctgtgaagggacaacagtcgttgtgaccgaagattgtggtaatagaggaccatcattaagaacaacaaccgcaagtgggaagttaattacggaatggtgttgcaggagctgcacactgccacctctaagatacagaggagaggatggttgctggtacggaatggaaataaggccgttaaaagacaaggaggaaaacttggtaaatagtttagttactgccggccacggacagatagacaacttttcacttggagtattaggaatggcgctattcctcgaagaaatgctaagaaccagggtagggaccaaacacgcaatattgctcgtagcagtatcattcgtaacactgataactggtaacatgagcttcagagatcttggcagggtcatggtaatggtaggtgcaacaatgaccgatgatataggcatgggggtcacttatttagctctgctcgcagccttcaaagtacgccccacattcgctgctggtttactgctgagaaaattaacctcaaaggaactaatgatgactacaatcgggatagtcctgctaagtcaatcaactataccagaaaccatactcgaacttactgatgccttggctttagggatgatggtcctaaaaatagttagaaatatggaaaagtaccaattggcggttacgataatggccatcttatgtgttccaaacgcagtgatactgcaaaacgcttggaaagtaagttgcacaattcttgccgttgtgagtgttagtcccttgctgctaacatcgtcacaacaaaaagcagattggataccgttagctttaactataaaaggattaaacccaacggcaatctttttgacaacactttcgcgaacttccaagaaaaggagctggcccctaaacgaagcaataatggctgttggaatggtatcaatactagcatcttctctattaaagaatgacattcccatgacaggtcccctagtagctggtggtctactaaccgtgtgttacgtcttaacgggtcgcagcgcagatttagaactagaaagagccgcagacgtcaggtgggaagatcaggcagaaatatcaggttcctcgccaatcctttctattactatatcagaagacggcagtatgtccataaagaatgaagaagaagaacaaacattaacaattctaatacggactggtcttctagtcatcagcggtttatttccagtctctattccaattacagcggccgcatggtacttatgggaagttaagaaacaaagagcgggcgtactgtgggacgtgccgtcgcctccgcctgtgggaaaagcagaactagaggatggggcttataggataaaacagaagggaattttaggatactcccaaatcggagcaggcgtgtataaagaagggacattccacacaatgtggcatgttactcgaggagctgtattaatgcacaagggtaaaaggatagagccatcatgggctgatgtaaggaaggacttaattagctacggtggcggatggaagctagaaggggagtggaaggaaggtgaagaagtacaggtacttgctttggaacctggtaaaaatccgagggctgtacaaaccaagcctggattatttaaaactaacactggaacaataggggcagtgtctttagacttttcaccaggcacaagtggtagccccattgttgataagaaaggcaaagtagtaggcttatacgggaacggggtagtaaccaggtcaggtacatacgtaagcgccatagcacaaacggaaaaatcaatcgaagataatccagaaatagaggatgatatcttccgtaagaaacgattaacaataatggacctgcatcccggcgccggaaaaacaaagagatatttgccagcaatagtaagagaagctataaagcgtgggctgaggactttgatactggctccgactcgggttgtagcagcagaaatggaggaagctctacgtgggctaccgataaggtaccaaactcccgcaatacgagctgaacatacaggcagggaaatagtagatttaatgtgccacgcgactttcacaatgagactattatctcctgtcagagtacccaactataatctaataatcatggatgaagcacactttacagatccagctagtatagctgcaagaggatacatatcgacgagggttgagatgggagaggcggcgggaatatttatgacagctacaccaccagggtccagagatccctttcctcaaagtaatgcgccaatcatggatgaagaaagagaaataccagaaagaagctggaatagtggacacgagtgggtgacagattttaaaggaaaaactgtttggtttgtgcccagtattaaggcagggaacgatatcgcagcgtgcttaagaaagaacggtaaaaaggtcatacaattaagccgtaagacctttgattccgaatacatcaaaacacgaacgaacgattgggattttgttgttacaacagatatatcagaaatgggcgccaactttaaggcggaaagagtgattgacccccgaagatgcatgaaacctgtaatattaactgatggtgaagaacgcgtaatcctggcaggcccaatgccagtaacccactcgtcagccgcacaaagacgtggtcgaatcggaagaaacccgaaaaatgaaaatgaccaatatatatatatgggggagccgctcgaaaatgatgaggattgcgcacactggaaagaagcaaagatgcttctagataacataaatacgcctgaaggtataataccatccatgtttgaacctgagagagaaaaggtcgacgcaattgatggtgagtatagattacgtggagaagctcgcaaaacttttgtagatttaatgagaaggggcgatttaccagtctggttagcctatcgagttgccgcagagggaataaactatgcagataggcgatggtgtttcgatggaatcaaaaataatcagattcttgaagagaatgtagaagtcgagatatggacgaaagaaggagaaaggaaaaagctaaaaccgagatggctagatgcgagaatatatagtgacccattggctttaaaagaatttaaggagttcgcagcgggaaggaaaagtctaaccctcaatctgatcactgaaatgggtaggctaccaacattcatgacgcaaaaagctagaaacgcactagataacctcgcggtacttcataccgcagaagctggtggtagagcatataatcatgcactttcggagttacctgaaacgctagagacattgctactattgacacttctagcaacagtgaccggaggaatatttttgttcctaatgtcaggaaaaggtataggtaaaatgacattaggaatgtgttgtataattacagcaagcatcctgctttggtatgcacaaatacaaccgcattggattgcagctagcatcatactcgagtttttccttatagttttattaattccagagcccgaaaagcaaagaacaccgcaggacaatcaactaacctatgtcgtaatcgcaattcttacggtggtggcggcgacgatggccaatgaaatgggtttcctggagaaaactaagaaagatttcgggttaggctccattgcaactcagcaacccgagagtaacatattagacatcgacttgcgtccagcgtccgcatggaccttgtacgccgtcgccaccactttcatcacaccgatgttgaggcatagtatagaaaatagcagtgtaaacgtgagcttaaccgctattgctaaccaggcaaccgtattaatgggtctaggtaaaggatggcctttaagtaaaatggacattggggtcccattacttgcaattggctgttattcacaagtaaatccgatcaccttaacagcagctctacttttgttagtcgcgcattacgcaataattggaccaggattacaagctaaagcaacacgcgaagcacaaaagagagcagccgcaggaataatgaaaaatcccacagttgatggaattactgttatagaccttgacccaataccctacgaccccaaattcgagaagcaattagggcaagttatgcttttagttttgtgtgtcacccaagtactaatgatgagaacgacgtgggctctgtgtgaagctctcacactagcgaccggaccaatcagtacgctttgggaaggaaatccagggcgcttttggaataccacaatagctgttagtatggcaaacatatttcgaggatcgtatctagcaggagctggactcctgttttccataatgaaaaatactgcgaacacgcgccggggaaccggtaataccggcgaaacgctgggagaaaagtggaagaatagactaaatgcattagggaagagtgaatttcaaatatataagaaaagcgggatccaagaagtagacagaacattagcgaaagaagggattaaacggggtgaaacggaccaccatgcagttagtcgaggatccgcaaaactaagatggtttgttgaaagaaatctggttacgccagagggcaaggtcgtggatttgggttgtggtcgaggagggtggtcttattactgtggtggacttaaaaatgttaaagaggtaaaagggctaacaaaagggggacctggacatgaagaacctataccaatgtctacttatggatggaatctagttagattacagtctggtgttgatgtctttttcaccccgccagaaaaatgtgatacactcctttgcgatataggggaaagttcaccaaatccaacagtagaagctggtcgaacattacgggtattgaacttagtggaaaactggttaaacaataacacacaattttgtattaaagtattaaatccctatatgcccagtgtgatagaaaagatggaagcgttgcaaagaaaatatgggggcgctcttgttagaaatccgctctcacgaaattctacgcacgaaatgtattgggtatctaacgcctccggcaacatcgtatcttccgtcaatatgatttcccgaatgttaatcaacaggtttactatgcgacacaagaaagccacatacgagcctgatgtggatttaggaagtggtacaaggaatataggaattgaaagcgagattccaaacttggatgtgattgggaaacgaatagagaaaataaagcaagaacatgaaacaagctggcactatgaccaagaccatccctacaaaacatgggcctatcacggatcatatgaaactaaacaaaccggatccgcatcatccatggtcaacggcgttgttagacttttaacaaagccttgggatgtaattcccatggtaacacagatggctatgacggatacaaccccattcgggcaacaaagagtcttcaaagaaaaagtagacacgagaacacaagagcccaaggaaggaactaagaaattaatgaaaataacagcggaatggttatggaaagagctgggaaagaagaaaacaccgagaatgtgtaccagagaggaatttacaagaaaagtacgatccaacgcagctctaggagctatctatactgacgaaaacaaatggaaaagcgcacgagaagcagtagaagactctagattttgggagctggttgacaaagaaagaaacctccatctcgaaggaaaatgtgagacatgcgtttataacatgatgggaaaaagagagaagaaactaggagagtttggtaaagcaaaaggcagtcgcgcgatttggtatatgtggctgggtgcaaggtttctggaatttgaagcacttggatttttgaacgaggatcactggtttagtagagaaaactcgcttagtggtgtagaaggggaaggactacacaaacttggttatatattgcgtgacgtttcaaagaaggaaggaggtgctatgtatgcagatgatacagcaggatgggatactcgaatcacattggaagacctcaaaaatgaagaaatggtaactaaccacatggagggtgaacataagaaattagctgaagccatattcaagctcacataccaaaacaaggtggtacgagtacagagaccaacaccccggggcacagtcatggacataatatcccggcgcgatcaacggggatcaggacaagttgttacgtacggtctaaataccttcacaaacatggaagcgcaactaatcaggcaaatggaaggagaaggagtttttaagagcatacagcatttaaccgtgacggaagagatcgccgtgaaaaattggctcgcacgagtggggcgtgaaaggttaagtcgtatggccataagtggtgatgactgtgtggtaaaacccttagatgatcgtttcgcaagcgctctaacagcattaaatgacatggggaaagtgcgcaaggacatccaacagtgggagccatcgagaggttggaacgattggacccaagtaccattctgctcacatcattttcatgagcttataatgaaagatggtagagtcctagtagtcccttgccgtaatcaggatgaactgatcggacgcgctcgcatatcacaaggagcaggttggagtttaagagaaactgcgtgtctgggaaaatcgtatgcacaaatgtggtctttaatgtatttccatcgacgtgatttaagacttgctgccaatgcgatatgctcagctgttccctctcactgggtacccacttcccggactacatggtcaatacatgcaacgcatgaatggatgacaactgaagacatgttaacagtatggaacagagtatggatccaagaaaacccttggatggaagataagacgcccgttgaatcttgggaagagataccctatctgggtaagagagaagatcaatggtgcgggagtttaatagggttgacctccagagcaacgtgggctaaaaatatacagactgctatcaatcaagtcaggagtttaatcgggaacgaagagtacacagattacatgccctccatgaaaagattcagacgcgaagaagaagaagcaggagtattgtggtaa

SEQ ID NO: 22911 - RNA, 9876 nt, synthetic construct
  misc_feature 1..9876: note = derived and/or modified CDS sequence (opt6) from DENV-2__GQ398264__SS-prME
  source 1..9876: mol_type = other RNA
acggcaggtatgattataatgatgatacctacagtaatggcatttcacctaaccactagaaacggagaaccacacatgatagtttcaaggcaagaaaaaggtaaatcactattgtttaaaactgagaacggagttaatatgtgtacacttatggctatggatttgggtgaactatgtgaagatacgattacgtataattgtccattacttagacaaaatgagcccgaagatatagactgttggtgtaattcaacgtcgacgtgggtaacgtacggaacctgtaccgcaacaggtgagcacaggagggaaaaacgatcagttgccttagtaccccatgtaggaatgggtcttgaaacgagaacggagacgtggatgagttcggaaggcgcttggaaacacgcacaaagaatcgaaacatgggtgctacgtcatccaggttttacaataatggcggcaatcctcgcgtacacaataggcacaacatacttccaacgagtcttaatattcatactcttaacagctgtggcaccaagtatgacaatgcgatgtataggtatttctaatagagatttcgtggagggagtctctggagggtcttgggtagatatcgtcctagagcatggaagttgcgtcacaacaatggcgaaaaacaaacctacattggattttgaattaattaaaactgaagcaaaacatccagctactttaagaaaatattgtatcgaagccaaattaaccaatacaacgactgcgtcacgatgccctacgcaaggggaaccctcattaaatgaagaacaggataaacgatttgtatgtaaacatagcatggtagacaggggttggggtaatggatgcggcctgttcggaaaaggaggaatcgtgacttgtgcaatgtttacatgcaagaaaaatatggagggcaaagttgtacagcccgaaaatttagaatatacaatcgtaataactccacattcaggcgaagaaaatgcagtaggaaacgacacaggtaaacatggtaaagagataaaaattacaccgcaatcgagtattacagaggcagaactaactgggtatgggacagtaactatggaatgttccccacgaactggattagattttaatgagatggtactcctacaaatggaaaataaggcttggcttgtacacagacaatggttcttggacctacctctaccatggcttccaggagcagatacgcaaggcagcaattggatacagaaagaaacattagtcacgtttaaaaatcctcatgccaagaaacaagacgtcgtagttttaggaagccaagaaggcgcaatgcatactgcgttaacaggagcaacagagattcaaatgtctagcggtaatttattatttaccggacacctgaaatgccgattgagaatggataaattgcagttaaaaggcatgagctactcaatgtgtacaggtaaattcaaagttgtcaaagagattgcagaaacccagcacggaacaattgtaattagagtacaatatgaaggcgatggttccccctgcaaaatcccatttgaaattatggatttagagaaaagacatgttttaggaagactgattacggtgaacccaattgtaacagaaaaggactcacctgtcaatatagaagcagaacctcctttcggcgatagctatattattattggagtagaacctgggcagctaaaattatcatggtttaaaaagggctcgagtataggacagatgttcgaaacgacaatgagaggagcaaaaagaatggcgatcttgggagacaccgcatgggactttgggagcttaggtggagtgttcacatcgataggtaaagcattacatcaagttttcggtgcgatttacggtgcagctttttcaggtgtttcgtggaccatgaaaatactaataggagttgtcataacatggatagggatgaactcaagatcaactagcttgtccgtttcactcgttcttgtgggagtggtcaccttatatctaggcgtaatggtacaggctgacagtggatgcgtagtatcctggaaaaataaagaactgaagtgtgggtcaggaatattcataacagacaatgtgcatacttggactgaacaatacaagtttcaaccagagtctccatccaagttagctagtgcaatccagaaagcccacgaggaaggcatatgtgggataaggtcagtcacaagacttgaaaatctaatgtggaaacaaattacaccagaattaaatcatatattaagtgaaaacgaagtaaagttaaccataatgactggagacataaaaggaataatgcaagctggaaagcgatctctcagaccccaacccacagaacttaaatattcttggaaaacctggggaaaagccaaaatgttaagtacagaattacataaccatactttcttaatcgatggtcccgaaactgcagagtgtcccaatacaaatagggcttggaacagtttagaagttgaggattatgggtttggggtattcacaacgaatatatggctcaaacttaaagaaaggcaggatgtattttgcgattcaaaattgatgtcagcagcaatcaaagataatagagctgtgcatgcggatatgggctattggatagaaagtgcactcaacgatacatggatgatagaaaaggcttcttttattgaagtaaaatcgtgccattggcctaaaagccacacactatggtcgaacggggttttggaatctgagatgatcataccgaaaaactttgcggggcctgtgtcacaacataactatcgtccaggctatcatactcaaacagccggtccttggcagttaggcaaactggaaatggatttcgacttttgtgaagggacgacggtagtagtgacggaggattgtggaaatagaggaccgtcactaagaacaactaccgcctcagggaaacttattacagagtggtgttgcagatcatgcacattgcctccactacgataccgaggggaggacgggtgctggtatggtatggaaataagaccgcttaaggaaaaggaagaaaacctggtaaacagcctagtgacagcagggcacggtcaaattgacaactttagtcttggtgtattaggtatggctctatttctggaagaaatgctcagaactagagttggtaccaaacacgcaattctgttagtagctgtatcgtttgttactctaattactggaaatatgagttttagagatttaggaagagttatggtaatggtaggggcaaccatgactgatgatatcggaatgggtgttacctatctagccctgttagcggcctttaaggttagaccaacatttgcagccggattgttattacgaaaattgacatccaaagagttaatgatgactactatcggaatagttctattgtcacaatccaccattccagaaaccatattagaactaacagatgcactagcgcttgggatgatggtattaaaaatcgtgagaaacatggaaaaataccaactggctgtaactatcatggctatattatgtgttcccaatgctgttatcttacaaaatgcgtggaaagtaagctgcacaacgctagccgttgtttctgtaagcccactactacttaccagttcacaacagaaagcagattggatcccacttgcattaactatcaaagggctgaatccgactgcaatctttcttaccacgctgagtcgaacgtctaagaaacggtcctggccgctaaatgaagcaataatggcggttggaatggtgagtattcttgcatcttctttactcaaaaacgatataccgatgacggggccccttgtagctggtggccttctaactgtatgctatgtcctcacaggtagatcggcagatctcgaactggaaagagctgcagatgtaagatgggaagatcaggcagaaattagtgggtcatctccaatattatctattacaatctcagaagatggaagcatgtcaataaagaatgaggaagaagaacaaacacttaccatcctcatccggacaggtttgttggtaataagtggactctttccggtaagtataccaattacggctgccgcatggtacctatgggaggtgaagaagcagcgagcgggagtattgtgggatgttccctcgcccccacctgtaggaaaagctgaattggaggacggtgcgtacagaataaaacagaagggtatccttggctactctcagattggcgcgggggtctataaggaagggacgttccataccatgtggcatgtcacccgaggagcagtcctcatgcataaagggaaaagaattgaacctagctgggcggacgtaaggaaggatcttatatcgtatgggggaggttggaaattagaaggtgaatggaaagagggtgaggaggttcaagttttagccctggaacctggtaaaaatccgagagctgttcaaaccaagcccggactttttaaaaccaataccggaactataggcgcagtatcactcgacttttcaccgggaacaagcggttccccaattgtagacaaaaagggtaaagtagtaggcttatacgggaacggagtagtcaccaggagcgggacatatgtttcagcaatcgcacagaccgaaaaatctatcgaggacaaccctgagatagaggacgacatatttagaaagaaacgattaacgataatggacttacatcctggagcaggaaaaaccaaacggtatctcccggcaatagttcgagaggctataaaacgtggtctaagaacgttaatcttagctcctactagagtagttgcagcagagatggaagaagcactgaggggtctaccaatacggtatcaaactccggcaataagagccgaacatacgggtagggaaatcgtagatctaatgtgtcatgcgacctttaccatgcgcttattgtctccggtcagggtgcctaattataacctaataataatggatgaagcacattttactgacccggcgtcgattgcagctcgtggatatattagtactcgagtagaaatgggtgaagcagcgggaatatttatgacggctacgcccccaggatcacgggatccttttccacaaagtaatgcaccaataatggacgaggaacgggagattccggagaggtcatggaactcaggacacgaatgggtaactgattttaaaggcaaaaccgtatggttcgtgccctctattaaagccgggaatgatatagcagcatgtctaaggaaaaatggtaagaaagtaatacaactgtcaagaaaaacatttgacagcgagtatataaaaacaaggaccaatgactgggacttcgttgtcacaacggatattagtgaaatgggggcaaattttaaagcagaaagggttattgatcccagacgctgtatgaaacccgtcatcctaacggatggagaggaaagagtcattctagcaggtcctatgccagtgacccatagtagtgcagctcaaaggcggggacgggttggcagaaatcccaaaaatgaaaatgaccagtacatatatatgggtgaaccgctagaaaacgacgaagattgtgcgcactggaaagaagcaaaaatgttacttgacaacataaacactccagaaggaattattcccagtatgttcgaaccagaacgcgaaaaagtagacgcaatcgatggagaatatagactacgcggagaggcgagaaaaacctttgtagatctaatgagaagaggagatctgccagtatggctagcataccgagtagcagcggaaggaataaactacgccgatagacgttggtgtttcgacggtgtaaagaacaaccaaatattggaagagaatgttgaagtagagatctggactaaggaaggtgaaagaaagaaattaaaaccgagatggttagacgcaagaatctactccgatccgctcgccctaaaagaatttaaggaatttgcagctggtcgaaaaagtttgacactaaatctaataacagagatgggcaggttacctacattcatgacacaaaaagcacgaaatgctctagacaacttagcagtgcttcataccgctgaagcaggcggtagagcctacaaccatgccttatcagaattacccgaaacattagaaacacttctgttgttaaccttattggccacagtgacaggcggaatatttttattcctaatgtccggcaaaggaattggtaaaatgacgctaggtatgtgctgtataataacagccagtatattactttggtacgctcaaatccaaccccactggatagcagcaagtataatattggagttcttcctgatcgtgctactcatcccagagcctgaaaagcagagaacaccacaggataatcagctaacatacgttgtaatagccattctaacagtcgttgcagcaactatggcaaatgaaatgggatttttggagaaaaccaagaaagattttgggctaggttcaactgcgactcaacagccagaaagtaacatcctagatatagatctccgacctgcatcagcctggaccctatatgccgtagctacaacgttcataactccgatgctaaggcactcgattgaaaattcatctgtgaacgtttctcttacggcaatagctaatcaagcaaccgttctcatggggctaggcaaaggttggccactaagtaaaatggatattggagtaccactcctggcaataggatgttatagccaagttaatcctattacacttacggcagccctattattattggtggctcattatgccatcatagggccaggtttacaagcaaaagcgacacgcgaagcgcagaagcgtgcagcggcaggaataatgaaaaatcctacagtagacggcattaccgtaatagacctagaccctataccgtatgaccccaaatttgaaaagcaattaggccaagtcatgctcttagtattatgcgtaactcaagtattaatgatgcgaactacttgggcattatgtgaagcgctcacattagcgaccggaccaatttcaaccctatgggaaggaaatccaggtagattctggaacacaacgattgcagtatctatggctaacattttcagaggatcctatttagctggtgccggattattatttagcatcatgaagaacacagccaacactagacgcggaactgggaacacaggtgaaacactgggagaaaaatggaaaaataggctaaatgctcttggaaaatctgaatttcaaatatacaagaaatctggcatacaagaggtagataggactttagcaaaagaaggaatcaaaaggggagaaactgaccaccatgccgtttcgcgggggagcgctaaactaagatggtttgtggagcgcaacttagttacaccagagggtaaagtagttgacctaggttgcggcagaggcggctggagttattattgtgggggtcttaaaaatgtaaaagaggtaaaaggtctaacaaaagggggtcccgggcatgaggaaccaataccaatgtccacttatggatggaatctagtccggttacagtcaggtgtcgacgtattctttacgcctccagagaaatgcgacacacttttatgtgatattggggaaagctccccgaatccaactgttgaagccggaagaacattgcgtgtcttaaatctcgtcgagaactggttaaataacaacacacaattttgcataaaagttctcaacccttacatgccttctgttatagagaaaatggaggcactgcagcgcaagtatggaggcgctcttgttaggaaccccttaagccggaacagtacacacgaaatgtactgggtttcaaatgcttcaggcaatatagtgtcctccgttaatatgataagtcgaatgctaattaaccgatttacaatgaggcacaagaaagcaacgtacgaaccagacgtagatttaggctcaggaacacgtaatattggtattgaatcggaaacaccgaatctggatattataggtaaaaggatagagaaaataaaacaggaacacgagacatcatggcattacgatcaggatcatccttataagacatgggcatatcatggatcatatgaaaccaaacaaacaggctcagcaagttctatggtaaatggtgtagtccgtcttctaacaaaaccctgggatgtgatcccaatggtcacacaaatggctatgaccgacacaaccccctttggtcagcaaagagtattcaaagagaaagtggatacccggacccaagagccaaaggagggaactaagaaacttatgaaaatcactgcggaatggctttggaaggagttaggcaagaagaaaacaccaagaatgtgcacaagagaagagtttacacgcaaggtcagatctaatgccgcgttaggtgcaattttcacagatgaaaacaagtggaaatccgccagagaagcggtagaagacagtgggttctgggaattagttgacaaggaacgaaacttacatctcgaaggtaaatgtgaaacatgtgtttacaatatgatgggcaaaagggagaagaaattaggcgaatttgggaaagctaaaggcagtagagcaatatggtacatgtggctaggtgcacgattcctagagtttgaagctcttggctttttaaatgaagatcattggttcagtagagaaaactcacttagtggagtagaaggggaaggtttacataaactcggttacattctaagggacgtctctaagaaagagggaggcgcaatgtacgcagacgatacggccgggtgggatactagaattacgttagaggatctaaagaatgaggaaatggttaccaatcacatggaaggagaacataagaaattagcagaagcgatttttaaactaacctaccaaaataaggtggtaagagtgcagagaccaactccgcgtggcacggtaatggatattatttctagacgcgatcagagaggaagtggacaagttgttacctacgggcttaacacatttactaatatggaagctcaattaattagacagatggagggagaaggtgtttttaaatccattcaacatcttacggtgacggaggaaattgccgtcaaaaattggctggcacgcgtagggagggaacgactgtcaaggatggctattagcggagatgattgcgtagttaaaccgctagacgacaggtttgcctcggccttaacagccttaaatgatatgggtaaagtacgaaaagatattcagcagtgggaaccaagtagaggatggaacgactggacacaggttcccttttgtagtcatcattttcacgaactaattatgaaagacggaagagttttagttgtaccctgtagaaatcaagatgaactcataggacgagcacgtatatcgcagggggccggatggtcactaagggaaacagcatgcttaggcaaatcttacgctcagatgtggtcccttatgtattttcaccgaagggatctgagactcgctgcaaacgcaatctgtagtgcagtacctagtcactgggtacctacgtccagaaccacgtggtcaatacatgctacccacgaatggatgactaccgaagatatgctgacagtatggaatcgcgtttggattcaggagaacccttggatggaagacaaaacacccgtggaaagttgggaggaaattccatatttaggcaaaagggaagatcaatggtgtggcagtttgataggactaacttcacgtgcgacctgggccaaaaacattcagacagccataaaccaggtgagaagtcttataggaaacgaagagtacaccgattacatgccctcaatgaaacgatttagaagagaagaagaagaagctggcgtactatggtaa

SEQ ID NO: 22912 - RNA, 9876 nt, synthetic construct
  misc_feature 1..9876: note = derived and/or modified CDS sequence (opt6) from DENV-2__GQ398260__SS-prME
  source 1..9876: mol_type = other RNA
actgcgggtatgattattatgcttattccgacagttatggcttttcatctaactacgaggaacggcgaaccgcacatgatagtgtctcgacaagaaaaagggaaatctctattatttaaaactgaagacggagttaatatgtgcacattaatggctatggatctaggggaattgtgcgaagacacaatcacctataattgccccctactgcgacaaaacgaaccagaagacatcgactgttggtgcaatagcacgagtacttgggtgacatatggaacctgtacagcgacaggcgaacatcgacgagagaaaaggagcgtagcattagtaccgcatgtcggtatgggacttgaaacccgcaccgaaacatggatgtctagcgaaggggcttggaaacacgcgcaacgaattgaaacatggattctgcgacaccccggatttacaataatggcagcaattctagcatatactatcgggacaacctattttcaaagggtgctgattttcatattgttgacggcagttgctccatccatgaccatgcggtgcatagggatatcaaatcgagatttcgttgaaggtgtatctggaggcagttgggtagacatcgttttggaacacggctcatgtgtaacaacgatggccaaaaataaacctacactggattttgaattaattaaaacggaagcaaaacaaccggcaaccctaagaaaatactgcattgaagccaaactgaccaacacaaccaccgcatcccgatgtcccactcagggagagccctcattaaatgaagaacaagataaaagatttgtgtgtaaacacagtatggtggatcggggttggggtaacggttgcggattattcggtaaaggaggaattgtgacgtgtgcaatgtttacctgtaagaaaaacatggaaggtaaggtagtgcaacccgaaaatttagagtacaccatagtaattacaccacactcaggggaagaaaacgcagtaggcaacgatacaggaaaacacggtaaagaaataaaaattactcctcaatcgagtataacagaagcagaattaatagggtatggcacagtcacaatggaatgcagccccaggactgggctagattttaatgaaatggtactacttcaaatggaaaataaagcatggttagtacatagacaatggttcttagacctcccactcccctggctaccgggagcagatacacagggcagtaattggatccagaaagaaacacttgtgacattcaaaaatccgcacgctaagaaacaagatgtagtcgtgctgggttctcaagaaggtgcaatgcatacagccttaacgggcgctactgaaatacaaatgagctctggaaacctcttgtttacgggccacctcaaatgtagattaaggatggataaactacaacttaaaggtatgtcttactcaatgtgcaccgggaaattcaaagtagtaaaagaaatagcagaaactcaacatgggacaatagtgatcagagtacaatatgaaggtgacggctcaccttgcaaaataccattcgaaataatggacttagaaaaacgacatgtattaggaaggctcataacagttaacccaatagtcacagaaaaagattcacctgtaaatatagaggctgaaccacctttcggtgattcttatattataattggtgtagagccaggacaattaaaactaaactggtttaagaaaggttccagtatcggacagatgttcgagacaaccatgagaggagcaaaacggatggccattttgggagatacagcttgggactttggctccctaggtggagtttttacgtcaattggtaaggctttacaccaagtatttggagcaatatacggagcggccttttccggtgttagttggacaatgaaaattctaataggagttgtgataacttggatagggatgaacagccgatcaactagcttatctgttagtctagtcttagttggagtcgtaacactttatcttggggttatggttcaagcagattcaggatgcgttgttagctggaaaaataaagagttgaaatgtggaagcggtatatttgtaacagacaacgtacacacttggacagaacagtataaatttcaacctgaatcaccatcgaaactagcatcagctatacaaaaagctcatgaggaggggatctgtggaataaggtcagtaactcgcttagagaaccttatgtggaagcaaattacgcccgaacttaatcatatcctatcggaaaatgaggtcaagctgaccatcatgacaggagatattaagggaattatgcaagccggcaaaagaagtctacgcccgcaaccaacagaacttaaatacagttggaagacttggggaaaggctaagatgttatcaacggaacttcacaatcagacattcctaattgatggaccggaaacggcagaatgccctaataccaaccgagcatggaatagtttagaggtagaagactatggatttggagtctttactaccaacatatggttgaaattgaaggaaagacaagacgtgttttgtgattctaaactcatgtcagcagcaatcaaagacaacagagctgtacatgctgacatgggctattggatagaaagtgcactaaatgacacatggaaaatagaaaaagcatcatttattgaagtgaaaagctgtcattggccaaaaagtcatacactttggagtaacggcgttttggaatcggaaatgataataccaaagaactttgcaggaccggttagccaacacaattacaggccaggatatcatacgcaaacggctggaccttggcacttaggaaaactagagatggactttaacttctgtgaagggacaaccgttgtagtcactgaagactgtggtaaccgaggtccaagcctgagaactactacagcatctggaaaactgataactgagtggtgttgcaggtcttgtaccctaccaccactcaggtacaggggagaggatggctgttggtatggcatggagatcagacctttgaaagaaaaagaagaaaatctagttaacagcttggtcactgctggacacggtcagattgacaacttctctctaggtgtattaggcatggccctatttttagaagaaatgcttcgaactagagtaggaacaaaacatgcgattttattggtcgctgtatcttttgttaccttaattacgggcaatatgagcttccgagaccttggacgggtcatggtgatggtcggcgccactatgacagacgatataggcatgggcgtaacttacttagcgctactagcggcatttaaagtcaggccaacattcgcagccggattgctgttgagaaagttaacaagtaaagaactgatgatgacgaccataggaattgtactattgagtcagtctacaataccggagacaatactagaactaacggatgcattagcgttgggaatgatggtacttaaaatagttagaaacatggagaaataccagttagcagttaccataatggcaatcttgtgtgtcccaaacgctgttattcttcaaaatgcttggaaagtatcatgtacaatactagcagttgtaagcgtatcaccactattactaacaagctcgcaacagaaagcagactggatcccgttagctctaaccataaaaggtttaaacccgacagcaatatttctaacaacgttaagtcgtacaagcaagaaacgaagttggcctctaaatgaagctatcatggcggtcggtatggttagtatccttgcatcttccttactcaaaaatgatatcccgatgacaggtccattggtggcgggtggattattaactgtatgctatgtcttaacagggagaagtgcggacttagaactagagagagcagcggatgttaggtgggaagatcaggcagaaatcagtggctcctcaccaatactatcaattaccatatcagaggatggctcaatgagtatcaaaaatgaagaagaggaacaaacgttaacgattctcatcagaacaggtttattagtcatttcagggttattcccagtcagtatacccataactgcagcagcatggtatctatgggaagtcaagaaacaacgtgctggcgttttatgggacgtacccagtccaccgccagtaggcaaagcagagttggaagacggagcatatcgaataaaacaaaaaggtattctcggctattcccaaattggagcgggggtatacaaggaagggaccttccatacaatgtggcatgtaaccagaggtgcagtacttatgcacaaaggaaaaagaattgaaccaagctgggctgatgtgaagaaagatttaatatcatatggaggtggatggaaactggagggagaatggaaagaaggcgaagaagtacaggtactagccttggaaccaggcaagaaccccagagcagtccaaacgaaaccaggattattcaagacaaacactggtacaataggcgctgtgagtcttgatttttcaccaggtacaagtgggagtcctattgtggataagaaagggaaagtagtggggctctatggcaacggagttgtgacaagatcaggaacctatgtaagcgctatagctcaaacggaaaaatccatagaagataatccagagatagaggatgatatcttccgaaagaagcgattaacgataatggatttacaccctggagctggaaaaacgaaaagatatcttccggctatcgtaagagaagctattaaacggggactcagaacactaatcttggctccgactagagttgtcgcagcggagatggaggaagcacttcgtggcttaccaataaggtaccaaacgccagcaatacgtgccgaacacacaggtagggaaattgtagaccttatgtgccatgcaacatttacaatgagattgttaagcccagtgcgtgtacccaattacaatttaataataatggatgaagcgcacttcacagatccagcgagcatagccgcgcgaggttacataagtacaagagttgaaatgggagaagcagctggaatattcatgacggcaacacctccaggcagcagggacccttttccccaaagcaacgctcctataatggatgaggagagagaaataccagaacgcagctggaatagtggtcatgaatgggttacggattttaaaggcaaaaccgtatggtttgtaccatccataaaggccggaaacgacattgcagcttgcctacgtaaaaatgggaagaaagtaatacaattatcgaggaaaacttttgattcagagtatataaaaacgaggactaatgattgggattttgtcgtcaccacagatatttctgaaatgggggcaaacttcaaagcggagcgggtcatagaccctcggcgatgtatgaaaccagtaattttaactgacggggaggagagggtaatactagcaggcccgatgcctgtgacacattcatctgctgcacaacgcagaggcaggataggtcgaaatcctaaaaatgaaaatgatcagtacatttacatgggtgaaccattagaaaatgacgaagactgtgcacactggaaggaagctaaaatgttactggataacataaatacacctgaaggaattatcccaagcatgtttgaaccagaaagagagaaggtcgatgccattgatggggaatatagactacgtggagaagccagaaagacattcgtagatctaatgcgtcgcggtgacctcccagtatggctggcatatagagtagctgccgaagggattaactatgcagataggcgatggtgcttcgatgggattaaaaataatcagatactggaagaaaatgtcgaggtcgagatatggactaaagagggtgaaagaaagaaattgaaacctcgctggttagacgctcgtatatatagtgaccctctggctttaaaagaatttaaggaatttgccgcaggtagaaaaagcctaacactcaatctcataacagagatagggaggttgccgacatttatgacgcaaaaagcgcggaatgcattagataacctagcagttctacatactgcagaagcagggggaagggcttacaaccatgctctctcagaactacccgaaactttagaaacactacttctattaacgctacttgctacagtgacaggtggcatatttttatttctaatgtcaggtaaaggcataggtaaaatgaccttaggtatgtgctgtataattacggcaagcatcttactatggtacgcacaaatacagccacactggatagccgcaagcatcatattggagttctttctaatagtgcttctcatcccagagcccgaaaagcaacgaactccacaagataaccaactaacgtatgtagtcattgcaatcctcacagttgtagcagcgaccatggcgaatgaaatgggattcctagaaaagaccaagaaagactttggcctaggttcaattgcaacacaacagccagaatcgaacattcttgatatagatttacgaccagcgtcagcatggaccctttacgccgttgctacgacatttataacaccaatgttaaggcactctattgaaaatagttctgtaaatgttagcctcaccgctattgctaatcaggccacagttctcatgggcctcgggaaaggatggcccttatcaaaaatggatattggagtaccccttctggctattggatgttacagccaggttaacccaattacactaactgcagcactactgctcttagtagcccattatgccattatcgggccaggactgcaagcaaaagcaactcgagaagcacaaaagcgagcagcagctggtataatgaaaaaccctaccgtcgatggcattactgtaatcgatttagatcccatcccgtacgatccaaaatttgaaaagcagctaggacaggtcatgctattagtattatgtgtcacacaggtactaatgatgagaacaacatgggcattatgcgaggccttaacacttgcaaccggtcccatcagtacactttgggaaggtaatccgggacgtttttggaatacaacgatagcagtttctatggcgaacatattcagaggctcgtacttagccggtgcaggcttattatttagtatcatgaaaaacacagcaaacacaagaagagggactggaaatacaggggaaacacttggagaaaaatggaaaaatcgattaaacgcattaggcaaatcggagttccaaatatacaaaaagagtgggattcaagaagttgacaggacgctggccaaagaaggtataaaaagaggagaaacggatcatcacgcggtatccaggggaagcgctaagttaagatggtttgtagaaaggaacttagttacaccggaaggcaaagtcgttgatctggggtgcggtcgaggaggatggtcatattactgcggcgggttaaagaacgtacgagaagtaaaagggctgacaaagggaggacccggacacgaggaacctataccaatgtccacttacgggtggaatttagtacgattacagagcggagttgatgtatttttcactcccccagaaaaatgtgatacactactttgcgatattggtgagtcgtccccaaatccgacgattgaagcaggacgaacactccgagtactaaacttagtcgaaaattggttgaacaataacacacaattttgtataaaagtccttaacccctatatgcctagtgttatagagaaaatggaggctttgcaaagaaagtatggaggcgctttagtgagaaatccgttatcaagaaattctacacatgaaatgtactgggtttcgaatgcgtctggtaacattgtctcgtctgttaacatgataagtagaatgctaatcaaccgattcactatgaggcacaagaaagcaacctacgagcccgatgttgatctaggtagtggcacaagaaatataggaattgaaagtgaaacccccaatttggatataataggcaagagaatagagaaaataaagcaagaacatgaaacgtcatggcattacgaccaggatcacccatacaaaacctgggcttatcatggcagttatgaaactaaacaaacaggttcagccagttcgatggtcaatggcgtcgtaagactattaacaaagccgtgggacgtaatccctactgtaacacaaatggcaatgacagatactactccttttggtcagcaacgtgtatttaaagaaaaggtggacacaagaacccaagaacctaaagagggaactaagaaattaatgaaaattactgcggaatggctttggaaagaactaggcaagaagaaaactcctagaatgtgtacccgtgaagagtttacgcgcaaagtgcgtagtaatgccgcgttgggggccatcttcacggacgaaaacaaatggaaaagcgcacgtgaagcagtggaagactcccgattctgggaacttgttgataaagaaagaaacctacaccttgaaggaaaatgcgagacgtgtgtatataacatgatggggaagagagagaagaaactcggcgagttcggaaaagcgaagggcagtagagctatttggtatatgtggcttggcgctagattcttagagttcgaggcattaggatttctaaatgaagatcactggttcagtagggaaaattccctctccggtgtagaaggagaaggtttacacaaactaggctacattttgagagatgtaagcaagaaagaaggcggtgcaatgtatgcagacgatacagcaggatgggacacccgaattacactagaggacttgaaaaatgaagaaatggtaaccaatcatatggaaggcgagcataagaaactagccgaggcaatattcaagctaacctaccaaaacaaagtagttcgggtgcagagaccgacaccacgtgggactgttatggacattatctcgcgtagagatcaaaggggaagcggccaagtaggtacttatgggctgaacacgtttacaaatatggaagcgcagttaattaggcaaatggaaggtgaaggtgtttttaagtcaattcaacacctaacagttacggaggaaatagctgtgcaaaattggctagctagagtaggacgagagcggttgagtagaatggcaatttcaggagacgactgtgttgtgaaaccccttgatgatcgattcgctagtgctcttactgcactcaacgacatgggtaaagtacgaaaggacattcagcaatgggaaccaagtagaggatggaacgattggacacaagtacccttctgttcgcatcattttcacgagttaatcatgaaagacggtcgcgtcttggtcgtgccgtgtagaaatcaagatgaactgataggcagagcaaggatatctcagggagcaggctggagtttgagagagactgcctgtttgggaaaaagctatgcacaaatgtggtccctaatgtatttccatcgtagagatcttcgcttggcagccaatgcgatatgttctgcggtaccttcacattgggtaccaacaagtagaactacctggtcaattcacgcaaggcatgaatggatgacgactgaggacatgctaactgtgtggaacagagtttggatccaagagaacccctggatggaggataaaaccccagtagaatcatgggaagagatcccttatcttggaaaaagggaagatcaatggtgcggatccttgataggtctaacaagtagagcgacttgggccaaaaatattcagacagcgataaatcaagttcgctctctaataggcaacgaagagtacacagactatatgccctctatgaagcgattccgccgtgaggaagaagaagccggagtgctttggtag

SEQ ID NO: 22913 - RNA, 9876 nt, synthetic construct
  misc_feature 1..9876: note = derived and/or modified CDS sequence (opt6) from DENV-2__GQ398262__SS-prME
  source 1..9876: mol_type = other RNA
actgcgggaatgattattatgttaattccaacggttatggcgtttcatctgacaactaggaatggagaacctcacatgattgtaagcagacaagaaaaaggaaagagtctactattcaaaacagaagacggagtaaatatgtgcacattaatggcaatggacctgggggaattatgcgaagatacgatcacatataattgtccccttcttcgtcaaaacgaacccgaggatatagattgctggtgtaactccacaagcacatgggtcacttatggtacatgcacagcgaccggagaacatagacgcgaaaaaagatcagtagcgttagtacctcatgtgggtatgggtctggaaacacgaactgagacctggatgtctagcgagggagcttggaaacacgctcaaaggattgagacatggatacttcgtcatccagggttcactattatggccgcgatattagcttacactattggaacgacatactttcagagagtactgatattcatcctactgaccgcagtcgctccttcaatgacaatgagatgtataggcatatctaatcgtgactttgtagaaggggtttcgggtggatcttgggtagacatagtactggagcatggaagctgtgtaaccacaatggccaaaaacaaacccactttagactttgagctaatcaaaaccgaggctaaacaacctgctaccctcaggaagtattgtatagaagctaaattaacgaacacaactactgcgtctagatgtccaacacaaggtgaaccgtccttgaatgaagaacaagacaaacgatttgtatgcaaacatagtatggttgatagaggatggggtaacggttgcgggttgtttggtaaaggaggtattgtaacgtgcgcaatgttcacgtgtaaaaaaaacatggagggtaaagtagtacaacctgagaatttagaatacaccatcgtaataactccccactcaggagaggaaaatgccgttggaaacgatacgggaaaacatggcaaagaaataaaaatcacacctcaatcgagcataaccgaagctgaattaactggatacggaactgtaacaatggagtgttcgccgagaacgggactagatttcaatgaaatggtcttattacaaatggagaacaaagcatggctagtacatcgtcaatggtttcttgatctcccgctaccgtggcttcctggggccgatacgcaaggtagcaactggatacaaaaagaaacacttgttacctttaagaatccgcacgctaaaaaacaagatgtagtagttctgggatcacaggaaggggctatgcatactgctctcacaggtgcaacagaaatacagatgtcgtcgggtaatttgctctttacagggcacctaaaatgtcgattacgcatggataaattacaattaaaaggaatgtcatatagcatgtgtacgggaaaattcaaagttgtcaaagaaatagcggagacacaacacggtaccattgtgattagggtccaatatgagggagacgggtctccgtgcaaaatcccgtttgagatcatggatttagagaaacgacacgttttgggaagacttataacagttaacccaattgtgacagagaaagactctcctgtgaatatagaggcggaaccaccatttggcgactcatacataattatcggtgtagaacctggccaattgaaactaaactggtttaagaaaggatcctctataggacaaatgttcgaaacgacgatgagaggcgctaaacgtatggcgatactaggagacactgcttgggatttcggctcgctgggaggtgtattcacttcaattggtaaagccttacatcaagtatttggcgcaatctatggtgctgctttttcgggagtttcctggacgatgaaaatactaataggagtcgtaataacgtggataggaatgaactcgcgatcaacttcattatcagtgagcctggtactcgttggagtagttactttatatttaggggtaatggtacaagctgatagtggctgtgtagttagctggaaaaacaaggaattaaaatgcggttcaggaatattcatcactgataacgttcacacatggacagaacagtataaattccaaccagaatcaccaagcaagttagcaagcgctatacagaaagctcacgaagaaggtatttgcggaatccgatctgtgacgcgattagaaaacttaatgtggaagcagattacacccgaattaaaccatatcctatcagagaatgaggtaagacttacaattatgacaggagacattaagggcatcatgcaagcaggaaaaagaagtctacggcctcaaccaactgagcttaaatattcctggaagacgtggggaaaagcaaaaatgctgagtacggagctccataaccaaacctttctaatagatggaccagagacagccgaatgcccgaacacaaatagggcctggaattctttggaggtcgaggattatggtttcggcgtgttcacaactaatatctggttgaagttaaaggaacgacaagatgtattctgtgactcgaaactaatgtcagccgctataaaggataaccgcgcggtacatgcagacatggggtattggattgaaagcgcattaaatgatacttggaaaatcgagaaagcgtcgttcatcgaagttaaaagttgccattggccaaaatcacataccctttggtcaaatggagtactagaatcagaaatgataataccaaaaaattttgcaggaccagtatcacaacacaactataggcccggttatcatactcagacagcaggaccatggcatttaggaaagttagaaatggacttcaacttttgcgaaggtacaacagtagtagttacagaagattgcggtaatcgaggacccagcttaagaactacaacagcaagcggcaaattaataactgaatggtgttgcaggagttgtacactacctccgctaagatacagaggagaagacgggtgttggtatggtatggaaataagacccctaaaggaaaaagaagaaaacttagtaaactcactagttacagcaggacatggtcaaattgacaatttctccttaggtgtgctagggatggcgttattcttagaagaaatgttaagaacccgagttgggacaaagcacgctatattattagtagctgtatcatttgtaaccctaattacaggaaacatgtcattccgagatctgggtcgtgtaatggtcatggtaggggctacgatgactgatgacataggtatgggagttacttacctagcgctgttagcagcatttaaagttcgcccaacgttcgctgctggactactgctacgaaagttaacttcaaaggagctcatgatgacaacaatagggatagttttactctcacaaagcacaattccagaaactatcctagaactaactgatgcattagctctaggcatgatggtcttaaagatcgtaaggaatatggaaaaatatcaattagcggtaacaataatggcaatactctgcgttcccaacgctgtcattctccaaaatgcatggaaagtgtcatgcacaattttagcagttgtgtccgtatcaccattacttttgacatcgagccaacagaaggcagactggatacctctagctttaacaataaagggtcttaatccaacggctatattcctcacgactttatccagaacatccaagaaacgttcctggccgttaaatgaagcaattatggcagttggaatggtcagcatactagcaagttctctattaaaaaatgatatcccgatgacaggtcctttagttgcaggcgggttactcactgtttgctatgtgctcacaggaagaagcgccgatttggagttggaaagagcagcagatgtccgatgggaggatcaagcggaaatctccggaagtagtcctattctttcaataacaatcagcgaagatggcagtatgagtataaaaaatgaagaggaggaacagacactcacaattctaataaggactggactgttagttatatcaggtcttttccctgtcagcatccctataaccgcagcagcctggtatctatgggaagtcaaaaaacaacgcgcgggcgtcctttgggacgtaccatcacccccgcccgtaggaaaagccgagctggaggacggggcgtatagaattaaacaaaaaggaatattgggatactcacagatcggagccggtgtgtataaagagggaacatttcatacgatgtggcatgtaaccagaggtgcagtgcttatgcataaaggtaaaaggattgaaccgagttgggcggacgtaaaaaaagatctaataagctatggtggagggtggaaactcgaaggtgaatggaaagaaggagaagaagttcaagttctcgctttggaacctggcaagaatccgcgtgcagtacaaactaaacctgggttatttaaaacaaatacaggtacaataggtgctgtttctcttgatttttctccagggacatcagggtcaccgatagttgataaaaagggcaaggttgttggcttatatggaaatggtgtcgttactcgaagtggtacatatgtaagcgcgatagcgcagacagaaaagtccatcgaagataatccagagattgaagatgacatatttcgtaaaaagcgcttgacaataatggatttacacccgggagcgggtaaaaccaaaaggtacctacctgctattgtgagggaagcaattaaacgtggattaaggactttaatcttggctcctactcgtgttgtagcagctgaaatggaggaagctttacgtggcctacctattagataccaaacaccagcaatccgtgccgaacatacaggtcgtgaaatagttgatttaatgtgccatgcaacatttaccatgcgattactatctccagttcgagtaccaaattacaatcttattattatggacgaggcacactttacagatcctgcatcgatagccgcacgtggttatattagcacaagagtcgaaatgggtgaagcagcaggaatattcatgacagcgacaccaccggggtctagggatccttttccgcaatcaaatgcacctatcatggacgaagagcgtgaaataccagagcgaagttggaacagtggacacgaatgggtaacggatttcaaaggaaaaactgtttggttcgtaccttcaataaaagcaggaaatgacatagcagcatgcttaagaaaaaacgggaaaaaagtcattcagttgagtaggaaaactttcgatagtgaatacattaagacacgaacgaatgattgggactttgtcgtaaccaccgatatatcagaaatgggtgcgaactttaaagcggaacgtgtaatagatccacgaaggtgcatgaaaccggtaatattaaccgatggtgaggaacgagtaattttggcaggacccatgcctgtaactcacagctcagcagcacaacgtagaggcagaatcggaaggaatccaaaaaacgagaatgatcaatacatctacatgggggaaccactagaaaatgatgaagactgcgcacactggaaagaggccaaaatgctattagataatatcaacactccagaaggaattataccgagtatgttcgaacctgaacgtgaaaaagtagacgcaatagatggcgaatacaggctaaggggagaggctcgaaaaaccttcgtggatttgatgcggagaggtgatttaccagtgtggctggcgtatcgtgtagccgcggaaggtattaattatgcagaccgcagatggtgttttgatggcataaaaaacaaccagatactcgaggaaaatgttgaagtagaaatatggactaaagaaggggagagaaagaaacttaaacctagatggttagatgcgaggatctacagtgatccactggctttgaaagaatttaaagagtttgctgccggaagaaaatcattaacgttaaaccttattacagagatgggtagactacccacatttatgactcagaaggcaaggaatgcattagacaatttggcggtattacataccgcagaagcaggtggcagagcttataatcacgcattaagcgaactccccgaaactctagaaacacttctattactaacattattagcaactgtaacgggcggcatcttcctcttcttaatgtctggaaaaggaataggaaaaatgacgttaggtatgtgttgtataatcacagcgagcattttactatggtatgcccaaattcaaccccactggatcgcagcttcaattatattagagttcttcctaattgtcctactcataccagagcctgaaaaacaaaggactcctcaggacaaccagttaacatacgttgtaatagctatcctaactgttgtggccgctacgatggcgaatgaaatgggtttcctagaaaaaacaaagaaagattttggactaggttctatcgccacacaacaaccggaatcaaacatcctagatattgatctcagaccagcttccgcatggactttatatgcagttgcgacaacattcataacaccaatgttgaggcattcgatagaaaattcgtccgtaaatgtctcattgacagctattgcaaaccaagcaacagtgttgatgggacttggtaaagggtggccactgagtaagatggacatcggcgtgccgttattggcaattggctgctactcgcaagtaaatcctataacattaacggcagcccttctattattagtagcacattatgcaatcataggtcccggattgcaagccaaagccacgagggaagcacaaaaacgagctgcagcgggcattatgaagaatccgacggtggatggaattacggttatagatcttgaccctataccctacgacccgaaattcgaaaagcaactaggacaagtcatgttattagtgctttgtgtcacacaagtattaatgatgcgtactacatgggctttatgcgaagcgctgactcttgctacggggcctatatcaactctttgggaaggtaaccctggccgcttctggaatactacaatcgccgtctcgatggcaaatatattcagaggatcatatttggctggagccggattgttgttcagcattatgaagaatacagctaacactagacgcggcactggtaatactggggaaacgctgggagaaaaatggaaaaacagattaaatgctttaggcaaaagtgagtttcaaatatataagaaatcgggaattcaagaagtagacaggacactggcaaaggaaggaataaaaagaggtgaaaccgatcatcatgctgtatcacgagggtcagctaaattaaggtggttcgtcgagcgaaatttggtaacaccagaagggaaggttgtggatcttggatgtggaagaggtggatggagttattattgtggggggttaaagaatgtcagagaagtcaaaggcttaactaaaggcggaccaggccatgaagagcccataccaatgtcgacatacggttggaatctagtaagactccaaagtggtgttgatgtattcttcaccccacctgaaaaatgtgatacacttttatgtgacataggtgaatcatctccgaacccaaccgtggaagcaggtcggacgctacgtgtgttaaacctcgtagaaaactggttaaataacaatacccaattttgcataaaagtactgaatccatacatgccaagtgtaatcgaaaaaatggaagcacttcaacgaaaatatggtggcgcactagtaagaaatccacttagtaggaacagtacgcatgaaatgtattgggtctcaaacgcttcaggcaacattgtaagtagcgtaaatatgatatcccgcatgttaattaaccgattcactatgcgccataagaaagccacgtacgaaccagatgttgatctcggtagtggaactagaaatattggcattgaatctgaaacgcccaatctagatataatcggtaagaggatcgaaaaaattaaacaggaacacgaaacttcttggcattatgaccaagaccatccgtacaaaacctgggcctatcatggcagttatgaaacaaaacaaacaggaagcgcttcgtcgatggtaaacggagtagtgagattactaacaaagccttgggacgtaattccaatggtaacccaaatggctatgacagatacaacgccatttggacagcaacgtgtttttaaggaaaaagtagatacgagaacgcaagaaccgaaagaaggtaccaagaagcttatgaaaattacggccgaatggttatggaaagagctaggtaaaaagaaaacccctcgcatgtgtacacgcgaagagtttacaagaaaagttagaagtaatgcggcgcttggggcgatcttcaccgatgaaaacaaatggaaatcagcaagggaagcagttgaagatagcagattttgggaactcgttgataaggaacgaaatttacaccttgaagggaaatgcgagacatgtgtgtacaatatgatgggaaaacgtgagaagaaactaggggaatttggcaaggctaaaggtagtagagctatatggtatatgtggcttggggccagatttttggaatttgaggcgttgggttttctaaacgaagatcattggttctctagagaaaattcactctctggagttgaaggagagggacttcataaattagggtatatactacgagatgtttcgaaaaaggagggaggcgccatgtacgccgacgatacagcagggtgggataccagaataaccctagaagaccttaaaaatgaagagatggtcactaaccacatggaaggtgagcacaaaaaactagcagaggctatattcaaactcacttatcaaaataaggtagtacgtgtgcaaagacctactcccaggggaacagtaatggatataatttcgcgccgagaccagcgggggtcggggcaggtaggcacttatggattaaatacttttacgaatatggaggcccaattaataagacaaatggagggtgaaggagtattcaaatcaatccaacacctcactgttactgaagaaattgctgttcagaactggttggcacgtgttggacgagagagactttcaagaatggctatttctggagacgactgtgtagttaaacctttagacgaccgatttgccagtgccctaacggcacttaacgacatgggaaaagtacggaaggacatccaacaatgggagccttcacggggctggaatgattggacgcaagtaccgttttgttcacatcattttcatgaacttataatgaaagatggacgggtattagtagttccttgtcgaaaccaggacgaactaattgggcgtgcacgcatttcacaaggagcaggttggagcttgagagagacggcatgtctaggcaagagttacgcacaaatgtggagtctaatgtattttcatagaagggatttacgactagcagccaacgctatctgttctgcagtaccgagccattgggtaccaacctcaaggacaacatggtctatacatgcacgtcacgaatggatgacaacagaggacatgctaaccgtgtggaaccgtgtgtggatacaagaaaacccttggatggaggacaagacaccagtcgaatcatgggaagaaatcccgtatttaggcaaaagagaggatcaatggtgtggatctctgatcggattaacgagtagagcgacgtgggctaagaacatacagacagcaataaatcaggtgcgaagtctcatcggcaacgaggaatatactgactacatgccgtcaatgaagagatttcgtcgtgaagaggaagaagctggtgtgttatggtaa

SEQ ID NO: 22914 - RNA, 9876 nt, synthetic construct
  misc_feature 1..9876: note = derived and/or modified CDS sequence (opt6) from DENV-2__GQ398261__SS-prME
  source 1..9876: mol_type = other RNA
acagctggaatgataataatgctaataccaaccgtcatggcatttcatctgacaacacgcaatggagaaccgcatatgatcgtaagtcggcaagaaaaaggaaaatctcttctatttaaaaccgaagatggtgttaatatgtgtactcttatggctatggatttaggtgaattgtgtgaagacacgataacgtataattgcccattattacgacaaaatgaaccagaagacatagactgttggtgtaatagcacaagtacgtggataacgtacggtacatgtacagcaactggtgaacatagaagggaaaaacgttctgtcgccttagtgccacatgtgggaatgggtttagaaactagaactgaaacttggatgtcgagtgaaggagcgtggaaacatgcacaaagaatcgaaacgtggatcttaagacatcctggcttcactatcatggccgccatcttagcttataccataggtacaacatactttcaaagagtactcatcttcatacttctaacagcagtggctccatcaatgacgatgcggtgcatcggaataagtaatcgagactttgtcgaaggagtatccggaggttcctgggtcgatattgtactggaacatgggtcttgtgtaacaacaatggccaaaaataaaccaacattggattttgaattaataaaaaccgaagctaaacaaccagcaacgctcagaaaatactgcatagaagcgaaactgacgaatacgacaacagcttctcgatgtccaacacaaggagaacctagtcttaatgaagaacaagataaaagattcgtatgtaaacattctatggtagatagaggatgggggaacggatgtgggcttttcggaaaaggcggtattgtaacgtgtgcgatgtttacttgtaagaaaaatatggaaggcaaagtcgtgcaacctgagaacttagagtatacaatagttataacaccgcattctggggaagaaaatgcagttggaaatgatacaggaaaacacggaaaagaaataaaaataacaccccagtcgtcaataacggaggcagagcttacaggctatggcacggtaactatggaatgtagcccacgaacgggactagattttaacgaaatggtcttacttcagatggaaaacaaagcctggctagttcacagacaatggttcctcgatttgccattgccctggctaccgggtgcagatacacaaggaagcaattggatacagaaggaaactctagtcacttttaaaaatcctcatgcaaagaaacaggacgttgtcgtattaggttcccaagaaggagctatgcacactgcgctgactggggcaactgaaatccagatgtctagtggaaatctattgtttacaggacatctcaaatgtcgtcttagaatggataagttacagctcaagggtatgtcatactcaatgtgtactgggaaatttaaggtggtcaaagagatcgctgaaacgcaacatggaacaatagtcgttagggtacaatatgagggtgacggctcaccatgcaaaatacctttcgaaataatggatcttgaaaaacggcacgtgcttggtcgacttatcacggtaaaccccattgtaaccgaaaaagactcccctgtgaatatagaggcggaaccgccattcggtgactcatacatcatcattggggtagagccagggcaactcaaattaaactggttcaaaaagggctcgtcgattggacaaatgttcgaaacaacaatgagaggtgctaagagaatggcaatcttgggagacacggcatgggacttcggtagtttaggaggtgtgtttacatcaataggtaaggcgttacaccaggtttttggagctatatacggtgcggcattttctggagtgtcatggacaatgaaaattctcataggggtagtgataacgtggattggaatgaactcacgatctacatctttgtcagtgtccctggtgttagtaggagtcgtaacattgtacctaggtgtcatggttcaggcagactcaggttgcgtcgtaagttggaaaaataaggagctcaaatgcggatcagggatcttcgtaacggataatgtccatacgtggaccgaacaatacaaatttcaacctgaatctccatctaaattagcgtcagcgatacaaaaagctcatgaggagggtatatgtggaataagaagtgtcacgcggttagaaaacctaatgtggaaacaaataacaccggaactaaatcacatcctctcggaaaatgaagtaaaactaaccataatgactggtgacatcaaaggcatcatgcaggcaggcaaaagatcactcagaccgcaacctaccgaactcaagtattcatggaaaacatggggaaaggcaaaaatgctgtcaacagaattacataatcagacttttctaatagacggtcctgagacggccgagtgtccaaacacaaacagggcatggaatagtcttgaggttgaagattatgggttcggagtctttactacaaacatatggttaaaattaaaagagcgccaagacgtattttgcgactcaaaacttatgagcgccgcaataaaagataatagagctgtccacgcagatatgggctattggatagaatctgcattgaatgatacatggaaaattgagaaggcttcttttatagaagtcaaaagctgtcactggcctaaatcccacacgttgtggagtaatggagtactggagtctgaaatgataatccccaagaactttgctggtcctgtcagccaacataactatcgaccgggctatcacactcaaactgcgggcccctggcaccttggtaaactagagatggattttaatttctgtgaaggaactacggttgtagtcacgggcgactgcgggaatagagggccggctttacgtacaaccactgcctcaggcaagctcattacggaatggtgttgtagatcttgcacattacctcccttacgctatagaggggaagacggatgttggtatggcatggagatacgtccgcttaaggaaaaagaagaaaatttagttaatagcttagtaaccgcaggacatggacaaatcgataacttctcgttaggtgtacttggtatggcactatttcttgaggagatgttacgaactcgagtgggtactaaacatgcaatactccttgttgccgtatcgtttgtaacactcattacagggaatatgagctttagggacctaggaagagtaatggtcatggtaggagctacaatgactgacgatataggcatgggggttacctacttagcacttttagcagcatttaaggttcgaccaacgtttgcggcaggcctcctattaagaaaactcaccagtaaagaattaatgatgacgacaatcggaattgttttactaagtcaaagtactattcctgaaactatccttgagttaacagatgctttagcgttgggcatgatggtccttaaaatcgtccgtaacatggaaaaatatcaattggcagtaactatcatggcaatattgtgcgtcccaaacgctgtgatccttcaaaatgcatggaaagtctcgtgcaccattttagcagtcgtgagtgtttctccgctgttattaaccagttctcagcaaaaagcagattggatcccgctagcacttactataaaaggtcttaacccaacagcgatattcttaaccaccctatctcgtacaagtaaaaagcgaagctggccgttaaatgaagctataatggcagtaggcatggtgagcattcttgcttcatctttactgaagaacgacataccaatgactggacctctcgtagctggaggccttttaaccgtctgttatgtactcacaggtcgatcggccgatttagaactagaacgagcggctgatgtaagatgggaggatcaagcagagatatctggtagttcacctatactttccataacgatatcagaggatggttcaatgagcataaagaatgaagaggaagaacagacactaacgatactgataagaacgggactattggtaatatcaggattattccctgttagcattccaataaccgcggcggcatggtatttgtgggaggtcaagaaacaacgcgcaggagttttgtgggatgtcccttcgccacccccagtcggaaaagcagaactagaagatggagcttatcggatcaaacagaagggtatacttggttatagtcaaattggtgccggggtatataaagaaggaactttccatacaatgtggcatgtgactagaggagccgtattaatgcacaagggaaaaagaatcgaaccctcatgggccgatgttaagaaagatcttataagttacgggggaggttggaaactagaaggggagtggaaagaaggagaagaggtccaagtactcgccttagaacctggtaaaaatccaagagctgttcagacaaaacccggactattcaaaacaaacacaggaacaataggcgctgtgtcgttggatttttcaccaggtacgagcggatctcccattgtggataaaaagggcaaagttgtagggctgtatggaaacggcgtcgtgacgcgctcaggaacttacgtctcggcaatcgcccaaacagagaaaagtatagaagataatccagaaatagaagatgacatatttaggaagaaacggttgaccataatggatctacaccctggggccggcaaaaccaaacgatatttacccgcaatagtcagggaagccataaaaagaggcttaagaacgctaatactcgcgcctacgagagttgtcgctgcagaaatggaagaggcattaagaggcctcccaattagatatcaaacaccagctattagggctgaacatacaggtcgcgaaatagttgatttaatgtgccacgcaaccttcactatgaggttacttagccccgtaagagtaccaaattacaatctcattattatggatgaagcacatttcactgatcctgccagtattgctgctcgtggttacatctcgaccagagttgaaatgggagaggccgctggaatatttatgactgcaacgcctcctggatcaagagatccattcccgcagtcaaatgcgcccattatggatgaagagagggaaattcccgaaaggtcatggaactccggccacgaatgggtaacagattttaagggcaagacagtatggtttgttccctcaattaaagctggcaacgacatcgcagcgtgcttaaggaaaaatggcaagaaagtcatacagctttctaggaaaacctttgattcagaatacattaaaacgaggacaaacgactgggactttgtggtaacaactgatatcagcgaaatgggagctaacttcaaagcggaacgagttattgaccccaggcgctgcatgaaacccgtgatattaacagatggagaagaaagagtaattcttgccggtcctatgcctgtgacacacagctcagctgctcaaagaagaggaagaatcggtcgcaatcccaaaaacgaaaacgatcaatacatatatatgggagaaccgctagaaaatgacgaagactgcgctcactggaaagaagcaaagatgttacttgataacattaatacaccagagggcataataccgagtatgttcgaacctgagagggaaaaagtcgacgcaatagatggagaatataggctcaggggtgaagcccgaaaaacttttgtagacctaatgcgaagaggggacttacccgtgtggctagcatacagagtggcagcagaaggtattaattacgcagatcgaagatggtgtttcgacggcataaagaataatcagatattagaagagaacgtagaagtggagatttggaccaaagaaggcgaaaggaagaaactaaaacctcgttggcttgatgcaagaatatattctgatccattggctctgaaagaatttaaggagtttgctgctggccggaagtccctaactcttaacttgataaccgaaataggacgtttaccaacttttatgacgcaaaaagctaggaacgctcttgacaatttagccgtactacatacagctgaagcagggggacgagcttataaccatgcactatcagaattgccggagacattagaaacattattactcttgactttactggctactgtaactggtggaattttcctgtttttgatgtctggtaaaggcatcggtaaaatgactttgggaatgtgttgtataattacagcgtcaatattactctggtatgcacaaatccagccgcactggatcgcagcttccattatactggaatttttccttatcgttctactgataccagaaccagaaaaacaacgcacgcctcaagataatcaactcacgtatgtggttatagcaatactaacagtggtagcagcaacaatggccaatgaaatgggattcctcgaaaagacgaagaaagattttgggcttggcagtatagcaacacaacaaccggagtcaaatatattggatattgatctgcgacctgctagcgcgtggacattgtatgctgttgccacaacattcattactccaatgttgagacacagtatagagaatagcagtgtgaatgtgagtttaaccgcaatcgcaaaccaagctacagttctaatgggacttggaaaaggatggccactcagtaaaatggatataggggtgcctcttctagccattggctgctacagccaagttaaccccataacacttactgcagccttgttactcctagtcgctcattacgcgatcataggcccaggattgcaagcgaaggcgactcgtgaagcacagaaaagggccgcagctggtatcatgaaaaatccgactgtagacggaataactgttatcgatttagatccaataccatatgacccaaaatttgaaaagcaactcggtcaagtgatgctcttggtactttgtgtaacgcaagtattgatgatgcgcaccacttgggcactatgtgaggcattaactcttgcaacgggacctataagcaccctttgggagggaaaccccggacgattctggaatacaacaatagcagtctccatggcaaacatattcagaggatcttacttagccggtgcaggtttattatttagtattatgaaaaataccgcgaatactcgacgtggaaccggcaacacaggagaaactttaggagaaaaatggaaaaaccgattaaatgcactagggaagagtgaatttcaaatatataagaaatcagggatccaagaagtcgatcgaaccctagcaaaggagggtataaaaaggggcgaaacggatcaccatgcggtatcccgtggaagcgctaaactccgatggttcgtagaaagaaatttagtcacacctgaaggaaaggtagtagacctcggctgcggtagagggggatggagttactactgtggaggactcaaaaatgtaagagaggtaaagggattaaccaagggtggtcctggccacgaagaaccaataccaatgtccacttatggctggaatttggtcaggttacaatctggcgtcgatgtgttctttacaccgccagaaaagtgcgatacactgttatgtgacataggagaatcttcaccaaaccctacaattgaagcaggacggactttaagagtcttgaaccttgttgaaaactggcttaacaataatacccagttttgcataaaggtacttaacccttatatgccatcagttattgagaaaatggaagccttacaaagaaaatatgggggtgccctggtacggaatcccttgagtagaaattcaacgcacgagatgtattgggtctcgaacgcatctggaaatatagtatctagtgttaatatgatatcacggatgttaattaacaggttcactatgcgacacaagaaagcgacctacgagccagatgttgatttaggttcaggaacaagaaatatcggcattgaaagtgaaaccccaaacttagatatcataggtaagcgaatcgagaaaatcaaacaagagcatgagacttcatggcattacgatcaagatcatccctacaaaacctgggcatatcatggatcctatgaaactaaacaaaccgggtctgctagtagtatggttaacggcgtagtacgtttattaaccaagccctgggatgtaatccccacagtaacccagatggctatgaccgatactacaccgtttggtcagcagcgagtattcaaagagaaagtagatacaagaacacaggaaccgaaagaaggtactaaaaagttgatgaaaatcaccgcagagtggttatggaaggaacttggaaagaagaaaactccaaggatgtgcacccgtgaagagttcactaggaaagtacgctcaaacgcagcgctcggggctatcttcacagatgagaataaatggaaatctgcacgagaagcggtggaagattcccgattttgggaattagtagacaaagaaagaaacttacaccttgaaggtaaatgcgaaacatgcgtatataacatgatgggcaaacgtgagaagaaactcggagagttcggaaaagcaaaagggtcacgggcaatatggtatatgtggctgggtgccagattcctagagttcgaagcacttggtttccttaacgaagaccattggttctcacgtgagaatagcttatctggggtagagggtgaaggtcttcataaacttgggtatattctacgggatgtgagtaagaaagagggcggcgcaatgtacgctgatgacacagccggctgggatacgagaataaccttagaagatcttaaaaatgaagaaatggtaacaaaccacatggaaggagaacataagaaactagcagaagccatatttaaactaacttaccaaaacaaggttgtccgagtacaacgccccacaccccggggaaccgttatggacataatcagtagaagagaccaacgaggatcgggccaggtgggaacctatggtttaaacactttcacaaacatggaggcacaactcatacgacaaatggagggtgaaggtgtcttcaaaagtatccaacaccttactgtaaccgaagaaatagcagtgcaaaactggttggctagagtgggacgtgagagactgagtagaatggcaatatcaggagatgactgtgttgttaaaccactggacgatagatttgcaagcgcgcttactgcattaaatgacatggggaaagtcagaaaggacatacaacaatgggaaccatcccgtggatggaatgactggacccaagtgccattttgtagtcatcacttccacgagctcattatgaaagacggaagagtattggtagtcccttgccgcaatcaggacgaattgataggacgagcgaggatatcacaaggcgcaggttggtcacttagagagacagcatgtctgggtaaaagctatgcacagatgtggagcctcatgtattttcatcgtagagatcttcgattagctgctaatgcaatctgttcagcggttccaagccattgggttccaacttctcggacaacatggtcaatccatgctcgacatgaatggatgaccacagaagatatgctaacagtctggaaccgagtatggattcaggaaaacccttggatggaagataagactcccgtagaatcatgggaagagatcccctatttaggaaaaagggaagaccaatggtgtggcagcctgataggcctaacgagtagggcaacctgggcgaaaaatattcaaaccgcaataaatcaagtgagatcgctcataggaaacgaggaatacaccgactacatgccctctatgaaacgatttcgccgcgaggaagaagaggccggtgtactctggtag

SEQ ID NO: 22915 - RNA, 9876 nt, synthetic construct
  misc_feature 1..9876: note = derived and/or modified CDS sequence (opt6) from DENV-2__GQ398313__SS-prME
  source 1..9876: mol_type = other RNA
acggcgggcgttataatcatgttaattccaacagcaatggcatttcatttaacaacgagaaacggagaaccacatatgatagtgggtagacaagaaaaaggcaaatctttgctatttaaaacggaagatggagttaacatgtgtactttaatggcgatagatctgggtgaactgtgcgaagatacgataacgtacaaatgcccgcttttgagacaaaacgaaccggaagatatcgactgttggtgcaactcgacttcaacatgggttacttatgggacttgtaccaccacaggcgagcacagaagagagaaaagatcagtcgcattggttccacacgtaggcatgggattagaaactcgaactgaaacatggatgagtagtgagggcgcctggaaacatgttcaaaggattgagacatggatcctaagacatcctggatttacgattatggcagccatattagcatatactattggtacaacacatttccagagagctctaatctttatactccttacggcggttgctccatcaatgaccatgcgttgtattggaattagcaaccgagatttcgttgaaggggtttcaggtggatcctgggtcgacatagtattggaacatggcagttgcgtaacgactatggccaaaaataaaccaactttagactttgaacttataaaaacagaagcaaaacagcctgctacgctacgtaaatactgcatagaagcgaaactgacaaacactactacagagagccgctgcccaacacaaggagaaccctcattaaacgaagaacaggataagaggttcgtctgtaaacatagtatggttgatagaggatgggggaacggatgcggtttatttggtaaaggtggtatagttacatgtgcgatgtttacctgcaaaaagaatatggaaggtaaagtggtattaccagaaaaccttgaatataccatagtgattaccccgcattcgggtgaagaacacgctgtaggaaatgatacgggaaaacacgggaaagaaataaaaataacaccacaatcgagtataaccgaggcggaattgactggctatggtacagtcaccatggaatgttcacctcgaactggtttagacttcaacgaaatggtattacttcaaatggaagataaagcgtggctagtacacaggcagtggtttctggatctaccactaccatggctacctggcgcggatacgcaaggaagcaactggatacagaaggaaacattagtcacttttaagaacccccacgccaagaaacaagacgtggtagtactagggtcccaagaaggagccatgcatacagctttaaccggagccactgaaattcagatgagtagtggaaatctattattcaccggacacctaaaatgcaggttaagaatggataaactgcaactcaaaggaatgagttacagtatgtgtactggcaaatttaaaattgttaaagaaatagcagaaacacagcacggaacaatagtgatccgagtacaatacgaaggtgatgggtcaccctgcaaaattcctttcgaaataatggatttggaaaagaggcatgtccttggacgattgataacagtaaatcctatagttgcagagaaagatagcccagtaaacatagaagcagaaccacccttcggagatagttatataatcataggagtagagccgggtcaattaaaactcaattggttcaagaaaggcagtagtattgggcaaatgtttgaaacgacaatgcggggagcaaaaaggatggctatactaggcgatacagcatgggattttggaagtctagggggagtatttacgagtataggtaaggccttacatcaagtattcggcgccatatatggagcagcgttcagtggagtatcatggacaatgaaaatcctcattggagttataataacatggattggaatgaactcgcgatctacgagtctcagcgtttctcttgttctagttggagtagtaaccttatacctaggtgctatggtgcaagcagattcgggttgtgtggtttcctggaagtctaaagaattgaaatgtggcagtggcattttcataaccgacaacgtacacacatggacagaacagtataaatttcaacctgaaagtcctagcaaactagcttcggcaatacaaaaagcgcatgaggaaggtatctgtgggataagatccgttactcgactagaaaatcttatgtggaagcaaatcacgccggagttgaaccatattctttcagaaaacgaagtcaaattaactatcatgactggagacattaaagggattatgcaagcaggaaaacgttctttgagaccacaacctacagaattaaaatattcatggaaaacctggggaaaagcgaaaatgctctccaccgaatcgcacaatcaaacattcctgatagacggacccgaaacagctgaatgtcccaacacgaatcgtgcatggaatagcctagaagttgaagactatggatttggagtattcacaacgaacatctggttgaaattaagagaaaaacaagatgtgttttgcgatagcaaattaatgtccgcagcaataaaggataacagggctgttcacgctgacatgggatattggattgaaagcgcactcaatgatacgtggaaaatggaaaaagcgtcttttatcgaagtcaagagttgtcattggccaaagagccacacactttggtcaaacggggtactcgagagcgaaatgattattcccaaaaatttcgcaggtcccgtgagtcaacacaactaccgacctggatatcatacccaaactgcgggaccttggcatcttggaaaattagaaatggattttgacttttgcgaagggaccactgtcgtagttaccgaagattgtggaaaccgagggccttcactcagaacaacaacagccagcggaaagctcatcacagaatggtgttgccggagttgcacactaccgccattgcgttacagaggtgaggatggttgttggtatggtatggaaataagaccacttaaagaaaaagaagaaaacctcgtaaattcattggttactgcaggacacggtcaaattgataatttcagtcttggtgttctaggcatggcactattcttggaagagatgttaagaacacgggtaggaactaagcatgcaatgctacttgtagctgtttcttttgtcactttaattacaggtaacatgagtttcagagacctagggagggttatggtaatggttggggcaactatgacggacgatattggaatgggaataacctatttggcgctattggcggcattcaaagtgaggcccactttcgctgcaggattattgcttagaaagctgacgtccaaagaacttatgatggcgaccataggtatagcattattatcccaaagtacaataccagaaaccatattggaattaacagacgctttagcattgggcatgatggtgttgaaaattgttcggaatatggaaaaatatcaattggctgtcactataatggcaatatcctgtgtccctaatgcagtaatacttcaaaatgcctggaaagtgtcatgtacgattctagcagcagtaagcgtctccccactgctgctaacaagttcacaacaaaaagccgactggatacccctagctctaacaatcaaaggtttgaacccaaccgcaatattcttaacgactctttccagaacaagcaaaaagagaagctggccactcaacgaagcagttatggcagttggtatggtgtctatacttgccagcagcctactaaagaatgacattccaatgacggggcctttagtcgctgggggactgttgaccgtctgttatgtactaacagggagatcagcggacttggaactagagagagcagccgacgtgaaatgggaagaccaggccgaaatcagcgggtcttctccaatacttagtataactatatcggaggatggaagcatgagtatcaaaaatgaagaagaagaacagactttaactatcttaatacggacaggacttctagtcattagcggagtttttccagtgagtataccaattactgctgccgcttggtacctgtgggaagtgaagaaacaaagagccggagtattatgggatgtcccgagtccgccacctgtcggaaaagctgagcttgaggatggagcttaccgtattaaacaaagaggaattttgggttacagtcaaataggggcgggtgtatataaagaaggaaccttccatactatgtggcatgtaactagaggagcggtattgatgcatcgaggaaaacgaatagagccttcgtgggctgatgtcaagaaagatcttatcagttacggaggtggttggaagctagaaggtgagtggaaagaaggagaagaggtgcaggtactggcattggaaccagggaagaatcctagagcggttcagacgaagcctggtttattcaaaactaatacaggaacgatcggagcagtcagcctggattttagcccaggaacctctggtagtccaatcgttgacagaaagggaaaagtggttgggttatatggaaacggagtagttacacgcagtggagcatatgtaagcgcaatcgcacaaacagagaaaagtattgaagacaatccagaaatagaggacgatattttccgcaaaaagcgactcacaattatggacttacatccaggtgcaggaaaaacgaagcggtatcttccagccattgtaagggaggccattaagcgtgggctccgcactcttattttggctcccacacgagtagttgccgcagagatggaagaagccttaagaggcttaccaattagataccaaacacccgcaattagagccgaacacacaggacgagaaatagtagatttaatgtgccatgcaacgtttacaatgaggctactcagcccagtgcgcgttcccaattataacctaattataatggatgaggcgcattttactgaccctgcctctattgcagccagaggatatatatcaacacgagttgaaatgggggaggctgcaggtatattcatgacagccactcctccagggtcacgcgatccgtttcctcaaagtaacgcaccaataatggacgaggaaagggaaattccagagagatcttggaactccggtcatgaatgggtcacggacttcaaaggcaagacagtatggttcgtaccgtccatcaaagctggtaatgacatagcagcttgcctaaggaaaaatggtaagaaagtgatacaattgtcgagaaaaactttcgattctgaatacgtcaagacaagagcgaatgactgggattttgtggtaacaacggacataagcgaaatgggtgctaatttcaaagcagagcgggtaattgacccgcgacgttgtatgaaaccggtcatattaacagatggtgaagaacgtgtcatactagcgggcccgatgcctgtcacacactcaagtgctgctcaaagacgtggccgtataggaagaaaccccaaaaatgagaacgatcaatacatatatatgggagaaccattagagaatgacgaagattgtgcgcactggaaagaagcaaagatgcttttagataatattaacacgccagaaggaatcatccccagcatgttcgagccggagagggaaaaagttgacgcaatcgatggagaatatcgtctaaggggagaagcaagaaaaactttcgtagatctaatgagaagaggagatttaccagtatggttggcttatagagtcgcggccgaaggaatcaattatgcagataggaggtggtgttttgacggcattaaaaataatcaaatattagaagaaaatgttgaagtagagatatggacgaaagagggggaaaggaagaaattaaaaccgagatggcttgatgccagaatatattcagatcccctcgctctaaaagaatttaaagagttcgcagccggcaggaaatcactaacactaaatcttatcactgagatgggtagactacccacttttatgactcaaaaagcaagagatgcactagataaccttgcagtcttgcacactgctgaagcaggaggacgagcttataatcacgcgcttagtgaacttcccgaaaccttggaaactttattgcttctaactttacttgcaacagtaacaggaggtatctttttatttttaatgtcaggtaaggggattggaaaaatgacactggggatgtgctgtatcattacagcttctattttactttggtacgcacaaatacaaccacactggatcgcggcaagcattatactcgagttctttttgattgtcttactcatcccagagcctgaaaaacaaagaactccacaggacaatcagctaacttacgttgtcatagcaatactgacggtggtcgctgctactatggctaatgaaatgggatttctagagaaaactaagaaagatctagggttaggttctatagcaactcaagaaagtgaaagtaacattttagatatagatctccgaccagcaagtgcatggactctatatgcagtagcaacaacattcgtaacaccgatgttacgtcacagcatagaaaactcatcagtcaacgtaagcctgaccgcgatagcaaatcaagcgacagttttgatggggctaggaaaaggttggccactatcaaagatggatatcggggtccccttgttagcaattgggtgttattcacaagttaatccaattacgctaactgccgcacttttactattagtggcacactacgcaattatcggacctggtttacaggctaaagcaactagagaagcgcagaaacgagcagccgcaggaataatgaaaaatccaactgttgatggaatcactgtaattgacttagagcctataccctacgatccaaaattcgaaaaacaactaggacaagtaatgctgctaatcttatgtgtcacacaagtactgatgatgagaactacttgggcgctatgcgaagcattaactttggcaacagggccaatcagtactctctgggaaggcaatcctggacgattttggaatactactatagctgtttcaatggctaatatatttcgaggatcatacctagcaggagcaggactactattttcaataatgaaaaataccacaaatacaagaagggggacaggcaatattggggaaacgctaggcgagaaatggaaaagtagattaaatgcgttagggaaatccgagtttcaaatttataagaaaagtggtattcaagaagtagaccgaacgctagcaaaagaaggaataaaaagaggtgaaaccgaccatcatgcagtatcaagaggttcggccaagctaaggtggtttgtggaaaggaatatggtaacaccagagggcaaagtggttgatttgggttgcgggcgtggcggttggtcatattactgtggtggtcttaaaaacgtaagggaagtgaagggtctcacaaaagggggaccaggtcatgaagaaccaattccaatgtctacctacgggtggaatctagtaaggctacagtccggtgttgatgtattcttcacacctccagaaaaatgtgatacactattatgcgatataggtgaatcctcacctaatcccacgatagaagcggggaggactctacgtgtactaaacttagtcgaaaactggttaaacaataatacacaattctgtataaaagttttaaatccttacatgcctagtgtaatagagaaaatggagactttgcaaagaaaatatggaggagcattagtgagaaatcctctgtctagaaattctacgcatgaaatgtattgggtatctaacgcaacaggaaacatagtatcgagtgtaaatatgattagcagaatgttaataaacagattcacaatgaaacacaaaaaggctacgtatgaaccagatgtcgatttggggtcagggacacgtaatattggtatagaatcagagatacctaatctagacatcatcggtaaacgaattgagaaaataaaacaggagcatgagacctcatggcattacgaccaagaccacccctacaagacttgggcctatcatgggtcttatgaaacgaaacagacaggtagtgcatcatctatggtaaacggcgtagtgaggctcctcaccaaaccctgggatgtagtaccaatggtaacacaaatggctatgactgatacgacaccatttggtcaacagagagtatttaaggagaaggtagacactagaacacaagagccgaaggagggaacaaagaaactcatgaaaatcacggccgaatggttgtggaaagaactaggaaagaagaaaacaccaagaatgtgtaccagggaagaatttacccggaaggtaagaagtaatgcggcattgggtgccatatttacagatgaaaataaatggaaaagcgcgagagaagcagtagaagatagcagattttgggaattaatagatagggaaagaaacttacacttagaaggaaaatgtgaaacgtgtgtgtataatatgatgggcaaaagagagaaaaagttgggagagttcggaaaagcaaaaggaagtcgcgcaatttggtatatgtggttaggtgcacgtttccttgagtttgaagcacttgggtttctgaatgaagatcattggttttcccgaggaaattcgttgtctggcgtagagggggaagggctccatagactgggctacatcttgcgagatgtaagtaagaaagagggaggagctatgtacgccgatgacacagcaggatgggatacacgaattacattagaggatctcaagaatgaggaaatggtcactaaccacatgaaaggagaacacaagaaactggctgaggctatatttaaactaacataccaaaacaaagtagttagggtccaaagacccacaccacgtggtaccgtaatggatattatttcacgtagagaccaaaggggatcaggacaagttgggacatatgggcttaacacattcacaaatatggaagcgcagttaataagacaaatggaaggggaaggtatatttaaatcaatacaacatctgaccgtcacagaagaaattgcggtacaaaactggttagcgagagttggcagagaaagactttctcgtatggcaataagtggggatgactgtgtagtaaagcctttggacgacagatttgcaagtgcgctaacggctttaaacgacatgggcaaagtcagaaaggatatccagcagtgggagccctcaagggggtggaatgattggactcaagtaccattctgtagccatcatttccatgaactggttatgaaggacggaagagtgctcgtcgtaccttgtcgaaatcaagatgaacttatcggtcgagccagaattagccaaggcgcaggatggagtctgaaagaaactgcgtgcctcggaaaatcttatgcgcagatgtggactctaatgtatttccaccgacgagaccttcgtttggctgcaaacgctatctgttctgcggttcctagtcattgggtacccacatcacgaaccacgtggtcaatacatgctaagcatgaatggatgacaacagaagacatgttagctgtctggaacagagtttggattcaagaaaatccttggatggaagataaaactccggtagagtcatgggaagaagttccgtatttaggaaaacgtgaggaccaatggtgcggatccctgattggtctcacaagccgggcgacatgggccaaaaatatacaaacagcaataaatcaagtcagatcattaattggaaatgaggaatatacagattatatgccaagcatgaaaaggttcagacgagaagaagaagaagctggagtactatggtga

SEQ ID NO: 22916 - RNA, 9876 nt, synthetic construct
  misc_feature 1..9876: note = derived and/or modified CDS sequence (opt6) from DENV-2__GQ398285__SS-prME
  source 1..9876: mol_type = other RNA
acagcaggagttataataatgctaattccgactgcaatggcgtttcacttaaccacaagaaatggcgaaccgcacatgatcgtcggtagacaggagaaaggaaagagtttactattcaaaactgaggatggtgtaaatatgtgtacgctaatggctattgacctgggggagctgtgtgaagacacgatcacctacaaatgtcctctactacgacaaaatgaaccagaggacatcgactgctggtgcaattcaacctcaacatgggtcacttatggaacgtgtactacgaccggcgaacaccggagagaaaagcgatcagtagcccttgtaccacacgtaggtatgggccttgaaacaaggaccgaaacatggatgtcgtcagaaggcgcctggaaacatgtacaacgaattgaaacttggatattaagacatccgggttttacaattatggctgcaattcttgcctataccataggcacaacgcattttcaaagagccttaattttcatcttattaacagcagttgcgccatcgatgactatgcgctgtatagggataagcaacagagattttgtggaaggagtatcgggagggtcctgggtcgacattgtgctcgaacatggaagttgtgtgaccactatggcgaaaaacaaaccaacactagactttgaattaataaaaaccgaagctaaacaaccggctaccctgaggaaatattgtatagaagctaaacttacaaatacaactacagaatctcgttgtcctacacaaggagaaccatccttaaacgaggaacaggataaacgatttgtatgtaagcactcaatggtggaccgcggatggggaaacggatgcggactgttcggaaaaggtggaattgtaacatgtgcaatgtttacctgtaaaaaaaacatggaagggaaagtagtactgccagagaacctagagtacactatagtaattacccctcatagtggggaagaacacgctgtcggaaacgacacaggaaaacatggaaaagagatcaaaatcactcctcaatcctccattactgaagcagagttgacagggtatggaacagtaactatggaatgctcgcctagaatgggattagattttaacgagatggtacttttacagatggaagataaagcatggctcgtacacaggcagtggttcttagatttaccattaccatggttacccggagcagatacccaaggtagcaactggatccaaaaagaaactctcgtcacattcaaaaacccgcacgcaaaaaagcaagatgtagttgtgcttgggagtcaagaaggagcgatgcataccgcactaactggcgccactgaaatacaaatgagctcaggaaacttattattcacgggacatctcaagtgtcgacttcgaatggataagctacaactaaaaggtatgtcatatagcatgtgtacaggaaagttcaaaatcgtaaaagaaatcgctgaaacacaacatggaaccattgtaatccgcgtccagtatgaaggagacggaagtccttgtaaaataccattcgagataatggatctggaaaaacgacatgtattaggacggctcatcacagttaatccaatcgtcacagaaaaagattcgcctgtaaacatcgaggctgagccgccctttggtgatagctatataatcattggagtagaaccgggccaactaaaactcaattggtttaaaaaagggagcagcataggtcagatgttcgagactacaatgagaggagcaaagaggatggcaattctcggcgatacagcgtgggatttcggttcattaggtggggtttttactagtattggtaaagcgctacatcaagtatttggcactatctacggagcagccttttccggcgtgtcttggactatgaagatcctaattggagtaattataacatggattggaatgaacagtcgcagtacatctttgtcagtgtcgctagttctagttggggtggttactttatatctgggagccatggtacaagctgactctgggtgtgttgtctcatggaaatccaaggaactaaaatgcggatctgggattttcatcacagacaacgttcacacatggacagaacagtataaattccaaccggagtccccgtcgaaactagcaagcgctattcaaaaagctcacgaagagggtatatgtggaataaggagtgtcactcgacttgaaaatctcatgtggaaacaaattactccagaactcaaccatattttatcggagaatgaagttaaacttaccattatgactggcggtataaaaggcataatgcaggccggaaaaaggagtctcagaccacaaccaacagaacttaaatatagctggaagacatggggaaaggctaaaatgttaagtacggaaagtcataatcaaacttttttaatagacggtcctgagacagccgaatgtcctaatacaaatcgcgcctggaactcactagaagtggaagactatggatttggtgtttttacaactaacatatggcttaaactacgagaaaaacaagatgttttctgcgatagtaagttgatgagcgccgcgataaaagacaacagggcagttcatgccgacatgggatactggattgaaagtgctttgaatgatacctggaaaatggaaaaagcaagttttatagaagtaaaatcgtgtcattggcctaagtcgcacacattatggagtaatggagttctagaaagcgaaatgattatccctaagaatctagcaggtcctgtaagtcagcataattatcgccctggatatcacacccaaaccgcaggaccttggcatcttgggaaacttgaaatggacttcgacttttgtgagggaaccactgttgtggtcaccgaggattgcggtaaccggggtccatccctacgaacaactactgcgtcaggtaaactcgtgacagaatggtgctgcagatcatgtacattaccccccttgagatacagaggtgaagacggatgttggtacggaatggaaattaggccactaaaagaaaaggaagagaatctcgtgaacagtctagtaactgcgggacatgggcagatcgacaacttcagtctcggggtattaggaatggctctatttcttgaagaaatgttaagaacgcgagtaggaacgaaacatgcaatactactggtagcggtatcgtttgtaacactgataactggaaatatgagttttagagacctgggcagagtaatggtaatggttggcgctaccatgactgatgatataggtatgggtgttacttacttagctttactagcagcatttaaagtaaggcctactttcgccgcgggattactgctacgcaaacttactagtaaggaattgatgatggctacgatcgggatagctttattaagccagagcactatacccgagactatcctcgagctaacagacgcgctcgccttaggaatgatggtgctaaagattgtaaggaacatggaaaaataccaacttgcggttaccataatggctatatcctgcgtccccaacgcagtcatactacaaaatgcttggaaagtcagctgcacaatactggcggcggtctcagtttccccattactactgacatcaagtcaacaaaaggcggactggataccactagccctaacaataaaagggcttaaccccacagcaatattccttactacactaagcaggacgagcaaaaaaagaagttggcctttaaatgaagcgattatggcggttggcatggtaagtatactggcttctagccttctaaaaaacgatatcccaatgacaggtccactagtcgcaggtgggctattaaccgtatgttatgtattgacgggtaggtcggcagatttagaattggaacgtgcagcggatgtgaagtgggaagatcaagcagaaataagtggcagcagtccaatattatcaatcacaatctccgaggatggaagcatgtcaataaagaatgaagaggaagagcaaactttaacgatactaatacgaacagggctcctagtaatatccggcgtctttcccgtatcaattccaattacagcggcagcctggtatctatgggaagtcaaaaaacagcgtgcaggagtgttatgggatgttccttctcctcctcccgttgggaaagctgaactcgaagatggtgcatatcgaattaaacaacggggaatcttaggatattctcaaatcggggccggcgtttataaggagggaacatttcacaccatgtggcatgttactagaggtgcggtcctaatgcacaggggaaaaagaatagaaccttcgtgggctgatgttaaaaaagatctcattagttatggtggcggttggaagctcgaaggtgaatggaaagaaggagaagaagtacaagtgcttgctttagaaccaggcaaaaatccgcgcgcagtccaaaccaaacccggattattcaaaacaaacactggtacgataggggccgtttcgctggatttctcaccagggactagtggctctccaatagtggatcgaaagggcaaagttgtcgggctgtatggaaatggagtagtaacacgtagtggcgcctatgtatcagcaatcgcacagacagaaaaaagtatagaagacaatccagagattgaggatgatattttccgaaaaaagcgactaacaatcatggatttgcatccaggagccggaaaaactaagcgttatctaccagcaatcgtgagagaggcaatcaaaagagggttgagaaccctaatattagcgccaactcgagtagtagctgctgaaatggaggaggctctacgaggactacctattcgttatcaaacgccagcgatacgtgctgagcatactgggcgtgaaatcgttgatttaatgtgtcatgcaacatttactatgagattactaagtccagttcgggttccaaattataacttgattattatggatgaggcccattttacagatccagcttctatagcagcaagaggatatataagcacaagagtagagatgggtgaagcagctggaatatttatgactgcaacaccacccggcagccgagatccattccctcaaagtaacgcacctattatggacgaagagagggaaattcctgaaagaagttggaactcaggccatgagtgggtaacagattttaaaggtaagacggtatggtttgttccatcaattaaggctggtaatgacatcgccgcatgcttgcgtaaaaacggtaaaaaagtaatccaactatcacgaaaaacctttgatagcgaatacgttaaaactcgcgctaacgactgggacttcgtcgtaactactgacatcagcgagatgggcgccaacttcaaagccgaaagagtaatagatcccagaaggtgtatgaagcccgtaatactaacggatggagaggaacgagtaattctggcaggcccaatgccagttacgcattcgagtgctgcccaaagacgaggaaggattggacgtaacccaaaaaatgaaaacgaccagtatatatatatgggcgagccacttgaaaatgatgaggactgcgcacattggaaggaagctaaaatgctgttagataacattaatacgcctgagggaataataccgagcatgtttgagccagaacgggaaaaagtggatgctatcgatggtgaatatcgcctgagaggagaggcacgtaagacttttgtagatctcatgcgccgaggcgacctaccagtatggttagcttacagagtcgctgctgagggaataaactatgctgatcgaagatggtgctttgacggaattaagaataatcaaatcctggaagaaaacgtagaagtagaaatatggaccaaagaaggtgaacgcaaaaaattaaaacctcgctggttagatgcacgaatatattccgacccattggctttaaaggagttcaaagaattcgcagcgggtcgtaaatctttaacattgaatttaataacggaaatgggaaggttaccaacgtttatgacacaaaaagccagaaacgcactagataatttagcagtactgcatacagcagaagcgggtggtagggcatataaccatgcattatcggaattgcctgaaacactagagacgctcttattactgaccctattggcaactgttacaggcggtattttcttatttctaatgtcaggcaaaggcataggcaaaatgacactaggaatgtgctgtataataacggcttccattttattgtggtatgcccaaattcaacctcattggatagcagctagtatcatactcgaattttttctgatagtcttattaatcccagaaccagaaaaacaaaggacaccacaggataatcaattgacgtatgtggtcatagcaattttaaccgttgtggctgctactatggctaacgaaatgggatttctcgaaaaaacaaaaaaagacctagggttgggttccatcaccacacaagaatcagaatcaaatatcctcgacatagatcttcgccctgcctcagcctggactctctatgcagtagccacgacattcgtaactccaatgttgagacattccatagaaaacagttctgttaacgtatctcttacagctatagcaaaccaagccacagtactcatgggtctaggtaagggatggcctctctcgaaaatggatataggtgttccattactagcgattggatgttatagccaagtaaatccgataaccctaacagccgcgttactcctccttgtggctcattacgctatcataggacctggcttacaggcaaaagcgaccagagaagcacaaaaaagagcggctgcaggaataatgaagaatcctacagttgatggaataacagttatcgatttagaacctatcccgtatgacccaaagttcgagaaacaattgggtcaagtaatgcttctaatactgtgcgtaacacaagtgttaatgatgcgtacaacttgggctctatgtgaagcgctaaccctcgcaactggacctataagcacactatgggaaggaaatcctggacgattctggaacacaactatagcagtatcaatggcaaacatttttcgtggttcgtacctagctggtgcaggcctactattttcaataatgaagaacacgacaaataccaggagaggtacagggaatataggagaaactctcggcgagaagtggaaatctagattgaacgcgctcggcaagtcagagttccaaatctataagaaaagcggaattcaggaagtcgaccgaacacttgcaaaggagggtatcaaaagaggggaaacagatcaccacgctgtcagtcggggaagtgcgaagcttcgatggttcgtcgagagaaacatggtaactcctgaggggaaagtagttgatctaggctgcggcagaggaggatggtcctattattgtggaggtctcaaaaatgtcagagaggttaaaggccttacaaaaggagggcctggacatgaagaacccattcctatgagcacctatgggtggaaccttgtgcgactacaaagtggtgtcgacgtattctttacaccgcccgaaaagtgcgatacgctgctttgtgatattggagaatcgagtccaaatcccactatcgaagctggccgaacactaagagtactgaatttagtagaaaactggttaaataataacactcaattctgtataaaggtgctaaatccctacatgccaagcgttatagagaaaatggaaactcttcaaagaaagtatgggggagcattggttaggaacccattatcgcggaacagtactcatgagatgtactgggtgtcaaacgcaacaggaaatatagtctcatctgtcaacatgatatctagaatgttaattaatcgatttactatgaaacataaaaaagcgacatacgagccagatgtagatctggggagcgggacgcgaaacatagggatagaaagtgaaatcccaaatttggatataattggaaagcgaatagaaaaaatcaagcaagaacacgagacgtcttggcattacgaccaagaccatccgtataaaacatgggcgtaccatggatcttacgaaaccaagcaaacaggatctgcctcaagcatggtgaacggggtggttcgtctattaaccaaaccatgggacgttgtaccaatggtgacacagatggctatgacagacacaacgccatttggtcaacagcgtgtattcaaggagaaagtagatacgaggacacaggaacccaaagaaggaacaaaaaaactgatgaagataacagcagaatggctatggaaagaacttggaaaagaaaaaacaccaagaatgtgcacaagggaagagttcgcacgtaaagtacgctctaatgcggcactcggggcgatctttacggacgaaaacaaatggaaaagtgctagggaagctgtggaagatagtagattctgggaactcattgatcgtgagcgaaatctacatctagaggggaaatgtgagacatgtgtttataatatgatgggaaaaagagagaaaaaattgggagagtttggaaaggcgaaaggctctagggctatctggtacatgtggttaggagctagattcttggaatttgaggcattaggattcttaaatgaggatcattggttttctagagaaaacagcctatccggcgtagaaggagagggacttcaccgtcttggttatatattaagagatgttagtaagaaggaaggaggagcaatgtatgccgacgatactgcgggctgggatacgaggattaccctagaagatttaaaaaacgaagaaatggtaacgaatcatatgaaaggcgaacacaaaaaattagcagaagcaatttttaagttaacatatcaaaataaagtggtaagggtacaacgtccaactcctagaggtacggttatggacattatcagtcgaagagatcaaagaggatcaggccaagtgggaacatatggactgaacacgtttaccaacatggaagcccaactgattcgtcaaatggagggagagggaatatttaaatcgatacaacacttaacagcaactgaagaaatcgcggtacaaaattggttagcaagagttggacgcgaaagattgtctcgcatggccatatcaggagatgattgcgttgtcaagcctttagatgatagatttgcatctgcccttactgctctaaatgatatgggcaaggtacgaaaagacatacagcagtgggaaccttcccggggctggaacgactggactcaggtcccattctgttcacatcacttccatgaactagtgatgaaagatggaagggtactagttgttccatgtagaaaccaagacgaattgatcgggagagcaagaatttcccagggtgcaggttggtctttaaaggagacggcatgtttaggtaaaagttacgcccaaatgtggactctgatgtattttcatagaagagaccttcggttagctgcaaatgctatttgttccgctgtacctagccactgggtgcctacatcaagaaccacttggtcaatacatgccaaacacgaatggatgacgacggaggacatgctagcagtatggaatagagtatggattcaggaaaatccgtggatggaagataagacaccagtagaaagctgggaagaagtaccatatttaggtaaaagggaagatcaatggtgtggatctctgataggattaacttcgagagcaacatgggctaaaaatatccagaccgcaataaaccaagtacgatcgctaattgggaacgaagagtacacggattacatgccgagcatgaagagattcagacgagaggaagaagaagcaggagtgttatggtag

SEQ ID NO: 22917 - RNA, 9876 nt, synthetic construct
  misc_feature 1..9876: note = derived and/or modified CDS sequence (opt6) from DENV-2__GQ398298__SS-prME
  source 1..9876: mol_type = other RNA
acagcgggggttataattatgttaatcccaacagcaatggctttccatctaaccacacggaacggtgaaccgcatatgatagtaggaagacaagaaaaaggaaaatcacttttatttaaaactgaagacggagtaaatatgtgcacacttatggcgatcgatcttggagaactttgtgaagatacaatcacttacaaatgtccactcttacgacaaaatgaacctgaagatattgactgttggtgtaactcaacctccacgtgggtaacatacggaacctgtacgacaactggtgaacacagaagagagaaacgaagtgtggcacttgtgccccacgttggaatgggtctagaaacgcgaactgaaacttggatgagttcagaaggagcatggaaacatgtacagagaatagagacctggatattgagacatcctggtttcactataatggcggcaatattagcttatactattgggactacacactttcaacgagcactaatatttatattgttgacagcagttgctccttcaatgacaatgagatgtatcggtataagtaatagagactttgtagaaggggtgtcgggaggatcctgggtagatattgtacttgagcatgggtcctgcgtaacaaccatggcgaaaaataaaccaactttagactttgagctaataaaaacggaagccaaacagcctgcaacgctacgaaaatactgtatcgaagcgaaactaacaaataccacaaccgaatctagatgtccaacacagggagaaccgagtttaaacgaagaacaggataaacgttttgtatgtaaacattcgatggttgatcgaggatggggaaatggatgtggcttatttggaaaaggtgggattgtgacctgtgcaatgttcacttgcaagaaaaatatggaagggaaagtagtattacccgaaaatttagagtacactatagtaattacaccacactcaggagaggaacacgctgtaggaaacgataccggtaaacatggtaaagaaataaaaataacgccacaatcatcaataacggaagctgaactaactgggtatggtacagttacgatggaatgtagccctagaacaggacttgattttaacgaaatggttttactacaaatggaggataaagcctggttagttcacaggcaatggtttttagaccttcctctaccttggttacctggcgcggatacgcaaggatcgaactggatacaaaaagaaaccttggtaacttttaaaaatccacacgccaagaaacaggacgtagttgtactaggaagtcaagagggggccatgcataccgccctgacgggagcaaccgagattcaaatgtcctcagggaatttattatttacgggtcacctgaaatgccgattaagaatggataaattacagctgaaaggaatgtcgtatagtatgtgtaccgggaaatttaaaatcgtaaaagagatagccgaaacacaacatggtactatcgtaatcagagtacaatatgagggagacggatcgccctgtaagatcccgttcgaaattatggacttagagaagagacatgttctaggaaggcttataactgtaaatcccatagtagcagagaaagactcgcccgtaaacatagaggctgaacctccctttggagatagttacatcattataggagtagagcctggtcagttaaaacttaattggttcaagaaaggtagctccataggacaaatgtttgagactaccatgcgaggagccaaacggatggcgatcctgggagacactgcctgggattttggatctctagggggtgtttttacatcaatcggtaaagcactacatcaagtattcggagctatctatggagcagctttctcaggagtctcttggactatgaaaatcttgataggggtgataataacatggataggaatgaatagcagaagtacatctctatcggtatcgctcgtgctagttggagttgttacattatatttaggggcaatggtccaggccgatagcgggtgtgtagttagctggaagtccaaagaattaaaatgtggaagtggaatttttatcactgataacgttcatacttggacagaacaatacaaatttcagccagaatcaccctcgaaactagccagtgcaatccagaaagctcacgaagaaggaatatgtggaataagatcggtcacccgattggaaaatctaatgtggaaacaaataaccccagagttaaaccatattttgagcgaaaatgaagtaaaactaaccattatgacaggggatataaaagggattatgcaagcagggaaaagatcattaagaccacagccgacagaattaaaatacagctggaaaacatggggaaaagcaaaaatgcttagcactgaatcacataaccaaacttttctaattgacgggcctgaaaccgccgaatgccccaatacaaatagagcgtggaactctttagaagtagaggactacggttttggagttttcactacaaatatttggttaaagctacgagagaaacaagatgtgttctgtgactccaaacttatgtcggctgcgattaaagataaccgtgcggtccatgctgacatgggatactggatagaatcagccctaaacgatacatggaagatggaaaaagcgtcattcattgaagtcaaaagttgccattggcccaaaagccacacattatggagcaacggcgtactcgagtcagaaatgataatacctaaaaactttgctggaccagtctcacagcacaactatagaccaggatatcacacacagacagcagggccctggcatctagggaaattagaaatggatttcgacttctgcgaaggaacaacagttgttgttactgaagattgcgggaataggggaccgagcttgcgaactacaacggcttccggaaaactaataaccgaatggtgttgtagatcctgcactttacctcctctacgctatagaggcgaggatggatgctggtatgggatggaaatcaggcccctaaaagagaaggaggagaatctagtgaacagcttggttacggcaggtcatggacaaatagataacttttcgctagggttactaggcatggcattatttttagaggaaatgctacgaacccgggtagggactaaacatgcaatgcttctagtcgttgtcagctttgttactctaattaccggaaatatgagcttcagagatttaggacgagtgatggttatggtcggtgctacgatgacagacgacattggaatgggaatcacatacctggcattactagcagcttttaaagttagaccaactttcgcagcaggactccttttgagaaaattaacatcaaaagaattaatgatggctacaataggaattgcgttgctatctcaaagtactattcccgaaacaattttagaactcacagatgccttagcactcggaatgatggtgttaaaaattgtacgaaacatggagaagtaccagctagcggtgacaattatggcaattagttgcgtacctaacgcggtaatacttcaaaacgcatggaaagtgtcttgtaccattttggctgctgtatcggtatctccactgcttctaacgtctagccagcaaaaagcagactggataccactagctttgacaattaaaggattgaaccccactgctatattcctgactactttatcacgaacatcaaagaagcgctcttggccgctaaacgaagctataatggcggttgggatggtcagcatacttgcctctagcctactgaaaaatgacattcctatgaccggccccttagtggcgggaggtcttctcaccgtttgttatgtattaaccggtagatctgccgatttagaattggaacgagctgccgacgttaaatgggaagaccaagcagaaatatcgggatcatccccgattctaagcattacgataagtgaagatggcagtatgtccatcaaaaatgaagaagaagaacagacattaaccatattaataagaacggggctactcgtaataagcggtgtgtttccggtttcgattccaattactgccgcggcttggtatctctgggaagtcaagaaacaaagagcaggggtactatgggacgtgccatcaccgccaccagttgggaaagcggagctagaggacggcgcttaccgtataaaacaacgaggcatactaggctattcgcaaataggcgcgggagtttacaaagaaggaacatttcacactatgtggcacgtaacaaggggcgcagtactcatgcatagaggaaaaagaatagaaccctcatgggctgatataaagaaagatttaatatcctatggaggtgggtggaaacttgaaggcgaatggaaggaaggagaggaggtacaggtactagcactagagcctggcaaaaatcctagagcagtccagaccaaacctggactgtttaagacaaatacaggtacaattggagcggtaagtttagatttttcgcccggcacatcaggaagtcctatagttgatagaaaaggaaaagtcgtaggcttatacggaaatggagtagtaactcgttctggagcttatgtatccgctatcgcccaaacagaaaaatcaatcgaagacaacccagaaattgaggatgacatatttaggaagaaacgattaacgattatggatcttcatccgggagcaggtaagaccaagaggtatttaccggcgatagttcgtgaagcaattaaacgaggcctaaggactcttatcctagcacccacacgcgttgtcgcggcagaaatggaagaagcactaagaggcctccctatacggtaccaaactccagctattcgggccgagcatacaggtagagagattgtagatctgatgtgccatgcgacattcacaatgagattattatcacctgtcagagttccaaattataatttgatcattatggatgaagctcactttaccgaccctgcatcgatagccgccaggggatacatatcaacacgagtcgaaatgggtgaggctgcaggcatattcatgacagctaccccgcccggatcacgtgatccttttccgcaatccaacgcgccgataatggatgaagagagagaaatacccgaaagaagttggaatagtggtcacgaatgggtaacagatttcaagggtaagacagtatggtttgtaccctctatcaaggccgggaacgacatcgctgcatgcttgcgtaaaaatggcaagaaagtgatccaactgtctagaaagactttcgacagtgaatatgtaaaaacacgagcaaatgactgggatttcgttgttacaacagacattagtgagatgggcgcaaattttaaagctgaacgcgtaatagatccgcgaaggtgcatgaaaccggtaatattgacggatggggaagaacgtgtaattttagcgggccccatgccagtcacacactcttcagcagcccaacggcgtggtagaattggacgaaatcctaaaaacgaaaatgatcaatatatctatatgggggaacccctagagaatgatgaagactgcgctcactggaaagaagctaaaatgttactagacaacataaacactccagaaggaatcatcccctcaatgttcgagccagaaagagagaaagtcgatgctatagatggtgaatataggttaagaggcgaagcaagaaaaacatttgtagacctcatgcggcgaggagatctcccggtgtggctggcatatagagttgcagccgaagggataaattatgcggatcgaagatggtgttttgatggcataagaaataatcaaatattggaggaaaacgtcgaagttgagatctggactaaggaaggcgaaagaaagaaattgaaaccaaggtggctggatgcaagaatttacagtgatccactggcgttaaaagagttcaaagagttcgctgcaggaagaaaatcattaacgctaaacctcataacagaaatgggacgattaccaacattcatgacacaaaaagcaagggatgcattagataatttagccgtcctccataccgctgaagctggcggtagagcttataaccacgcattaagcgagctgcccgagacactagaaactttactcttgcttacattactagcgacggtaaccggaggaattttcctttttctaatgagcggaaaaggaatcggtaagatgaccctaggcatgtgctgtatcataacagcgagcattctcctgtggtatgcccagattcaaccacactggatcgcagcatcaataatactagagttctttttgatagtactgctaataccggaacctgaaaaacaacgaacaccacaagataaccagttaacatatgtagtgatcgctattttgactgtcgtagccgcaacgatggcgaatgaaatggggttcttagagaaaactaagaaagacttgggactcggctctatcgcaacgcaggagagtgaatcaaacatcttagatatagatctaagaccagcaagtgcttggacactatatgcggttgctactacctttgtaacaccaatgctcagacattctatagagaactcaagcgtaaatgtaagcctcaccgcaattgcaaatcaagcaacagttctaatgggtttggggaaaggttggccactatccaaaatggatattggagtacctcttttagcaataggatgttattctcaagtaaatcctattaccttaactgctgctctattattgctggtcgcgcactacgcaataataggacctggactacaggcaaaagcgacaagggaagcccaaaaacgggctgctgctggaataatgaaaaatcctacagtagacggaatcactgtaatagatctagagcccatcccctacgacccaaagttcgaaaaacaactaggacaggtgatgttattgatattgtgtgtaacacaagtattaatgatgagaactacttgggcactttgtgaggctttgacccttgctacaggtcccatctcaacactatgggaaggaaatccgggacgcttctggaatactaccatagccgtaagcatggccaacatttttagaggttcttatcttgcgggagctggacttctattttctataatgaagaacaccacgaatacaagaagaggtacaggcaacattggtgagacactgggagaaaaatggaagagtcggttaaacgcacttggcaagtcagagttccaaatttataagaagtcaggtatacaagaagttgacaggaccttggcaaaagagggaattaaacgaggcgaaactgatcatcatgcagtaagtcgaggaagtgcaaaactaagatggttcgtcgaaagaaacatggtcactccggagggtaaagtggtagacttagggtgcggtagagggggatggtcctactattgcggagggctcaagaacgtacgggaagtgaaaggactaacaaagggtggtccaggccacgaggaacccattcctatgagcacatatggttggaatttggttagactgcagagcggcgttgatgtattcttcacaccgcccgaaaaatgtgacaccctattatgtgacattggggaatcaagcccaaacccaacaatagaagctggtcgaacattaagagtgctcaatttggtagagaattggctaaacaataatacgcagttctgtataaaagtactaaatccatacatgccaagcgtgatagagaaaatggaaacactgcaaaggaaatacggtggagcccttgtacgaaatccgctatcacgtaacagtacacatgagatgtattgggtaagtaacgcaacaggtaatatagtatcaagtgtaaacatgatatcgcgtatgttaataaatcgattcacaatgaagcataagaaagctacatatgaaccagacgtagatttgggtagcggaactcgcaacataggaattgaatctgaaatcccgaacttagacataataggaaaaaggatagagaaaataaaacaagaacatgaaacaagctggcactacgaccaagaccacccatacaaaacgtgggcttaccacggatcttatgaaactaaacaaacaggatcagcttcctctatggtaaacggggttgttagattattaacaaagccatgggatgtagtaccaatggttacccaaatggctatgactgataccacaccctttggacagcaacgcgtgtttaaagaaaaagtagacacgagaactcaagaacctaaggaaggtactaagaaattaatgaagataaccgccgaatggttatggaaggaactcggtaagaagaaaacaccaagaatgtgtactagagaagaatttacgaggaaagtccggagtaacgccgctctaggagcaatatttacggacgaaaataaatggaaaagtgctagggaagcagttgaagacagtcgcttctgggaacttatagatagggaaagaaacctacacctggaaggaaaatgcgaaacctgcgtatacaacatgatgggaaaacgtgagaagaaactgggggagttcggaaaagctaaaggctcaagagcaatttggtacatgtggctcggcgccaggttccttgagttcgaagcgctaggatttctgaacgaagaccactggttttctagaggaaattctctatccggtgttgaaggcgaaggactacataggcttggttatattttacgagatgtatcgaagaaagaaggaggagccatgtatgcggacgatacggcaggctgggacactaggataacattagaagatctcaaaaatgaggagatggtaacgaatcatatgaaaggtgaacataagaaattggctgaagcaatatttaaacttacctatcaaaataaagtagtgcgagttcaaagaccgacgcccaggggcacagtcatggatatcatctcaagacgcgaccagagggggagtggtcaagtcggcacttatggtttaaacacattcactaatatggaagcgcagttgatcaggcaaatggaaggagaagggatttttaaatcaattcaacatttgaccgtgaccgaagagattgcggtccaaaattggctggccagagtaggcagagaaagattaagtcgtatggcaataagcggagatgattgtgttgtgaaaccccttgatgacaggttcgcttcagctcttacagcgttaaacgacatgggaaaggttaggaaagacatacagcaatgggaacccagtcggggctggaacgattggacgcaagttcctttctgttctcaccattttcatgagttggtcatgaaagatggtcgtgtattagtagttccatgccgaaaccaggatgaattaataggtagggcaaggatttcacaaggggcaggatggtcattaaaagagaccgcatgcctaggaaaatcatatgcacaaatgtggacattaatgtacttccaccgacgggatttacgcctagctgcaaacgcaatatgttccgctgtcccgtcacactgggtaccaacttcgagaactacttggagtatacacgccaaacatgagtggatgaccactgaagacatgttagcagtgtggaatagagtatggatacaggaaaatccatggatggaagataagactcccgttgaaagttgggaagaagtaccgtatttaggtaaaagagaagatcagtggtgtggaagtttaatcggcctcacttcacgtgcgacgtgggcaaagaatattcaaaccgcaattaaccaggtacggagcctcataggaaatgaagaatacactgactacatgcctagcatgaaaagattccgtagagaagaagaagaagcaggagtcttatggtag

SEQ ID NO: 22918 - RNA, 9876 nt, synthetic construct
  misc_feature 1..9876: note = derived and/or modified CDS sequence (opt6) from DENV-2__GQ398301__SS-prME
  source 1..9876: mol_type = other RNA
actgcaggagtaataattatgctaatacctacggctatggcttttcatttaacgactagaaacggcgaaccacacatgatagtaggaagacaagaaaaaggaaaatccttactttttaaaaccgaagatggcgttaacatgtgtactttaatggctatagatcttggagaactttgtgaagataccataacttataaatgtccactacttcgtcagaatgaacccgaagacatagattgttggtgtaactcgacaagcacctgggtaacgtatggaacctgtactacaacgggcgaacatagacgcgagaaaagatccgtagcactggtacctcatgtaggaatgggattagaaactagaactgaaacttggatgtcatccgaaggggcatggaaacacgtacaacgaattgaaacatggatactgcgtcacccaggctttacaattatggcagctattttggcttatacaataggtaccacacatttccaaagggctctcattttcatactactgacagctgttgcaccatcaatgactatgagatgcattggaatatcaaacagagattttgtggaaggcgtctcaggaggcagttgggttgatatagtgcttgaacatggaagctgtgtgactacaatggccaaaaataaaccaacattggattttgaattgataaaaacagaagcgaaacagcctgctacactacgtaaatactgtatagaagcgaaattaactaacacaacgacggaaagtagatgtcctacacaaggtgaaccgtctttaaacgaagaacaggataaaagatttgtctgtaaacatagtatggtagatcgaggatggggaaatggttgcggactcttcggcaaaggaggtatagtaacatgtgcaatgtttacctgcaagaaaaatatggaaggtaaagtggtcttacctgaaaatcttgaatacaccatagtgataacaccccacagcggtgaagaacatgcagttgggaatgatacaggcaaacatggcaaagaaattaaaataacgccacaaagttcaatcacggaagctgaactaacggggtatggaaccgtgacaatggaatgcagcccacgtactggtcttgactttaacgagatggtacttctacaaatggaagacaaagcgtggttagtacatcgtcaatggtttttggatctcccattaccctggctgcctggtgctgatacacaaggatcaaactggatccagaaagaaaccttagtaactttcaaaaatccccacgcaaagaaacaagatgttgtggtgcttggtagtcaggaaggagcaatgcacacagctttgacaggtgcaacagaaatccaaatgagctcaggcaatcttctattcacaggacatcttaaatgtcgtcttagaatggacaaactacagcttaaagggatgagttattcaatgtgcacaggaaaattcaaaatcgtgaaagaaattgcggagacacaacatggaactatagtcatacgggtacagtatgagggagacggaagcccttgcaaaatacctttcgaaatcatggatcttgagaaaagacatgttcttggaaggttgataactgtaaatcctatcgtagccgaaaaggactcgccagttaatatcgaagcagagccgccatttggagattcgtatataataattggcgttgaacccgggcagttaaaactcaattggttcaaaaagggaagctcaatcggacaaatgttcgaaacaacaatgagaggtgcgaaaagaatggctatattaggagatacagcttgggacttcggaagtctaggaggtgtttttacctcgataggaaaagcactccaccaagtatttggcgcgatatacggtgccgcattcagtggagtatcatggacaatgaaaatattaataggtgttataataacctggataggaatgaatagtagatcaactagcctgagtgtgtcattggtcctagtaggtgtagtaacactatatcttggggcaatggtacaagcagatagtggttgcgttgttagttggaaatcaaaagaactaaaatgtggatcagggatattcataacagataatgtacacacatggactgagcaatacaaatttcaacccgaatcaccttctaaactagcttccgcaattcaaaaggcgcatgaagaaggtatttgtggaatacgatcagtaacacgattggaaaaccttatgtggaaacaaataactccagaattgaaccacatactgagtgagaatgaagtcaaattaactatcatgactggagacataaaaggcataatgcaagcaggaaaacgaagccttagaccacaaccaactgaacttaaatacagttggaaaacgtggggaaaagcaaaaatgctgagtacagaatcacataatcagactttcctgatagacggaccagaaacagctgagtgccccaatacgaatagagcgtggaactccttagaagtagaagattatggcttcggagttttcacaacaaacatttggctaaaactaagagaaaaacaggatgttttctgtgatagcaagttaatgtcagcagccataaaggataatcgagcagtccacgcagatatgggctattggatagagtctgcccttaacgacacatggaagatggaaaaggcatcttttattgaagtgaaaagttgtcactggccgaaaagccatactttatggtcaaatggggtgttggagtccgaaatgattatccctaaaaattttgcgggacccgtatcccagcataattatagacctggatatcatacccaaacagctggtccatggcacctaggaaaacttgaaatggacttcgatttttgtgaaggaacaacagttgttgtgacagaagactgcggaaaccgaggaccctcgcttaggacaactactgcatcagggaagctaattacagaatggtgttgtagaagttgtacattaccacccctaaggtaccgaggtgaagacggatgttggtacggaatggaaatccgaccattgaaagagaaagaagaaaacttagtaaactcattagttaccgccggacacgggcagattgataattttagtctaggcgttttaggaatggcactttttctagaggagatgttgcgaacccgcgtaggaaccaagcatgccatgctcctagttgcggcaagtttcgtaacactaataacaggaaacatgtcattcagagacttgggtagagtaatggtaatggtgggcgcaacaatgacggatgatatcggtatgggaataacatatttggcactgttagctgccttcaaagtgagacctacttttgcagccgggctattattacggaagttaacctccaaagagctgatgatggccaccatcggaatcgctctactcagtcaaagtacaatcccagaaacaattctcgaactcacagatgcattagcactcggaatgatggtgttgaagatcgtacgcaatatggaaaagtatcaactagccgtaaccataatggctatttcctgcgtgccaaatgctgtcatattgcagaatgcatggaaagtaagctgtacaattttagcagccgtgagtgtatctccattgttattaacatcatcgcaacagaaagctgactggattccattggctttaacgataaaaggccttaatcctacagccatatttttaacaacccttagtagaaccagcaagaaaagaagttggccattaaacgaagcgataatggcagttggaatggtctctattttagcaagctccctactcaaaaacgacatacctatgactggaccacttgtcgccggagggttacttacagtctgttacgtattaactggacgttcagcagacttagagttagaaagagctgccgatgtaaaatgggaagatcaagctgaaataagcgggtcttcaccaatactttcaattaccatttctgaggatggctccatgagtatcaaaaacgaagaagaggaacagaccttaacaattctgattcgaaccgggctattggtgataagcggggtctttccagtatctataccaataaccgctgctgcttggtatctttgggaagtcaagaaacaacgtgcaggagtcttgtgggatgttccttcaccacctcccgttgggaaagctgagttagaagatggcgcatatagaattaaacaacgaggcattctaggatatagccaaattggcgctggtgtgtataaagaaggtacattccacacgatgtggcatgtaactagaggagcggtccttatgcacagagggaagcgaattgaaccctcgtgggcggatgttaaaaaggaccttattagctacgggggcggttggaaactagagggggaatggaaagagggagaggaagtacaagttttggcactcgaaccaggcaagaacccaagagcagtacaaactaaacctggtctctttaaaactaacacaggcacaataggggcggtatctctagacttttctccagggacatctggatcgccaatagtagataggaaagggaaagtggtcggtttgtatggaaatggtgtagttacgagatcaggtgcatatgtttcagccatcgcgcagactgaaaaatcaatagaggataatccggaaatagaggatgatattttccgtaaaaagcgattaacaataatggatttgcatccaggagccggaaagacaaagagatatttgccagctatcgtacgagaggcgattaaaagaggcttgcgaactctaattcttgcgccaacccgtgtcgtagctgcagagatggaagaagcattaagaggtttacccataagataccaaacaccggctataagagcagagcatactggccgagaaatagttgatctcatgtgtcacgcgacttttacaatgagattattaagccctgttcgtgtaccgaactataacctgataatcatggatgaagctcactttaccgacccagcctcaattgcagctcgcggctacatctcaacacgagttgaaatgggggaggcagccggtatatttatgacagcgacccctcccggaagtagagatccattccctcagtccaacgcgcctatcatggatgaggaacgagaaatccctgagaggtcctggaactcaggacatgagtgggtaactgattttaaaggaaagactgtttggtttgttcctagtataaaagcaggtaacgacatcgcagcttgtctaaggaagaacgggaagaaggttatacagttgtcaaggaaaaccttcgattccgaatatgtcaagacgagggcaaatgattgggattttgtagtaacaacagacatcagcgaaatgggtgctaacttcaaagcagaacgcgtgatagatccacgacgatgcatgaaaccagttatattaacggacggcgaagaacgagtgatattggctggcccgatgccagtaacacattcatcagccgcacagcgtagggggcggatcggtagaaaccctaaaaatgagaacgaccagtacatatacatgggagagccgttagagaatgatgaagattgcgctcattggaaagaagccaaaatgctactagataacattaatacgcctgaagggattataccatcgatgtttgagccagaaagagaaaaagtagatgcaattgatggagaataccgtctaagaggtgaagcaaggaaaacctttgttgatttgatgcgacgcggtgacctccccgtatggctagcctatagagtagcagccgaaggtataaattatgctgacaggagatggtgcttcgacggaatcaaaaacaatcaaatattggaagaaaacgtagaggttgaaatatggacaaaggagggagaaaggaagaaactaaaaccaagatggttggacgcacgaatctacagcgatccactagcactgaaggagttcaaagaatttgcagcggggcgtaaaagcctcaccttaaatctcattaccgaaatgggacgacttccgacctttatgacacaaaaggcccgagatgcattagacaatttagccgtattacacaccgctgaagcgggtgggcgagcatacaaccatgcgttgtctgaacttcctgaaacgctggaaacactattgttattaactttgttagcaacagtcacgggtggcatattcttgtttttaatgagtgggaaaggtataggtaagatgacgctgggcatgtgttgtataataactgcctcaatcttgctttggtacgctcaaattcaaccacactggatagcagctagtataattttagagttcttcttaatcgtactcttaattccagaacctgaaaagcaacgaacgccacaagacaaccaattaacttacgtagtaattgctatactaacagtcgtagcagcgacaatggctaatgaaatggggtttcttgagaaaaccaagaaagatttgggcctaggatctattgctacccaggaaagtgaaagtaatatactagacatagatctacgaccagcgagcgcttggacgctttacgcagtagctaccacatttgtgactccaatgttacgacactccattgaaaatagttcagtaaatgtcagtcttacggctattgcaaatcaagctacggtgctgatggggttagggaaagggtggccacttagcaagatggacattggcgtaccgctgctagctatagggtgctatagtcaagtcaaccctatcacgctaactgctgccttgctattattagtagcacattacgcaatcatcgggccaggtttgcaagcaaaagccactcgagaagcacagaaacgtgcggcagccggtatcatgaagaacccaaccgtggacgggataacagtaatagatctagaacctattccatatgatcctaaattcgaaaaacaattgggtcaagtaatgttgcttattctttgcgtgactcaagtattaatgatgagaacaacatgggcattatgcgaagcactgacattagcgacagggcctatatcaactttatgggaaggaaaccccgggcggttctggaacacgacgattgccgttagcatggcgaatatttttcgagggtcatatttggccggtgcaggattattgtttagtataatgaaaaacaccactaacactaggagaggaacaggtaatattggcgaaactctaggtgaaaaatggaaatcgagattaaatgctctcggtaaatcagagtttcaaatatataagaaatctgggattcaagaagttgacaggactctagctaaagaaggcataaaaagaggggaaacagatcatcacgcagtaagtagagggtcagcaaaattgagatggttcgtggagagaaacatggtaacacctgaaggtaaagtggtcgacctaggatgtggcagagggggttggagttattattgtggtggtctcaaaaatgtccgagaagtgaaaggtttaaccaaaggcgggccaggtcatgaagaacccattccaatgtcaacatacggatggaatcttgtgcgtttacaatcaggagtagacgtatttttcactccacctgaaaagtgtgatacactactctgtgatattggagagtcgagcccaaacccgacaatcgaagcgggtaggactctaagagtcttaaatttagtagaaaattggttaaataataacacacaattttgtattaaagtattgaatccatatatgcctagtgtaatagagaaaatggaaacactacaacgaaaatacggaggtgccttagtaagaaaccccctctccaggaactccacccacgaaatgtattgggtttcgaatgcaacgggaaatatagtttcaagcgtcaacatgatttcgcgtatgcttattaaccgcttcacaatgaaacataagaaagcaacttacgaaccagatgtagatctcggtagcggaacaagaaacataggaatagaaagcgaaataccaaatcttgatattataggaaaacgaatcgagaaaataaagcaagaacatgagaccagttggcactatgatcaagatcatccatataaaacatgggcttaccacggatcctacgaaaccaagcaaaccgggtctgccagttcaatggttaacggagtcgttcgacttttgacgaaaccgtgggatgtagtgcctatggtaacacaaatggctatgaccgacactaccccatttggacaacaaagagtatttaaagagaaagtagataccaggactcaagagcctaaggaggggacgaagaaacttatgaaaataacagcagaatggctctggaaagagctgggtaaagagaaaactcctagaatgtgcacacgagaggaatttacacggaaagttcgttctaacgcagctcttggggcaatcttcactgacgagaataaatggaaatcagcaagagaggcggtagaagacagcagattctgggagctaatagacagagagcgaaatcttcacctggagggaaaatgcgaaacatgcgtttacaatatgatgggtaaaagggagaagaaactaggagaatttggaaaagctaaaggaagtagagcaatatggtacatgtggctgggcgctagatttttagaatttgaagctctaggcttccttaatgaagaccattggttttctagaggcaactcattgtcaggggtagagggtgaggggttgcaccgtctcggttacatattaagagacgtgagtaagaaagaaggaggggcaatgtacgcagacgatacagcggggtgggatacgcgaataaccttggaagaccttaagaacgaggaaatggtcaccaaccatatgaaaggagaacataagaaactggcagaagctatatttaaactaacgtatcagaacaaggtggtaagggttcagcgtccaacccccagaggaaccgtaatggatattatatctaggcgagaccagcgaggttcaggacaggtgggtacatatggcctaaatacctttacaaatatggaggcccaattaatcagacaaatggaaggagaagggatttttaagagcatacaacatctcacagttaccgaagaaatagcagtgcagaactggttagcgagggtaggacgagaacggttgtcaaggatggctatatcgggagacgattgtgtagtgaaacccctagacgatcggttcgcgtcagcattgacagcactaaatgacatgggcaaggtacgaaaagatatacaacagtgggagccatctagaggttggaatgattggacacaagtgcccttttgctcacatcattttcatgagcttgtaatgaaagatgggagagtattagtggttccctgtaggaaccaagatgaactaatagggagagcaaggataagtcaaggggcaggctggtctttaaaagaaacggcatgtttaggcaagagttacgcacaaatgtggacactaatgtactttcatcggagagacctccgattagccgcaaacgcaatatgttcagcggtcccatcccattgggtgccgacaagccgtaccacctggagcatacatgcaaaacacgaatggatgactactgaggatatgctggcggtatggaaccgggtctggattcaggagaatccttggatggaagataagaccccagttgaatcttgggaagaagtcccatatttgggaaaaagggaagaccaatggtgtggttcactaatcggactgacatcccgggccacttgggctaaaaacatccaaacagcgattaatcaagtcagatcgttaattggcaatgaagagtatactgattatatgccatccatgaaacgatttagaagggaggaggaagaagcaggagttctatggtaa

SEQ ID NO: 22919 - RNA, 9876 nt, synthetic construct
  misc_feature 1..9876: note = derived and/or modified CDS sequence (opt6) from DENV-2__GQ398312__SS-prME
  source 1..9876: mol_type = other RNA
acggctggtgttataataatgctaattcccactgctatggcatttcacctgaccactcggaatggagaaccgcacatgatagttggtcgacaggaaaaaggtaaaagtttattatttaaaaccgaagatggagtgaatatgtgcactttaatggctattgatttgggagaactatgcgaagatacgattacttataaatgtccactgctgaggcaaaacgaaccagaagacatagattgttggtgtaatagtacgtcaacatgggtgacctatggcacatgtacaacaactggagaacaccgcagagaaaaacgatcagtagcgctggttccacacgttggaatgggcctagaaacgcgtaccgaaacttggatgagttcagaaggggcgtggaaacacgttcagagaattgagacatggattttacggcatcccggatttacaattatggcagcaatattagcgtacacaataggaaccacacattttcaacgtgcattgatattcattctcctaacagcagtggccccttcgatgaccatgaggtgcataggtatatcgaatagagattttgttgaaggtgtttcaggaggttcttgggtagacatagtattagagcacggcagttgtgtaacgacaatggctaaaaacaaaccaacgctagacttcgagttaataaaaacagaagcaaaacaaccagctacattaagaaaatactgtatcgaagctaaacttacaaatacaactactgagtcgaggtgtcctactcaaggtgaacccagcttaaatgaagaacaagacaaaaggttcgtttgcaaacactcaatggtagatcgcgggtggggaaacggatgcggattatttggaaaaggaggaatcgtaacgtgtgcaatgttcacatgtaagaaaaacatggaaggtaaagtcgtcttaccagaaaacctagaatatacaatcgtaataacaccacactctggggaagaacacgctgtaggcaacgacaccggcaaacatgggaaagaaattaaaataactcctcaatctagcatcactgaagccgaactaacgggttatggtactgttacaatggagtgctctcctagaacaggattagactttaatgaaatggttttattgcaaatggaagataaagcatggctggtgcatagacaatggtttctagacctcccgctaccatggttaccaggagcggatacacaagggtcaaattggatacagaaagaaaccttagtcacttttaaaaatccgcatgcgaaaaagcaggatgtagtagtcttgggatctcaagagggtgcaatgcatactgcattaaccggcgcaacagaaattcaaatgagcagtggaaacctactgtttactggtcatctaaagtgtcgacttagaatggacaaattacaactgaagggaatgagctattccatgtgtacaggtaagtttaagatagttaaagaaatagcagaaacacaacatggaacaatcgtaatacgagtccaatacgaaggggatggttcaccctgtaaaataccatttgagattatggacctcgagaagagacatgtattaggtcgccttattacggtaaaccccatcgtggctgaaaaagattctccagtaaatatcgaagcagaaccaccatttggagattcgtatattatcattggtgttgagccaggtcagttaaagttgaactggtttaagaagggaagttcaataggacaaatgtttgagactactatgcgcggagcaaaaagaatggctatattaggggatacagcgtgggatttcgggtcactagggggagtattcacatcaataggaaaggccctacaccaagtatttggtgccatttatggggcagcgttcagcggcgtctcgtggacaatgaaaatattgattggagtcataattacctggattgggatgaactcgcgttcaacttcattaagtgtatcattagtacttgtcggagttgttaccctctatttaggggcaatggtacaagcggattcgggttgtgttgtttcatggaaatcaaaagaattaaaatgcggcagtggaatattcattaccgataatgttcacacatggacagagcagtataaatttcagcctgaatcacctagtaaattagcatcagcaattcagaaggctcacgaagagggtatctgcggaatacgcagtgttacacgattagagaatctcatgtggaaacaaattactcctgaacttaaccatatattaagtgaaaatgaagtaaaattaacaataatgaccggcgacataaaagggattatgcaagctggaaagagaagtctaaggccgcaacctacagaactcaaatactcttggaaaacttggggaaaagcgaaaatgctgtcaactgaatctcataatcaaacattcttaatcgatggaccggaaaccgctgaatgccctaatactaatcgggcttggaactctctggaagtggaggactacggcttcggcgtattttcgacaaatatttggctaaaactgcgagaaaaacaggacgtattttgtgattccaaactaatgtccgcagcgattaaggataacagagctgtacacgccgatatgggttattggatcgagagtgcattgaatgacacatggaaaatggaaaaggcgagcttcatcgaagtcaaatcatgccattggcctaaatctcacactctatggtcaaatggggtattggaaagtgaaatgattatacccaaaaattttgcaggtccggtaagtcagcacaattaccgacctggttaccacacgcaaactgcaggcccttggcatttgggtaaactagagatggattttgacttttgtgaggggacgacagtagtggttacggaggactgtggtaaccgaggacctagcctgagaactactaccgcgagtggtaaattaattacagaatggtgttgtagaagctgcacattgccaccactaagatacagaggggaagatggctgctggtacggaatggaaatccgccccttaaaagaaaaagaggaaaatctagtaaactcattagtaactgcaggacacggacaaatagacaactttagcttaggtgtcttgggaatggccctgtttttagaggaaatgttacgaactcgagtggggactaaacatgccatgcttctagtggccgtttcatttgtcactcttataacaggaaatatgagcttccgggaccttggtcgagtaatggtaatggtgggtgcaacgatgacggatgatatagggatgggcataacatatttggcactgttggcggcttttaaagtccgtcctacatttgccgcaggtttgttactccggaaattaacatcaaaagagttaatgatggcaacaattggcatagctctcttatcacaaagtactatacctgaaactatattggaactaaccgatgctctagctttaggaatgatggtattgaaaatcgtaagaaatatggaaaaatatcaattagctgtaacaattatggccataagttgtgttccaaacgctgttatcctacaaaatgcatggaaagtttcctgtactatacttgcagccgtaagcgtcagtccactcttattaacatcaagccagcaaaaagccgattggatccctttagccttaacaataaaaggcctaaatccaactgctatatttctgacaactctgtcaagaacgtccaaaaagaggtcttggcctctgaatgaggctatcatggcagtgggtatggtaagcatactagcatcaagtcttctcaaaaatgacattcctatgacagggcccctcgtagcagggggattgctgacggtctgttatgtgcttaccgggcgcagcgcagacttagagctagaaagagcagctgacgtaaaatgggaagatcaggcagaaatatcaggcagttccccaattttatcaataactatatcagaagatgggtccatgtccatcaaaaacgaagaagaggaacaaactctcacaatactaattcgcacaggcctattggtgataagtggggttttccccgtatcaattcccataacagcggccgcgtggtatctctgggaagtcaagaaacaacgagctggagtactatgggatgtcccgagtccgccgccagtcgggaaggccgaactggaagatggcgcatatcgaataaaacagaggggaatactgggatattcacaaatcggagctggcgtctacaaagaaggtaccttccacacaatgtggcatgtaacgcgcggggctgttctaatgcacagagggaaaagaatagagcccagctgggctgatgtgaagaaagatttaataagttacgggggcggatggaaacttgagggggaatggaaagaaggggaggaggtacaagttctcgcattagaaccggggaaaaacccgagagccgtgcaaacaaaacctggcttgttcaaaacgaatactggtactataggagcagtaagtctagattttagtccaggtacttcaggttcaccaatagtagatcggaagggaaaggtcgtaggcctatacggcaatggagtagtgacgcggtcaggtgcatatgttagcgcaattgcacaaactgagaagtcaattgaagataaccctgagatagaggatgacatattcaggaagaaaaggttaacaataatggaccttcatccaggcgcaggtaaaactaagagatatctaccagccattgttcgagaagccataaaaagaggcttgagaacattaatattagcgcctacccgagttgtagccgcggaaatggaagaagcgttaaggggattgcccatcagatatcaaacaccagcaatcagggctgaacatacgggccgggaaattgtggacctaatgtgccacgccacattcacgatgcgattattaagccctgtaagagtacccaactataatctgataataatggacgaagctcactttacagacccagcaagcattgcggcgcgaggttacatatcaacaagggtggaaatgggggaagctgcggggatttttatgacagcaacaccacccggctcccgtgacccctttccccaatctaatgcacccataatggatgaagagagagaaatacctgaacgtagttggaactccggtcacgaatgggtaacagatttcaaagggaaaacagtctggtttgtaccctcaataaaagcaggaaacgatattgcggcgtgccttcgtaaaaatggcaagaaagtaatccagctctcgcgtaaaacgttcgacagcgaatatgtcaaaactcgagctaacgattgggattttgtagtcacaaccgacatatctgaaatgggagctaactttaaagccgaacgagtaatagacccaagacgatgtatgaaaccagtcattcttacagatggtgaagaacgggtaatacttgctggacccatgcctgtcacccactcctcggcagcgcaaagaagaggtagaatcgggagaaatcctaaaaatgagaacgaccaatatatttatatgggcgaaccattggaaaatgatgaagactgtgcccattggaaggaagcaaaaatgttactagataacataaatacaccagaagggataataccgtcaatgttcgaaccagaaagggaaaaggtggatgccatagacggagaatatagactaaggggtgaagctcgtaagacattcgtggatctgatgcgtagaggggaccttccagtatggcttgcataccgcgttgcagcagaaggcataaactatgcagaccgtagatggtgtttcgatggtatcaaaaacaatcaaattttggaggaaaacgtagaagttgagatctggacaaaagaaggagaaaggaaaaagctaaagcccagatggctcgatgcaagaatatatagcgatccgctcgctctaaaagagttcaaagagttcgccgcaggtcgtaaatctcttactttaaatctgataacagaaatgggcagactaccaacatttatgacgcaaaaagcaagagacgctctcgacaatctagctgtattgcacacagcagaagctggaggccgcgcttataaccatgcattgtccgagcttccagagaccctagaaaccctcctcttattaacactattagccacagtaacaggcggaatattcttatttttaatgagtggaaaaggcattgggaagatgacacttggaatgtgttgcataattacagcaagtatattactctggtatgcacaaatacaacctcattggatagctgcgagtatcatcctcgagttctttttaatagtactattaataccggaaccagaaaaacaacgaacgccacaagacaatcaattaacctacgttgtcatagccattctaacagttgtagctgcaaccatggcaaatgaaatgggtttcttggagaaaaccaagaaagatcttgggctaggtagtattgctactcaagaatccgagtccaacatcctcgacatagatctacgaccagctagtgcatggactttatatgcagttgcgactacgtttgttacgccaatgttgcgacactcaattgaaaattcttccgttaatgtaagcctcactgctatagctaaccaagcaacagtattaatgggattagggaaaggatggccgttatcaaaaatggacataggggtacccctgttagcgataggatgttatagccaagttaatccaataacattaatcgcagcgcttctattgctggtcgcccactatgcgattattggacctggcctgcaagcaaaagcgacccgagaagctcaaaaacgagcagcagcaggaataatgaaaaatccaacagttgacggtatcactgtaatcgacttagaaccaataccttatgatcccaaatttgagaaacaacttggtcaagtgatgctattaatattatgcgtaacgcaagtactaatgatgagaacaacatgggctttatgtgaagcactaacccttgcgactggaccaatatcgacgttatgggagggcaatcctggaaggttttggaatacaacgatagccgtttcgatggctaatatatttcgcggcagctaccttgccggtgcgggtctcttatttagcataatgaaaaatacgacaaacaccagaagaggtaccggcaacataggtgaaacccttggagaaaaatggaagtcacgacttaatgcgcttgggaagtctgagttccaaatctataaaaagagcggaatccaggaagtagacagaacgctagcaaaagaaggaatcaaacgcggagaaacagatcatcatgcagtatcccggggatcagcaaaattaagatggttcgtagaacgaaacatggtaactccggaaggaaaagtcgttgatttaggttgcggcagaggtggatggagttactactgcgggggactcaaaaatgtccgggaagtcaaaggactcacaaaaggtggaccaggacatgaagaaccaattcccatgagcacatatggatggaatttagtacgtttacaatccggtgtagatgtattcttcacaccacctgagaaatgtgacacacttttatgtgatattggagagagctcaccaaaccccacaatagaagcaggtcgaacacttagggtcttaaacctggttgaaaattggctgaacaacaacacgcagttctgtataaaagtactaaatccatatatgccatccgttatagagaagatggaaacattacaacgaaaatacggaggtgcgttggtacgcaatccgttatcaagaaattcaacacacgaaatgtattgggtatccaacgctacgggcaatatagtaagttctgtaaacatgatttcgcggatgttaataaacaggtttaccatgaaacataagaaagctacttatgaaccagatgttgacctgggatctggtaccagaaacatagggatagaatctgaaatcccgaacttagacatcataggaaaaaggattgagaagatcaaacaagaacacgaaactagctggcattatgatcaggatcatccatacaagacctgggcatatcatggttcgtacgaaacaaaacaaacaggaagtgcatccagcatggtgaacggagtagttcgattactaacgaagccatgggatgttgtgccgatggtaactcaaatggctatgacagatacaacacctttcgggcagcagagggtttttaaagagaaagttgatactagaacacaagagccaaaggaagggactaagaaactgatgaaaattacagcggaatggttatggaaagaactaggcaagaagaaaacaccaagaatgtgcacccgcgaggagttcacacggaaagttcgctcaaacgcagcattaggagctatctttacagacgaaaacaaatggaaaagcgcaagagaagcggttgaagattcacgcttctgggagctaatagatagagaacgaaacttacatttagaaggtaaatgtgaaacatgtgtatataacatgatgggtaaaagggaaaagaaactaggagagttcggtaaagcgaaaggatctcgagcgatatggtatatgtggcttggggcgcgattcctggagtttgaagcgctcggattccttaatgaagaccactggttctcaagaggtaattccctgagcggtgtagaaggagaaggactccatcgattaggttacattttaagggacgtaagtaaaaaggaaggtggtgcaatgtatgcagacgacacagccggatgggacacacgtattacgctcgaagatctcaaaaatgaagaaatggttacaaaccatatgaaaggagaacacaagaaattagcagaagctattttcaaactgacttaccaaaacaaagtagttcgagtacagagaccgacaccgagaggtacagtcatggatataatttctcgacgtgatcaacggggcagtgggcaggttggtacatatggactgaatacatttactaatatggaggcacaactaatacgacaaatggaaggagaaggaatcttcaaatccatacaacacctaactgtaacggaggaaatagctgttcaaaactggcttgcaagggtgggtagagaaaggttgagtagaatggctatatcaggcgacgactgtgtggtcaaaccgttagatgataggttcgcctcagcactcactgcactaaacgacatggggaaagtaaggaaagatattcaacaatgggagccttcccgaggctggaatgattggacacaggtaccattttgcagtcaccactttcacgaacttgtaatgaaggatggtcgagttctcgtcgtaccctgtaggaaccaagacgaactcattggacgtgctcggataagccaaggcgcaggttggagtcttaaagaaacagcatgtcttgggaaatcttacgcacaaatgtggacactgatgtattttcatagacgggatctcagattagcagcaaatgcaatctgttccgcagtgccatcacattgggtacctacatccaggacaacgtggtctatacacgcaaaacacgaatggatgacgacggaagacatgttagccgtttggaatcgtgtctggatccaggaaaacccctggatggaagacaagactccggtagaaagctgggaagaagtcccctatcttggtaagcgagaagaccagtggtgtggtagccttattggactaactagcagggcgacttgggccaaaaatatccaaacagcaataaatcaagtacgaagcctgataggaaacgaggagtacacagactacatgccttcaatgaaacgatttaggcgagaggaagaggaagcgggggtattatggtaa

SEQ ID NO: 22920 - RNA, 9876 nt, synthetic construct
  misc_feature 1..9876: note = derived and/or modified CDS sequence (opt6) from DENV-2__GQ398289__SS-prME
  source 1..9876: mol_type = other RNA
acagctggtgttataataatgttgattccaacagcaatggcatttcatttaacaacaagaaatggggaaccccacatgatagttggtagacaggaaaaaggcaaatcattgttatttaaaacagaagatggagtgaacatgtgtacactgatggcaatagatttaggggaactgtgcgaggatacaataacatataaatgcccactgctaagacaaaacgagccagaagatatagactgctggtgtaactctacaagcacctgggttacctatggtacttgcactaccaccggagaacacagaagagaaaaacgaagcgtggcattagtaccgcatgtcggaatgggcctagaaacgagaacagaaacttggatgtcatccgaaggagcatggaaacatgttcaacgtatagaaacatggatactgcggcaccccggattcgctataatggcagctatacttgcttatacaataggtacaacacatttccaaagagcgttgatattcattttgcttacagcagtcgcaccgtcaatgacaatgcgttgtataggtatatccaacagggattttgttgaaggggtttccggaggatcctgggtggatatagtattagagcacggatcctgtgtcacaactatggccaaaaataaaccaacgttggattttgagctaataaaaactgaagcgaaacaaccagcaacgttaaggaaatattgtatagaggcaaaactaaccaacacaaccaccgaatcaagatgcccgacacaaggtgagccttcgctcaatgaagaacaagataaacgctttgtatgcaaacatagcatggtagacaggggatggggaaatggatgtggcttatttggcaaagggggtattgtaacatgtgcaatgtttacttgtaagaaaaacatggaaggcaaagtagttttaccagaaaatctagaatacacaatagttattactccgcactccggagaagaacatgcggtaggaaatgatactggtaaacatggcaaagagataaaaattacacctcagtctagtataactgaggcggaactaacgggatacggtacagtgaccatggagtgttctccacgtaccggcctcgattttaacgaaatggtactcttacaaatggaggacaaagcatggcttgtgcatcgacaatggtttttggacctaccactgccatggctaccgggagcagatacccagggatcaaattggattcaaaaagaaacgttagtgacttttaaaaacccacacgcaaagaaacaagatgtggtcgtattggggtcacaggaaggtgccatgcatacagctctaacaggtgctacagaaattcaaatgtcaagcggtaacttgctgttcacagggcacctaaaatgcagactaagaatggacaaattacaactaaaaggaatgtcgtattccatgtgcactggcaaatttaaaatagtaaaagaaatagcagagacacaacatggtactattgttataagagtgcaatatgaaggcgatggctcgccttgtaaaataccatttgaaataatggacctagagaaacggcatgtacttggtaggttaataacagttaacccaatagtaaccgagaaagattcacccgtaaacatagaagcggaacccccgttcggcgattcatatataattattggagtagaaccagggcaattaaaacttaattggtttaagaaaggaagttcgattgggcagatgttcgaaacaacaatgagaggggccaaaagaatggcaattctaggcgataccgcatgggactttgggtctttaggaggagtatttacatcgataggaaaagccttacatcaagtttttggggcaatttacggcgcagctttttctggtgtaagctggaccatgaaaatattaataggtgtcataataacatggatcggaatgaatagccgatctacgtcactctcagtgtccttggtcctagttggagtggtaacgctgtatctcggtgcgatggtacaggcggatagcggttgcgtggtatcgtggaaatctaaagagcttaaatgtggctctgggatttttattacagataatgtgcacacttggacagagcaatataaatttcaaccagagtcaccttcaaaactcgcgagtgcaatccaaaaagctcacgaggaggggatatgtggtatcagaagtgtaactagactagagaatttaatgtggaaacaaatcactcctgaacttaatcatattctaagcgaaaacgaagttaagctaacaataatgactggtgataccaaaggaatcatgcaggcaggaaagaggagtcttagaccgcaacctactgaactaaaatacagttggaaaacctggggaaaagcgaaaatgttatctacagagtctcacaatcaaacatttttaatagacggaccggagacagcggaatgtccaaatacaaatagagcttggaactcattggaggttgaagattatggatttggagtcttcacgaccaatatatggcttaaacttagagagaagcaagacgtattttgtgattcaaaacttatgagcgccgcaataaaagacaatagggctgtacatgcagacatggggtactggatagagtcagcactgaatgatacatggaagatggaaaaagcaagttttatagaggtaaaatcgtgccactggcctaaatcacacactctctggagcaatggtgtattagaatccgaaatgataatcccgaagaatttcgcaggaccggtgtctcagcataattataggcctggatatcacacccagacagcaggaccatggcacctggggaaattggagatggatttcgatttctgtgaaggaactactgttgtcgttacggaggattgtggaaatagaggcccgtctctgcgcacaaccacggcgagcgggaaactaattaccgaatggtgctgccgttcatgcacattaccacctcttaggtatcgcggcgaagacggatgttggtatggaatggaaatacgccctttaaaagaaaaggaggaaaatctagtcaattctctggttacagcaggtcatgggcaaattgataattttagccttggagtattggggatggctctatttctcgaggaaatgttaaggactcgtgtagggacaaaacacgccatactgcttattgctgtgagctttgtcacactaataacaggaaatatgtctttcagagatctaggtagagtaatggttatggtgggtgcaacaatgacggatgacattggaatgggcgtaacatatttagcgttgttagccgcttttaaagtacgtcctacctttgctgccggattgttactacgaaaattgacctcaaaggaactaatgatggctaccattggcatcgccttactcagccaatcgacgataccagaaacaatcctagagcttacagatgctctggccctggggatgatggttttaaagattgtaaggaatatggaaaaatatcaactagcagtaacaataatggctataagctgtgtaccgaacgcggtaattctacagaatgcttggaaggtaagttgcacaatactggccgccgtcagcgtatcacccttactacttactagcagtcaacagaaggcggattggattccattggccttaactattaaaggactaaacccaacggcgatttttcttacaaccctttcaagaacgtctaagaaacgaagttggccgctaaatgaagcaataatggcagttggaatggtatcgatactagcctctagtctcctcaaaaatgatataccaatgacagggcctctagtagccggtggcctgcttaccgtatgttatgtattgaccggaagaagtgctgatctagaattggagagagctgcggatgttaagtgggaagatcaggcagaaatctcaggatctagcccaatcctatctattactatttctgaagatgggtcgatgagcatcaaaaacgaagaggaggaacaaaccctgactatcttaataaggacaggattattggtcataagtggcgtcttccctgttagcataccaatcacggcagctgcttggtatctatgggaagtcaagaaacagcgagcgggcgtattatgggatgtcccctcaccaccccctgtaggtaaagccgaacttgaagatggtgcatataggatcaagcagagagggattttagggtactcacaaataggtgcaggagtctacaaagaagggacattccacacgatgtggcatgtcactagaggagcagttctaatgcatagaggaaaaagaatcgagccatcatgggcagacgtcaagaaagatttgatttcctacggaggtggctggaaactcgagggagaatggaaagaaggggaggaagtacaagtgttagcacttgaacctggtaaaaatcctcgcgccgttcagacaaaaccaggattatttaagaccaatacgggaactataggagcagtctctctagacttttcgccgggaacatccggatcacctatcgtagaccggaaaggaaaagtcgtcggactatatggaaatggagtagtaacgagatcaggagcgtacgttagcgcaattgcacaaaccgaaaagtcaatcgaggataacccagagattgaagatgacatcttcagaaagaaaagactgacaattatggacctccacccaggagctgggaaaacgaaaagatacttgccagcgatagtgagagaagcaataaaaagagggttacgcacactcatactagccccgacccgagtcgtcgcagctgaaatggaagaggcacttcgaggcctgccgataagatatcagacccctgctattagagccgaacacacgggaagagaaattgttgacttaatgtgtcatgcgactttcacgatgcggctattgagtcccgtaagagtacccaattacaatctaattataatggatgaggcacactttacagaccctgcatcaattgcagcccgtggctacatatcaacacgagtagaaatgggcgaggcagcagggatatttatgacagcaacacccccgggatcacgagatccctttccacaaagtaatgcgccaatcatggatgaagaacgggaaatacctgaacgatcttggaactccggtcacgagtgggtaacagacttcaaaggaaaaactgtttggtttgtaccatctattaaagcggggaatgatattgctgcatgtttaaggaaaaatggtaagaaagtaatacaactttctcgaaaaacattcgatagtgaatacgtaaaaactcgggccaacgattgggacttcgtcgtgacaactgatataagtgaaatgggggcaaattttaaagcagaaagagttattgatccaagaaggtgtatgaaacccgtaatactaactgacggcgaagagagagtaatcttggcaggccctatgccggttacacattccagtgcggcacaaagaaggggacgtataggaagaaatccgaagaacgagaatgaccagtatatatacatgggggaacctcttgagaacgacgaagattgcgcccactggaaagaagctaagatgctactggacaacattaacacaccagaaggaattattccgagccttttcgagccagaaagggagaaggtagacgctattgacggcgagtacagactgaggggcgaagctcgaaaaacttttgtagatttaatgcgtagaggcgacctaccagtatggttggcttatcgtgtagcagcagaaggaataaattacgcagatagaagatggtgtttcgatggaatcaaaaacaatcaaatccttgaagaaaatgttgaagttgaaatctggacaaaagaaggtgaacgtaaaaagctaaaacctcgatggttagacgctcgcatatactcggacccactcgccctaaaggaatttaaggaatttgcagccgggcgaaaatcactaacactaaacctgataacggaaatggggagattgccaacctttatgacccagaaagcccgtgatgcgttagacaatttggcagtattacatacagccgaagcaggcggcagggcttataatcatgctttatcggaactaccagaaacactagagactcttttgctcttaacactgttggcgacagtcacaggtggcatattcctcttccttatgtcagggaggggaatagggaaaatgactctaggcatgtgctgtataatcactgcgtcaatactactatggtacgcgcagatccaacctcattggatagcggcttcaattattttggaatttttcctaatcgtccttcttattcccgaacctgagaaacaacgaaccccacaagataatcaattgacgtacgtagttatcgccatcttaacggtagtagcagctacgatggctaatgagatggggttcctggaaaagacgaaaaaggacctaggtctaggaagtattactactcaagaaagcgaatcaaatattttagatattgacttacgtccagcttccgcgtggacattgtatgcagtagcaactacgtttgtgacaccaatgttaaggcacagcattgaaaattcttcagtgaatgtttcactgactgcaatagcaaaccaagcgacagtattaatgggtttgggaaaaggatggccattatctaaaatggacattggagtaccactcttagccattggatgctattcacaagtgaaccccataacgctgacagcagcattactattgttggtagcccattatgcaataatagggcccgggctccaagcgaaagcaacacgtgaagctcagaagagagctgctgccggtattatgaaaaacccaacggttgacggcattaccgtaatcgatttagaacctatcccttacgacccgaagtttgaaaagcaattagggcaagtaatgctgttaatattatgtgtaactcaagtactaatgatgagaacaacatgggccctatgtgaagccttaaccctggcaactggaccaatttcaactttatgggagggaaaccccgggcggttttggaacactacgatagcggtctctatggcgaacatttttaggggcagctacctagcgggagcaggacttctattcagtattatgaaaaacacgaccaatacgcgaagaggaaccggtaatattggagaaacactaggtgaaaaatggaagtctaggcttaacgctttgggaaaaagtgaatttcaaatatataagaaaagcggaatacaggaagtagacaggactttagctaaagagggaataaaacgaggcgaaactgatcatcatgcagtctcaagaggtagtgcaaaacttcgctggtttgttgaacgaaacatggtaacacccgaggggaaagtggttgacctgggttgcggtagaggaggatggtcctattactgtggcggacttaaaaatgttagagaagtaaaagggctaacgaaagggggtcctggacacgaagaacccatacctatgagcacgtatggatggaacctagtaaggcttcaatctggagttgatgtattctttactcctcctgagaaatgcgatacactactttgcgacatcggggaatcgagcccgaacccaacgattgaagcaggacgcacactccgcgtactaaatcttgtcgaaaattggttgaataacaacactcagttttgtattaaggtgctgaatccatatatgccaagcgtgatagagaaaatggagactctccagcgcaaatacggcggagccttagtccgcaacccattaagcagaaacagtacgcacgagatgtattgggtatccaatgccactggcaatatcgtttccagtgtcaatatgataagtcgcatgctaattaacagattcacgatgaaacacaagaaagcgacatacgaaccagatgtagatctagggtctggcacaagaaacataggcatagaaagtgaaataccgaatctagacattataggaaaaagaatagaaaagatcaaacaagaacacgaaaccagttggcattatgaccaagatcatccgtacaagacctgggcataccacggaagctatgaaacgaaacaaactggttcggcatctagtatggtcaatggcgttgttcgcttgcttacaaaaccgtgggatgtcgttccaatggtaacccaaatggcgatgacagatacaaccccctttggacagcagagagttttcaaggaaaaggtggacactcgcacccaagaaccaaaagagggtaccaagaaactaatgaagattactgcagaatggctttggaaagagcttgggaagaagaaaacacctagaatgtgtacaagggaagagttcacacgaaaagtgcgaagtaatgcggcgttaggagctatttttactgacgaaaacaaatggaaaagcgcgagggaagctgtagaagactctcgattttgggaactcatagatagagaacgcaatttacatcttgaagggaaatgtgaaacctgcgtgtacaatatgatggggaaaagagagaagaaattgggagagttcggtaaagcgaaagggagcagagcaatatggtatatgtggctgggtgctcgattcctagaatttgaagcgttaggatttttaaatgaagatcactggttttcgcgaagaaatagcttgagcggcgtagaaggcgaaggacttcatagactcggatatatacttagggacgtaagtaaaaaggaaggaggagcgatgtacgcagacgacacagctggttgggacacgcgaataaccctagaagatcttaaaaatgaagaaatggtaacaaatcatatgaagggtgaacacaagaaactcgcagaagcaatattcaaattaacttatcaaaacaaagtagtccgtgttcaacggccaaccccaagaggaactgtgatggacattataagtaggcgagatcaacgggggtctggacaagtagggacatatgggttaaatacgtttacaaatatggaagcacaattgataaggcaaatggaaggagagggaatattcaaatcaattcaacatcttacggtaaccgaagaaatcgcagtacaaaactggttggcaagggtcggaagagaacgtctaagtagaatggcgatatccggagatgactgcgttgttaaaccactcgatgataggttcgcctcggccttaacggctttaaatgacatgggcaaagttaggaaggatatacagcaatgggaaccgtctagaggatggaacgactggacacaggtgccattttgctctcatcatttccatgagctagtgatgaaagatggaagagtcttagttgttccttgcagaaatcaagacgaattaattggccgagcacgaatttcacaaggggcagggtggtctttgaaagaaaccgcttgcttagggaaatcatacgctcaaatgtggactcttatgtactttcatagaagagacctaagacttgcagcaaacgctatatgctcggcagtaccaagtcattgggtgcctacttcaagaactacgtggagcatccacgccaaacatgaatggatgacgacggaggatatgctagcagtatggaatagagtctggatacaagaaaatccgtggatggaagataaaacaccagtggaaagttgggaagaggttccttatctcggtaaaagagaagaccaatggtgtggatctttgattggacttacaagtagggcaacatgggccaaaaatatacaaaccgctataaatcaggttaggtcgttaatcggcaatgaagaatacactgattatatgccatcgatgaaaagatttcgccgcgaagaagaggaagccggggtactgtggtaa

SEQ ID NO: 22921 - RNA, 9876 nt, synthetic construct
  misc_feature 1..9876: note = derived and/or modified CDS sequence (opt6) from DENV-2__GQ398290__SS-prME
  source 1..9876: mol_type = other RNA
acagctggagtaattataatgttgataccaactgccatggcttttcacttaacaacacgaaatggagaaccacatatgatagtaggaagacaggaaaaagggaaaagtttattatttaaaactgaagatggtgtgaacatgtgtactcttatggcaatagatctcggagaactctgcgaagacacaattacatataaatgccccctattgagacaaaacgaacctgaagatatcgattgctggtgcaatagcacgtccacttgggttacttacggtacctgtacgacaactggagagcatagacgagagaaaagatcagtagccctagttccacatgtcggtatgggactagaaaccagaactgaaacctggatgagttcggaaggagcctggaaacatgtacagcggatagaaacctggattctccgccatccaggatttacaataatggctgcaatacttgcttacacaatcggcaccacccactttcaaagagcactaatatttatacttttaactgctgtagcacccagtatgaccatgcgatgcatcggaattagcaatagagattttgtcgaaggtgttagcggaggatcatgggttgatattgtattggaacacggttcttgcgtcacgacgatggccaaaaataaacctacactggatttcgaattgataaaaacagaagcaaaacaacctgctacgttaagaaaatattgtatagaagcgaaattaactaatactaccacagaaagtcggtgccccacccagggagaaccttcactgaacgaagaacaagataaaagatttgtatgtaaacatagcatggtagatagaggttggggtaacggatgtggtctatttgggaaaggcggtattgtgacgtgtgccatgtttacatgtaagaaaaacatggaaggtaaagtcgttcttccagaaaatttcgaatatacaatcgttattaccccacatagtggcgaggaacatgcagttggaaatgataccggaaaacatggaaaagaaattaaaattaccccacaatcatctataaccgaagccgagcttacaggatatggtacagtaacgatggaatgcagtcccagaactggactggattttaatgaaatggtcttattgcaaatggaagataaggcttggttagtccaccgacagtggtttttagacttaccattgccttggctcccaggtgcagatacacaaggaagtaattggatacaaaaagaaacattggttacattcaaaaatccacacgcaaagaaacaagacgtagtagtactaggcagtcaagaaggtgcaatgcatacggcattaactggcgcaactgaaatccaaatgagttcagggaatttactattcacaggtcatttaaaatgcagacttagaatggataaactacaactcaaaggcatgtcctatagcatgtgtacaggaaagttcaagatcgtgaaagaaatagccgaaacacagcacggcactatagttataagagttcaatatgaaggcgacggttcaccgtgcaagataccattcgaaatcatggacttggaaaaacgtcatgtattaggaagactaataacagttaatccaatagtgaccgaaaaagacagtcctgtaaatattgaagccgaaccacctttcggcgactcttacataataataggtgtagagccaggtcagcttaaacttaactggtttaaaaaggggtcctcaataggtcaaatgtttgaaacaacaatgagaggggcaaagagaatggcgatactaggtgatacagcgtgggattttggatcgctaggcggggtttttacaagcattggtaaagcgttacatcaggtgtttggagcaatttacggagctgcttttagcggtgtaagttggactatgaaaattcttataggtgttataataacttggataggtatgaactctagaagtacttcattatcggtatcacttgtcctagtcggcgtcgtaactctttatcttggagcgatggtccaagctgatagtggatgtgttgtaagctggaaaagtaaggaattaaaatgtggtagtgggatatttattacagataatgtccatacttggaccgaacaatacaaattccaaccggaaagcccaagtaaactcgcatccgctatacaaaaagcacacgaagaagggatttgtggcattcgtagcgtgactagattagaaaacctgatgtggaaacagataactcctgaactgaatcacatattatcggaaaatgaagttaaattaactattatgactggagacattaaaggaatcatgcaagcaggaaagaggagtcttaggcctcaacccacagaattaaagtattcctggaaaacatggggtaaagccaagatgttgtcaacagagtcacacaatcaaacctttcttattgatgggcccgaaactgcagagtgccctaataccaatagagcctggaactcccttgaagtagaagactacggtttcggagtcttcactactaacatatggttaaaactcagagaaaaacaagatgtattttgcgattcaaaattaatgtctgcagccatcaaagacaatagagctgtacacgcggacatgggatattggattgagtcagcactaaacgacacatggaaaatggaaaaagcgtctttcatcgaagtaaaaagttgccattggccaaaatcacacaccttgtggagcaacggagtcttggaaagcgaaatgataatacccaaaaattttgcgggcccggtcagccagcacaattacagacctggttatcatacgcaaaccgcaggaccatggcatttaggcaagttagagatggatttcgacctctgcgaaggaactacagttgtggtgactgaaaactgtgggaatcgtggccctagcttacgaaccacaacagcttcagggaaactgattactgagtggtgttgtcgttcatgcacgctacccccacttagatatcgcggtgaggacggatgttggtatggaatggaaataagaccgttaaaggaaaaggaggaaaatcttgttaactcactcgtgacagctgggcatggccaaatagacaacttttccctgggggtattgggcatggctctctttcttgaggaaatgcttagaaccagggtaggtactaagcacgcaatattacttgtagcagtttcctttgtaacactaattacagggaacatgagctttcgtgacctaggaagggtaatggtcatggtcggcgcaactatgacagatgacataggaatgggagtaacatacttagcacttctagccgcgtttaaagttcgaccgacatttgcggccggtttactactgagaaaactcaccagcaaagaattaatgatggctacaatcggtatagcattgctctcccaaagtactatcccagaaactatcttggaattgacggatgctctagctcttggaatgatggtattaaaaatcgtcaggaacatggaaaagtaccagttagcagtgacgatcatggcgatatcgtgcgtaccgaacgcggtcatactgcaaaatgcttggaaagttagctgcacaatcttagctgctgtcagtgtatcaccgctgttgttaacatcaagtcagcaaaaagcagattggataccattagcactaacgataaagggtctaaacccaacagccatttttctaacgactttatcgagaacttcaaagaaaaggagctggccacttaacgaagcaataatggctgtcggaatggttagcatactagcgtcttctttactaaagaatgatataccaatgacgggtccattagtagcgggaggactattaacagtatgttatgtccttaccggcagaagcgccgatcttgaattagagagggctgcagacgtgaaatgggaagatcaagccgaaatttccggaagttcacccatattatcgattacaatctctgaagatggtagtatgagcatcaaaaatgaagaagaagaacagactctgactattctgataagaacagggctgctagtgatatcaggtgtttttcccgttagcataccaataactgctgctgcgtggtacctatgggaagtgaagaaacaacgggcaggagttctatgggacgtaccaagtccacccccagttggcaaagctgaactcgaggacggagcatatagaattaaacaaagaggcattctcggatacagccaaataggagcgggagtgtataaggaaggaacctttcacacgatgtggcacgtaacacgtggagcagtattaatgcaccggggcaaaagaatagagccgtcatgggctgacgttaaaaaggatttaataagttatggaggtggatggaaattggaaggtgaatggaaagaaggggaagaagtacaagtcctggcgttggagcctggcaaaaatccgcgggcagtgcaaactaagccgggtcttttcaagacaaatacaggcacaattggagcagtctcgctagatttttctcctggcaccagtggttcccccatagtagatagaaaaggaaaagtcgtggggttgtacggtaatggggttgtaactagatcaggagcatatgttagcgcaatagcccaaaccgagaaaagtatagaagataatcccgaaatagaagatgacatctttaggaagaaacgtctaacaattatggatctccatcccggtgctggaaaaaccaaaagatatttgccggcgatagtgcgtgaagcaattaaacggggactccggacgttaattctggctccaactagagtggtcgccgcagaaatggaagaggctttgcgagggttaccgatacgatatcagactcctgcaataagggcagagcataccggccgagaaattgtcgatctaatgtgtcatgctactttcacaatgaggcttttaagccccgtgagagtaccaaattataatttgataattatggatgaagcccacttcactgatcctgccagtatagccgctaggggatacataagtacaagggttgaaatgggcgaggcggcggggatttttatgacagcgacgccccctgggagccgagacccatttccccaatctaatgcgcctattatggacgaggaaagagaaataccagaaaggtcctggaactcaggccatgagtgggtgactgactttaaaggcaagacagtgtggttcgttccctccataaaagcaggaaatgatatagcggcctgcctaaggaaaaatggcaagaaagtaatacagttatctcgaaagacatttgatagtgaatacgtaaagacaagagccaatgattgggattttgtagtaactacggacatatccgagatgggggctaactttaaggcagaacgtgtaatagatccaaggcgatgcatgaagcccgtgatactaacggacggggaagaaagagtaatcctcgcaggtccaatgccagtgacgcatagtagtgccgctcaaagaagaggtcgaataggtagaaatcctaaaaacgaaaacgatcaatatatctatatgggagaaccccttgaaaatgatgaagactgcgcacattggaaggaagctaagatgctacttgataatatcaataccccagaagggataataccttcaatgtttgagccagagagggaaaaagtagatgctattgacggtgaatatagattgagaggagaagctcgaaaaacattcgttgacctcatgagacggggagatctccctgtatggctagcatatagagtggccgccgaaggaataaattatgcggaccgaagatggtgttttgatggtattaaaaataatcaaatactagaagagaatgtggaagttgaaatatggacgaaagagggggaaaggaaaaagttaaaaccaaggtggctagatgcccgaatatatagcgacccccttgccctgaaagagttcaaggaatttgctgccggcaggaagagtctcacattaaacctaataaccgaaatgggtagactacccacctttatgactcagaaagcaagagacgccttagataacttagcagtcctacatacagctgaagcaggaggtagagcgtataatcacgcgttgtcagaattaccagaaaccttggaaacgctattactacttaccctgcttgcgacagtaactggtggaatttttctgtttctaatgagtggcaggggtattggcaaaatgaccttaggaatgtgctgcattataactgcaagtattttgctatggtatgcacaaattcaaccgcactggattgctgcttccataatccttgaatttttcctaatagtactattgataccagaaccagaaaaacaacgaacccctcaagacaaccaattaacatatgtagttatcgcgatacttacagttgtcgcggcaacaatggctaatgaaatgggattcttagaaaagacgaagaaagaccttggtctcggatctataaccacgcaagaatcagaatcaaacatattggacattgatcttcgcccagctagtgcatggacactttatgccgttgcgaccacatttgttacaccaatgctcagacattccatagaaaatagtagcgttaacgtctcactcacagcgatagcaaatcaagcaacagtacttatggggttgggcaaaggttggcccttaagcaaaatggacataggcgtacctctactagccataggatgttattcacaagtaaatccgataaccctaacagctgcattattactgttagtcgcccattatgcgatcataggtccggggctacaggcaaaagcaactagagaagcccagaaacgcgccgctgccgggataatgaagaatcctactgtagacggtattactgtaatagatttagaacccattccctacgatccaaaattcgaaaaacaactaggccaagtaatgctgcttatcctatgtgtcacccaagtattaatgatgaggaccacatgggcactatgtgaagcactaactcttgcaacaggcccaatatcgacgttatgggagggtaatcccggaagattctggaatacgactatcgcagtttcgatggccaacattttcagaggctcttacctagcaggggcgggtttactcttttctataatgaagaacacaaccaatactagaagaggaacaggtaacatcggggaaaccttaggagaaaagtggaaatctcgtctgaacacgttaggaaaatccgaatttcagatctataagaaatctggaatacaggaagtggatagaacattggcgaaagaggggataaaaagaggtgaaactgatcatcacgctgtttctagagggagcgcgaaactacgatggttcgtggagaggaatatggtcacacctgaaggcaaagtggtggaccttggctgcggaaggggagggtggtcatattactgtggtggtctgaaaaacgttagggaagttaagggacttacaaaagggggtcctggtcatgaagaacctatacctatgtccacatatggatggaatttggttagactccagtccggagtagatgttttcttcacaccacccgagaagtgtgatactctactttgtgatataggggaaagctccccaaatccaacaatcgaagctggccgcaccttacgagtattaaacctagtggaaaactggttaaacaacaatacgcaattctgcataaaagtgctaaacccatatatgccttcagtcattgagaaaatggaaaccctacagaggaaatacggaggtgcattagtccgaaaccccctttcgcgaaacagcacacatgaaatgtattgggtatccaatgcaacaggaaatatcgttagttcagttaacatgatttctagaatgcttattaatcgattcactatgaaacacaagaaagcaacttatgaacccgatgtagatttggggtcgggaacaagaaacataggtatcgaaagcgaaatccccaatctggacataatagggaaacgtatcgagaaaattaaacaagaacacgaaacaagctggcattacgatcaagaccatccctataaaacatgggcttatcatggctcttacgaaaccaagcaaacagggagcgcttctagcatggtcaacggagtagtgagattactcacaaagccctgggatgttgtacctatggtcacccaaatggctatgacagatactacaccttttggccaacaaagagtctttaaagaaaaagtcgacacgcgaacccaagaaccaaaagaaggtactaaaaagctaatgaaaataactgctgaatggctatggaaagaactaggcaagaagaaaactcccagaatgtgtactagagaggaatttacacgtaaagtccgctcaaatgcagccttaggagcaatttttacggatgagaacaaatggaaaagtgcaagagaagcagtggaagattctcgtttttgggagttaatagacagagagagaaacctccacctagaaggcaaatgtgaaacatgtgtatataacatgatgggaaaaagagaaaagaaacttggagagttcggtaaggcgaaaggatctagagcaatatggtatatgtggttaggtgctagattcctagagttcgaggccctaggattccttaatgaagaccattggttctctaggggcaactctctctcaggggtagagggagaaggactccatagactaggatacattttacgagacgtatctaagaaagaaggcggagctatgtacgctgatgacacggctggctgggacacacgaattacattagaggacttgaaaaacgaggaaatggtaactaaccacatgaagggggaacacaagaaactcgccgaagctatatttaagctcacctatcaaaataaagtagtaagagttcaacgacctacgcctagaggaacagttatggatataattagtaggagagaccagcgaggcagtggacaagttggaacatacggtcttaacacatttacaaacatggaagcacaactcatacgacaaatggaaggagaaggtatatttaaaagcatacagcacctaactgctaccgaagagattgctgtccaaaattggttggcaagagtaggaagagaaagactatctaggatggccataagcggagacgattgtgttgtgaaaccgttggatgacagatttgcttccgcactcacagcattaaacgacatggggaaagttagaaaagacatacaacaatgggagccgtcacgaggttggaatgattggacacaagtacccttttgctcacatcatttccatgagctagtaatgaaagatggtcgagtattagttgtgccatgtagaaaccaagatgaactcatcggacgggctagaatttcgcagggagctggatggtcactaaaagaaacagcttgcttaggaaaatcatatgcccaaatgtggacattaatgtacttccacagaagagatctacgtttagcagcaaatgcgatctgcagtgcggtaccatcgcactgggttcccacctcgagaacaacttggtctatacacgcaaaacacgagtggatgaccaccgaagacatgctcgctgtatggaatagagtctggattcaagaaaatccctggatggaggacaaaaccccagtggagtcctgggaagaggttccctaccttggaaagagagaagatcaatggtgcgggtcactaattgggttgactagccgcgcaacctgggcaaagaatattcagactgcaataaatcaagttcgatctcttataggaaatgaagaatacacagattacatgccatctatgaaaagatttcgtcgggaagaagaagaagctggtgtattatggtaa

SEQ ID NO: 22922 - RNA, 9876 nt, synthetic construct
  misc_feature 1..9876: note = derived and/or modified CDS sequence (opt6) from DENV-2__GQ398284__SS-prME
  source 1..9876: mol_type = other RNA
actgcaggagtaataattatgctgataccgacagcaatggcattccacctaaccactcgaaacggagaacctcatatgattgtaggtaaacaagagaaaggtaaatcccttttattcaaaaccgaagacggagttaacatgtgtaccttaatggcaatcgaccttggagaattatgtgaagatacaattacctacaaatgcccgctattgcgccaaaatgaacctgaagatatcgactgttggtgtaattcaaccagtacatgggtaacgtatggaacatgcactaccactggggaacatagaagagagaaaaggtcagttgcccttgttccacacgtagggatgggactcgaaactcgtacagaaacatggatgagttcggaaggtgcatggaaacacgtacaaagaattgaaacttggattctgagacatcctggatttactatcatggcagcaattttggcttatacaataggaacaacgcatttccaaagagctctaatatttattttattaacagcagttgccccttcaatgacaatgaggtgcattggtatcagtaatcgagacttcgtcgaaggagtatccggaggaagctgggtagacatcgtcctggaacatgggtcatgcgtcacaacgatggcgaaaaacaaacctacattagattttgaactgataaaaacagaagccaaacaaccagcgacgctacgcaaatattgtattgaagcgaaactaactaacacaacgacggaaagtaggtgtccaacgcaaggcgaaccttcacttaacgaagaacaagacaaaaggttcttatgtaaacatagtatggtagatcgagggtggggtaatggttgtggactgtttggaaaaggaggcatagttacctgtgccatgttcacatgcaagaaaaacatggaaggtaaagtcgtccagcctgaaaacctagaatacacaatagttattacaccccacagtggagaggagcatgccgtgggtaatgatacaggtaaacacggcaaagagataaaaataaccccgcaatcatcaataacagaagctgaacttactggctatggtacagtcacgatggagtgtagcccaaggactggattagatttcaatgaaatggtccttttgcaaatggaagacaaagcatggttggttcatagacaatggttcttagatttaccgcttccctggttacccggtgcagacactcaagggagcaattggatacaaaaagaaacccttgtgacatttaaaaacccacatgcaaagaaacaagacgtagtagcactagggtcacaagaaggagcaatgcatacagctctaactggagctacggaaatacaaatgtcctctggtaatttattatttaccggccatttaaaatgtagacttaggatggataaattacaattgaaaggcatgtcatattcaatgtgtacggggaaattcaaaattgttaaagaaattgcagaaacgcaacacggtacaattgtgatccgagttcagtatgaaggtgatggctcaccttgtaaaattccgtttgaaataatggacttagaaaaacgtcatgtacttggtagactaataactgtgaacccgatagtcaccgaaaaagatagcccggtcaatattgaagcagagccgccgttcggagatagctacattataataggtgtggagcctggccagttaaaactaaactggtttaagaaaggatcatcaataggccagatgttcgaaacaacaatgagaggggctaaaagaatggcaatactgggggatacagcctgggacttcggatcgttaggaggcgtgtttacaagtatagggaaggctttgcaccaagtattcggagccatatatcgagctgccttttcaggagtatcatggaccatgaaaatactaattggagtaataattacatggataggtatgaatagtcgaagcacgtcactatctgtatcattagtcctagttggagttgtgaccttgtacctgggggcgatggtgcaagcagactcgggatgcgtcgttagttggaaaaacaaagaattaaaatgtggctcaggaattttcataaccgataacgtgcacacctggactgaacagtataaatttcagccagaaagcccatcaaaactggcctcagcgatacaaaaagctcacgaagaaggaatatgtggcatacgttctgtaacgagactagaaaatctcatgtggaaacaaataaccccagagcttaaccatattttatccgaaaacgaggtaaaactaacaatcatgacaggtgacatcaaaggaattatgcaagccggcaaacgaagtctcaggccccaaccgaccgaacttaaatattcatggaagacttggggtaaagccaaaatgttgtcgaccgaaagtcataatcaaaccttcttgatagatggccctgagacagcagaatgccctaatacgaatcgagcatggaatagtctagaagtagaagattacggatttggtgtattcactacaaatatatggttaaaattaagggagaaacaagatgtattctgcgattccaaattaatgtctgctgcaattaaagataatagggctgttcacgctgacatggggtattggattgaaagcgctcttaacgatacctggaaaatggaaaaagcatctttcatcgaagtcaagagttgccactggcccaaaagccacacattatggagtaatggagtactagaaagtgaaatgataatacccaaaaatttcgcgggtccagtaagtcagcacaattataggccgggatatcatacacaaactgccggcccatggcatctaggaaaacttgaaatggatttcgatttttgcgaaggaactacagtagtcgtcactgaggactgtggtaatcggggaccttcgctaaggacaacaacagcaagcggaaaacttataacagaatggtgctgcagatcatgtaccctgcctcccctgagatatcgaggggaggacggttgctggtatggtatggaaataagacctttaaaagaaaaagaagaaaatctcgttaactctttggtaacggcaggacacgggcaaattgataatttttcattaggggttctcggaatggcactgtttttggaggagatgttaagaacaagggtcgggacaaaacacgcaatattattggtagcagtttcattcgttacgttaataacgggaaatatgagttttagagatctaggaagagtgatggtcatggtcggggcgacaatgacagatgacattggtatgggcgtcacatatctagcacttttagcagcatttaaagtacgacccacattcgcagccggcctattattacgaaaactcacatccaaagaacttatgatggctaccattggtattgcattattaagtcaatctaccataccagaaacaattttagaacttactgacgccctagcactcggaatgatggtacttaaaatagtcagaaatatggaaaaataccaacttgcagtaacaatcatggccatctcgtgcgtacctaacgcagtgattctccaaaatgcatggaaagtaagctgcactatattagctgcagtatcagtatcgccattgctattaacgagttcacagcaaaaggcagattggataccattggctctaacaataaaaggacttaacccaaccgccatatttttaacaaccttatcacgcaccagtaagaaaaggtcctggccgttgaacgaagcaataatggccgtggggatggtgagtatacttgctagcagcttgctaaagaacgatatacctatgactggtccacttgtcgccggtggtctccttactgtttgttacgtattgacaggtagaagtgcggacctagaactggaacgagctgccgatgttaagtgggaagatcaagcagaaattagcggttcgagtcctatcttaagcatcacaataagcgaagatggatcaatgtcaataaagaacgaagaagaagaacaaacgctgacaatcttaattagaacggggttgctcgttatttcaggcgtttttccagtcagtattccaataactgcggccgcctggtatttatgggaagtcaagaaacaaagagctggagtcctctgggatgtaccgagtccccctcctgttgggaaggctgaactagaagatggtgcctataggataaaacaacgaggtatcttaggctatagccaaataggtgctggtgtatacaaagaaggtacatttcatacaatgtggcatgttacgcgaggagctgttttaatgcacagaggcaaacgaatcgaaccatcttgggccgatgtcaagaaagatttaattagttatggagggggatggaagctagagggagaatggaaagaaggtgaagaagtccaagtacttgcgctggaacctggaaagaatcccagagctgtgcaaacgaaaccaggattgtttaagactaacacaggcacgattggggcagtttcgctagattttagtccaggtacctccggctcgccaatagtagataggaaaggaaaagtagttggactatatgggaacggagttgtaacccggagcggggcatatgttagtgcgatagcacaaacagaaaaatctatcgaagacaatccggagatagaagatgacatctttaggaagaaaagattgacaataatggacttgcatccgggggcaggtaaaacgaaaagatatctgccggcgattgtacgagaagccatcaaaaggggtttacgaacacttattctcgcacctacgagagtggttgctgccgaaatggaagaagccttgagagggctacccattaggtatcaaactccagcaataagggctgagcatactggaagagaaatcgtcgatctgatgtgccatgctacttttacaatgcgtctgctctcccccgttagagttccgaactataatctgataataatggatgaagcacactttactgaccccgcctccatagcagctagaggctacataagtactagagtagaaatgggcgaagctgcaggtatattcatgactgctacccctccaggctctagagatccttttccgcaaagcaatgccccaatcatggatgaagaaagagaaatacccgagcgttcatggaacagtgggcatgagtgggtgacagactttaaagggaagacagtgtggttcgtaccatcaattaaagctggcaacgatatagcagcctgcctcagaaagaatggcaagaaagtaattcaactatctagaaaaacttttgatagtgagtatgtaaagacaagggcaaatgattgggattttgtagtcaccacggatatctcagaaatgggtgcaaactttaaggctgaacgagtgatcgatccaagaagatgtatgaagccagttattttaaccgatggggaagaacgggtcatactagcagggcccatgcccgtaactcattccagtgcagctcaaaggagaggaagaattggacgaaacccgaaaaacgaaaatgatcaatatatatacatgggtgaaccattagagaatgatgaagactgcgctcattggaaagaggcaaaaatgttgctcgacaacataaacactccagaaggaataattccatcaatgtttgaaccagaaagagaaaaagtagatgccatagacggtgaatataggctcagaggagaagcgcgtaaaacatttgttgatctaatgagaagaggtgacttgcccgtctggctagcttatcgcgtggcagcagaagggatcaattacgcggacagaagatggtgttttgatggaatcaaaaacaaccaaatcctagaagaaaatgtcgaggtagaaatatggactaaagaaggtgagcgaaagaagctaaagccccgttggcttgatgcaagaatttatagtgacccactagcgctgaaagaatttaaagaatttgcagcaggtagaaagtccttaaccctgaatcttataactgaaatgggaaggttaccaacctttatgacgcagaaagcgagggatgcactggataatcttgctgttctacacacagcagaagcagggggaaaggcttacaatcacgcgcttagtgaactaccagaaacactggagactttgctactactgaccctccttgctactgtaacgggcggaatatttctttttctgatgtctggcaagggtataggtaaaatgaccctaggtatgtgctgtattataacggcctcgatattactatggtatgcccaaattcaaccccattggattgccgcttcgataattttggaatttttccttatagtattgctcattccagagccggaaaaacaacgtactccacaagataatcagctaacgtacgttgtcattgccattctcactgtcgtagctgctactatggccaatgaaatgggattcctggaaaagacaaagaaagacttaggcttagggtcaataataactcaagaaagtgaaagtaatatccttgatatagatctacgacctgcatcagcttggacactttatgcggtagccacaaccttcgttacaccaatgcttagacacagtattgagaactcaagcgtgaatgtgtcattgacagcaatagctaatcaagcgacagttctaatgggtcttggaaaaggctggcctctatccaaaatggatataggggtaccacttctggccatcgggtgctactcacaagtgaatcctataacactaactgccgcccttctgctattagtagcacactatgcaatcataggtccaggattacaagctaaagccactcgtgaagctcagaaaagagcagcagcaggtattatgaaaaaccctactgtagatggcattactgtgatagatctagaaccaataccctacgatcctaaattcgaaaaacagttaggccaggtgatgttgcttatattatgcgtaactcaagtcctaatgatgaggacgacttgggcgttatgtgaggcactcacattagcaacaggaccaataagtactttgtgggaagggaatcctggaagattttggaacacaaccatagctgttagcatggcaaatatattcagaggatcatatctcgcaggcgcaggacttctattttcaataatgaaaaatacgacaaatactaggaggggtacaggcaatataggtgagacgctgggtgaaaaatggaagtcaagactaaatgctttagggaagagtgagtttcaaatatataagaaatccggtatacaggaagtagatcggacattagcaaaagaaggaatcaaacgcggagaaacggaccatcatgcggtaagccgtggaagtgctaagttgcggtggttcgtagaaagaaacatggtcacacctgagggaaaagtagtagatttaggctgcggcagaggaggatggagttactactgcggaggccttaaaaatgtacgtgaggtcaaaggcttaacaaaaggagggcctggccatgaggaacctatccccatgagcacctacggctggaatcttgttcgattacaatcgggtgttgacgtattctttacacctcccgagaagtgcgatacccttctatgcgatataggcgaatccagtcccaatcccacaatagaagctggtcggacgctgcgtgttctcaacttagtagagaattggttaaataacaatactcagttttgcatcaaagtactcaacccttatatgcctagtgtgatcgagaagatggaaacattacaacgcaaatacggaggggccctagttcgtaacccactatctaggaatagtacgcatgaaatgtactgggtatccaacgccacagggaatatagtaagtagcgtaaatatgataagcagaatgctaataaatcgttttacaatgaaacacaaaaaggccacatatgaacctgatgtcgatttagggtcagggacgaggaatataggcatcgaaagtgaaatacctaatttagacataataggaaagcgcatagagaaaataaagcaggaacatgaaacttcgtggcactatgatcaagatcacccatacaaaacttgggcataccacggaagctacgaaactaaacaaactggatccgcttcctccatggtcaatggtgtggtccggttactaacaaaaccttgggatgttgtacccatggtaactcaaatggcaatgacagataccacgccttttggtcaacaacgtgtgtttaaggaaaaagtagacacacggacacaggaacctaaagaaggtacgaagaaactcatgaagatcacggcagagtggctgtggaaagaactgggcaagaagaaaactccaagaatgtgcaccagggaagaatttaccagaaaagttaggagcaatgctgctttaggagcgattttcacagatgagaataaatggaagtcggctcgagaagctgtagaggattcccggttttgggagcttgtagacagggaacgcaatctccacctagaaggtaaatgcgaaacatgtgtatataatatgatgggaaaacgcgagaagaaattaggggaatttggtaaagcaaaaggttcacgtgcgatatggtacatgtggctaggagcgcgctttctagaatttgaagcgctcggcttcctaaacgaagatcattggttctcgaggggaaattcactatccggcgtagaaggtgaagggcttcatagactaggttacatactgcgagacgtctctaagaaagaaggaggtgcaatgtatgctgacgatacagcgggttgggatacgagaattactttagaagaccttaaaaacgaagaaatggttacaaatcatatgaaaggggaacacaagaaattagcagaggcgatttttaaattaacctatcaaaataaagtagtgagggttcaaagacctacccccagaggaacggtaatggatataatctcacgaagagaccaaagaggaagtgggcaagtgggaacgtatggtcttaatacattcacaaatatggaagctcagttgataagacaaatggaaggagagggaatttttaaatcgatacaacatctcactgttacggaggaaatcgcagtacaaaactggctggcccgagtaggacgtgaacggttaagtcgaatggccatatccggtgatgattgtgtagtaaagcctcttgacgatcgttttgcgagcgctctaacggcccttaatgatatgggtaaagtgagaaaggatattcaacaatgggagccatccagaggatggaatgattggacccaagttcctttttgttcgcaccattttcacgaattagtgatgaaggatggaagggtattagtggtgccctgtagaaaccaagatgaactaatcggcagagcacgaatatctcagggtgcaggatggtctctgaaagaaacagcctgtttaggaaaatcatatgcgcagatgtggacactaatgtatttccatcgaagagatttaaggcttgcggctaacgcaatatgtagcgcggtacccagtcattgggtaccaacaagtaggactacatggtcaattcatgctaaccacgagtggatgacaacagaggacatgttagcagtctggaatagagtatggatccaagaaaacccttggatggaggacaaaactcctgtggagtcatgggaagaagtgccatatcttggaaaaagagaagaccaatggtgcggtagtcttattggtctaacatcaagagctacatgggcgaaaaatatacagaccgcgataaaccaagtacgtagcttaataggaaatgaagaatacaccgattacatgccaagtatgaagagatttaggagagaagaagaggaagccggtgttctatggtag

SEQ ID NO: 22923 - RNA, 9876 nt, synthetic construct
  misc_feature 1..9876: note = derived and/or modified CDS sequence (opt6) from DENV-2__GQ398308__SS-prME
  source 1..9876: mol_type = other RNA
accgctggagtaataattatgcttataccgaccgccatggccttccacctcacaacacgtaacggggaaccccatatgatagtcggccgacaagaaaaaggtaaatcgctattattcaaaacagaagatggtgtaaacatgtgtactttaatggctatagatctcggggaactttgcgaagatactataacatataaatgccccctactgcgtcaaaacgaaccagaagatatagactgttggtgcaatagtacttcgacctgggtcacatacggaacgtgtacaactactggcgaacaccgaagagagaaacgatcggtagctcttgttccgcacgtcggaatgggcttagaaaccaggacagaaacctggatgagttcagaaggtgcctggaaacatgtacaacgtatagaaacttggatactacgacaccctgggttcacgataatggcggctatattagcatatacaattgggacaacacattttcaacgggccttgatctttatactactaacagctgtggcaccttctatgacaatgaggtgtattggtatttctaaccgagattttgtagaaggagtcagtggcggttcatgggtggatatagtacttgagcacggaagttgtgtaacaacgatggcgaaaaacaaacctacgttagattttgaactaataaaaacagaagcaaaacaacccgcgaccttaaggaaatattgcatcgaagcgaaactgacaaatacgacaacggaatcaaggtgtccaactcaaggtgagccttcattaaatgaagaacaagacaaaagatttgtctgtaaacattctatggtggataggggctgggggaatggatgtgggctattcggaaaaggaggaatcgtcacctgtgcaatgtttacgtgtaagaaaaacatggagggtaaagttgtactacccgaaaatttggaatacacgatcgttataactccgcactcaggcgaagaacacgcagtaggcaatgatacgggtaaacatggaaaagaaatcaaaataactccacaatcgagcatcacagaagcagaattaacgggatacgggactgtaactatggaatgtagtcccagaacgggacttgattttaatgaaatggttttacttcagatggaagacaaagcgtggttagtacatagacaatggtttctagacttaccgctgccatggcttccgggtgctgatactcaaggatcaaattggattcaaaaggaaacactcgtaacattcaaaaacccacacgcgaagaaacaagatgtcgtagtacttggaagtcaagaaggtgcaatgcatactgcactaacaggggctacagaaatccaaatgtcaagtggaaatttactgtttactggacatctaaagtgtagattacggatggataagttgcaattaaagggaatgtcctatagtatgtgtacaggaaaattcaaaatcgtaaaggaaatcgctgaaacacaacacggtacaattgttataagggtacaatacgagggtgacggatctccatgcaagataccatttgagataatggaccttgaaaaacgacatgtattaggtcgacttattacagtgaatccaatagtagcagaaaaggactcaccagtcaatatagaggccgagccaccatttggagattcttacataattattggcgtagagcctgggcagttgaaacttaattggttcaagaaagggagctctattggacaaatgttcgaaactaccatgcgaggcgcgaaaagaatggcaattctaggtgatacggcttgggactttggttcattaggtggcgtcttcaccagcataggaaaagctctacatcaagttttcggtgcaatctatggggcagccttctcaggagttagctggaccatgaaaattctaatcggagttatcataacttggataggtatgaatagtcgtagtaccagcttatcggttagcttagtattggtaggtgtagtcaccttatatttgggtgccatggttcaagctgattcgggctgtgtagtcagctggaaaagtaaagaattgaaatgtggctctggtatatttatcaccgataatgtacatacttggacggaacagtacaaatttcaaccagaaagtccttccaagttagcatcggcaatacaaaaggcgcacgaagagggaatatgtggtatcagatcagttacgcgactagaaaacttaatgtggaaacaaataacaccagaattaaatcacatcctcagtgaaaatgaagtgaaattaactataatgacaggagatataaaaggtatcatgcaagctggaaaaaggagcttaagaccccagccaacagaactcaagtatagctggaaaacatggggtaaggctaagatgcttagtacggagagccacaatcaaacattccttatagatgggccagagacggccgaatgtccaaacaccaatagagcctggaactctctagaagttgaagattatggattcggagtattcagtacgaatatatggctcaaattacgcgaaaaacaagatgtgttttgcgatagtaaattaatgtccgcggcaattaaggacaatcgtgcagtacatgcagatatggggtattggatcgagagtgctttaaacgatacatggaaaatggagaaagcctcattcatcgaagtaaaaagctgtcattggccaaaatcccatacattatggtctaacggagtgcttgaaagcgaaatgataatccccaagaattttgcgggcccggtctcacaacataattatcgaccaggatatcacacacaaacagcaggaccctggcacctaggaaaacttgaaatggattttgatttctgtgaagggaccaccgtagtcgtaaccgaagactgcggcaacagaggaccctcattgcgaaccacaacagcttcagggaaactaataacagaatggtgttgtagaagttgtaccttgccacctctacgatacagaggcgaagatggatgctggtatgggatggaaatacgaccccttaaagaaaaagaagaaaatttagtaaatagcttagtcacagctgggcatggtcaaattgacaacttcagcttaggtgttctaggaatggcgttatttttagaagaaatgttacgaacgagagttggtactaaacacgcaatgttattagtagcagtatcattcgtaactttaataactggtaacatgtcattccgagacttaggtagagttatggtaatggtcggagccactatgaccgatgacatagggatgggaataacatacctagcattgctagctgccttcaaagtacgacctacattcgcagcagggctcttactcagaaaactaacatcaaaagaattgatgatggcaaccatcggaatcgccctactaagtcaatcaacaataccagaaacgattttagagcttactgacgccttagcattaggtatgatggtgttaaaaatagtgagaaatatggaaaagtatcaactcgcagtcaccataatggctatttcttgtgtaccaaatgccgtaatactacagaatgcttggaaagtatcttgtactatcctagctgctgtatcagtgtctcctctgttattaacctcatcacaacagaaggccgactggataccactagcactgacgataaaagggctaaatccgactgcaatctttcttacaactctgtcccggacgagtaagaaaaggagttggcctctgaatgaagctataatggcagtcggtatggtatcaatacttgcatccagtttgctcaaaaatgacataccgatgaccgggcctttggtagcaggagggttattaacagtatgttacgtactcaccgggcgaagtgcagacttggaacttgaaagggcagccgatgtaaaatgggaagatcaagcagaaatttcaggcagctcgccgatattaagcattacaatcagtgaagacggttctatgtcaataaagaacgaagaagaggaacaaacattgacaatcttaattagaaccggactattggttatatccggggtctttccagtttcgataccaatcacggcggcagcgtggtatctgtgggaggttaaaaagcaacgtgcaggagtactctgggatgttccgagtccacctcctgtgggaaaagccgagctggaggatggagcgtatagaatcaaacaaaggggaatactaggctactcgcaaataggcgcgggagtatacaaagaaggtacatttcatacaatgtggcacgtaacaagaggagcagtacttatgcatagagggaaaagaattgaaccgtcttgggctgatgtgaagaaagatttaatttcatacggcggaggctggaaactcgaaggggagtggaaggaaggcgaagaagttcaagttttagccctagaacccggtaaaaatcccagagcagttcaaactaaaccaggccttttcaaaacaaataccggaaccataggcgcagtgtcactagatttctctccggggacatcagggagtccaatagtagatagaaaaggtaaggttgtaggtctatatgggaatggcgtagtaacccgttctggagcgtatgtgtcagcgatagctcaaaccgaaaaatctatcgaagataaccctgaaatagaagacgatattttccgtaagaagcggttaactataatggatctacatccaggcgcgggaaagacaaagcgctatctaccagcaatagtgagggaagctattaagagagggctaagaacgttaatactagcccctacaagagtagtagctgcagaaatggaagaagctctaagaggattgcctatccgataccaaactccagcaatccgggctgagcatacaggtagagaaatagtagatctaatgtgccatgcaacatttactatgagacttctgtcgccagtcagagtacccaattataatttgatcattatggatgaagcccatttcactgatccagcgagcattgccgcgcgtgggtatatttctacacgtgtagagatgggcgaagctgccggaatatttatgacagctacaccaccaggatctcgcgatccgtttccacagtcaaatgcgcctattatggacgaagaaagagaaattcctgagcgtagttggaactcgggacacgaatgggttactgactttaaaggaaagacagtatggtttgtacctagcatcaaggcagggaatgacattgctgcatgtctccgtaaaaatgggaaaaaggtaatacaactatctagaaaaaccttcgactccgaatatgttaagactcgcgccaacgactgggacttcgtcgtaacaaccgatatatctgagatgggggcaaacttcaaagcggaaagagtaatagacccaagacgctgtatgaaacctgtaatacttaccgacggagaggaaagagtcatactggcgggaccgatgccagtaactcattcttctgcagcacaaagaagaggtagaataggtcgaaatcccaaaaacgagaatgatcaatacatctacatgggagaacctctagagaacgatgaggactgcgcacattggaaagaagcaaagatgctcttagataatataaatacccctgaaggaatcattcctagcatgtttgaaccagagcgcgagaaggttgatgctattgatggagaatataggttgagaggtgaagctaggaaaactttcgtggaccttatgcgacgtggcgatctccccgtatggttagcttaccgcgtggccgcggaaggaataaattacgcggacagacgatggtgctttgacggaatcaaaaataatcaaatattggaagaaaatgtagaagtagaaatatggacaaaagaaggcgaaagaaagaaactcaaaccgagatggttggatgctaggatatatagcgatccacttgcactaaaagaatttaaagaatttgcagccggccgaaagtctttaacactcaatcttatcacagaaatgggacgcttaccaacgttcatgacacaaaaagcgcgtgacgctttagacaatctcgccgtactacatactgcagaggctggcgggcgagcatataaccacgcactgtcagagcttccggagactttggagacactactattattaacattattagcaaccgtaaccggaggaatatttctgttcttaatgagcggcaaaggaattggtaagatgaccttaggaatgtgttgcataatcacggcatcaatcctattatggtacgctcagatacaaccacactggatcgcggcaagcataatcctagagttctttttaatagttttactaataccagaacccgaaaagcaacgtactccgcaagataatcagctaacttatgtagtcatcgctatccttacggtagtagcagcaaccatggctaatgaaatgggctttctggagaaaactaagaaagatctgggtttaggatcaattgcaacacaggagagcgaatctaatatccttgatatagatttacgcccagcatcagcatggaccctatacgcagtagctaccacctttgtcacacccatgttgaggcacagcatagaaaattcatctgtaaatgtatcgctaaccgctatagcaaatcaagcaacagtacttatgggactaggaaaaggatggccactttctaaaatggacattggagtaccattactggccataggctgttacagccaagtaaatcctataacattgactgcagcactcttattactcgtagcacactacgcaattattggacctggtcttcaggcaaaggcaacacgcgaagctcagaaacgtgcagcggctggcataatgaaaaatcctacggtagacggcatcacggtgatagatttagaacctattccatatgatcccaaattcgaaaagcaactaggacaagttatgctcctcattttatgtgttacacaggtattaatgatgcgcacaacttgggctttatgtgaagcgttgacattggcaactggtccaatatccacgttgtgggagggaaacccagggagattttggaatacaacgattgcagtcagcatggctaacatctttagaggctcatatttggccggtgcgggtttgctattttccattatgaagaatactacaaatacacgaaggggaacagggaatataggtgagacgctcggagaaaagtggaaaagtcgacttaacgcgctcggtaaatcagagttccagatttataagaaatcgggaatccaagaagtagatagaacactagctaaagagggtatcaagagaggcgagaccgaccatcatgcagtcagccgcggctcggcaaaattaagatggttcgtagaaagaaatatggtaaccccggaaggtaaagtcgtagatttgggatgcggtcgagggggatggtcgtactattgtggaggcctgaaaaacgtgcgagaagttaaaggtctaacaaaagggggaccaggccacgaggaacctatacccatgtcaacatacggatggaatctcgttaggttacagtcaggtgtcgatgtattctttaccccaccagaaaaatgtgacacactcttatgcgatattggagaaagttcgcctaaccctacaatagaggcaggacgcactttgagagtattgaatctagtggaaaactggttgaacaatgacactcagttttgtataaaggttttaaatccgtatatgccttctgtaattgagaaaatggagacactccagagaaaatatggcggagctattgtacgtaatccgctttcgagaaactcaacccatgaaatgtattgggtgagtaacgcaactggaaatattgtaagcagcgtaaacatgatttctcgaatgttaattaataggtttacaatgaaacacaaaaaggctacctacgaaccggacgtggatttgggcagcggaacacgaaatattggtatagaatcagagattcctaatctagatataattggtaagcgaattgaaaagattaagcaggagcatgaaacaagttggcactatgaccaagatcatccatataaaacctgggcgtatcatggctcatacgaaacaaagcagaccggctctgcttcatccatggtgaatggcgtagttaggttattgaccaaaccatgggatgtagtccccatggttacacagatggcgatgacagatacaacgcctttcggtcagcaacgagtgtttaaagaaaaagtagacacccgcactcaagaacctaaagaaggaacgaagaaactcatgaaaataaccgcagagtggctatggaaagagctgggcaaaaagaaaactccacggatgtgtacaagagaagagttcacacgtaaagtaagatcgaatgcagcgttaggagcaatatttaccgacgaaaataaatggaaaagtgctagagaagcagtcgaggactcccgattttgggaactaatcgatagggaaaggaatttgcacctagaaggtaaatgtgaaacatgcgtatataatatgatgggtaaaagagagaagaaactaggagaatttggtaaagcaaaagggagccgtgctatatggtatatgtggctaggcgctagattcttagagtttgaagcactgggtttcctgaatgaagaccattggttctcccgcggcaattccctttctggagtagaaggcgaaggactacataggctcggttacatactacgagatgtaagcaagaaggaaggaggagcaatgtacgctgatgatactgcgggatgggatacaaggattactctcgaagacctcaaaaatgaggaaatggtcactaaccatatgaagggagaacacaagaaactcgcggaggcgatattcaaattaacctatcaaaataaagtcgtcagggttcaacgaccaactccaagaggaacagtcatggatattatatcgcgaagagaccagcgcggatcaggccaagtaggtacatatggcttaaatacctttaccaatatggaagcacaattaattaggcaaatggaaggtgaaggaatattcaagagcatacagcatttgaccgtgacggaagaaatcgcagttcagaactggcttgccagagtcggaagagaaagactatctaggatggctataagtggagatgactgcgtcgttaaaccactagacgatagatttgcttctgcattaaccgctctaaacgatatgggtaaagtaaggaaagatatacaacaatgggaaccttcaagaggctggaacgattggactcaggtacctttctgttcccaccattttcatgaattagttatgaaagacggcagagttttagttgtaccttgtcgtaaccaagacgaattaatcggcagagcaagaatatcgcaaggagctggctggagcctaaaagaaacagcctgtctaggaaagtcttatgcacaaatgtggacattgatgtactttcacaggagagatcttagattagcagccaacgcaatctgcagtgccgtcccttcgcactgggtaccaacaagtcgtactacgtggtcaatacatgccaagcatgaatggatgacaacagaagacatgctcaccgtctggaatagagtttggatacaagagaacccttggatggaggataaaacgcccgttgagtcatgggaggaggttccatatctaggtaagcgagaagaccagtggtgcggatcattaataggtcttaccagtcgcgcaacatgggccaaaaacatccaaacagctataaatcaagttcgtagtttaattggtaacgaagaatacactgattatatgccgagtatgaaacgtttcagaagagaagaggaggaagctggcgtattatggtag

SEQ ID NO: 22924 - RNA, 9876 nt, synthetic construct
  misc_feature 1..9876: note = derived and/or modified CDS sequence (opt6) from DENV-2__GQ398287__SS-prME
  source 1..9876: mol_type = other RNA
acagcaggtgtaataatcatgttaataccaactgcaatggcttttcacctaacaacgcgcaatggagagccgcatatgatagttggacgtcaagagaagggaaaaagtctgttgttcaaaacggaggacggagttaacatgtgtaccttgatggctatagacctgggggaactttgtgaagacaccatcacatataaatgccccttgctaagacaaaacgaaccggaagatatagattgctggtgcaactctacatctacttgggtgacatacgggacatgtacaacgacaggagaacatcgaagagaaaaacgatcggtggccctagtgccacatgttggtatgggcttagagacgcgaaccgaaacttggatgtcaagtgaaggggcctggaaacacgttcaaagaatagagacatggatattaaggcatccaggttttgcaataatggcggctattctagcatatactataggtactacacacttccaacgagcccttatattcatacttttaaccgcagtcgccccatcaatgacgatgcgttgtatcgggattagcaatcgtgactttgtagagggtgtatctggtggttcctgggtagacatcgtgcttgaacacggctcatgcgtaacaaccatggcaaagaacaaaccaacgctggacttcgaattaattaagacggaagctaaacagccggcaactctgaggaaatattgcattgaggctaagctcacaaataccacgacagagagtagatgtcctacccaaggtgaacccagcctcaacgaagaacaagacaaaagattcgtctgtaaacatagtatggtggatcgtggatggggcaatggatgtggattattcggaaaaggaggcattgttacttgcgcgatgtttacttgcaaaaaaaacatggagggtaaagtagtactcccagaaaaccttgagtatacgatagttataacaccccactcaggcgaagaacacgcggttggaaatgacactgggaaacatggaaaagaaataaaaatcacacctcaatcgtccattactgaggctgaactaactggatatggtactgtgacgatggaatgctcaccaagaacaggattggattttaatgaaatggtcctactacaaatggaagacaaagcatggttagtacatcgtcagtggtttttggacctaccgttaccatggttaccgggagctgatacccaaggaagcaattggatacagaaagaaacacttgtgacatttaaaaatccccatgcgaaaaaacaagatgtagtagtactcggcagtcaagaaggtgcaatgcatacagctttaactggggcgacagagattcaaatgagttccggtaatctattgttcacaggacatctaaagtgccgacttcgtatggataaacttcagttaaaaggaatgtcttattccatgtgtactggaaaatttaaaatagtcaaggaaattgcggaaacacaacatggaactattgtgataagagttcaatacgagggagatggatctccatgtaagatcccctttgaaataatggatctggaaaaaagacatgttttagggcgcttgatcacagtaaatcccatagtcacggaaaaagattcacctgttaatattgaggcagaaccccccttcggggattcatatataatcataggagtagaaccagggcaattaaaactgaattggttcaaaaaaggtagtagcatcgggcaaatgtttgaaacgacgatgagaggagcgaagcggatggcaattcttggggatacagcatgggactttggaagtttaggaggagtatttacctcaatcggtaaagctctccaccaggtatttggcgcgatatatggtgcagccttttctggagtgagttggacaatgaagattttaattggcgtaataatcacgtggataggaatgaacagccggtcaacaagcctatcagttagcttagtattagttggagtagtaacattatatcttggtgctatggtccaggccgatagtggatgtgtggtgagttggaaaagcaaagagttaaaatgcggctcaggaatattcataacagataacgttcacacttggactgaacaatataaatttcagcccgaatctccttcgaaattagcgtcggcaatccagaaagctcatgaggagggaatatgcggcatacgcagtgtaacaagactggaaaatttaatgtggaaacagataactcccgagctaaatcacatactgagtgaaaatgaagttaaactcacgatcatgactggagatatcaaaggcatcatgcaagcagggaaaagaagcttacgaccacaaccgacagaactgaaatactcttggaaaacatgggggaaagcaaaaatgttatctaccgaaagccacaaccagacatttttaattgatggccctgaaacggcagagtgtccaaatactaacagagcatggaactctctcgaagttgaagattatggttttggtgtctttaccacgaacatatggttaaaattacgcgagaaacaggatgtattctgcgatagtaagctaatgagtgccgcgattaaagataacagggcagtccacgctgatatgggctactggattgagagcgcattgaatgacacgtggaagatggaaaaggcatcctttattgaggttaaatcatgccactggccaaaatctcataccttatggtcaaacggggttctggaaagtgaaatgatcattccaaaaaacctcgctgggcccgtctcacagcacaattatagaccaggttaccatacacagaccgccggtccatggcatttaggtaagttggaaatggactttgatttctgtgaggggacgactgttgtcgttaccgaggattgtggcaatagaggaccatctcttagaacaaccacagcaagcggaaaattaatcacagaatggtgttgtcggtcttgtaccctccctccactccgatacaggggagaagatggctgctggtatgggatggagatacgacccttaaaagaaaaagaggaaaatctagtcaacagtctggttactgcgggacacggccaaattgacaacttctccttaggcgtacttggaatggcactatttcttgaagagatgttacgcacgagagttggtacaaaacacgcaattctactcatcgcagttagtttcgtaacactaataacagggaacatgtccttcagagacttaggccgagtgatggttatggtaggcgctactatgaccgatgatattggcatgggcgtgacttacttggccctactggctgcatttaaggtaagacctacattcgccgctggacttttactccgaaaattaacaagtaaagaacttatgatggccacgataggtatagcactcctttcccaatcgacaatacctgaaactatattggaattaaccgatgctttagccttaggcatgatggtcctgaaaatagttagaaatatggaaaaatatcaactagcagtcacgattatggccatatcttgcgtacccaatgcagttatcttacaaaatgcttggaaagtttcatgcaccatattggcagctgtctcggtatcaccacttttattaacatcatcacagcaaaaagccgactggattccgttagcactcacaataaaaggattaaacccaaccgcaatctttttaaccactttgagcagaacttctaaaaaaagatcgtggccactcaacgaggctataatggctgtcggtatggtatccattctcgcaagtagtctactcaagaatgatatcccaatgactggacctttggtcgctggaggcctgctgaccgtatgttatgtgttgaccgggcgctccgcagatttagagttggaaagagcggccgacgtaaaatgggaggatcaagccgagatttcaggaagttctccgatactcagcattacgatatccgaagatggcagtatgagtattaaaaatgaagaggaggaacaaactctaacaatattaatccgaacaggattactagtaatctcaggagtattcccagttagtattcctattactgccgcggcgtggtatctttgggaagttaaaaaacaaagggcaggagtattatgggacgtaccatcaccgcctccagtcgagaaagctgagctagaggatggagcttataggatcaaacagagaggcatactcggatattcacagataggtgcgggagtgtataaggaaggcaccttccacactatgtggcatgtaaccagaggggccgttttaatgcacagagggaaacggatagagcctagctgggcagacgttaagaaagatttaatatcatatggaggtggttggaaactcgaaggtgaatggaaagaaggtgaagaagtgcaagtgttagctttagaaccaggaaaaaacccgcgtgcagtacaaacaaaacccggattattcaagactaacacaggaaccattggagcagtgtcgttagattttagtccaggtacctcgggttcccctatagtagatcgcaaaggcaaagtagttggattatatggtaacggtgtagttacgcgttcgggagcatacgtgagcgccattgcacaaaccgaaaagagtattgaagataatccggagatcgaagatgacatttttcgaaagaagcgtttaactattatggatctacacccaggagctggaaagacaaaaaggtacctacccgcaatagttcgtgaagctataaaaagaggactaagaaccttgattttagcaccgacccgcgtagttgcagccgaaatggaagaagctttacgaggattgcccattagatatcaaactccagcaataagagctgagcatacgggacgggaaatcgtagacctaatgtgtcacgcaacgttcactatgagattacttagccctgtacgggtacccaattataatttaattataatggacgaagcacactttaccgaccccgctagtatagctgcgaggggatacatctccacacgagtagaaatgggcgaggccgcaggaatcttcatgacggcaacccccccaggttcacgagaccctttcccacagagtaacgccccaataatggacgaagaaagagaaattccggagagaagttggaacagtggacatgagtgggttactgattttaaaggaaaaacagtatggtttgtgcctagcattaaagctggaaacgatattgccgcatgtttaagaaaaaacggtaagaaagttatacaattatctaggaaaactttcgatagtgaatatgtaaaaacgcgagcgaatgattgggacttcgtagtaacaacagatatctcagaaatgggagccaattttaaagccgaaagggtgatagaccctcgcaggtgtatgaaaccagtaatcctaacagatggagaggaacgcgtcatcttagcaggaccgatgccagtaacccattcgagcgcagcacaacggcgaggaaggataggaagaaatccgaaaaacgaaaatgatcaatacatatacatgggtgagcctctcgaaaacgacgaagactgcgcacactggaaggaagctaagatgcttttagataacataaacactcctgaaggaataataccctctttattcgaacccgaaagagaaaaagtagatgccattgatggtgaatacagattgcgaggggaagctaggaagactttcgttgatttaatgagaaggggcgatttaccagtatggctagcttaccgagtagcagcagaaggcataaattacgctgacaggagatggtgtttcgacggtatcaaaaataaccaaatactcgaagaaaacgtagaagttgaaatctggacaaaagaaggagaaaggaaaaaattaaaacctagatggctggatgcgagaatatattccgatccacttgcgttaaaagagtttaaagaatttgccgctgggaggaaaagtctcacattaaatctaatcactgaaatgggacgactccctacatttatgacacaaaaagcccgggatgcgctagacaatctagcagtcttacatactgcagaagccgggggacgcgcgtataatcatgcgctatctgaacttcccgaaactttagagacattattactcttaactttgcttgcaacagtcaccgggggtatattcttgttcctaatgtcaggtcgaggcattggtaaaatgacattaggtatgtgctgtataataacggcgtctattctactatggtatgcccaaattcaaccacactggattgctgcttcgataatactagaatttttcttaatagtgttattaatacctgagccagaaaaacagagaaccccccaggataaccaattaacgtacgtagttattgcgatattaacggttgtagctgcgacgatggcaaatgaaatgggatttttagaaaaaaccaaaaaagatcttggtttaggatccataaccacacaagagagtgaatcaaatattttggacatcgatctccgaccagcctcagcctggacactatacgcagtagcaacaactttcgtgacaccgatgttaaggcacagcatcgaaaactcctcagtgaatgtatctctaacggcgattgctaatcaagctacagtgttaatgggtctaggaaaaggttggccattgtcaaagatggatataggtgtgcctttgttggcaatagggtgctacagtcaagtgaaccccattaccctaacagcagcgttgctactcctcgttgcccattatgcgataataggaccagggcttcaagcgaaagctactagggaggcacaaaagagagcagcagcgggtattatgaaaaatccaacagtagatggtattacagtaatagacctggaaccgataccctatgatccaaaattcgaaaaacaattagggcaggtaatgttactgatcttatgcgtcactcaggtgttgatgatgagaacaacatgggctttgtgtgaagcgcttactttggctactggaccaatttcaacactatgggaaggtaaccccggcaggttctggaatacaactattgctgtatcaatggcgaacattttcaggggttcttaccttgcgggcgcaggattgttattctcaattatgaaaaatactacaaacacgaggcgagggactggcaacattggtgaaacgttaggagaaaaatggaaatctaggcttaacgctttaggcaaatctgaattccaaatatacaaaaagtcaggaatacaagaggtagatagaacactggcaaaagaaggaataaaaagaggggaaactgaccaccacgcagtgagtagaggatcggccaaactgagatggttcgtcgagaggaacatggtgacacctgaagggaaggtagtagacctaggatgcggaagaggaggatggtcctattactgtggaggattaaagaatgttagagaagttaaaggactgacaaaaggcggccccggtcacgaggaacccattccgatgagcacatatggatggaacctagtacgattgcaaagcggggtagatgtattctttactcccccagaaaaatgcgatacagttctatgtgatataggagagtcatcacccaatccgacaatagaggctggaagaactctaagagttctaaacctggtcgagaattggttaaacaataatacgcaattttgcatcaaagtactaaatccatatatgccttcagtgattgaaaaaatggagacgttgcaaagaaaatatggcggagcattggttagaaacccattatccagaaacagtactcacgaaatgtattgggtcagtaatgctacaggcaatatcgttagttcagttaatatgataagtagaatgttaattaatagattcacgatgaagcataaaaaagcgacttacgagcccgatgttgatctaggatctggaacacgaaatattggtattgaaagcgaaataccaaatttagacataatcggcaagagaattgaaaaaataaaacaggagcacgaaacaagttggcattatgatcaggatcacccatataaaacatgggcttaccacggctcgtatgaaacgaaacaaacaggatcagcgagttccatggtaaatggagtagtaagattattgacgaaaccatgggacgtcgtaccaatggtaactcaaatggcaatgacagatacaacaccctttggacaacaaagagtattcaaagaaaaagttgacacgagaacccaggaaccaaaagaaggtacaaaaaaactaatgaaaattacggcagaatggttatggaaggaattgggtaaaaaaaaaactccacggatgtgcaccagagaagaatttactaggaaggttcgatcaaatgcagcactaggtgcaatattcaccgatgagaataaatggaaatctgctcgagaggcagtagaagattccaggttttgggaactaatagatagggaacgtaacctacatttagaggggaagtgtgaaacgtgtgtctacaacatgatgggaaagcgcgagaaaaagctaggtgaattcggaaaggcaaaaggatcgagagccatatggtacatgtggctaggcgcacgttttttggagtttgaagcattgggtttcctcaacgaagaccattggttctcaaggagaaattcactttcaggtgtcgagggggagggattacatagattaggatacatattacgagatgtaagtaagaaagaagggggcgcaatgtatgcagacgacacggcaggatgggatactagaataaccctagaagatttaaaaaatgaagaaatggttactaatcatatgaaaggggagcataaaaaactagcagaggcaatatttaagttaacctatcaaaacaaagtggtcagggtacagcggcccactcccaggggaacggtgatggacataatatctcgaagagatcaaagaggcagtggccaagtagggacctacggactgaacacatttacaaatatggaagcacaattaatacgtcaaatggagggagaaggaatattcaaaagtatacaacatttaacagtgacagaagagatagcagtacaaaactggttagctagggtaggtcgtgaacggttatcaagaatggcaatcagcggtgacgactgcgtagtgaaaccgttagacgatcgttttgcaagcgcactaacagcgctgaatgatatgggtaaagttagaaaagacatacagcagtgggagccaagccggggatggaatgattggacgcaagttccgttctgtagtcaccatttccatgagctagttatgaaagatggtcgcgtattagtcgtgccttgtagaaatcaagacgaattaattgggagagcgcgcatatcccagggtgcaggttggtcattgaaagagactgcatgtcttggtaagtcatacgcgcagatgtggactcttatgtacttccacagacgagatctacgtctcgccgcgaacgcaatctgtagtgctgtgccttcacattgggtaccaactagtaggacgacatggagtattcatgcaaaacatgaatggatgacgaccgaagacatgctggcagtgtggaatcgcgtatggattcaggaaaacccatggatggaagataaaacgccagttgaaagttgggaggaggttccttatttaggtaagagagaggaccaatggtgtggatctttaattggactcactagccgagctacatgggcaaagaacatacaaacagcaattaatcaggtacgatctttaattggaaacgaagaatatacggattatatgccgtcaatgaagagatttcgacgcgaagaagaagaagcaggcgttttatggtga

SEQ ID NO: 22925 - RNA, 9876 nt, synthetic construct
  misc_feature 1..9876: note = derived and/or modified CDS sequence (opt6) from DENV-2__GQ398302__SS-prME
  source 1..9876: mol_type = other RNA
actgcaggagtcataatcatgctcataccaaccgcaatggcatttcatttaaccactagaaacggagaacctcacatgatcgtatcaagacaggaaaaaggaaaatctttactcttcaaaactgaagatggtgttaatatgtgtacattgatggctatagacttaggagaattatgcgaagacaccataacgtataaatgcccactattgcgacagaacgaaccagaagacatagattgctggtgcaattccacttcaacatgggtcacatatggtacctgtacaaccacgggagaacatcggcgagaaaaacggtctgtggctctagttccacatgttggaatgggcttggaaacacgcaccgagacttggatgtcgtcagaaggggcgtggaaacatgttcaaagaatcgaaacgtggatccttcgacatccaggattcactattatggctgcaattcttgcgtataccataggaactacacattttcaacgagcactgatcttcatactattaacagcagttgcaccttcaatgactatgaggtgtataggaattagtaatagagattttgtggaaggggtgagtggtggttcatgggtagacatagtattagaacacggtagctgtgtaacaactatggctaaaaataaaccaacactggattttgaacttataaaaactgaggcaaaacaaccggcaacgctgcgaaaatactgcatagaggcgaaacttaccaacactaccacagaaagtagatgccccacacaaggtgaacctagtttaaatgaagaacaagacaaaagattcgtttgtaaacactcgatggttgatagaggttgggggaatgggtgtggtctatttggaaaaggaggaatagttacatgtgccatgttcacgtgtaagaaaaatatggagggcaaagtcgtattaccagagaatctagaatatacaatagtgataactccacatagtggagaagaacatgcggtaggcaacgataccggaaaacacggaaaagaaatcaaaataacaccgcagtcctctataacggaggccgagcttaccgggtacgggactgtaacgatggaatgttctccgagaacgggtctcgacttcaacgaaatggtgcttttacaaatggaagataaagcatggttagtgcacagacaatggtttttggatttaccgcttccgtggttacccggtgcagacacccaagggagcaactggattcaaaaagaaactctagtaacatttaaaaatcctcacgctaagaaacaggacgttgtggtgttaggaagccaagaaggcgctatgcacacggctctcacgggcgcaacagaaatccaaatgtcatctggcaacctactatttactggacatctaaaatgtaggctgagaatggacaaattgcaattaaaaggcatgtcgtactctatgtgcaccggtaaattcaaaatagtaaaagaaatagcggagactcagcatggaacaatagtgattagagtccaatatgaaggggacggaagcccatgtaaaatcccgtttgaaataatggatcttgagaaaagacatgtgctaggtcggcttataacagtaaatccaatagtagccgaaaaagattcacctgttaatattgaagcggaaccgccatttggggacagctatataattattggagttgagcccggtcaacttaaattaaattggtttaagaaaggttcatccatcggacaaatgtttgaaacaaccatgcgaggagcaaaacgtatggccattttaggggataccgcttgggattttgggagcttgggtggtgtatttacatctattggaaaagcattacaccaagtgttcggagccatatatggtgctgcattttctggtgtttcatggaccatgaaaatattaatcggtgtaattataacctggatcggaatgaactcaaggtcgaccagcttatccgtttccctagtattagtgggagtcgtaacgttatatctaggagcgatggtgcaagcagattcaggatgcgtagtttcttggaaaagtaaagagctcaaatgcggatcaggtattttcataaccgataacgttcatacatggaccgaacaatataaatttcaaccagagtctcctagtaaactagcatcggcaatacaaaaagctcatgaagagggtatttgcggaatacggtcagttacaagactagaaaatctaatgtggaaacaaatcactccagaattgaaccatatactatctgagaacgaggtaaaattaacgatcatgacgggtgacataaaaggtataatgcaagctggcaagcgttcactcagacctcagccaacagaactgaaatatagttggaagacctggggaaaagcaaaaatgctaagtacagaatcccataaccagacattcttaattgacgggcctgagacggctgagtgccctaacacaaatcgagcctggaactccctagaggtagaagactacgggtttggagtctttacaacaaacatatggctaaaattacgagaaaaacaggatgtcttttgtgattcgaaattaatgagtgcagctattaaagacaaccgagcggtacatgccgacatgggatactggatagagtctgcacttaacgatacttggaagatggagaaagccagctttatagaagtcaaaagttgtcactggcctaaatcacacacattatggagtaatggagtactagaatcagaaatgataatacccaaaaattttgctggcccagtctcacaacataattaccgacccgggtatcacacccaaaccgccggtccgtggcatctcgggaaacttgaaatggactttgatttttgcgaaggcacaacagtcgtagtaaccgaagattgcggtaaccggggacctagcttacgaacgactacagcgtcaggaaaactaataacggaatggtgctgtcgttcatgtactcttccgccccttcgatataggggagaagacggttgctggtacggaatggaaattagacccctcaaagagaaggaagagaatttagttaattccctagtgactgcggggcatggccagatagataattttagcctgggtgtattaggtatggctctatttctagaggagatgcttagaacacgtgtaggaaccaaacatgctatgttgctggtagcagtgtctttcgtcacccttataacaggcaatatgagtttccgtgaccttggtcgagtaatggtcatggtaggtgctacaatgacggatgacataggtatggggattacatacctagcattacttgcagcatttaaagtaagacccacattcgccgccggcctcttattgagaaaattaacatcaaaagaattaatgatggcaacaatcggaatcgcattgttatctcaaagtacaattccagaaaccattctagaactaacggacgctttagcccttgggatgatggtactgaaaatagtaaggaacatggaaaaataccaattggcagttacaataatggcaataagctgcgtacccaacgctgtgatccttcaaaatgcgtggaaagtttcatgtacgattttagcggccgtttctgtatcccctttactcttaacatcatcgcaacaaaaagctgattggatccctctggctctaaccataaaagggctaaatccaacagccatattcttaacaacactctccagaacgagtaagaaacgaagttggcctttaaatgaagcgattatggctgtgggtatggtaagtatacttgcatctagtttgctcaaaaatgacatacccatgacagggcctctcgtagccggaggattactcacggtatgttacgtgttaactggaagatctgccgacttagaacttgagagggctgctgacgtgaaatgggaagaccaagcagagataagtggctcatctccaattcttagcattactataagtgaagatggatcaatgagcattaagaatgaggaagaggagcaaaccttgacaatactgataagaacaggccttttagtaataagtggtgtttttcctgtttcaattcccataactgcagccgcatggtacttgtgggaagtgaagaaacaaagggctggagtcctctgggatgttcctagtcccccacctgtgggtaaggccgaattagaggatggtgcatatcgaataaaacaaagaggcattctcggatacagtcaaataggagcaggcgtatataaggaaggtacattccatactatgtggcacgttacgcgcggtgctgtgctcatgcatcgtggaaagcgcatcgaaccaagttgggcagacgtaaagaaagacttgatctcatacggaggagggtggaagttagaaggggaatggaaagaaggagaagaagtccaagtactagcccttgaacctggcaaaaatcctcgagcagtacaaacgaagcctgggctctttaagaccaatactggcacaataggggccgtgagtcttgatttcagcccaggaacttcaggatcccctatcgtagacagaaagggaaaggttgtagggttatatggtaatggtgttgtcaccagatcaggggcgtacgtaagcgcaatcgcgcaaacggagaaaagtattgaggataaccctgaaatagaagatgatatatttagaaagaaacgtttaacgattatggatctacatccaggagcagggaagacaaaaagataccttccagcaatagtaagagaggccattaagcgaggtttacggactcttatcctagcaccaacacgagtcgtcgccgccgagatggaggaagcacttaggggattaccaatccggtatcaaacaccagcaatcagggcggagcatacgggtagagaaattgtagatctaatgtgccatgctacatttactatgaggcttctgtcaccagttagggttccaaactacaacttgatcattatggatgaggcacatttcaccgaccccgcaagcatagcggcaagaggatacataagtactcgcgtagaaatgggtgaagcggctgggatatttatgacagcaacaccaccaggatctcgtgatccgtttccacaaagtaacgcacccattatggacgaagagagggaaattccggaaagatcatggaatagtggacacgaatgggttacagattttaaaggaaagacagtgtggtttgtgccatcaattaaagcaggaaacgatatagcggcttgtctacggaagaacggaaagaaagtaatacagttaagtagaaaaacttttgacagcgaatatgtcaagacacgtgcgaacgactgggactttgttgtaacgacggatattagcgaaatgggtgcaaatttcaaagctgagagagtcatagatccgcgcagatgcatgaaaccagtaatattaacagacggagaagaaagagtaatcctagccggtccaatgcccgtaacacattcaagtgctgcccaaaggagagggagaataggacgaaatcccaaaaatgaaaatgatcaatatatctacatgggcgaaccattagagaatgatgaagactgcgcacattggaaagaggcgaaaatgctcttagataacataaatacaccggaaggaatcatcccgtctatgttcgagccagaacgagaaaaagtcgacgcgatagacggagaatacagactccgtggggaggctagaaagacttttgtggatctaatgagaaggggcgacctacccgtctggctggcataccgtgttgcggcagaaggcataaactatgcagatagacgatggtgttttgacggaattaagaataaccaaattctggaagaaaacgtagaagttgaaatatggacaaaagaaggagaaagaaagaaattgaaaccgagatggctggacgcaagaatttattcggatccattagcattaaaagaatttaaagagttcgcagctgggcgaaaatcactaacactcaatttgataacggaaatgggacgactgccgacatttatgacacaaaaggccagagatgctttagacaatctagcagtacttcatacagcagaagcgggaggacgagcatacaaccatgcattatccgaactgccagaaactctagaaaccttgctactactaacactgttagcaactgtaacgggaggtatctttctgttccttatgtctggaaaaggcataggaaaaatgaccctgggaatgtgttgtataataacagcgtcgatactattatggtacgcacaaattcaacctcattggatagcagcatccattatactagagttctttttaatagtgcttttgataccagaacccgaaaaacagcgaacgccacaagacaaccaactcacttacgttgtaattgcaatcttaacagtagtagcagcaacaatggcgaacgaaatgggtttcttagaaaagactaagaaagacctaggactaggatctatagcaactcaagaaagtgaatcaaacatattagatatagatttaaggccagcttctgcctggacactttacgctgtggctaccaccttcgttacccctatgctccgacactctatagaaaacagcagcgtaaatgtatccctaacggcaatagccaaccaggcaaccgtacttatgggactgggaaaaggatggccgttaagtaaaatggacataggtgttccactccttgccataggatgctattcacaggtaaatcctatcacgttaactgcggcattgcttcttttagtggcacactacgctataataggtccaggacttcaagcaaaagctacaagggaggctcaaaagcgggctgcagcaggtataatgaaaaatccaacagttgacggcataacagtaatagatttagaacccatcccatacgacccaaaatttgaaaaacaattgggtcaagtaatgctactgatcttatgtgttactcaagttctcatgatgagaactacatgggcattatgcgaagcattaacacttgccaccggaccaatatctacactatgggaaggcaaccctggaagattctggaacaccacaatagcggtttcgatggcaaatattttcagagggtcgtacttagccggtgcgggattattgttttcaatcatgaagaatactacaaacacacgcagaggaaccggcaacattggtgaaacactaggcgaaaaatggaaatcgcgccttaatgcactgggaaaatctgagttccaaatctacaagaaaagcggtatacaggaggtagatagaactttggctaaagaaggcattaaacgcggagagaccgaccaccatgctgtatcgcgaggaagcgctaaattacggtggtttgtggagaggaacatggtcacaccagagggtaaagtcgtagaccttggatgtggacgaggcggttggtcatattactgcggcggacttaaaaatgtaagagaagtgaaaggtctaactaaaggagggcctggtcatgaagaaccgatcccgatgtcaacctatggttggaatttggttaggctacagagcggagtggacgtattctttacaccccctgaaaaatgtgatacgctactttgcgacataggcgaatcatcccctaatccgacaatagaagccggtcgaactctcagggttctaaacctagttgaaaattggctcaataataacacccaattttgtatcaaagtattaaatccatatatgccctcagtcatagagaaaatggaaacactccaaaggaaatatggtggtgctctagtacgaaatccactgtcaaggaatagcacgcatgaaatgtactgggtcagtaatgcaacaggaaatatcgtatcatctgtaaatatgataagtaggatgctcattaatagatttacgatgaagcataagaaagcaacatacgaaccggatgttgatctaggaagtggtactagaaacataggcatagaaagcgaaattccaaatctggatattataggtaaacgcattgagaaaatcaaacaagaacatgagacatcatggcattatgaccaagatcacccttataagacctgggcctatcatggatcatacgaaacaaaacagacgggcagtgcttcatccatggtaaatggagtagtaaggttattgactaaaccctgggacgtcgtaccaatggttacccaaatggctatgaccgacacaacaccgtttgggcaacaaagagtttttaaagaaaaagtagatacaaggacgcaggagccaaaggaaggcacgaagaaacttatgaaaataacggctgagtggctgtggaaagagttaggtaaaaagaaaactccacgtatgtgcactcgcgaggaatttacccgcaaagttagaagtaacgcggctttaggagccatatttacagatgagaacaaatggaaatcagctcgagaagcggtcgaagactcacgattttgggaactcatagatcgggaaaggaacctccacttagaaggcaagtgtgagacttgtgtatacaatatgatgggtaagagagagaagaaactaggagagttcggaaaagcgaaaggttcaagagcaatctggtatatgtggctcggtgctagatttctagagttcgaagcgctgggattcttaaacgaagatcactggttcagtaggggtaattcgttatctggcgtagaaggagaaggattacacagattaggatacatattacgagatgtaagtaagaaagagggaggtgctatgtacgctgatgacaccgcgggatgggatactagaataaccttagaagacctcaaaaatgaagaaatggttaccaaccacatgaaaggagaacataagaaactagctgaagcaattttcaaactaacttatcaaaataaggtagttcgggtgcaaaggccaactccacgagggactgtaatggacatcatatcccgacgagaccaacgaggttccggacaggtcggtacttatggcttaaatacctttaccaatatggaagcgcaactgattcgacaaatggaaggggaaggaatcttcaaatcaatacaacacttaacagtaacggaagaaatcgccgtacaaaactggctagccagagtaggtcgggaacgcttgtcacgtatggctatttctggggacgattgtgttgtaaaacccttagatgaccggtttgcaagcgcattaactgcattgaatgacatgggaaaagtacgaaaggacatacaacaatgggaaccaagtcgtgggtggaatgattggacgcaggtaccattctgctcgcatcattttcacgagttagtaatgaaagacggacgggtattagtcgtcccctgtcgaaaccaggatgaactgataggccgcgcacgaatcagtcaaggtgctggatggtcactaaaagaaactgcttgcttgggaaagtcctatgcacaaatgtggacgttgatgtattttcaccgaagagacttaagattagcagccaatgcaatatgttctgccgtaccatcacactgggtacccacaagtcgcacgacatggtccatccacgcgaaacatgaatggatgacaactgaggacatgctggctgtatggaatagggtttggattcaagaaaatccttggatggaagataaaacacctgtagaaagttgggaagaagttccatatctagggaagagggaggatcagtggtgcggcagcttaatcggtctcacaagtcgcgcaacatgggccaaaaatatacaaacagcaataaatcaagtgagatctttaatcggcaatgaggaatatacagactatatgccaagtatgaagagattcagaagagaagaggaagaagcgggagtattatggtag

SEQ ID NO: 22926 - RNA, 9876 nt, synthetic construct
  misc_feature 1..9876: note = derived and/or modified CDS sequence (opt6) from DENV-2__GQ398272__SS-prME
  source 1..9876: mol_type = other RNA
accgcaggtgtaattatcatgttgatacctaccgcaatggcctttcatttaacaactagaaatggagaaccgcatatgatagtaggccgacaagaaaaaggaaaaagcctattatttaagacagaagacggcgttaacatgtgtacattaatggcgattgacctcggagagttatgtgaagatactattacatataagtgtccacttttaagacagaatgagcctgaggatattgactgttggtgcaactccacatctacatgggtcacgtatgggacttgtactactacaggggagcaccgccgagaaaaacgaagcgtcgctttagtacctcacgtaggtatggggctcgaaactagaactgaaacatggatgtcgtcagagggagcctggaagcacgttcagagaatagagacctggatactaaggcatccaggatttacaataatggcggcaatattggcctacactataggtacaactcactttcagcgcgctcttatatttatcctcttaacagccgttgcgccaagtatgacaatgagatgtataggtatatcaaatagagattttgttgagggagttagtggaggttcttgggtagatatagttctagaacatggaagttgtgtcacaacgatggcaaagaataaacctacattagacttcgaattaataaaaacggaggctaaacaacccgcgacactacgaaaatattgtatagaagcaaaattaaccaacacaactaccgaatctcgctgtcctactcagggtgaaccatcattgaatgaagagcaagacaaaaggtttatatgtaaacactctatggtcgacagaggctggggaaacggttgcggactattcggaaaaggaggtatagttacttgcgcgatgtttacttgtaaaaagaacatggagggaaaagtagtattacccgaaaatcttgaatacactatcgttataactccacattctggagaagagcatgccgtagggaatgacacaggcaaacatggaaaagagatcaaaatcacaccacagtcaagtatcacagaggcagagctaaccggttatggaacagttacgatggagtgtagtccaaggacaggattagatttcaatgagatggtattactacagatggaagataaagcctggttagtgcaccggcaatggttcttggacttgccactgccttggctaccaggcgcggatactcaaggaagcaactggatacaaaaagaaacattagttacttttaaaaaccctcatgcaaaaaagcaggacgtagtagtactagggtcacaagagggtgccatgcatacggcactaaccggcgcaacggagatacagatgtcaagcggaaatttactatttacaggtcatctaaaatgcagattgaggatggacaagctacaattaaaagggatgtcatatagtatgtgcacgggaaagttcaaaatagtcaaggaaatagctgaaacccaacacggaaccatcgtaattcgcgtacaatatgaaggtgacggaagcccctgtaaaataccattcgaaattatggatttagagaaaagacacgtactcgggcgtttgattacagtaaacccaatagtcacggaaaaggatagcccagtgaacatcgaagccgaacctcccttcggagatagttatataataatcggagtggagccgggtcaacttaaactaaattggttcaagaaaggtagtagtatcggacaaatgtttgaaactaccatgcgaggagcaaaaaggatggcaatcctcggggacacagcatgggactttggatcactaggcggcgtatttacctctattggtaaagcgctccaccaagtatttggcgccatttatggtgcggcgtttagtggagtatcatggacgatgaaaatactcattggggttatcatcacctggataggaatgaactcaagaagcacttcgttatcggttagtttagtgctagtaggggttgtaactctttatctcggcgtaatggtacaggccgatagcggttgtgtggtatcatggaagaacaaagaattaaaatgtggaagtggcattttcataactgataatgtacacacatggacagaacagtataagtttcaaccagaatccccatcaaaattagccagcgcaatacaaaaagctcacgaggagggtatatgcggaattaggagtgttaccagactagaaaatttgatgtggaagcagatcaccccagaactaaatcatatattgtctgaaaacgaagttaaacttacaattatgacaggagacattaaaggcataatgcaagcaggtaaacgtagccttagaccacagcctacagaattaaaatactcctggaaaacttggggaaaagccaaaatgttgagcacggaatcacataaccagaccttcttgattgatggtccagaaaccgccgaatgtccaaacacaaatcgcgcatggaactctctcgaagtagaggattacggattcggagtatttagcacaaacatatggttgaaactgagggaaaaacaagacgtgttctgtgattctaagctgatgtcagcagcgataaaagacaaccgagcagtccatgccgacatggggtactggattgaaagtgcattaaatgatacatggaagatggaaaaagcgtcttttatagaagtaaaaagttgtcattggcctaaatcccatacactatggagcaacggtgtgttggaaagcgaaatgataattcctaaaaatttcgcgggcccggtaagtcaacacaattatagacccgggtaccacacccagacggccggcccttggcatttgggcaaacttgagatggactttgacttctgcgaaggaacgaccgttgtggtcacagaagattgcggcaatcgaggaccatccctaagaacaactactgcatctgggaaacttatcactgaatggtgttgtcggagctgtacgttaccccctttaaggtatagaggggaagatggatgttggtatggcatggaaatacgaccgttaaaggaaaaggaggaaaatttggtaaattcacttgtaactgctggtcacggtcaaatagataacttttcactgggggtcttgggtatggcattatttttggaggaaatgttacggacacgtgtggggacgaaacatgccatcctcttagtagcagtaagcttcgtgacgttaataaccggcaacatgagcttcagggatttaggaagagtcatggtaatggtaggagcaaccatgacggatgacataggtatgggcgtaacttacttagcattgctcgccgcttttaaagtacgtccaacttttgcagccgggctacttctaagaaaactaaccagtaaagaacttatgatggcaaccattggaatagcgctactgtcacagagtaccataccagagacgatattggagctaactgatgcacttgctctcggcatgatggtattaaaaatcgtccgaaacatggaaaaataccaattggcagtaacaataatggcaatatcctgcgttccgaatgcggtgatcctacaaaacgcgtggaaagtatcgtgtactattttagctgccgtttctgtaagtcctctattattaacttcttcacaacaaaaagcggactggattcccctagccttgacgattaagggtcttaatccaacggcaatatttctgaccaccttatcacgaacctctaagaaaagatcttggccattgaatgaagcagtaatggctgtagggatggtaagcattctagcatcaagcttactaaaaaatgacataccaatgactggacccctggtggccggtggtctattgacagtatgttatgtactcactggaagaagcgccgacctagaacttgagagggcggctgacgttaaatgggaagaccaagctgaaataagcggttctagcccaatcctatccataacgatatcagaagatggatcaatgtcgattaagaatgaagaagaggagcagactctaacgattctaattagaacaggccttttagtaatctcaggcgtcttcccagtaagcatacccataactgcagcagcctggtacctctgggaggtaaaaaaacagagggcaggagtgctttgggatgtccctagcccaccaccggtaggaaaagccgaactagaagatggagcataccgcataaaacaaagaggaatattcgggtattcccaaataggagcaggagtatacaaggagggcacatttcataccatgtggcacgtaacgcgcggagcagtattaatgcacaggggaaaaagaatagagccatcttgggcggacgtgaaaaaagacctcatctcatacggaggagggtggaaattagagggtgaatggaaggaaggagaagaagttcaggtcctggcactggaaccgggcaaaaacccccgagcggtacaaactaaaccaggcctattcaaaactaacacaggtacaattggggcagtctcattggacttttctcccgggactagtgggtcacctatagttgatcgaaaaggaaaagtagtggggctgtacggaaatggagtggtaacgaggtcgggagcttacgtatctgcgatcgcgcaaactgaaaaaagtatcgaggataatccggaaatagaagatgatatttttcgtaagaaaagactaactataatggatctacacccaggggcaggaaagacaaaaaggtaccttcctgcgatagtacgagaagcaattaaaagaggtttgcgcacgcttatattggccccaacgagggttgtagcagcagaaatggaggaagctctacgtggattgcccatcaggtatcaaacacccgccataagagcagaacacacaggtagagaaatcgttgatctgatgtgccacgccacctttacaatgcgcctgttgagtccagtgcgcgtcccgaattataatttaataattatggatgaagctcattttactgacccagcatccatagcagcacgaggctacatatctacacgcgtagaaatgggtgaagctgcaggaatatttatgacagcaactccgcccggttccagagatccgtttccgcaatctaatgcaccgatcatggacgaagaacgggaaataccagaaaggtcgtggaatagtggacacgaatgggttacagatttcaaagggaaaactgtatggttcgtcccttccataaaagcgggtaacgatatagctgcgtgtttgcgaaaaaacgggaaaaaggttatacaattaagtcgaaaaacgttcgatagtgaatacgtcaaaacaagagccaatgactgggactttgtcgtgactacagacataagtgaaatgggagctaattttagagcagaaagagtaatagacccacgacgatgtatgaagccagttatccttaccgacggcgaggaaagagtgatacttgccggaccaatgccggtgacacatagttcagctgcacaaagaagaggtaggattggtaggaacccaaaaaatgagaatgatcaatatatctatatgggagagcctttagaaaacgatgaagattgtgctcattggaaggaagcaaaaatgctattggacaatatcaatacgcctgaaggtataataccttcaatgtttgagccagaacgagaaaaggtcgatgctatagatggggagtatcgtctacgcggagaagcaaggaaaacattcgtagacctaatgagacgcggagatttaccggtctggctggcatacagagtagctgctgaagggataaactatgcagaccggaggtggtgttttgatggaattaaaaataatcaaatcctagaagaaaatgtcgaagttgaaatctggacgaaggaaggtgaaaggaaaaaactaaaaccaagatggttagatgccagaatctatagcgaccccttagcgttaaaagaatttaaagaattcgctgcaggtagaaaaagtctaacgctaaatcttataacagaaatgggccgtttacctacattcatgacacaaaaggcaagagatgcgttggataacctggcagtgcttcacactgccgaagtgggaggaagagcgtacaatcatgcattaagtgagcttccagaaacattagaaactctcttactcctaacactgctagctaccgtaactgggggcatatttttatttctaatgagtggcaagggtattggaaaaatgaccctagggatgtgttgtatcataacagctagcatcctactatggtacgctcaaatacaaccgcattggatagcagcttccataattttagaattctttctaatagttctattgattccagagcccgaaaagcaaaggacgccacaagataatcagctaacatacgtagttatagcaattcttacagttgtagcagccacaatggctaacgaaatgggttttttggaaaaaactaaaaaagatttaggcctaggatcgatcataacgcaggagtcagaaagtaatatactcgacattgacctcagaccggctagtgcatggactttatatgccgtagcgacaacgtttgtaacacctatgctaaggcacagtattgaaaattctagtgtaaatgtatccctaacagctattgcaaatcaggcaactgttctgatgggactgggaagaggttggccgctatcaaagatggatataggtgtccccctcctagcaattggttgctatagccaagtaaatcctatcacattgattgcagccctactgctgctggtcgcccactatgctataattggaccaggtttacaagccaaagcaacacgtgaagcacaaaaacgagctgcagcagggataatgaagaaccccacagtagatggaataacagtaatcgatctagagccaattccctacgatccgaagttcgaaaaacaattgggccaagtaatgctgcttgttttatgcgtcacccaggtcctaatgatgaggactacatgggcgttatgtgaagccctgacccttgctactggacctatatccactttatgggagggaaatcctggaagattttggaataccactatcgcagtatcaatggctaacatattccgaggtagctacctggcaggtgctggcttactgttctcaattatgaaaaacaccaccaacacaaggcgaggaacgggcaacataggagaaacgttaggagagaaatggaaatcaagacttaacgccttaggaaaaagcgagtttcagatctataaaaaatcaggtattcaggaagtagatcgaaccttagcaaaagagggaataaaaagaggggagacagaccaccacgcagtctccagaggatcggcgaaattgaggtggtttgtcgaaagaaacatggtaacaccagaaggaaaagtcgtagacctaggatgtggaagagggggctggagttattattgcggtggccttaaaaatgtcagagaagtaaagggtttaaccaaaggtggacctgggcacgaggaaccaatcccaatgagtacttacggatggaatttagtacgtttacaaagtggagtagacgtattcttcaccccgcctgaaaagtgtgacacactcctatgtgatataggcgaatcgagccccaatcccacaatcgaagcgggtcgcacgctaagggttttgaatttggtagaaaactggttaaataacaatacccaattctgcataaaagtcttaaatccgtatatgccttctgtaatcgaaaaaatggaaaccctacaaagaaaatatggaggagccttagtgaggaatccattaagtaggaatagtacccatgaaatgtattgggtttcgaacgcgactggtaacatagttagttcagttaatatgatatcgagaatgttgataaatcggtttactatgaaacataaaaaggctacgtatgaacctgacgtagaccttggctcaggcactcgtaatatagggatcgaaaatgaaatcccaaatttggacatcattggtaaaagaatcgaaaaaattaagcaagaacacgagacgagttggcattacgaccaagaccatccatacaaaacatgggcttatcatggatcatatgagactaaacaaacaggatcagcatcgtcgatggtaaacggcgtcgtaaggctgctaacgaaaccgtgggacgtggtcccaatggtgactcaaatggcgatgacagacaccacaccatttggtcaacaaagagtatttaaagaaaaggtagacactcgcacccaagaacctaaggaagggactaaaaaactaatgagaatcacagctgaatggctttggaaagaactaggaaagaaaaaaacccctcgcatgtgtactagggaggaattcacacggaaagttagaagtaatgctgcacttggcgccatattcacggatgaaaataaatggaaatcagcacgggaggctgtagaagacagcagattctgggaattagtagatcgtgaaaggaacctccatttagaaggcaaatgcgaaacctgtgtatataatatgatgggcaaacgtgagaaaaaattaggtgaattcggtaaggcgaaaggatctagggcgatctggtatatgtggctgggagcgaggtttttggaattcgaagcactaggatttctaaatgaagatcattggtttagccggggtaattcgttaagcggcgttgaaggtgaaggtctgcacaaattaggatatatattacgagacgttagcaaaaaagaagggggtgctatgtacgcggatgatactgcaggatgggataccagaataacactggaggacctaaaaaacgaagagatggtcaccaatcacatgaagggagaacataagaaactagccgaggccattttcaagttgacctaccaaaataaagtcgtaagagttcaacgtcctactccgagagggactgtaatggatataatctcaagaaaagaccagaggggtagcggacaagtaggcacctacggattgaatacatttaccaacatggaggcacagcttatccggcaaatggaaggagagggaatttttaagtcaatccagcacctaacggtaactgaagagattgccgtccaaaattggttagcaagagtaggaagagaaagactgagcaggatggctataagtggtgatgattgtgttgtaaaaccattagacgacagatttgcaagcgcactaacagcattgaatgacatgggtaaggtacgaaaagatatccaacagtgggagccttcaaggggttggaacgattggacacaagtaccattctgttcacatcattttcacgaattagtgatgaaagacggccgagtactagttgtaccctgccgaaatcaagacgaattaataggtagagccagaattagccagggtgcgggttggtcactcaaagaaacggcctgcctaggaaaatcttatgcacaaatgtggacgttaatgtacttccaccgaagggatctgagacttgcagccaacgcaatatgtagcgcagtaccatcacattgggttcctaccagtagaacaacttggagtatacacgcgaaacacgagtggatgacaacagaagatatgcttgccgtctggaatagagtttggatccaagaaaacccttggatggaagacaaaacgccagtcgaatcgtgggaggaagtcccctacttaggcaaacgagaagatcaatggtgcggaagcctcattggtctaacatctagagcaacatgggccaaaaatatacaaacagcaatcaaccaagttcgatcattaataggaaatgaagagtacaccgattacatgcctagtatgaaacgtttccgaaaggaggaagaagaagctggagtactttggtga

SEQ ID NO: 22927 - RNA, 9876 nt, synthetic construct
  misc_feature 1..9876: note = derived and/or modified CDS sequence (opt6) from DENV-2__GQ398292__SS-prME
  source 1..9876: mol_type = other RNA
actgccggggtttttatcatgttaattcccactgcgatggcctttcacttgacaacgcgtaatggggaaccgcacatgattgtggggcggcaagaaaaaggtaaaagtctcttgtttaaaacagaagatggggtgaatatgtgcacattaatggcaatagatttaggagaactgtgcgaggacacgattacgtataaatgtcccctattacgtcagaacgaaccagaagatatagattgttggtgtaattcaaccagtacctgggtaacatatggaacatgcacaacaacaggcgaacatagacgagagaaaaggagcgttgcacttgttccacatgtcggaatgggtttagaaactcggacagagacgtggatgagttcagaaggagcgtggaaacatgttcagagaatcgaaacctggattatgcggcaccctggttttacaatcatggcagccatactcgcttacactataggaacaacccatttccaacgtgccttaatcttcatcctccttacagcagttgctcccagcatgaccatgcgctgtatagggatatcaaatagagattttgtagaaggtgttagcggagggtcgtgggttgacatagttttggagcatgggtcgtgtgtaacaacaatggctaaaaacaaacccacgctggatttcgaactcataaaaactgaggcaaaacaacctgccaccctaagaaaatactgcattgaagctaaattaaccaatacaacgacggaaagtcgctgtccaactcaaggggaacctagcttaaatgaagaacaggataaaaggtttgtctgtaaacactcgatggtagatcgaggttggggaaatggatgcggcctgtttggtaaagggggtatcgttacgtgcgcaatgtttacatgcaagaaaaatatggaaggaaaagtagtacttcctgagaacctggaatatacaattgtaataaccccacattcaggagaagaacacgcagtgggtaatgacacaggcaaacatgggaaagaaatcaaaataaccccgcaatcctctattactgaagcggaactaaccggttatgggactgtgacaatggaatgctcgccaagaactggtctggacttcaatgaaatggtattattacaaatggaagacaaagcatggctagtgcacagacaatggtttcttgatttacctctaccatggctaccgggagccgacacgcaaggttctaattggatacagaaagaaacacttgtaacatttaaaaatccgcatgccaagaaacaggatgttgtagtactaggaagccaagagggagcaatgcatactgctcttaccggagctacagagatccaaatgtcgagcggtaatctactcttcactgggcatcttaaatgtcgtctgagaatggataaattacaattaaaaggaatgtcatatagtatgtgcacaggaaaattcaaaattgtaaaagaaatagcggagacacaacatggtactatagtgattagggtacagtacgaaggggacgggagtccttgcaaaataccttttgaaataatggacctggagaaacgacatgtcctaggtagacttattacagtaaacccaattgtggctgaaaaagattcaccggtaaacatagaagctgaacctcctttcggagacagttatatcattattggagtagaacccggtcaactaaaacttaactggtttaagaaagggtcaagcataggccaaatgtttgaaaccactatgaggggagctaaaaggatggctatcttaggcgatactgcatgggactttggatcattaggaggggtttttacaagcatcggtaaagcattgcatcaagtatttggcgcaatctacggtgctgccttcagcggagtaagttggaccatgaaaattctaattggagtaattataacatggatcggaatgaactcgagaagtacaagtttatccgtaagtctcgttttagttggggtagtaaccctgtatttaggcgcaatggttcaagctgatagcggttgtgtagtttcatggaaatctaaagaactaaaatgcggctctggaatttttatcactgacaacgttcatacgtggacggaacaatataaatttcaacccgaaagtccatccaaattagctagtgcaattcagaaagcacacgaagagggaatttgtggtattaggtcggtaacacgtctagaaaatttaatgtggaaacaaatcacgcctgaacttaatcacatattaagtgaaaatgaggttaagctaacgattatgacgggtgatataaaaggaataatgcaggcagggaagcgttcacttagaccgcagcctacggaactaaaatattcatggaaaacgtggggcaaagctaagatgctgtcgacggaatcacataaccagacatttctcatagatggcccagaaacggccgaatgcccaaatactaacagggcgtggaactccctagaagtagaagactatggatttggcgttttcacaacgaacatttggctcaagttaagagaaaaacaagatgtgttctgtgatagtaaactcatgtctgcagcaataaaagacaatagggcagtacatgctgacatgggttattggatagaatcggctcttaatgacacatggaagatggaaaaggcatcatttatagaagttaaatcttgccattggccaaaatcacacactttatggagtaatggcgtattagaaagtgaaatgataatacccaaaaacttcgccggcccagttagtcaacataactacagacctggataccatacacaaacggcaggaccctggcaccttggaaaattagaaatggacttcgatttttgtgaagggactaccgtagttgtgactgaagactgcggaaaccgcggaccatctctacgaacaacaacagcatcaggaaaattaattacggaatggtgctgtagaagttgtacactaccacccctacggtatagaggtgaagatggttgttggtacggaatggaaataaggccacttaaagagaaggaagaaaatttggtgaatagtctagttacagctggacatggtcaaatagacaacttttcgctgggtgtattgggtatggctttatttttagaagaaatgttacgtacacgtgttggtactaaacatgcaatgctactggtagcagtctcttttgttacattgatcaccgggaacatgtcctttagagacttaggaagggtaatggtaatggtaggggccacgatgacagacgatattgggatgggaataacctacttggctctattggccgcattcaaagtacgacccacttttgcagctgggttgttactacgcaagctcacttcgaaagaacttatgatggcaactataggtattgcattattatcccaatctacaattcccgaaactattcttgaattaacagacgccttagcacttggtatgatggttcttaaaattgtccggaacatggaaaagtatcaactagcagtaacgataatggccatttcttgtgtgccaaacgcagtaatactacaaaacgcatggaaagtcagttgtacaatcctagctgctgtaagtgtatctccactactcttgacttctagccaacagaaagcagattggatacccttggcactgacaatcaaaggattgaacccgacggcaatcttcttaacaaccttaagtagaactagcaaaaagagatcatggcctttaaatgaagcaatcatggctgtaggaatggtcagcattctagcatcatcattattaaagaatgacattccaatgactggacctttggtcgctggcggattactaacagtttgctatgtgttaactggtaggtcggctgatctagaactagaaagagcggcagacgttaaatgggaagatcaagcggaaatatcaggttcttcaccaatcctatctattacaatatctgaagacggatcaatgtcaattaagaatgaagaagaggaacagacgttaaccatattaatacgcactgggttgctggtcataagcggagtgtttccagtgagcatacccatcactgcagctgcatggtacctctgggaagtcaagaaacagagagccggggttctgtgggacgtacctagcccgccccctgtagggaaagcggaattagaagatggtgcatacagaattaagcaacgtggtatactcgggtactcgcaaataggagcaggagtttacaaagaaggtacttttcacaccatgtggcacgtaactagaggtgcggtactaatgcaccgtggaaaacgtatagaaccaagttgggctgatgttaagaaagacttaataagttacggagggggatggaagttagaaggtgaatggaaagaaggagaagaggtgcaagtcttggctttagaaccaggtaagaatccacgagcagtacaaaccaagcccggactattcaagacgaacacaggtacgatcggagccgtgtctttggactttagtcctggcacttcgggatctccgatagtagacaggaagggcaaagtagttggtctctatggaaacggggttgtcacgagatcgggggcttatgtttccgcgatagcccaaacagaaaaatctattgaagataatccagaaatagaagatgacattttccgcaagaaaagattaacgataatggatctacaccctggtgctgggaaaacaaaaaggtatttaccagcaatagtgcgggaagcgataaaaaggggattacgaacgttaatattagctcctactagagttgttgcagctgagatggaagaggcattaagggggttacccattaggtaccaaactcctgcaatacgtgcagaacacaccggaagagagatagtagacctaatgtgtcacgccacatttacgatgcgactactaagccccgttcgcgtacccaactataatctgatcataatggatgaagctcacttcacagatccagccagcatagcagcaaggggatacatatcaaccagagtagaaatgggggaagcggcaggaatttttatgacagctacacctccaggtagtcgtgatccttttcctcaatcaaatgcacctataatggatgaagaaagggaaatcccagaacggagctggaactccggacacgaatgggtaacagacttcaaaggaaagacagtctggtttgtaccatcaataaaggctgggaacgacatcgctgcatgcttgaggaaaaatggaaagaaagtcatacagctatcgagaaaaacctttgattcagaatacgtaaaaaccagggctaatgattgggatttcgtcgttacgactgacataagcgaaatgggggctaatttcaaggccgagagagttatagacccgcgaagatgtatgaaacccgtgatattaactgacggggaggaacgagtgattctagctggtccaatgcctgtgacccactcgagtgcagcgcaacgaagaggcaggattggacgtaatcctaagaatgaaaacgatcaatacatttacatgggggaacctttggagaacgatgaggactgcgcgcattggaaagaagctaaaatgttactcgacaacataaacacacctgaaggaattatacctagcatgtttgagcctgagagagaaaaagtcgatgccattgatggagaataccggttacggggcgaagctagaaaaacatttgttgaccttatgcgtcgaggtgatctacccgtgtggctcgcatatagagttgccgcggagggcatcaattatgcagaccgaagatggtgttttgatggaataaagaataatcaaattttagaagagaacgtagaagtagagatatggacgaaagaaggtgaacgaaagaaattaaaaccaagatggttagacgccaggatatattcagatccactagccttaaaagaatttaaagaatttgctgctggaagaaaatccttaacactaaatttgataactgaaatggggcgattaccgacgtttatgacgcaaaaggcaagagacgcattagataacctcgccgtattacatacggcagaagccggtggacgagcgtataatcatgccttatccgaattacccgaaaccctagaaacactacttctgttaacgttattggcgactgtaacagggggtatattcctgttcttaatgtcaggcaagggaattggcaagatgacccttggaatgtgctgtataataacagcctcgatcctgctatggtacgcacaaatacagcctcactggattgcagcgagtataatcttggaatttttcctaatcgtccttcttatcccggaaccggagaaacagaggacgccacaagataatcaattaacatacgttgttatagcaatcttaacagttgtggcggcaacaatggccaacgagatgggctttctcgagaagaccaagaaagacttaggcctaggatcaatagcgacacaagaaagcgagtctaatatcctggatatagacctaagacccgcctctgcatggactttatatgcagttgctacaacatttgttactcctatgttaaggcattctatagaaaatagtagcgtaaatgtatcattaacagctatcgccaatcaggcgacagtccttatggggttaggcaaagggtggcccctaagcaaaatggacattggtgtaccacttctcgcaatcggatgctactcccaagtaaatcccattactttaactgctgcattactactactcgttgcacactatgctataattggacctggtttacaagcaaaagcgacgagggaagcgcagaaaagggctgcggcaggaattatgaagaaccccacagtagacggcattactgtaattgatttagaaccaataccatatgatcccaaattcgagaaacaacttggccaagtcatgttgctaatactctgtgtaacacaagtcttaatgatgcgtacaacatgggctctttgtgaggccctcactttggccaccggacctatttcaacattgtgggaaggcaatcctggaagattctggaacacaactatagcggtatctatggcaaatatctttcgaggcagttatttggcgggtgcgggcctattattcagtattatgaagaacactacaaatacacgcagaggtactggaaacattggcgagactcttggcgaaaaatggaaatcaaggctcaatgcgttgggtaaatcagaatttcaaatttataagaaaagcggaatacaagaagtggatcgaacgttggctaaagagggcattaaacgtggagagacagatcaccatgcagtaagtagaggtagtgccaagctcaggtggtttgttgaaaggaacatggtaacacctgaaggaaaggtagtggatctaggatgtggacggggtggatggtcttactattgtggaggcctcaaaaatgtccgagaggtaaaaggtctaacaaagggaggacctggccacgaagaaccaatacccatgagcacatatgggtggaacttagtaagattgcaaagtggagtagatgtattctttacaccaccagaaaaatgtgacactcttttgtgtgacataggtgaaagttcaccaaacccaacaatagaagcaggaagaacattgagagtattaaatttggtcgaaaattggctaaacaacaatactcaattctgcataaaagtactcaatccctatatgccatcagtaatagaaaagatggaaacactacaacgcaagtatggcggagcgttggttcgaaaccctctgagtcgtaactctacgcatgagatgtattgggtatctaacgcaactggaaacatcgtttcaagtgtgaatatgatttcgcgtatgttaataaatcgatttacaatgaaacacaaaaaggcgacatatgaacctgacgttgatttaggctcaggtacacgaaatatcgggatagaatctgaaataccaaatctagatattataggcaaacgcatcgagaaaataaagcaagaacatgaaacaagttggcattatgatcaagaccacccatataaaacgtgggcataccatggttcttatgaaacaaaacaaaccggctctgcaagtagtatggtcaacggtgttgttaggttgctcacgaaaccctgggacgttgtaccaatggtaacccaaatggctatgactgacacaactcccttcggccagcaaagagtattcaaggaaaaagtagatactaggactcaggaaccaaaggagggtacgaagaaattaatgaaaatcacggccgagtggctatggaaagaacttggcaagaagaaaacgccacgaatgtgtactcgagaagaatttacacgtaaagtacgaagcaacgcagcgcttggagcaatattcacggatgaaaataaatggaaaagcgcacgggaagctgtagaggactcgagattctgggaactaatcgatagagaacggaatttacacttggaaggaaagtgtgagacctgtgtgtataacatgatgggaaagagggagaagaaacttggtgaatttggaaaggcaaaagggtctagagcaatatggtatatgtggttaggagcacgattccttgaatttgaggctttagggtttctaaatgaagaccattggttttctcgcggtaattcattgtcgggcgttgaaggagaagggttgcatagattaggttatattcttcgagatgtgagcaagaaagaaggtggagcaatgtatgcagacgatactgcaggctgggacaccagaatcacactggaagatctgaagaatgaagaaatggttactaatcacatgaaaggtgaacataagaaactagcagaagccatattcaaattaacataccaaaataaagttgtaagggttcaacgaccgacgccccgaggaaccgtcatggatatcattagcaggcgagaccaaagaggaagtggacaagtaggtacctatggcttaaatacatttacaaatatggaagcacaactaataagacagatggaaggagagggaattttcaagtcaattcaacatttaactgtcaccgaagaaatagcagtacaaaactggttggccagggtgggacgtgaaagattatcgcgcatggcaatatcaggagatgactgcgttgtcaaaccattagatgataggttcgcgagcgcattaacagctcttaacgacatggggaaagtgagaaaagatatacaacaatgggaacctagtagaggttggaatgactggacacaagtcccgttttgcagtcaccatttccatgaacttgttatgaaagatggacgagttctagtggtaccatgtagaaaccaggacgaacttataggtcgcgctagaatctctcagggtgcaggatggagcttaaaggaaactgcatgtttgggaaaatcttacgcacaaatgtggacattgatgtactttcacagaagagatcttagactagctgccaatgctatttgtagcgcggtaccttcacactgggtcccaacgtcaaggactacatggtcgattcacgctaaacacgagtggatgacaacagaggacatgttggcggtatggaaccgggtgtggatccaagaaaatccctggatggaagacaaaacaccagtcgagagctgggaggaagtaccatatttaggtaagagagaagatcaatggtgtggttcactaatagggttgaccagtcgtgctacatgggcgaagaatatacagaccgcaatcaatcaggtaagaagcctaattggaaatgaggagtatacagactatatgccaagcatgaaacgattccggagagaagaggaggaagcgggggtcttgtggtag

SEQ ID NO: 22928 - RNA, 9876 nt, synthetic construct
  misc_feature 1..9876: note = derived and/or modified CDS sequence (opt6) from DENV-2__GQ398267__SS-prME
  source 1..9876: mol_type = other RNA
actgctggaataataataatgatgattcctaccgtaatggcattccatttaactactaggaatggagaaccccacatgattgtaagccgtcaagaaaaaggtaaatctctactatttaaaactgaaaacggagtgaacatgtgtacattgatggctatggatcttggagaattgtgcgaagatacaatcacgtacaattgtccattattacgccagaatgaaccagaagatatagattgctggtgcaatagcacaagcacgtgggtcacatacggaacgtgtacggcaacaggagaacatagaagagaaaaacggagcgttgcattagtaccacatgttggaatggggttagaaacacgcacagaaacgtggatgtcatctgaaggggcatggaaacacgcacaacgcattgaaacatggatccttcgtcatcctggattcacaattatggcagcgatacttgcatatactatcgggacgacgtactttcaaagggttctaatatttattttgcttaccgcggtaactccttccatggccatgagatgtatcggtatttctaaccgcgattttgttgaaggtgtatctggcggcagttgggtcgatatagtcttagaacatggaagctgtgtaaccaccatggccaaaaataaaccgaccctagattttgaattaataaaaactgaggcaaaacatcctgcaacactacggaaatactgcgttgaagctaaattaacaaacactacaacggcgtcaaggtgtccaactcaaggagaaccttcactaaacgaagaacaagataaacgattcgtatgtaaacattccatggtggatcgggggtgggggaacggttgtggtcttttcggcaaaggagggatcgtcacatgtgctatgtttacatgcaagaaaaatatggagggtaaagtcgtccagcccgaaaaccttgagtacacaattgtgataaccccacattcgggagaggaaaacgcagttggaaatgacactggaaaacatggtaaagaaattaaagttacccctcaatcatcaattactgaggcggagctaaccggctacgggacagtaacaatggagtgcagcccaagaaccggactagatttcaatgaaatggttttactgcagatggagaacaaagcctggttagtgcataggcagtggtttctagatcttcctcttccctggctacctggtgcagatacacaaggcagtaattggatacaaaaagaaacattggtaacattcaaaaatccccacgccaagaaacaggatgttgtagtcttaggatctcaagaaggcgctatgcatacggcactaactggtgccactgaaatacaaatgtctagcggcaaccttctatttactggccatctaaaatgcagactacgcatggataaactacaacttaaaggtatgtcttattccatgtgtacgggtaaattcaaagttgttaaagaaatagctgaaacacagcatggaacaatcgtgatacgcgtacaatacgaaggagatggatctccctgtaaaattccattcgagataatggaccttgaaaaacgccatgttctaggtagactcattacagttaatccaattgtgacagaaaaagattctcccgtgaatattgaagcagaaccgccgtttggcgatagttatataataataggtgttgaacctggccagcttaaactgtcttggttcaagaaaggatcttctattggccaaatgtttgaaactacgatgagaggtgcaaaacgaatggcaattctgggagatacagcgtgggattttggttctttgggtggagtatttacatcaataggcaaagcactacaccaagtttttggtgctatatatggagctgcattttcaggagtatcttggacaatgaaaatcctgataggcgtagttataacgtggataggaatgaacagtagatccacaagtttgtcagtatctttagtcttagtgggtgtggttaccctataccttggtgtcatggtacaggctgacagtggatgcgtagtctcgtggaaaaataaagagctgaaatgtgggagcggcatattcataacagataatgtacatacatggactgaacaatacaaatttcagccggaatcaccgtcgaaattagcgagtgcaattcaaaaagcgcatgaagaaggaatatgcggtatacgcagtgtaacgagactagaaaacttaatgtggaaacaaattacaccagagttaaatcatatactaactgagaatgaagtaaaactaacaataatgacaggagatattaaagggatcatgcaggcaggaaaaagatcattaagacctcaacctactgagttaaaatactcgtggaaagcgtggggaaaagcaaaaatgcttagcacagagctacataaccacacgtttctcattgatggtcctgagaccgccgagtgccctaacacgaatagagcatggaatagtcttgaggtagaagattacgggtttggggtatttacaacgaatatttggctgaaattaaaagaaagacaagacgtattttgtgattctaaattgatgtcagcggcaatcaaagataacagagccgtccatgccgatatgggttattggatagaatctgcacttaatgacacgtggaaaattgaaaaggcttcttttatagaggtaaaatcgtgccactggcccaaatcacacaccttatggtctaatggtgtattagagtccgaaatgattatacctaaaaatttcgcaggtcccgtctcccaacacaactaccgacccggttaccacacacaaacagcagggccatggcatcttggtcgactggagatggatttcgatttttgtgaagggacaactgtagtcgtgacagaagattgtggaaatagaggtccatcactccgaactaccaccgccagcgggaaactgatcacagaatggtgttgccggtcgtgcactcttccaccactgaggtatagaggggaagacggttgttggtatggtatggaaattcgtcctctcaaagagaaagaagagaacttagtcaattccctagtaaccgctgggcatgggcagatcgataacttctctctcggagtgttaggtatggccctattcctagaagaaatgctacgcacaagggtaggaacaaagcatgctatattgcttgtagccgtgtccttcgtaacccttataacaggaaatatgtcttttcgagacctagggagagtaatggtcatggtgggggcgacaatgacagatgatataggcatgggtgtaacatacttggcattactggcagcttttaaagtgagaccaacgtttgccgcagggttgttactaagaaaactaacctcaaaggaattaatgatgacaacaatagggatagttttattatctcagtcaacaattcctgaatcaattttggaactaacagatgcactagcccttggcatgatggtgcttaaaatagtgagaaacatggaaaaatatcaactcgcagtaacgataatggctattttatgcgtacctaacgctgttatacttcaaaacgcctggaaagtatcatgtactactcttgcggtagtgtctgtttcgccccttctacttacgtcatcacaacaaaaagccgattggatacctttagcgctaacaattaaaggtctaaacccaactgcaatatttttaactaccttaagcagaacctccaagaaaagaagttggcctctcaatgaagcaatcatggctgttggaatggtatctattctagctagttccctcctgaagaacgacatacctatgaccggacctttggtagccgggggattattgaccgtatgctacgtgttaacgggacgatcagcagacctggagctagaacgcgctgcagatgtaagatgggaggaacaagctgaaataagtggttctagccccatactctcaataaccatatcagaagatggatctatgtccattaaaaatgaagaagaagaacaaactttaactatcttgatcagaacaggactattagtcatcagcggattattcccagtcagtatacccatcaccgctgcggcgtggtacctgtgggaagtcaagaaacaaagagcaggagtattgtgggatgttccgagtcctccacccgtcggaaaagcggaattagaggacggagcttacagaattaaacaaaagggaatactaggatatagccaaattggagctggcgtctataaggagggtacatttcacacaatgtggcatgttaccagaggagctgtacttatgcacaaaggaaaaagaattgaaccgtcctgggcggacgtaaagaaggatctcatatcatatggtggaggatggaaactagaaggagaatggaaagaaggagaagaagtccaagtattagcattagagccaggcaaaaatccaagagcagttcaaactaaacccggtttatttaaaacaaataccgggacaataggagcagtgagtctagactttagcccaggtacttctggaagcccaattgtggataagaaaggcaaagtcgtcggtttatacggaaacggagtagtcactagaagcggaacatatgtttcggccattgctcaaacagagaaaagcatcgaggataatcccgagatcgaagacgatatcttccgtaagaaaagactgacaataatggacttacatccaggagcaggaaagacgaaaagatacttaccagcaatagtaagggaagcgatcaaaaggggattgagaacgttaatacttgcacccacaagagttgtcgcagccgaaatggaagaagcattgagaggacttccaataagatatcagactccagcaattagggcggaacacactggtagggaaatagtggacttaatgtgccatgctacgtttactatgagactgctgtcgcctattcgcgtgccgaattataatttaataatcatggacgaagcacacttcaccgatcctgcttctatagcggcaagaggatacataagtacacgagttgaaatgggagaagcagctggcatatttatgacggcgactcctcctggctctagagatccctttccacaaagtaatgcaccgatcatggacgaggaaagagaaatccccgagagaagttggaacagtggtcatgaatgggttacagacttcaaaggaaaaaccgtatggtttgttccatcgataaaggctggtaatgatatcgcagcatgtttgcgcaaaaatggtaagaaagtgatacaactatctcgaaaaacatttgattccgaatacataaaaacacgtacaaatgattgggacttcgtagtgacaacagacatatcagagatgggagcaaacttcaaagcggaaagagttattgatccgagacgatgcatgaaaccagtgatattaacagatggggaagaaagagttatattagctggcccaatgcccgttacccatagtagtgctgctcagaggagagggcgggtcggacgtaatcctaagaatgaaaacgatcaatatatctatatgggagaacccctcgaaaacgatgaagattgtgctcactggaaagaagcaaaaatgcttttagacaatatcaacactccagaaggaataattccttcgatgtttgagccggagcgagaaaaggtagatgctatagatggcgaatacagacttagaggagaagctagaaaaactttcgtagacttaatgcgacgtggcgatttaccagtgtggcttgcttacagagttgcagccgagggtatcaattatgcggacaggaggtggtgttttgatggagtgaaaaataatcagatattagaagaaaacgtggaggttgaaatatggactaaggagggggagcggaaaaagttaaaaccacgctggttagatgcaaggatctattcagatccactagccctaaaagagtttaaggagttcgcagcaggtagaaaatcattgactctaaatctcataacagaaatgggacgcctaccaacgtttatgacacaaaaagccaaaaatgctttggacaaccttgcagtattgcatacagctgaagctggtggacgggcttataatcatgcgttaagtgagcttccagagacattagaaacactcctcctattaacattactagctactgtaacaggcggtatctttttgttcttaatgagcggaaagggcataggaaagatgaccctgggtatgtgttgcattataaccgcttctattcttctatggtacgcccagatacaaccacactggatcgctgcaagtataattttggaatttttcttaatcgtattattgataccggaaccggagaaacaacgcactccacaagacaatcagctaacctatgtcgtaatagcaatacttacggtagtagcagctactatggcaaacgagatggggtttctggagaaaactaagaaagactttggactcggttcaataactacacaacagccagaaagtaatatactcgacattgatttaagaccagcaagtgcatggacgttatatgctgtagctacaacatttattacgcctatgttgaggcacagtatagaaaattcgtctgtaaacgtgtcattaacggcaatcgctaatcaggctacagttttgatgggtctaggtaaagggtggccattaagcaaaatggacattggcgtacctctattagcgatagggtgctatagtcaggtgaatccaataactcttatagcggcattactactgctagttgctcactacgcgatcataggtcctggcttacaggcgaaagcgacaagagaagctcagaaacgtgcagctgcaggtatcatgaaaaatccgactgtggatggaatgaccgtaatcgatcttgatcccattccttatgatcctaaatttgagaagcaattaggtcaggtgatgttacttgtactatgtgtaacccaagtgttaatgatgcgaacaacatgggcactctgcgaagccttgacactggcaactgggcccatttcgaccctatgggaaggtaatccaggacgtttttggaatacgaccatagctgtatccatggcaaacatatttagaggttcgtatcttgccggagccggcttactcttttcgataatgaagaatacggcaaacactcgaagaggcactgggaatattggagaaactttaggagagaaatggaagaatcgtctaaacgcgcttggaaaaagtgagttccaaatttataagaaatcaggaatacaagaggttgaccgcacgctcgctaaggagggaattaaaagaggagagacggatcaccatgcagtatcgcgaggtagcgcaaaacttcggtggttcgtagaaagaaacttagtaacccctgaaggaaaggtagtcgatttaggttgtggaaggggaggctggtcatattattgcggaggtttaaagaatgttaaggaagtaaagggcttgaccaaaggcggaccaggtcacgaagaacctatacccatgtcgacctacggctggaatctagttcgattgcagagtggggtggatgtattctttacacctccagaaaagtgtgatacattactttgtgatataggtgaatcatcgcccaatccaacggttgaagctgggaggacccttcgagtgcttaacttagtggaaaattggcttaacaacaacacacaattttgtatcaaagtcttgaatccatacatgcctagtgtaatagagaaaatggaggcacttcagaggaaatacggtggtgctttagtgagaaatccactatcaagaaattccactcacgagatgtattgggtctcaaacgcgtctggtaatatagtaagcagtgtcaatatgatatcccggatgttaattaacagattcacaatgagacacaagaaggcaacatacgaacctgatgtggatctaggatcaggaaccagaaatataggcatagaaagtgaaacaccgaatctggatataatcgggaaacgtatagagaaaatcaaacaagaacacgagaccagctggcactacgatcaagatcatccttacaagacatgggcgtaccacggaagttatgaaacgaagcaaaccggaagtgcatcctcaatggtaaatggggtagtaagacttctcactaagccttgggacgtaataccgatggtaacgcagatggcgatgacagatactacccctttcgggcagcagagagtatttaaagaaaaagtagatacaagaactcaagaacccaaggaaggcactaagaaattaatgaaaataacagccgaatggctgtggaaagagcttggtaagaagaaaactccaagaatgtgcacaagagaagagttcactcgcaaagtacgctctaacgcagccttaggtgccatttttacagatgagaataaatggaagagtgctagagaggccgttgaggactcagggttttgggagttagtagataaagaacggaacttacacttagagggaaaatgcgaaacatgtgtatataacatgatgggtaaacgggagaagaaactaggcgagttcgggaaagctaaaggaagtcgagcaatatggtacatgtggctgggtgcacgctttttagaatttgaagcgttagggtttttgaatgaagaccattggttcagcagagaaaacagcttatcaggagtggaaggagaaggattacataaattaggttacattctaagggacgtatctaaaaaggaaggcggcgctatgtacgcagacgatactgccggatgggatacacgtattacacttgaagatctcaaaaatgaggaaatggtaaccaatcatatggaaggagagcacaagaaactcgcggaagccatctttaaattaacataccaaaacaaagtggtccgagttcaaaggccaactccaagaggtacagtcatggacattatttcacgaagagatcagcggggcagcggccaggttgtcacatacggattaaatactttcacaaatatggaggcccaactaatcaggcagatggaaggggaaggcgtattcaagagtatacaacagctcacagtaaaagaggagatagcggtcaaaaattggctgatacgcgtgggacgagaaagactttctagaatggctatatccggagatgattgtgtcgtaaaacccctcgatgaccgattcgcatcggctcttattgcgctaaacgatatgggcaaagtcagaaaggacattcaacagtgggaacctagccgtggctggaacgactggacacaagtacccttttgttctcaccattttcatgagttgataatgaaagacggtagggtcctagtagtaccgtgcagaaaccaagatgaacttataggtcgagctcggattagtcaaggagcaggttggagtcttcgggaaaccgcttgtctcggtaaatcctatgctcagatgtggtctctaatgtacttccaccgacgtgacttaagattagcggcaaatgcaatatgtagtgctgtaccatcacactgggttccgaccagccgtacgacgtggtcgattcacgcaactcatgaatggatgacaacagaagatatgctaacagtctggaatagagtatggattcaggaaaatccatggatggaagataaaacaccagtagaaagctgggaggaaataccctatctaggaaagagggaagatcaatggtgtggttctctaataggcttaacaagccgagcgacttgggcaaagaatatacaaacagcaatcaaccaagtaaggagtttgataggaaatgaagaatacaccgattatatgccatcaatgaaaaggttcaggagagaagaagaggaagcaggagtgttatggtaa

SEQ ID NO: 22929 - RNA, 9876 nt, synthetic construct
  misc_feature 1..9876: note = derived and/or modified CDS sequence (opt6) from DENV-2__GQ398266__SS-prME
  source 1..9876: mol_type = other RNA
accgcaggtatcattatcatgatgattccgacagtaatggcctttcatttgactaccaggaatggagagccccacatgatcgtatccagacaagaaaagggtaaatctttattgttcaaaaccgaaaatggagtaaatatgtgcacgttaatggctatggatctgggagaactttgtgaagacactataacatacaattgtcctttactcaggcaaaatgaaccggaggacatagattgttggtgtaattcaacctccacatgggtaacgtatggtacatgtaccgccacaggtgaacataggcgagaaaaacgctcggtagctttagtcccgcatgttggaatggggctagagacacgaactgaaacgtggatgtcaagtgaaggagcctggaaacacgcacaaagaatagagacgtggatattaaggcatccagggttcacgataatggctgctatattagcatacactataggaacaacatactttcaaagagttctaatcttcattttattaacagcagtaactccatccatggccatgcgctgtatcggcatatctaatagagacttcgtggaaggtgttagtggtgggagttgggtagatattgtgctagaacacggatcatgtgtaacaacaatggccaaaaacaaaccaacgttggactttgaattgataaaaactgaagccaaacatccggcaacgctaagaaaatactgtgtggaggcaaagttaacaaatactacaacagcgagtagatgtcctacacaaggtgaaccgtccttaaacgaagaacaagacaaacgtttcgtttgtaaacatagtatggttgatcggggctggggcaatggctgtggattattcggtaaggggggaatagtgacatgtgcgatgttcacctgtaaaaaaaatatggaaggtaaggtagtgcagcccgagaacttagagtatacaattgtaataacaccccatagtggggaagagaatgcggtgggcaatgatacaggtaaacatggtaaagagattaaagtaactccacagtcgtctataactgaggcggaactcacaggctacggcacagttactatggagtgctcccctagaacagggttagacttcaatgagatggtactcttacaaatggaaaataaggcctggcttgtacaccgacaatggtttctagatctcccattaccgtggctaccaggagcagatacacagggctcaaattggatacagaaagaaacactggttacgttcaaaaaccctcacgcaaaaaaacaggatgtagttgtcctggggtcccaagaaggcgcaatgcatacagcgttaacgggggctacagaaattcaaatgtcaagcggcaatttattattcactggccatctgaagtgcagattacgaatggataaactacaactaaaaggtatgtcatatagtatgtgtacaggaaaatttaaggtagttaaagagattgctgagactcaacatggaacaatagtcatccgtgttcagtatgaaggggatggctcaccatgcaagattccatttgagataatggatttggaaaaaagacacgtattaggacgattgatcacagttaatccaattgtgactgaaaaggacagtccagttaatatagaggctgagccaccgtttggagatagttacataatcataggggtagaaccaggccaattaaaattatcctggtttaaaaaaggttcaagcataggtcaaatgtttgagacaactatgagaggtgcgaaaagaatggcaatactcggagatacggcttgggacttcggcagcctaggaggtgtatttacctcaataggaaaagcactgcatcaggttttcggagctatatatggagcagcattcagtggagttagctggacgatgaaaattctaataggtgtggtaataacgtggataggaatgaacagccgttcaacatccctctcagtatctctggtgctggtaggcgtagtaaccttatacctcggcgtaatggtacaagctgattcaggatgtgttgtctcatggaaaaataaagaactcaagtgcggctcaggcatatttataaccgataatgtgcatacttggacggagcaatataaatttcaaccggagtctccatcaaaattagcatcagcaatacaaaaagctcacgaagagggtatctgtggtatcaggagcgtaacgaggctggagaaccttatgtggaaacaaattactccagaactaaatcacatacttaccgaaaatgaagtcaaattaactattatgacaggcgatataaagggaataatgcaagccggcaaacgatctctacgaccacaaccaactgagttaaagtacagttggaaggcctgggggaaagcaaaaatgttgagtacagaactgcataaccacacattcctaatcgacgggcccgaaaccgctgaatgccctaataccaaccgcgcctggaattcgttggaagtagaagattatggatttggtgtatttactacaaatatatggttgaaactgaaagagcgccaagatgtcttttgtgatagtaagcttatgagcgcagccataaaagacaatagggcagttcatgctgacatgggttactggatagaaagtgctctgaatgacacctggaagatcgaaaaagctagttttatagaagtaaagagttgtcattggcctaaatctcacacactttggtcaaacggggtcctagaatctgaaatgattattccgaagaactttgcagggcctgtctcacaacacaactatcgacctggctatcatacacaaactgcaggcccatggcacttgggaaggttagaaatggattttgacttctgcgaaggcaccaccgtagtggtaactgaggattgcggaaaccgtggtcccagcttaagaactacaacagcatcgggtaaattgattactgaatggtgttgcaggagttgcacacttccacccctaagatatcgcggtgaagatggttgctggtacggcatggaaataagacctttgaaggagaaagaagaaaatttggtaaatagtctggttaccgccggccatggacaaatagataacttctccttgggagtcttgggaatggcactctttttggaggagatgctccgaaccagagtaggaacgaaacatgctatactacttgtagcagtgagttttgtgacgcttatcactggaaatatgtcatttagggatcttggaagggtaatggttatggtaggggccaccatgactgacgatataggaatgggagtgacttatttggcccttttggcagcgttcaaggttcgtcctacgttcgccgccggattgttattaagaaaacttacatcaaaagaattgatgatgaccacgatcggcatagttctattatcacaaagtaccataccagaatcgattcttgaactgacagatgctttagccctaggaatgatggttctaaaaattgttagaaatatggagaaataccagctagcggtaacaataatggctatactatgcgttccaaatgcggttatactacaaaatgcctggaaggtatcgtgtaccaccttagccgttgtttcggtctcacctttactattgactagttcacaacaaaaggccgactggatcccgttagctttaacaataaagggcttaaatccaacagcgatttttctaactacactctcacgaacaaataaaaaaagatcctggccattgaatgaggcgataatggccgtaggtatggtaagcatattagcctcctccctactaaaaaacgatattccaatgacgggcccattggtcgcgggaggtctactaacagtgtgctatgtactcacgggaagatcggccgatctggaactggaaagagccgcagatgtaaggtgggaagaacaagcagaaatttcgggatctagccctatattatcgattacaataagcgaagatggttccatgtccatcaaaaacgaagaggaagaacaaaccctcacgatactcatccgtacgggattacttgtaatatccggacttttccctgtatctatcccgattactgctgctgcatggtatttatgggaagtcaaaaaacaacgagcaggtgtgctctgggacgtgccctcgccacctcctgtcggaaaggcagaactcgaagacggtgcataccgcatcaaacaaaaaggtattttaggatactcgcagataggagcaggtgtatataaagagggaacattccatacaatgtggcacgtaacacgaggggctgtattaatgcacaaaggtaaacgaatagaaccatcgtgggcggacgttaagaaggacctaatatcatacggcggcgggtggaaactggaaggtgaatggaaagaaggtgaggaagtacaagtcttagccctagagcctggaaaaaatccaagagcagtgcaaaccaaaccaggattattcaaaacaaataccggaaccataggtgctgtttctctagatttctcgccaggaacttcaggatcaccaatagtagataaaaaagggaaggtagtaggattgtatggaaatggagttgtgactcgcagtggaacctacgtctcagcgatagctcaaacagaaaaaagcattgaagataacccagagatcgaagatgacatatttagaaaaaaacggttaactattatggatttacatccaggcgcaggcaagacgaagaggtacttacctgcaatagtaagggaagccattaagcggggcttaagaacactaatactagccccgaccagggtcgtagctgcagaaatggaagaggcccttaggggtttacctattaggtaccagactcctgcaatccgagcagaacatactggcagagaaattgtcgatctaatgtgtcacgctacttttacaatgcgattacttagtcctatacgtgtaccgaattacaatcttataataatggacgaagcacattttacagatcccgcctctatcgcagcccgtgggtatatcagtacacgagttgaaatgggcgaagcagcaggcatcttcatgacagccactcctccaggaagcagagatccttttccacaaagtaatgctccaataatggatgaggaaagagaaataccggaacgtagttggaactcaggccatgagtgggttacagattttaaaggtaaaacagtttggttcgtaccatcaattaaggctggtaatgatatagcagcctgcctacgaaaaaacggtaaaaaagtcatacaattatctagaaaaacctttgactcggaatacataaaaacccgcacaaacgactgggattttgttgtaactaccgatatttcagaaatgggggcgaatttcaaggctgaaagagtaatagacccaagacgttgtatgaaaccagtaatccttacagacggagaggaaagagttattctggcaggtccaatgccagtaacacactcgagtgcagcccaacgccgaggcagagtaggtcgcaatcccaagaatgaaaacgaccagtacatttatatgggtgaaccattagaaaatgacgaagactgcgcacattggaaggaagccaaaatgctattagacaacattaacacaccggaaggcataataccgagcatgtttgagccagaaagagaaaaagttgacgctatagacggagaatatcgtttaaggggtgaagcaaggaaaacgtttgtagacttaatgcgcagaggagatcttcccgtatggttagcctaccgcgtagcggccgaagggataaattatgcagataggagatggtgctttgatggagttaaaaataatcaaatactggaagaaaatgttgaggttgaaatatggactaaggaaggtgagcgtaaaaaactaaaacctcgctggttagatgctcgaatctactccgatcccttagctttaaaagaattcaaagaatttgcggcagggagaaaaagtcttacgcttaatttaatcacagagatgggaaggctaccaacatttatgactcaaaaagcaaagaatgctttggacaatttagcagttttacacactgcagaagcaggaggaagggcatacaaccatgcgctttctgagctacccgaaactttggaaacacttttactgttaactttgctagctacagtaacagggggcatttttctgtttttgatgtctggtaagggcataggaaaaatgacattagggatgtgttgtattataacggcgagtatactattatggtatgcacaaatacaaccacactggatagccgcaagcataatcctagagttcttcttaatagtcttattgatacctgaaccagaaaaacaacgaactccccaagataaccagcttacttatgtcgtgatcgcaatattgactgttgttgctgcaaccatggctaacgaaatggggtttttagaaaaaacaaaaaaagactttggtctagggtcaataacaacacaacagcctgaatcgaatatactagatattgatcttcggccagcgagtgcatggacattgtatgctgtggccacaaccttcattacaccaatgctcagacattctatagaaaattcaagtgttaacgtttcactcaccgcaattgctaatcaggcaaccgttctgatgggacttggcaaaggttggccactatctaagatggatatcggggtacctcttctggcgatcggttgttacagtcaagtaaaccctattacgctgatagcagccctacttctgctagtcgctcattatgctattattgggcctggactccaagctaaagccacgagagaagcacagaagcgcgctgctgcggggataatgaagaatcctacagtagatggtatgacagtaatcgacttagatccaattccatatgatccaaaatttgaaaagcaacttggacaagtgatgttattagtactttgtgtcacacaggttctaatgatgagaactacttgggcactatgtgaagcactaacattagcaactggtcctatctcaacgctctgggagggaaatcctgggcggttttggaacacaacaattgcagtaagtatggcaaatatatttcgaggttcgtacctagcaggagctggactcctattttctataatgaaaaatacagctaacactcgacgaggaactggtaataccggcgagactcttggtgaaaagtggaaaaatcggctaaatgcattaggaaagtcagaatttcaaatatataagaagtcagggatacaggaagtagatagaacattagccaaagaaggaataaaaaggggtgagacggatcaccacgctgtatcgagaggatcagcaaagcttcgatggtttgtagaaagaaacttagtaaccccagagggaaaggttgttgacctaggatgcggaagaggaggatggagttactattgcggcgggctgaaaaacgttaaagaagtaaaaggtctaacaaaagggggaccaggacatgaagagccaattccaatgagcacttatggatggaacttagttcgattacaaagcggcgtcgatgtcttcttcacaccacctgaaaaatgtgatacactactatgcgatataggagaatcatcaccaaaccctacagttgaagccggaagaactctgagggtactaaatcttgttgaaaattggttgaacaacaatacacaattttgcataaaagtgttaaacccgtacatgccaagtgtaattgagaagatggaggctcttcaacgtaaatacggtggggcattagttagaaaccctctatcgaggaatagtacgcatgaaatgtattgggttagcaatgcatcaggaaatattgtatcatctgtgaacatgatatctaggatgcttataaatcgtttcacgatgagacataaaaaagccacgtacgaaccggatgttgatcttggatccggaactcggaacattggaattgaatccgaaacacctaatctagacataataggtaagaggatcgaaaagattaaacaagagcacgagacgtcatggcattatgatcaagatcatccatacaaaacctgggcgtatcacgggtcgtatgagacaaaacaaactggaagtgcctcgtctatggtaaacggggttgtacgattgcttactaaaccatgggacgttatacccatggtaactcagatggcgatgactgacactacaccattcggccaacagagagtattcaaagagaaagtggacacaagaacacaagagccaaaggaaggaacaaaaaagctcatgaaaataactgcagagtggctatggaaagaattaggaaaaaaaaagacacctaggatgtgcactagagaggaatttacaagaaaagtgcgctcaaacgcagcactaggggctatatttactgatgaaaataaatggaaatcagccagagaagctgtcgaagattcaggcttttgggaactagtcgacaaagaaagaaatctacatcttgaaggtaaatgtgagacatgtgtatataacatgatgggaaaaagagaaaaaaaattaggagaatttggaaaggcaaaaggatcaagggcaatttggtatatgtggctcggggccaggttcttagagtttgaagcattaggatttctaaacgaagaccactggttttcacgagaaaattcattgtctggagttgaaggagaaggactacataaacttggctatattctaagggatgtatctaaaaaagaaggaggcgcaatgtatgctgacgatactgccggttgggacaccaggataacactagaagatttaaaaaatgaagaaatggttacgaatcatatggaaggagaacataaaaaattagccgaggctatatttaaattaacctatcagaataaagttgttagggtccagcgaccaaccccaagggggactgtgatggatataatatcgaggcgggatcaacgtggatcaggtcaggtcgttacttacggattaaacacgtttactaatatggaagcccaattaataaggcaaatggaaggggaaggggtatttaaaagcattcagcaactaacggtaaaagaagaaatcgctgttaaaaattggttaatccgggtaggcagagaaagattatcacgtatggcaataagcggcgatgattgtgtggttaaaccacttgatgacaggtttgcgagcgcgctcactgctttgaatgatatggggaaggtaagaaaagatatacaacagtgggaaccaagtaggggctggaatgattggacccaggtaccgttttgctcacatcactttcacgaactcataatgaaggacggcagagtcctagttgtgccttgccgtaaccaggacgagcttatcggtagggctagaatatcacaaggagcaggatggagcctccgtgaaacggcatgtttaggtaaaagttacgctcaaatgtggagtttaatgtattttcatcgtcgtgacctgaggctagcagcgaatgcgatatgtagcgcggtcccatcacattgggtcccgacatcaagaacaacttggtcaattcacgcaacacatgagtggatgacaacggaagatatgctcactgtatggaacagagtttggattcaagaaaatccatggatggaagacaaaacaccagtggaatcgtgggaagaaataccttacttaggcaaacgcgaagatcaatggtgcggatcattaatcggactaacaagccgagccacatgggcaaagaatatccaaacagcgataaatcaagttcgttcgttgattggtaacgaagagtataccgattatatgccctctatgaaaaggtttaggcgcgaagaagaagaggcgggcgtattgtggtaa

SEQ ID NO: 22930 - RNA, 9876 nt, synthetic construct
  misc_feature 1..9876: note = derived and/or modified CDS sequence (opt6) from DENV-2__GQ398265__SS-prME
  source 1..9876: mol_type = other RNA
actgcgggaattataataatgatgatcccaacagtaatggcatttcacttaacaactaggaatggagaaccgcatatgatcgtatcacgtcaggaaaaaggtaaaagtcttctgtttaaaactgaaaacggagttaacatgtgcactttaatggcgatggatctaggagaattgtgtgaagacacgattacatataattgcccactattaagacaaaacgaacccgaagatatagattgctggtgcaattctacgagtacttgggtaacatatgggacatgcacagctaccggtgagcacagaagagagaaacgatcagtagctttagttccgcatgttgggatgggattagaaaccagaacagaaacttggatgtcgtcagagggagcatggaaacatgcacaacgtatagaaacatggattctgagacaccccgggttcacaataatggcagctatactagcatacacaataggtacaacttatttccaacgcgttctaatatttattttgctaaccgccgtgacgccttcaatggccatgaggtgtatcggtatttcaaatcgagactttgtagaaggagtcagtgggggttcatgggttgacattgtcttagagcatggaagctgcgttacgacgatggccaaaaacaaaccaacattggactttgaattgataaaaacagaggctaaacatccagcaactcttcgaaaatactgtgtagaagcaaaattaactaatacgaccaccgcaagccgttgcccaacacaaggagagcctagtttgaatgaagaacaggataaaagattcgtctgtaaacactctatggtagaccgtgggtggggcaacggatgtgggctgtttgggaaaggaggaatagttacctgcgcgatgtttacttgcaagaaaaatatggagggaaaagtggttcaacctgaaaacttagaatacactatcgttatcacaccacactctggagaagaaaatgctgtgggaaacgacacaggcaaacacgggaaagaaataaaagtgacaccccaatcatcaatcactgaagctgagctaactggttatggtactgtgacaatggaatgttcaccaagaacaggcttagacttcaatgaaatggtgctactacaaatggaaaacaaggcttggcttgtgcatagacaatggttccttgacttacccttaccttggctgccaggagcagatacccaaggttccaactggattcaaaaagaaacattagtgacgttcaaaaaccctcatgcaaagaaacaagatgtggtggtacttggaagccaggaaggagcgatgcatacagcgctgacgggagcgactgaaatacagatgagctccggaaatttgctatttacaggtcacctaaaatgtagactccgaatggataaattacaattaaaagggatgtcatattcaatgtgtacaggcaaattcaaagttgtaaaagaaatagctgaaacacaacatggaactatagtaatccgtgtgcaatatgagggtgacggatctccctgtaaaatcccctttgaaataatggatctagaaaaacgacatgttctaggaaggctaattactgttaaccctatagtgactgaaaaagacagcccagtcaatatcgaggctgaacctccctttggagatagttatataatcattggggtcgaacctgggcagctaaaactttcttggttcaagaaaggatcttcaattggacaaatgttcgaaactacaatgaggggtgcgaaacgaatggcgatactcggggataccgcatgggacttcggttcattaggcggagtctttacatcaataggtaaggctttacatcaagtattcggtgcaatctacggtgcagcatttagtggagtgagctggacaatgaaaatattaataggcgtcgtaattacctggataggtatgaactctagatctacaagcctatcagtcagccttgtgcttgttggtgtggtcactctttacctaggtgttatggtccaagcggattcagggtgtgtcgtttcctggaaaaacaaagaactcaaatgtggtagtggtatatttataacagacaacgttcatacatggacagaacaatacaaattccaacctgaatctccgagtaaactagcctcagctatacaaaaagctcacgaagaaggcatttgtggaataaggagtgttacacgtctcgaaaacttgatgtggaaacaaattactcccgaacttaatcatattttaactgaaaacgaggtcaaactaacaataatgacaggagatattaagggcatcatgcaagcaggaaaacgtagcttgagaccacaacctactgaattaaaatacagctggaaagcatgggggaaggccaaaatgttatcgacggaattacataaccatacttttctaattgacggaccagaaactgctgaatgcccaaacaccaatagggcttggaactccttagaggtggaggattatggtttcggtgtctttacaacgaacatatggttaaaactaaaagagaggcaagacgtcttttgtgattccaagctgatgagtgcagccataaaagataacagagcggtacatgctgatatgggatattggattgaatcagctttaaatgacacgtggaaaattgagaaggcatccttcatagaagtcaagagctgtcattggcctaaaagtcacacactttggtcaaatggtgtcttagaaagtgaaatgataataccaaagaatttcgcgggccctgtttctcaacacaattatcgcccgggttaccatacgcaaacagccggaccgtggcatcttggtcgactagaaatggacttcgatttttgcgaaggcacaacagtcgtggttacggaggactgtggaaaccggggtccttctctacgcactacaacagccagtggtaaattgattacagaatggtgctgtagatcatgcacgctaccacccttaagatataggggtgaggatggttgttggtacggtatggagatccggcctttaaaagagaaggaagagaaccttgtcaacagtttagtaactgcaggacacgggcagattgataacttctccctcggggtcctaggcatggcacttttcttagaagaaatgcttcgtacaagagttgggacaaagcacgccattttattagtagcggtaagttttgtgacattaattacaggcaacatgagtttccgagatttaggaagagtgatggtcatggtaggcgctacaatgacagatgatataggaatgggagtcacctaccttgcattgttagcagcgttcaaagttaggcccacatttgctgctggtctattacttagaaaattaacctccaaagaactaatgatgaccacgataggtatcgtcctgttatcgcagtctactattccagaatccatcctagaattaactgacgctctcgcgttgggcatgatggtactaaaaatcgtgaggaatatggaaaaatatcaactagctgtgacgatcatggcgatactctgcgtaccaaacgcagttatactccaaaacgcctggaaagtaagttgtacaacactagctgtcgtgtcagtatctccattattactgacttcttcgcaacaaaaagcagattggataccattagcactaactatcaaagggctgaaccccactgctatatttctaactacattatcccggaccaataaaaagcgaagttggccgctaaatgaggcaatcatggctgtaggtatggtaagtatactggcgagttctctacttaaaaatgatatcccaatgacaggccccctagtagcaggaggattgctcacagtgtgttacgtactaactggtagaagtgctgatttagagttggaaagagcagcagatgttagatgggaagaacaagctgaaatatcgggatcgtcaccaatactctcgattacaatatcagaagatgggtctatgtccatcaagaacgaggaggaagaacaaactttaactatattaatacgcacaggtttgttagtaatatcaggcttatttccagtttcgatacctataactgcagctgcgtggtacctttgggaggttaagaaacaaagagcaggagtgctatgggatgtcccgagtcccccacctgtgggaaaagccgaattagaagatggtgcgtatagaattaaacaaaaagggatcttaggttattctcaaataggggcaggcgtgtataaagagggaacctttcataccatgtggcatgttacaaggggagcagtactaatgcacaaaggaaaacgcattgaaccttcgtgggccgatgtcaagaaagatctgatttcatatggaggaggatggaaattagaaggggaatggaaagaaggcgaagaagtccaagtgttagcactagaaccagggaaaaatccaagggcagtgcaaaccaagccaggacttttcaaaacaaacacaggaaccataggtgcagtatcgctagactttagtccaggcacaagtggtagcccaatagtcgacaaaaagggaaaagtagtgggactttacggcaatggggtggtgacaaggtctggaacctacgtatcagcaatagcccagactgagaaaagtatcgaggataacccggaaattgaagatgacatttttcgtaagaaacggttaacgattatggatctgcacccgggcgcaggtaagactaagcgatatctccccgcaatcgtaagagaagcaattaagagagggcttagaacgttaattctagcaccaaccagggtcgtagcagctgaaatggaagaagcacttcgtgggttgcctattagatatcaaacgccagccatacgagcagaacacaccggaagggaaattgtcgatctgatgtgccatgcgaccttcactatgcgactgctatcaccaatacgtgttccaaactacaacctaatcattatggatgaagcacattttaccgaccctgcatcgatagctgcaaggggatatatttctacaagagtcgaaatgggcgaggcagcaggtatatttatgacagccacgcccccagggagtagagatccatttccccaaagcaacgcacccattatggacgaggagagggagattccagaacggtcttggaactctggacacgagtgggttaccgacttcaaagggaaaacagtatggttcgtaccaagcataaaggcaggaaatgatatagcagcatgcctacgtaaaaatggaaagaaggtgatacaactaagtcgcaaaacattcgatagcgagtatataaaaactcggactaatgactgggattttgtagttaccaccgacatatctgaaatgggagcaaactttaaagcagaacgagttatagatccacgaaggtgtatgaaacccgtgattctgacagatggagaagaaagagttatccttgcggggccaatgcccgttacccattctagcgcagcacaaaggagaggaagagtaggacgtaatccaaagaatgagaacgaccagtatatttatatgggggaaccactagagaatgacgaagattgtgcacattggaaagaagcaaaaatgttattagataatatcaacacacctgaagggataataccaagcatgttcgaacccgaaagagagaaagtagacgcgatcgatggcgaatatagattaagaggtgaagccagaaaaacatttgtagatctgatgaggagaggggatttgccagtctggctagcgtatagagtagctgctgaaggaattaattacgcggaccggcgatggtgctttgacggagttaaaaataatcaaatactcgaggaaaacgtagaagtagaaatatggacaaaagaaggggaacggaagaagttgaaaccgaggtggcttgatgcacgtatttacagcgacccgttggctttaaaagaatttaaagaatttgctgctggtagaaagagtttgaccctgaatctgataacagaaatgggaagattaccaacattcatgacacagaaagccaaaaatgcactcgacaacctcgcagtccttcataccgcagaagcaggcgggagagcatacaatcacgcgctatcagaacttcctgaaaccttagaaacccttttgctactaacattactagctactgttacgggcgggatatttttattcctaatgtctggtaaaggcataggtaagatgacacttgggatgtgctgcatcataacagccagcatcctgttatggtatgcgcaaatacagccacactggattgccgcaagtatcattttagagttctttttaatagtcttactcatacctgaacccgaaaaacaaaggacaccgcaagacaaccaacttacatacgtcgtaatagctattctaacagtagtcgcagcaacaatggctaatgaaatgggatttctcgaaaagacgaagaaagactttgggttaggatctatcacaacccaacagccagaatccaatatattagacatagacttacgtcctgccagcgcctggaccctatacgcagtcgcgacaacattcataaccccaatgttaagacatagtatagagaatagtagtgttaacgttagtctcacggctatagccaatcaggcaacagtattgatgggacttgggaagggttggccgttatctaaaatggacattggagttccgttactagcaatagggtgttattctcaagtaaatccgataactttaacagcggcgcttctactattagtagcacactacgctatcataggtccaggccttcaggcgaaagctacaagggaagcacaaaaacgagccgcagcaggtattatgaagaacccaacagtagacggaatgacagtaatagatctagatccgatcccatatgatccaaaatttgagaaacaacttggacaagtgatgttattagttctttgtgtaacacaagttttgatgatgcgaaccacatgggctctctgtgaggcgctgacgttagccactgggcccattagcactttatgggagggtaacccaggtagattttggaatacaaccattgccgtatcgatggccaatattttccgaggctcatacctggcgggtgcaggactgctattttctataatgaaaaatacagcaaacactagaagagggacaggcaatacaggagaaacattaggggaaaaatggaaaaacagattaaatgccttgggtaagagtgagttccaaatctacaagaaatccggcatacaagaagtggacagaacactagctaaagaaggaattaaaaggggcgaaaccgaccatcacgcggtaagtaggggatctgctaaattgcggtggtttgtcgagaggaatttagtaacaccagaaggtaaagtcgtagatttaggttgtgggagaggcggctggtcctattactgtggtgggcttaaaaacgtcaaagaagtaaaaggattaacaaaaggaggtcccggacacgaagaacccattcctatgtctacgtatggttggaacctggtaaggctacaatcaggcgtcgatgtattcttcactcccccagaaaaatgtgatacccttctatgtgacataggtgaatcgagcccaaaccccaccgtagaagctggaaggactttacgcgtattaaacttggtagaaaattggctgaataacaatacgcagttctgcataaaggtactaaacccttacatgccaagcgtgattgagaaaatggaagcattgcaaaggaaatatggaggggcattagtcagaaaccccttgtcaagaaattccacccatgaaatgtactgggtttcgaatgcttctgggaacatcgtaagttcagtcaatatgatatcgcgcatgctcattaatcgtttcaccatgagacataagaaagcgacctatgagccagacgtggatttaggatccggcacgaggaacattggaatagagagtgaaaccccgaatcttgatataattgggaagaggatagagaagatcaagcaagagcatgaaacttcatggcactatgaccaagaccacccatacaaaacatgggcctaccatggaagttatgaaacaaaacaaacagggagcgcaagttccatggtaaatggggtcgttcggttgctaacaaaaccatgggatgtaataccaatggttactcaaatggctatgacagataccacacctttcgggcaacagcgagtattcaaagaaaaagtagatactcgaactcaagaaccaaaagagggcactaagaaactaatgaaaataacagcagagtggctgtggaaggaactcggtaagaagaaaacacctcgcatgtgcacacgcgaggagtttaccaggaaggtacgatcaaatgcagctttaggagcaattttcacagacgaaaataaatggaagtctgccagagaagcagtcgaagattcgggattctgggaacttgttgataaagaacgtaacttacatttagaaggcaagtgtgagacttgtgtgtataatatgatggggaaacgcgagaagaaattaggagagttcggcaaggccaagggtagtcgagctatttggtatatgtggttaggtgctcgattcttagaatttgaagccttaggttttcttaacgaagatcactggtttagtcgagaaaatagcttaagtggtgtggaaggggaaggcttgcataaactaggctatatattaagagacgtcagcaagaaagaaggtggtgctatgtacgcggacgatacggcaggatgggatacaaggatcacgttagaagacctcaaaaatgaagaaatggtaactaaccacatggaaggagaacataagaaattagcagaagctatatttaaacttacttatcagaataaagttgtgcgagtgcaacgccctacacccagaggaacagtcatggatatcataagtcgtagggatcaaagaggctcaggtcaagtggttacttacgggttaaatacattcactaacatggaagctcaactcattaggcaaatggaaggcgaaggcgtctttaagtcaatccaacaacttacagtaaaagaggaaatcgcggttaaaaactggttaatacgcgttggaagagaacgattatcacgaatggcaatatcaggagacgattgcgttgttaaacctttagatgaccgattcgcatcagcgcttacagccttgaacgacatgggaaaagtgaggaaagatatccaacaatgggaaccatcaagaggctggaacgattggacgcaagtccccttctgctcacatcattttcacgagttaataatgaaagatggtagagttcttgtagtcccatgtcgaaaccaagacgaactcataggcagagcgaggatctcccaaggtgcaggatggagtctacgcgaaacggcgtgccttggaaagtcgtacgctcaaatgtggtcattaatgtatttccaccgaagagacctgcgtttggcagctaacgctatatgttcagcagtcccatcgcactgggttcccacaagccgaacgacatggagcattcacgcgactcacgagtggatgacaacagaggacatgctaactgtatggaatcgtgtatggattcaagaaaatccttggatggaggataaaacacctgttgagagctgggaagaaataccctatcttggaaaacgcgaagatcaatggtgtggcagtctcataggattgacgagcagagcgacctgggccaaaaacatccagacggctattaatcaggtcagatcacttataggaaatgaagaatacacggactatatgccatccatgaaaagattccgaagggaggaagaagaagcaggagtactttggtga

SEQ ID NO: 22931 - RNA, 9876 nt, synthetic construct
  misc_feature 1..9876: note = derived and/or modified CDS sequence (opt6) from DENV-2__KX702403__SS-prME
  source 1..9876: mol_type = other RNA
acagctggtgtgatagtaatgcttatacccactgcaatggcattccacctcactacacgaaacggagaaccccatatgatagttggacgacaggaaaaaggaaaatcattactattcaaaacagaagacggagtcaacatgtgtaccttaatggctatagatcttggggaattatgtgaagatacaataacatacaaatgcccattattacgccaaaatgaacctgaggacattgactgttggtgtaattcaacaagtacatgggtaacgtacggaacctgtaccactactggcgaacatcggagagaaaaacgttctgtagctctcgttccacatgtcggcatggggctagaaacacgtacagaaacctggatgtcgagcgaaggggcttggaaacacgtccaacgaatagaaacgtggatacttaggcacccaggttttacaattatggctgcgatactggcgtatactattgggacaactcactttcagagagcattgatacttatcttattgaccgcagtcgctccttcaatgacgatgcgatgtatcggcataagcaaccgagactttgtagaaggagtttccgggggttcatgggttgatatagtactggaacacggctcgtgcgtaactacgatggctaaaaacaaacctactctagatttcgaacttataaaaacggaagccaaacaaccggcaactctacgtaaatactgtattgaggcaaaattaacaaatactacaacagaaagtaggtgtcccacacagggagagccgtctctaaatgaagaacaagacaaaagattcatttgtaaacattccatggtagataggggatggggcaatggttgcggtctattcggaaaaggaggtattgtaacttgtgcaatgtttacgtgtaagaaaaatatggagggcaaaatagttcagccagaaaaccttgagtatactattgttataacaccacatagcggcgaagaacatgcggtgggtaatgacactggaaaacatggcaaagagataaaaattacacctcaatcatctactacagaggctgaactaacaggatatggaactgttactatggaatgttccccaagaacgggattagactttaacgagatggtattattgcaaatggaagataaagcatggctggtacacaggcaatggttccttgatctaccgttgccatggctaccaggtgccgatacccagggaagcaactggatacaaaaagaaactctcgtaacttttaaaaacccccacgccaagaaacaggatgtagtcgtcttgggcagtcaggaaggtgctatgcatacagcgctgacaggagcgactgaaatacaaatgagctccggtaatttactttttacgggacatctcaaatgtagattgaggatggataaattacaactcaaagggatgtcctattccatgtgcaccggaaaatttaaaatagttaaagaaattgcagaaacccaacatggtaccattgtaattagagtacaatacgaaggggatggtagcccatgcaaaattcctttcgagatcactgatttagagaaacgacatgttctaggtaggttgataacggtaaaccctatagtaacagaaaaagattctcctgtgaatatagaagcagaacctccctttggtgactcctatataattgtgggtgttgaacctggacagttaaaattaaactggttcaagaaagggagcagcatcggacaaatgtttgagaccacgatgagaggggcaaaacgcatggcgatccttggcgacacagcctgggactttgggtctctaggtggagtttttacaagcataggaaaggctttacatcaagtatttggcgccatatatggagccgcattttcaggagtgtcgtggaccatgaaaatcttaataggagtgataattacgtggatcggaatgaactcacgatctacaagccttagcgtatccttagtactggttggggtagtgactttatatctaggtgctatggtgcaagccgattcgggttgcatagttagctggaagaacaaggagttgaagtgcggtagtgggattttcataacagataacgttcacacatggactgaacaatataagtttcaacccgaaagtcccagtaaattagcatccgcaatacaaaaggcccatgaagagggaatctgcggaataagatctgttactaggttggaaaacttgatgtggaagcaaataaccccggaattaaaccatatactcagtgaaaatgaggtaaagctaacgattatgacgggagatatcaagggaataatgcaagcaggcaaaagaagtttacggccacagccgacagaactcaagtattcttggaagacatggggtaaagctaagatgctgagtacagaatctcataatcaaactttcttgatagatgggccggaaaccgcagaatgtccaaacacaaatagagcgtggaactctcttgaggtagaagattatggcttcggggtattcacaacaaacatctggcttaaattaagagagaagcaagacgtattctgtgatagtaaattaatgagtgccgcaataaaggacaatagggcagtccatgcagacatgggatattggatagagtcagccctgaatgatacatggaaaatggagaaagcatctttcatagaagttaaaagctgccactggccgaaatcacatactctatggagcaatggagtattagaatcggagatgattatacctaagaattttgcagggccggtatcacaacacaattaccgtccgggatatcatacgcaaactgcaggcccctggcacctaggcaaattggaaatggatttcgatttttgcgaaggtacaactgtcgtagtaacggaggattgtgaaaagcgtgggccgtcgttacgaacaacaactgcttcaggcaagttaataacagaatggtgttgtaggagctgtactttacctccattgagatacagaggcgaagacgggtgttggtacggaatggaaatacggccactaaaagaaaaagaagagaacttagtaaatagcttagtaactgctgggcatgggcaaatagataattttagtctaggcgtacttggaatggcactatttctggaggagatgcttagaaccagagtcgggacaaaacacgcgatactcttagttgcattatcatttgtaacattgataacaggaaatatgagcttcagagatctaggacgggtgatggtaatggtgggagccactatgacagacgatattgggatgggagtcacttacttagcattactagctgctttcaaagttcgcccaacttttgcagcaggcttactccttagaaaactgacttctaaggaattaatgatggcaactatcggtatcgccttattaagtcaaagcacattaccagaaaccattttagaattaactgatgcgctcgcattaggaatgatggcactcaaaatagtacgaaatatggagaaataccaattagcagtaaccattatggctatatcttgcgtcccaaatgctgtaatattacagaatgcatggaaggttagctgtacaatccttgccgcagtctcggtatctcctttgttgttaacgagctctcaacaaaaagcagattggattccattggcgttgactataaaaggattaaaccctactgccatatttctaactacgttatctcgtacgagcaagaaacgatcatggccattaaatgaggcgatcatggcggttggaatggtgagtattttggccagtagccttttgaaaaatgatatacccatgactggacctctagtagcaggaggtctactaacagtgtgctatgtactcactgggagaagcgcagacctagagttggagagggcggcagacgttaaatgggaagatcaggcagaaattagcggcagttcacctatactgagcataaccatatcagaggacggtagtatgtcaatcaaaaatgaagaagaggaacaaacgttaacaattcttattaggacaggtttattagtaatctccggagttttccccgtatccatacccataacagcagcagcctggtatctttgggaagttaagaaacagcgagccggtgtcctttgggatgtaccaagtccaccgccagtaggcaaagcagagttagaagacggggcatacagaataaaacaaagaggtatacttgggtactcacaaataggcgcaggagtgtacaaagaggggacattccacacgatgtggcacgttactcgaggagcggtacttatgcatcgcggaaagcgcattgagcctagctgggcagacgtaaagaaagatttaatatcatatggcggaggttggaaacttgaaggtgaatggaaagaaggcgaagaggtgcaagttttagctctagaacctggcaaaaatcctcgcgccgtacaaacaaaaccaggaatatttaaaacaaacacaggaacaataggtgcggtatccttggatttttcacctgggacatcaggttccccaatagtcgatagaaaaggaaaagtggttggcttgtatggtaacggcgttgtgactcgatccggagcctacgtatctgcaatagcgcagaccgaaaaatcaattgaagataatcccgaaatcgaggatgatatctttagaaagaaaagacttaccattatggatctccacccaggcgctggcaaaaccaaaagataccttcccgcaattgtaagggaagccataaaaagaggactccgtacgctgattttagctcctacgagagttgtggctgctgaaatggaggaagcacttaggggactaccaattagataccaaacgccggcaatacgtgcagagcatactggaagagaaatagttgatttaatgtgccatgctacctttacaatgcgcttactatccccagtaagagtcccgaattataatttaataatcatggatgaagctcattttacagacccagcttcaatcgctgcaaggggatacattagcacaagggtcgaaatgggagaagcagcaggaatattcatgacggctacccctccgggctccagggacccgttcccccaatcaaatgcaccaattatggacgaagaaagagagattccggaacgctcatggaactcaggtcacgaatgggttacggattttaaaggaaagactgtatggtttgtaccgtcaatcaaagcaggaaatgatattgccgcgtgtttaaggaaaaatggcaaaaaggtaattcaattaagcagaaaaacattcgattcggagtatgtcaaaacaagggcaaacgactgggacttcgtagtaacaactgatataagcgaaatgggagctaatttcaaggcggaacgcgtgatcgaccctcgaagatgtatgaagccagtaattctaaccgatggtgaagaacgtgttatccttgcgggacctatgccagtgactcactcaagcgctgctcaacgacgtgggcgaataggtaggaatcccaaaaatgaaaatgatcaatatatatacatgggcgagccgcttgaaaacgacgaagactgcgcccattggaaagaagcgaaaatgctattagataatattaatactccggaaggtataattccatcgatgtttgaaccggaaagggaaaaagtggacgccatagacggagagtatcgcctaagaggagaagcaaggaaaacatttgtcgatctaatgagaaggggcgatttacctgtatggcttgcatataaggttgctgccgaaggcataaactacgctgataggaaatggtgtttcgacggcattaaaaataatcaaatacttgaagaaaacgtagaagtagaaatatggacaaaggaaggagaaagaaagaaattaaaaccccgttggttggatgcaagaatatatagcgaccctctcgcattaaaagagttcaaagaatttgcagccggccgaaagtcgttgacattaaatttgataacagagatgggaagactaccgacttttatgacgcagaaagcaagaaatgctctggataacctcgccgtactgcacacagctgaagtgggaggcaaggcatacacgcacgccctttctgaattgccagagactctagaaacactattactacttacattattagctgctgtaacgggcggtatcttcttatttcttatgtccggcaagggtattgggaaaatgacccttggtatgtgctgtattatcacagcatcgattcttttatggtacgcacaaattcaaccacattggatagcagctagcataattctagagttctttctgattgtactacttattccagaacccgaaaaacaaaggaccccgcaagataatcagcttacctacgtcgtaatagcaatattaacagtagtagccgcaacaatggcgaacgagatgggtttcctcgagaagacaaagaaagacctaggatttggcagcataacaacacaggaaagcgaaagtaatattctagacattgacttacgtccggcatccgcatggactctatatgccgtagcaacaactttcgtgacgcctatgttacgccacagtatagaaaattcaagcgtgaacgtctctctcacagcaatcgcgaaccaagcaacagtacttatgggattgggtaaaggatggcccttgtcgaagatggacatcggcgtaccgctactggccataggttgctacagtcaggtaaacccaatcacgctaactgcagcgttattattattagtagctcattacgccattataggtccaggattgcaagcgaaggcaacaagagaagcacagaaaagagctgcagccggaataatgaagaatccaacagttgatgggataactgtaatagacctagaacctatcccgcatgatccgaaattcgaaaaacaactaggccaagtaatgctcttaatactatgcgttacacaagtactaatgatgcggacaacgtgggcactatgcgaggctctaacactagcaactggtccaatatctactctgtgggagggcaaccccggcaggttctggaacaccactatagcagtaagcatggctaatatatttcgaggttcttatttagcaggagcaggtctactattttccataatgaagaacacaacaaatacaagacgaggcactggaaacgttggtgaaacattgggtgaaaaatggaagtctcgtttaaatgcattaggtaaatccgagttccaaatatataagaaatcaggtatccaagaagtagatcgaacattagcgaaagaaggtataaaacgaggagaaaccgatcatcacgcagtgtctcgcgggagcgcgaaattaaggtggtttgtcgaacgaaacatggtcacacctgaaggtaaagtagtagacctcggttgtggaagaggaggatggagctattactgtggaggcttaaagaatgtccgagaagtgaaaggtcttacaaaaggaggccccggtcatgaagaacccatacccatgtcgacgtatggttggaatctagttcggctacagtcaggtgtagatgtattctttactccgccagaaaaatgcgatacattattatgtgatatcggagaatcaagtcctaatccaaccatcgaagccggacgcactttgagggttctgaatcttgtagaaaactggctgaataacaacacacaattttgtattaaagttttaaacccctacatgccgtctgtgattgagaaaatggagacattgcaacgaaaatatggcggtgccctagtacggaaccctttatcgcgaaattcaacacatgagatgtactgggtaagcaacgcaactggaaacatcgtgtcctcagtaaatatgatatcgagaatgttaataaacaggtttacgatgaaacacaagaaggctacgtatgaaccggacgtagatctcggatcgggtacacgaaatataggcattgaatcggagacaccaaatcttgacataatcggcaaacgaatagagaaaataaaacaagagcatgaaacgtcctggcattatgatcaggatcacccgtataaaacatgggcatatcacggatcatatgaaacgaaacaaacaggtagtgcatcatccatggtaaatggtgtagttcgactattaaccaaaccttgggacgttgtacccatggttacacagatggctatgactgacacaactccattcggacaacaaagagtgttcaaagaaaaggtcgacacgagaacccaagaaccaaaagagggcacaaagaaactaatgaaaataaccgcagagtggttatggaaagaattaggcaaagagaagacacctcgaatgtgtacgagagaagaatttactcgcaaagtaagaagtaatgcagctttaggagcggtatttaccgatgaaaataagtggaaaagtgccagagaggccgtagaagatggaagattctgggaactggtggatcgagagcgaaatttacatttagaaggtaaatgcgaaacctgcgtatataatatgatgggcaagcgagaaaagaaacttggcgaatttggtaaggcaaaaggtagccgagcgatatggtacatgtggctaggtgctagattcctagaatttgaagcactaggtttcttaaacgaagaccactggtttagcaggggtaattccctgtcaggagtagaaggagaaggtctccaccgtctgggatatattctacgtgaggtagggaagaaagaaggtggtgcaatgtacgctgacgacaccgcaggttgggatacaagaatcactctagaagaccttaaaaatgaagaaatggtcacaaaccacatgaaaggtgaacacaagaaactcgcggaggcaatcttcaaattaacttatcaaaacaaagtagtacgagtacaaagacctacaccaagaggtactgtaatggacataatctccagaaaggatcagcggggttctgggcaagtaggaacgtatgggttaaacaccttcactaatatggaagcacaattgataaggcagatggaaggtgagggaatattcaagagtattcagcaccttacggcaactgaagaaactgcagtccaaaactggttagcaagagtgggtcgagaacggttatcaagaatggcaatatctggtgatgattgtgtagttaagccaatagatgatagatttgcatccgcgctaacggcactcaacgacatgggaaaagtacgcaaagatatacaacaatgggaaccttccagaggatggaacgattggacgcaagtaccattttgttcacaccattttcacgagctagtaatgaaagatggcagggtattagtcgtaccatgtagaaatcaagacgagctaataggacgagcgagaatttcccaaggagcagggtggtcccttaaggagaccgcctgccttggcaaaagctacgcacaaatgtggacgttgatgtattttcaccgaagagatttaaggctagctgcaaatgctatttgctctgcggtaccctcccactgggtccccacaagtagaaccacatggtctattcacgccaaacatgaatggatgacaaccgaagatatgctagctgtgtggaaccgagtatggattcaagaaaacccatggatggaagataaaacgccggtggaatcgtgggaagaagttccctatcttggaaaaagggaggaccaatggtgtggaagcctcataggactaacaagtagggccacctgggcgaaaaacatccaaacagcaataaaccaagtccgaagcctgataggcaatgaaggatatacagattatatgccatcaatgaagagattcaggagagaggaagaagaagccggagtactgtggtaa

SEQ ID NO: 22932 - RNA, 9876 nt, synthetic construct
  misc_feature 1..9876: note = derived and/or modified CDS sequence (opt6) from DENV-2__KX702404__SS-prME
  source 1..9876: mol_type = other RNA
actgcaggagttatagttatgctgataccaacagctatggcatttcatctaacaactcgtaatggtgaaccccatatgatagtgggaaggcaggaaaaaggtaaaagtttattatttaaaactgaagatggagtaaatatgtgtactttaatggcaattgacttaggtgaactttgcgaagacaccataacatataaatgccctttactacgtcaaaatgaaccagaagatattgactgctggtgtaacagtacaagcacctgggtaacatacgggacttgtactacaactggagaacatcgcagggaaaaacggagcgtagctttagtcccacatgttggaatgggtcttgaaaccaggactgaaacatggatgagtagtgaaggagcatggaagcacgtacaaaggatagaaacctggatactgcgacatccaggatttacgataatggctgcaatacttgcttatactatcggtacaactcattttcaacgcgcattaatctttattttgttaactgccgtcgctccatcaatgaccatgagatgtataggaatatcaaatagagacttcgtagaaggagtctcgggaggtagttgggtggatatcgtactagaacatggtagttgcgtcactacaatggctaaaaataaaccaaccctagatttcgaactaatcaaaaccgaagccaaacaacctgctaccctaagaaaatactgtatagaagctaagttaactaataccactacagaatcccgttgccccacacaaggagaaccttctctaaacgaggaacaagataaaagattcatttgcaagcattccatggttgacagaggatggggaaatggatgcggattatttggtaaaggaggaatagtaacttgtgcgatgtttacatgtaagaagaatatggagggaaaagtcgtccaaccggaaaatttggaatatacaatcgtaattactccacatagtggagaagaacacgccgtgggaaacgatacgggaaaacacgggaaagaaatcaaaatcacacctcaaagctctacgacggaggccgaactaactggttatggcacggtgacaatggagtgtagcccaagaacgggtctggactttaatgaaatggtattactgcaaatggaagacaaggcatggttggtgcatagacaatggtttttggaccttcctttaccttggctgccgggggcagatacgcagggaagtaactggattcaaaaagaaacacttgttacatttaagaatccgcacgcaaagaagcaagacgtcgttgtgctaggttctcaagaaggggccatgcacacggccttaacgggagcaactgaaatacaaatgtccagcggaaacttgctattcacaggacacttaaaatgtcggttgagaatggacaaattacaactgaaggggatgagctattcaatgtgtacaggtaagtttaaagtcgtaaaagaaatagccgagacacaacatgggacaatcgtaatacgagtgcaatatgaaggtgacggtagcccatgtaagattccatttgagattacagacctcgaaaagcgacacgtactagggcgactaataacagttaatcccattgtaacggaaaaagactcgcctgttaacatagaggcggaacctccatttggagattcatacataattgtaggagtcgaaccaggacaactcaaacttaactggtttaagaaaggatctagtatcggacaaatgttcgaaacaactatgagaggcgccaaacgaatggctatattgggagacactgcttgggacttcgggtcacttggcggagtctttacatctatcggaaaagcattacatcaggtattcggagctatttatggagcagcattttctggtgtatcatggaccatgaaaattctaattggtgtaataattacttggattggaatgaactcaagaagcacctctttgagtgtttctctagtcttggtaggcgtggtaacgctatatttgggagccatggttcaagccgattctgggtgtgtagtatcatggaaaaacaaagaattaaaatgcggctcggggatatttataacggataacgtacacacttggacagaacagtataaatttcagcctgaatcacctagtaaattagctagtgcaatacagaaagcacatgaggaagggatctgcggaatacgatcagtcacaagactagagaacttaatgtggaagcaaattacgccagaactaaaccacatattatcggaaaatgagataaagttaacgatcatgacaggggatataaaaggcataatgcaagcaggaaaacgatcattacgaccacaacctacagaattgaaatacagttggaaaacctggggtaaagctaaaatgttgagcacagaatcacataaccagactttcttaatagatggtccagaaacagcagagtgtcctaatacgaaccgtgcttggaatagtctagaagtcgaggactacggattcggggtattcactactaatatatggctgaaactgagggaaaaacaggatgtattttgcgattcaaaattaatgtctgccgctattaaagacaatagggcagttcatgctgatatgggatattggattgaatctgcgttaaatgacacatggaaaatggaaaaagccagctttatagaggtgaagagttgccactggccaaagtcccacacattgtggtcaaatggcgtcctagaatctgaaatgataattcccaaaaattttgcaggaccggtctcgcagcataattatagacccgggtaccacacacaaaccgcaggaccatggcatctcggtaaactcgaaatggactttgatttttgtgagggcacaacagtagttgtcacagaagattgtggtaatagaggtccgagcctcagaacgacgacagcgtcgggtaaattgatcacagaatggtgctgtaggtcatgtacgttaccacctttacggtacaggggagaagatggatgttggtatggaatggaaatcagacccctaaaagaaaaggaagagaacctagttaactccctcgttacagcaggtcacggtcaaatcgataacttttctttaggagtcttaggtatggccttgtttcttgaggagatgctaagaacccgtgtaggtactaaacatgctatcttacttgtagcattgtcctttgtaactttaattacaggaaatatgtccttcagagatcttggtagggtcatggtcatggtaggggcaacgatgacagatgatattgggatgggtgtcacatatctggccctattagcagcatttaaagtacgtccaactttcgcggcgggacttctgctaagaaaactaacaagcaaagaacttatgatggctacgatcggaattgctttattgtcgcaatcgacacttccagaaacgattttagaactaactgatgcattggcactaggaatgatggcacttaaaattgtccgtaacatggagaagtatcaattagcagttacaatcatggctatttcgtgtgtcccaaatgcagtaattctacaaaacgcgtggaaggtatcatgtacgattctagccgcggttagcgtgagcccattattacttacgtcttcacaacagaaagccgattggatacccttagcactaaccatcaaagggctcaatccaacagcaatatttctcacaacactctcccgtacatcaaagaagcgcagctggccgttaaatgaagcaatcatggccgtcggaatggtgagcattttagctagcagcttactcaaaaatgacatacccatgaccgggccacttgtagccggcggattactaacagtttgttacgttctaacaggaagaagcgcagatttagaactagaaagggccgcagatgtcaaatgggaggatcaggccgaaattagcggatcttcccctattttgtccatcactatatctgaagacgggtcaatgtcaatcaaaaatgaagaagaggaacagaccctaacaattctaataagaaccggcttgttagtgatttcaggagtgttccccgtcagcataccaattaccgccgccgcatggtacttatgggaagttaagaagcaaagagctggagtgttatgggacgttccttcacctcctccagtcgaaaaagctgaattagaagacggtgcttacagaattaaacaacgtggcattttaggatacagtcaaataggtgcaggagtgtataaagaaggcactttccatacaatgtggcatgtaacacgaggtgcagtactgatgcatcgcggaaaaagaattgaaccgtcatgggccgatgttaaaaaggacctcatcagctacggtggtggctggaagttagagggggaatggaaagaaggggaagaagtgcaagtgttagcccttgagccaggcaaaaaccctagagcagtacaaacaaaaccaggaatattcaaaactaatacaggaacgataggcgcggtctctttggatttttctcccggaacaagtggcagtcccatcgtagacagaaaaggcaaagtagtaggactttacggcaacggagtagttactagaagtggggcatacgtatctgccatcgctcaaacggagaagtctatagaagacaatcctgagatagaagacgacatttttaggaagaaacgattaactattatggacttacatccaggagctgggaaaaccaagcgttacctaccagccatagtccgagaggctattaagagaggcttgcgaacattaatactagctcctacaagggtcgtagcggcagaaatggaggaagctctcagaggattgccaattagatatcaaactccggccataagagccgagcacacagggagagagatagttgatctaatgtgtcatgcgacgtttaccatgagattactctccccagtcagggtaccaaactataacctcatcatcatggacgaagcccactttacggacccagcctcgattgccgctcgaggatacataagtacccgggttgaaatgggggaggcagcaggcatattcatgacagcaacaccgccaggaagtagagacccgttcccgcaaagcaatgctcccattatggatgaggaaagagaaattcccgaaagatcatggaactctgggcatgaatgggtaacagatttcaagggtaaaactgtttggtttgtgccttcgatcaaagctggaaatgatatagctgcatgtttaaggaaaaacggcaagaaagtcatccaactatcaagaaagacatttgactcggaatatgtaaaaactcgtgctaatgattgggattttgtggtaacgactgacatctctgaaatgggtgctaacttcaaggcagaaagagttatagacccaagaagatgtatgaaacctgtgattttaacagatggagaagaacgagtaatattagccgggccaatgcctgttactcattcgtctgccgcgcaacggaggggaagaataggtcggaatcccaaaaatgaaaatgaccaatatatatatatgggtgaacctctggagaatgacgaagactgcgcgcactggaaggaagctaaaatgctattagataatatcaatacacctgaaggcataatcccgagcatgtttgaacctgaacgagaaaaagtggatgccatagatggcgaatatcgccttcgaggtgaggctagaaaaacgtttgtagacttgatgcgcagaggagatttgccagtctggcttgcatacaaagttgctgctgaaggtatcaactatgctgatagaaaatggtgtttcgatggcattaaaaataaccagatactggaggagaacgtagaagtagaaatatggacgaaggaaggagaacgcaagaagttaaaaccgcggtggctggacgcacgaatatatagtgatccattggccctaaaagaatttaaagagtttgctgcgggaagaaagagcttaactttaaacttaataaccgagatgggaaggttgcccaccttcatgactcaaaaagcacgaaatgcactggacaatctagcagtattgcacaccgctgaagttggtggaaaggcatacacacacgccttatcagaattaccagaaacgttagaaactctgttattattaaccttattggccgcagttacagggggaatattcctatttctaatgtcaggaaaaggaatagggaagatgaccctcggcatgtgttgcataattacagcgtctatcttactttggtacgctcagatacaaccgcattggatagcagcaagcataatacttgagttctttcttatcgttttattaataccagaaccagaaaaacaaaggactccacaggataaccaactcacatatgtggttattgcaatactgacagtagtagcagcaaccatggcaaatgaaatgggtttccttgagaaaacaaagaaagatcttggttttggctccataacaactcaagaaagtgagagtaatatattggacatagatcttaggccagcctcggcatggaccttgtacgctgtagcaacaactttcgtcaccccgatgctacgccactcaatagaaaacagcagtgtgaacgtcagcttaaccgcgattgctaaccaggctactgtccttatgggtctcgggaaagggtggcccctgtcaaaaatggacataggggtaccactattggcaattggctgttatagccaagtgaaccctattaccttaacggctgctctactattacttgttgcacactatgcgatcattggtcctggattacaagcaaaagcaacaagagaggcccagaaaagagcagctgccggaattatgaaaaatccaacagttgatgggatcacggtgatagatttggaacctattccatacgaccctaaattcgaaaaacaactggggcaagttatgttattgattctatgcgtaactcaagttttaatgatgcgaacaacttgggcattgtgtgaggctttaacccttgcaaccggacctatctcaacactgtgggaaggtaacccaggtcgattttggaatacgactatagctgtgtctatggcgaacatcttccgaggatcgtacctagccggagctggattactgtttagtattatgaagaatacgactaacacaagaagaggaacagggaacgttggagaaacactaggcgaaaaatggaaatcgagattaaatgcactaggaaaatcggagttccaaatttacaaaaagagtggcattcaagaagttgacaggactctagcaaaagaagggataaaaagaggagaaacggatcaccatgcagtaagtaggggctctgcaaaattacgatggttcgtagaacgtaatatggttactccggaaggtaaggtagtagaccttggatgtggaagaggtggatggagttactactgtggaggcttgaaaaacgttagagaagtcaaaggcttaactaaaggaggacccggccacgaagaaccgatcccaatgagcacttatggctggaacttggttaggctacaatctggtgtggatgtattcttcacaccacccgaaaaatgtgatacactattatgcgacataggtgaaagcagcccaaatccaactatcgaggccggaagaacacttagagtcttaaacttagtagaaaattggttaaacaataacacccaattttgcataaaagtgcttaatccatacatgccttcggtaatagagaaaatggagacccttcaacgaaaatatggaggcgcgttagttcgaaaccctttatcaagaaactcgacacatgagatgtactgggtgagcaatgcaacaggcaacatcgtaagtagcgttaacatgattagccgaatgcttataaatcgctttactatgaagcataagaaggccacctatgaaccagatgtcgacttagggtccgggaccagaaatatcgggattgaatcagaaataccgaacctcgacatagttggaaaacgaatagagaaaattaaacaagaacatgaaaccagctggcattacgaccaagatcatccatataaaacatgggcataccatggcagttacgaaactaaacagacaggatctgccagctcaatggttaatggagttgtaagactactaactaaaccatgggatgtcgttccaatggtcacccagatggcgatgactgatactacaccattcgggcaacaaagagtattcaaagaaaaggtggacaccagaacacaggaaccaaaagaaggaacaaagaaacttatgaaaataactgctgaatggttgtggaaagagctaggtaaagaaaagacgccaagaatgtgtacaagagaagagtttacacgaaaagttagaagtaacgcagcactgggagccgtctttaccaatgaaaataaatggaaatcagcacgggaggctgtagaagacggacgtttttgggaattagttgatagagagagaaacctccacttagaaggtaaatgcgaaacatgtgtatacaatatgatgggaaaaagggagaagaaattaggtgaatttggaaaagcgaaaggttcacgcgccatatggtacatgtggttaggggcaagatttttagaatttgaggcacttggatttcttaatgaagatcactggtttagcagaggaaatagcttgagcggagtggaaggggagggcctacacagactcggctacattctaagggaagtcggcaaaaaggaaggcggcgcgatgtacgctgatgacaccgctggttgggataccagaataacgttagaagacctcaaaaatgaagagatggtcacaaaccatatgaaaggtgagcacaagaaattagccgaggccatatttaagttgacttatcaaaataaggtcgtaagagtacagagaccaacacctagaggaaccgtcatggatataatatcaagaaaggatcaacgtggaagtggtcaggtaggaacgtacggattgaatacctttacaaatatggaagcgcaactaattcgacaaatggagggtgaaggaatttttaaatccatacaacatttaacagcaaccgaagaaatagccgtgcaaaattggttggcgagagtaggtagagaaaggttatcaagaatggctatcagcggagacgattgcgttgttaagcccatagatgacaggttcgcgtctgctttaactgccttaaatgatatgggtaaggtacgcaaagatatacagcaatgggagccgtcacgaggctggaatgattggacacaagtcccattctgctcacatcattttcatgagctagttatgaaggatgggcgcgtcttagtcgttccatgtagaaaccaggatgaattgataggcagagcgagaataagtcaaggtgcaggatggagtctgaaagagacagcttgtcttggcaaatcgtatgcacaaatgtggacacttatgtactttcatcgtagggatcttcgactagctgcaaatgctatatgcagtgcagtaccaagccattgggtaccgaccagtagaacaacgtggtcaattcacgccaaacacgagtggatgacgactgaagacatgttagcagtttggaatcgtgtttggatacaagaaaacccctggatggaggataaaactcctgtagagtcttgggaagaagttccatatttgggtaaaagagaagaccaatggtgcggatctttaatcggactaacctcccgagcgacgtgggccaaaaatattcagacggcaataaatcaggttcgttcgttgataggaaatgaaggttataccgactacatgccaagtatgaaacgttttagaagagaggaggaagaagctggagtactctggtaa

SEQ ID NO: 22933 - RNA, 9873 nt, synthetic construct
  misc_feature 1..9873: note = derived and/or modified CDS sequence (opt6) from DENV-2__JQ686088__SS-prME
  source 1..9873: mol_type = other RNA
actactgggatgataattatgctaataccgacggtgatggcctttcatctaacgacaagaaacggagagcctcacatgatagtcagtcgccaggataaaggaaagtcacttttatttaagacaaaagatggaactaacatgtgtaccctcatggctatggatctgggagaactatgtgaagacacaataacatacaagtgtccatttttaaaacaaaatgaacctgaggacatagactgctggtgtaattctacatcaacgtgggttacatatggcacatgtacgacgactggagaacatagaagagaaaagagatccgtggcactagtcccacatgttggcatgggactcgaaactaggacagaaacttggatgtcttcggaaggtgcatggaaacatgctcaacgaatagaaacatggatactacgacatccggggtttacgataatggctgcaatattagcatataccataggtacaacgcacttccaacgggtactaatctttattttattaactgcagtcgcgccatcgatgacaatgagatgtatcggaatcgctaatagggactttgttgaaggcgtaagcggtgggtcatgggtggatatagttctggaacacggcagctgcgtgaccacgatggctaaaaataaaccaacattagattttgaacttatcaaaacagaggccaaacaaccggcaacgctgcgtaaatactgcattgaagccaaactaactaataccactactgactcccgatgtccaacacaaggcgagccatcactgaacgaagagcaagataaaagatttgtatgtaaacacagtatggtagatagaggctggggaaacgggtgtgggctttttggtaaagggggaattgtcacttgtgcaatgtttacgtgtaagaaaaatatgaaagggaaaatcgttcaacctgaaaacttagaatataccatcgtcataaccccacattcaggcgaagaacacgccgtgggcaatgacaccgggaaacacggaaaagaggtgaaaattacaccacaaagctcgataactgaagctgaactcactgggtacggtacagttacgatggaatgcagcccgcgtacaggcttggactttaatgagatggtccttttacagatggaagataaggcatggctagtgcatagacaatggtttttagacctacctctaccatggctgccaggtgcagatacacaaggatcgaattggatccaaaaagaaactttagtaacgttcaagaatcctcatgccaagaaacaggatgtagtagtgctaggaagccaggaaggagcaatgcacacggcacttactggagcgacagagatacagatgagttccggtaatcttctatttaccggacacctaaaatgcagattaagaatggataaactgcaacttaaaggcatgtcttatagcatgtgtacaggcaaatttaaagtagtgaaagagatcgccgaaactcaacatggtacaatagttatacgagtccaatatgaaggagatggctctccttgcaaaataccctttgaaattatggatctagaaaaaagacacgtgctgggacgcttaattacggtgaacccaattgttacagaaaaagatcgcccggtaaatatagaagcagaaccaccctttggagactcgtatataatcataggagtcgaacccggacaattaaaattgaattggtttaaaaaaggatcttcaataggacagatgtttgaaactacaatgaggggagcaaaacgcatggcgatactaggagatacagcttgggattttggttcactcggaggtgttttcactagcatagggaaagcactacaccaagtgttcggagctatctatggagccgccttctccggtgtatcatggacgatgaaaatactcataggtgtaatcataacatggataggaatgaacagtaggagcacgagcctgtcagtttcactggttcttgtgggtatagtaaccttgtacctgggagtgatggtgcaagctgattcaggctgtgttgtaagttggaaaaataaggaactcaaatgtggaaacggaatcttcgtaaccgataatgtacatacatggaccgaacaatataaattccagccagaaagcccgagcaagcttgcaagtgcaatccaaaaagcacacgaagagggtatatgtggtatccgttcagttacaaggttagaaaatctgatgtggaaacagataactcccgagttaaatcatatattatctgagaatgaggttaaattaacgattatgacgggggacataaaaggaataatgcaggtgggaaaacgatccctgcaacctcagccgactgaattacggtattcatggaaaacatggggaaaggcaaagatgctcagtaccgagctccacaaccagacatttttaattgacggaccagaaacagcagaatgtccgaatacgaatagggcctggaactccctagaagtagaggattatggatttggtgtttttacaactaatatatggttaaaacttcgagaaaagcaggatgtcttttgtgatagtaaactaatgagtgccgcaataaaagataaccgtgctgtacatgctgacatggggtattggatagaaagcgcgttgaatgacacatggaaaattgaaaaagcctccttcatcgaagtgaaaagttgtcactggcccaaaagccataccctttggagtaacggagttctggaatctgaaatgataatacctaaaaatcttgccggacctgtatcgcaacacaataatcgtccaggatattatacgcaaactgcaggcccgtggcatctgggaaaactggaaatggacttcgacttttgtaaaggaactacagtggttgtgacggaggactgtgggaaccggggtccatctctaagaactactactgcatcgggaaagcttattacggaatggtgttgtagaagttgtacgttaccaccgctccgttacagaggtgaggacggttgctggtatggtatggaaataagaccgctgaaagaaaaagaagaaaacttggtgaactctcttgtaacagcagggcatgggcagatagacaacttcagcttaggcatattgggtatggctctattccttgaggagatgctaaggacaagagtagggacaaaacatgcaatattacttgtagccgtaagtttcgtaacactaataacaggcaacatgagctttagggacttaggtagggttatagttatggtaggcgcaaccatgacagacgacataggcatgggtgtaacatatcttgctctactagcggcctttaaagtgagaccaacctttgcagctggactactgctcagaaaattaacaagtaaggaactgatgatgactacgattgggattgtactattatcgcagagttctatacctgagactatactcgagttaacagatgcattggcgctaggaatgatgatactaaaaatggttcgaaatatggaaaaataccaactcgcggtaacgattatggcaattttatgcgtacctaacgccgtaattttacaaaatgcatggaaagtaagctgtacgatccttgcagttgtctctgtatctccattgcttctaactagtagccagcagaaggccgattggatcccgatcgcattgacaataaagggcttaaatccaacagctatatttcttaccactttaagcaggacaagtaaaaaacgaagttggcccttgaacgaagccataatggcagttggtatggtatcaatattggcgtcatcgctattaaaaaatgatattccaatgacggggcctttagttgcgggtggattactaacagtatgttatgtattgacggggcgcagtgccgatctagaattagagcgcgctgcggatgtaaaatgggaggaccaggcggaaatctccggttcatcaccaatattatccataacaatatcagaagacggctctatgtcaataaaaaatgaagaagaggaacaaactctgactatactcatccgaactggcttgttggttgtatctggattgtttccggtgtcagttccaattacagctgcagcttggtatctgtgggaggtaaaaaaacaaagggcaggcgtgttatgggacgttccttcacctccaccagcgggaaaagcagaactggaggatggagcttacagaataaaacaaaaaggaatcttaggctattcacaaataggggctggcgtctataaagaaggaactttccatactatgtggcacgttacacgtggtgccgtactgatgcataaaggaaaaaggatagaaccgagttgggctgatgtaaagaaagacttaatatcctatggcgggggttggaaactagagggtgaatggaaagaaggagaagaggtacaggttttagcattggaacccggaaaaaaccccagggcagtacaaacaaagcctggtctatttaaaaccaatacaggaacgattggagccgtatcattagatttctccccgggaactagtggcagcccgattgttgataaaaaaggtaaagtagtaggactctatggaaacggcgtcgtcacgaggtcaggagcatacgtgagtgcgatagcccagacggaaaagagcattgaagataatccggaaattgaagatgacatatttcgaaaacgacgtttgactattatggatctacatcccggagctggtaaaacgaaaagatatttgcctgcgatagtgagagaagcaatcaaaagaggtctcaggacattaattttagcccccacaagagttgttgccgctgaaatggaggaggcgcttagaggattgcctgtgagatatcaaacaccagccataagagcggaacatacaggacgtgaaatcgttgatttaatgtgccatgcgacctttacgatgcgtctactatctcctatacgcgtacccaattataatttaatcatcatggatgaagcccactttactgatccagcatcgattgctgcacgtggctatattagcacgcgagtagaaatgggtgaagctgctggcatatttatgacggcgacaccacccggttctcgagatccatttccccaatctaacgcaccaataatggatgaggaaagggaaataccagaaaggagctggaatagtgggcacgaatgggtaactgatttcaagggcaaaacagtttggttcgtcccttcaataaaaaccggcaacgatattgcagcgtgtttacgtaaaaacgggaagcgagtaatacaattaagccgtaaaacatttgattccgagtatattaagaccagaacgaacgactgggattttgtagtgaccaccgacatatctgagatgggagccaactttaaagctcaaagagtaattgatccacggagatgcatgaaaccagtaattcttactgatggagaagaaagagtcatattggcagggcctatgcccgttactcacagctcagcagcacaacgcggcagagtaggtcgaaacccaaaaaatgagaatgaccaatacatatatatgggtgaaccacttgaaaacgatgaagattgtgcacattggaaagaagctaaaatgttattagacaatattaatacaccagagggaattataccttccatgtttgagccagagagagaaaaagtagatgctattgatggggaatacaggctgcgaggggaagcgagaaagacattcgtggacttaatgcgaagaggagatttgcctgtatggctggcttacaaagttgcggcagaagggataaactacgcagatagacggtggtgcttcgacggaacaagaaataatcaaatattagaggagaatgtcgaggttgaaatatggacgaaggaaggtgagagaaagaaacttaaacccaggtggttggatgcaaggatctacgcggatcctttagcgttaaaagagttcaaagagtttgcagcgggtagaaaatcactaactctgaacttgataacagaaatgggaagactccctacatttatgacacaaaaagtgcgggacgcattagataacttagctgtattgcataccgctgaagcaggtgggaaagcatataaccacgcattaaacgagttaccagaaacactagagaccttactattactaactttgcttgcgacagtaactggcggcatattccttttcttaatgtcaggaagaggcataggcaaaatgacgttaggcatgtgctgcattattacagcaagtatcctgctatggtacgcacaaatacaaccacattggatagctgcatcaataatacttgaattctttttaatagtacttttaatacccgagccggaaaagcagagaacacctcaggacaaccagttgacatacgtagttatcgccattctcacagtagtagcagcgacaatggcgaacgaaatgggtttcttggagaaaactaagaaagatttaggcctagggagtattgtaacccagcaacctgaaagtaatatacttgatatagatcttcgcccagcatcagcatggactctttatgctgtcgcaacaacttttataactccgatgctacggcatagcatagaaaactcctcggtaaatgtatcattaacagcaatagctaaccaagcaaccgttttaatgggattaggaaaaggctggcccctgtctaaaatggacataggagtgccactacttgcgataggatgttattcgcaggtgaacccaattacattgactgctgctttattccttttggtagcgcattacgcaattataggtccaggcttacaggctaaggcgaccagagaagctcaaaaacgtgccgcagctggcattatgaaaaatcctacagttgacggtattactgtgatagatcttgatcctattccgtatgatcccaagtttgaaaaacaattagggcaagtaatgctattagtcttatgtgtgacacaagtattgatgatgagaactacgtgggcattgtgtgaagcgctcacattagcgacaggacccgtatcaactctttgggaagggaatcctggaagattttggaacactactatagctgtatcaatggcaaatatattccgaggaagttatctagcaggggctgggctattattttccataatgaaaaacactacctctgctaggagaggtacaggaaatataggagaaacgctaggtgaaaaatggaagagtcgactgaatgcactcgggaaaagtgagttccaaatatacaagaaaagtggcattcaagaagttgatagaacattagctaaagaaggcataaagagaggggaaacagatcaccatgcagtaagccgagggtcagctaaattaagatggtttgtcgaacgaaatttagtaacccctgaaggtaaagtcgtagacttaggatgcggacgaggaggctggtcttactattgtggcggcctaaagaatgttcgagaagtgaaaggactaactaaaggcggccccggccacgaagaaccaattccaatgtcaacgtatggctggaacctagttcgtcttcaaagtggtgttgacgtcttttttatacctccggagagatgcgacaccctattgtgtgacattggagaaagtagtccaagtcctacagtagaagcgggacgaactcttagagtgctcaaccttgtagaaaattggttgtcaaataatacacaattctgtgtcaaagtcctcaatccatacatgccctctgtaattgaaaaaatggaagctttgcaaagaaagcacggcggtgctctcgttagaaatccactttcgaggaatagtacacatgagatgtactgggtttctaacgcatcaggaaatatcgtgtcttcagtcaacatgatatcaaggatgttgatcaatcgatttacaatgagacacaaaaaagccacgtatgagcctgatgtcgacctcggatccgggactcgaaatataggaatcgaatctgagaccccaaatctcgatataataggtaaacgaattgaaaaaataaaacaggaacacgaaacttcatggcactacgaccaagaccacccctacaaaacttgggcgtatcatggatcttatgaaacgaaacaaacaggttctgcgtcttctatggtgaacggtgtagtccgactcttgactaaaccatgggacgttgtaccaatggttacccaaatggccatgaccgacacaacccctttcggtcaacaacgggtttttaaggaaaaagtggatacaaggacacaagagccaaaagaaggaacgaaaaaactaatgcgtattacggcggaatggctatggaaagaactaggcaaaaaaaagacacctcggatgtgtactcgagaagaattcacgaaaaaagttagaagcaatgcagctttaggcgctatctttacagacgaaaacaaatggaaatctgcacgcgaagcggttggggacggtcgattctgggaactagtggacaaagaacgaaacctgcacttagaaggtaagtgcgagacttgtgtatataatatgatggggaaacgcgagaaaaagcttggagaatttggaaaagcaaaaggttcccgagcaatatggtatatgtggctaggggctcgttttttagagttcgaggcactaggctttcttaacgaagatcactggttttcgagagaaaattcattaagcggtgtcgaaggagaaggtcttcataagctgggatatatattgcgcgaggtatcaaaaaaagaagggggtgcgatgtatgcagacgatactgcagggtgggataccagaataacgatagaggacttgaaaaacgaagaaatgattaccaatcatatggaaggtgaacataaaaaattagccgaagcgatatttagactaacatatcaaaacaaagtcgtaagagtacaaagaccaactccacggggcactgtaatggacataatttcccgcagagatcaaagaggaagtggacaagttggaacctatggacttaacactttcacaaatatggaagctcaattaatacgccaaatggaaggagagggggttttcaaaagtatccaacaccttacagccgcagaagaaattgcggttcaaaactggttagtacgtgtgggccgcgaacgacttagcagaatggcaatatcaggtgacgattgcgtagttaagcctctagacgatagatttgcgagagcattaaccgcgttgaatgatatggggaaagtgagaaaagatattcaacaatgggagccaagtaggggttggaatgactggacccaagtaccattttgctcacatcatttccatgagcttataatgaaagatggacgaattctagtcgtaccgtgtcgaaatcaggacgaacttatcggaagagccaggatttcccagggagcaggatggtccttaagagaaactgcttgtctaggaaaatcctacgcgcaaatgtggtctctaatgtatttccacaggcgtgacctccgattagcagcaaatgctatttgttcagctgtaccaagtcattgggtcccaaccagtagaactacttggagcatccacgcgtcccatgaatggatgacaacggaagatatgttaactgtttggaaccgagtttggatccaggaaaacccatggatggaggacaaaactcctgtggaaagctgggaagagataccgtacttaggcaagagggaagatcagtggtgtgggtcgttaattggtctcacatcaagagcaacttgggcaaagaacatacagacggcaataaatcaagtaagatccttaatcgggaacgaagaatacactgactacatgccttcaatgaaaagatttcgtcgagaggaagaagaagcgggagtcttgtggtaa

SEQ ID NO: 22934 - RNA, 9876 nt, synthetic construct
  misc_feature 1..9876: note = derived and/or modified CDS sequence (opt6) from DENV-2__KF479233__SS-prME
  source 1..9876: mol_type = other RNA
acggctggggttatcatcatgttgattcctactgcaatggcatttcacttgaccacacgaaatggtgaaccacacatgatagtaagtaggcaagaaaaaggaaaatctttgttgtttaaaacggaagacggtgtaaatatgtgcacattaatggcaatggatcttggcgaattatgcgaagacacaataacttacaattgcccattactaaggcagaatgaaccagaagacatagattgctggtgtaatagcacatcaacctgggttacgtacggaacctgtacggcgacgggagaacacaggagagagaaacgaagtgtagcgttggtgcctcatgtaggaatgggcttagaaaccagaacagaaacatggatgtcaagtgaaggagcatggaaacatgctcaacgaattgaaacttggattttaagacacccaggatttacaataatggcagcgatactagcttacacgattggtaccacctattttcagagagttttaatttttatattactaactgctgtggcaccatcgatgacaatgcgttgcattggaatatccaatagggacttcgttgaaggggtgtcaggaggatcttgggtagatatagtgttagaacacggttcctgtgtgactactatggcgaaaaacaaaccgacattagattttgaacttataaaaacagaagcgaaacaaccggctaccttaagaaaatactgcattgaagctaaactaacgaataccacaacagcctctcgatgtccaacgcaaggggaaccctctttaaatgaagaacaggataaaagatttgtttgcaaacattctatggttgatcggggatggggaaacggatgtggtctattcggcaagggagggatcgttacatgtgcgatgtttacatgtaagaaaaacatggagggaaaaattgtacaacccgaaaatttggaatatactatagttgtaacgccccatagtggtgaagaaaatgcggtaggaaacgatacgggaaaacacgggaaggagattaaagtaacacctcaaagttccataacggaggcggaactaacaggatatggtacagttacgatggagtgctcgccgcgaactggcctagattttaatgagatggtattgttacaaatggagaataaagcatggttagtacatagacagtggtttctagatctcccacttccttggctgccaggagctgatacacaaggttcaaactggatccagaaagaaacactcgtcacgtttaaaaatcctcatgccaagaaacaagacgtggtagttttaggctcacaagaaggagcgatgcataccgctttaactggggctacggaaatccaaatgtcaagtggaaatctgttatttaccggtcatctgaagtgcagacttagaatggataaactccagttaaaaggcatgagttattcgatgtgtactgggaaatttaaagtagtcaaagaaatagcagagactcagcacggaacaattgtagtaagagtgcaatacgaaggagatggtagcccttgtaagataccattcgaaataatggacttagagaaaagacatgtactaggtcggctaatcacagtgaatcctatagttaccgagaaggacagccctgtgaacattgaagctgaaccacccttcggggatagctatattataattggggtagagccgggacagctaaaactatcctggttcaagaaaggctccagtataggacaaatgtttgaaacgacaatgcgaggagcaaaaaggatggcgatactaggtgacactgcgtgggattttggatcgttaggaggcgtattcacctcaataggtaaggcgttgcatcaagtattcggcgcaatttatggagctgccttcagtggggtatcatggactatgaagattctaataggtgtagttattacctggataggaatgaactctagatccacttcgctatcagttagtctcgtgttagttggtgtagtcacactatacctcggggtaatggttcaggccgatagtggttgtgtcgtatcatggaaaaataaggagcttaagtgtggaagcggcatcttcatcacagataacgtacatacctggacagagcaatacaaatttcaacctgaatcaccttcaaagttagcaagtgcaatccaaaaagctcacgaggaaggaatatgtggcataagatcggttacaagattagaaaatctgatgtggaagcaaataactcctgagctcaaccatatattgagcgaaaatgaagtaaagctcactattatgactggagacattaagggtattatgcaagcggggaaacgctccctaagaccccaaccaactgaattgaaatatagctggaaaacatggggtaaagcgaaaatgttgtcgacagagccccagaatcaaacatttctaatagacggcccggagacagctgaatgcccaaatacgaatagagcgtggaacagcctagaagttgaagactacggttttggtgtatttaccactaatatctggttaaaattaaaagaaagacaagatgtgttttgtgacagtaaattgatgtcagcagccattaaagacaacagggctgtccatgcagatatgggatattggattgaaagtgcacttaacgacacatggaaaattgaaaaggccagttttatagaagtaaaaagttgtcattggccaaaaagtcatacgctctggagtaatggggtgctcgagagcgagatgattattccaaagaatttcgcaggacctgtctcccagcataattatagacctggctatcatacgcaaacagcaggtccgtggcatttaggtaaactagaaatggactttgacttttgtgaaggaaccacagtggtggttacagaggattgcggaaacagagggccttccctccgtactactacagcaagcggtaaattaatcactgaatggtgctgtagaagttgtaccttacccccgttaagatacaaaggagaagatggatgttggtacggtatggaaatacggccacttaaagagaaagaggagaacttggtcaattctcttgtaaccgctggacacggtcaaatagacaattttagccttggcgtgttaggaatggctctattcttagaagaaatgttacgtacacgcgtaggcacaaaacacgctgtattacttgttgctgttagtttcatgacattaattactggaaatatgtcatttcgcgacctcggcagagtgatggtaatggtgggagcagccatgactgatgatataggtatgggagttacgtatctcgccttattagctgcatttaaagtaagacccacattcgctgcgggtctcctgctgcgaaaactaacaagtaaagaattaatgatgactacaattggtatcgttttgctttcacaaagtactataccagaaaccatactcgagttgacagatgcattggctctcggtatgatgatattgaaaatagtgagaaatatggaaaaatatcagctagccgtgacgataatggctatattgtgtgtcccaaatgccgtaatattacaaaacgcttggaaagtatcctgtactatactagcagtagtatcagtatcgcctcttctactcaccagctcacaacaaaaagcagattggattccacttgccttaacaatcaagggtttgaatcccaccgcaatattcctaaccacactatccaggacaaataaaaagagatcctggccattaaatgaagcaataatggctgttggcatggtttcaatcttagcatcttcacttcttaagaatgacatacccatgaccggaccgctagttgccggtggattattaactgtgtgctatgttctaacaggaagaagcgcagatctagaactagaacgagcagctgatgtacgatgggaagaccaagccgagatctctggatcttctcctatactcagtattaccatatcagaagatggatctatgtcaatcaaaaatgaagaagaagaacaaacccttactatcctaattaggactggactattagtaattagtggtttatttccagtaagtatacctattactgctgcagcttggtacctatgggaggtaaagaaacaaagggctggagtattgtgggacgtgccctctccgcctcctgtaggtaaggcagagctggaggatggagcatatagaataaagcaaaaaggtatattagggtactcgcaaattggggcaggagtatacaaagaaggcacgttccacacaatgtggcacgtaacccgaggagcagtgttaatgcataaaggaaaacgaatagaaccgtcgtgggccgatgttcgaaaagaccttatctcgtacggcggagggtggaaacttgaaggagaatggaaagaaggcgaggaggttcaagtattagctctagaaccgggtaagaatcccagagccgtccaaactaagccaggattattcaaaacaaacactggtacaatcggagcagtcagccttgattttagtccagggacaagtggctcaccgatagtagataagaaaggcaaagtagtcggactttacggaaatggtgtcgtaacaagatcaggaacctacgttagcgccattgctcaaacggagaagtcaattgaagacaacccagagattgaggatgatatatttaggaaaaagcgtttgaccattatggatctacatccgggtgcagggaaaacaaagaggtacttaccagcaattgttcgtgaggcgattaaacgaggactccgaactttaatattagcaccaactagagttgtagctgcggaaatggaagaagcattgcgaggacttccgatccgataccaaactcctgcaatccgtgccgaacataccggaagagaaatagtagacctcatgtgccatgctacattcacaatgagattactcagtcctgtacgtgttcctaactataacttaattattatggatgaagcccactttaccgatcctgcctctatagctgcaaggggatacatatcaacacgcgtcgaaatgggagaagcggcaggaatattcatgactgcaacacctccgggctctcgggacccgttcccacaatcaaacgcaccaattatggatgaggaacgggagattccagaacgtagttggaactcaggccatgaatgggttaccgatttcaaaggtaaaacagtatggttcgtgccttcgattaaagcaggtaatgacatcgctgcatgcctacgcaaaaacggtaagaaagtcatccaattaagcagaaaaactttcgattctgagtatataaagacccggacaaatgactgggactttgtagttacaacagacatcagtgaaatgggggcgaactttaaagctgaacgcgtaattgatccaagaagatgcatgaaacctgtaatattaacggatggagaagaaagagtaatattggcaggacccatgcctgtcacacacagttccgcagcccaaagaagaggcagaattggaaggaaccccaagaatgagaacgatcaatacatttacatgggtgagccactagagaacgacgaggattgcgcgcattggaaagaagcaaaaatgctactggataacataaatacgcccgaaggcataataccttcaatgttcgaacctgaaagggaaaaggttgatgcaatagatggcgaatataggcttagaggggaagctagaaagacctttgtagaattaatgcgcaggggagacctacctgtttggttagcctatcgcgtggcagcagaaggtatcaattatgcagatagacgatggtgtttcgatggtataaagaataaccagatattggaagaaaatgtcgaagtcgaaatctggacaaaggagggcgagaagaagaaacttaaaccacgatggttggatgcaagaatttattctgacccgctcgctttaaaggagttcaaagaatttgccgctggacgtaagtcacttacaatgaatctaataacggaaatgggaaggttgcctacattcatgacacaaaaagctcgaaatgcattggataatttagctgtcctgcatacggcagaagccggtggtagagcctataatcacgcgttatctgaattaccggaaacattggaaactctactattactgacactattggcaacggttacaggtggaatattcttattcctaatgtcaggtaaaggaataggtaagatgacactaggaatgtgttgcattataaccgcatccatactattgtggtacgcacaaattcaaccgcattggatagcggcttcaataattttagaatttttcttgatagtactattgataccggaaccagaaaaacaacgcacaccacaagacaatcaactcacctatgtagtcattgcgatattaaccgtcgtggcagctacaatggcaaatgaaatggggttcttagagaaaactaaaaaggatttcggtctaggatcgatcgttacacaacagccagaaagtaatatattagacattgacttgcgaccggcttcagcgtggactttatacgccgtcgctacaacttttatcacgccaatgctccgtcattccatagaaaactcttcagtcaatgtatctctaactgcaatagcaaatcaagcgacggttctcatgggcttggggaagggatggccactatctaagatggatattggcgtaccactactggcaatcggctgttattcacaagtaaatccaataactctaactgcagcgctgcttcttctggtagcacattatgccataattggaccaggattgcaagcaaaggcaaccagggaagcacagaagagagccgcggcgggcattatgaaaaaccccacagtagacggaataacagtcatagaccttgatcctatcccgtatgaccccaagtttgaaaaacagctaggacaagtaatgctcttagttttgtgcgttacccaggtcttaatgatgcgaaccacatgggccttgtgcgaggctctgacacttgcaactgggccaatttctacactgtgggaaggaaaccccggacgattttggaatacgaccatagcagtgtcgatggcaaatatatttcgtggatcatacctggctggcgctggactattattctctataatgaaaaacacggcaaatactcggagaggcaccgggaacaccggagaaacactaggcgaaaaatggaagaacagactgaacagcctagggaagtcagagtttcaaatatacaaacgtagtggtattcaggaagttgatagaacattagcaaaggaaggaattaagcgaggagagacagaccaccatgcggtaagtagaggatcggccaagctcagatggttcgtagaaagaaacttggtaacgccggagggtaaagtcatggacctgggttgtggtagaggaggctggagctattattgtggagggctcaaaaatgtacgtgaagttaagggactaaccaaaggaggccctggtcatgaagaacccatacccatgtctacgtatggctggaacttggtacgtctacaatccggagtagatgtcttctttacaccacctgaaaagtgcgatacactattatgtgatataggggaatcaagccccaatcccaccgtggaggctgggcgaacattgagagtattgaatttagtggagaactggttaaacaacaacactcaattttgcataaaagttttaaatccttatatgccttctgtcattgagaaaatggaaacactacaacgaaaatatggaggggcattagtccgaaaccctctgtcgagaaattcaacgcatgaaatgtattgggtaagcaatgcaagtggtaacatagtatcaagcgttaacatgatttcgcgtatgctgatcaatagatttacgatgcgtcataagaaagcaacttatgaacctgatgttgatttggggtcgggaacacgtaacatcggaattgaatctgaaataccaaatcttgatataattggaaaaagaattgagaaaataaaacaagaacatgaaacaagttggcattatgatcaagaccatccatacaaaacatgggcatatcacggctcttacgaaacaaaacaaaccggatctgcatcaagcatggtaaatggtgtagtcagattactaacaaaaccgtgggatgtgattccaatggtaacgcaaatggctatgactgatacgaccccctttggacaacaaagagtctttaaagaaaaagtagatacacgaacccaagaaccaaaagaaggtactaaaaagctcatgaagatcacagcagaatggctctggaaagagctaggtaagaagaaaacacctagaatgtgcacacgagaggagtttactcgtaaagtaagaagcaacgcggcactcggagcgatatttaccgatgagaataaatggaaaagtgccagagaagcagtcgaagactcgaggttctgggagctagtagacaaagaacgaaatttgcatttagaaggtaaatgcgaaacatgcgtgtataatatgatgggaaaaagggagaagaaaataggagagtttgggaaagctaaaggatcaagggctatctggtatatgtggctaggcgcgagatttctagaatttgaggccttaggctttttaaacgaagaccattggttctccagagaaaatagcctatcaggcgttgaaggagaaggattacacaaactaggatacatactgagggaggtgagcaagaaagagggcggagcgatgtatgcggatgatacagcgggatgggacactcgtataacattagaggatctaaagaatgaagaaatggtaactaaccatatggaaggggagcacaaaaagctcgcagaagctatatttaaactcacatatcagaacaaagttgtgagagtgcagagaccaactccgcgaggcacagttatggatatcatatcacgacgggatcaaagaggtagcgggcaagttgggacttatggtctaaacacttttacgaacatgggcgctcagttaattcgacagatggagggagaaggggtatttaaatcaattcagcatctcacaacaacagaagaagttgctgtacaggattggctagctagagtaggaagggaacgactgagcagaatggctatatctggtgacgattgcgttgtaaaaccacttgatgatcgattcgcctccgcactaacagctttgaacgatatgggcaaagtgagaaaagatattcaacaatgggagcccagcagggggtggaatgattggacacaagtaccgttttgtagtcatcatttccacgaactaataatgaaggatggcagagtcttagtagttccctgtcgaaaccaggatgaattaataggaagggctagaatatcacaaggcgctggatggtcattaagggaaaccgcttgtctcgggaaaagttatgcccaaatgtggtccctaatgtactttcacaggagagacctacgattggccgcgaacgccatttgcagcgcagtgccgagtcattgggtaccaacaagtagaacgacctggtcgatccacgctagacatgaatggatgactactgaagatatgctcaccgtttggaaccgagtctggattcaggaaaatccgtggatggaagataaaacaccggtggagtcgtgggaagaaatcccatatctcggaaaaagggaagaccaatggtgcgggagcctgatagggctaaccagtagagccacttgggccaaaaacattcaaactgcaattaatcaagttaggtcactgataggatcagaagagtatactgattatatgccatcaatgaagcggttcaggagagaagaagaagaagctggcgtactctggtaa

SEQ ID NO: 22935 - RNA, 9876 nt, synthetic construct
  misc_feature 1..9876: note = derived and/or modified CDS sequence (opt6) from DENV-2__KX372564__SS-prME
  source 1..9876: mol_type = other RNA
accgcggggataattataatgatgatccctacagtcatggcttttcatctaacaacacgtaacggggaacctcatatgattgtgtctcgacaagaaaaagggaaaagcctactgttcaaaactgaaaacggagtaaatatgtgtacactgatggcaatggatttaggtgagttgtgtgaagacacaatcacatacaattgtccactattacgacaaaatgaaccagaagatatagactgctggtgtaatagtacaagtacatgggtcacgtacggtacatgtactgccactggtgaacatagacgagaaaaacggagtgtagctctagtaccacacgttgggatgggacttgaaacaagaactgagacatggatgagctcagaaggtgcttggaaacatgctcaaagaatagaaacttgggtactacgtcaccctggatttacgattatggcggcgattctagcctacacaattggtacaacatacttccaacgagtactgatatttatactattaacagcagttgctccaagtatgacgatgagatgcattggtatctctaatagagattttgttgaaggtgttagcggtggatcctgggtggacattgtacttgagcatggaagctgtgttacaactatggctaaaaataaaccgactttagattttgaattaatcaaaaccgaggctaaacatccagccacactccgtaaatattgtatagaagcaaaactaactaatactactactgcttcacgttgccctacacaaggggagccttcactaaatgaggaacaagacaaacgatttgtttgcaaacattcaatggtagatagggggtggggaaatggctgcggtttatttggaaaaggtggcatagtaacgtgtgcaatgtttacctgcaagaaaaatatggaaggaaaaattgtccaacctgaaaatctcgaatacacaatagtaatcactccgcattcaggagaagaaaatgcggtaggtaacgataccggaaaacacggaaaagaaataaaagttactccacaaagttcaataacagaagctgaactcactggctacggaacagttaccatggaatgcagtccaaggaccggtctggatttcaacgagatggtccttctgcaaatggaaaataaagcatggttagtccatcgtcagtggtttctagatctaccactaccatggttaccgggagcagatactcagggcagcaattggatccaaaaagaaactcttgtgacatttaaaaatccacatgcgaagaaacaagatgtagtcgtcttaggtagccaggagggagcaatgcacaccgctctcactggcgcaacagaaatacaaatgtcctcaggcaatctcttatttacgggacacctgaaatgccgactcagaatggataaattacagctcaaaggaatgtcttattcaatgtgtacaggaaaatttaaagtggttaaggaaatagccgaaacccagcatggaacaatcgtaattcgagttcaatatgaaggtgatgggagtccgtgcaagatcccctttgaaataatggatctagagaagcgtcacgtacttggtaggctaatcacagtaaaccctattgtaactgaaaaagactctccagttaacatagaggctgaaccaccgtttggcgactcatacataatcattggagtagaaccaggtcaattaaaattaagttggtttaagaaagggtcatcgataggtcagatgtttgaaacaaccatgcgtggggccaaacgaatggctattctcggggatacagcgtgggatttcggtagtctcggcggagtattcacgagtataggaaaagcattacatcaggtctttggggcaatatatggtgcagctttttcaggtgtctcgtggacaatgaaaatcttgataggtgtcgtgataacatggatcgggatgaactctagatcaacctccctctcagtgtcattggtacttgtcggcgtggttacactctatttaggagtaatggttcaagcagacagcggatgtgttgtatcctggaaaaataaagaattaaagtgtggttcgggtattttcataaccgacaacgtacatacatggacagagcaatataagttccaacctgagagtccatcgaaactagcaagcgcgattcagaaagcacatgaggaaggcatatgcggaataagaagtgtcacgcgactcgaaaatcttatgtggaagcaaattaccccggagctgaatcatatattaactgaaaatgaagtcaaactaactattatgacaggtgatattaaaggaattatgcaggcaggtaaacgcagtttacggccacaaccgacagaactaaagtatagttggaaagcatggggtaaggctaaagtattaagtacagaattacacaaccacacttttctaatagatggaccggaaacagcagaatgcccaaacactaatagggcatggaacagcttggaagtcgaagattatggattcggcgtttttacgacaaatatatggctcaaacttaaagaaagacaagacgtttcttgtgatagtaagctcatgtcagcagctattaaagataaccgagcagtgcatgcagacatggggtattggatagaatcggctctaaacgatacgtggaaaatcgaaaaagcatcgtttatagaagtaaaatcatgtcactggccgaagtctcatacgctgtggagtaacggtgtcttagagtcggagatgataatacctaaaaattttgcaggtccagtgtcacaacataactatagacccggatatcatacacaaacggctgggccatggcacctaggaagattagagatggattttgacttttgcgaagggacgacggtagtagtaactgaggactgtgggaatagaggaccctcactgcgaacgactactgcatcgggaaagctcattactgaatggtgctgcagaagttgcacattgccaccattgagatatcggggcgaagacggatgctggtatggtatggagattaggccattaaaagagaaagaggaaaaccttgttaattccctagtgactgctggccacggacaaatagacaattttagtctaggggttctcgggatggcgctatttttagaagagatgttgcgtacgagagttggaacaaaacacgcaattttactggtcgcggtatctttcgtaacactgattacgggaaatatgtcgtttcgcgatttaggccgtgtaatggtcatggtaggggccacaatgacagacgacatcggaatgggggtgacgtacctagccctactagcagcatttaaagtcagaccgacatttgcggctggactactgctgaggaaattaacgagtaaagagttaatgatgactacaataggtatagttttattgtctcaaagtacaatcccagagacaatattggagttaacggacgctctagcgctgggaatgatggtactgaagatagttaggaatatggaaaaataccagttggcagttacaattatggctatactttgtgtcccgaatgctgtaattctacagaatgcttggaaagtttcttgtacagcacttgcagtggttagcgtttctcctttattgttaacttcatcacagcaaaagacagactggatacccttagctctaacaattaaaggtctaaatcctacagcaatttttctaactacattaagccgtacgagcaagaaaaggtcttggcctctaaacgaggcgattatggcagtcggcatggtatcaatactcgcaagttcattcttaaagaacgacattccaatgactggaccattagtggccggaggactactaactgtctgttacgtgttaactggaagatccgcagatctcgagctagagcgggcagcagatatccggtgggaggaacaagctgaaatttctggatcctctcccattttatccattacaatttccgaggatgggagcatgagcatcaaaaacgaagaagaagaacaaactttaactatcctaatccgtactggattattagtaatttctggactatttccagtgagcataccgatcactgccgctgcatggtacttatgggaagtcaagaaacaaagggcaggagtattatgggacgtgccgtcacctccacccgttggtagagcggaacttgaagacggcgcttataggataaaacaaaaaggcatattaggatactcacaaatcggagcaggagtctataaggaaggtacatttcacactatgtggcatgtaactagaggcgccgtcctaatgcataaaggaaaacgcatagagccgtcatgggccgatgtaaagaaggacttaatatcatatggaggaggttggaagttagagggtgaatggaaagaaggagaagaggtacaggtcttagcactagaaccaggtaaaaatccacgagcagtacaaaccaaaccaggcctatttaagacgaatacaggaactatcggcgccgtctcgctggactttagcccggggacttcaggaagtccgattgttgataagaaaggaaaagtggtaggtctttatggtaatggtgttgtaacacgatcaggaacatacgtctcagcaatagcgcaaacggaaaaatcgatagaggacaatccggagatagaagatgacattttcaggaagaaaagattaacgataatggacttacatccaggagctggaaaaactaagagatatctacccgccattgtacgcgaagcaattaaaaggggtttaaggactctcattctggcacccacaagagttgtggcagctgaaatggaagaagcattaagaggtttaccaataagataccaaacgcccgctataagagcagaacacacaggaagagaaatagtagatttaatgtgtcatgctacatttactatgcgactcctatcaccaatacgagttccgaactataacctcataataatggatgaagcgcattttacagatccagcatccattgcagccagaggatatatatcaactagagtagaaatgggggaagcagcaggtatattcatgaccgccaccccgcctggaagtagagatccgtttccgcaatcaaacgcaccaatcatggacgaagaacgagaaattcccgaaaggtcttggaatagcggtcatgagtgggttaccgatttcaagggcaaaaccgtttggtttgtaccgtcgataaaagctggaaatgacatagctgcgtgcttgaggaaaaacgggaagaaagtaatacaattatccagaaaaacctttgattccgagtacattaaaaccagaaccaatgattgggactttgtagtgacaacagacataagcgaaatgggagctaattttaaagcagagcgtgtaatagacccaagaagatgtatgaaaccagttatactgactgatggcgaagaaagagtcatactagcaggtccaatgcctgtgacccacagttcagcagctcaaagacgaggtcgcgttggaagaaatcccaaaaatgagaatgatcaatatatctacatgggagaaccactcgaaaatgatgaagattgtgcacattggaaggaagcaaaaatgttactggataacattaatacacctgaaggaattataccgtcaatgttcgagcctgaaagagaaaaggttgatgccattgatggggaatatcgcctaagaggcgaagctaggaaaaccttcgtagatttaatgcgacgaggcgatcttcctgtatggctcgcctacagagtggcagctgaagggattaattacgcagacaggaggtggtgctttgatggcgtcaaaaacaaccagatattagaggagaacgtagaagtagagatatggaccaaagaaggcgaaaggaagaaactaaaacctcggtggctagacgcgagaatctattcagacccattagcgctgaaagaatttaaagaatttgctgcaggtcgtaagtcgttaacattaaatttaatcacagaaatgggacgtctgcctacattcatgacacagaaggctcgaaacgcattagacaatctcgctgttctgcatactgctgaagcgggtggaagggcctacaatcatgccttgtcggaattacccgaaacgttagagaccttgttattgttgacgcttctagccaccgtcacaggcggcatatttttgttcctgatgtcagggaaaggaattggcaaaatgaccttaggaatgtgttgtattgtgactgcttctatacttttgtggtatgcccaaatacagccacattggattgcggctagcataatattggagttctttttaatcgtactattaatacctgaaccagaaaaacagagaacgccacaagataaccagctaacatacgtagtgattgcaatattgacggtagtggctgctacaatggcaaatgaaatgggctttctagagaaaactaagaaagacttcggattagggtcaataacgacacaacagccagaatcgaacatcttagacatagatttacgaccagcgtcagcttggacattatatgctgtagctaccacgttcataactcccatgctccgtcatagcattgaaaattcttcggttaatgtttctttaactgccattgcaaaccaagcgacggttttgatggggctaggtaaaggatggcctctctcaaaaatggacatcggagtgccactactagctattgggtgttacagtcaagttaatccgattactctgacagcggcattgctactattagtagcgcattatgccataataggtccaggactccaagctaaagccacaagggaagcgcaaaagagagcagctgcagggataatgaaaaaccccaccgtggacggaataacagtcatagatctcgaccctataccctatgatccaaagtttgaaaaacaattaggccaagtaatgctattggtattatgtgtaacgcaggtactgatgatgagaacaacctgggcactatgcgaagctcttaccctggccacgggaccaattagcactctatgggaaggtaacccgggtagattctggaacaccacaattgcagtcagtatggcaaacatctttcggggttcttatttagcgggggcaggcttgttatttagcataatgaagaatacggcaaatacccgaaggggcacagggaacacgggagaaacgttaggggaaaaatggaagaatcgtttaaatgcattaggaaaatctgaatttcaaatttataagaagtcaggtattcaagaagtagataggacactagcaaaagaaggaataaaaagaggtgaaacggatcatcacgcagttagcagaggaagcgccaaacttagatggttcgtagaaagaaacctcgtaacacccgaaggcaaggtagtagacctcggttgcgggcgtgggggctggtcctattactgtggaggactcaaaaatgtaaaggaggtcaagggattgacaaagggaggtccgggccatgaggagccgataccaatgtcgacatatggatggaatttagtcaggctacaaagtggcgtggatgtgttctttacgccgccagaaaaatgtgacactttactttgtgacatcggagaatcatccccgaacccaacagttgaggccggaagaacattgcgcgtgttgaacttagtcgagaactggctgaataataatacccagttctgcataaaagttctaaatccatatatgccatcagttattgagaaaatggaagccttacaacgacggtacggtggagccctcgtacgaaatcctttaagtagaaacagcacccatgaaatgtattgggtgtcaaacgcatcaggaaacatcgtttcaagtgtcaatatgatatctagaatgcttatcaacaggtttacaatgcgacacaagaaagccacctatgagccagatgtagatctaggatcaggaacgagaaatattggaattgaatctgaagtgccaaaccttgacattataggaaaaagaatcgaaaagataaaacaagaacacgagacatcatggcattatgaccaagaccacccttacaagacgtgggcgtatcatggctcttatgaaactaaacaaacaggatccgcaagttcaatggtaaacggagtagttaggctactaacgaaaccctgggacgtgatccccatggtcactcaaatggctatgacagatactacccctttcgggcaacagcgtgtctttaaagaaaaagtggacacgaggacacaagaacctaaggaagggacaaagaaattgatgaaaatcacagcagagtggctttggaaagaactaggcaaaaagaaaacgccacgcatgtgcacgagggaagaatttacccggaaagtacgtagtaacgccgctttaggagcaatatttactgacgaaaataaatggaaatcagcgcgtgaggcagtagaagactcaggtttctgggaattagttgacaaagaaagaaacctacacctagaaggaaaatgtgaaacgtgcgtatataacatgatgggtaaacgcgagaagaaattaggagaatttggtaaagcaaaaggatcgagagcgatatggtacatgtggctcggggcaagatttttggagttcgaagctctaggatttctcaacgaagatcattggttctcgagagaaaattcattatcaggagttgaaggtgagggacttcataaactgggatatatattaagagacgtgtccaagaaagaagggggagccatgtatgccgacgatacggctggctgggacacgaggataacgctagaagacctgaaaaatgaagagatggttaccaatcatatggaaggcgagcacaaaaagctagctgaggcgattttccgcctaacctatcagaacaaggttgtaagggtgcaaagacctacaccgagaggtacagtgatggatataatatccagaagggatcaaagaggttccgggcaagtagttacatacgggctaaacacatttactaatatggaggctcaacttatccgtcagatggaaggtgagggggttttcaaatccatacaacatcttacagctaccgaagaaattgcagtgaaaaactggttagtaagggtaggaagagaacgactctctcgcatggcaatttcaggtgatgattgtgttgttaaacccttcgatgacagatttgccaacgctttaactgcacttaacgatatgggaaaagttagaaaagacatacagcagtgggaaccgagcagaggatggaatgattggacgcaggttccgttctgttctcatcactttcacgaacttattatgaaagacggaagagttctcgtagtaccatgcaggaatcaggatgaactcatcgggagggctagaatatctcagggagcagggtggagtttacgtgagacggcttgtttgggtaagagttatgcacaaatgtggtcattaatgtactttcaccgccgagacctccgcctagcagcaaatgcaatctgttcagccgtaccaagccattgggtaccgacatcacgaacgacttggtcgatacatgcaacccacgaatggatgactaccgaggatatgcttacagtatggaacagagtatggatccaagagaatccctggatggaagacaaaactccagtggagtcctgggaagaaattccttatttagggaagagagaagaccagtggtgcggttcccttataggactaacttcgagagctacatgggctaaaaacatacaaacagcaataaatcaagtgcgaagcctaatcggcaacgaagaatacaccgactatatgccaagtatgaagaggtttagaagagaagaagaagaagctggagtgttatggtaa

SEQ ID NO: 22936 - RNA, 9873 nt, synthetic construct
  misc_feature 1..9873: note = derived and/or modified CDS sequence (opt6) from DENV-2__KX274130__SS-prME
  source 1..9873: mol_type = other RNA
tcagcggcaacattattgcttcttgtaccaactattatggctttccacttaacaactagaaacggggaaccgcatatgatcgtagcacgacatgaaaaaggcaaatctttgatatttaaaaccgaaaatggtgttaatatgtgtacacttatggcaatggatctaggagaactatgcgaagaaacggtaacatataaatgtccgtatctaaaacagagtgaaccagaagacatagactgctggtgtaatactacgagcacgtgggtaacttatggaacatgttcgtcctccggcgaacatcgaagagagaaaagaagcgtggctttggctccacacgtaggaatgggattagaaacaaggacggaaacttggatgtcgagtgaaggtgcatggaaacatgcacaaaggattgaaaattggattttgcgacatccaggttacacggtaatggcagcagcaatagcaatggcaatcggaactaacaactttcagcgcgcactaatctttgtgctactaacagcagttgcaccatctatgacaatgagatgtgtaggaattgcaaacagagattttgtagaaggggtatcaggaggatcatgggtagatatagtactcgaacacggttcatgtgtcacaaccatggccaaaaacaaaccaaccttagattttgaattaacaaaaaccgaagctaaacttcctgcaacattaagaaaatactgtatagaagcaaaactcacgaatacaacaacggagtcgagatgccctacacagggtgaaccttctctacctgaagaacaggataaaagattcatatgcagacacagtctggtggatagaggatggggtaatggatgcgggctttttggtaaaggaggcattgtaacatgcgcaatgtttacttgtaagaagtacatggaagggaagattgttcaaccagaaaatttggaatatacagttgcagtcaccccgcactcaggcgaagaacacagtgtaggaaatgataccggaaaacatggacaagatgttaaaatcacaccacaaagttcaattacggaaacggccctagaaggatatggtagtattagtatggaatgttcaccacggactgggctagatttcaacgaaatggtactactacaaatggaggataaagcatggcttgtacatcggcaatggtttcttgatctaccattgccgtggctcccaggttcggacacacaaggcagtaattgggtgcaaaaagaaacactggtcacgttcaaaaatccacatgcgaagaaacaggatgttgttgtattaggaagtcaggaaggggcaatgcatagcgctttgacaggtgcgacggaaattcaaatgacatcgggtaatctcttatttacgggccatttaaaatgtagactgcgtatggataaactagaactaaagggaatgtcgtactcgatgtgtactggaaaatttaaagtcgttaaagagatagcagagacgcaacatgggaccatcgtcatacgagttcagtacgaaggcgaaggttcaccatgcaaaattccctttgaaataatggatctcgagaagaaacacgtactcggaagattgataactgttaacccgattattactgaaaaagataaacctacaaatatagaagccgaaccaccctttggagatagttatatactaataggcgtggaaccgggtcaactaaagatgaattggttcaagaagggtagcagtataggacaaatgttcgaaacaacaatgagaggggcaaagagaatggcaatattaggtgatacggcatgggattttggctctctaggtggcgtattcaattcgatcggaaaagcacttcatcaagtatttggggcagtatacaacgccgctttctctggagtctcgtggacgatgaaaatactaataggggtcataataacatggatcggaatgaactcgcgctcaacatcgatgtccattaccctggttatggtcggtttagtcactctgtacttaggtgtggttgtgcaagcagactctggatgcgtagtcagttggaaaacaaaagaactaaagtgcggcagcggaatatttgtcacggacaatgttcacgtatggactgaacaatataaatttcaacccgagtcgcctgctaagttggctgccgcaataaagaaagcacatgaagaaggagtttgcggcattcgctctgtcacaaggctcgaaaatataatgtggaaacaaattacacctgaacttaatcacattctcactgagaacgacgtaaaagttactattatgacgggggatataaaaggaatactacaacaagggagaagggcgttgcgcccccaacctacagaattaaaatattcttggaaatcttggggaaaatctaaaatagtatcatcggaaacacacaaccagacattccttattgacggaccagaaacaacagagtgcccagacaccaatagagcatggaatagcctcgaagttgaagactatggattcggcttattcagcacgaatatatggctaagattaagagaaaagcaagacacgctctgtgatagtaaattaatgagtgcagccgtcaaagacgaaagagccatacacgcagacatggggtactggatagaaagtaaattaaatggaagttggaaaatagaaaaggccagcttcttagaggtaaaatcgtgcacatggccaagaagccacacattatggagtaatggcgtattggaatctgaaatgataattcctaagaacctaggaggccctgtatctcagcataactaccgacctggatactatacgcaaacaacagggccgtggcatcttggaaagctggaaatggacttcgactattgtgaaggaacaacggtgatagtcacagaagagtgcaacaatcgcggacctagcctccgaaccacaaccgcatctggaaaattgattacagaatggtgctgccgatcgtgtactatgcccccgcttcgatttaagggtgaggatggatgttggtatggcatggaaataagaccacttaaagaaaaagaagaaaatctcgtaaattctctcgtgacagcggggcatggacaaattgataatttttcactaggaatacttggaattgcgctattcctagaagaagtaatgaaatccaggataggtataaaacacacgattggaatgaccataatcactttcttactgctagtgacaggaaacgtctcgtatagagatctaggtagggtgattttaatggtaggaagcactatggcggacgagatggggatgggtgtgacttatttggcactactagcaacatttcgaataagaccgacatttgctcttgctttaatgataaggaaactgacaagtaaagaactattgatggctacgatcggaatagtgttaatagcccaatgcgatgtacctggtactattttagagataactgacgcgtgtgcgttaggcctcatgttattgaaaatgactcgcgagctggaacgatatcaattagctgtcacactacttagcttgacttgtatcccaaatgcaacaattatgtggggagcttggaaagtaacatgtactatcctaacattggttagtatggcacccttgttcttgacgactagcagacagaaaacagactgggttccggttgcactttcaatctatggacttaatccaacggcaatatactttacaactttagcaaaagccaagaaaattagaagctggccgctgaatgaagcagtaatggctgtaggaatggtaagcattttagcatcgagtctattgaggaacgatattcctatggccggaccacttgttgcagggggcctgttgaccctctgctatgtactaaccgggaggtcagcagaccttgagctagagaaaagtgcagacataaagtggaacgatgatgccgaaatatccgggtcctcaccaataataaatgtcgcggtcagcgaagacggttccatgagtatcaaagacgaagaagaagagaatacactaactatcctaatacggacaggactccttgccataagtggaatgtaccctatggcgatacccgctactgcagcggtctggtatttttgggaagcacggaaacaaagggcgggtgtactttgggatgtgccttcccctcctccaacaggcaaagctgaattggaagaaggagcgtataggataaagcaaagaggtatatttgggtatagccaaattggagccggcgtttacaaagaaggcacattccataccatgtggcacgttaccagaggatcagttcttatgtgtaaaggaaaacgtttagaaccaagctgggctgacgttaaaaaggatttaataagctatggcggtggttggagattagatggagaatggacagaaggcgaagaggttcaggtattggcactggagcctggaaagaaccctagggcagttcagacaaagccagggatgtttaagacagatactggaaggattggggcagtatcattagactttgcacctggaacaagcggaagtcctataatagataagaagggtaaggtcattggtttatatggcaacggagtggtaatgaaatctggtgcatatgtttcgagtatagcacaaactgagaaaagagaagacgaaatccccgagatagaagacgacatatttaggaaacgaagactcacaattatggatctacatccaggagcaggtaaaacaaaacgatacttacctgcaatagtacgcgaagccataaaaagaggcctaagaactcttatattagctccaaccagggtagtagcagctgagatggaggaagcactgagagggttgccaatacggtatcaaactcctgcaatcagagcggaacacacaggacgcgaaatcgtcgatcttatgtgccacgcgacattcaccatgcgactattaagcccagtacgggtaccgaactacaatttaataattatggacgaagcacacttcacagatccagcttctattgctgctcgtggttatatagctaccagagtagagatgggagaagcagccggtatattcatgaccgcgacgccaccaggaagcaaagatccgtttccccaaagtaacgcccctattatggatgaggagcgagagatacccgagagatcctggaactcgggccatgaatggataaccgacttcgaaggtaaaacggtatggtttgttccgtcaattagagcaggtaatgatatagctacgtgcctaaggaaaaacggtaagaaagtaatccaattgagcagaaaaacatttgacacggaatacattaagactcgaaataacgattgggattttgtagtgactacagatatctcagaaatgggcgcgaatttcaaagccgaaagagtaatagatcctcgccggtgtatgaaaccagtcatcctcacagacggagaagaacgtgtaatactagccggaccgatgccagttactccatcaagtgctgctcaaagaaggggacgaataggaagaaaccccaaaaacgaaaatgatcagtatatctatatgggggaaccacttgagaatgacgaagactgtgctcattggaaagaggctaagatgctattggacaatatcaacactcccgagggaataatacccgccatgttcggaccagagagagagaaaacagatgcaattgacggcgagtacaggctaaggggcgaaagtcgtaaaacttttgtagaacttatgagaaggggcgatttacctgtatggttagcctataaagtagcttcggaaggttatagttacgccgaccggagatggtgttttgagggtgttaaaaacaaccagatattagaagaaaatctggaagttgagatatggaccaaagaaggtgagaggaagaaacttcggccaaaatggctagacgcacgaacgtattcagatccacaagcattgaaagactttaaagaatttgccgcaggacgaaaaagcacaactcttaatttgatagcggagttaggaagactaccgacatacatgactcaaaagacaagagacgcacttgataatcttgccgtgcttcacacggccgaggaaggagggagagcctatcaacatgcaatatcggaactcccagaaaccttggaaacattactcttgttatgtttactagcgacggtatcaggcggtgtcttcctatttttaatgtccggtaaaggtataggaaagatgagtatgggactaggatgtataataactgcgtcaggtctcctctggtatgcgcagatacagccacactggatagctgcaagtataatcttagagtttttcttgattgtattactaatcccagaaccggaaaaacagagaactccacaagataatcaacttacgtatgtggtgatagctatattaacattagtagctgctaccatggcaaatgagatggggtatctcgagaaaactaaaaaggacttaggttttgggaacccatatgtagcatctcatgaagccgctattctagacattgatctacaccccgcgtcagcatggacactttatgccgtagctacaacactgattacacctatgctaaggcacagtatcgagaactcaagcaccaacgttagccttaccgcaatagccaatcaagctacagtattgatggggctaggaaaaggttggcctctgagtcgaatggatcttggggttccactgctcgctttaggctgttattcacaagtaaatcctctaacgcttacggcaagtcttctccttttaataggacactacgcaatcatcggtccgggattacaagcaaaggcaacaagggaagcacagaaaagaactgcagcaggcataatgaaaaatcccactgtagatggaataacggtaatcgacatagaacccataccatatgatccgaagttcgaaaaacaattgggacaagtaatgctccttgtactatgtgttgcacaagtcctaatgatgagaactacgtgggcaatgtgcgaagctctaacaatagctacaggaccaatatccacactctgggaaggaaaccctggcaagttctggaatactacaattgcagtatcaatggctaacatattcagaggatcatacctcgccggagcagggcttctcttttcgataatgaaaaatactgtcactggaaggagaggcacgggagtcgcaggggagacgcttggagaaaagtggaaaataaaattaaatggattaggtcgtaccgactttcaaacatataaaaggtcaggcattatcgaagttgatagaacgttagccaaggaaggaattaagcgaggagagacaaatcatcatgccgtttctcgaggtagcgcaaagctacgttggttcgtagaaaggaatctggttaaaccagaaggaaaagtaatagacctcggatgcgggagaggcggatggtcatactactgtggtggattaaagaatgtaacagaagtaaagggattaaccaagggaggtccaggacatgaagaacccataccaatgagcacttatggatggaaccttgtaagactccagagcggtgttgacgtcttcttcacacccccagaaaagtgcgatacccttctctgtgatataggcgagtcatcacctaacccaacaatagaagcgggaagaactttaagagtacttaatatggttgaaaattggttaggcaacaatcaattctgcataaaggttttgaatccttatatgcccagcgttatcgagaaaatggagaaccttcagcgtaaatttggagggactttggtacgtaatccgttgagtagaaattccacacatgaaatgtattgggtatcaaatgctagtggaaatatagtatcctcagtgaatatgatttcaaggatgctaattaatcgattcactatgaaacataagaaaccaacctatgaacaggatgtagatctcggttcaggaactagaaatgtgggtatagaaacggaaaaacctaatctggagattataggtaaaagaatagagaaaattaaagatgaacataaacaaacatggcattacgatttggatcatccttacaaaacgtgggcttatcatggcagctatgaaacaaagcaaactggtagtgccagttcaatgataaacggagttgttaaactattgacaaagccatgggatgttattccaatggtaacacaaatggctatgactgataccacaccttttgggcaacaaagagtttttaaagaaaaagtagacacaaggactccagaacccaaagaaggcacaaagaagttgatgaaactaacggccaaatggttatgggcggaactaggtagacacaaagtcccgagaatgtgtacaagagatgaatttacaaataaagtaagaagcaatgcagctatgggtgcggtctttaccgaagaaaacagatggtctagtgctaaggaggctgtagaggatgaggctttctgggatttggtggacagagaaaggaaattacatttacaaggaaagtgcgaaacttgtgtgtacaatatgatgggtaagagggagaagaaattgggagagttcggccgcgcaaaaggtagtcgcgcgatatggtacatgtggcttggcgcgcgctttctagaatttgaagcgctcgggtttttaaacgaagatcactggttttcacgggaaaactctttatccggtgttgaaggtgaaggccttcacaaactgggctacatcttgagggaaataggtgcaaaagatggaggtatgatgtatgcggatgatacggcagggtgggataccagagtaacagaagaagacttgaaaaacgaagaaatgataagtgagcagatgaaaggcgaacaccgtacgctagcagaggctatctttaaactgacgtatcaaaataaggtagttcgtgtgcaaagaccaacacccaagggaacggtgatggatataataagtagaagagaccaacgtggttcaggccaggtggggacttatgggttgaatacctttacgaacatggaagcccaacttattcgacaaatggaaggtgagggactgttcagagatatcagtaagttgaccatacaagaagagaccgccatactcacgtggctaaaagaaaaaggacgagacagactttcaagaatggctattagcggagatgattgtgtagtaaaacctgtcgatgatcgatttgcgcatgctttgacggcgctcaacgatatgggaaaagtaagaaaagatattcaacagtgggaggcatccaagggatggaatgattggacacaagtacccttttgctcgcatcacttccacgaaattataatgaaagacgggaggaagctagtggtgccatgccgaaaccaagatgagctaattggtcgggctagaatctcacagggagccgggtgggcattaaaagaaacagcatgcctaggaaaagcctacgcacaaatgtggtccttaatgtattttcataggcgggatctgcgcctagcagccaatgcgatttgttcagccgtaccttctcattgggtccctacaagcagaacaacgtggagtattcatgctcaccaccaatggatgacgaccgaggatatgctagacgtgtggaacagagtttggatattagaaaatccttggatggacgacaagacttgtgtaaaatcatgggaagaagtaccataccttgggaagagggaagatcagtggtgcggaagtttaatagggttaacctccagggcaacttgggccaaaaatatcaaggttgctatcgaacaggtaagatccctaataggaaaggaagaatataccgattacatgccttcaatgaaacggtttaaacaggagcaatccactgagggtgccttgtggtag

SEQ ID NO: 22937 - RNA, 9876 nt, synthetic construct
  misc_feature 1..9876: note = derived and/or modified CDS sequence (opt6) from DENV-2__GU289914__SS-prME
  source 1..9876: mol_type = other RNA
tcagcaggaatgatcattatgctaatcccgaccgttatggcattccacttaacaactcgcaatggtgaaccgcacatgattgtttcacgtcaagaaaaaggaaaaagtctactttttaaaacagaagatggagtcaacatgtgcactcttatggctatggatcttggggaactgtgcgaagacaccataacgtataattgtcccttattacgacaaaacgaacccgaagatattgattgctggtgtaatagcacaagtacatgggtcacttacggaacatgtaccaccacaggtgaacacaggagagaaaaacgatcagtagcacttgttcctcatgttggtatgggattagaaacgaggacagaaacgtggatgtcttctgaaggagcatggaaacacgcacaaagaattgaaacatggatacttaggcaccctggttttaccattatggcagcaattctagcatatactataggtacaacacatttccagagagcattaatatttatattactgaccgcagtggcgcctagtatgactatgaggtgtataggaatcagcaatagggatttcgtcgaaggggtttctggaggatcttgggttgatatcgttttagagcacgggtcctgcgtcacgaccatggccaaaaataaaccgactcttgattttgagttaataaaaaccgaggccaaacaacccgcaacgttaagaaaatattgtatagaagccaaattaactaataccacgactgaaagccgttgccccacccaaggagagccgtcattgaacgaagaacaagataaaaggttcgtgtgtaaacattcgatggtagatcgcggatggggtaatgggtgtggactattcggaaaaggtggaattgtaacgtgtgctatgtttacgtgtaagaaaaacatggaaggaaaggtagtccaaccagaaaatctcgaatacacaattgtcgtaactccacactccggcgaagaacatgcggtaggaaatgatacaggtaagcacggtaaagagataaaagtaactccccaaagttcaataaccgaggcagaattaacaggctatgggaccgttacaatggaatgtagtcccagaactgggttagattttaacgaaatggtactactacagatggaaaacaaggcttggttagtacatcgtcagtggttcttagatcttccactaccatggctcccgggtgccgatactcaaggaagtaactggatacagaaggaaaccctagtgacattcaagaacccgcacgctaagaaacaagacgttgtcgtcttaggatctcaagaaggagctatgcatacagcgttaacaggagctacagaaatacaaatgtctagcggaaatttactttttacaggccacttgaaatgtaggttacgtatggacaaacttcaactaaaaggtatgagttatagtatgtgcaccggaaaatttaaagttgtgaaagaaatagcggagacacaacatggaacgatagtcattagggttcaatacgaaggggatgggtcaccttgtaaaataccgtttgagattatggacctagaaaaacgtcatgtgctaggaaggttaataactgtgaatccaatagtaactgaaaaggacagtcctgtaaatattgaagcagagccacccttcggtgactcgtacataataattggtgtagacccaggtcaattaaagctaaactggtttaagaaaggttcttctataggacaaatgtttgaaaccacaatgagaggcgcaaaacggatggcaatattaggagatactgcttgggactttggaagtcttggcggggtattcacatcaataggtaaagcattacatcaggtgttcggagccatctatggagccgcattttcaggcgtctcatggacgatgaaaatcctaattggagtcataataacatggataggcatgaactctcgttctactagcttatctgttagcctagtattagttgggatagtaacattatatctaggcgtgatggtacaagcagattcaggttgcgtcgtatcatggaaaaataaagaattaaaatgcggatcagggattttcataactgataacgtccacacgtggacagaacagtacaagtttcaacccgaatcgccctcgaaattggcatcggcaatacaaaaggcacaagaggaaggtatctgtggtatacgaagtgttaccagactcgagaaccttatgtggaaacaaataacgccagaacttaaccacatactggcggaaaacgaggtgaagctgactatcatgacaggcgacataaagggaattatgcaagccggtaagagatccttaaggccacaaccgactgaactcaagtattcctggaagacatggggcaaggctaaaatgctgtcaaccgaatcacacaaccaaacgtttttaatcgacggtcccgagacagcggaatgtccaaacaccaatagagcttggaatagtctagaagtggaggactacggttttggagtgtttacaaccaacatatggttaaagttaaaagaaaaacaggatgctttttgtgattcaaaactaatgtctgcggctatcaaggataatagggccgttcacgctgacatgggctattggatcgagtcagcattaaacgatacttggaaaatcgagaaagcgtcattcatagaagtcaaaaactgtcactggccgaaaagccacactttatggtctaacggtgtactagaatcagaaatgataatcccgaagaacctagccgggccagtctcacagcacaattacagaccagggtaccacacgcagatcgcgggaccgtggcatctcggaaaattggaaatggactttgatttttgcgatggaacgacagtagtagttacggaagattgcggtaaccgtgggccgagtctaagaacaactacagcgtcaggaaagttaataactgaatggtgctgcaggtcctgcactctacctcccctaagatataggggagaagatggttgttggtacggaatggagatacgacctttgaaagaaaaggaagaaaatttggtcaatagcctggtaactgcagggcacggacaagtcgacaatttctctctcggggtcttaggaatggcactgtttctagaggaaatgttacggacacgagttggaacaaaacatgcaatcctattggtggcagtctcatttgtaactttaattacaggcaatatgtcatttcgagatctaggccgtgtagtagtaatggttggggcaacaatgacagatgacataggaatgggagtcacatatttagctctattggctgcttttaaagtgagacctactttcgccgcgggactgctattgcggaaactgacatcgaaagaactaatgatgaccacgattggtatagttttgctaagccaatcaacaatacctgagaccattttagaattaacagacgccctagcgctcgggatgatggtactaaagatggttaggaatatggaaaaatatcaactggcagtaacaataatggcaatattgtgtgtaccaaatgccgttattttgcagaacgcatggaaagtttcttgtactattttagcggtggtttcagtatcgcctttactattaacttcgagtcaacagaaaaccgactggatacctcttgcactaacaataaaagggctaaaccctactgctattttcctaacaactttatcacgtacgagcaagaaaaggtcttggccattgaatgaagcgattatggctgtaggtatggtttcaatattagcatcctcgctcttaaagaatgacatcccaatgactggtcctctagtcgctgggggtttactaactgtatgctatgtacttacaggaaggtcagctgatttagaacttgaaagagcagcggatgtcaaatgggaagaccaagctgagatatcaggcagtagtccaatactatcaataacgatttcagaagacggctcaatgagcatcaaaaatgaagaggaagaacaaacgttaacaattttaatacgcacgggcctcttagtgataagtggattattcccagttagcattccaatcaccgccgcggcatggtatctttgggaggtcaagaagcaaagagccggtgtgttgtgggacgtccctagtcccccaccaatgggaaaggctgaactcgaagacggagcttaccgtatcaaacaaaaaggaatactgggttattcccagataggagctggcgtgtacaaggagggaacttttcataccatgtggcacgtaacacgcggagcagtgttaatgcataaaggaaagcggatagaaccttcatgggccgatgtcaaaaaggatctaataagttacggaggagggtggaagttagaaggtgaatggaaagaaggcgaagaagttcaagtcctggctttagagcccgggaaaaatccaagggctgtacaaactaaaccagggctgtttagaactaacgcaggtactatcggtgcagttagcttagatttctcaccgggaacaagtgggagtccgataatagacaagaaaggcaaggtcgttggattgtatgggaacggggttgtgacgcgtagtggtgcttatgtttctgctatagcccaaacagaaaaatcaattgaagacaacccggaaatagaggatgatatattcaggaaaaggagattaacaattatggatttacacccaggcgcagggaaaaccaaacgctatctccctgccatcgtacgagaagctataaaacgtgggctcagaaccttaatattagcccctacccgtgtcgtagcggcagagatggaggaagctctaagaggtcttcccattagataccaaactcctgcgatcagggccgaacatactggaagagagatagtagacttaatgtgtcatgctactttcactatgagacttctgtcaccggtcagggtacccaattataacctaattatcatggatgaagcccattttacagatccggctagcattgcagcgagaggatacataagcacccgtgtagaaatgggtgaagcggcagggatatttatgacagccacgccacccggatcaagggatccctttccccaatctaacgcccccattatagatgaagaaagggaaattcccgaaaggtcatggaactcaggacatgaatgggtaacggactttaaaggcaaaacggtttggtttgtacctagtattaaagcaggcaacgatattgcggcatgcttgcgaaagaatggaaagaaggtcattcaactaagcagaaaaacattcgacagcgaatatgttaagacacgtaccaatgattgggattttgttgtcactacggacatttccgaaatgggggcaaacttcaaagccgaacgcgtaatcgacccgagaagatgtatgaaaccagttatattaaccgacggggaggaacgcgtaatactcgctggtccgatgccggtcacgcattcgtctgcagcccagcgtagaggtcgaatagggcggaatcccaagaacgaaaacgatcaatacatatacatgggcgagccgctagaaaatgacgaagattgtgcacactggaaagaagcaaaaatgctccttgacaacatcaatacacctgagggaataataccttcaatgtttgaaccagaacgtgaaaaagtagacgcaattgatggagaatatagacttagaggggaagctcgaaaaacatttgtcgatttaatgaggcgtggagacctccctgtgtggcttgcatataaggtagctgctgaagggattaattatgcagacagacgatggtgcttcgatggtataaagaataaccaaattctagaggaaaacgttgaagtagaaatttggactaaagaaggcgaaagaaagaaacttaaaccgcgatggttggacgcgagaatttattcggaccctttagcactcaaggagtttaaggaatttgcagctgggaggaaaagtttaacattgaacctgattacagaaatgggtagactcccgacttttatgacgcaaaaagcccgcgacgctttagataatttagctgtattgcatacagcagaagctggaggtagggcatataatcacgcactctcagagctaccggagaccttggaaacattgctgctattaacacttttagccacagttacaggcggcatattcttatttctaatgagtggaagaggaataggaaaaatgacattaggaatgtgttgtattatcacagcgtcgattttactttggtatgctcaaattcaaccgcactggatagcagcgagcataattttggaatttttcctaattgtgttgttaataccagagccagagaagcaacgtacgcctcaagataatcagttaacatacgtggtaatcgcaatcttaactgtagtagctgccacaatggctaatgaaatgggatttcttgagaaaacaaagaaagatctcggacttggttcaattgcgacccaacagcctgaaagcaacatactagacattgatctgagacctgcaagtgcgtggaccctatacgcggtggctacaacattcgtaacaccgatgctccgccatagcatagagaactcctcagtcaacgtatcgttgacagccattgctaatcaagctaccgtactaatgggactaggtaaaggatggcctttgtctaaaatggacatcggggtaccattactagccataggttgctattcgcaagtaaatcctataactctgaccgcagcgcttctgctcctcgtggcccactacgccataattggtcctgggctgcaagcaaaagcaacgcgcgaggcccaaaagagggctgccgcgggaataatgaaaaatcccacagtagatggaattacagttatagaccttgatccaattccgtacgacccaaaatttgaaaaacaattaggtcaagtaatgctactggtattgtgtgttacacaggtattgatgatgcgaactacctgggcgttatgcgaagctcttactcttgccacaggtccaatctccactctctgggagggcaatcctgggcgtttctggaatacaaccattgcggtttcaatggctaacatatttcgaggttcgtatttagctggtgcaggattactctttagcattatgaaaaatacaacgaatactcgtcgaggtacaggaaacataggagaaactcttggcgaaaaatggaaaagcagacttaacgcgttggggaaatcagaatttcagatttataagaaatcgggcattcaagaggtagaccgaacactcgcgaaagaaggaattaagcgaggcgagaccgatcaccacgctgtctcccgtgggtcagctaaattacgatggttcgtagaaagaaatatggtaacaccagagggcaaagttgtagatttaggatgtggtaggggaggttggtcttattactgcggcggcctaaagaatgttagggaagtcaagggcttaacaaaaggcggaccggggcacgaggaaccaatcccaatgtcaacttatggctggaatctcgttcggttacaatcgggagtcgatgtattctttatacctccagagaaatgcgatacactactgtgcgacattggcgaatcaagtccaaatcctaccgttgaagccggcagaacactacgagttttaaacctcgttgaaaactggctgaataataacacccaattctgcattaaagtcctgaatccatatatgccttccgtaattgagaaaatggaaacattacaacgtaagtatggcggcgcgctcgttagaaaccctctatctagaaacagtacccatgaaatgtattgggtatctaatgcgtccggaaacatagtttcaagtgtgaacatgatatcaaggatgttaatcaatagattcacaatgagacataagaaagcgacatatgaacctgacgtcgacctaggctcaggcacccgaaacataggaatagaaagtgagattcctaacttagacataataggtaagagaattgagaaaataaagcaagaacatgaaacttcgtggcattacgatcaagatcacccatataagacatgggcgtaccatggatcatacgaaactaaacaaaccgggagcgcttcatctatggtcaacggggtggtccgcttgctgacgaaaccatgggatgtggtacctatggttacacaaatggcaatgacagacacgacaccattcggccaacagcgcgtgtttaaagaaaaagtagatactcggacccaagaacctaaagaggggacaaagaaattgatgaaaataaccgcagagtggttatggaaagaattaggcaaaaagaaaacaccaagaatgtgtacccgggaagagttcacaagaaaagtaaggagtaatgcagcgctaggagctatctttaccgatgaaaataaatggaaaagtgccagggaagcagtagaagactcccgattctgggagctagtggataaagaaaggaatttgcatttagaaggtaaatgtgagacttgtgtctataacatgatgggaaaaagggaaaagaaacttggcgaatttggaaaagcaaaaggttcgagggcgatttggtatatgtggttaggcgccagattcctagagtttgaagcgctaggttttctaaatgaagaccattggttctctagagaaaatagcctttcaggcgtggaaggggaaggcttgcataaactagggtacatactaagagacgtcagcaagaaagaaggaggagctatgtacgcagatgacaccgccggatgggatacaagaattacgctggaagatctgaaaaacgaagagatggttacaaaccatatggaaggtgaacataagaagttagccgaagcaattttcaaactaacgtaccaaaacaaagtagttagggtgcagaggccgactcctagaggcactgtaatggatataattagtcgtagggatcaaagaggatccggacaagtaggaacatatggactaaatactttcacgaatatggaagcgcagctaattcgtcaaatggaaggagaaggggttttcaaaaatatccagcaccttacggtgactgaagagattgcggtccaaaattggctcgcgagggtggggagagaaagattaagtagaatggcgatatcaggagacgattgtgtcgtaaaaccactcgatgatcgtttcgcatcggcactcacagcgttaaatgacatgggaaagattaggaaagatatacaacaatgggaacccagtaggggctggaacgactggacccaagtaccattttgtagtcatcattttcatgaactcattatgaaagacgggcgcgtcttagtagttccgtgtagaaaccaggatgaattaatcggcagagcaagaataagtcagggcgctggttggtcgttgagagagacagcatgccttgggaaatcatatgcacaaatgtggagcttaatgtattttcataggcgtgaccttagactagcagccaatgcaatatgttcagcggtcccatcccactgggtcccaacttctcgaacaacttggagtatacacgctaaacacgaatggatgacaacagaagatatgctaaccgtctggaatagagtttggatacaggaaaatccatggatggaggataagactccagtagaatcatgggaagagatcccatacttaggcaagagagaagatcagtggtgcgggtctttaattggcttaacttcaagagcaacctgggccaaaaatatccaagctgcaatcaatcaagtaaggtcgttaataggcaatgaggaatacaccgactacatgccaagcatgaaacgtttccgcagagaagaggaggaggccggagtattgtggtaa

SEQ ID NO: 22938 - RNA, 9876 nt, synthetic construct
  misc_feature 1..9876: note = derived and/or modified CDS sequence (opt6) from DENV-2__AY858036__SS-prME
  source 1..9876: mol_type = other RNA
actgcaggaataattataatgatgataccaaccgtaatggcattccatttaaccactagaaatggggaaccacacatgattgtgtcacgacaagaaaaaggaaaaagcctactatttaaaacggaaaatggtgtaaatatgtgtacactaatggcaatggatcttggcgaattatgtgaagacacgataacttataattgtcccttactacgacaaaatgaacccgaagatatcgattgttggtgcaattcaaccagtacatgggttacttatgggacgtgtacagctaccggtgaacatcgtagagagaaaagatcggtggctctagttccacacgtagggatgggactagaaaccagaacggaaacatggatgtcatcagaaggcgcctggaaacatgcccaacggattgagacgtgggtattacgccaccccggctttacgataatggcggctatactagcatacaccatcggtactacatatttccaacgagtacttatctttattctattaacggccgtagctccatccatgacaatgcgttgtatcggtatctcgaacagagacttcgtagaaggtgtatctggaggcagctgggtggatattgtcttagaacacggaagttgtgtcacgaccatggccaaaaataaaccaacgctcgactttgaactaataaaaacggaagctaaacaccctgcgaccttacgaaaatattgtatagaagctaaattgacgaatacaacaacagccagtcgatgccccacgcagggagaacccagcttaaacgaagaacaagataaaagatttgtgtgtaaacattctatggtagatagaggatgggggaatggttgcggactatttggcaaaggaggaatagtgacttgcgctatgtttacttgtaaaaagaatatggaaggtaaaatagtgcagccagaaaatctggaatacacaattgtcattacgccacacagtggcgaggaaaacgccgtcggaaatgatacagggaaacatgggaaagaaataaaagtcaccccacaatcgtcgataacagaggctgaactaacaggatacggtacggttacaatggagtgctccccacgaacgggactagatttcaacgaaatggttctattacaaatggagaataaagcgtggctggtacaccgacaatggtttcttgatcttccgctcccttggcttccaggtgcagacacacaaggttcaaactggattcaaaaagaaactcttgtaactttcaaaaatcctcatgccaagaaacaggacgttgtagtcctagggtcacaagaaggagctatgcacacggcgctaactggagcaacagaaatccagatgagttcgggtaacctcttatttaccggccacttaaaatgtagactacgcatggacaaattacaactaaaaggaatgtcttattcaatgtgtacaggtaaattcaaagtagtaaaagaaatagcagaaactcaacatgggacaatagtcatacgagttcaatacgaaggagatggcagtccttgtaaaatacctttcgaaataatggatcttgagaaaagacatgtattaggacgtctaataacggtgaacccgatcgtcaccgaaaaagacagtcccgtaaatatcgaggccgagccacccttcggagatagctatattataattggcgtagaaccaggtcaactcaaactaagctggttcaagaaaggatcttcaatcgggcagatgtttgaaactacaatgcggggtgccaaacgtatggctatactaggcgatacagcttgggattttggctcattgggtggagtctttacatccatcggtaaggctttgcatcaagtgttcggtgcaatctacggtgcagcattctctggggttagttggactatgaaaatactaataggagttgttataacatggataggtatgaacagtagatctacaagtctatcagtgagcttggttctggtgggagtcgtaacactatacttaggagtaatggtacaagcagatagcggatgtgtcgtatcgtggaaaaacaaagaactaaaatgtggatctggtatcttcgtaaccgataacgtgcatacttggaccgaacaatataaattccaaccagaatcaccatctaaactagcctccgcaatacagaaagctcatgaggaaggtatatgcggaatacgaagtgttactagactagaaaatctaatgtggaaacagatcacacctgaactaaatcacatcttgtctgaaaatgaagtcaaactgacaataatgacaggcgatatcaaagggatcatgcaagcaggaaaacgctccctaagaccccaacctacggagttgaaatattcgtggaaaacatggggcaaagccaaaatgctctctacagagcttcataatcacacattcttaatagatggcccggaaacggcggaatgtccaaacaccaatcgcgcatggaactctcttgaagtggaagactacggatttggcgttttcactacgaatatttggttaaaactaaaagaaagacaagacgtattttgcgacagtaaacttatgtctgcagcaataaaagataacagggccgtacatgctgatatggggtactggatagaatcagccctaaatgatacatggaagatcgaaaaggcatcattcattgaagttaaatcatgccactggccgaaaagccatacactatggagcaatggagttttagaatcagagatgataatccccaaaaatttcgcaggaccggtgagtcaacataattatcgacctgggtatcatacacaaaccgcgggtccatggcacctaggtagattagaaatggactttgacttttgcgaaggtacaacagtagtggtcactgaggattgcggtaaccggggaccctctctcaggactacgacagcttcaggcaaactaattacagaatggtgctgcagaagctgtacactgccaccactgcgctacagaggagaagatgggtgttggtatggtatggaaataagacctcttaaagaaaaggaagaaaaccttgttaacagtctggttaccgcaggccatgggcaaatagacaacttttcgctcggagtattagggatggcgttatttctcgaagaaatgctcaggaccagagttggaaccaagcatgcaatattactcgttgcggtctcatttgtaacgctaataaccgggaacatgtcttttagagatctaggacgtgtcatggtcatggtaggtgcaacaatgacagatgatattggaatgggtgttacatacttagccttgttagccgcatttaaagtgaggcctacgtttgctgcaggcttacttttacgtaagctaactagcaaagagctcatgatgactacaataggtattgtactgttgtcacagtcaaccattccagaaacgattttagaacttactgacgcactagctttagggatgatggttctgaaaatcgtgaggaacatggaaaaatatcagttggcagtaactatcatggctatcttatgtgtcccaaacgccgtaatcttacaaaatgcttggaaagtttcttgtacaacattggcagtcgtgtctgtctccccactactattaacttcctctcaacagaaagctgattggattcccttagcactgactatcaaaggtcttaaccccaccgctatttttctcactaccctagcacgcacaagcaagaaaagaagttggcctctcaacgaagcaataatggctgtggggatggtgtctatattagcatcatctttactcaaaaatgatataccgatgactggtccgttagttgccggaggtcttttaacagtttgctacgttctaactggtcgatcagctgatttagaattagaaagggctgcagatgtaagatgggaggagcaggctgaaatatccggctctagtcccatcctcagtatcacgatctccgaggacggttcaatgagtatcaaaaacgaagaggaagaacaaacattgaccatattaataagaacaggcctcctagttatatccggactttttcccgtgagtattccaattacagcagcagcatggtatttgtgggaggtgaagaaacaaagagcaggagtattatgggacgtaccctcacctccgccagtaggaaaagcagaattagaagacggtgcttacagaattaaacaaaaaggcatactcggctattctcaaattggggcaggcgtatataaagagggtacttttcatacaatgtggcatgttaccagaggagcagtattaatgcacaaaggaaaacgaatcgagccctcatgggcagatgttaaaaaggatctaattagttacggcggaggatggaaattagagggagaatggaaagaaggtgaggaggtacaagtactagctctagagcctggaaagaatcccagagcggtccaaacgaagcctgggttgttcaaaactaacactggaactattggagccgtgtccttagacttcagtcccgggacatctggtagtcctatagtagataaaaagggtaaagtggtgggactatatggcaacggagtggtaaccagaagcggaacttacgtaagtgccatagcccagaccgaaaaatcaatcgaagacaatcctgaaatagaagacgacatattcaggaagaaacgcctaaccataatggatttacatcccggtgcaggaaagaccaaaagatacctgcctgccatagtaagagaagccataaaaaggggactgagaacgcttatacttgcaccaaccagagtagttgccgcggagatggaagaagcgctacgaggtcttccaatacgttaccaaacgcctgcaattagagcagaacatacaggaagagaaatcgttgatttgatgtgccatgcgacatttacaatgcgattattaagcccaataagggtaccaaactataacctcataataatggatgaggcccatttcacagatcctgcgagtatagcagcacgaggttatatatctacacgtgtggaaatgggagaggccgcgggaatcttcatgactgcaaccccgccggggtccagagatccatttcctcaatctaacgcacctataatggatgaagaaagagaaataccggagaggtcttggaactctggtcacgaatgggtaaccgattttaaaggaaaaactgtgtggtttgttccaagcataaaagcggggaatgacattgcagcatgtctgagaaagaatggtaagaaagttatccaattatcgcggaaaacgttcgattctgaatatatcaaaacaaggacaaatgattgggattttgttgtgacaacagatatatcagaaatgggcgccaatttcaaagcagaacgcgtaatcgatccaagaaggtgcatgaaacctgtaatcctgactgatggagaagagagggtgatcctggccggaccaatgccagtgacacattcatccgctgcacagaggcggggcagggtaggtcgcaatcctaaaaatgaaaatgatcagtacatttatatgggcgagccactcgagaacgatgaagattgtgcacactggaaagaagccaaaatgttattagacaatattaatactcctgaagggatcataccatcaatgtttgaaccggaaagagaaaaagtagatgcaattgatggcgaatataggttgagaggagaagcaaggaaaacatttgtggatctgatgagacgtggagacctaccagtatggctggcgtacagggtcgcagcagaagggataaactatgcagatagaaggtggtgctttgatggcgttaagaacaaccagatattagaggagaacgttgaagtggaaatttggacaaaagaaggtgaaaggaaaaagctaaagccgagatggttagacgcccggatatactcggacccattagccttaaaggaatttaaagaatttgcggctggaagaaaatcattgactctaaacttaattaccgaaatgggtaggctgccaacctttatgacccaaaaagcgcgtaatgcacttgacaatctcgcagtactacatacagcggaaacgggaggtcgggcatacaaccatgcccttagcgaacttccagaaacattagagacactattattattgactctgttagcgacagtaaccgggggaatattcttgttcctcatgtctggcaaagggatcggtaagatgaccttaggtatgtgttgtatcatcacagctagcatactactatggtacgcccaaatacaacctcattggatagcagctagcattatactagagttcttcttgattgtcttgttaataccagaaccggaaaaacaacgtactccacaagacaatcaattaacgtacgtggtaatagcgatactcactgtcgtagctgccacaatggcaaatgaaatgggtttcctggagaaaacaaagaaagactttggacttggatcaataacaacacaacaacctgaatcaaacattttagatatagatctaaggccagcatccgcatggacattatatgcggttgcgaccacctttataaccccaatgctgagacattctatagaaaactcaagcgtgaatgtgtcattaaccgcaatcgctaaccaggcgaccgtattaatgggtttgggtaaaggctggcctctttccaaaatggacattggggttcctttactagcaattggctgttatagtcaggtgaatccaattaccttgacagcggcactactgctactcgttgcgcattatgccattataggtccaggactccaagctaaagcaacgagagaagcgcagaaaagagctgcggcaggaataatgaaaaatccgacggtggatggaataacagtcattgacttagacccaattccctatgatccaaaatttgaaaaacaacttggacaagtaatgcttctcgttttgtgcgtcacccaagtcctaatgatgcgaacgacctgggccctatgtgaagcccttactcttgctaccgggcccataagtacattatgggaaggtaatcccggaaggttttggaatacaactatagcagtctctatggcaaatatcttccgcggttcgtatttagcaggggcaggactactattcagtattatgaaaaacacggcaaatacgagacgtggtacagggaacacaggcgaaacattaggtgagaaatggaagaatagactaaatgctttaggtaaatctgaatttcaaatatataagaaaagcggcatacaagaggttgatagaacgcttgcaaaggaaggcataaaacgtggcgaaacagatcaccatgccgtttcgcgtggaagcgcgaaattgagatggttcgttgaaagaaacctggtgacaccagaaggcaaagtagtagatttaggctgtgggcgaggaggctggagctactactgcggaggtctaaagaatgtcaaggaggtcaaaggattaacgaaaggaggaccaggtcacgaagaaccaatcccaatgtcaacatatggatggaacttagttagactacaatctggagtggacgtattctttacaccaccagaaaaatgcgatacgctcttatgtgatatcggcgagtcaagtccgaaccctactgtagaggcgggcagaacgttgagagtgcttaacctcgtcgagaattggctaaataataatacacaattttgtataaaagtgctcaatccatatatgccctctgtaatagaaaagatggaagcgttacaaagaaagtatggtggagcgctagtaagaaatcccctatcacgaaattcgacccacgaaatgtattgggtttcaaacgctagcggtaatatagtatcttccgtaaatatgataagcaggatgctgataaacagatttactatgaggcataaaaaggccacttacgaaccagacgtcgatctaggttcgggaacgcgaaatatagggatagaatcagaaactcctaacctagatataatcggaaaaagaatcgagaaaattaaacaagaacatgaaacttcgtggcattatgaccaggatcacccatataaaacttgggcatatcacggaagttacgaaactaaacaaaccggctctgcaagctcaatggttaatggggtagttagattactaacaaaaccatgggacgttatacctatggtcacacagatggctatgacagatactactccatttggccaacaacgtgtatttaaggaaaaagtggacaccagaacccaagaacctaaagaaggtactaaaaagttaatgaaaataaccgccgaatggctctggaaagagctaggtaagaagaaaacgccacgtatgtgtactcgagaggagttcacgaggaaagtccggtccaatgcagcacttggggcaatctttaccgacgaaaacaagtggaaatcagctagagaagctgtcgaagatagtgagttctgggaattagtagacaaagaacgtaacttacacctggaaggaaaatgtgaaacatgtgtctacaatatgatgggaaaacgcgagaaaaagttgggagagttcgggaaagccaaaggttcaagagcgatatggtatatgtggcttggggcaaggttccttgagtttgaagctctaggattcttgaatgaagatcactggttttcccgagaaaacagcctgtcaggtgtggagggtgagggcttacacaaacttgggtacatactaagggatgttagtaagaaagaaggtggcgcaatgtacgcagatgacaccgcaggatgggacacacgtattacactagaagacctcaagaatgaagaaatggtcactaaccacatggagggcgaacacaagaaattagccgaagctatcttccgactaacatatcagaacaaggtagtaagagtgcaacggcctacacctagaggtacagttatggacataatctcaaggagggatcagagagggtcaggtcaggtcgttacatacggactaaatacctttactaacatggaagctcaattgatacgacaaatggaaggagagggagtatttaagtcaatccaacatttaactgtaaccgaggagatagcagtgaaaaattggctagtccgagttgggcgggagagacttagccgtatggcgatatctggagacgattgtgttgtgaaacctctcgatgacagatttgctagcgcattaacagctctgaacgacatggggaaggttcgaaaggacatccaacagtgggagccatcgagaggttggaacgattggacacaagtccccttctgttctcatcattttcacgaactaataatgaaggatggtagagtcctagtagttccttgtcggaatcaagatgaattaatcggcagagccagaataagtcaaggagctggttggtcgcttcgtgaaactgcctgtcttgggaaaagttacgcacagatgtggagcctaatgtattttcatcgacgagatttaaggctagctgctaacgcaatatgtagtgcagtaccaagtcattgggtgccaacaagccgtactacatggtcaatccacgcaacgcatgaatggatgacaacagaagatatgttgacggtctggaatagggtatggattcaggaaaatccttggatggaagacaaaaccccagtagaatcttgggaggagataccttatttagggaaaagagaggatcaatggtgtgggtctttgattggtctaacatctcgtgcaacttgggcgaaaaacatacaaactgctataaatcaggtacggtctctcattggaaatgaagaatacactgactatatgcctagcatgaagcggttcagacgcgaggaagaagaagcgggagtcctttggtga

SEQ ID NO: 22939 - RNA, 9876 nt, synthetic construct
  misc_feature 1..9876: note = derived and/or modified CDS sequence (opt6) from DENV-2__HQ332184__SS-prME
  source 1..9876: mol_type = other RNA
acagcgggtgtaatcattatgttaatcccaacagcaatggctttccatttaacgacacgaaacggggaaccacacatgatagtgggccggcaagaaaaaggtaaatcccttcttttcaaaaccgaagacggcgttaacatgtgcaccttgatggccattgatttaggagaactctgtgaagacactataacttataaatgccccttattaagacaaaacgaaccggaagacatcgattgttggtgtaacagtacatctacatgggtgacatacgggacgtgcacaaccacaggtgaacaccgaagagagaaacgaagcgttgcattagtaccacacgtaggtatgggactagagactagaactgaaacatggatgagtagcgaaggagcatggaaacatgtgcaaagaatagaaacatggatcctacgtcatcctggttttacaataatggccgccatattagcatacactataggaaccactcacttccaacgcgccttgatttttatattattaacagccgtggcacctagtatgaccatgagatgtatcgggatatcaaatcgggactttgtagaaggggtttctgggggcagctgggttgatatagttctagaacatggctcatgtgttactactatggcgaaaaacaaacctactcttgactttgagttgataaaaacagaagccaaacagccagcaactctgagaaaatactgtatcgaagctaaattgaccaatacgactactgagagtaggtgcccgacccagggagagccctcactgaatgaagaacaagataaacgatttatatgcaaacacagtatggtcgacagagggtggggcaacggatgcggtttatttggtaaaggcggtatagtgacatgtgccatgtttacttgtaagaaaaatatggaaggtaaagtagtacaaccagagaatctagaatacacgatagtaataacaccgcactccggagaagaacacgcagtcggaaatgatacaggaaaacatgggaaagaaataaaaataaccccgcaaagttcaatcacggaagcagagttgactggatacggaactgttacgatggagtgctccccgagaacgggattagatttcaatgaaatggtcctcttacagatggaagacaaagcgtggcttgttcatagacagtggtttctggacctcccactaccatggttgcccggcgcagacactcaaggctctaattggatacaaaaagaaacactggtcacattcaaaaatccgcatgcaaagaaacaagacgtcgtagtacttggatcacaagaaggcgctatgcatacggcgctaaccggcgcaacagagattcaaatgagctctgggaacctactatttaccggacatttaaaatgtcgattgcgtatggataagctgcagctaaaaggcatgagttacagcatgtgcacaggcaagtttaaaatagtcaaagaaatagccgaaacacaacacggaacaatagtaataagaatccaatatgaaggagacggctcgccttgcaaaattccatttgagataacggaccttgagaaaaggcatgtattaggaagattaatcacagtcaatccaattgttatagaaaaagactccccagtcaatattgaagcagaacccccttttggtgactcatacataataattggggttgaaccaggacaattgaagctcaattggtttaagaaaggtagtagtatagggcaaatgtttgaaacgacgatgcgcggtgctaaaaggatggcaatactaggagatactggttgggattttggatcccttggcggagtattcacttcaataggaaaagctctacaccaggttttcggggctatatacggtgccgcgttttctggagtaagttggactatgaaaatactcattggcgtggtcattacctggataggcatgaactctcggtctacatctttaagtgtatcgctagtgctagtaggggtagttacactttatttaggagcaatggtacaagccgattctggctgtgttgtatcatggaagaataaagaattgaagtgcgggtccggcatctttataaccgataatgtacacacctggacagagcaatataaatttcagcctgaaagcccttcaaaactagcatcagcaatacaaaaagcccatgaagaaggtatatgtggaatacgcagtgtaaccagattagaaaacttaatgtggaagcagatcacaccagaattaaatcacatcctttccgaaaatgaagtcaaattaactataatgacaggagatactaaaggtataatgcaagctgggaaaagaagtcttcgtccacagccgacagagttaaagtattcctggaaaacatggggtaaggctaaaatgttaagtaccgaatcacacaaccaaacctttctaattgatggaccagaaacagctgaatgtcccaacaccaatcgagcatggaatagtctcgaggtcgaagattacgggtttggagtttttacgaccaacatttggcttaaactaagagagaaacaggacgtattctgtgattctaagctaatgtctgcagctataaaagataatagagcggtacacgcagacatggggtattggatcgagagtgcgctgaatgatacttggaaaatggaaaaagcgagttttattgaagtcaaatcatgccattggccgaaatcgcatacattgtggagtaatggggtcttggagtctgaaatgataattcctaaaaactttgctggacccgtatcacaacataattataggccaggttatcatactcaaaccgcaggtccctggcacttggggaagctagaaatggattttgatttttgtgaaggtactacagttgttgtgaccgaagactgcgggaacagagggccctcactacgaacaaccacagcctcagggaaattaattacagaatggtgttgtcggtcctgcacgttaccacccttaagataccgaggcgaagacggttgctggtatgggatggaaattaggccactaaaagaaaaagaagaaaacttagtaaattcattagtaacggctggtcatggccagattgataacttctcattaggagtattaggaatggcattgtttcttgaagaaatgttacgtactcgggtaggaacaaagcacgcgacactattagtcgctgcgagttttgtaacgctcatcactggaaacatgagtttccgtgatttaggtagagtcatggtcatggtcggcgccacaatgactgacgacatcggaatgggggtaacatatcttgctcttttagcagcgtttaaagtgagacctacattcgcggctggactattgttaagaaaacttacgtccaaggaacttatgatggccacaataggtataacacttctttcgcaaagtacaatccccgaaacaattttagaactgacggatgcactagcgttagggatgatggtcttaaagatagttagaaatatggagaaatatcaactagctgttacaattatggcaatcagctgcgttccgaatgccgtcattcttaggaatgcatggaaggttagctgcactatactcgcggcagtgagtgtcagtccccttctcttaacaagctctcagcaaaaagccgactggattcctcttgcattaacaataaaaggtttgaatcctactgcaatttttctaaccacactatctagaactagcaagaaacgaagctggccgctaaatgaggcaataatggcagtaggaatggtttctatcctggcaagctcactactaaagaatgatataccgatgactggcccattagtcgcaggaggacttctaacagtgtgctatgtattaacaggaagaagcgccgatctggaactagaacgtgctgcggatgtaaaatgggaagatcaggcagaaatatctgggagctccccaatattatcaatcactataagcgaggacggaagcatgtcaatcaaaaacgaagaagaagaacagaccttaacaattttaataagaacgggactcctcgtaatatcaggagtcttcccagttagtataccgattacagcggccgcatggtacctctgggaagtcaagaaacaaagagcaggggttctatgggacgtaccaagtcctccaccagtgggaaaagcagaacttgaagatggcgcatatcgtataaaacaacgaggaatactcggttactcacaaattggcgctggagtgtataaagagggtacatttcacaccatgtggcatgtcactcgcggggcagtactcatgcaccgaggaaaacggatagaaccttcgtgggcagatgtaaagaaagatttaattagctacggtggcgggtggaaactcgaaggagaatggaaagaaggtgaagaagtacaagtcttagcactagagcccggtaaaaacccaagggcagtccagacaaaaccaggtattttcaaaacaaacacaggaactatcggtgctgtatcactggacttttcgccaggtacaagcggcagcccaatcgtggacagaaaaggaaaagtagtaggactatatggcaatggagtggtgacccgctcaggggcatacgtcagcgctattgctcaaacagagaaaagcatcgaagacaacccggagattgaagacgatatatttcgtaagaaacggcttacgataatggacttgcacccaggggcaggaaaaactaagcgctatcttccagcaatagtcagggaagcaattaaaaggggtctccgaacattaattttagcgccaacaagagtggtagccgcagaaatggaagaagcactgcgcggtttgcccataagataccaaacaccagcaattaaagcagagcacactggtagggagatcgtagatttaatgtgtcatgcgacttttacgatgagattactctctccggtccgagttccaaattacaatctgataattatggatgaggcacattttacagatccagcatcgatagccgcccgaggttatatatcaactcgagtagaaatgggcgaagcagctggaatatttatgactgcaacgcctcctggaagtcgagacccgtttccacaatcgaatgcgcctataatggatgaagagagagaaattccagaaaggagttggaactccggacatgaatgggtcactgactttaaagggaaaaccgtctggtttgttccaagtattaaagcaggtaatgatatagcagcatgtttgcgcaagaatggaaagaaagtcatacagctgagcaggaagacctttgatagtgaatatgtaaaaacacgcgcaaatgactgggacttcgtggtaacaacggatatctcagagatgggtgctaatttcaaggcagaaagagtaattgaccctcgacgatgtatgaaacctgttatattaacagatggagaagaacgagtaattctcgccggaccaatgcccgttacccatagttccgcagcacaacgtagaggcagaatcggaagaaaccccaaaaatgagaacgatcagtatatttacatgggcgaaccgttggaaaatgatgaagactgcgcccattggaaagaagctaaaatgctgctggataatataaatacacccgaaggaataataccatcaatgttcgagccagaaagagaaaaagtagatgcaattgatggggaatatagattaaggggtgaggcgaggaaaacttttgtggatttaatgcgacgtggggatctaccggtctggctagcctataaggttgctgcagaggggataaattatgccgatagaaaatggtgtttcgatggtatcaaaaataatcaaattttggaagaaaatgtggaagtagaaatctggactaaagaaggcgaaagaaagaaactaaaacccaggtggctggatgccagaatttactcagatccactcgcgctaaaggaatttaaggaatttgcggctgggagaaaatcattaacattgaacttgataacagagatgggacggttgcctacattcatgacacaaaaagctagaaacgcgttagacaatttagcagtattacatacagcagaagcaggagggagagcgtacaatcacgctctatctgaactaccggagacactagaaacactcttactattaacactacttgcaactgtaaccggaggtattttccttttcctaatgtcagggaaaggaattgggaaaatgacattaggtatgtgttgcatcatcacagctagtgttttactatggtacgcacagatacaaccccattggatcgccgcgtcgataattttagaatttttcctcatcgttctgttgatacccgagcctgaaaaacagcgaacaccgcaagacaaccagctcacgtatgtagtaatagccattttaacagtggtggctgcaacaatggcgaatgaaatgggctttcttgagaaaactaagaaagatttaggtttaggatcgattacgacacaagaatcagaatcgaacatcctagatatagacttacgaccggcctcagcctggacattatacgctgtagccacgacatttgtgactcctatgctgagacattccatagagaacagttcggtaaatgtcagtctaacagcaatcgctaaccaagcgactgtcctaatgggcctaggcaaaggatggcccctatcaaaaatggacataggagtaccattattggccattggatgctattcccaggtcaatccaattactttaacagcagctctcctattattggtggcacactacgctataatcggaccaggattacaagctaaagccacccgagaagcacaaaaacgcgcagcagcgggtataatgaaaaatccaacagttgacggaataacggtaatagacttggaaccaataccatatgatccaaagtttgaaaaacagttgggacaggtaatgttactgatattgtgtgtaacacaagtactaatgatgcgaaccacatgggcattatgtgaagcactaacgttagcgacaggtcccataagcacattatgggaaggtaacccaggaagattttggaacacaacaatagcagtatcaatggccaatatttttaggggatcatacttggccggtgccggcttattattctctatcatgaaaaacaccactaatacacgaaggggaaccggcaatataggagaaactttgggagaaaaatggaaaagccgtttaaatgctctaggaaaaagcgagtttcaaatatacaagaaatcaggcatccaagaagtagatcgaactctagcaaaagaaggtatcaaacgcggagaaactgatcatcatgcagtatcacgcggaagcgctaaacttcggtggttcgtggaaagaaacatggtcacacctgaaggaaaagtcgtagatctaggatgcggacgtggcggctggtcgtactactgtggtggacttaaaaacgtacgagaggtaaaaggtcttactaagggaggcccaggacacgaagaaccgataccaatgagtacgtacggttggaatcttgtacgtctacaaagcggtgttgacgtattctttactccacctgaaaaatgcgacacactgttatgcgatatcggagaatctagtccaaacccgactatagaagctggaaggactctaagggtactgaatctggttgagaactggttgaacaacaatacacagttttgcattaaagtactaaatccgtatatgccgagcgtaattgagaaaatggaaacattacaacggaaatacggtggggctttagtacgaaacccactaagccggaactctactcatgagatgtactgggtcagtaatgcgacaggcaacatagttagtagtgtaaacatgatctctcgtatgcttataaaccgttttaccatgaaacataaaaaggcgacgtatgagccagatgtagatctaggtagtggtacccggaatattggaatcgaaagtgaaatacccaatttagatattataggaaagcgaatagaaaagattaagcaagaacatgaaacctcttggcattatgaccaagatcatccatacaagacctgggcataccatggttcttacgaaactaagcagacaggatctgcaagctctatggttaacggcgtcgtaagattattaactaagccatgggacgtggtgcctatggtaacgcagatggctatgaccgacacgactccctttggccaacaaagagttttcaaagaaaaagtggacacccgtacgcaagaaccgaaagaaggtacgaagaaattgatgcgcattacagctgaatggttatggaaggaactggggaagaagaaaacgccacgtatgtgtacgagggaagaatttacacgtaaagtaagaagcaatgcagcgttgggtgctatattcacagacgaaaacaaatggaagtctgcccgggaggcggtagaagatggccggttctgggaacttgtggacaaagaaagaaatctacatttagagggaaagtgcgaaacatgcgtttataacatgatgggaaagcgagagaagaaattgggggaatttggaaaggccaagggatcaagagcgatttggtatatgtggctaggggcgagatttctagagttcgaagcacttgggtttctcaatgaagaccactggtttagtagaggaaattcattatccggagttgaaggagaaggactccaccgattaggctatattctgcgagatgtaggcaaaaaggagggaggagcaatgtatgctgatgatacagcaggatgggataccaggattacactagaagacctaaagaatgaagaaatggttacaaaccacatgaaaggggaacataagaaattagcagaagcaatctttaaattaacttatcaaaataaagtagtgcgggtacaacgaccaaccccacggggaacagttatggatataatcagtcgaagggaccaaagaggaagtggacaagtcggaacatatggattaaatacatttaccaacatggaagcacaactcatcaggcaaatggaaggagaaggaattttcaaaagcatacaacatttaaccgcaacagaagaaatagccgtgcaaaattggctagcgagagttggaagagaacgtttgtctaggatggctatttcgggagacgattgtgttgtgaaaccaattgacgatagatttgcatctgctttgacagcattgaatgatatgggtaaagtaaggaaggatatacagcaatgggaaccatcacgaggatggaatgattggactcaagtccctttctgcagccatcacttccatgaacttgttatgaaggatggcagagttcttgtagttccctgccgaaatcaagatgagcttattgggagagcacggataagccaaggggctggctggtcgctgaaagaaacagcctgtttaggcaaatcttacgcccaaatgtggacattaatgtatttccacagaagagatcttagactcgcagcaaatgctatatgtagcgcagttccctctcattgggtcccaacctctcgaaccacttggtcaatacacgcaaaacatgaatggatgacaaccgaagatatgctagccgtgtggaatagagtgtggatacaagaaaatccatggatggaggacaaaactcctgtggaatcgtgggaagaagttccataccttggcaaacgagaagaccaatggtgtggaagccttatcggtctcactagccgagcaacgtgggctaaaaatatacaaaccgcaatcaaccaggtccgtagcctaatagggaatgaggaatacacagattatatgcctagtatgaagaggtttcgaagagaagaggaggaagccggagtgctgtggtaa

SEQ ID NO: 22940 - RNA, 9876 nt, synthetic construct
  misc_feature 1..9876: note = derived and/or modified CDS sequence (opt6) from DENV-2__HQ332185__SS-prME
  source 1..9876: mol_type = other RNA
actgctggtgttataatcatgttaatacccacagctatggcattccacctgacaacgcgaaatggtgaacctcatatgatcgtcggacgacaagagaagggaaaatccttgctattcaaaacagaggacggggtaaatatgtgcactttaatggctatagatttaggtgaactatgtgaggacaccataacttacaaatgtcctttgttgagacagaacgaaccggaagatatagactgttggtgtaattcaacctcaacgtgggttacttatgggacgtgcactacgactggagaacacagaagggaaaaacgatcagtagcattggtcccgcacgtgggaatgggtctggagacaagaaccgaaacatggatgtcctctgaaggtgcctggaaacatgttcaaagaatcgaaacgtggatcttacgacaccctggctttaccatcatggcggcaatactagcctataccatcgggactacgcattttcaacgagccttgatcttcattcttctaactgcagtagccccatctatgactatgagatgcattggcatttcgaacagggacttcgtcgagggagtgtctggtgggagttgggttgatatcgtattagaacacggttcatgtgtaactaccatggccaagaataagccgactctggattttgagctaataaaaactgaagcaaagcaacctgccacccttaggaaatattgtattgaagcaaaattaacaaacacaaccactgaaagcagatgcccaacacagggagagccaagtctaaatgaggaacaggacaaacgctttatctgtaagcatagcatggtcgatagaggttgggggaatggctgtggactatttggaaaaggtggaatagtaacttgtgctatgttcacttgcaaaaaaaatatggaaggtaaggtagtgcaaccggaaaatttagaatatacgatagttataacgccgcattcaggggaagaacatgccgttggtaacgatacaggaaaacacggaaaagagataaagatcacccctcaatctagtataacagaagcggaactaactggatatggaaccgtaaccatggaatgcagtccacgcacaggcttagactttaacgaaatggtattacttcaaatggaggacaaggcatggcttgtgcaccgccagtggttcttggatctaccgttaccttggctcccaggcgcagacactcaaggctccaattggatacaaaaggaaacccttgttactttcaaaaatccacacgcaaagaagcaggatgtagtcgttttaggatcgcaggagggcgcaatgcatactgctttaacaggtgctaccgaaattcaaatgagttctgggaatctactttttactggacacttaaaatgtcgattgagaatggacaagttacagctgaagggaatgagctacagcatgtgtacgggcaaatttaagattgtcaaagagatagcagagactcaacacggaactatagtaatacgaatacagtacgagggagacggttctccatgtaaaattcctttcgaaataaccgatcttgaaaaaaggcatgtcttaggtcggttaattacagtaaatcctattgtaattgaaaaagacagcccggtcaatatagaagcggaaccaccttttggtgactcatacattattataggagttgagcccggccaattaaagctaaattggtttaaaaaaggatcttcaatcgggcagatgttcgaaacaacaatgagaggtgctaaaagaatggcaatattgggggacacggcttgggattttggaagtctaggaggcgtatttacttcaatcggtaaagcgttacatcaagtatttggagcaatatatggggctgcattttctggcgtatcctggaccatgaaaattttaattggtgtagtaattacctggataggtatgaattctcggtcaacatctttgtcagtcagcctcgttttggtcggagtagtgacattatatttaggcgcgatggtgcaggccgattctggatgtgtggtctcctggaaaataaaagagctaaaatgcggctccggcatcttcataaccgacaacgtgcatacctggacagaacaatacaagtttcaacccgaatctccttcaaaactggcatcagcaattcaaaaggcccatgaagaaggcatttgtgggataaggtcggtaactagactcgagaacctaatgtggaaacagataacccctgaactgaatcatatactgtctgaaaacgaagttaagttaacgattatgacaggagacacgaaaggaataatgcaagcggggaaacgaagcctaagaccacaaccaacagagttaaaatattcatggaaaacatggggtaaggcaaaaatgctatcaacagagtcccataaccagacatttctcatagatggacctgaaacagcagaatgtcctaatacgaatcgagcatggaattcattggaggtagaagattacggcttcggagttttcacaacgaatatctggctcaaactaagagaaaaacaagacgtattctgcgatagtaagcttatgtcagcggcaatcaaaaataaccgagcagtccacgctgacatgggatactggatagaaagcgcattaaatgacacatggaaaatggaaaaagccagctttattgaagtaaaaagttgccactggcccaaaagtcacacattatggtcaaacggtgtccttgagtctgaaatgataatcccaaagaatttcgccggccccgtatcccaacataactataggcccggatatcacacacagaccgcggggccttggcatctagggaaattggaaatggattttgatttttgtgaaggtactactgtcgtcgtaactgaagattgtggaaatcgtggtccatctcttagaactaccacagcaagcggcaaacttattacagaatggtgctgtcgctcatgtacactgccaccgttacgatatagaggagaagacggatgttggtatggaatggagattagacctctaaaagagaaagaagaaaatttagtaaactcgttggttaccgcaggacatggtcaaatagataatttcagcttaggcgtgctcggaatggcacttttccttgaggaaatgcttagaactagagtaggaaccaaacatgcgattcttctagtagctgtctcatttgtaacattaataacaggaaatatgtcgtttcgagatctaggtagagttatggtaatggtcggagctacaatgaccgatgacattggcatgggtgttacttatttagcactattggctgcattcaaggtcaggcctactttcgcagctggtttacttctaagaaaattaaccagtaaggaattaatgatggcaacaattggaataacgttacttagtcaatctacaataccagaaactattttagaactaacagacgcactggctctaggaatgatggtgctaaaaattgtacgtaacatggagaaataccaactagccgtaacaattatggccatctcatgcgtcccaaatgcggtaatcctacggaatgcatggaaagtatcgtgcacgatattagcggcagtaagcgtaagtcccctcttattaactagttcacaacaaaaggcagactggattccgctagcattaacaataaaaggcctcaatccaactgccatatttctaactaccctctcacgcacatccaaaaagcgaagctggccattgaatgaagcaatcatggcagttggaatggtatcgatcctcgcatcaagtttattaaaaaatgatatcccaatgacaggacctttagtggccggtggactacttaccgtatgttatgttctaacgggacggtccgcagatttggaactagaaagagcagccgacgttaaatgggaagaccaagctgaaataagcggtagttcgcccatccttagcataactattagtgaggatggttccatgtcaattaaaaatgaggaagaagaacagacccttacaatcttaattcgtacaggattgcttgtaatctcgggagtttttccagtatctattcctattacggcggcagcttggtacttatgggaagtaaaaaaacaacgtgcaggggtactctgggacgtgccaagcccaccaccagttgggaaggccgaactcgaagacggcgcctacagaataaaacaaagaggcatattgggttattcacagataggtgcaggggtatataaagagggaacgttccataccatgtggcatgtgacacgcggagctgtcttaatgcatcgaggaaaaagaattgagcccagctgggcagacgtcaagaaagacttaatttcctacggaggcggatggaaactagaaggtgaatggaaggaaggtgaggaagtacaagtactagcactagagcccggaaaaaatccacgcgccgtacaaacgaagcccggaattttcaaaaccaatactggaacaataggcgccgtgtccctggacttctccccaggaactagtggaagtccaatagtggatcgaaaaggcaaagtagttggtctatacggaaatggagtagttacacgatccggcgcatatgtatcagcaattgcccaaacagagaagtcaattgaagataatccagaaatagaagatgatatcttccgaaagaaaaggttaacgattatggacttacatcccggggccggcaagaccaaacgttatttaccggctatagtaagggaagcgatcaaaagaggacttaggacgttaatactagccccaacaagagtcgtggctgcagagatggaagaggcattacgtggtctccctatacggtaccagactcctgcaattaaagctgaacataccggaagagaaattgttgatcttatgtgtcatgcaacgttcacaatgcgattgctgtcacctgtcagggtgcctaactataatttaatcataatggacgaagcacatttcacggatccagcgtcaatcgcagcacgagggtacatctccacgagggttgagatgggcgaagcggccggaatattcatgactgccactccgccaggatcgagagaccctttcccccagtcaaatgcaccaatcatggatgaggagagagaaatcccagaaagaagttggaattccggacacgaatgggtaacagatttcaaaggcaaaacggtttggtttgtaccatctatcaaagctgggaatgacattgcagcatgtttgagaaagaatggaaaaaaggtcattcagttaagccggaaaacattcgactcggaatacgtaaaaacacgagctaatgactgggactttgtcgtaactacggatataagtgaaatgggagctaacttcaaagcagaaagagttatagatccgcggagatgtatgaaaccggtaatcctaacagatggagaggaacgggtaatcctagcagggcctatgccagtaacgcatagtagtgcagctcaaaggcgtggtcggataggtagaaaccctaaaaatgaaaatgaccagtacatatacatgggtgaaccattagaaaacgatgaagactgtgcgcattggaaagaggccaaaatgttacttgacaacattaatactccagaaggaataattccttcaatgtttgaacccgaaagagaaaaagtagacgcaatagatggcgaataccgtttacgaggggaggcaaggaaaacgtttgtggatttaatgaggcgtggagatctccctgtttggctagcatataaagtagctgcggaaggcataaattacgccgacaggaagtggtgctttgatggaataaagaataaccaaatactagaagaaaacgtagaagtagaaatatggaccaaagaaggtgaaagaaagaaattaaaacctaggtggctagacgcaaggatttatagtgatcctctcgcactgaaagagttcaaagaatttgcagctggccgaaaaagtttaacactaaacctaataaccgagatgggacgtttacctacgttcatgacccaaaaagcaagaaatgcactagataatctcgcggtacttcataccgccgaggctggagggagggcgtataaccatgcactatccgaacttccggagacactcgaaacattacttttattaaccttactggcgaccgttactggtggtattttcttgttcctaatgtcgggcaagggaataggtaagatgacccttggaatgtgttgcataataactgcttctgtgctgttatggtacgcgcaaattcaaccgcattggatcgctgcaagcattatactagaattttttttaatagtattacttatacctgaaccagaaaaacaacgtaccccacaagataaccaattaacgtatgtcgtcattgctatattgacagtagtcgctgccactatggcgaacgaaatgggttttctggaaaaaactaagaaggatcttggtttgggaagcatcaccacacaggagtcagagagtaatattttagacatcgatttacggccagcatccgcatggacgttgtatgctgttgccactactttcgttactccaatgttaagacacagtattgaaaatagtagtgtaaatgttagcttgacagctattgctaatcaagcaacagtactaatgggtctgggaaaaggctggccactatcaaaaatggatataggtgtgccattactcgctatagggtgttattcccaagtaaatcctattacactaactgctgccttgctattgctagtagcacattatgccattataggaccaggactgcaagccaaagctaccagagaggcccaaaaaagagccgcagccggcattatgaagaaccccacagtggatggtattaccgtaattgatcttgaaccaattccttatgatccaaaattcgagaaacaactgggacaggtcatgttgctcatcctgtgcgttacgcaagtactaatgatgcggaccacatgggctctctgtgaagcacttacactagcgactggacccatcagcacattgtgggaaggcaacccggggaggttctggaacactactattgcagtctctatggcaaacatttttagaggctcatatctggctggagcgggacttctatttagcattatgaaaaatacgacgaacacaagacgaggtactggaaatatcggtgaaactctaggagaaaaatggaaatcaaggttgaatgcactcggaaagagcgaattccaaatatataagaaaagcggtatacaagaagttgacaggaccctagctaaagaaggtataaaacggggagaaactgaccaccatgcagtgtcgagaggttcagcgaagttacgctggtttgtggaacgaaatatggttacaccagaaggcaaagtagtcgacctgggttgtggtagaggtgggtggtcatactattgcggaggtctgaagaatgttagagaagtcaaaggacttacgaaggggggtcccggccacgaagaacccataccaatgagtacatacgggtggaacctcgttcgtctccagtcaggtgtggacgttttttttacaccgcctgaaaaatgcgatactttgttatgtgatattggggaaagttcaccaaatcctacaatagaggcaggtaggactttaagagttctaaacttagtcgaaaattggctaaacaacaatacacagttttgtattaaagtcttaaatccgtacatgccatcggtcatagaaaaaatggaaactctacaaagaaaatatggtggggccttagttcgcaatccactaagcaggaattccacacacgagatgtattgggtaagtaacgctacgggtaacatagtttcgtcagtcaatatgatcagcaggatgctgataaaccgatttactatgaaacataaaaaagcaacctacgaaccagatgttgatttaggaagcggaacacggaatataggtatcgaatcggaaatacctaacttagacattattggaaaaagaattgaaaagataaaacaagagcacgaaacgtcatggcactatgatcaggaccatccttataaaacctgggcataccacggaagctatgaaaccaagcagacaggatctgcgtctagtatggttaatggggttgtaagactcttaacgaaaccttgggatgtagtcccgatggttacgcaaatggctatgactgatacaactccatttgggcagcagcgagtgttcaaggaaaaagtcgacacgcgcacacaggaacctaaagaggggactaaaaaactaatgagaattacggccgagtggttgtggaaagagctcggaaaaaagaaaacgccgagaatgtgcaccagagaagaatttacccgcaaagttcgttctaacgcagcgctaggtgctatttttaccgatgaaaataaatggaagagcgcaagggaggcagtagaggacggaaggttttgggaactagtggataaagaacgaaacttacatttagaaggaaaatgtgaaacatgtgtttacaacatgatgggcaaacgggaaaaaaaacttggagaattcggaaaggctaaagggagtcgagccatatggtatatgtggctgggcgctagatttcttgaatttgaagcattaggttttttaaatgaagatcattggttctcaagaggaaattcgttatcaggggtagagggagaaggccttcatcgattaggttatattctaagagacgtaggaaagaaagaagggggagctatgtacgcagatgatacagccggctgggacacaagaataacactagaagatctgaaaaacgaagaaatggtaaccaatcatatgaaaggtgaacataagaagttagcagaagcaatttttaaattgacatatcaaaataaagtggtaagagttcagagaccgacccctagagggacagtaatggacataatttcaaggcgagaccagagaggttcaggacaagttggaacgtatggcctgaatacattcacaaatatggaagcacaacttataagacaaatggaaggtgagggtatatttaagagcattcaacatttgacagcgacagaagaaatagctgttcagaattggttagcaagagtcggcagagaacgcttgtctagaatggcaattagtggagatgactgtgtggtaaagcccatagatgacaggtttgcttctgccttgacagccttgaacgatatgggaaaagtacgaaaggacattcaacagtgggaaccgtcaagaggatggaacgactggacccaagtgccattttgcagtcatcacttccatgaattggtcatgaaagatggccgagtattagtagtaccttgtagaaaccaagacgaattaatcggtagagctagaataagtcaaggagctggctggtcactaaaagaaacagcgtgtctgggaaaatcatatgcacagatgtggacgttgatgtattttcaccgcagagacctgcgattagcagcaaatgcgatttgcagtgccgtgccgagtcactgggtaccaacaagccggacaacttggtctatacacgccaaacatgaatggatgactaccgaagacatgttagctgtgtggaatagagtttggatacaggaaaatccatggatggaagacaagaccccagtggaaagttgggaggaagttccatacttggggaaacgtgaagatcaatggtgtggatcactaataggattgacatctagagccacctgggcaaagaatatacaaacggccattaaccaagtaagaagccttataggaaatgaagaatatacagactatatgccctcaatgaagcggttcaggagagaagaggaagaagctggagtgctatggtaa

SEQ ID NO: 22941 - RNA, 9876 nt, synthetic construct
  misc_feature 1..9876: note = derived and/or modified CDS sequence (opt6) from DENV-2__HQ332186__SS-prME
  source 1..9876: mol_type = other RNA
acggctggagtaatagtaatgctaattccgaccgcaatggcatttcatttgactacgcgaaacggagaacctcacatgatagtcggacggcaggaaaaaggaaaatctcttttatttaaaactgaagacggagtaaacatgtgcacgctaatggcaattgatttgggggaattatgcgaagacactataacgtataaatgcccgttgttacgccaaaatgaaccagaagatatagattgttggtgtaactcaacctccacatgggtaacgtacggtacttgtacaacaactggtgaacatagacgagaaaaacggtcagttgctttagtccctcacgtaggaatgggattagaaactaggacagaaacttggatgtctagcgaaggagcatggaaacacgtacaacgaatagaaacgtggatactaagacatccaggtttcacaatcatggcagcgatactagcatatacgattggtacaactcattttcaacgggcattaatatttatattattaactgctgtagctccatcgatgacaatgcgctgtataggaatttcaaacagagacttcgtcgaaggtgtgtctggtggtagctgggttgacatagttttagaacacggatcatgtgttactacgatggcgaaaaataaaccaacattagattttgaattaatcaaaacagaagcaaaacagcctgcgacgttaagaaaatactgcatcgaagcaaaactgacgaatacgacaactgaatcgcgctgcccgacacaaggcgaaccctctttaaatgaagaacaggataaaagatttatttgtaaacatagcatggttgacagagggtggggaaatggctgtggattatttgggaaaggaggaatagtaacatgtgctatgttcacttgcaagaaaaacatggaaggaaaagtggtacagcctgaaaatttagaatatacaatagtcatcactccgcattctggtgaagaacatgctgtaggaaatgatacaggcaaacacggtaaagaaattaaaataacacctcaaagttctattacggaagccgaattgactggatacggaactgtaacgatggagtgcagtccaagaacaggtctagatttcaatgaaatggttctgctacaaatggaagataaagcatggctagtacaccgccaatggttcttggatctacctcttccttggctacctggtgctgatacccaaggttcaaattggattcagaaagaaacattagttacattcaaaaacccgcacgctaagaaacaggatgttgttgtacttggaagtcaagaaggtgctatgcatacagccctgactggggccacggaaattcaaatgtcgagcggcaatttactatttacaggtcacttaaaatgtcgtcttagaatggacaaactacaactaaaggggatgtcatacagcatgtgcacaggaaagttcaaaatagttaaggaaatagctgagacacagcacgggactatagtaattcgcgtacaatatgaaggagatggtagtccgtgcaaaataccgtttgagataacagacctagaaaaacgacatgtactgggtagactaataacagttaacccaatcgttattgaaaaagatagtcccgtaaatatagaagctgaacctccgttcggtgattcttatataattatcggggttgagccaggccaattaaaattaaattggttcaaaaaggggtccagtattggtcaaatgtttgaaacgacaatgagaggcgcaaaaagaatggctatactaggtgatactgcatgggattttggcagtctaggaggggtatttacgtccattggtaaagcattgcatcaagtatttggagctatatacggagccgcattttcaggtgtttcgtggacaatgaaaatattaataggggtggtaataacttggatcggcatgaactccagaagtacaagtttgagtgtatctcttgtgctagttggagtagtaacactctacctaggagctatggttcaagcggattcagggtgcgtagtctcatggaaaaacaaggaattaaaatgcggttcaggaattttcattactgacaatgtacatacatggacagaacaatataagtttcagccggagtctccgtctaaactggcgtccgcaatacagaaagcacatgaagaggggatatgtgggataagatctgtaaccagactcgagaatttaatgtggaaacaaataacgccagagctaaaccatattctatcagagaatgaggtaaaattaaccatcatgactggagatacaaaggggatcatgcaggccggtaagcgatcattacgaccacagcctacagagctaaaatacagttggaaaacgtggggaaaagcgaagatgttaagtaccgagtctcataatcagacattcttaatcgacggacctgaaactgctgagtgtccgaatactaaccgggcttggaacagtttagaagtagaagactatggattcggagttttcactacgaatatctggttgaaactaagggaaaaacaagacgtattttgtgacagtaaattgatgtcagccgcgataaaagacaatagggctgtacacgcagacatgggttattggatagaatctgccctaaatgatacttggaaaatggaaaaggctagtttcatagaagttaaaagttgtcactggcccaagagccatacattttggtcaaatggggtcttggagtctgaaatgattatacccaaaaattttgctgggccggttagtcagcataattacagacccggttatcatacacaaattgccggcccctggcatcttggtaaattagagatggactttgatttctgtgaggggacgacagttgtagttacggaagactgtggcaacagagggccatctcttagaacgacaacggcttccggcaaactgattaccgaatggtgttgcagatcctgcacactgccgcctctaagataccggggtgaagacggatgttggtatggcatggaaataagacctttaaaagagaaagaggaaaaccttgtgaatagcctagtaaccgcaggccacggacaaatagataatttctccttaggtgtgttaggaatggccctttttctagaagagatgttaagaacgcgcgtaggaacaaaacacgctattctattagttgccgtatcgttcgtgacccttataactggtaatatgagctttcgagatctaggtcgtgtcatggtcatggtaggtgcgacaatgacagatgatatcgggatgggagtgacataccttgcattgttagcagccttcaaagtgagacctacattcgccgccggtttattattacgtaaactaacatctaaagaattaatgatggcgacaattggaataacattattgagtcagagtacgatcccagaaactatattagaactgacggatgcgttagcactagggatgatggtattaaaaattgtacgcaacatggagaaatatcaactagcagtaactataatggctatcagctgtgttcctaatgcagtcatactcagaaatgcgtggaaggttagttgtacgatactcgcggctgtatctgttagcccattgctactaacatccagccaacagaaagcagactggataccactggctttaacgatcaaaggacttaatccaactgccatatttttaactacgctgtcacgtacaagtaagaaaaggagctggccactaaatgaagcaattatggctgtaggaatggtgtctatattagcatcctcattattaaagaacgatataccgatgacaggtcctttagtagcgggaggtttacttacagtctgctatgtattaacaggaagaagtgcagatttagaattggaaagagcagctgatgtcaaatgggaggaccaagctgagatctctggctctagccctatactatcaataaccatctcagaagacggatcaatgtccatcaaaaatgaggaagaggaacagacattgaccattctaataagaacaggactattagtaatttctggcgtttttcccgtatccataccgattaccgcagcagcttggtacctgtgggaagttaaaaagcagcgtgccggagtcttgtgggatgtcccttcacctcctccagtgggtaaagcagagttagaagatggtgcctatcgaataaaacagcgaggtatcctaggctatagccaaataggagcaggagtgtataaagaaggaacttttcataccatgtggcacgtaaccagaggcgcggtcttgatgcatagaggaaagagaatagaacctagttgggccgacgtaaagaaagatttgatttcttatggcgggggatggaagctagaaggtgaatggaaagagggagaagaagtgcaagtactagctctggagcctggcaaaaatccgagagcggtacaaactaaacctgggatattcaagactaatacaggtacgattggagcagttagtctcgattttagtccaggaacatccggctcaccaatcgtagatagaaaaggaaaagtagttggattatacgggaatggagtggtgactaggtcaggtgcctacgtaagcgcgatagcgcaaacagaaaaatcgatagaagataaccccgaaattgaagatgacatattcaggaagaagaggttgacaataatggatttacatccaggcgcaggaaaaaccaagcgttatctaccagcgatcgttcgagaagctataaaacgtggattacgaactttgatattagcacctactagggttgtagcagctgaaatggaagaagcactgcgaggattaccgatacgttatcaaactcctgcaatcaaggcagagcatactggaagagaaatagtagacctaatgtgtcacgctacatttactatgaggttattatctcccgtacgagttcccaactataatctaattatcatggacgaagcacatttcacggatccagcttcaatagcagctcgaggttacatttcgactagagtagagatgggtgaagctgcaggaatcttcatgaccgccacacctcccggatcacgtgacccatttcctcagtcaaatgcacctataatggacgaagaacgagaaatcccagaacgaagctggaactctggtcatgaatgggtaaccgactttaaaggtaaaacagtttggttcgtaccgagtattaaagccggaaatgatatagcggcatgcttacgcaaaaacggaaagaaagtgattcaattaagtagaaaaacattcgattcagaatatgtgaaaactagagctaacgattgggattttgttgtcaccacagatatatctgagatgggagctaactttaaagcagaacgtgttatagatccacgtagatgcatgaagccagttatactcacagacggggaggaacgcgttatactagcaggaccaatgccagtgacacatagtagcgcagcgcaacgtagaggacgaatcggaagaaatcccaaaaatgagaatgatcaatatatttatatgggagagccactagaaaatgatgaagactgtgcgcattggaaagaagccaaaatgttattggacaatattaatacacctgaaggtataattccaagtatgtttgaaccagagcgagaaaaagtcgatgctattgatggcgaatatcgtttacgcggagaggcccgcaaaacctttgttgatcttatgaggagaggtgacttgccagtatggctagcttataaagtcgcagcagaaggaataaactacgcagacaggaaatggtgctttgatggaattaaaaacaaccaaattttggaggaaaacgtggaagtcgaaatatggacaaaggaaggggaacgaaagaaacttaaaccccggtggctagacgcacggatatatagtgatccgctagcactaaaagagttcaaagagttcgcggcgggaagaaaaagtctcacactcaatctaattactgagatgggaagattaccaaccttcatgactcaaaaagccagaaatgcattagataacttagcagttcttcacacagcagaggcgggaggtagagcctacaatcatgcattaagcgaattacccgaaacactcgaaacattactactgcttacattgctcgcaaccgtcacagggggaatatttctgtttttgatgagcggcaaaggaattggcaaaatgacacttggcatgtgttgcattattacagcttctgttcttctatggtacgcacaaattcagccgcattggatagccgcctctatcatattagaatttttcctaattgtattactcattcctgaaccagagaaacaaaggacgccccaagataatcaattaacatatgtcgtcatagcaatattgacggtcgttgcagccacaatggcaaacgaaatgggttttctcgagaaaacgaagaaagatttaggattaggatctataaccactcaggaacccgagtcgaacatactagatatagatcttagacccgcttccgcatggacgctatatgctgtcgcaactactttcgttacgccgatgctacgtcatagtatagaaaattcatcagtaaacgtctcattaacagcgatagctaaccaggcgactgtgctaatgggtctgggtaaaggttggccattaagcaagatggatataggcgtacctttactcgctataggatgctactcccaggtcaaccctataacacttaccgcagcactgctactcctagttgctcactatgcgatcataggtccaggcctacaagcgaaagctacaagagaggcacaaaaacgggcagccgcaggtatcatgaaaaatcctaccgtagacggaataacagtaatagatctcgaacccataccatatgaccccaaatttgaaaaacaattagggcaagtaatgctcctgatattatgcgtaacccaagtactaatgatgcgaacgacttgggctttatgtgaagcgttaaccttggctaccggtccaatatccactctatgggaagggaatcctggaagattttggaacacaacaatagctgtctcaatggctaacatatttcgcggcagttacttagcgggtgcaggtttactgtttagcatcatgaaaaatacaaccaacaccagacgaggtacagggaatattggagaaacactaggagaaaagtggaagtcacgtttaaatgccctaggtaaatcagagttccaaatttacaaaaagtcaggaatacaggaagtagatcgcacactagctaaagaaggaattaaaagaggtgaaactgatcaccacgcagtgtcgcgcggaagtgccaagttacgttggttcgttgaaaggaatatggtcacacctgaaggcaaagtagttgatctaggatgcgggagaggtggatggtcatattactgcggcgggcttaaaaatgtccgtgaagtcaaaggactaactaaaggtgggccaggccatgaagaaccgatacctatgtccacatatgggtggaatctagttagactgcaatccggagttgacgtatttttcaccccaccagaaaaatgtgatacgcttctatgtgatattggagaatcaagtccgaaccctacgattgaagcaggaagaaccctacgagtattaaacttagtcgaaaattggctgaataataacacccaattttgtatcaaggttttaaatccctatatgccgagcgttattgaaaagatggaaactctgcagagaaaatacggcggtgccctagttcggaatcctttgtcaagaaacagtacccacgaaatgtattgggtaagcaatgcgacaggaaatatagtgagttctgtaaatatgatatcccgaatgttgataaatcgatttacaatgaaacataagaaagctacatacgaaccggatgtagacctgggtagtggtacacgtaatattggtatagagtctgagataccgaacctggatattatagggaagcgaatagagaaaataaagcaggaacacgagacatcatggcattatgaccaagatcacacatacaaaacttgggcatatcatggtagctatgagacaaaacaaacaggatcagcttcatcaatggtgaacggggtggtacgtctcttaaccaagccgtgggacgtagtacctatggtcacccaaatggcaatgacagataccacgccatttggtcaacagagggtgtttaaagagaaggtggatacgagaactcaggaacccaaggaaggtacaaagaaactaatgaggattacggctgaatggttatggaaagaattagggaaaaagaaaacaccaaggatgtgtacgcgagaagaatttactcgaaaggtacgaagtaacgccgccttaggggctattttcaccgacgaaaacaagtggaaaagtgcacgtgaagccgtcgaagacggacgattttgggagctagttgaccgcgaaagaaatctacatcttgaaggtaaatgcgaaacgtgtgtctacaatatgatgggcaaaagggaaaagaagctgggagaatttggtaaagccaaggggagtcgtgcgatatggtacatgtggctaggtgccaggttcctagagttcgaagcattagggtttctaaatgaagatcactggttctctaggggaaactccctctccggagttgaaggagaaggattacacaggctaggatatatactgagagacgtgggcaagaaagagggcggtgctatgtacgctgacgacacggccggttgggacacacgaattacattagaagatttaaagaatgaagagatggttactaatcatatgaagggagagcacaagaaactagcagaagccatctttaaattgacgtaccaaaataaggtagtccgagtgcaacgtccaacaccgagaggcacggtaatggacataatcagccgaagagatcaacgaggtagtggacaagtaggcacttatggacttaacacatttacgaatatggaagcacaactaattcgtcagatggaaggtgaagggatattcaagtccatacagcatttaacagttacggaggaaattgcggtacaaaactggcttgcaagagtaggaagggaaaggctctcgaggatggctatttctggagatgactgtgttgtaaaaccaattgatgatagatttgcatccgcccttacggctctcaacgatatgggaaaggtacgaaaagacatacaacagtgggagccatcgagaggttggaacgactggacacaagttccattttgctcacaccactttcatgaacttgtaatgaaggatggaagagtgctagtcgtcccctgtaggaatcaagatgaactcatagggcgagcacgtataagtcaaggagccggatggagcctaaaagaaacagcatgtctaggaaaaagttacgcacagatgtggactttaatgtattttcacagacgagatttaagactagcagctaatgctatctgttcggcagtgcccagccactgggtgcctacaagtagaactacgtggtcaatccatgcaaaacatgagtggatgacaactgaggatatgctcgctgtatggaatagggtttggattcaagagaacccttggatggaagataaaaccccggtcgagagttgggaggaggtcccatatcttggaaaacgcgaagaccaatggtgtggatccttgattgggcttacatcccgggcaacttgggctaaaaatattcaaactgctattaatcaagttcggagcctgataggaaatgaagaatatacagattatatgccaagcatgaagagatttagacgagaagaagaagaagctggagttttgtggtaa

SEQ ID NO: 22942 - RNA, 9876 nt, synthetic construct
  misc_feature 1..9876: note = derived and/or modified CDS sequence (opt6) from DENV-2__HQ332187__SS-prME
  source 1..9876: mol_type = other RNA
acagcaggagtaataatcatgttaattccgacagcgatggcgtttcacctaacaacgagaaatggagaacctcacatgatagtaggtagacaagaaaaaggtaaaagccttttgtttaaaacagaagacggagttaatatgtgtaccctaatggcaatagacctcggcgaactgtgcgaagatactataacatacaaatgtccactcctacgtcaaaacgaaccagaagacattgattgttggtgcaactcgacgtccacatgggttacgtacggtacatgtactacaacgggggaacatcgtagagaaaaacgatctgttgcattagtgccacacgtaggaatgggtttagaaacaagaacagaaacatggatgtcttctgaaggtgcttggaaacacgtacaaagaatcgaaacctggattctccgtcatccaggatttaccattatggccgctatattagcatacacaataggtacaactcattttcaaagagctttaatctttatattattaacagcagtagcaccaagcatgaccatgcgttgcatcggaatcagtaatcgagacttcgtagaaggtgtatccggtgggtcttgggtggatatagtcttagaacacggaagttgtgttacgacaatggccaaaaataaaccgacactagacttcgaattaattaaaactgaagcgaaacaaccagcaacattgcgcaaatattgtatagaagcaaaactcaccaacactacaactgaaagcagatgcccaactcagggtgaaccttctttaaacgaagaacaagataaaagattcatctgcaaacactcaatggtggatcgagggtggggaaatgggtgcgggctattcggaaaaggaggtattgtgacatgcgctatgttcacttgcaagaaaaacatggaaggtaaagtggttcaaccagaaaatctggaatatacgatagtaatcacgccacatagcggagaagaacacgctgtaggaaatgatacaggtaaacacggtaaagaaataaaaatcacacctcaatcaagtataactgaagcagaactaacaggttacggtactgtcaccatggaatgctcccctagaacaggtctagacttcaatgaaatggtcttgttgcagatggaagacaaggcttggttggtgcacaggcaatggtttctagatctgcctctaccatggctaccgggcgcggatacgcaaggttcaaattggattcaaaaagaaacattagtcacatttaagaaccctcatgccaagaaacaagatgtagtggttctcggtagtcaagaaggggcaatgcacacagcgcttacgggcgccacggagatccagatgtcgagcggaaatttgttatttacagggcatttaaagtgcagactaagaatggataaattacaactaaaaggaatgagttactcaatgtgtactggtaaatttaagattgtaaaagagattgcagagacacaacatggtactatagtcatacgtatacaatatgagggagatggtagcccatgtaaaataccattcgaaattaccgatctggagaaaaggcatgtgttagggagactaattactgtaaacccaattgttatagagaaggacagtccagttaatatagaagcagaaccaccatttggtgactcttacataattatcggggtagaaccaggacaattaaaattaaattggttcaaaaagggatcttccattggccagatgtttgaaaccacgatgcgaggtgcaaaacgaatggcgattcttggagacaccgcatgggactttggctctctgggaggtgttttcacgagtatcggaaaagcattacatcaggtgttcggggcaatatacggagcagcattcagcggtgtcagctggactatgaaaatattaattggagtagttatcacgtggataggtatgaactcaagatcaacatcacttagtgtatccctagtcctagttggcgtagtgacactctaccttggtgccatggtgcaagccgattctggatgtgtcgtgagttggaaaaacaaggagctcaagtgtggctcaggaattttcataacagacaatgtacatacatggacggagcaatataagttccaacccgaaagccctagtaaactcgcaagcgcgatccaaaaagcgcacgaggaaggaatttgcgggataaggtctgttactagactagagaatcttatgtggaaacaaattactccggaactgaaccatatactatcagagaacgaagtgaagctaactataatgactggagacacaaaaggcataatgcaagcaggaaagcgtagtttgaggccccaacccacagaattaaagtactcatggaaaacatggggaaaggctaaaatgttatcgacggaatctcataaccaaacatttttaatcgatgggcctgaaacagctgagtgcccgaatacaaatagagcatggaatagcctagaagtcgaagattacggttttggtgtgtttacaactaatatatggctaaaattaagagagaaacaagatgttttctgcgattccaagctaatgagcgcggcgataaaagacaatagagcggttcacgcggatatgggatattggattgaatcagcacttaatgacacttggaaaatggagaaagctagtttcattgaggtcaaatcatgtcattggccaaaatcgcataccttgtggtcaaatggcgtcttagagagcgaaatgataatacccaaaaattttgccggaccggtaagtcaacacaactatcggccaggataccacacacaaactgcaggaccctggcatttgggcaagttggaaatggatttcgacttctgtgaaggtacaactgtagttgttaccgaggactgtggaaacagaggacccagtctacgaacaacaacagcgtccggaaagttaattactgaatggtgttgtcgaagctgtacgttaccaccattacgatacagaggagaagacggttgctggtacggaatggaaataagaccgctaaaagaaaaagaagaaaatttagttaactccctcgttactgccggtcacggacaaatagacaactttagtctaggtgtattgggcatggcactatttttggaggaaatgttgaggacccgagtgggcacaaaacacgcgattctactcgtcgcagtctccttcgttacgctaataactgggaatatgagcttccgagacttaggacgagtcatggttatggtgggagcaaccatgactgatgatatagggatgggcgtgacttatttagccttattagcggcattcaaggtaaggccaactttcgcagcaggccttttattaaggaagctaacctctaaagaactaatgatggctacaataggtataactctactttctcaaagtaccataccagagacaatattagaattgacagatgccttagcgttaggtatgatgattttaaaaatcgttcgaaatatggaaaaatatcagctagcagtgactattatggccatatcctgtgttccaaacgcagttatcctgagaaatgcctggaaagtatcttgtacaatcctagctgccgtgagcgtgtcaccacttctgctaacttcgtcacaacaaaaagcggactggataccgctagctttaaccataaaaggattaaatcccacagccatttttctgacgacactttctcgaacgagtaaaaagcgctcatggccactaaatgaggcaattatggcggttggcatggttagtattctagcaagttcactcttaaagaatgacatccccatgacggggccacttgtggcaggaggtctattaacggtatgttacgtattaacaggaaggagtgcagatttagagcttgagagagctgcagacgtaaaatgggaagatcaagcggaaatatcaggatcatcacccatacttagtatcacaatctcagaggatggttcaatgtctattaagaacgaggaagaagaacaaacactaaccattttgatacgaacgggactgctggtaatttctggggtctttccagtaagcataccaataaccgctgcagcatggtatctctgggaagtgaagaaacaaagagctggcgtcttatgggacgttccgagcccaccaccggtgggcaaagccgaactggaggacggcgcatataggataaagcaacgaggtattctcggatactcacaaataggcgcaggggtgtataaggaaggaacattccatacaatgtggcacgtgacccgcggcgccgtcctcatgcatcgggggaaaagaattgaaccgtcctgggctgacgtaaagaaagatttaatttcgtacggtggtggttggaaactagaaggtgaatggaaagagggtgaagaagtacaagtcctagccctagaacccggaaagaacccgcgcgcagtccagaccaaacctggtatctttaaaactaatacaggcacgataggtgcagtcagcttagatttctcacctggcacgtctggttcacccattgtagacaggaaaggaaaagtagtcggtctatatggtaatggggtcgttacaagatcaggcgcctatgtgagtgccattgcacaaactgagaaaagcattgaagataatcccgaaattgaagatgacatatttagaaagaaaagattaaccataatggacttacacccaggtgctggcaaaacgaaaaggtatttacctgttatagtgagggaagcgattaaacgcgggttaagaacgctgatactcgctccgactcgggtcgtagctgcagagatggaagaggcactccgtggattgccaattaggtaccaaacaccagcgattaaagcagaacataccgggcgcgaaatagtcgacttaatgtgtcatgctacatttacaatgcggttactatcccctgtccgggtaccaaactataatctaattataatggacgaagcacattttacagaccccgccagcatagccgcccggggatatatttctacacgagtggagatgggagaggctgcaggaatatttatgacagccacgccacccggatcacgagatccgtttccacaatctaatgcaccaattatggacgaagaacgagaaataccggaacgcagctggaatagtggccacgaatgggttacggacttcaaagggaagacagtatggtttgttccaagcataaaagcaggcaatgatatagctgcctgcttaagaaagaacggcaagaaggtaatccaattaagtagaaaaacgtttgatagtgaatacgtcaaaacaagggccaatgattgggattttgttgtcaccaccgatatctcagagatgggtgcgaactttaaagccgagcgcgttatagatcctagacgctgtatgaaacctgttatacttacagatggcgaagaacgtgtcatcttagcaggtcccatgcctgtaacacactccagcgccgcacaacgtcgaggacgaataggaaggaaccccaaaaatgagaatgatcaatatatttatatgggggaacccctcgaaaatgatgaagattgtgcacattggaaggaagctaaaatgctactagacaatattaatacgcctgaaggaattataccctcaatgtttgaaccggaacgtgagaaagtggatgccatagatggagaataccgtctccgaggcgaagcaagaaagacattcgttgatctgatgcgtcgaggagatctccctgtgtggttggcatataaggtggctgcagaaggtataaattacgcggatagaaaatggtgtttcgacgggattaaaaacaaccaaattctcgaagaaaatgttgaggtagaaatttggaccaaagagggagaaaggaagaaactcaaacctcgatggctagacgcacgtatatatagcgaccccctggctctcaaagagttcaaagagttcgcagccggacgcaaatctctaacactcaacttaattacagagatgggaagattgcccacttttatgacccagaaggcgagaaatgcgctagacaatttagccgtactgcatacggcagaagccggtggtcgagcatacaatcacgccttgtcggaattacctgaaacgttagagacgttgttgttgttaaccttactggcgacggtaacaggaggtattttcctattcttgatgtcaggaaaagggattggaaaaatgactcttggtatgtgttgcatcattacagcttcggtattattatggtacgcacagattcagccacattggatcgcagcatcaattatattagaatttttcctaatagtgctcttgatccctgaaccggaaaaacagagaactccacaagataaccaactaacatacgtggttattgctatcctaaccgtcgtagcggccactatggccaacgagatgggctttttagagaaaaccaagaaagacctgggactaggatcaataacaacccaggagtcagaatcaaatatattagacatagacttaaggccggcttcagcatggactctatacgccgtcgcaaccactttcgtaaccccaatgttgaggcacagtatagaaaactctagtgtgaatgtaagtttgacagcaatagccaaccaggctactgtgctgatggggttaggtaaaggttggccattatccaagatggacataggagtgcctttattagcaataggttgctatagtcaagtcaatccaattacactaacagcagccttgttactattagtagcgcactatgcgatcattggtccaggactacaagcaaaagctacacgcgaagcacaaaagagagccgcagcgggaataatgaaaaatcctacggttgatggtataacagttattgatttggaaccaattccatatgacccaaaatttgaaaaacaactaggacaggtaatgttgttaatactatgcgtaactcaagttctcatgatgaggactacttgggcactttgtgaggcactaacattagctaccggaccgataagcaccttatgggagggcaatccagggcgtttttggaacacgactatagctgtttccatggctaacatattcagagggagctatctagctggagcaggattgctattctcaataatgaagaatactacaaatacacgaagaggtacaggaaatattggtgaaacattaggcgaaaaatggaaaagccgactaaacgcactaggaaagtcagagtttcaaatatacaagaagagtgggatacaagaagttgataggacgttagcgaaggagggaataaaaagaggggaaacagatcatcacgccgtctcgcgaggaagtgcaaaacttagatggtttgtagagcggaacatggtgaccccggagggtaaagtagtagacttaggctgcggaagagggggctggtcatattattgtggcggccttaaaaacgtcagagaggtgaagggtctaacaaaaggcgggccaggtcatgaggagccaattcctatgagcacatatggatggaacttagtgagattacaatccggagtggatgttttctttacgccaccagagaaatgcgacactttactatgcgatataggtgagtcatcccctaacccgacaatagaagctggaagaacactgcgagttctaaacttagttgagaactggctaaataataatactcaattttgcataaaagtattgaatccatatatgccttcagttatagagaaaatggagacactacagagaaaatatggtggagcactcgtaaggaacccactatcacgtaacagtacacacgaaatgtattgggtcagcaatgcaacgggcaacattgtaagtagtgtgaacatgatttcccgaatgttaattaataggtttaccatgaaacataagaaagctacgtatgagccggatgtagatctgggatcaggtacacgaaacattggtatagaatcagaaatacctaacctggatataatcggcaagaggatcgagaaaataaagcaggaacatgaaacttcgtggcattacgatcaagatcatccctataagacttgggcctatcatgggtcatatgaaactaaacaaaccggatcagcatccagtatggtgaatggagtagtaaggttattaacaaaaccctgggatgttgtaccaatggtgacacaaatggccatgactgataccactccatttggtcaacaaagagtgttcaaagaaaaagtagacactagaacccaggagcccaaggaaggtacaaagaaacttatgcgaattacggcagaatggctatggaaagaactaggtaaaaagaaaacacccaggatgtgcacgagagaagagttcacacgaaaagtacgaagtaatgccgcgctaggtgctatttttacggatgaaaataagtggaaatctgcacgagaagcagtagaagacgggaggttcggcgaattagtcgataaggagagaaacttgcatctggaaggcaagtgcgaaacatgcgtatataacatgatgggcaagcgagagaaaaagttaggtgagttcggtaaagcaaaaggaagtcgtgctatttggtacatgtggctaggagcaagatttctagagttcgaggcattaggatttttaaatgaagaccactggttctcacggggaaacagtctatccggcgtcgaaggcgaaggtttacatagactagggtacattttgagagacgtgggcaagaaagaaggaggagcaatgtatgctgatgatactgcaggttgggacacaaggattacactagaggacctcaaaaacgaagaaatggttacaaatcacatgaaaggagaacataagaaacttgcggaagcaatctttaaacttacatatcagaacaaagtagtacgagtacagagacccacaccacgaggaaccgttatggatattatttcacggcgtgatcagagagggagtggacaagttgggacatacggtttaaatacattcaccaacatggaggctcaactaataaggcagatggaaggagaaggaatctttaaatctatccaacatctaactgctacggaggaaattgcagttcaaaactggctagcacgggtcggaagagagcgcctgagcaggatggcaatcagtggtgatgactgtgtggttaaaccaattgatgacaggttcgcatcagccctaacggcattaaatgatatgggaaaggtcagaaaagacatacaacagtgggaacctagccgagggtggaacgattggactcaagttcctttctgtagccatcatttccatgagctggttatgaaagacggtagagtactggtggtaccatgtaggaatcaggatgaattaataggccgggccagaatctcacaaggcgcaggatggagtctcaaagaaactgcatgtttagggaagtcttatgctcaaatgtggactctaatgtattttcatcgcagagacttgcgattagccgcaaatgcaatatgttcagccgtacctagtcattgggtacccacatcacgtacaacatggagtatacatgcaaagcacgaatggatgactacggaagatatgctcgcagtctggaatcgtgtatggatacaagaaaatccatggatggaagataagactcctgttgaaagttgggaggaagtaccatacttgggaaaaagagaagatcaatggtgtgggagtctcataggattaacctctagggccacatgggccaaaaatatacaaaccgcgataaaccaggtgcgtagtttaattggaaacgaagaatataccgattacatgcctagcatgaaaaggtttcgaagagaagaagaggaggctggagttctttggtaa

SEQ ID NO: 22943 - RNA, 9876 nt, synthetic construct
  misc_feature 1..9876: note = derived and/or modified CDS sequence (opt6) from DENV-2__HQ332188__SS-prME
  source 1..9876: mol_type = other RNA
actgcaggcgtcattgttatgcttatacctacagcgatggcatttcacttgacaactagaaatggtgaaccgcatatgatagttgggagacaagaaaaaggtaaatcactgctgtttaaaaccgaagatggtgtaaacatgtgtacgttaatggctatagatttgggggaattatgtgaagatacgattacatataaatgccccctattaagacaaaatgaaccagaagatattgattgttggtgtaacagtacctctacatgggttacctacggcacttgtacaactactggtgaacatagacgagagaaaagaagcgtagcactggtaccacacgtgggtatgggtttggaaactcggactgaaacttggatgtcaagcgaaggggcttggaaacacgtgcaaagaattgaaacgtggatattaaggcatcccgggtttacaataatggcagcaatattagcatacacaattggaaccacacattttcagagggctctaatatttatcttacttactgctgttgcgccgtctatgacgatgaggtgtatagggataagtaaccgggactttgttgaaggggtttctggaggttcatgggtagatattgtccttgaacatggcagttgcgtaacaactatggccaaaaacaaaccaacattggatttcgaactaataaaaacagaagcaaaacagcctgctacattaaggaaatattgcatagaagctaaattgactaacactaccacagaatccaggtgtccgacccaaggggaaccttcattaaacgaagaacaagacaaaagatttatatgtaaacatagcatggtggatagaggatgggggaacggttgtggactatttgggaaaggtggcatagtcacttgtgcgatgtttacatgtaagaaaaatatggagggaaaggtggtacagcccgaaaacttggaatacacaatagtgatcacaccacacagtggcgaagaacatgcagtaggaaatgacacgggaaaacacggaaaagaaattaaaataacaccacaatcttcaataactgaagcggaactcacaggttatggaacggtgaccatggaatgtagcccccgaacaggattagactttaatgaaatggtacttctgcagatggaagataaagcctggctagtacatagacaatggttcctcgatctgccgctgccgtggttaccgggagcagatacacaaggatcgaactggatccaaaaagaaaccctagtcacgtttaaaaacccccatgcgaagaaacaagatgtcgtagttttgggcagtcaagaaggtgctatgcacactgcgttaactggagcaacggaaatccaaatgtcgtccggtaatctgttatttacgggacatttaaaatgccgattaagaatggataaattacaattgaaaggcatgtcgtactctatgtgcacagggaaattcaaaatagttaaagaaattgctgaaactcaacatggcactatagtaatcagagtccaatatgaaggggacggctcaccatgtaaaataccttttgaaattacggaccttgaaaaacgacatgttcttggaagactaataactgtaaaccctatcgtgatagaaaaagactctcccgtaaacatagaagcagaaccaccgttcggcgacagctatatcataattggggttgaacctggtcagttaaaattaaactggttcaagaaaggttccagtattggccaaatgttcgaaaccacaatgcgaggcgctaaaagaatggcaatattgggagatacggcatgggattttggaagtctaggaggggtttttacgtcgataggtaaagctctacatcaagtatttggtgctatttatggggctgccttttctggggtatcctggacgatgaaaattctcataggagttgtaattacatggataggtatgaactcacgaagtacgtcgttatcggtatcgttagtattagtgggtgtggttacgctttatctcggtgccatggtgcaagccgactcaggctgtgtggtgtcttggaagaataaagaactaaaatgtggatccggtatttttattaccgacaacgtacacacgtggacagaacaatacaagttccaaccagaaagccctagcaaattagcctcagcaatacaaaaagctcatgaagaaggaatttgtggtataagatccgttaccagacttgagaacctgatgtggaaacaaattactccagaactgaatcatatacttagtgaaaatgaggtaaaattaaccataatgactggtgatacaaagggagtcatgcaagctggaaaacgaagcctccgaccccaaccaacggaattaaaatactcatggaaaacctgggggaaagctaaaatgctctcgacggaatcacataatcagacgtttcttatagatggcccagaaacgacggaatgtcccaacacgaatagagcttggaacagtttagaggtagaggattatggatttggagtctttacaacgaacatttggttaaagctccgcgagaaacaagatgtattctgtgactcaaagttaatgtctgcggcaataaaggataatagagctgttcatgcagacatgggctattggatagaatcagcattaaatgacacgtggaagatggaaaaagcgagttttattgaggtaaaaagctgtcactggccaaagtcacacactctctggtcaaatggagtactagaatctgagatgataatacccaaaaactttgctggtccagttagccaacataattataggccagggtaccatacacaaatagctggtccatggcatttaggaaaattggaaatggacttcgatttctgtgagggaacgacagttgtcgtaacagaagattgtggtaatcgtggaccatcacttcgtacaacaacagccagtgggaaattgataacggaatggtgctgcaggagctgcacgttaccgcctctaagataccgtggtgaggacggatgctggtacggtatggaaataagacctttgaaagaaaaagaagaaaatctcgtaaactctcttgtaaccgccggacacggacaaatagataacttctcattaggtgttttaggtatggcccttttcttagaagaaatgttacgcactagggtaggaaccaagcacgcaatactactcgtagcagtatccttcgtgacattaataacaggaaacatgtcattcagggatctaggtagagttatggttatggttggtgcaactatgaccgatgatataggtatgggcgctacatacttagcattactagcggcatttaaagttaggccaacatttgcggctggtctacttctacgcaaattgacctccaaggaactcatgatggcaacaataggaataacattgttaagtcagagtacaattcccgaaacaatattagaacttactgacgctttggctctcggaatgatggtcctcaaaatcgtacgaaatatggagaagtaccaattagcggtaacaataatggctataagttgtgttcccaacgctgtgatattgagaaacgcctggaaagttagttgtaccatattggctgctgtaagcgtatcaccattacttctaacaagcagccagcagaaagcggattggattccattggccttaacaataaaagggttaaatccaactgccatattcctcacgacgctgagtaggacatccaagaagagatcatggcctcttaacgaagcaatcatggcggttgggatggtgtccattctggctagttctctccttaaaaacgacataccgatgacgggaccgctagttgcaggcggtctgttgactgtatgttatgttttaacaggtcgatctgctgacttagaactagagagagccgctgatgttaaatgggaggatcaggctgagatttcaggatcgtctccaattttatcgataacaatttctgaggacggatctatgagtatcaaaaatgaggaagaggaacaaacgctaactatattaatccgtacagggttgctcgttatcagcggagtattcccagtatcaattcccattacggcagccgcttggtatctctgggaggttaagaaacaacgagcgggtgtactctgggatgtacccagtccgccgcctgtaggaaaagcagaactggaagacggagcctatcgaataaaacaacggggaatattagggtacagccagattggtgcgggtgtatataaggaaggtacttttcacactatgtggcatgtgactagaggggcagtgctaatgcaccgaggtaaaagaattgaaccatcatgggcagatgtgaaaaaggatctaatttcttatggaggtggatggaaactcgaaggggaatggaaggaaggagaagagattcaggttctggccttggaacctggtaaaaacccccgggccgttcagactaaacctggaatattcaaaacgaatacgggaacaattggcgccgtaagtctggatttctcaccaggaacatccgggtctcctattgtcgatagaaagggcaaagtagtcggactatacggcaatggagtagtaacacgaagtggagcctacgtaagtgcaatagctcagactgagaagtcaatcgaagacaatccagaaatagaagatgatatttttcgaaagaagcgacttacaatcatggatctccatcctggtgccggcaaaacaaagagatacttacccgcaatcgttagagaagctattaaacgaggactaagaaccctgattttagcaccaacgcgagtggtagcggcagaaatggaagaagctctacgagggttgccaattaggtatcaaacccctgcgataaaggcggaacacacgggaagagaaatagttgatctcatgtgtcatgcaacgtttacgatgagattactaagtcctgtaagggtacccaattacaatcttattataatggatgaagcacactttacggaccctgcatctattgctgccaggggatatattagcacgagagtagaaatgggagaagctgcaggcatcttcatgactgctactcctcccggatccagagatccctttccccagagtaatgctcccataatggacgaagaaagagaaatacctgaacgctcctggaatagtggacacgagtgggtcacagacttcaaaggcaagacagtctggttcgttccaagcattaaagccgggaatgatatcgcagcctgtcttcgtaaaaacggtaagaaagtaattcaactttcgcgaaaaacatttgattccgaatatgtaaagactcgagcaaacgattgggattttgttgtgaccacggatattagtgaaatgggtgcaaactttaaagctgaacgcgtaattgacccccgaaggtgtatgaaacctgtcattctaaccgatggagaagagagagtcatcctggcagggccgatgcctgtgacccatagcagcgccgcgcaaagaagaggtcgtatcggaagaaatcctaaaaatgaaaatgatcaatatatttatatgggtgaacctcttgagaatgacgaagattgcgcgcattggaaagaagcaaagatgttactagacaacataaatacgccagagggtataataccgtcaatgtttgaaccagaaagagaaaaagtagatgctatagatggagaatacagactacgcggagaggccagaaaaacatttgtagatctaatgagaaggggcgacctaccagtatggttggcatacaaagtagcagccgaaggcattaattatgccgatcgaaagtggtgcttcgacgggattaaaaacaatcaaatactagaagaaaacgtagaagtggaaatatggactaaagagggtgaacgaaagaaattaaaaccacgatggctcgacgcaaggatatatagcgaccctttggcactcaaagaatttaaagaatttgcagccgggcgcaaatctctcacactcaatttgataactgaaatgggtcgattaccgactttcatgacacaaaaagcgaggaacgctcttgacaatcttgctgtattgcatacagccgaagctgggggccgcgcatacaatcatgccttaagtgagctaccggaaacactagaaactctattacttttaacactattagctacagtgacaggtggtatattcttgtttttaatgtcaggtaaagggattggcaaaatgaccttggggatgtgttgtataataacagctagtgtattactctggtatgctcaaatccaacctcactggatcgcagcgagcatcatactagagttctttctaattgtactacttattcctgaaccagaaaaacaaagaacacctcaagataaccagcttacttacgttgttatcgcaatactcacagtggttgcagcaacgatggcaaacgaaatgggctttctagaaaagaccaaaaaggacctcgggctcgggtcaataacaacccaagaaccagaatccaatattcttgatatagaccttagaccagctagtgcttggacactttacgccgtggccacgacattcgtcacaccaatgctaaggcattccattgaaaacagctccgtaaacgtcagtttaacagcaatagctaaccaggctaccgtgctcatgggtttagggaaagggtggcccctaagcaagatggacataggtgtgccgctcttagcaattggatgttacagccaagttaatcccattaccttaacagcggcattactcttattagtagcccactatgcaataattggacctggattgcaagccaaagcgacaagagaagcacagaaacgtgcagcggccggaatcatgaaaaaccctacagtcgatggaataacagttatagatttagaaccaattccatacgatccaaaattcgaaaaacagcttggacaagtaatgctattaatactatgcgtaactcaggtcctaatgatgcggaccacatgggcattatgcgaagcattaactctcgccaccggacccataagtacgttatgggaaggtaatccagggagattttggaatacgacaatcgcagtatctatggccaatattttccgaggaagttatcttgctggcgcaggactactatttagtataatgaaaaacactacaaacacaagaaggggcacagggaacatcggggaaacattaggcgaaaagtggaaatcaagattaaatgcattaggaaagtccgagttccagatatataagaaaagtggtattcaagaggtcgacaggactctggcaaaagagggaattaaaagaggagaaacagatcatcacgcagtgagccgcggaagcgccaaactacgttggtttgtagaaagaaacatggtaacgccagaaggaaaggttgtagatctcggttgtggtagaggtggatggagctactactgcggagggcttaagaatgtacgggaagtaaagggattaactaagggtggaccgggccacgaggaaccaatacccatgtcaacgtacggctggaaccttgtgagattgcaatctggggtagatgtatttttcaccccgcccgaaaaatgcgacacactattatgcgatattggagagagtagcccaaatcccactatagaagcaggacgaacgttgagagtactaaatctagttgaaaattggctaaataataacacacagttctgtattaaagtactaaacccctatatgccatctgtaatcgagaaaatggaaacactacaacgtaagtatggaggtgcattagttagaaatccactatcgcgaaattcgacacatgaaatgtactgggtttccaacgcaacggggaatattgtatcatctgttaatatgatatcaagaatgcttatcaaccggttcacaatgaaacataagaaagcaacctatgagccggacgtggacttaggatcaggaacccgaaacatcggaatagagtcggagatcccaaatttagacatcataggaaaaaggattgaaaagataaaacaagaacacgagaccagctggcattacgaccaagaccacccttacaaaacctgggcataccatggtagctatgaaacgaaacaaactggatccgctagtagtatggtaaatggtgttgtaaggttactaacaaagccgtgggacgtagtgcccatggtaacacaaatggctatgaccgacacaactccatttggccaacaacgggtatttaaggaaaaagtcgatactcgaacacaagaacctaaagagggaactaaaaagctaatgaggatcacggcggaatggttatggaaggagttaggcaagaagaaaacacctaggatgtgtactagagaagaatttacacgaaaagttcgatctaacgcagcattgggagccatcttcacagatgaaaataaatggaagtcggcgcgtgaagcagtcgaagatggacgtttttgggaattagtggaccgagaacgaaatctccacttggagggaaagtgtgaaacatgcgtatataacatgatgggaaaaagagagaagaaacttggggagtttggcaaagctaaaggttcacgtgcaatctggtatatgtggctcggagccagatttctagaatttgaagcgttgggatttttgaatgaagatcattggttttcaagaggcaacagtttatcaggagttgaaggtgagggtttacataggttgggttatattttgcgagacgtgggcaagaaagaaggtggagcaatgtatgcagatgacacagctggatgggacacgcgcatcacactggaagacttgaaaaacgaagaaatggtaaccaatcatatgaaaggtgaacataagaaactcgctgaagctatatttaaactcacataccaaaacaaagtagtgcgtgtacaaagaccaactccacgaggcacagtaatggacatcatatcacgtagggatcagagaggaagtggccaggttggaacatatggactaaatacatttacaaacatggaagcgcaattaataaggcaaatggagggtgaaggaatatttaaaagcatccagcatctgacagtaactgaagaaatagcagttcaaaactggttggcccgagttggacgtgaacgtttgtcgagaatggccatatccggtgacgactgcgtcgttaaacccatagatgatagatttgcgtcggcactgacggcactgaacgatatgggtaaagtccgcaaggatatacaacaatgggaaccctcccgtggctggaatgactggacccaggtaccattttgtagtcatcatttccacgagttagttatgaaagatggtcgagtattagtagttccttgtagaaatcaagacgaacttataggccgagcaaggataagtcaaggagctggatggtcattaaaagaaactgcatgtctcggcaagtcatacgcacagatgtggacgttgatgtattttcatcgaagagacctcagactcgcagcaaatgcaatctgttccgcagtcccgagtcactgggttccgacaagtagaactacctggtccattcatgcaaaacatgagtggatgaccacggaggatatgttagcagtctggaacagagtctggatacaagaaaatccctggatggaagataagacaccagttgagtcatgggaggaagtaccatatctaggtaaacgagaggatcagtggtgtggctcacttattggtttaacttcacgagcaacttgggccaaaaatatacaaacagctattaatcaagtgaggtcacttatcggaaatgaagaatatactgattatatgccatctatgaaaagatttaggcgtgaagaagaagaagcaggagttctatggtaa

SEQ ID NO: 22944 - RNA, 9876 nt, synthetic construct
  misc_feature 1..9876: note = derived and/or modified CDS sequence (opt6) from DENV-2__HQ332189__SS-prME
  source 1..9876: mol_type = other RNA
actgcaggagttatagtgatgttgattcccacggcaatggccttccaccttacgactcggaatggagaacctcacatgatcgtaggcaggcaagaaaaaggtaaaagtctattatttaaaactgaagatggtgttaacatgtgtacactaatggcaatagaccttggagaactgtgcgaagatacgattacatacaaatgcccgctcctacgacaaaatgaaccagaagatattgactgctggtgcaattcaacatcaacatgggtaacttatggaacatgtacaactacaggtgaacatcggagagaaaaacgttcggtagccctggtaccgcatgttggtatggggctagagactcgaacagaaacgtggatgtcttccgaaggtgcgtggaaacacgtacaacgaatcgaaaattggatcctcagacatccagggtttacaataatggcagctatactggcgtacaccattgggacaacacatttccaaagagctctgatttttatcctactaacggcagtagcgcccagtatgactatgcggtgtataggaatatctaatagagattttgtagaaggagtctccgggggctcgtgggttgatatagtattagagcatggatcatgcgtcactacaatggcgaaaaataaacccacactagattttgaattaataaaaacagaggcgaaacaacccgcaacgttacgcaagtattgtatagaggcaaaacttaccaatacgacaacagaatcaagatgcccgacccaaggcgaacccagcttaaacgaagaacaagacaaacggtttatatgtaaacatagcatggtggataggggttggggtaatggctgcggcctatttggtaaaggtgggatagtaacatgtgcaatgtttacatgtaagaaaaatatggaaggaaaagtagtacagcctgagaatcttgaatacacaattgtaataaccccacacagtggagaagaacatgcagtggggaacgatacaggcaaacatggaaaggagataaaaatcaccccacaatcgtctataactgaagccgaacttacaggttatggaacagttactatggaatgctcgccccgtacaggtctagacttcaacgaaatggtattactacaaatggaagataaagcatggcttgtacaccgacaatggtttctcgacttacctcttccatggttaccgggagctgatacgcagggatcaaactggatacagaaagaaaccttagtgacttttaaaaatccgcacgctaagaaacaagatgtagttgtactagggtcacaggaaggagcgatgcacacagctctcaccggcgcaactgaaatccaaatgtctagcggcaacttattattcacagggcatttgaaatgcagattgcgtatggacaaactacaattgaagggtatgtcatattcgatgtgtacaggtaagttcaaaatagtcaaagaaattgcagaaacacagcatggcactatagtaattcgcgtgcaatacgagggtgatggatctccttgtaagataccgttcgagattaccgacctagaaaaacggcatgtcctaggtcgcctaataacagtgaacccaatcgtaattgaaaaagatagcccggtgaatatagaggcagaaccgccgttcggagattcatacgtgattattggtgttgagcctggccagttgaagctgaattggtttaagaagggttcgagtatcggtcaaatgtttgaaaccactatgaggggcgccaagcgcatggccatactaggggatacagcctgggattttggatcattgggtggtgtattcacatcgatagggaaagccttacatcaagttttcggtgcgatctatggcgcagcgttttcgggcgtttcgtggacgatgaaaatacttataggagtcgtaataacgtggataggaatgaatagccgatcaacaagtttatctgtctcactggtactggtcggggtggtaacactatacttaggcgcgatggtgcaggctgattcggggtgcgtggtgagctggaaaaacaaggaattaaagtgtgggagcggtatatttatcacagacaacgttcatacatggacagagcaatacaaatttcagccggaatcaccaagcaaattagcgagcgctatacaaaaggctcacgaagaaggaatatgtggaatacggagtgtaacaagactagagaatttaatgtggaagcaaataacaccggaactaaatcatatattaagcgagaatgaagtcaaacttacaatcatgacaggagacacaaaaggcatcatgcaagctggaaagcgtagcctaagaccacaaccaactgaactaaaatactcatggaagacatggggcaaagcgaaaatgctctcgacagagtctcataaccaaacattcctaatcgacgggccggaaacagcagagtgtcccaatacgaatagagcttggaacagtcttgaggttgaagactatggtttcggcgttttcaccacaaacatatggcttaaactacgtgaaaaacaggacgtcttttgcgatagtaaacttatgagtgcggccattaaagataacagagctgtgcacgctgatatgggatactggattgaatcagctctaaatgacacatggaaaatggaaaaggcttcattcatagaagtaaaatcatgccattggcctaaaagccacaccctatggagtaacggtgtattagaaagtgaaatgattatccctaaaaactttgcaggaccggtgagtcaacataattatcgaccagggtaccacacacaaaccgcaggtccttggcatttgggaaaactcgagatggatttcgacttctgcgaagggactacagtagtagtcactgaagattgtggtaatcgaggcccatcgttgaggacaactaccgcatctggaaagttaatcaccgaatggtgctgcagatcttgtaccttgcccccactaagataccgaggagaggatggatgctggtatggtatggaaattcgaccgctaaaagaaaaagaagaaaatctagtaaattccttggtcacagcaggtcatggccaaatagataatttttcacttggggttttaggaatggcactattcctggaagaaatgctaagaaccagggtggggacgaaacacgccatactcctagttgcagtaagttttgttacattaatcacaggtaatatgtcattccgtgatctcggtcgagtaatggtgatggtcggtgctactatgacagacgatataggcatgggtgttacttacctggccttactagcggcttttaaagttagaccaacattcgcagctggtctattactcagaaaactaacgtctaaagagcttatgatggcaactattggaataacactgctaagccaaagtacaataccggaaaccatattagaactgacggacgcattagcattaggaatgatggtccttaaaatagtcagaaatatggagaagtaccagctcgcagtaacaattatggcgataagttgtgtcccaaatgcggtaatattaagaaatgcctggaaggtttcttgcaccattctcgcagcagtttccgtaagtcccttacttttaacatcctcacagcagaaagcagactggataccactagcactaacaataaagggtcttaatccgactgcaatctttttaactacgctttcacgcacgtcgaagaaaaggtcctggccactgaatgaagcaatcatggcagtggggatggttagcattctggcatcgtctctattgaaaaatgacatacctatgacaggacctctagtggctggtggcctacttacggtgtgttatgttctcacgggaagaagcgcagacttagagcttgagagagcagcagatgttaaatgggaagatcaagctgaaatcagcggaagcagcccaatcttgtcaataaccatatctgaagacggttctatgtcaattaaaaatgaagaagaggaacaaacacttacaattctaattaggacaggtctactggttatatcaggtgtgtttccagtaagcatacccattacagcggctgcatggtatctatgggaagtaaagaaacaacgtgcgggagtattatgggacgtaccctcaccccctccagttggtaaagcagagctggaagatggtgcctaccgtattaaacaacgaggaatcctggggtactcccaaatcggagcaggcgtgtacaaagaaggaacttttcatacgatgtggcatgtcacacgaggtgctgtgcttatgcatcggggaaagcgaatagagccttcctgggctgatgtcaagaaagatcttatatcttacgggggcggatggaagctagaaggagagtggaaagaaggggaagaagtgcaagtacttgcattagaaccaggcaagaatcctagagcagtacagaccaaaccagggatatttaaaacgaataccggcaccataggcgccgtcagcttagatttcagccctggaacaagtgggtctcctattgtagacagaaaaggtaaagtagtaggactatacgggaatggtgttgttacaagatcgggtgcatatgtttcggcaattgctcaaaccgaaaagtctattgaagataatccagaaattgaagatgatatttttagaaagaaaagacttacaattatggatttgcatccgggagctggaaagacaaaaagatacttacctgctattgtaagagaagcaattaaacgaggcttacgtactcttatactggctccaacgagggttgtagcggcggaaatggaagaagctctacgaggtctcccgatacgataccaaacacccgcaattaaggcagaacatactggtcgagagatagtagatttgatgtgtcacgctacatttacaatgcgcctattatcgccagttagagtaccgaattacaacctgataatcatggatgaagcccactttacagacccggcttcaatagcagcacgtggatacataagcacccgagtcgaaatgggagaagcagcggggatatttatgactgccacgcctccggggagtagagatcccttcccgcagagtaacgcaccaatcatggatgaagagagagaaatccccgaaagatcatggaactcgggtcatgaatgggtaacagactttaaaggtaaaacagtctggtttgttccgagtataaaggctggtaatgacatagcagcatgcctaagaaagaatgggaagaaagtgatccaattaagccgaaaaacttttgattcagaatatgtgaaaacaagagcaaatgattgggatttcgttgtgacaactgatattagcgaaatgggagcaaattttaaagcggagagagtgatagacccaagaagatgcatgaaacccgtcatacttacagacggtgaagaacgcgtaattctagcaggtccaatgccagttactcactcgtcagcagcacaaagacgaggtcgtattggtcgaaatcctaaaaatgagaacgaccaatatatttacatgggagaacctcttgagaacgatgaagattgtgcacactggaaagaggcaaaaatgctcctagacaatataaacaccccagaaggaataatccctagcatgttcgagccggaaagggaaaaagttgatgccattgatggtgaatatcgactaagaggcgaagcccgcaaaacttttgtggatcttatgcgtagaggtgatctacccgtctggctagcatacaaggtagctgcggagggtatcaattacgcggaccgcaaatggtgtttcgacgggattaaaaataatcaaattttggaagagaatgttgaagtcgaaatctggacaaaggaaggtgagagaaagaaacttaaaccacgctggctggatgcacgtatctatagtgacccccttgcattgaaagagtttaaggaatttgccgcaggtcgtaagtcgctgacactaaatcttattactgagatgggtagacttccaacattcatgacacagaaagcaagaaacgcattagataacctggctgtattacatacggctgaggccggtggacgagcatataatcacgcattatcggagttacccgaaaccctagaaacgctattacttctaacgttactagcaactgtaacaggaggaattttcctattcttaatgtcaggaaaaggcataggtaagatgaccctgggtatgtgctgcattataacagcgtcagtattgctatggtacgcacaaatacaaccacactggatagcagccagcattatattagaatttttcttaattgttctattgatccccgaaccagaaaagcagagaactccacaagacaaccagttaacttatgtggtcatagctatactgacagtagtagcagctactatggccaatgaaatgggattcttagagaagactaagaaagacctgggtttgggaagtataacaacacaagagtccgaatccaacatattagatatagacttgagaccagcatcagcatggactttgtacgctgtagctacaaccttcgtaacgcccatgttaagacatagtatagaaaattcaagcgtaaacgttagtttaactgctatagcaaaccaggctactgtattaatgggattaggaaaaggctggcctctatcaaagatggatattggcgtgccattattggcgattggttgctattcacaagtaaacccaataacactaaccgctgccttattattattggtcgcacattacgcaataataggaccgggattacaagcaaaggctacaagagaggcacaaaagcgtgccgcggcaggtataatgaaaaaccctaccgtggatggcataactgtaatagatttagaaccaattccatatgatccaaaattcgagaaacagcttggacaagtcatgttgctaatattatgtgttacacaggtgttaatgatgcgtacaacatgggcgctatgtgaagcactcaccttagctaccggaccgatatcaaccttatgggaaggaaatcccggaagattttggaataccacaatcgccgtctcaatggccaatatattccgaggatcctacctggcaggggctggattgttattcagtattatgaagaacaccacaaatactcgtagaggcacaggaaatataggagagaccttaggtgagaaatggaaatctagattaaacgcactgggtaaaagcgagttccaaatttacaagaaatcgggaatacaagaggtggatcgaaccttagccaaagaagggataaagagaggggaaacggatcatcatgcagtttcaagagggagcgccaagctcagatggtttgtagagagaaacatggttacgcccgaaggaaaggtagtggatttaggatgcggcagaggagggtggagttattactgtggcggactcaagaatgtacgcgaggtcaagggattaacaaaaggtggaccgggtcacgaagaaccaataccgatgagtacatatggatggaacttggtacgattacaatcaggagttgatgtattctttacaccacccgaaaagtgcgatacactcttatgcgatataggggaatcaagtccgtcaccaactatagaggcaggacgcacactcagagtcctcaacttagtagaagattggcttaacaacaatactcaattctgtataaaagtactaaatccttatatgccctcggtcatagagaaaatggaaacattacaaaggaaatatggcggagccttagtaagaaatccacttagtcgaaattccacacacgaaatgtactgggtaagcaacgcgacgggaaacattgtgagcagtgtgaacatgattagcagaatgcttataaatcgatttaccatgaaacacaagaaagcgacatacgaacccgatgtagacttaggtagtggtacacggaatattggcatagagtcagaaataccaaatttagatattatagggaaaagaatagagaaaataaaacaagaacatgagacatcgtggcattacgatcaggaccatacgtataaaacatgggcctatcatgggagctacgaaacgaaacaaaccggttcggcaagttcaatggttaatggtgtggtaagactgctaactaagccgtgggacgtagtaccaatggtcacacaaatggcaatgacagatacaaccccctttggtcaacaacgagtatttaaagaaaaagttgacacaagaacacaagaacctaaggaaggcacgaagaaactcatgcggattacagctgaatggttgtggaaagaactgggtaagaagaaaacacccagaatgtgtactagagaagagtttacaaggaaagttaggtcgaacgcagcactaggagcgatttttaccgatgagaacaaatggaaaagcgctagagaggctgttgaagatgggcgattttgggagctagtagatagggaacggaacttgcatctagaaggcaaatgtgaaacttgcgtgtataacatgatgggaaagcgtgaaaagaaattgggtgagttcggaaaagcaaaagggagtcgtgccatatggtatatgtggcttggagcaaggttcttggagttcgaagcactagggtttctcaatgaagatcattggttctcacggggaaatagcttgagcggagtagaaggtgagggattacatagactgggttatatactaagagacgttggcaaaaaggagggcggtgctatgtatgcggacgacactgcagggtgggatacccgaataactcttgaagatcttaagaatgaagaaatggtaacaaaccacatgaaaggggaacataagaaattagctgaagcaatctttaaactcacatatcaaaataaagttgtacgggtgcagagaccaactccgcgaggaactgtgatggatatcatatcaaggagagaccagagaggtagtggacaggtaggaacttatggactaaatactttcacaaatatggaggcacagttgattagacagatggagggagaagggatattcaaatctatacagcatttaactgcgacagaagagattgctgtccaaaactggttagccagagtaggtagggaaaggctttcaagaatggcaataagtggagatgattgtgttgtaaagccaatagatgatagattcgcctcagcattaactgctctgaacgatatgggtaaagttaggaaggacatacaacaatgggagccttcaaggggctggaacgattggacgcaagtcccattttgttcacatcatttccatgaactcgtcatgaaggacggacgtgtgctggttgttccatgccgtaaccaagacgaactgatagggcgagcacggatatcccaaggcgcaggttggtcgctaaaagaaactgcatgtttagggaaaagctatgctcaaatgtggacactaatgtatttccatcggagggatttacgtctggcagcaaatgcaatttgttcagcagtgccgtcacattgggtgccaacctcacgaaccacatggagcatacacgcgaaacacgagtggatgacaactgaagatatgctggccgtgtggaaccgagtctggatacaagaaaatccctggatggaagacaaaacaccagtagagagttgggaagaagtcccttatctaggaaaaagagaagatcaatggtgcggttcgctgatagggttaaccagcagagcaacctgggcgaaaaacatacaaaccgcaattaaccaagtacgcagtctaataggcaacgaagaatatacagattacatgccaagtatgaaacggttccgaagggaagaggaagaagctggtgtgctatggtag

SEQ ID NO: 22945 - RNA, 9876 nt, synthetic construct
  misc_feature 1..9876: note = derived and/or modified CDS sequence (opt6) from DENV-2__JN368476__SS-prME
  source 1..9876: mol_type = other RNA
agtgctggtatgataataatgttaataccgacagttatggctttccatttaacaacccgtaatggtgaaccacatatgatagtgggtattcaagaaaaaggaaaaagtttgttatttaaaaccgaagatggagtgaatatgtgtacgttaatggcaatggatttgggagaactatgcgaagacacaataacatacaaatgcccattactgagacaaaatgaaccagaagacatagactgctggtgtaactcaacgtcaacttgggttacatacggaacgtgtacgacgacaggtgaacataggagagagaaaagatccgtagctctggttcctcatgtaggaatgggattagaaacaagaacggaaacttggatgtctagtgaaggggcctggaaacacgcgcaaagaattgaaacatggatactcaggcatccgggttttacgattatggccgctattcttgcttatacaattgggactacgcacttccaaagagctctaatttttatcttgctcacagcagttgcgccttcgatgacaatgaggtgtattggaataagtaacagagattttgttgaaggtgtttcaggaggtagttgggtcgatattgtgctggaacacggtagttgtgtaacaacaatggccaaaaataaacccaccttagactttgaactgattaaaactgaagcgaaacaaccagcaaccttgcgtaaatattgtatagaagcaaaattaacaaacacaactacagaatcaagatgtccaacacaaggtgaaccttcgcttaaagaagaacaagacaaaagattcgtatgtaaacatagcatggtcgaccgtggttgggggaacggatgcggattattcggaaaaggtggtattgtgacatgtgcaatgtttacatgcaagaaaaacatggaaggaaaaatcgtacaaccagagaatttagaatatacgatagtagtaactccacatagcggggaagaacatgcagttggaaacgacactggaaaacacggaaaagaaataaaagtgacaccacaatcctctataaccgaagccgaactgacaggatatggcacagtaactatggaatgttcaccccgaacaggactagactttaatgaaatggtcttactccaaatggaatctaaagcgtggcttgttcacagacagtggtttttagacctgccattgccgtggttgccaggcgccgataaacagggttcaaattggatacaaaaagaaacgctagtcacatttaaaaacccacatgctaagaaacaagatgtggttgttttaggaagtcaggagggtgcaatgcatactgcactcacgggtgcgacagagatacaaatgagctctggtaacctcttatttactggccatctaaaatgcagattacgtatggataaattgcaattaaaaggaatgagttatagtatgtgtacaggaaaatttaaagtagtaaaagagattgcagaaacacaacatgggacaatagttattagggtacagtatgaaggagacggatctccgtgtaaaataccattcgaaatcatggatttagagaaaaggtacgtccttggcaggctaataacagtcaatcctatcgtaacagaaaaagatagtccagtgaacatcgaagccgaacctcccttcggagattcatacattataataggtgtggaacctggccaattgaaattaaattggtttaagaaagggtcgagtatcggccaaatgttcgaaacaactatgcgtggagcgaaaagaatggctattcttggagatacggcttgggatttcggcagcttaggcggagtatttacaagtatcggtaaagcacttcaccaagtatttggagctatatacggtgcagcattctccggtgtaagttggactatgaaaattcttataggtgtaatcattacatggataggaatgaactcccggtctacaagtctttcagtatccttggtattagtcggaatagtaacattatatctgggagtaatggtccaagcagactcaggatgtgtcgtatcgtggaaaaacaaagaattaaaatgtggttctggcattttcataacggataatgttcatacatggactgagcagtataaatttcaaccggagtcaccttcaaaactggcatcggcgattcagaaggctcaagaggagggaatatgtggaataagatccgttacaagactcgaaaatctaatgtggaaacagattacgccagagttaaaccatattttggcagagaacgaggtcaagttaacaattatgacaggcgatataaaaggtataatgcaagcagggaagagatcgttacgcccacaacctactgaactgaagtacagctggaaaacgtggggcaaggctaagatgctctcaacagaatcacataatcaaacatttctaatcgatggtccagaaacggcagaatgtcctaatacaaacagggcctggaatagcttagaggtagaagattatggctttggtgtattcacaacaaacatatggttaaaattaaaagaaaagcaagatgctttttgtgactcaaaactaatgtctgccgccattaaggataatagagcagtccatgccgatatgggatactggatcgaaagcgcactaaatgacacttggaaaattgaaaaggcttcgtttatagaagttaagaattgtcactggccaaaaagccatactttatggagcaatggcgtactagaatctgaaatgataattccaaagaatctagctggacctgtaagtcaacataattaccgcccaggttaccatacgcagaccgcggggccctggcacttaggtaaattagaaatggacttcgacttttgtgatggaacgaccgtaatagtgacagaggattgtggtaacagagggccatcgctaagaaccacgactgcttcaggtaaattaataacagaatggtgctgtagatcttgtaccttaccgccgttacgatatcgaggagaagacggatgttggtatggcatggagatacgaccacttaaggaaaaagaagaaaacttagtaaattcgttggtgactgctggtcacggtcaggttgacaacttcagcttaggggtactaggtatggctctctttttggaggaaatgttaagaacaagagtaggaacaaagcatgcaattctgcttgtggcagtatccttcgtaacattgataactggaaatatgtctttcaaagatctaggacgtgtcgttgttatggtcggtactactatgactgatgacatcggtatgggtgtcacctacttagctttactagccgccttcaaagtgcgtcccaccttcgcagcaggccttcttttaaggaaactaaccagtaaagaactcatgatgacaacaatagggattgtattattaagtcaaagcacaatccctgaaacaatattggaattaactgatgcattagcactaggtatgatggttctcaaaatcgttcgagacatggaaaagtatcaactagccgtgaccatcatggcaatactttgcgtcccaaacgcagttattcttcaaaacgcatggaaagtaagttgtaccatactggcagtagtttcggtaagtcccctattactaaccagctcccagcagaaaacagattggatacctcttgcacttaccataaagggattaaatccaaccgccatattcctaactactctatcgagaacaaacaagaaaaggtcctggcctctaaatgaggcaataatggcagtcggcatggtatcgatccttgcatcttctctgcttaaaaatgatatcccaatgactggacctcttgtagctggtggattattaactgtttgctacgtattgacgggtaggtctgcagatttagaacttgaacgcgctaccgatgtaaaatgggaagaccaggcagaaatatctggaagcagtccaatactaagcataactatcagcgaggacggatcaatgtcaatcaaaaatgaagaagaggaacaaaccttaactatcctaattagaacaggtcttttagtaataagtggattattcccagtatcaatcccaataacagcagcagcatggtacttatgggaagtcaagaaacagagagcgggggtgttatgggatgttcctagcccgccaccaatgggaaaagctgaattggaagatggtgcatatagaataaaacaaaaaggaatactaggctattctcaaattggtgctggcgtgtacaaagaaggaacatttcacaccatgtggcatgtaactaggggagcggtattgatgcataaaggaaaaagaatagagccgtcttgggctgatgttaagaaagacttaatttcgtatggaggaggatggaaactagaaggtgagtggaaagagggagaagaagttcaagtattagcattagagccgggcaaaaatccacgagcagtacaaaccaaaccaggactattcaaaacgaacacagggactatcggcgcagtaagcctagatttctctcccggtacgagcggctccccgataatcgataagaaaggaaaagtagtagggttatatggaaacggtgtagtcactagatcaggggcttatgtatcagcgatagcgcagaccgaaaaatctatagaagataatcctgagattgaggatgatatttttagaaaaagacgcttaacgattatggatctacacccaggtgcgggcaagactaaaagatatcttccagccatagtgcgcgaagctataaaacgaggactaagaacgttaattctagcgcctacgagagtagtagcagcagaaatggaagaggcactacgagggcttccaatacggtatcagacgccggccatacgagctgagcacaccggacgggagatagtagaccttatgtgccatgccacctttacgatgagactgctatcaccagtcagagtacctaattataacttaattattatggacgaagctcattttacggatccggcatctatagctgcaaggggatatattagtaccagggtggagatgggtgaagccgcgggtatattcatgacagccacgcctccaggatcgagagatccgtttccacaatcaaacgcgccaataatagatgaagaaagggaaataccggaaaggtcgtggaacaccgggcacgagtgggtcaccgattttaaaggaaagacagtgtggtttgtgccaagcataaaagctggcaatgacattgcagcctgtctgaggaaaaatggaaagaaagtcatccaactaagtcgtaaaaccttcgattcagagtacgtcaaaacacgtacaaatgactgggacttcgttgtaaccaccgacatatcagaaatgggagcgaattttaaggcagaaagagtaatagatcctagaagatgcatgaagcccgtaattttgacagatggtgaggaaagagtaatcctagccggaccgatgcctgttacacatagttccgctgctcagcggaggggaagaatcggacgaaaccccaaaaatgaaaatgaccaatatatatacatgggtgaaccgttagaaaacgatgaagattgtgcacattggaaagaagccaaaatgctactagataacatcaacacgccagagggaatcattccatcaatgtttgagccagaaagagagaaagtagatgctatagacggcgagtaccgattacgtggagaagctcgaaaaacctttgttgatttgatgcgacggggagatctcccggtttggttggcgtataaggtcgcagctgaaggcataaactacgcagatagacgttggtgtttcgatggaatcaaaaataatcaaattctagaggaaaacgtagaggttgaaatatggactaaagaaggtgaacgcaagaagctcaagcctagatggttagatgcgcgaatctactctgatccactagctttaaaagagtttaaagaatttgccgccggccgaaaaagcctgacactaaacttaataacagaaatgggaagactaccaacttttatgacgcagaagacccgggatgcattagacaacctggctgtactgcatacagcagaggcagggggcagagcttataaccacgccctttcagaactaccagaaacacttgagacgctcctgttattgacgctacttgcaaccgtgacaggagggatatttctcttcctaatgagtggaaggggaatcggaaaaatgacgctaggtatgtgttgtataataactgctagtgtccttttatggtatgcgcaaatacaacctcactggatcgctgcaagcataatactggaatttttcctgattgtactactaataccggaaccggaaaaacaacgaacaccacaggataaccaattgacatacgtagtaatagccattctaactgtcgtagctgctacaatggcaaacgaaatgggattcttagagaagaccaagaaagacctcggacttggaagcatcgcaacacaacaacccgagtcaaacatattagacatagatctgagaccagcctcagcatggacactatatgcagtagcaaccacgttcgtaacgcctatgttaaggcactctattgaaaacagttctgtaaacgtatcgctgacagctattgccaaccaggcaacagtacttatgggcttaggaaagggctggccactcagtaagatggatattggagtaccgttactagcaatcggatgttactcccaagtcaaccctattacactaacagctgctttactcctcttggttgcgcattatgcaataattggaccaggcctacaggctaaagccactcgagaagcacagaaacgtgcagcagctgggataatgaagaatcctaccgtagatggcattacagtaatagatttagaccccattccatacgatcccaaattcgaaaagcaactcggacaggtaatgttattgattttatgtgtgacacaagtccttatgatgagaacaacatgggcattatgcgaggcactaactctggcgacggggcccataagtacactatgggaaggtaaccctgggcgtttttggaatactactatagctgtgtcaatggcaaatatattccgcgggagttacttggcaggggcaggcctattattctcgattatgaaaaacacaacgaacacgagacgtggtacaggcaacatcggcgagacgttaggtgaaaaatggaagtcccggttaaatgccctcggcaaatcagagttccagacatataaaaagagcggaatacaagaagttgaccggaccttagcaaaagaaggaattaagcgcggggagacagatcatcatgctgtgagtaggggcagcgcgaaattgagatggtttgtagagagaaatatggtaactccagagggcaaggtggtagatctagggtgcgggagaggtggttggtcatactactgtggtggattgaaaaatgtaagggaagtaaaaggactaaccaaagggggcccaggacacgaggaacccataccgatgagtacatatggatggaatctagtacgactacagtcaggtgtcgacgtattctttatcccacctgagaaatgtgacacgttattgtgcgatatcggagagtcaagtccaaatcctactgtagaggccggaagaacgctccgagtgttaaatctagtagaaaactggcttaacaataacacgcaattctgcatcaaggtacttaacccatatatgcccagtgttattgagaaaatggaagcactacaacgcaagtatggaggtgccctagtaagaaatccattaagcagaaattccacgcatgagatgtattgggtaagtaatgcaagcggaaatattgtatccagcgtcaatatgatttcgaggatgctgattaacagatttacaatgagacacaagaaagcaacatatgaaccagatgtagatctaggctcggggactagaaacataggaatagaatctgagataccgaatcttgatataattggaaaacgaattgaaaagattaaagaggaacacgagacttcatggcattacgaccaagatcatccctacaaaacatgggcataccatggctcttatgaaaccaaacaaacggggtcagcatctagtatggtaaacggagtcgtgcgacttctgaccaaaccttgggacgtactaccaactgtaactcaaatggcaatgaccgatacgacccccttcggacaacaacgagtttttaaggaaaaagtggatactcgcactcaagagcccaaagaaggcaccaagaaactcatgaaaatcaccgctgaatggctgtggaaggagctcggcaagaagaaaacaccacgtatgtgtacaagggaggagttcactagaaaggtcagatcaaacgcggcattaggggcgatatttactgatgaaaataagtggaaatcagctcgtgaggcagtggaagacagtagattctgggagttagtggacaaagaaaggaatctgcaccttgaaggtaaatgtgagacatgcgtgtataatatgatgggtaaaagagaaaagaaactaggggagtttggaaaagccaaaggtagccgggcgatctggtatatgtggttaggagcaagatttctagagttcgaggcattaggatttcttaacgaagatcattggttcagtcgggaaaatagcttatctggagtagaaggcgaaggtttacataagctaggctatattcttagagatgtcagcaagaaagagggaggggctatgtatgctgatgataccgcaggatgggatacccgaattacacttgaagatctcaaaaatgaggaaatggtaacaaatcatatggagggagaacataagaagctagcagaagcaatctttaaactaacatatcagaacaaagtcgtaagagtgcaaaggccgactccacggggaactgtgatggacattattagtcgccgagatcagagaggttctggccaggtcgggacatatggtctgaatacgttcaccaatatggaggcgcaattaattcgacaaatggagggtgaaggtgtgttcaaaaacatacaacatttgacagttactgaggaggccgcagttcaaaattggcttgcaagagttggaagggaacgtctaagcagaatggcaatatctggcgatgattgtgtggtgaaaccactggatgaccgatttgcaaatgctttaactgcactaaatgacatgggcaaaattcgtaaagacatacagcaatgggaaccgagtaagggttggaatgactggacacaagtaccattctgcagccaccatttccatgaactgataatgaaggacggtcgtgtgttagttgtaccttgcagaaatcaagatgaattgataggaagggcacgaatttctcaaggagctggatggtctttacgagagaccgcatgtttaggtaaaagctacgcccaaatgtggtcacttatgtattttcatagaagagatctaagactggctgctaatgctatctgctctgcagtaccttcacattgggtacccacatcacggacgacatggtcaattcacgctaaacatgagtggatgaccacggaagatatgcttactgtctggaatagggtatggatcagggagaatccatggatggaagacaagacccccgttgagtcgtgggaagaaataccatatctcggcaaaagagaagaccaatggtgcggatcacttataggactcacatcgagggcgacatgggctaagaatatacaagccgctatcaaccaagttagatccctaatcggtaacgaagagtatacagactacatgccgtcgatgaaacgctttcgtcgagaagaagaagaagctggagtactatggtaa

SEQ ID NO: 22946 - RNA, 9876 nt, synthetic construct
  misc_feature 1..9876: note = derived and/or modified CDS sequence (opt6) from DENV-2__JF260983__SS-prME
  source 1..9876: mol_type = other RNA
actgctggattcttgataatggttattcccaccgtaatggcttttcatctcactaccaggaatggggaaccgcatatgatagtaagtaaaaacgaaaaggggaaaggattactcttcaaaactgaaaatggaatcaatatgtgcacattgatggcaatggatctaggtgaactgtgtgaggacacagtgacatacaaatgtccgtttttaaaacaaaatgaacctgaagacatagattgttggtgcaatagcacatctacatgggtcacgtatggcacgtgttcgagcactggagaacacagaagagaaaaaaggtcggtagcactagttccacatgtaggaatgggtcttgaaaccagaactgaaacatggatgtcatcagaaggagcttggaaacaagctcaacgaatagagacttggatcttacgacaccctggatttacgctgatggccgccgtacttgcatacacgataggcacaacacatttccagcgggcactcattttcatattgcttacagcagtagcgccatctatgactatgagatgcatcggaatttcaaatcgcgactttgtggagggcgtctcgggcgggtcttgggtggatatagtgctagaacatggctcctgcgtaactacaatggcgaaaaataaacctactttagactttgaacttataaaaacagaagctaaacaaccagccactctgagaaaattttgcatcgaggcaaaattgacaaacactacaaccgaatcacgatgcccgactcaaggagaacccagcttggtggaagaacaagataaaagattcgtttgccgtcacagtatggtagacagagggtggggcaacggttgcggattattcggtaaggggggtatagtaacttgtgcgatgtttacttgtttaaaaaagatggaaggaaaagtcgtacaacctgagaatcttgaatatacaattgttataaccccacattcaggtgaggagcatgcagtggggaatgacacagggaaacacggcaaagaggtaaaaattacacctcagagcagtatcagtgagaccgaacttacggactatggaacaatcacaatggaatgtagtccaagaactggattggattttaatgaaatggtattactccaaatggagtccaaagcatggttagtccaccgacagtggtttttagatttaccattaccctggctaccaggtgcagatactcaaggcagtaattggatacaaaaagaaatgctggtgactttcaaaaatcctcacgctaagagacaagatgtagttgttttaggtagtcaggaaggagcaatgcatactgcactaacaggcgcaacggaaatacagatgtctctaggaaatatcctctttatgggccatttaaagtgtagattaagaatggacaaattgcaactaaaaggtatgagttactcaatgtgtacaggaaagtttaaagttgtaaaagaaattgccgaaacacaacatggtactatagttataagagttcagtacgagggcgatgacagcccatgtaagataccatttgagataatggacctagagaaaaaacatgtcttaggacgtctgataaccgtcaatccgatagtcacggaaaaagatagtccaataaatatagaagctgaaccaccttttggcgacagttatatcgttataggggtagagcctggtcagctaaaattgaattggttcaaaaaaggaagctccataggtcaaatgttcgagacaacaatgcgtggcgcaaagagaatggctatcttaggtgacacggcttgggactttggaagtattggaggagtctttacgtcggtgggcaaagctctacaccaggttttcggtgcaatatatggagcagcattttcaggagtctcttggacaatgaaaattcttataggcgtggtgataacatggattggtatgaattcaagatctacctcactgagcgtcactttggtacttgtcggtatcgtgactttgtaccttggcgtaatggtacaagcggattcgggctgtgtcgtcagttggaagaacaaggaattaaaatgcggatctggaatcttcgtcacggacaatgtacacacttggaccgaacaatataagttccaacctgactctccctccaaattggcaagtgcaattcaaaaagcgcatgaagaaggcatatgcggcattaggtctgtaacaagattggaaaatctgatgtggaaacagattacccccgagttaaaccacatcttatctgagaacgaggtgaaactaacaattatgaccggggaaataaagggcatcatgcaggccggacgtcgaagtctaaagccccagcctactgagctacggtattcatggaaaacatggggtaaagctaaagtactatctaccgagctacagaatcaaacctttctaatagacggaccagaaactacggaatgtcctaattcaaatagggcttggaactcactcgaagtggaggattacggattcggaatttttacaaccaacatatggttgaagctgagggagaaacaagatatgatatgtgattcaaaattaatgagtgctgctgtgaaagatgatagggctgtccatgccgatatgggttattggatcgagagcagattaaatgacacatggaaaatggagaaagctagtttcattgaggtaaaatcatgttactggccgagaagtcataccttgtggtcaaatggagttttggaatctgaaatgattatacctaaaaacctcgccggaccagtatcacaacacaactacagaccaggttactatactcaaacggcagggccatggcatttgggcaaactagaaatggatttcgaattctgtgaagggacaacagtcgtcgtcacagaagactgcggcaatcgaggaccttctttaagaacaacgaccgcaagtggaaaacttataaccgaatggtgctgtagaagctgtacactacctcctttaagatataggggagaagatggttgttggtatggcatggaaattcgtcctttgaaagaacgagaagagaatctcgtaaattcgttggttaccgcgggtcatggacagatagacaattttagtcttggaatattaggtatggcacttctccttgaagaaatgttacgaaccagggtcggcacaaaacacgctttattgctcgtagcgatttccttcgtgacgttaataacaggaaacatgagtttcaaagacctagggagagttataattatggtaggcgcagctatgacagacgagatgggaatgggtgtaacttatttagctcttcttgctgccttccgagtccgtccaaccttcgctgtcggtttgcttttaagaaagctcaccagcaaagaattattaatggcaaccattggcgttgttcttctatcacaaagtaatatcccagggactgtattggagctaactgacgcgattgctctcggcattatggtcctaaaaataatgaggagtatggaaaaataccaattagcggtgacagttatggcaatgctatgtatcccgaacgtaatgatcttacaacacgcatggaaagtggggtgtacaatcctggccgctgtatcggtaagtccgctccttcttaccagcagccagcaaaaaaccgactggataccactggcgctaaccattaagggactaaatccgacagcgatctttctcaccacgttatcaagacccagtaaaattagaagctggccactaaatgaagcaataatggcagtaggaatggtaagtatacttgcaagttctttactcaaaaatgacatcccaatgacaggaccgctagtcgcaggaggattactaactgtttgttatgtactaactggacgttcggcagaccttgaacttgaaaaagcggcagaagtaaaatgggaagaccaggctgaaatcagtggaagcagtcctatattgtccatcactatctcagaagatgggtcaatgagtattaagaatgaagaggaagaacagacactcactatactcatcagaacaggattattagtcatttcaggattattcccagttagtatcccgattaccgctgcggcttggtatttatgggagaccaaaaaacaaagagccggtgtgctatgggacgtaccttcaccaccaccaatgggtaaggcagagctagaagatggagcatatcgaataaagcaacgaggaatctttgggtattcacaaataggagcaggagtatataaagaaggaacgtttcatactatgtggcatgtcacaagaggcgcagttttagtacataaaggtaagcgtttagaaccctcatgggccgatgtgaaaaaggatctaatctcctacggaggaggatggaaactagagggcgaatggaaggacggagaagaggttcaagtcctcgctcttgagcctggtaaaaaccccagagcagtccaaactaaaccaggtctgttcaaaacaaacacaggtacgataggtgctgtttctctagatttttcaccggggacatcggggagccccataatcgatcgaaagggcaaagttgtaggactatacggaaacggcgtagtgacacgttctggaacttatgtatcgtcgattgcacaaactgaaaaatccgttgaggataacccggaaatcgaggatgatatattccgaaaaaaaagattaactataatggacttacatccaggagcaggaaaaactaaaagatatctgccagcgatagttagggaggcaattagaagaggattgcgcacactcatactagcgcctacgagagtagtggctgcggagatggaagaagccttacgaggacttcctattcgataccagacacctgctattaaggctgaacacacaggccgagaaattgtagaccttatgtgccatgcaacatttaccatgaggttacttagtcctatccgtgtaccgaattacaacctgattattatggatgaggcacactttacagatccagcttctattgcggcacgtggatatataagcactcgcgttgagatgggagaagcagcaggaattttcatgactgcaacacctccagggtcaagagatcctttcccacaatcaaatgccccaatcatggatgaagaaagagaaatacctgaaagatcttggaattctggtcatgaatggattactaacttcaaagggaagacggtctggttcgttcctagtattagagcgggcaatgacattgcagcatgcctcaggaaaaatgggaagagagtcattcagttatcacgtaaaacctttgatacagaatatacaaaaactcgaacgaatgactgggactttgtagtaacaactgatatctctgagatgggagcgaacttcaaagcagaaagggtaatagacccaagacgatgcatgaaacctgtaatattaacagacggagaagaacgtgttgtactcgcaggtcccatgccagtcacgcatagttcagcggcacaaagacggggaagaatagggagaaatccgaagaatgaaaatgatcaatatatctacatgggcgagccactcgaaaacgatgaagactgcgcacactggaaagaggctaagatgcttctagacaatataaatacacctgaaggtattataccctcaatgttcgagcccgaaagggagaaagtcgatgctattgacggggagtatcgtttaagaggcgaagcaaggaaaactttcgtagatttaatgaaacgtggcgatttacctgtatggcttgcatataaagtagcatcagaaggtatcaactatgccgacagaaaatggtgcttcgatggaatacgtaataaccaaattttagaagaaaacatagaagtagaggtgtggaccaaagaaggggaaaggaagaaattgaaaccaagatggttagatgcgagaacttactccgatcctttagctttgaaagaatttaaagaattcgcggcaggtagaaaatctttaacactctcattgataacagaaatgggaaggttgcctacgtttatgacacaaaaaacgcgggacgctttagataacttagcagtattgcactcagccgaaatgggtggacgagcttacaatcatgcactatcggaattacctgaaactttggaaacactacttcttttaggattacttgcaaccgtaactgggggcatcttccttttccttatgagtgggagaggggtagggaaaatgacccttggaatgtgttgtattataaccgcaagcggcctcttatggtacgctcaaattcaaccgcactggatagcagcatccatcattctcgagttttttttaatagttttattgattcctgaaccggaaaaacaacgaacccctcaagataaccaattaacatacgtagtaattgcaatcttaactttggtagcagcgaccatggcgaatgaaatgggattcctagagaagacaaaaaaggatttaggactcgggggatttacgatgcaacaaccagaaataaacatactggatatagacctacgtccagctagcgcatggactttatatgctgtagcaacgacttttgtgacgcccatgttacgtcatagtattgagaattcctcagtaaatgttagcctgacggcaatagctaatcaagcaactgttttaatgggtttagggaaagggtggccgctatcgaaaatggatataggggttccgctccttgccataggttgttattctcaggtgaatccaatcacgctaacagcagctcttctactcttagtagctcattacgcaataattggtcccggcttacaagcgaaggcgactcgagaagcacagaaaagagctgcagccggaattatgaaaaatcccaccgtagacggaattactgtaattgatctagaaccaataccttatgacccaaagtttgaaaaacaactgggtcaagtcatgttattagtactgtgcgtcacacaagtacttatgatgagaacaacctgggctttatgcgaggctttgactttagcgacaggacctatctcgactctttgggaaggtaatcccgggaaattctggaacacaaccattgcagtctcaatggccaatatttttagagggtcgtacttagcgggagcaggactattgttcagcattatgcggaacacaacaagcgcacggaggggaactggtacgattggagaaacccttggtgaaaaatggaaatcacgtttaaacgcgctaggaagatccgagttccaaatatacaagaaatctggcatacaagaggttgaccgaacgctggccaaggaaggaatcaagcgaggggaaacagatcatcatgctgtgtcgagaggaagtgctaaacttaggtggtttgtagaaagaaatatggtagcgccagaaggaaaagtagttgaccttggatgtggaagaggaggttggtcctattactgcgggggcttaaaaaatgtgagggaagttaaaggtttaaccaaaggagggcccggacatgaagaaccaattcccatgtcaacatatgggtggaatttagtccgattgcaatccggagtagatgtttttttcaccccaccggaaagatgcgatacattgctatgtgatattggtgaatcgtctcctaacccgaccgtcgaagcggggaggacattaagggtgttaaatctggtagagaattggttaggatccaatacacagttctgtataaaagtccttaatccatacatgccatcagtaattgaacgtatggaaacgttacaaagaaaattcggcggagctctagtccgcaatccactctctaggaattcaacacatgaaatgtactgggtctcaaatgcatcaggaaacattgtaagtagcgtcaacatgatatcaagaatgcttataaacaggttcactatgagacacaaaaaggcaacatatgaacccgatgtggacttagggtccgggacacgaaatataggaatagagtgcgagacccctaatatggacatcataggaaaacggatagaaaaaataaaacaagaacacgaagcttcatggcattatgatcaagaccatccttacaaaacgtgggcctaccacggaagttatgaaaccaaacaaacagggtcagcgtcaagtatggtaaacggtgtggtcagactcttaacgaaaccatgggatgtcattccgatggtaacccaaatggcgatgacagatactacaccatttgggcaacagagggtgtttaaagaaaaggtggatacgcgcacacaggaaccaaaagaaggtacgaaaaagttgatgagaatcacggctgaatggctatggggtgagctgggtagacgcaaaaaaccgagaatatgtacaagagcagagttttgtaacaaggtgcgatcaaacgcagctctaggtgcagtgttcacagacgaaaataagtggaaaagtgcacgtgaggccgtagaagacgagcgcttttgggaacttgtagaaaaagaaagaaatttacacctcgatggaaagtgcgaaacatgcgtttataacatgatgggtaagagagaaaaaaaacttggtgaatttggtaaagcaaaaggatccagggcaatatggtatatgtggctgggtgcaagatttctggagttcgaagcattaggatttctgaacgaagatcattggttttccagggaaaacagcttgagcggagttgaaggggaaggattgcacaaattaggctacattctcagagacatcagcaggaaagctggcggcgcaatgtacgcggacgatacggcggggtgggacactagaatcactagtgaagaccttaagaacgaggagatgattacagaccaaatggaaggaagacataaaaaattagctgaagccatctttcggttgacttaccagaacaaggttgtaagggtacaacgaccaacacctcgagggaccgtaatggatataatatcacgtagagatcaacgagggagcggacaagtaggaacgtatgggctgaacacctttacaaatatggaagctcaactaatacgtcaaatggaaggagaggggctatttaaatctatattacacctaactcctcaagaagaaactgcagtccacgcctggctggtgcgtgaaggtcgagagcgactagctcgaatggcgatttcaggcgatgattgcgtagtgaaaccattagacgaccgattcgcaagagcactaacggctctaaatgacatgggaaaagtaagaaaagatatacaacagtgggaaccatctaagggttggagtgattggacacaagtacccttttgttctcatcattttcacgaactaattatgaaagacggaaggaaactagtagtaccatgtagaaaccaggacgaactaattggcagggctaggattagtcaaggagccggctggagtcttagagaaacggcatgtttgggaaagtcatacgcacagatgtggtccctaatgtattttcatagacgtgatttacgacttgcagcgaacgcaatatgcagtgcggtgccgtcacactgggtgcccacaagtcgaaccacgtggtcaattcacgcatcacatgaatggatgactacagaggatatgttagctgtttggaaccgtgtctggatacaagacaacccatggatggaggacaagacccccgtagaatcatgggaagacataccatacctaggaaaaagagaagatcaatggtgcggctcattaataggattaacatctcgagcaacatgggctaaaaatatacagacagctataaaccaagtgagagcacttataggtgaagaagaatacatggactacatgccttctatgaaaaggtttcgaagcgaagaagaggaaagcggagttttatggtga

SEQ ID NO: 22947 - RNA, 9876 nt, synthetic construct
  misc_feature 1..9876: note = derived and/or modified CDS sequence (opt6) from DENV-2__AF119661__SS-prME
  source 1..9876: mol_type = other RNA
acagtgggcgtgattatcatgcttatacccacagcgatggcatttcatctaactacacggaatggggaaccccacatgatagtcggacgacaagaaaaaggaaaatctctactatttaaaactgaagacggagtcaacatgtgcacactaatggctattgacttaggagaactgtgtgaagataccataacgtataaatgtccgctactacgtcaaaacgaaccggaagatatagactgttggtgcaatagtacgagtacatgggttacgtacggaacatgcactacaaccggtgaacatcggcgagaaaaacgaagtgtggctcttgttcctcacgttggtatgggactagagacacggacagagacttggatgagtagcgaaggggcctggaaacacgcacaacgaattgaaacctggattcttagacatcctggcttcattatcatggcagcaattctagcatacacaattggtactactcactttcaaagggctctgatatttatactacttaccgccgtggctccttcaatgaccatgcgttgtataggggtgagcaaccgtgatttcgtagaaggagtaagcgggggatcctgggttgatattgtcctagaacatggctcatgtgtgacaacaatggctaaaaacaaacccacactagacttcgaattaatcaaaacggaagcaaaacaaccggtgactcttcgcaaatactgcattaaagcaaaattgacaaacaccactacagaaagccgatgcccaacccaaggagaaccgtcgctcaatgaagaacaggacaaaagatttgtctgcaaacacagcatggttgatagaggatggggcaatggttgcggcctttttggaaaaggtggaatagtaacatgtgcaacatttacgtgtaagaaaaatatggagggaaaaatagtacagccggaaaatctggaatacacaatcgtcattacaccacactctggggaagaacatgcggtgggtaatgacacaggtaaacatggtaaagaaatcaaaataacaccccagtcaagcatcaccgaggcagaattaaccgggtatggcactgtaacaatggagtgcagtcctagaacaggattagactttaatgagatggttcttcttcaaatggaagataaggcttggttggtccataggcaatggtttctagacctcccacttccgtggctgccaggggctgatactcaggggtccaactggatacaaaaggaaaccctagtcacattcaaaaacccccatgcaaagaaacaagacgtagtcgttttgggaagtcaagaaggggcgatgcatactgcattgacgggcgctacagaaatccaaatgtcgtcaggaaacctccttttcacgggtcatctaaaatgccgtctcagaatggataaattgcagttgaagggaatgtcttatagcatgtgtactgggaaatttaaaatcgtgaaggaaattgcagaaacacagcatggaacaatcgtaatccgcgtccaatacgagggtgatggttctccctgtaagattccgtttgaaataatggatttagagaaaagacacgtcctagggagactgatcacggtaaatcccatcgtgactgaaaaagatagccctgttaatattgaggcagagccaccgttcggagacagttatataatcatcggcgtcgaacccggccagctaaaattaaattgggtcaagaaaggtagctcaatcggtcaaatgtttgaaactacaatgcgaggagcaaaacgaatggctattctgggggatacagcatgggattttggaagcctaggcggagttttcacttcgatagggaaagcactccatcaagtatttggagcaatatatggtgccgcgttcagtggcgtatcatggaccatgaaaatactgatcggagtgatcattacatggataggtatgaacagcagatccacgagtttatcagtttctctcgtgctagtcggcgtaataactttgtatcttggggctatggttcaggccgactctggctgcgtagtaagttggaaaaataaagagctcaaatgtggaagcgggatcttcatcactgacaacgttcatacatggactgaacaatataagttccaaccggaatcgccgagcaaattagcttccgcaatacaaaaggcacatgaagaaggcatttgtggaatacgaagcgttacacgcttagaaaatctaatgtggaaacaaataaccccagagctcaaccatatactctctgaaaatgaggtgaaactcacaataatgacaggcgatataaaaggaattatgcaagctggaaaacgatcattgcgaccccagccgacagaattaaagtactcatggaaaacctggggaaaagctaaaatgctgtcaacagagtcccataaccagacttttctcatagatggacctgagacagcagaatgccctaacacaaatcgagcatggaactcacttgaagttgaggactatggcttcggagtattcacgacaaacatttggctcaaacttagggaaaaacaggatgtattctgtgactccaaactaatgagtgccgccatcaaagataaccgcgctgtacatgcagacatgggatactggatcgaatcagccctcaacgatacctggaaaatggaaaaagcatcattcattgaagtgaaatcatgccattggccaaaatctcatacattatggtcgaacggagtcctcgaaagcgaaatgataattcctaaatctttcgctggcccagtctcacaacacaactatagaccgggttattatacacaaactgctgggccatggcacctaggtaaattggaaatggattttgatttttgtgagggaactactgtcgtagttacagaggattgtggtaatagaggtccatcactgaggaccacaacagcatcaggaaaactaattacagaatggtgctgcaggagctgtactttacctccactgagatatagaggggaagatgggtgttggtatggaatggagataagaccattaaaggaaaaagaagaaagtcttgtcgatagtctagtaaccgcaggacatggacagatcgataattttagtttaggagtcttaggtatggctctctttttggaagaaatgctgagaactcgtgtggggacaaaacatgctatactcttagtagctgttagttttgtaactctgataacaggcaatatgtcgttgagagatctgggcagagtgatggtaatggttggtgctacaatgactgacgacataggaatgggtgtaacctatctggcccttttagcggccttcaaagttcgacccacttttgccgcaggtcttctattgagaaagctaacgagtaaagaactgatgatggcaacaatcggcatagcattactaagtcagtctacaatcccagagaccatacttgaacttactgatgctctagcgttggggatgatggttttgaagatagtaagaaatatggaaaaatatcagttagcggtgacgattatggccatatcctgcgtgcctaacgcagttatactccaaaatgcttggaaagttagttgtacaatccttgcggctgtaagcgttagtccactacttttgacaagcagtcaacaaaaagcagactggatccccttggcactaacgatcaaaggtctaaatcccactgcaattttcctaacaactctagcgcgcacatctaaaaagcgaagttggccattaaatgaggctataatggcggttgggatggtgagcatattagcaagttcactcttaaagaacgacatacccatgactggacctctagttgcgggagggctactaaccgtgtgctatgtattaacaggcagaagtgcagacctagagctggagcgtgctactgacgtaaagtgggaagatcaagccgaaattagtggatctagtccaattctatctattaccatatccgaagacggaagtatgtcgataaagaatgaagaggaagaacaaactcttaccatcctgatacgaacaggcttacttgtaataagtggcttatttcctgtcagtattccgataaccgcagctgcctggtacttatgggaagtcaagaaacaaagggcaggagtactctgggacgtaccgtctccaccaccagtagaaaaagctgaattagaagatggagcctatagaattaaacaaaaaggtatactaggttattcacagatagggactggagtgtataaagagggtacattccatacaatgtggcatgtaacgagaggggctgtactgatgcaccgagggaaaagaatcgaaccatcctgggcagacgtgaagaaagatcttatatcttatggtgggggttggaagttagaaggtgaatggaaagaaggcgaagaagtccaagtacttgcattagaaccgggtaagaacccaagggcagttcaaactaaacctgggttattcaaaactaacacgggaacaataggcgcagtgagtctagactttagtcctggcacgtcggggtcgcctattgtcgatcggaaaggcaaagttgtaggactgtatggtaatggtgtagtaacaagaagcggggcttatgtatcagcaatagctcaaacagagaaatccatagaagataatccagaaattgaagacgatatttttaggaagaaacgattgacaataatggatttgcaccccggtgccgggaaaacaaaaagatatttaccagccattgtgcgcgaagcaataaaacgcggattgagaactttgatattggctccaacccgcgtagtcgcagcagaaatggaagaagcattacgtggacttccaattagatatcaaacgccagcaattagagcagaacataccgggcgagagatagtggatcttatgtgtcatgcaacatttacaatgaggctcttatcacccgtccgagtgcccaattataatttaatcataatggatgaagctcattttacagaccctgcgaatatagcagcacgaggatacatctctacacgcgttgaaatgggagaagcagccggaatatttatgactgcaacgccgcctggatcacgtgatccttttccccagtctaacgcgccaataatggatgaagaaagggagatacccgaacgatcctggaactcgggccacgagtgggtcacagatttcaaaggtaaaaccgtttggttcgtacctagtataaaagctggaaatgacatagcagcatgtttaaggaagaatgggaaaaaggtcatccagttaagtaggaaaacgttcgactcagaatacgtaaaaacacgaactaatgactgggactttgtagtaacaacagatattagtgaaatgggagccaatttcaaggcagaaagagttatcgacccaagaaggtgtatgaaaccagtcatattaaccgatggagaagaacgtgttattcttgccggaccaatgcctgtaacacatagctcagcagcacaacggagaggtcgtatcgggagaaatcctaagaatgaaaatgaccaatatatatatatgggcgaaccattagagaacgacgaagattgcgcgcactggaaggaagcaaaaatgcttctagacaatataaatacaccagaaggtattattccaagcatgttcgaacctgaaagagagaaggtcgacgccattgacggtgagtataggctaagaggagaggccagaaagactttcgttgatttaatgaggcgaggcgaccttcccgtatggcttgcatatagagtcgccgccgaaggaataaactacgcagaccgacgatggtgttttgacggagtcaagaacaatcaaatattagaagagaacgtggaagtagaaatttggaccaaagagggagaaagaaagaaactaaaacctaggtggttggacgctaggatatattctgatccactagctctaaaggaatttaaagaatttgctgccgggcgcaagtcattgactttgaacttaataacagaaatggggagactcccaacatttatgacccaaaaagctagagatgcacttgataatttagcagtacttcacactgctgaagccggaggtagagcttacaaccatgctttaagcgaattacccgaaacgctcgagacattgctacttctaacattgcttgccacagttaccggcggcatattcctattcttaatgtccggaaagggtgttggtaagatgacattaggtatgtgctgtatcataacagcttctattctactctggtatgcccagattcaaccccactggattgcggcgtccataatcctagagttctttttaatggtactacttatacccgaaccggaaaaacaacgcacacctcaagacaatcagttaacttatgtagtaatagctattttaactgtagttgcagcaacaatggcaaatgaaatgggctttttagagaagactaagaaagatttaggtcttggaagtattgccacacaagaaccagaatcaaacattttagacatagacttacgacccgcgtctgcatggaccttatatgcagtagctacgacttttgtaacacctatgttgcgacattcgattgaaaattcaagtgtgaatgtttcattaaccgcaatagcaaaccaagccacagttctaatgggactaggaaaggggtggccgttaagcaaaatggacatcggcgtgccgttactagctataggttgttattcgcaagtaaaccctataacccttacagcagccctattacttctagttgcacattatgccataataggaccgggactacaggcgaaagccactcgtgaagcacagaaaagagctgcagcgggtataatgaaaaatccaacggtggatggaataactgtcatagatttagatccaatcccatatgatccaaaatttgaaaaacaacttggacaagtaatgctgctaatactctgcgtaacgcaagttttaatgatgcgaacaacatgggcattatgtgaagcgctgactctagcaactggtccaatttcaactttatgggaaggtaacccgggcaggttttggaacaccactatcgccgtatcaatggcaaatatttttcgaggttcataccttgcgggtgcaggtctacttttcttcataatgaaaaatacgactaacactagaagaggcaccggaaacattggtgaaacattaggtgagaagtggaagtcaaggctaaacgcactaggcaaatcagagttccaaatatacaagaaaagcggcattcaggaagttgatcgaaccttagcaaaagaagggataaaaagaggagaaacagaccaccacgccgtttcacgtggctctgcgaaactacgatggttcgtagaaaggaatatggtgacacctgaaggcaaagtagtagaccttggttgtggacgaggcggctggtcatattattgtggaggattgaaaaacgtccgagaagtgaaaggactaacgaaaggagggccaggtcacgaggagcctataccaatgagtacttacgggtggaacttggttagactgcagtcgggggtcgacgtgttcttcactcccccggaaaaatgcgacacattgctgtgtgatattggagaaagttccccaaaccctacaattgaagcaggacgtaccttacgtgtattaagtttagtcgaaaattggcttaataatgacacccaattttgtattaaagttcttaacccatacatgccatcagttatagagaaaatggaaacgttacaacgaaaatacggtggtgccttggtacgtaatccactaagtcgaaatagtactcatgaaatgtattgggtaagcaatgctacgggaaatattgtaagttcagtaaatatgattagtcggatgctgataaatagattcacaatgaagcataaaaaggcaacttacgaaccagacgtagaccttggaagtggcacccggaatataggcatagagagcgaaattccaaacttagacatcataggtaaaagaatagagaaaatcaagcaggagcacgaaacatcttggcactacgaccaagaccatccatataaaacatgggcctaccacggttcatacgaaacaaagcaaactggctcagcctcttcgatggtaaatggagtcgtacgcctgctgactaaaccttgggatgtagttccaatggttacgcagatggcaatgactgatactacgccatttggacaacaaagagttttcaaggaaaaggtggatacaagaacccaagagccaaaagaaggtaccaaaaagttaatgaaaataacggcggagtggctatggaaagagttaggaaagaagaaaactccaaggatgtgcaccagggaagagttcactaggaaagtaagatcgaacgcagcattaggggcaatatttacagatgagaataaatggaaatccgcacgtgaagccgtagaagataatcgcttctgggagcttgtggacaaagagcggaatctacatctcgaaggaaaatgcgagacctgtgtatataacatgatgggaaaacgagagaagaaattaggcgagtttggaaaagccaaagggtcccgggcaatttggtacatgtggttaggggccagattcctagaatttgaggcactcggattcttaaatgaagaccactggtttagcagagaaaactcacttagtggtgttgaaggagagggattacacaaattaggttatatacttagggacgtaagcaagaaagagggaggcgctatgtatgctgatgataccgcagggtgggatacaagaataacattagaggatcttaaaaatgaagagatggtaacaaatcacatggaaggtgaacataagaaactagcagaagccattttcaaacttacatatcaaaataaagccgtacgagtccagagacccactcccagaggaacggtcatggatataataagtaggcgggatcaacgtggatcaggacaggtaggaacctacggacttaacacttttaccaatatggaggctcagttaataagacaaatggaaggggaagggatattcaaatccatacaacatttgacggttacagaagaaatagcagtccaaaattggttagcgagggtaggacgcgaaaggctgtcaagaatggcaatttctggggatgattgtgtggtaaaaccattagacgatcgatttgcaagtgcattaacagcccttaatgatatgggaaaagtacgcaaggacatacaacagtgggaaccatctcgagggtggaatgattggactcaggtgcctttttgtagtcatcactttcacgaactgataatgaaagacgggagggttttagtagtaccctgtcgaaaccaagatgaattaataggtcgggccaggatttcacaaggcgcagggtggtctttgaaagaaacagcatgtcttggcaaatcatatgcacagatgtggagtttaatgtattttcatagaagagacttaagactagcggcgaatgcaatctgcagtgcagttccctcccattgggtgccgacaagtcgtacaacctggagcatacatgcaaagcacgaatggatgactactgaggatatgttgacagtatggaacagagtatggatacaagaaaatccctggatggaagacaaaacaccggttgaatcgtgggaggaagtaccttatttaggaaagagagaagatcaatggtgtggatcactgatcggactaacatctagagctacatgggctaagaacatacagacagcgattaatcaagttagatcactgatcggtaatgaagaatacactgattatatgcccagcatgaaaagatttcgtcgggaagaagaggaagctggagttctttggtaa

SEQ ID NO: 22948 - RNA, 9876 nt, synthetic construct
  misc_feature 1..9876: note = derived and/or modified CDS sequence (opt6) from DENV-2__EU056810__SS-prME
  source 1..9876: mol_type = other RNA
actgctggtataataataatgcttattccaacagtaatggcttttcatcttacgacacgaaacggtgaaccacacatgatcgtaagtagacaggaaaaaggtaaatccttattgtttaaaacagaagatggtgtaaacatgtgcaccctgatggctatggacttgggtgaactgtgtgaagatacgataacatataactgtcctctattacgacaaaacgaaccggaagatatagactgctggtgtaattccacgtcaacatgggtcacatacggtacatgcacggcaacaggagaacatcgtcgagaaaaacggagtgtagccctagtgccccatgttggtatggggctagaaacccggactgaaacatggatgagttcagaaggagcttggaaacatgcacagagaatagaaacatggatcttgagacaccctggatttaccataatggctgcaatcctagcatacacaatcggtactacctactttcaacgtgtattaattttcatccttctaacagcggtagctccgagtatgactatgagatgcataggaattagcaaccgtgacttcgtcgaaggggtatccggtggctcatgggtagatattgttttagaacacggatcttgcgttacaactatggctaaaaacaaaccaaccctagactttgaacttataaaaacggaagcaaaacagccagcaaccctaagaaaatattgtatagaagctaaattaacaaatactacaacagcaagcagatgtccaacacaaggagaaccaagcctaaatgaagaacaagataaaagattcgtttgtaaacatagtatggtagaccgaggatggggcaatgggtgtggactttttgggaaagggggaatagtcacttgcgcgatgtttacatgtaagaaaaatatggaagggaaagtggtacagcccgaaaacctggaatatactatagttataaccccgcattcaggtgaagaaaatgccgtcgggaatgatacaggaaaacatggtaaagagataaaaataaccccacagtcatctatcacagaggcagaattaaccggctacggtacagtcactatggaatgtagtccgcgaacagggcttgacttcaatgagatggtcctacttcaaatggaaaataaagcatggctagtccatcgacagtggtttctggatttaccactaccatggcttccgggcgcagatacacaagggtcaaattggatacaaaaagagactctagtgacttttaaaaatccacacgctaagaaacaagatgtcgttgtactaggaagccaggaaggagctatgcatactgccctaacgggggccaccgaaatacaaatgagcagcggcaatctacttttcaccgggcatttaaaatgcaggcttagaatggacaagttacaattgaaagggatgtcgtattccatgtgtactggcaaatttaaagtagtgaaagaaattgcagaaactcaacacggaaccatcgtcgtaagggttcaatacgaaggtgacggatcgccatgtaaaattccatttgaaattatggacttagagaaaagacatgtgctcggacgattaataacagtaaacccaattgtaacagagaaagatagtccggtgaacatcgaagccgagccgccatttggggactcgtatataataataggggtagaacctggccagcttaaactaaattggttcaagaaaggatcatcgatcggacaaatgtttgagaccacaatgagaggagcaaaaagaatggcaatattaggcgacactgcatgggacttcggttcactaggtggcgtatttaccagcataggtaaggcacttcatcaagttttcggcgcgatttacggagcagcattttcgggcgtgtcttggacaatgaagatattaattggggttgtgattacatggatcggaatgaactcacgaagtacatcgttgtcggtaagcctcgtcctcgtgggggtcgtaacgttatatcttggagtaatggtacaagctgactcgggatgcgtggtctcatggaaaaacaaagaactgaagtgtggaagtggtatttttgttaccgataatgtgcatacctggacagaacaatataaattccagccagagtcaccatccaaacttgcgtctgctattcaaaaagcacacgaagaggggatatgcggcatccgaagcgttacccgactagagaacctaatgtggaagcagattacccctgaattaaaccatatcctatcagagaatgaggtaaagttaacaataatgacaggtgacataaagggaataatgcaggcaggaaaaaggtcattacgaccacaaccgactgaacttaaatactcatggaaaacatggggaaaggccaaaatgttgtcgactgaactgcacaatcaaacatttctaatcgatggaccagaaacggctgaatgtcctaacactaaccgagcatggaatagcctcgaggtagaagattatggttttggtgtattcacaactaatatatggttaaaactaaaagagaggcaagatgtgttttgcgacagtaaactaatgtcggcagccataaaagataatagagctgttcacgcagacatgggctattggatagagagtgctttaaacgatacttggaaaattgagaaagctagtttcatcgaagttaaaagttgtcattggccaaaatcccatactctgtggagcaacggagttttagagtcggaaatgattatccccaaaaattttgcgggaccagtaagccagcataactatagacctgggtatcacacacagactgccggtccatggcatttgggaaaattagaggtagattttaatttctgcgaaggtactacagtagtagtaaccggagattgtggcaatcgggggccaagtctacgaacgacaactgcaagtgggaaactaattacagaatggtgctgtcgaagttgtacacttccgccactaaggtatcgcggtgaagacggctgttggtacggtatggagataagacctcttaaagaaaaagaggaaaacttagtaaattcccttgttacagcaggtcacggtcaaatcgataatttctccttaggtgtattaggaatggcgctatttttagaagaaatgttaagaacaagggttggaactaaacatgctatattattagtagccgtgagtttcgtcacacttattacaggaaacatgtcattcagagacctgggaagagtcatggtgatggttggcgcaactatgacagatgacatcggaatgggggtaacctatctcgcattattggctgcctttaaagttaggccgaccttcgcagcaggactattattgcgaaaattgaccagtaaggagttaatgatgacaacaatcggaattgtactgctatcacaaagtacaattcctgaaactgttttagaactaacagatgcgctagcgttgggtatgatggtcttaaagattgtgagaaatatggaaaagtatcaattagctgtaactataatggcgattctatgcgttccaaatgctgtaattttgcagaatgcgtggaaagtatcttgtacaattttggcagtcgtatcagtatcgccattgcttttgaccagctcacaacagaaagcagattggataccattagccctaaccatcaaaggtttaaacccaacggcgatatttttaacgacattgagtcgaacttcgaagaaacgctcatggccgttgaacgaagctattatggctgtaggaatggtcagtatactagcaagttcactcctcaaaaacgatataccaatgactggtcccctagtggctggaggtctgttaacggtctgttacgttcttacaggccggagcgctgacttagaactcgaaagagcggcagacgtcagatgggaagatcaagcggaaataagtggaagctcccccatattatccataacaatatcggaagacggttcaatgtccatcaaaaacgaagaggaagaacaaacgctaacaatcttgatccggacaggactgttggtgataagcggactatttccagtctcaattcctataacagctgctgcttggtatttatgggaagttaagaaacagagagccggggttttatgggacgtaccaagccctccgccagtaggaaaagcggaattagaggatggagcatatcgtataaaacagaaaggcattcttggatatagtcaaattggggcaggggtatataaggaagggacatttcatactatgtggcacgtaactagaggggccgtacttatgcacaaagggaaaaggattgaaccaagctgggcagacgtgaaaaaggacctgatcagttatggaggcgggtggaaattggaaggagaatggaaagaaggagaagaagttcaggttctagctctagagccaggcaaaaacccaagggccgtacagaccaaaccgggactatttaagaccaatacaggtacaatcggagccgtttctctagacttctcaccaggcaccagtggatcaccgatagttgataagaaagggaaggttgtaggtttatatggaaacggcgtggtaacccgatcgggtacttatgtatcggccatagcacaaaccgagaaaagtatagaagataatccagaaatagaagatgatattttcaggaagaaaagactaacaattatggatctgcacccaggagcgggaaaaacgaaacgatatctgcctgcaatagttagagaagcaataaaaaggggactaagaacattaattttagcacctacaagggtagttgccgctgaaatggaggaggccctacggggacttcccataagataccagacccctgctataagggcagaacatacaggacgagaaatcgtggatttaatgtgccacgccacatttacaatgagattattgtctccggttagggtacctaattacaacttgatcataatggacgaagcgcattttacagacccagcgtctatagcggcaagaggctacatttctacccgagtcgaaatgggagaagctgcgggaatcttcatgacagccacaccaccgggtagccgtgatccttttccgcaatcaaacgcaccaatcatggatgaagaacgtgaaataccggaaagatcatggaactcaggtcatgaatgggtaactgatttcaaaggtaaaaccgtatggttcgtcccaagcataaaggccggaaatgatatagcagcctgcttgaggaaaaatggcaagaaagtaatacagctatcgcgaaaaacctttgactctgaatatataaaaactcgaacaaacgattgggatttcgtagtaactactgacataagcgagatgggagccaacttcaaagcagaaagagtaattgatcctcgtaggtgtatgaaacctgtgatactcactgacggagaagaaagagtcatactagcagggccaatgccagtaacacacagcagcgcggcgcaaagaaggggtagaattggacgaaatcccaagaacgaaaacgatcaatatatatatatgggtgagccccttgaaaatgatgaggactgcgcccactggaaggaagcaaagatgctattagataatataaatacaccggagggaatcatcccaagtatgttcgagccggaaagagagaaagtagatgcaatagatggggaataccgattgcgcggggaagcacgaaaaacatttgttgacttaatgagaagaggagatttgcctgtttggttagcttatcgtgtagcggccgaagggataaactatgcagatcgccgttggtgctttgatggcataaagaacaaccaaatattagaagaaaacgtggaggtcgaaatttggacaaaagaaggggaacggaagaaacttaagcctcgatggctggatgcccgtatatattcggatccactggcgttaaaagaatttaaggaatttgcagctggtcggaaatcactaaccctgaatttgataactgaaatgggaagattgcccactttcatgacgcaaaaagctcggaatgcattagacaatctcgctgtactgcacactgcggaagctggaggacgagcatacaaccatgctctttcggagttacccgaaactctcgagactctgttactattaacactacttgctacggtgacaggaggaatttttctgtttcttatgagtggtaaaggtatagggaagatgacactgggaatgtgttgcatcataacggcatctattttactatggtatgctcagattcaaccacattggatagctgcttcgataattttggagttctttcttatagtcttactcatacccgaacccgaaaaacaaagaacaccacaagacaaccagttaacttatgttgtgatcgcgattttgacagtcgtagcagcgactatggctaacgaaatgggatttcttgagaagaccaagaaagacttcggtctaggttcgatagctacccaacaacccgaaagtaatatattagacatagatttacgacccgcttctgcatggacgctttatgcagtcgcaacaacattcataacaccaatgttaagacattctatagaaaattctagtgtaaatgtgagtctaaccgcaatcgcaaaccaagcaaccgtgcttatgggactaggaaaaggctggccgttgtcgaagatggatattggcgtaccgttacttgcaattgggtgctattcacaagtcaaccctattactttaactgctgccctattattattagtcgcgcattacgcgattataggtcctggtttacaagcaaaagcaaccagggaagctcaaaaacgcgctgcagcaggtatcatgaagaatccgacggttgatggaataacggttatagacctagacccaataccatacgatcctaaattcgaaaaacaactaggtcaggttatgctccttgtactatgcgtgacacaagtacttatgatgaggacgacttgggccttatgcgaagcactcacactagctactggccccatatcaactctatgggaaggaaacccagggagattttggaatacgacgatagcagtctccatggcaaatatcttccgaggatcatatctagcgggggcaggtctattattttcaattatgaaaaacacagcaaatacccgacggggtaccggaaatactggagaaaccttaggtgaaaaatggaaaaatagattgaatgcattaggaaaaagtgagtttcaaatctataagaaatctggaatacaagaggtggatagaaccttagccaaagagggcataaagcgtggtgaaactgatcatcatgctgtgtccagaggctccgccaaattgaggtggttcgtggaacgcaatttagtcactccagaaggaaaagtagttgacctaggctgtgggcgaggtgggtggtcatattactgtggcggactgaaaaacgttagagaagtaaaaggtctcacaaaaggaggtcctggtcacgaagaaccaatccctatgtcaacttacgggtggaatttagtccggttgcagtctggagtcgacgtcttctttacacctccggagaagtgcgatacacttctatgcgatataggagaaagttctcctaatcctacaatagaagcgggtagaacattacgagtattgaatttagtggaaaactggttaaataataacacgcaattctgcataaaagtcctcaacccatatatgccgagcgtgatagagaaaatggaagcgctacaacgtaaatatggaggggcactcgtacggaacccattatcaagaaactcaacccacgaaatgtattgggtctcaaacgctagtggcaatattgtgagctcggtaaacatgattagccgtatgttaataaacaggttcactatgagacataagaaagccacctatgaaccggatgttgatctgggcagtggtacacgtaatattggaatagagtctgaaacaccaaacttagatataataggcaaacgtatcgagaaaattaaacaagagcatgaaacaagttggcattacgaccaagatcatccatacaaaacgtgggcttatcatgggtcatatgaaacgaaacaaacaggatcagcaagcagtatggtgaacggagtagtaaggttattaactaaaccttgggatgtaataccaaccgtgacgcaaatggcaatgaccgatacgactccctttggccaacaacgagtcttcaaggaaaaagttgacacacgaacccaagaacccaaggaaggaaccaagaaactaatgaaaataacagccgagtggttatggaaagagttgggcaagaagaaaacaccacggatgtgtacacgagaagaatttacacgtaaggtacgatcgaatgcagccttaggagctatcttcacggatgaaaacaagtggaagtcagcgagagaagcagtagaagattcacgcttttgggaattggtagacaaagagaggaatcttcatttagagggcaaatgcgaaacgtgtgtttacaacatgatggggaagagagagaagaaattaggtgaatttggtaaagcaaaaggttcgcgtgccatttggtatatgtggttaggagcaagatttttagagttcgaggctttaggattcttaaatgaagatcattggttttcccgggaaaactcactatcaggggtagaaggagagggtttacacaaattgggctatatcttaagggatgtgtccaagaaagaaggtggggcaatgtatgcagacgacacagcggggtgggatacacgtataacgctagaggacttgaaaaatgaagagatggtaactaatcacatggaaggagaacacaagaaactagcggaagcaattttcaaactaacataccaaaataaagtagtgcgtgttcaacgtcccacacccagaggaacagtaatggatataatatcaagacgtgatcaaagaggatcaggtcaagtaggtacttatggactaaatactttcactaacatggaagctcaattgattcgccagatggaaggtgaaggagtgttcaaaagtatacaacatcttacagtaactgaggagataacagtgaagaactggttggcccgagtaggtagagagagattgagtagaatggcaatttctggagatgactgtgtagtgaagcctttagacgacagatttgccagcgctctaacggcccttaatgacatgggcaaagtaagaaaagatatacagcaatgggagccaagccgcggatggaacgactggacacaagtccctttttgctctcaccattttcatgagttgataatgaaagacggtcgtgtattagtagttccatgtaggaaccaagacgaacttatagggagagctagaatcagtcagggggctggttggagtttacgagaaaccgcttgtttaggaaaatcatacgcacaaatgtggagtttgatgtattttcaccggcgagatttgaggttagcagcaaacgctatatgctcagcagtgccatcgcactgggtcccgacaagcaggacgacctggtcaattcacgccagacacgaatggatgacaaccgaagatatgcttacagtgtggaatagagtttggatacaagaaaacccctggatggaggacaaaacgcccgtcgaaagttgggaagaaatcccatatttggggaaaagagaagaccaatggtgtgggagtttaattgggctgacatcgagagcaacgtgggccaaaaacattcaaactgcaataaatcaagttcgatccttaatagggaatgaggaatatacagactacatgccatcgatgaaaagattccgaagagaagaagaagaagccggagttctgtggtga

SEQ ID NO: 22949 - RNA, 9876 nt, synthetic construct
  misc_feature 1..9876: note = derived and/or modified CDS sequence (opt6) from DENV-2__EU056811__SS-prME
  source 1..9876: mol_type = other RNA
acagcaggaatgataattatgctcatccctacagtaatggcttttcatcttaccactcgtaatggtgaaccgcacatgatagtatctagacaagaaaaaggaaaatcactgttatttaaaacaaaagatggtacaaatatgtgcactctgatggcaatggatctcggcgaattgtgtgaagacactataacatataaatgcccatttttaaaacagaatgaacctgaagacatagactgttggtgcaacagtacttctacgtgggtgacatatggaacctgtacgacgacaggagaacataggcgagagaaaagatcagtcgcactggttccccacgtaggtatgggattagaaacaagaaccgaaacttggatgtcatcggaaggagcatggaaacatgctcaaagaattgaaacttggatactaagacaccctggctttactataatggctgcgatactcgcatatacaatagggacgacacactttcaaagggttttaatatttatacttttaaccgcaattgcaccaagcatgactatgcgctgcatagggatatctaaccgggatttcgtcgaaggcgtttctggtggatcgtgggtcgatatcgttttggaacatggatcgtgcgtaaccaccatggccaaaaataaacctaccctagatttcgaattaataaaaacggaagctaaacaacctgcaacgttgcggaaatactgcatcgaagcaaaattgactaatacgacgacagactcacgttgcccaacacaaggggaaccgactttaaatgaagaacaggataaacgatttgtttgtaaacactcaatggtagataggggatggggcaacggttgtggtttgtttggaaaaggaggaatagtaacctgcgcaatgtttacttgtaagaaaaacatggaaggaaaaatagtacaaccagaaaatttagaatacaccgtggtcatcactcctcactcaggcgaagaacacgcggtagggaatgataccgggaaacatggcaaagaagttaaaattacaccacaatctagtatcactgaagcggagttgacaggctatgggacggtcacgatggagtgctcacccagaactgggctagattttaatgagatggtgctactccaaatggaagacaaagcatggttggtacataggcaatggttcctagatttaccactcccgtggttaccgggcgctgatacacagggatcgaactggattcagaaagagacattagtaacgtttaaaaacccacatgcaaagaaacaggacgtggtagtcctaggctcacaagaaggggccatgcacaccgcgctaacaggcgcgacagaaattcaaatgtcatcaggtaacctactttttactggtcatttgaaatgcagacttcggatggataaattgcaattaaaaggaatgtcgtatagcatgtgtactggaaaatttaaaatagtaaaagagatcgcagagacacagcatggtacaatagtcatacgagttcaatatgaaggagatggaagtccatgcaaaatacccttcgagataatggatcttgaaaaacgacatgtactgggtcgtttgataacagttaacccaatcgtcactgaaaaagattcaccggttaacatagaagccgaacccccattcggggatagctacataatcataggtgtagaaccaggtcaactaaaacttgactggttcaagaaagggtcctccattggtcaaatgttcgaaacaacaatgagaggtgctaaacgaatggcaatactaggtgataccgcatgggacttcggctctttgggaggggtctttacgtcgataggaaaagctctccaccaagtattcggcgccatttacggtgctgcattcagtggtgtttcatggactatgaaaattctaataggtgtaataatcacctggatagggatgaacagtagatctacatctctctccgtgtctctagtactcgttggaatagtgaccctgtatctcggagtcatggttcaagcagactctggttgtgttgtgagttggaaaaacaaagagctaaaatgtggatcaggcatatttgttacagataatgtgcacacatggacagaacaatataaatttcaaccagaaagtccatccaaacttgcgagtgctattcaaaaagctcatgaagaaggtatttgcggaatcaggagtgtgactcggctagagaatttaatgtggaaacagattacaagtgaactaaaccatatcttatcggaaaatgaagtaaaactcactatcatgacgggagacataaaaggaattatgcaagtcgggaaaaggtccttaagaccgcagcctacagaacttaggtactcttggaagacctggggaaaagctaagatgttatcgaccgaactacataatcaaacattcctcatcgacgggcctgaaactgcagagtgtccaaatactaatagggcgtggaatagtcttgaagttgaagattacgggtttggagtttttaccacgaatatatggttaagattaagagagaaacaagatgcgttctgcgactcaaaattaatgtcagcggcgataaaggataacagagctgtacatgcagatatgggctactggatagaatcagcacttaacgatacttggaagattgagaaagcaagtttcattgaggtgaagagttgtcattggccaaagagccatacgttatggtccaacggggtgctagagagcgagatggtaatccccaaaaatatagcaggcccagtatcccaacacaacaatagaccaggctatcatacacagacagcgggaccctggcatctcggaaaattggagatggattttgatttctgcgaaggaactacagtcgtagtaacagaagagtgtggaaatagagggccgtcattgagaacaactacggccagcggtaaactcatcactgaatggtgctgccgatcatgcacattaccgccgcttagatatagaggtgaagatggatgctggtatggaatggaaattagaccccttaaggaaaaagaagagaaccttgtttcaagcctagtaacagcaggtcatggacaaattgataactttagtttaggaatattaggcatggcactgtttctagaagagatgctaagaacacgtgtgggaacaaaacatgctatcctgttagtagccgtgagtttcctcacgttaatcacaggaaatatgtcatttcgtgatctagggcgagttatggtaatggttggtgccacaatgacagacgatatcggaatgggcgtgacgtatttagctttactagcagcatttaaagttagaccaacattcgcggctgggctgctgttaaggaaactaaccagtaaagaattaatgatgactactataggaatagtcttactaagtcagagttcaattccggagactatattagaattaaccgatgctttagctttagggatgatggtgttaaaaatggtgagaaatatggaaaaataccaattagctgtaaccatcatggcgatactatgtgtaccgaacgcggttattctgcaaaacgcatggaaggtgagctgcaccactttggcagtggtatctgtatcaccccttttgttgacatcgtcacaacaaaaggcggactggatacctctggcattaacaattaaaggattaaacccgaccgctatatttttaactacgttaactagaacttctaagaaaagatcttggccactaaatgaagctattatggctgtaggaatggtaagtatcctcgcaagtagtctgcttaaaaacgatatccccatgaccggaccactcgttgcaggcgggttactaacagtgtgttatgtgctcactggaagatcagcagacttagaattagaaagggctacagatgtcaaatgggatgatcaagcggaaattagcgggtctagcccaattctctcaataaccatctctgaagatggatcaatgtcaattaaaaatgaagaagaggagcaaacactaacgatcttgataagaactgggctattagttatatcaggcctgtttcctgtatcaatcccaattacagctgctgcgtggtatctatgggaagttaagaaacaacgtgcaggagttctatgggacgttccctcacccccgcctgtcggcagagcagaactagaagatggcgcatatagaataaagcagaaaggtattctagggtatagtcaaatcggcgccggtgtctacaaagagggaacttttcataccatgtggcatgtgacccgaggagcagtacttatgcacaaaggtaaaagaatcgagccttcctgggcagacgttaagaaagatttaattagttacggcgggggatggaaattagaaggcgagtggaaagagggtgaagaagtacaggtactagctttagagcccggcaaaaaccctagagcagttcagactaaaccaggcttatttcgtacgaatacgggcactataggtgctgtttccctcgattttagtcccggaacatctggaagtccaatagtcgataagaaaggtaaagtcgtgggactttacggtaatggggtagtaacaagaggaggggcatatgttagtgctatagcacaaacagaaaaaggtatagaagataatccggagatcgaagatgacatttttagaaagaggagactaaccattatggatctccatccgggtgcgggaaagacgaagcgatacttaccagcgatagttagggaagcaatcaaaagaggtcttagaacactgatcctcgcgcctaccagagtcgttgcggcagaaatggaggaggcgctccgtggtttacctatcagatatcaaacccctgcaattagagcagaacatacaggacgagaaatagtagatctgatgtgccacgctacttttaccatgaggttgttgagtcccattcgcgtgcctaattataacctcattataatggatgaagctcatttcacagatcctgcctcaatagctgcaagaggttacatatcaacacgtgtcgaaatgggtgaagcagcaggaatattcatgaccgcaacacctccaggtagtagagacccctttccccagtctaacgccccgataatggacgaagaacgtgaaattccggagaggtcttggaatagtggtcatgaatgggttacagacttcaaaggaaagactgtctggtttgtaccatccattaaaacaggcaatgacattgcagcttgtctaaggaaaaacggaaaaagggtcatacagttatctcgcaaaactttcgatagtgaatacgtaaagacgcgaacaaatgattgggacttcgtcgtaaccacagacataagcgaaatgggagctaactttaaagcagagcgagtgatcgaccccagaagatgcatgaaacctgtcatacttactgatggtgaggagagggtaatactagcgggaccaatgcctgtaacacactcctctgcggcacaaagaagaggaagaataggcagaaatcctagaaacgaaaatgaccagtacatatatatgggagagccattggaaaacgacgaggactgtgcacattggaaagaagccaaaatgcttctagataacattaatacaccagaaggaataataccatctatgttcgaaccagaacgagaaaaagtcgacgcaatcgacggtgaatacaggctcagaggggaagcacgaaagaccttcgtagacctaatgaggaggggtgatttacctgtctggcttgcttacaaggttgcagctgaaggtattaattacgcagatcgaagatggtgcttcgacgggacaagaaataatcagatactagaagaaaatgtagaagtagaaatatggactaaggaaggcgaacgaaagaaattaaaaccgagatggttagatgccaggatttattccgatccattagcactgaaagaatttaaggagttcgcagcaggccgaaagagcttaactctcaacttaattaccgaaatgggccgtttaccaacgtttatgacacaaaaagcccgagacgcgctcgacaacctcgcagtacttcacaccgcagaagcgggaggcaaggcttacaaccatgcattatcagagttaccagaaacgttggaaacactcttattattaactttattagctacagttacagggggaatctttctgtttctgatgtccggtcgcggaataggtaagatgaccctcggaatgtgttgcattataacagctagcattctactttggtacgcccagattcaaccccattggattgcagcttcgataatattggaatttttcttgatcgtattattaatacctgaaccagaaaaacagagaacaccccaagacaatcaactgacatatgtgatcattgcaattctgactgtcgtggccgcaacaatggccaatgagatgggtttcctcgagaaaactaagaaagacttaggattaggacatatagcaacacaacaaccagagtcaaacattctagatattgatcttagaccagcatcagcctggacactttatgcagtggccacaacttttataacaccaatgctcagacattcaatagaaaattcaagcgtgaacgtatcattaacagctatcgctaatcaagcgacagtgttaatgggtttgggcaagggatggcccctatcaaagatggatatcggcgtgcctttgctcgcgattggatgctattcacaagtaaaccctataacactaactgcagccttacttatgcttgtggcacattatgcaataataggaccagggctacaggccaaagctacacgtgaagcccagaaacgagctgctgcaggcattatgaaaaaccccaccgttgacgggataacggtaattgatttagaccccataccatacgacccgaaattcgaaaaacagcttggacaagtaatgctgctggtactctgcgtgacacaagtattgatgatgagaaccacttgggctctctgtgaggccttaacattagccacgggacctgtatctaccctttgggagggcaatcctggaaggttctggaataccacgatcgcagtgagcatggcaaacatattcagaggatcgtatcttgcaggagcgggtctactatttagcataatgaaaaacacgacttccacacgaagagggacagggaacatgggagaaaccctaggagaaaaatggaaaaacaggctaaatgcattaggcaagtctgagttccaaatatataagaaatctggtatccaagaagtagatagaacacttgcgaaggaaggaattaaaagaggggagacggaccaccacgcagtcagtcgtggttcagcaaaactaagatggtttgtcgaacgaaacctcgtaacaccagaaggtaaagttgtagatttaggatgtggtcgaggtggttggagttactattgtggcggccttaaaaatgtaagagaagtaaaagggttgactaaagggggaccgggccatgaagaaccaatcccaatgtcaacctatggatggaacttagtccgacttcaatcgggagtggatgtatttttcgtacctccggaaaaatgtgataccttactttgtgatataggggaatcaagcccaaacccaaccgtagaagctggaaggactcttcgagtgctaaatttagttgagaactggctcaataacaacacacaattttgtgtaaaagttttaaatccatatatgccatctgtaattgaaagaatggagacccttcagagaaaatatgggggcgccctagttcgaaatccactatcgcgaaactcaacccatgaaatgtactgggtaagtaatgcgtctggaaatatagtttccagtgtaaacatgatatcaagaatgcttataaacaggttcactatgaggcataagaaagctacttatgaaccagatgtagatcttggatccggaactcgaaacatagggattgaatcagaaacaccaaacttagatatcattggaaaacggatcgagaaaataaagcaagagcacgaaacgagctggcattatgatcaagaccacccatacaaaacatgggcttatcatgggtcctatgaaacaaaacaaacgggcagcgctagctctatggtaaatggagtagtcagattattaaccaaaccttgggacgtgatacccatggttacgcaaatggcgatgacggatacaactccgttcggacaacaaagggtattcaaagaaaaagttgacacaagaactcaggagccaaaggagggcaccaagaaacttatgaagataactgccgaatggctatggaaagaactaggaaagaagaaaacgcccagaatgtgtacaagggaagagttcacaaagaaagtcaggtcaaatgctgcacttggtgcgatatttactgacgagaacaaatggaaatcggcgagggaagctgtagaggataaccggttctgggaacttgtagataaagaaagaaacctgcacttagaaggtaaatgtgaaacatgcgtatataatatgatgggtaaaagggagaagaaactaggagaatttggtaaagctaaaggttctcgggctatttggtatatgtggctcggtgcgcgattcttggagttcgaagcactcggattcctaaatgaagaccattggttctcaagggaaaattcactttcgggagtcgaaggagaggggctacataaactcgggtatatactgagagaagtcagtaaaaaggaaggtggcgcaatgtatgctgacgatacagcaggatgggataccagaatcacaattgaggacctcaaaaacgaagaaatgataacaaaccatatggctggcgaacataagaaattagcagaagcaatctttaaacttacatatcaaaataaagtcgtgagagtccaacgacccacacctcgaggaactgttatggatattatttctcgaagagatcaaagaggatcgggacaagttgtaacttatggtctaaacacctttacaaatatggaagcacaactaatacggcaaatggaaggcgaaggtgtatttaaaagtattcaacatctaacagcatcagaagaaatcgccgttcaggattggttggtaagagtcggcagagaaaggcttagcagaatggcaataagcggagacgactgcgttgttaaaccacttgacgatcgtttcgctaaagcgcttacagcactaaatgacatgggtaaggttcgtaaggatatacaacagtgggaaccatcacgcggatggaatgattggactcaggtcccattttgctcccatcattttcatgagctaatcatgaaggacggacgaacacttgtcgttccatgtcgcaatcaagatgagttaataggaagggcacgaattagccaaggcgccggatggtcactacgagaaacggcatgtctagggaaaagctatgcccaaatgtggtcactcatgtatttccatcgtagagatctccgattggcagcgaatgcaatctgctcggcggttccgtcacattgggttcctacctctaggaccacctggtcaattcatgccagtcatgaatggatgacaacagaagacatgttaaccgtctggaatcgagtttggatactcgagaatccatggatggaagacaaaacgccagttgaatcctgggaagagataccatatctaggaaagagagaagaccaatggtgtggcagtttaattggtttaacctcaagagctacttgggccaaaaatatacaaaccgcgataaatcaggtacggagtctaataggtaatgaagaatacacggattacatgccctcaatgaaaagattcagacgggaagaggaagaagctggtgttctatggtag

SEQ ID NO: 22950 - RNA, 9876 nt, synthetic construct
  misc_feature 1..9876: note = derived and/or modified CDS sequence (opt6) from DENV-2__DQ645545__SS-prME
  source 1..9876: mol_type = other RNA
acagcgggggttataataatgatgatacctacagttgtagcatttcatttaacgacacggaacggagaaccgcatatgatagtttcacgacaagagaaaggtaagagcttactatttaaaacagaaaatggtgtaaacatgtgtactttaatggcgatggatctcggcgaactttgcgaagacacaataacatataattgtccactcctacgacaaaatgaaccagaggacatagactgttggtgtaattccacgagcacctgggttacgtacggaacatgcacagcaacaggggaacacagacgtgaaaagaggagtgtcgctctagtcccgcacgtaggaatgggattagaaactcgtacagaaacctggatgtcttcacaaggtgcatggaaacacgcacaaaggattgaaacctgggttcttagacatccagggtttaccatcatggcagcaatactcgcatacacgataggtacaacttactttcagagagttctaatattcatattgttaaccgcagtagctcctagcatgactatgcgctgtattggtatttcgaatagagatttcgtggaaggggtaagtggaggatcctgggttgatatagtattggaacacggctcatgcgtaacgactatggctaaaaataaaccgaccttagattttgaacttattaaaacggaggcaaaacacccggcaactcttagaaaatactgcatagaagcaaaactgactaacacaacaaccgcaagtagatgtcctacacaaggggagccatctctaaatgaggagcaagacaaaagattcgtctgcaaacactcaatggtagacagggggtgggggaatggatgtggactctttgggaaaggagggatagtaacatgtgcaatgtttacatgtaagaaaaacatggaaggcaaagtggtacaacctgaaaacctagagtatacaattgttatcacaccacattcgggtgaagagaatgcggtaggaaacgatactggtaaacatggcaaagaaatcaaagtcacccctcaatcctccatcacagaagccgaactaactggctacggtacggtgaccatggagtgctctcctaggactgggctagactttaatgaaatggtattgctccaaatggaagataaagcatggcttgtacatcggcagtggtttctagacttacccttgccgtggcttccaggggccgacacgcaaggatctaactggatacaaaaagaaactttagtcaccttcaaaaatcctcatgccaagaaacaagatgtcgtcgtacttggttcacaggaaggtgccatgcacacagctctcacaggtgcgacagaaatacaaatgagttctggaaacttattatttaccggtcatctaaaatgcagattgagaatggacaaactccagctaaaaggtatgtcatattccatgtgtactggaaaattcaaagtagtgaaagaaatcgctgaaactcagcatggaactattgtcatacgcgtacaatacgaaggagatggttcaccatgcaaaataccgttcgaaattatggaccttgagaaaagacacgtcctcgggaggttaattacagtaaacccaattgtaacaggaaaagattctcccgtcaacatagaagcagagccaccttttggagactcgtatataataattggtgtagaacccggacagttgaaactgagctggttcaagaaaggaagttcaatcggccaaatgttcgaaactaccatgagaggtgctaaaagaatggccatcttaggagataccgcttgggattttggaagtttaggtggagttttcactagcatcggcaaagcattgcatcaagtctttggcgcaatatacggagcagcctttagtggcgtatcctggacaatgaaaattctaataggcgtagtaatcacatggatagggatgaacagccgcagcacatctctcagtgtaagtctcgttcttgtcggcgtcgtaaccctctatttaggtgttatggttcaagcggacagtggatgtgtcgtttcgtggaaaaataaagaactcaaatgtggttcagggatattcataaccgacaatgttcatacatggacagagcaatataaatttcagccagaatcacccagtaaattggcaagtgctatacagaaagcgcatgaagaaggtatatgtgggattcgatctgtgacacgactagagaacttaatgtggaaacagatcacaccggaactaaaccatattttatcagaaaacgaagtgaaactaactattatgacaggggacataaaaggaataatgcaagcaggtaaaagatcattaaggcctcagccaactgaattaaaatactcatggaaggcttggggaaaagcgaaaatgctgtctactgagttacacaaccatacattcttaattgacggcccagaaacggctgagtgtccaaacacgaacagagcgtggaatagcctggaggttgaagactatggttttggtgtcttcacaacaaacatttggctgaagttaaaagaacgtcaagatgtattttgtgactcaaaactaatgtcagcggcaatcaaggataatagagctgtgcatgcggacatgggatactggattgaaagcgctcttaatgatacatggaaaatagaaaaagccagctttatagaggtcaagagttgccactggccaaaatctcatacgctatggagtaacggggtattagaatcagaaatgattatacctaaaaactttgctggcccagtgtcacaacacaactacagaccaggttatcacacacaaactgctggaccatggcatcttggaaaactggaaatggactttgatttctgtgaaggaacaaccgtggttgtaaccgaagactgtggtaatcgaggaccatctttgagaaccacaaccgcatctggaaagttaataacagaatggtgttgcagatcctgcacactgccacccttaagatatagaggggaagacggttgctggtacggcatggaaattaggcctttaaaagaaaaagaggaaaatttagtgaatagtctagtaacggctggtcatggacagatagataattttagcttgggtgtactgggaatggcattatttcttgaagagatgctaagaactcgagtagggactaagcatgccatattgttagtagctgtctcgtttgtaacacttatcaccggtaacatgagttttagagacctaggtcgagttatggttatggttggtgccaccatgacagatgatatagggatgggagtaacttatttagcgctattggcggcattcaaagtcagaccaacgtttgcggcaggactcctacttcgaaaattgacttcgaaagaacttatgatgacaacaataggaattgtactactatcacagtctactatcccagagactattttagaattgactgatgcactcgccctaggcatgatggtgctaaaaatagtacgaaatatggagaaataccaactggcagttacgattatggctattttgtgcgttcctaacgctgtaattttgcagaatgcatggaaggtgtcctgtacaatattggcagtcgtatcagtatcccctttactattaacaagtagccagcaaaaagcagactggatacctttagccttaactatcaaaggcctcaatcctaccgcaatttttcttactacactaagtcgaacaagcaaaaagcgctcatggccgttaaacgaagcgattatggctgtggggatggtctccatactagcttcgagtcttcttaaaaacgatataccgatgactggacctctcgtagcgggagggttgctaacagtctgttacgtacttacggggagaagcgctgatctagagttggaaagagcagcagatgtgagatgggaagaacaagcagagatatcagggagctcgccaattctttcgataacgataagtgaggatggttccatgtcgatcaaaaatgaggaagaagaacaaacactaacaattttaatccgaacagggctactcgtgatatcgggcctctttcctgtgtcgatcccaattacagccgcagcttggtacctatgggaagttaagaaacaacgggctggtgtgctttgggatgtgccatcccctccccctgtaggtaaagcagaactggaggacggagcatatcgaattaaacaaaaagggatattaggttatagccaaatcggtgctggagtttacaaagaaggaacttttcatacaatgtggcacgtaaccaggggtgcagttttaatgcacaaaggaaaaaggatagagccgagctgggcagatgtcaagaaagacctaataagttacggaggcggatggaaactagaaggggagtggaaagaaggtgaagaggtccaagttctagcgctggagccaggcaaaaatccgagggccgtgcagacgaaaccagggttatttaaaacgaatacaggaacgataggagcagtttcactagattttagccccggaacgtcgggtagtccaatagtagacaagaaaggaaaagtagtcggactatacggaaatggtgtcgtaactagatccggaacttatgtcagtgccatagctcaaactgaaaaatcaattgaagataatccagagattgaagatgacatcttcaggaaaaagcgcttgacaataatggatctccatcctggggctggcaagaccaaaagatatttgcccgcgattgtgcgggaagctataaaacggggtctcagaacactaatactagcgcccacaagggtagtggctgcagagatggaagaagccttaaggggtttacctatcagatatcagaccccggcaataagagccgagcacacgggccgagaaattgtcgatttgatgtgccatgcaacattcactatgcgtctactgagcccaataagggtaccaaattataatctcatcataatggatgaggcgcattttaccgacccagcttctatagctgcgagaggttatataagcacgagagtggagatgggagaagcggccggtatctttatgaccgcgacccctccaggatctagagacccattccctcagagcaacgcccctataatggacgaggaaagagagataccggagcggagctggaacagcgggcacgaatgggtgacagattttaagggaaaaaccgtttggtttgtgccctctataaaagctggaaatgatattgcagcttgcctaaggaagaatgggaaaaaggttatccaattatcgagaaagacatttgattctgaatacgtaaaaacacgaacaaatgactgggattttgtggttactactgacatcagcgaaatgggtgctaattttaaggcggaaagggtaatcgatccccgaagatgtatgaaacccgtcatcctaacagatggcgaagaaagagtgatcctagccggaccgatgcccgtgacgcatagttcggccgcacagagacgtggacgtgtaggaagaaatcctaaaaacgaaaatgaccaatatatatatatgggagaacccctggaaaatgacgaggactgcgctcactggaaagaggctaaaatgctccttgataatataaacaccccagagggtatcataccttcaatgttcgaacccgagagagagaaagtggatgcaattgacggagagtacagattaagaggagaggcacgaaaaacttttgtagacttaatgagaagaggggacctcccggtatggttagcttatcgagtagcagccgaaggtatcaactacgcagatagaaggtggtgttttgacggtgttaaaaacaatcaaatacttgaagaaaatgtagaagtagagatatggacaaaggaaggtgaaaggaagaaactaaaaccccgttggctcgatgcgagaatttattctgatcctctcgctctcaaggagtttaaagaatttgccgccggaagaaagagcttaacgttaaatcttataactgaaatggggcgattaccgacatttatgacacaaaaagcaagaaatgctctagataatttagcggtgttacatacagcggaggcaggaggaagggcgtacaaccacgcattaagcgaattgcccgaaacgctagaaacactcttacttctaacactcctggctacagtaaccggtggaatattcctgttcttaatgagtggcaaaggcattggtaaaatgaccctaggtatgtgctgcattattacagctagcgttttactatggtatgcacaaatacaaccacattggattgctgcgtcgatcatactagagtttttcctgattgtcttgttgatccccgagcctgaaaagcaaagaactcctcaagacaaccaattaacctacgtcgtaatcgctatactaacagttgtagctgcaactatggcaaatgagatgggtttcttggagaaaacgaagaaagattttggtctgggaggaatagcaacacaacaaccagaaagtaacatacttgatatagatcttcggcctgcatcggcgtggacactatatgcggttgcaacaacctttataactcccatgcttcggcactctattgaaaattctagtgtaaacgtatcattgacagctattgcgaatcaagccacagttttaatgggcttaggtaaaggatggcccctcagtaaaatggatatcggggtcccattattagcaatcggatgttactcgcaagtgaacccaatcactctaaccgcagcactcttactccttgtagcacactatgctatcatcggcccaggattacaagcaaaagcaaccagagaggctcagaaaagagcagctgccggaattatgaaaaaccccactgtggatggaataactgtaattgatttagatcccatcccctacgatccaaaatttgagaaacaactcggacaagttatgttgcttgttctttgcgtaacgcaagtccttatgatgcgaaccacctgggctctatgtgaagctcttacattagcgacaggaccaatttccactctttgggaaggtaacccagggcgcttctggaatactaccattgcagtaagtatggctaacatattcagaggctcatatttagccggggctggcttattgttttcgatcatgaagaacaccgctaacacccgtagaggcacaggaaataccggcgagacccttggagagaaatggaaaaatcgtctgaatgcattaggtaaaagtgaatttcaaatatacaagaaatcggggatacaagaagtggacagaacactagcaaaggaaggaataaagcggggtgagacagatcaccatgcggttagcagaggatctgcaaagttgcgttggttcgtagaaaggaatctagtcacccctgaaggaaaagtaatggacttaggttgcggccgtggaggttggtcttactactgcggagggctaaagaacgtaaaagaagtaaaagggttaactaaaggaggcccaggccatgaggagccaatacctatgtcgacctacggatggaacttggtcagactccaaagcggtgtagacgtatttttcacgccgccagaaaaatgtgacaccctattatgtgatataggtgaatctagccctaatcccacagtagaagcaggaagaactctccgggtgttaaacttggtcgagaactggctaaataataacacacaattttgcattaaagttcttaatccgtatatgccaagtgtcatcgagaaaatggaggcactccagagaaaatatggaggtgcactcgttcgtaaccccctgtctagaaattcaacacatgaaatgtattgggtaagtaatgcgtctggtaatatagtatcatcagtgaacatgatatcgagaatgctaattaatagatttacaatgagacataagaaagcgacgtacgagcctgatgtcgacctaggtagtggaactagaaatatcggaatagaatcagaaacaccaaatttagacatcattggaaaacggattgagaaaattaaacaggaacacgaaacaagttggcactatgaccaagatcatccatataaaacttgggcatatcacgggtcgtatgagacgaaacagacaggtagtgcaagtagcatggtgaatggtgttgttaggttattaacaaagccatgggatgtcattccaatggtcacacagatggccatgacggatacaacaccatttggacaacaaagagtatttaaagagaaggtggatactagaacacaagaaccaaaagaaggtactaagaaactaatgaaaatcaccgcagagtggttgtggaaagaacttggcaaaaagaaaacaccaaggatgtgtacccgtgaagagtttacgcgtaaagtaagatcgaatgcagcgttgggagcaatcttcaccgatgagaataaatggaaatcagcaagagaagcagtagaagactctggattctgggaacttgtagacaaagaacgaaatttgcacctagaaggaaaatgcgaaacgtgtgtatataatatgatgggcaaaagagagaagaaattgggtgaatttggcaaagcgaaaggaagcagagcaatttggtatatgtggttaggagcacgatttcttgagtttgaagcattaggatttttgaatgaagatcattggttcagtagggaaaactctttatctggtgtagaaggagaaggtctacacaaacttggatacatactcagagatgtcagcaagaaagaagggggagcaatgtatgcggacgatacagccggatgggatacaagaattacattagaagatttgaaaaatgaagaaatggtgacaaaccatatggagggtgaacacaagaaattagccgaagctatatttaaattaacttatcaaaataaagtggttcgggttcaacgcccaacccccagaggaaccgtaatggacataattagcaggagagatcaacgtggctcagggcaagtagttacgtatggattaaatacattcacaaatatggaagcacaattaattcgtcaaatggagggcgaaggagtattcaaatcaatacaacaattaactgcaactgaggaaatcgcggtcaaaaactggcttgcgagagtaggtagggaacgattaagtcgcatggctatcagcggggatgactgtgtggtcaaaccattagatgacaggtttgcgagtgcattgaccgcgctcaacgatatgggaaaagtccggaaggatatacaacaatgggagccttcaagaggatggaatgattggacccaagttccattttgctcacatcactttcatgaactgattatgaaagacggaagagtattagtagtaccctgtcgaaatcaggatgaattaattggcagagcccgaattagccaaggggcagggtggtcattaagagaaacagcatgtttgggaaagtcatatgcacaaatgtggagcctaatgtattttcaccggcgagatctccgattagcggcgaatgctatatgctctgctgtacccagccattgggtaccgacttcaaggactacgtggagcatccacgcaactcatgaatggatgaccacagaagacatgctaacagtctggaatcgcgtctggattcaagaaaacccttggattgaagataaaacgcctgtcgagtcgtgggaagaaataccatatcttggtaagagggaggatcagtggtgtggatcgttaatagggttaacaagtcgagctacttgggccaaaaatatacagacagctataaaccaggtaaggagtcttattggcaacgaagaatatactgattacatgccctctatgaaaagattcagaagagaagaagaagaggcgggagtcttatggtaa

SEQ ID NO: 22951 - RNA, 9876 nt, synthetic construct
  misc_feature 1..9876: note = derived and/or modified CDS sequence (opt6) from DENV-2__DQ645546__SS-prME
  source 1..9876: mol_type = other RNA
actgctggtgtaataataatgatgatacccactgtagtagcattccatttaacaacccgaaatggagaaccgcacatgattgtgtcacgtcaagaaaaaggtaaatcgctcttatttaaaacagaaaatggtgttaatatgtgcacactaatggcaatggatctaggagaactatgcgaagatactataacatataactgtccactgcttcgccaaaatgaacccgaagatatagattgttggtgtaattcaacatctacatgggttacctacggaacatgtactgctacaggtgaacatcgacgagagaaaagaagtgtggctctagtgccacacgtaggaatgggtctagaaacgaggacagaaacatggatgagcagtgaaggggcttggaaacatgcgcaaagaatagaaacgtgggtacttagacatcctggattcaccataatggctgcaattttagcatatactataggaaccacgtactttcaacgtgtattgatctttatactactcaccgcggtagccccttcaatgacaatgaggtgtatcggaatttcaaatagggatttcgtagaaggtgtatccgggggaagctgggttgacatagtgctcgaacatggatcatgtgttaccactatggcgaaaaataaacccactttagactttgaattaataaaaaccgaagcgaaacatccagctactcttcgaaaatactgtatagaagcgaaactgactaacacaacaacagctagccgctgtcctacacaaggagaacctagtctcaacgaagaacaagataaaaggtttgtatgcaaacactcaatggtagataggggatggggaaacgggtgtggactttttggaaaaggtggaatcgtgacttgtgcgatgtttacatgcaagaaaaatatggaaggaaaagttgttcagcctgaaaacctagaatatacaatcgtcataacacctcatagcggagaagaaaatgctgtgggaaatgacacagggaaacatggtaaagaaatcaaagtaacgcctcaatctagcatcacggaagcagaactcacaggatatgggacagttacaatggaatgttcgccccggacaggtctcgattttaacgaaatggttttactgcaaatggaagacaaagcatggttagtacataggcaatggtttctggatctccctctgccatggcttccgggggcggacacacaaggatcaaattggatccaaaaagaaaccttggtgactttcaaaaatccgcacgctaagaaacaagacgtcgttgtactaggtagccaagaaggtgctatgcataccgcacttacaggagccaccgaaatacagatgtcttcaggaaatctgcttttcactgggcatttaaaatgcagattgcgcatggataaattacagctgaaaggaatgtcttacagcatgtgcaccggtaaattcaaagttgttaaagaaatagcagaaacacaacacggaaccattgtgataagggtgcagtatgaaggagacggctccccatgcaaaataccctttgaaatcatggacctcgaaaaacgacatgtacttggccgattaataacagtaaacccaatagtgactgagaaagatagcccagtaaacatagaagcagagccgccattcggagattcatacatcataattggggttgaacctggccaattgaaactgtcgtggttcaagaaagggagcagcattggacaaatgtttgaaaccacaatgcggggagcgaaacgaatggcgatactcggagacacggcatgggacttcggttccctagggggtgttttcactagcattggtaaagcgttacatcaagtatttggagctatatatggtgccgctttttctggcgtatcttggacaatgaaaatattgataggagtggtaataacctggataggaatgaatagcagaagcactagcctatctgttagtctggtactggtaggagtcgttacactgtatttaggtgtaatggtccaggccgattctggttgcgtcgtatcctggaaaaataaagagttaaaatgtggttccggaatcttcataacagataatgtacacacctggacagaacaatataaatttcaacctgaatcaccatcaaaactggcgtcggcgatacaaaaagcacatgaagaaggcatatgcggtatacgctcagtcacccgattggaaaacttaatgtggaaacagataacgccagaattaaatcatattctcagtgaaaacgaggtcaaactgactataatgaccggcgacataaaaggcataatgcaagccggaaagcgatccttgagaccccaacctacagaactaaaatattcatggaaagcgtggggtaaagcgaaaatgttatctacagaattacataaccacacatttcttatcgatggcccagaaactgcagaatgcccgaacactaacagagcttggaatagcctagaggttgaagattatggatttggtgtgtttacaaccaatatatggttaaaactaaaagagagacaggacgtgttctgtgattctaagttaatgtcagctgccattaaagacaacagagcagtacacgcagatatgggttattggattgaaagtgccctaaatgatacgtggaaaatagaaaaagcgtcttttattgaagtaaaatcatgtcattggccaaaatcacatacactgtggtcaaacggagtcctggaatcagagatgattattcccaaaaactttgcaggtccagtaagtcaacataactatagaccgggttatcacacgcaaactgccggtccgtggcacttaggtaaactagagatggacttcgatttttgtgagggtacaactgttgtcgtaacagaggattgtggaaatagagggcctagtttaagaacgaccacagcctcaggcaaactcattaccgaatggtgctgcagatcctgcacccttccacctttacgttaccgaggtgaagacggctgttggtatggaatggaaatacgcccgctaaaggaaaaagaggagaatttggtaaatagtcttgttactgcaggccacggacaaattgacaacttctctctgggggtattagggatggctttatttctagaagaaatgttgagaacacgtgttgggacaaaacatgctatattattagtcgctgtatctttcgtaacattgataacaggcaacatgagctttcgggatctagggcgagtaatggttatggttggtgccactatgacggacgacataggaatgggagtgacctatttagcactgcttgcagcctttaaagttagacctacgtttgccgcagggttattgttacgtaaacttactagcaaggaactcatgatgactactattggtatcgttctcttatcacaatcaacaattcctgagacaattcttgaattaacagacgcattagcactgggaatgatggtcttaaaaatagtaaggaatatggaaaagtatcaactagccgttacaataatggcaatattatgcgttccaaacgctgtgatattacaaaatgcatggaaagtttcttgtactattcttgcggtagtatctgtgagcccactattgctaacaagtagtcaacagaaagctgattggatccccctggctcttaccataaaagggctgaatcccacagcaatttttctcaccacgttgagtagaacctccaaaaagagaagctggccgctgaatgaagctataatggcagtaggtatggtttccatactagcaagttcgttgctgaaaaatgatatcccaatgacaggacctctagtggctggtggtctacttacagtttgctacgtattaacaggacgatcagctgaccttgaactagaacgtgccgcagacgtcaggtgggaggaacaagcggagatttccgggagctcgccaattctaagtataactataagtgaagatggctcaatgagcatcaaaaatgaggaagaagaacagacccttacgatactaatccgaacaggactgctggtaataagcggcttatttcctgtatcaataccgataactgcagcggcgtggtatctatgggaggtgaagaaacaaagagccggagtcttgtgggacgttccttcaccgcctccagttggcaaagcagaactcgaggacggcgcctatcgtattaagcaaaaaggaatcctgggctattcacagatcggagccggcgtctacaaagaagggacgtttcatacaatgtggcatgttacgcgcggggctgttcttatgcataaaggtaaacgtattgaaccttcatgggcagatgtcaagaaagacttaattagttacggaggaggatggaaattagaaggagaatggaaagagggagaagaggtccaagttctagcactagaaccgggcaaaaatcctcgggcagtacaaactaagccaggcctatttaagaccaatacaggcacgataggagcagtaagtttagacttctctccaggaacaagtggttctccaatagtggacaagaaaggaaaggtggttggactatatggaaacggtgtcgttacaaggtccggaacctatgtctcagcgatcgctcaaactgaaaaatctattgaagataacccggaaatcgaggacgatatattcaggaaaaagagactcactataatggacttgcaccctggagcgggtaaaacaaaaagatatctacctgcaatagtcagagaagcaataaaaagaggtctaagaacattaatactagctcctactagagtagttgcagcggaaatggaagaagcgttacgtggattaccgataagataccaaactccagcaataagagctgagcatactggaagagagattgtagatttaatgtgccacgctacattcaccatgcgattattatcaccgattcgtgttcccaactataatttaatcatcatggacgaagcacactttacagatcctgcttcaatagctgcaagaggatacatctccacaagagttgaaatgggagaagcagcaggaatcttcatgacggcaacaccaccaggatcgcgtgatccttttccccaatccaacgctccaataatggatgaggaaagagagatacccgagagatcatggaatagcgggcacgaatgggtaacagattttaagggaaagactgtttggttcgttcccagcataaaagctgggaatgacatagctgcatgcctccggaaaaacggcaagaaagttattcagctttctagaaagacattcgacagtgaatacgtaaaaactagaactaatgattgggatttcgtagtaacaacagacatatcggagatgggagcaaattttaaagccgaaagagtgatagatcccaggagatgcatgaaaccggttattctaaccgatggtgaagaaagggtaattctggcaggtcctatgccagtaacacattcgtccgccgcacaacgacgtggacgagttggcaggaaccctaaaaacgagaacgatcagtatatctacatgggggagccgctagaaaatgacgaagactgcgcacattggaaggaagctaagatgctcctagacaatattaatactccagaaggaataattccgtctatgtttgaacccgagagagaaaaggtcgacgcgatagatggagaatatcgcttacggggagaagcacggaaaacattcgtagatctcatgcgcagaggcgatttgcctgtttggttagcataccgagtcgcagccgaaggcataaattatgcggatagacgctggtgtttcgacggcgtcaaaaacaaccaaattttggaggaaaacgtagaggtggaaatttggactaaagaaggggaaaggaaaaagctaaaaccgagatggttagatgcaaggatttatagcgatcccttagccctcaaagagtttaaagaatttgcggctgggagaaagagcttgactttgaacctgataacagaaatgggtcgactacctacatttatgactcaaaaagcacggaatgctttggataatttagctgtattgcacaccgcagaagcaggagggagagcttacaaccacgccctatctgaacttcctgaaacattagaaacactactactattaacactactagctacagtcacaggtggaatatttttgtttttaatgtccggcaaagggattggaaaaatgacattgggcatgtgttgtatcattacagcatccgttttgctctggtacgctcagatacaaccccattggattgcggcatcaataatacttgagtttttcctaatagtactgttaataccggaacctgagaagcagaggacaccccaagacaatcagttgacatacgttgtgatcgcaatactaacagttgtcgctgccactatggctaatgaaatgggctttcttgagaaaactaagaaagatttcggcttaggtggtatagccacacagcaacctgaatcaaacatcctcgacattgatctaagacctgcgagcgcatggactctatatgcagtagcaactacgttcataactccgatgctccggcactcaattgaaaacagctcagtaaatgtttcactaaccgctattgcgaatcaagcaaccgtgctaatggggttaggaaaaggttggcctctgagtaaaatggatattggagttcccctacttgcgataggttgttacagccaagtcaaccctattactttaacggccgccttactactattagtggcccattacgctataataggaccgggattacaagccaaagcaactagagaagcacagaaaagagcagccgcagggattatgaagaatcctacggtagacggtataaccgttatagatttagatccgatcccatacgatccaaaattcgaaaaacagctaggacaagttatgttacttgtattatgcgtgacgcaagtcttaatgatgagaacaacatgggcactatgcgaagccttaacactagcaactggcccaatcagcacgttatgggaaggcaatccgggccgattctggaacaccacaatagcagtttcaatggccaacatattcagaggttcttacttagcgggtgcgggcttattattttcaataatgaaaaacactgccaatacaagaaggggaactggaaataccggcgagactctaggagaaaagtggaaaaatagattgaacgccttagggaagtcggaatttcaaatatataagaaaagtgggatacaggaagtagaccgaacactggctaaagagggtattaaacgaggagaaacagaccaccatgcagttagtcgtggtagcgccaaactcagatggttcgttgagcgtaatttagtaaccccggaaggtaaagtaatggatcttggctgtggacggggaggttggagttattactgcggtgggctcaaaaacgtcaaagaggttaaaggacttacaaaaggagggcccggacacgaagaaccaatacccatgtccacttatggatggaacctggtgaggctacaatcgggagttgatgtattctttacacccccggaaaaatgtgacactctactgtgcgacataggggagagttcaccgaacccaaccgtcgaagccggaagaactctaagagtattaaatctagtagaaaattggctgaacaataatacccagttttgcatcaaagtgcttaacccctatatgccgtcggtaatcgagaagatggaggcactacagcgaaaatatgggggagcgttagtccgtaacccactgagtagaaattctacacacgaaatgtattgggtaagtaatgccagtggaaacatcgtgagtagcgtcaacatgattagccgtatgctaatcaatcgctttacaatgcgacataagaaagctacgtacgaaccagacgttgacttaggatccggcacacgtaatataggtattgaaagtgaaacaccaaatctagacattataggaaagagaatagagaaaataaagcaagaacatgaaacgagctggcattatgaccaagaccacccttacaaaacttgggcgtaccatggaagttacgagacaaaacagacaggtagtgcctcatctatggtgaacggggtagtacggttgctaactaaaccgtgggatgttataccaatggtgacacaaatggctatgactgatactacaccgtttggtcagcaacgtgtgtttaaggaaaaagtggatacacgaacgcaagaaccaaaagaaggaacaaagaaactaatgaaaattacagctgaatggctatggaaagagttaggcaagaagaaaacgcccagaatgtgcacgcgggaagagttcacaaggaaagtgagatcaaatgccgcacttggggctatatttacagacgaaaataaatggaaaagtgcgagagaagcggtagaagacagcggattttgggagttagtagacaaagaacgaaacttacatcttgaaggtaagtgtgaaacgtgtgtctataatatgatgggaaaaagggaaaagaaactgggtgagttcggtaaggccaagggaagtagagcaatatggtatatgtggttaggcgcgagattcttagagttcgaagcactaggcttcctcaatgaagaccattggttctcccgcgaaaattctctttctggggttgagggtgaaggactgcacaagctcggatatatcctacgagacgtttctaaaaaggagggaggagctatgtatgcagacgacacagcaggatgggataccaggattacactagaagacctcaagaacgaagaaatggtaacgaatcatatggaaggggaacacaagaaactagctgaagcgatatttaaactgacatatcagaataaagtagtacgggtacagaggccaaccccacgcggaactgtaatggatatcatttccaggagggaccaacgaggatccgggcaagtagtaacgtatgggttaaacacctttacaaacatggaagctcagctcattcgtcaaatggaaggtgaaggcgttttcaaatctatacaacaacttacagccacggaagaaatagctgtcaagaactggttagcccgagttggaagggaaagattgtctaggatggccatatcaggggacgactgcgtggtaaaacccctggatgaccgctttgcatctgctctcacagcactaaatgatatgggtaaagtaaggaaagatatccaacagtgggaaccctcaagaggctggaacgactggacccaagtaccattttgctcccatcatttccatgaactaatcatgaaggacgggcgagttttagtggtcccatgcagaaaccaagatgagctaataggcagagcacgtataagtcagggcgctggttggagcttacgagaaactgcctgtttaggcaaaagctatgctcaaatgtggtcactaatgtatttccatagacgagacttacgcctagccgcaaacgctatatgctcagctgtcccttctcattgggtaccaacctctagaaccacgtggtccattcatgcaacacacgagtggatgacgacagaggacatgttgacagtctggaacagggtttggatccaagaaaatccatggattgaagataagacaccagtagaaagctgggaagagataccctacctcgggaaaagagaggatcaatggtgcgggagtttgattggacttacaagtcgagctacgtgggccaaaaatatacaaactgcgataaaccaggtcagatcgctaataggaaacgaggaatacacagactacatgcccagtatgaaaagattccgacgggaggaagaagaagcaggcgtattatggtga

SEQ ID NO: 22952 - RNA, 9876 nt, synthetic construct
  misc_feature 1..9876: note = derived and/or modified CDS sequence (opt6) from DENV-2__DQ645547__SS-prME
  source 1..9876: mol_type = other RNA
acagcaggcgttatcataatgatgatacccactgtcgtagcgttccacttaacgacgaggaacggggagccacacatgattgtctcacgacaagagaaaggtaagtcacttttattcaaaactgaaaatggcgttaacatgtgtacgttaatggcaatggatttgggtgaactctgcgaggatactattacatataattgcccattattacgacagaacgaaccagaggatattgattgttggtgcaacagtacttccacctgggtaacatatggtacttgtacagctacaggagaacatcgaagggagaaacgtagtgtagcattagtaccacacgtagggatgggtctagaaacgcgaactgagacatggatgtcaagtgaaggtgcatggaaacatgcacaaaggatcgaaacatgggtccttaggcatccaggattcaccatcatggctgctattctagcatatacaattggcacaacttattttcaaagagttttaatattcatcttgttaacagctgtagctccctctatgacgatgcgatgtataggtataagtaaccgtgatttcgtagagggcgtatcaggcggcagttgggtagacatcgtactggaacacggttcgtgtgtaacaactatggcaaagaacaaacctacattagactttgagttgataaaaacagaggccaaacacccagcaacgctacggaagtattgtatagaagctaaactaacaaacacaacaacagcgtcccgatgtccaactcaaggcgaaccgagtcttaacgaagaacaagataaacgatttgtgtgcaaacatagtatggtagacaggggatggggaaacggttgcggtttattcggtaaaggaggcattgtgacatgtgcgatgttcacatgcaagaaaaatatggaaggtaaagtcgtgcagccggaaaatttagaatacaccattgttatcactccccatagtggtgaagaaaatgctgttggcaatgatacaggtaaacatggaaaagaaattaaagtaacacctcagtccagcatcaccgaagcagaacttacggggtatggcaccgtgacaatggaatgcagtccaaggacgggtttagactttaatgaaatggtactcctgcagatggaagataaagcatggctcgtgcatcgacaatggtttcttgatctacccctgccatggttaccaggggcagatacacaaggatctaactggatacaaaaagagacactagttacattcaaaaacccacacgcgaaaaaacaggatgttgtcgttctaggaagccaggaaggcgccatgcatactgcactaactggagcaacagaaattcaaatgtcatcaggaaatcttttatttaccgggcacttgaaatgtagattaagaatggacaaactacagttgaaaggcatgagttatagtatgtgcacaggaaaatttaaagtagtcaaagaaatagcggaaacgcaacatggaactatagtgataagagtacaatacgaaggcgacggtagtccttgtaaaattccattcgaaataatggacttagaaaaacgccatgttcttggtagacttataacggtgaatccgatcgtaacagaaaaagatagtccagtgaatatagaagctgaacctccattcggcgatagctacataatcataggggtagagccgggacagttaaaactcagctggtttaagaaagggtctagtataggtcaaatgtttgagactactatgcgcggtgccaaaagaatggctattttaggagatacagcatgggatttcggcagtctcggaggagtattcacttcaataggaaaagctttacaccaagtcttcggggcaatatatggcgccgcattttctggagtatcctggactatgaagatcttaataggtgtagtgataacttggataggaatgaattctagaagtacttccttgtcagtttcactagtgttagtcggggtagttacactatacctaggcgttatggtccaggctgatagcggatgcgtagtgtcttggaaaaacaaagaacttaaatgtggaagcggaatctttataacagataatgtccatacctggacagaacagtataaattccagcctgagtccccatcaaagctagcttctgccatacagaaagcacatgaagagggtatctgtggtattagaagcgttacacgactcgagaatctcatgtggaagcaaattaccccagaactaaatcatatattgtctgaaaatgaagtaaaattaacgataatgaccggtgatataaagggtattatgcaagctggcaaaaggtccctacgcccccagcctacagagctaaaatactcttggaaggcatgggggaaagccaagatgcttagcactgagctgcataatcacacattcttaatcgacggacctgagacagctgaatgtcccaacacaaatcgtgcatggaattcgctagaggttgaagactacgggtttggagttttcacaacaaacatatggctaaagctaaaggaaagacaggatgtattctgtgattcaaaattaatgagcgcagcaataaaagataaccgagcagtgcatgctgacatgggatactggatagagtccgcattaaatgatacctggaaaattgagaaagcgtcatttatagaagtcaaatcctgccactggcctaaaagtcacacattatggagcaatggtgtattagaatccgaaatgataattcctaaaaattttgcaggaccagtaagtcaacataactataggccaggctatcacacccaaacagcggggccttggcatttaggaaaattggaaatggatttcgatttttgtgaaggtacaacagtagtcgttactgaagattgcggtaaccgaggtccatcactacgaacaaccacagcatcggggaagctaattacagagtggtgttgccgaagttgcacccttccacctctcagatatagaggtgaagatggctgttggtatggaatggaaataaggccgttgaaagaaaaagaagaaaacttagtaaattctttagtaactgcaggtcatgggcagattgataacttttcccttggcgtactagggatggcattgtttctagaagaaatgcttcgaacacgggttggaacaaaatatgcaatattgctagtagcagtaagttttgtaacattaataactggcaacatgtcattccgtgacttagggcgcgtaatggttatggtgggcgcaacaatgacggatgatatcggcatgggcgtgacctatctagctttgcttgcagctttcaaagtaagaccaacattcgctgcgggactgttattgaggaagctaactagtaaggaactaatgatgacaactatagggatagtcttacttagtcaaagcaccatacctgaaacaatcttggaattgacagatgcgctcgctttggggatgatggttttgaagattgtaagaaatatggaaaaataccaactcgcagtaacaataatggcaatactctgcgttccaaatgcagtgatattgcaaaatgcttggaaagtctcgtgtacaatcttggcagtcgtatccgtcagcccgctcttgttaacatcttcacaacaaaaggcagactggattccacttgcgctaacgattaaaggattaaaccctaccgcaatttttctaacgacgctaagcagaacttcgaagaaacgaagctggccactaaatgaggctataatggccgtaggaatggtatcaatattagcatcatctctcttaaaaaacgatataccaatgactgggcccttagttgcaggtggattgctaacagtgtgctatgtattaaccggtcgaagtgcagatttagaactagagcgggctgctgacgttaggtgggaagaacaagcagagatcagcggttctagccccatattaagcattactataagtgaagatggttcaatgagcatcaaaaacgaagaagaggaacaaactttaactatattaatccgaacaggattactagtcatatcaggactatttccagtgtctattccgataaccgctgcggcttggtatttgtgggaagtcaaaaaacagagagcaggagtattatgggatgtaccatctccaccaccagttgggaaagcagaactcgaggacggagcttatcgtataaaacaaaaaggtattctaggttatagtcagattggtgcaggggtttataaggaagggaccttccatacaatgtggcatgtaacccggggagccgttctcatgcataaagggaagcggatcgaaccgagttgggccgacgtcaagaaagatctcatctcttacggaggcggatggaagctagagggtgaatggaaagaaggagaggaagtacaagtactagctctagagcccggtaaaaaccccagagctgttcaaaccaaaccaggcttattcaaaaccaatacagggacaatcggcgccgtttcactggattttagcccagggacctccggatcacctatagttgataaaaaaggtaaagttgtaggtctttatgggaatggtgtagtcaccagaagcggcacttacgtatcagcaatagcccaaactgagaaatccatagaggataaccctgagatcgaagacgacatattcaggaaaaaacgtctcactataatggatttacatcccggggctggcaaaacaaaacgatacctaccagcaatagttagagaggccataaaacgaggtttacgaactctaatcctagcacctacacgagttgtagctgccgaaatggaagaagcattgagagggttgcctataagataccagacaccagcaatccgtgctgaacatacaggaagggaaattgtagatctaatgtgccacgcaacattcacaatgaggttactgtcaccaatcagagtaccaaattacaacttaatcatcatggacgaagcccattttactgatccggcctcaatagccgcacgcggttacatttctacgagggtcgaaatgggcgaggctgcaggtatattcatgacagcaacgccacccggaagtcgcgatcccttcccgcaatcgaacgcaccgataatggacgaagagcgtgaaataccagaacgaagttggaactccggacatgaatgggtaactgatttcaagggtaaaaccgtgtggtttgttcccagtattaaggcaggaaatgatatagcggcatgtctaagaaagaatggcaaaaaggtgatccagctcagtcgaaaaacattcgatagcgagtatgttaaaacaaggaccaacgattgggattttgtggtgacaactgatatctctgaaatgggagcaaattttaaagcagaaagagtaattgacccacgcagatgcatgaagccggttattttgaccgatggtgaagaaagggtaattttagctgggcccatgccggtaacccatagtagcgccgctcaaaggagaggacgagtaggacgaaaccctaaaaacgaaaacgatcaatatatttatatgggcgaacctctggagaatgatgaagactgcgcgcattggaaggaggcaaaaatgttgctggataatatcaataccccagaaggaataatcccttctatgtttgagccagaaagagagaaggtagacgccatagatggagaataccgactacgaggtgaagcacgcaagactttcgtagatttaatgagacgtggcgatctacccgtttggttagcgtatcgcgttgctgccgaaggaatcaattacgccgatcgtagatggtgtttcgatggcgtaaaaaacaaccaaatacttgaagagaatgttgaagttgaaatctggactaaagaaggagaaaggaaaaaattaaaacctagatggctagacgctcgaatatacagcgatcccctcgctctgaaagaattcaaagaatttgccgccggaagaaaatcattaacactaaatttaataacagaaatgggtcgattgccaacattcatgacacagaaggcaaggaacgccttagacaatctagcggtattacatactgccgaggcggggggcagagcttataaccatgccttgtctgaacttccagaaaccctggaaactttattattgttaaccttgctagccacagtcacaggtggaattttcttgttcttgatgagtggcaaaggtattggtaaaatgactcttggcatgtgttgcataattacagcttccgtactcctatggtatgcacaaatacaaccgcattggatagctgcttcgattatcctagaattttttcttattgtattattaataccagaacctgagaaacagagaacaccacaagacaaccaattaacctacgtcgttatagcgatattgaccgtagtggctgccacaatggctaacgaaatgggattcctagaaaaaaccaaaaaagatttcggactcggtggaatagccacacaacaacctgaatctaacatattagatatagatctaaggcccgcatctgcatggactctctatgccgtagcaacaacattcatcaccccaatgctaaggcattctatagaaaacagttcagtgaacgtatcgttaacagcaatagcaaaccaagcgacagtacttatgggactaggaaaaggttggcctttgtcaaagatggacattggagttccgttactcgcgataggctgttactcacaagtaaaccccattacgctaaccgcagcgttacttttattagttgcacattatgctatcattggaccaggattgcaggctaaagcaacaagggaagcacagaaaagagcggccgcgggaataatgaagaatccaactgttgacgggataaccgtcatagaccttgatccgataccttatgatccaaagttcgagaaacaactaggacaggtaatgctactagttctatgtgtaacgcaagtactcatgatgaggacgacttgggccttatgcgaagcactaacgctagcaacaggtccaatatctactttgtgggaagggaacccaggccgattctggaacactacaattgccgtttcgatggctaatatattccgaggatcatatctagcaggagctggcttgctattttcaataatgaagaatacggcgaacacacgaaggggcacaggaaacacaggagaaacgttaggagagaaatggaaaaatcgcctaaacgctctcggtaagtcggaatttcagatttataaaaaaagcggaatacaggaagtcgatagaacactggcaaaagagggaattaaacgaggagaaacggatcatcacgcggtgagcagggggagcgcaaagttgagatggttcgtagaaaggaacttagtaactccagagggaaaagtaatggacttaggatgcggacgaggaggatggtcttattattgcgggggactaaagaatgtaaaagaagtaaaagggctcactaaaggtggacctggccacgaggaaccaattccaatgtcgacttatggttggaatctagtcaggttacagtcaggtgtagacgttttttttactccacccgaaaagtgtgatacgttactatgcgatataggggaatcgagtcctaatccgactgtagaggcaggcaggacattacgggtactaaaccttgtcgaaaattggctcaacaataacacacaattttgcatcaaagttttgaacccttatatgccaagtgtaatagaaaagatggaggcccttcaaagaaaatacggtggtgctctagtccggaacccattgtcgagaaattctactcatgagatgtattgggtaagcaatgcttcaggtaacatagtgtcaagtgtaaatatgataagtaggatgctaattaaccgttttacaatgagacacaaaaaagcaacctatgaaccggatgtagatttagggtcaggtaccagaaacataggcatcgagtccgagacgccaaacttagatataatcggcaagagaatagagaagattaaacaagaacacgaaaccagttggcattacgatcaagatcacccatacaaaacgtgggcctaccacggttcttatgagactaaacaaactggatcagctagcagtatggtgaacggagtcgtaaggttattgaccaaaccctgggatgtcattccaatggtaacacaaatggcgatgacggataccaccccgttcggacaacaaagggtatttaaagaaaaggtggatacacgtacacaagaaccaaaagaagggacaaaaaaactgatgaaaattaccgcagaatggttgtggaaagaactcggtaagaagaaaacaccgaggatgtgtacccgagaagaatttacgcgtaaagtacgaagtaatgcggctttaggagcaattttcactgatgaaaacaaatggaagtcagcacgcgaagctgtcgaggattccggcttttgggaattagtagacaaagagagaaacttacatttagaaggaaaatgcgaaacttgtgtatacaatatgatggggaaacgagaaaagaaacttggagaattcggcaaggcaaaagggtctagagccatttggtatatgtggctgggtgcacgattcttagaattcgaagcactcggatttctcaacgaagaccactggttttccagggagaattcattaagcggcgtggagggtgaaggactacacaaattaggttacatcctaagagatgtatctaaaaaggaagggggagcaatgtacgcagacgacactgcgggttgggacactagaataacactcgaagatctaaaaaatgaggaaatggtgacaaatcatatggaaggcgaacataaaaagctagcagaagcaatatttaaattaacataccaaaataaggtggtccgagtacaaaggcccacccctaggggaaccgttatggatataatcagtaggagagaccaaagaggctccggacaagtggtaacatacggactaaatacattcacaaatatggaggctcagttgattagacaaatggaaggagaaggagtcttcaaatccatccagcagcttacagcgaccgaagagatcgcagtaaaaaattggctagcgagggtgggaagggaacgcttgagtaggatggccataagcggtgacgattgtgttgttaagccactagatgacagatttgcatctgcactaactgcgctaaacgacatgggtaaagtaagaaaagatattcagcaatgggagcctagtcggggatggaatgactggacccaagtaccgttttgtagccatcacttccacgagctaataatgaaagacggcagagtattggtagttccgtgcagaaatcaagatgaattaattggtagagctagaatctctcaaggtgctggatggtccttaagagaaacagcttgtttaggtaagagttacgctcaaatgtggagtctgatgtatttccataggagagatttaagattagccgcaaacgcgatctgttcagcggtaccatcacactgggttcctactagtagaacaacatggagcatacatgcaacgcatgagtggatgactaccgaggacatgttaacagtatggaatagagtgtggatacaggagaatccatggatagaagataaaacaccagtagaatcatgggaggagatcccttacctagggaaaagagaagatcaatggtgtggatcacttattggcttaacatcgagagctacctgggcaaaaaatattcagacagcaataaatcaggtccgttccttgataggtaacgaagagtacacagattatatgccaagtatgaaaagatttagaagagaagaggaagaagcgggagtcctttggtaa

SEQ ID NO: 22953 - RNA, 9876 nt, synthetic construct
  misc_feature 1..9876: note = derived and/or modified CDS sequence (opt6) from DENV-2__DQ645549__SS-prME
  source 1..9876: mol_type = other RNA
acagcaggggttattataatgatgataccaacagtagttgcttttcatctgactacaaggaatggggaaccacacatgatagtatcaagacaggaaaaaggtaagagcttactatttaaaacagaaaatggagtaaacatgtgtacattaatggcaatggaccttggagaactatgcgaagacacaataacttataattgtcctttgctacgccaaaatgaaccagaagatattgactgctggtgtaatagtacttctacgtgggtaacatacgggacatgcacagcaactggcgaacataggcgagagaaacgcagtgtcgctttagtaccacatgtaggaatgggattggaaaccaggacagaaacatggatgagttctgaaggggcatggaaacatgcacaaaggatcgaaacatgggtattacgacacccaggtttcactataatggcagcaatccttgcctataccatcggaactacatattttcagcgcgttttgatcttcatacttctgacggctgtagcaccatctatgactatgagatgcattggaatatcaaaccgggacttcgtagaaggagtatctggaggaagctgggtggacattgtacttgaacacgggtcgtgcgtaacaacaatggctaaaaataaacccacgttagattttgaattaatcaaaaccgaagcaaaacacccagccactttacgaaaatattgcattgaagccaaacttactaatactaccactgcaagccgttgccctacacaaggagaaccgagtttaaacgaggagcaagacaaacgttttgtatgcaaacacagtatggtagacagagggtggggtaatggatgcggattgttcggtaaaggaggaattgtaacatgtgcgatgttcacctgtaagaaaaatatggaaggaaaagtagtacaaccagagaatttagaatatactattgtaataacaccccactcgggagaagaaaatgcagttggaaacgacacagggaaacacggaaaagaaatcaaagtaacgcctcaatcttcaataaccgaggccgaattaaccggttatggtaccgtaactatggagtgcagtcccaggacaggactagatttcaacgagatggtccttcttcaaatggaagacaaagcgtggttggtccatagacaatggttcttggatttacctctgccgtggctacccggtgccgacactcaaggatcaaattggatccaaaaagaaaccctcgtaacatttaaaaaccctcatgcgaagaaacaggatgtagtggttttggggtcacaagaaggggcaatgcatactgcgttaactggagcaacggaaatacaaatgagtagtggaaacctactatttactggacacctgaaatgtaggctaaggatggataaacttcaattaaaaggcatgtcctactcgatgtgtacaggaaaattcaaagtagttaaagaaatagcagaaacgcaacatggaactattgtaataagagtgcaatatgaaggagacggtagcccctgcaaaatcccttttgagataatggacctcgaaaaacgacatgttttggggcgtctaattacagttaacccaatagttacagaaaaagactcacctgtcaacatcgaagctgagccaccattcggagatagctatattataattggagtcgaaccagggcagctaaaactatcttggtttaagaaaggatcatcaataggccaaatgtttgaaacaacaatgagaggtgcaaaacgaatggcaatattgggagatacagcatgggattttggatctttaggcggagtctttacatctattggaaaagcgttacaccaagtctttggtgccatctatggagccgcctttagtggagtttcatggacaatgaaaatactaatcggcgtagtaataacatggattggcatgaactcgcggagtacctcgctctcagtcagcttagtcctggttggcgtcgtgacgctatacttaggagtgatggttcaagcagatagcggttgcgttgttagttggaaaaataaagagctgaaatgcggctcgggtatcttcatcacagataacgtgcatacttggaccgaacagtataaatttcagcctgaaagtccgagtaaacttgcatcagcaattcagaaagcgcatgaagaaggcatatgtgggattagaagcgttacacgtctcgaaaacctaatgtggaaacagattactcctgaattaaatcatattttgtcagaaaatgaggtaaaactaactataatgacgggagatataaaaggaatcatgcaagcaggtaaaagatcacttagacctcaacctacagaattaaaatactcgtggaaagcatgggggaaagcaaaaatgttaagtacggaactacataatcataccttcttaatagatggaccagagaccgccgaatgccctaatacaaatagagcatggaactcattagaagtggaagactatggatttggagtttttacaaccaatatctggctaaaattaaaagaaagacaagacgtattctgtgattcaaaactcatgagcgcagcaataaaggacaatagagcagtccatgcagatatgggatattggatagaaagtgccctgaacgatacatggaagatagagaaggcttcatttattgaagtgaagtcctgtcattggcctaaaagtcataccttatggagtaacggagtccttgaaagcgagatgataataccgaaaaacttcgcaggccctgtgtctcagcataattaccgaccaggttatcatacccaaactgctggaccgtggcatctaggaaagttagaaatggacttcgatttctgtgaaggcacaacagtggtcgttacagaagattgtgggaatagaggaccatccctaagaacaactaccgcaagtggtaaactaattacagagtggtgctgtcgatcatgtacgctaccccctctgagatacaggggcgaggacggttgttggtatgggatggagatacgacccctcaaggaaaaagaagaaaaccttgtaaatagcttagttacagcgggacacggtcaaatagataacttctcacttggtgtcttgggtatggcgttgttcttggaagaaatgctgcgtaccagagtcgggacaaaacatgctattcttttagttgctgtatcattcgtgactttaatcacaggtaacatgtcgtttagggatttagggagagtcatggtaatggttggggccaccatgacagacgatattggcatgggagttacatacctagccctcctagctgcattcaaagtaagaccaacgttcgctgcaggtttactcttaagaaaacttacaagtaaagaattaatgatgacaacaataggaattgttttactttcacaatccacaataccagagaccattcttgagctaactgacgccctagcactaggcatgatggtactaaaaattgttaggaacatggagaaataccaattggcggttacgatcatggcaatattatgtgtgcctaacgctgtgatcttacagaatgcatggaaagtttcatgtactattttggccgtcgtgtccgtttctccgcttttattaacatcatcacaacagaaagcagattggattcccctggctttaacgattaaaggtcttaatcccacagccatctttctcacaactttatcccgaacttccaagaaaagaagctggccattaaatgaagcaataatggctgtaggtatggtaagcatcttagcatctagcctcttaaagaatgacattcccatgactggacctttagtcgcagggggactattaactgtgtgctacgtccttaccggccgatcagcggatcttgaattagaaagagctgctgacgtacgatgggaagaacaagccgaaataagtggcagctcaccgatattgtccataactatatcggaagatggctcaatgagcattaaaaacgaagaggaagaacaaacccttaccattctaatccgaacgggattacttgtaattagcggactatttcctgtatctattccgattaccgcagctgcatggtacctatgggaggtaaagaaacaacgtgctggggttctctgggatgtccccagccctcctccagtgggtaaagctgaacttgaggatggagcttaccgcatcaaacaaaaaggcattctgggttactctcagataggagcaggagtatataaggagggcaccttccacactatgtggcatgtgacgcgaggagccgttctaatgcataaaggtaagcgcatcgaaccttcatgggctgacgtcaagaaagatttaatatcatatggcggtggatggaaattggaaggagaatggaaagagggggaagaagtccaagtcttagcgttggaacccggcaaaaacccaagagccgtgcagacaaaacctggattgtttaaaacaaatacgggcacgataggggctgtatcactcgacttctctcctgggacatcgggatcgccaatagtagataagaaaggaaaggttgtaggattatatggaaatggagtagtgacgagaagcggaacatacgtatccgctatcgctcaaacagaaaaatctatagaggataaccctgaaatagaagatgatatatttaggaagaaaagacttaccattatggatctacacccgggagctggaaaaacaaaaagatacctcccagctattgttagagaggccataaaacgtggattacggaccttaatattagctccaacgagagtagtagccgcagaaatggaagaagccttaaggggtctgccgatcagatatcaaacaccggcaattcgtgcagaacatactggacgggaaatagtagatctaatgtgtcatgctacatttacgatgcgacttctatccccaatccgggtccccaactataatctaataataatggacgaagctcattttacagatcctgcatccatcgcggcgcgtggatacataagtactagagttgagatgggggaggctgctggaattttcatgacagctacaccacctggcagtagagacccatttccacaaagtaatgcaccaattatggatgaagagagagaaataccagaaagaagctggaatagcgggcatgaatgggtcactgattttaaaggcaaaacagtctggttcgtgccttccataaaagcgggaaacgatattgccgcctgcctccgcaaaaatgggaagaaagtaatccagttgtctaggaaaacatttgatagtgagtatgtaaagacgaggacaaatgattgggatttcgtagtaacaacagatattagtgaaatgggagctaactttaaggccgagagagtaattgatccaaggaggtgcatgaagccggtgatactgacagatggtgaagagagagtgatccttgcgggccccatgcctgtaacacattcatccgctgcccagaggagaggaagggttggtcgtaaccccaaaaatgaaaatgaccaatacatctacatgggtgaaccattggaaaacgacgaagactgtgcacactggaaagaggccaaaatgctactagataatattaatacacccgaaggtataataccaagtatgtttgaaccagaacgagaaaaggtagatgcgatagatggggagtatcgtcttagaggtgaagctcgtaaaacattcgtggatttgatgcgaagaggtgacttacccgtatggttagcgtatcgagtagcagcagaaggtattaactacgcagacagaaggtggtgcttcgatggtgtcaaaaataaccagatcctggaggaaaacgtagaagttgaaatttggacgaaggaaggtgaacgtaagaaattgaaaccgagatggctggatgcaagaatatatagtgatccattggcactcaaagagtttaaagagtttgcggccggacgaaaatcattaacactaaatttgatcacggaaatgggtcgcttgccaacttttatgacacaaaaagctcggaatgctctagacaaccttgccgtgcttcataccgctgaagcgggtggtagggcatacaatcacgcattgtcagaattgccagaaacccttgaaactttactattactgactttattagccactgtaacaggagggatttttctatttctcatgagtggaaaaggaatcggaaagatgactctcggcatgtgttgtataatcaccgcctcggtcctgttgtggtatgctcaaatacaaccacactggattgcagcaagtataattctagagttctttcttatcgtattactcatccccgagccggagaagcaaagaactcctcaagataatcaacttacatacgtggtaatagccattctcacagtagtagcggctacaatggccaatgaaatgggatttttggagaaaaccaagaaagatttcgggttaggagggatagcgacacaacagcccgaatccaacattctggatatagatttaaggcccgcctctgcatggacactatatgctgttgccaccacctttatcacacctatgctacgccacagtatagaaaattcatcagttaacgtctcgctgacggccattgctaaccaagcgactgtcttaatgggattaggtaaaggttggcccttaagcaaaatggacataggagtacctctgctagcaatagggtgctattcgcaagttaacccgataactctaacagccgcattgttgctacttgtggctcactacgctataatcgggcccggactacaagcaaaggctacaagagaagcgcaaaaacgagcagcagcaggcattatgaaaaatccaacagtggatgggatcaccgtcatcgatcttgatccaataccctatgatccaaaatttgaaaaacaactcggacaggtcatgcttttagttttatgcgtaacccaagtcttaatgatgcgaacaacatgggccttatgcgaagctctaaccctggcgacaggtcctatcagcacattatgggaaggaaatccgggcagattttggaatacgaccatagcggtatccatggcaaacatatttcgaggttcatatttagcgggcgcaggactactattctcaataatgaaaaacacagcaaatactagaaggggcacaggcaatacaggagaaacattaggagaaaaatggaaaaatagattaaatgctcttggaaaaagcgaatttcaaatttataagaaaagcggaatccaagaagttgaccgtactttggcaaaggaaggtataaaaaggggcgaaacagatcaccatgcagtctcaagagggtcggcaaagttaagatggtttgtagaaaggaacttagtaactccggaaggaaaagtcatggatttagggtgcggtagaggaggttggagctattattgcggaggtctcaaaaatgttaaagaagtgaagggtttaactaagggaggtccgggccatgaggaaccaataccaatgtcgacttatggttggaacctggttagactgcaatcaggtgtagatgtgttctttacgccacctgaaaaatgcgatacgctgctgtgtgacataggagaaagtagcccaaatcctacggtggaggcagggaggactctaagggttctaaacctcgtcgaaaattggcttaacaacaatacacaattttgtataaaagtcttaaacccgtatatgccctcagtgatcgaaaagatggaggctttacaaaggaaatacggaggagcacttgtaaggaatcccttaagcagaaatagtacacacgaaatgtattgggttagtaacgcaagcggaaacattgtaagtagcgttaatatgatcagtcggatgctaatcaatcgcttcactatgaggcataagaaagcaacttatgaacctgacgtagatctaggatcgggcacaagaaacattggaatagagtctgaaactccaaatctagatattatcgggaagagaatagagaaaataaaacaggaacatgaaactagctggcattatgaccaagatcatccatacaaaacgtgggcctaccatggatcatatgagactaagcaaaccggtagtgcaagcagtatggtgaacggtgtagtacgcctattaacaaaaccatgggacgtcatccccatggtaactcaaatggctatgactgatacgaccccgttcggacaacagcgagtgtttaaagtaaaagttgatacacgaacacaggagcctaaagaaggcacgaagaaactcatgaagataaccgccgagtggctatggaaagaattgggcaagaagaaaacaccgagaatgtgcacaagagaggagtttacaagaaaagtacggtcaaatgctgcactaggcgcgatatttactgatgaaaacaaatggaaaagtgcaagggaggcagtagaagactctgggttttgggagctagtagataaagaaagaaacctacatttagaaggaaaatgtgaaacatgtgtgtataatatgatgggtaaacgggagaagaaactgggggagttcggaaaggcgaaaggatcaagagccatatggtatatgtggctcggtgcgaggtttctagagtttgaagcgctcggattcctaaatgaggaccactggtttagcagagaaaattccttgtcgggcgttgaaggtgaaggattacacaaattaggctatattctaagggatgttagcaagaaggaagggggcgctatgtatgcagatgataccgctggatgggacactagaatcacactagaggacttaaagaatgaagagatggtaaccaatcatatggagggtgaacataagaaacttgcagaggcaatattcaaactaacgtatcaaaataaagttgttcgagtccaacgaccaacaccacgaggtactgtaatggacataataagtcggcgagaccagagaggtagcggacaagtagtcacatatggtctcaacacgtttactaacatggaagcacagctaattagacaaatggagggggaaggagtattcaagagtatacaacaattgacggcaaccgaagaaattgcagtcaaaaattggttagcacgagtaggcagagaacgcctatctcgaatggctatatcaggagatgattgtgtagtaaaacctcttgacgacagatttgcttcagcgcttaccgcactaaacgacatgggtaaagtgcgaaaagatatacaacagtgggaaccatcgagaggatggaatgactggacacaagttccgttttgttcacatcatttccatgaactaataatgaaagacggaagggtactggttgtcccgtgtcgaaatcaagatgaattgataggtcgcgcacgcatttcccagggtgcagggtggtcacttagagagacggcctgtctggggaaatcttacgcgcagatgtggagtcttatgtacttccatcggcgtgaccttcgactagctgcgaacgctatatgcagcgctgtgccttcacattgggtgccaacatctcgtacaacatggtcaatacatgcaacacatgaatggatgacgacagaagatatgttgaccgtatggaatagggtatggatacaggaaaatccatggatagaagataaaacacctgttgaaagttgggaagaaataccatacttgggaaaaagggaggatcaatggtgtggatcattaattggcctaacttctcgtgcaacttgggccaaaaacattcagaccgcaataaatcaagtacggagcttgataggtaacgaagagtacacagattatatgccgtcaatgaaaaggttcagacgggaagaagaagaggctggtgtactatggtga

SEQ ID NO: 22954 - RNA, 9876 nt, synthetic construct
  misc_feature 1..9876: note = derived and/or modified CDS sequence (opt6) from DENV-2__DQ645550__SS-prME
  source 1..9876: mol_type = other RNA
acggcaggggtgataattatgatgattccaaccgtagttgcatttcacttaactactcggaacggagaaccacatatgattgtttcgcgccaagaaaaaggtaaaagtttactattcaaaacagaaaatggtgtcaatatgtgtaccctaatggcaatggatctaggggaactttgcgaagatacaataacatataattgtcccttattaagacagaatgaacctgaagacattgactgttggtgtaattccacatcgacctgggtgacatatggaacatgtactgcaacaggagaacaccgcagagaaaaacgatcagtggcattagttcctcacgttggaatgggactggaaacaagaactgaaacatggatgagttcagaaggtgcatggaaacatgcacaacgaattgaaacgtgggtcctgcgacaccctggatttacaattatggccgcgatactagcgtataccatagggacaacatatttccaaagagttctaatttttatattgttgacggcggtcgccccttctatgacaatgagatgtattggaatatccaatagagactttgttgaaggagtctcaggtggaagctgggtagacattgtattagaacatggcagttgtgtcacaaccatggccaaaaataaaccaacactagactttgagctaataaaaacagaggctaaacatccggctactctgcgtaaatattgcatagaagccaaacttaccaacacgaccactgcaagcagatgtccaactcaaggtgaaccaagccttaatgaagaacaagacaaacgtttcgtatgtaaacatagcatggtcgacaggggttggggtaatggctgcggtttatttggcaaaggaggaattgttacatgcgcaatgtttacctgcaagaaaaatatggaaggcaaagtggttcaaccagaaaacctggaatatacaatcgtaatcacgcctcattcaggagaggaaaacgcagtgggaaatgatacaggtaaacacggaaaagagattaaagtcacacctcaaagttcgatcaccgaagctgaactaacaggttatggaaccgtcacaatggaatgtagccctcggacaggattagactttaatgaaatggtcttgctacaaatggaagataaggcgtggctcgttcaccgacagtggtttctcgacttgccactaccctggctgccaggagctgacacgcagggttcgaattggatacaaaaagaaactttagtaacattcaaaaatccgcatgctaagaaacaagatgttgtagtcttaggatcacaagagggcgctatgcacaccgcactgactggagcaaccgaaatccaaatgagcagtggaaatctactattcaccgggcacctcaagtgtagattacgcatggacaaactacagttaaaaggaatgtcttattccatgtgtactgggaagtttaaggttgttaaagaaatcgctgaaacgcaacacggaacaattgtcataagagttcaatatgaaggagacgggtcaccctgcaaaatcccttttgagatcatggatctagaaaaacgacacgtactcggtagattaatcactgttaaccccatagtaacagaaaaagattcgccagtaaatatagaggccgaaccaccattcggagattcgtacatcataattggagtagaacccggacaattaaagctatcctggttcaagaaaggtagttcaatcggacaaatgtttgagactactatgcggggtgctaaacggatggcaatactgggagatacggcttgggatttcggaagtttaggaggtgtattcacaagtattggaaaagccctgcatcaggtattcggagcaatctatggggcggcgttcagtggcgtttcttggacgatgaagatacttataggggtcgtcatcacctggattggcatgaactcaagatctaccagtctatctgtcagcttagtactcgtcggagtcgtgacgctatacttaggggtcatggtacaagcagattctggctgtgtagtaagctggaaaaacaaagaactaaaatgcggatcaggtatattcatcactgataacgtacacacttggacagagcagtataaattccaaccagagtccccatcgaaactggcttcagcaattcaaaaagcacatgaagaggggatctgtggaatacgcagtgttacccggttagaaaatcttatgtggaaacagattacgcctgagttgaaccacattttaagtgaaaatgaggtaaaactaacgataatgactggggacataaaaggtataatgcaagctgggaaaaggagtttgaggccccaaccaacggaactaaaatattcgtggaaagcatggggtaaagcaaaaatgctgagtactgaacttcataaccacacattccttatcgatgggccggaaacggcagaatgtcccaatacaaatagagcctggaatagcttagaagtggaagactatggttttggagtctttacaacaaatatatggttaaaactaaaagagagacaggacgtcttctgtgatagtaaacttatgagtgcggccataaaggataacagagcggtccacgcggatatgggttactggatagaatcagcactaaatgatacgtggaaaatagaaaaagcatcttttattgaggtaaaatcatgtcactggccgaaatcacataccctatggagcaatggagtactagaaagtgagatgataatccccaaaaactttgcaggaccagtttcacaacataattatagacccgggtatcatacacaaacagcgggaccatggcatttaggaaaactagaaatggacttcgatttctgcgaaggcactacagttgtagtaacagaagattgcggcaaccgtggtccaagtttacgaaccacgactgcgtccggcaaacttattaccgaatggtgttgccgaagttgtacgttaccacctctccgatacagaggagaagatggatgctggtatgggatggaaattagaccactaaaagaaaaggaggaaaacctggtaaacagcctggtaacggcaggacatggccaaatcgataatttctcactcggagtactaggtatggcattattcttagaagagatgttaagaacaagagtcggaactaaacatgcaatccttctcgtagcagtgagttttgtaacactgatcactggaaacatgtctttccgtgatctggggcgcgtcatggtaatggtcggtgcaacaatgacagatgacattggcatgggtgttacttacctggcattactagccgcttttaaggtaaggccgacttttgcagcgggacttttacttagaaagttaacatcaaaggagttgatgatgactacgataggaattgtattactatcacaatccactatacccgagacaattctagagttaacagacgccttggctttaggtatgatggtgctaaagattgtacgaaatatggaaaaatatcagttagccgtcacaattatggctatcctctgcgtaccgaatgcagtaatactacaaaacgcctggaaagttagttgtacgatcctagcggtagtatcggtgagccccttattactcacaagtagccaacaaaaagctgattggataccacttgcacttactatcaaaggattaaaccctaccgctatctttctaactacgttgtcaagaacaagtaagaaacgaagttggcccctaaacgaggctataatggcagtcggtatggtttccatcctagcgagtagcctactcaaaaacgatataccaatgactggcccgttggtagcagggggtctactgacagtctgttatgtgctaacgggacgatccgcagatctagaactagaacgcgccgcagatgtcagatgggaagaacaggctgagataagcggatcttcgccaattctatcaatcacgatttctgaagatggtagcatgtccatcaaaaatgaggaggaggaacaaactctcacgatcctaattcgaacaggattgctggtcatatctggattatttcccgtaagtataccaatcacggccgcggcgtggtacttatgggaagtaaagaaacaacgtgccggagtactctgggatgtaccctctccaccaccggtaggcaaagccgaacttgaagacggagcatatcgaatcaaacaaaaagggatattagggtactcccaaatcggagctggtgtatataaagaagggacttttcacacaatgtggcatgttacaagaggagctgttttaatgcataaaggtaaaagaatcgaaccgtcatgggcggatgtaaagaaagacttaatctcatatggaggtggttggaaactcgaaggagaatggaaagaaggagaagaagtacaagttctagcactggaacctggcaagaaccccagagcagttcaaactaaacccggattatttaaaactaacacaggcacaatcggagctgtgagcctagattttagtccaggaacttcgggatcacccatagtggataagaaaggaaaagtagtcggactttatgggaacggtgtggtaaccagatctggtacatacgttagtgcaatagctcagacagagaaaagcatcgaagacaatccagaaattgaagacgatatatttcgaaagaaacgtttaacgattatggatttacatcctggggccggtaaaacgaaaagatatttaccagctattgttcgagaagcaattaaaagagggctgcgtacacttatactcgctccaacacgcgttgtagctgcagaaatggaggaagcattgcgtggattaccaatacgttaccagacccccgcaatcagagcagaacatactggccgagagattgttgacctgatgtgtcatgcaactttcactatgcgtctactaagtcccataagagtccccaactataatctaataattatggatgaagcacactttacagatcctgcgtcgatagcagcaaggggctatatttcaacacgggtagagatgggagaggctgccggcatatttatgacggcaactccaccaggatcaagagacccatttccacaaagtaacgcaccaattatggatgaagaacgagaaataccggagagatcttggaacagtgggcacgaatgggtaacagactttaaaggaaaaacagtctggttcgtgccaagcatcaaggccggtaatgatattgcagcctgtctcaggaaaaacggcaagaaagttatacaattatcgcgaaaaacctttgactctgaatatgttaaaaccaggaccaacgactgggattttgtagtcactacggatataagtgaaatgggcgccaacttcaaagctgagagagtaatagatcctaggcgatgtatgaaacccgtaatattgactgatggagaggaacgtgttatcttggcgggaccaatgcctgtcacacacagcagcgcggcgcaacgacgtggtcgcgtaggaagaaatcctaaaaacgagaacgatcagtacatttacatgggggaaccacttgaaaacgatgaagattgcgcacattggaaagaggcaaaaatgttgttagacaacattaacacccctgaagggatcatacctagcatgtttgaacctgagagagaaaaagttgacgcgatcgatggcgaatatcgacttcgtggcgaagcaaggaaaacttttgttgatctaatgagacgcggggatcttccagtgtggctggcatatcgcgtagctgcagaaggtattaactatgcagaccgtagatggtgcttcgacggtgtcaagaataaccaaatcttagaagaaaacgtagaggtggagatatggacaaaggaaggagagagaaagaaactaaaaccgagatggcttgacgcgaggatatacagtgatccactagctttaaaagagtttaaagagttcgcagcaggaagaaaatcccttaccctaaatttaatcacagagatgggtcgcttaccaacatttatgacacagaaggcacgtaacgcattagataatctagcagttctacacactgctgaagccggtggtcgtgcatataaccatgcactaagtgagctacctgaaaccttagaaacgctacttttacttactttacttgctacagtcactggcggcatctttttatttcttatgagtggaaaaggcataggcaaaatgacattaggcatgtgctgcattattactgcttccgtccttttatggtacgcacaaattcaaccccattggatagcagctagtattatactggaatttttcttaatagtactacttatccctgaacctgagaaacaacgtaccccgcaggataaccagttaacatatgtagtgatagctatattaactgtggtcgccgcgacgatggccaatgagatgggctttttagagaaaaccaagaaagactttggtttaggtggaatagctacacaacaaccagagagtaacatccttgacattgacttacgtccggctagtgcatggacattatacgctgtagcaacaaccttcatcacaccgatgctccgccattcaatagaaaatagcagtgtcaatgtgagcttgactgccatcgccaaccaggccacagtactcatggggctaggcaaaggttggccattaagtaaaatggatataggtgtaccactgttagcgataggatgttactcacaagtcaacccaataacgttaacagcggcacttctactcctagttgcacattatgctataataggtccaggtttacaagcaaaagccactcgtgaagcacaaaagagagctgcagcaggaataatgaaaaatcccacagtggatggaataacagtgatagatcttgatcctatcccgtatgaccctaagtttgaaaaacaacttggccaagtgatgcttctggttttatgcgtgactcaggttctgatgatgcggacgacatgggctctatgtgaagccctaaccttagcaacgggcccaatatcaacattatgggaaggaaatccgggtagattatggaacacaacgatagcagtttctatggcaaacatatttagaggcagctacctagctggcgctggattattgttctccatcatgaaaaatactgcgaatacgcgacgtggtaccggaaatactggtgagaccttgggtgaaaagtggaaaaacagattaaatgccttaggcaaatctgagttccagatctataagaaaagtggtattcaagaagtagatagaacgttggcgaaagaaggtataaaacgcggcgaaacagatcaccacgccgttagtagaggaagtgctaaactacgatggttcgtggaaaggaacttagtgaccccggagggcaaagttatggacctaggatgtggtcggggaggttggtcctattattgcggagggctcaaaaatgtaaaagaagttaaaggactgacgaaagggggtccgggacatgaggagcctattcctatgagcacatacggctggaatttagttagactccaaagcggtgtagacgtgtttttcactccacccgagaaatgcgacactttattgtgtgatattggtgaaagcagtcctaatccgaccgtggaagccggcagaacactacgagtacttaatctagtggaaaattggctcaataacaatactcaattttgtattaaagtcttaaacccatatatgcccagcgtaatcgagaaaatggaagcactccagaggaaatatggaggtgcattagttagaaatcctctgtctaggaatagcacacatgagatgtattgggtatccaatgcttcgggtaatatagtaagtagtgttaatatgattagtcgtatgttaataaacaggtttacaatgcgtcataagaaagccacttatgaacccgatgtcgacttaggatccggtactcgcaatattggtatagagtccgagacccccaatttagacataataggtaaacgtatagagaaaattaaacaagagcatgagaccagctggcactatgatcaagaccatccatataagacatgggcttaccacggtagctatgagaccaagcagaccgggagtgctagttcgatggtaaatggcgtagtaaggctactaacaaagccatgggacgtaatcccaatggtcactcaaatggctatgacagacacaactccgtttgggcaacagagagtattcaaagtaaaagtagacactagaacgcaggagccgaaagagggtactaagaagctgatgaaaattactgcggaatggttatggaaagaactaggcaagaagaaaaccccacgtatgtgtactcgggaagaatttacaagaaaagtcagatcaaacgcagccttaggtgcgatttttactgacgaaaacaaatggaaaagcgcaagggaagcagtagaagactctgggttttgggagctagttgacaaagagaggaatttacatttagaaggaaaatgtgaaacatgtgtatataatatgatgggaaaacgagagaagaaattaggcgagttcggaaaggcaaaggggtcacgggctatttggtatatgtggcttggagctcgttttctagagttcgaggcactaggctttctaaatgaagaccactggttttctagagaaaacagtctttctggtgtcgaaggggagggactccacaaattagggtatatattaagagacgtgagcaagaaagaaggaggtgcaatgtacgccgacgacacagccggatgggacacaagaataacactagaagacttgaaaaatgaagaaatggtaacaaatcatatggagggcgaacataagaaactcgctgaggcaatattcaaactcacatatcaaaataaagtagtaagagtgcagagacctactccacgaggaacagtcatggatattatcagtcggagagatcaaagaggatcgggacaagtcgtaacatacggattaaataccttcacgaacatggaagcacaattaatcaggcagatggaaggagaaggcgtgttcaaatccatacaacagttaacagcgactgaagaaatcgctgtcaaaaattggttagcaagagtaggtagagaaaggttaagccgaatggcaatatcaggagatgattgcgttgtcaaaccactggatgatagatttgcatccgctttaaccgcgctaaacgatatgggaaaagttagaaaggacatacagcaatgggaaccttcaagaggatggaacgactggacacaagtccccttttgttcacatcacttccacgaattaattatgaaagacggccgagttttggtagtcccatgtcgtaatcaagatgaactaataggacgagcaagaatatcgcaaggtgctgggtggtccctacgggagactgcgtgtttaggaaaaagctatgctcagatgtggagcttaatgtatttccatagaagagaccttcgcttagcagcaaacgctatatgttccgccgtaccatctcactgggttcctacatcacgaacaacgtggtccatacatgcaacacacgagtggatgactacggaagacatgttgacggtgtggaacagggtctggattcaggaaaatccgtggatagaggacaaaacaccagttgaaagctgggaagaaataccctatttaggaaaaagggaagaccaatggtgcggcagcttaatcggactcacgtctagagctacgtgggccaaaaacatacaaacagcaataaatcaagttaggtccttaattggcaatgaggaatatacagactacatgccgtccatgaaacggtttagaagagaagaagaagaagcaggcgtattatggtaa

SEQ ID NO: 22955 - RNA, 9876 nt, synthetic construct
  misc_feature 1..9876: note = derived and/or modified CDS sequence (opt6) from DENV-2__DQ645551__SS-prME
  source 1..9876: mol_type = other RNA
accgccggtgttataattatgatgattcctacagttgtagcctttcatctgactaccagaaatggagaacctcatatgatagtatccagacaggaaaaaggaaaatctttattgttcaaaacggaaaatggagtaaacatgtgcacgcttatggctatggacttaggggaactttgtgaagacacgatcacgtataactgtccattgctaagacaaaacgaaccagaggacatagattgttggtgcaattccacttcaacttgggtaacatacggaacgtgtaccgctacgggtgaacatagacgagagaaaagatcagttgctttagtaccgcacgtaggaatgggtcttgaaacgcgcacagaaacgtggatgtcatcagaaggagcctggaaacatgcacaaagaattgaaacatgggttcttcgacatcctggcttcactataatggcagccatactagcatacaccattggcactacctattttcaacgggtcttaatatttatactcctaactgctgttgctccttcaatgacgatgagatgcataggaatcagcaaccgagattttgttgagggtgtatctgggggatcatgggtcgatattgtgttagagcacggatcgtgtgttactacaatggccaaaaataaaccaactttggattttgaactaataaaaactgaagctaaacacccggctacactgagaaaatattgtatagaggcgaaactaacgaacacaacgaccgcgtcgcgatgccctacacagggggagccttcactgaacgaggagcaggataaacgatttgtttgtaaacactcaatggtagatagaggatggggtaatggttgtggcctattcggaaaaggaggtatcgtaacatgcgctatgtttacgtgcaagaaaaatatggaaggtaaagtcgtacaaccagagaatcttgaatacacaatagtgatcacacctcatagtggagaagaaaacgctgtggggaatgatacaggcaaacatggaaaagaaatcaaagtaacgccacagtcgtctataacagaagcggaactcacgggctacggtactgtgacaatggagtgctccccaagaacaggacttgactttaacgaaatggttcttctccaaatggaagataaagcatggttagtgcacagacaatggtttttagacctacctctaccatggctccccggagctgatacccagggcagcaattggatacagaaagaaacattagttacttttaaaaatcctcatgcgaagaaacaagatgtagtcgttcttggcagccaagaaggcgcaatgcacacagccctgacaggcgctaccgagatccaaatgtcctcaggaaacttactattcacgggccacctaaaatgtagattgcgaatggacaaactccaactaaaaggtatgagttacagcatgtgtacagggaaattcaaagtcgtgaaagaaattgcagagacacagcatggaactattgtcattagagttcaatacgaaggagatggctcaccatgcaaaatcccttttgagattatggacctagagaaacgccatgtgttaggcagattaatcactgtaaacccaatagttacagagaaagactcaccggtcaacatagaagccgagcctccattcggtgatagctacataataatcggtgtagaaccagggcagttaaaactatcttggtttaagaaaggaagctcaataggacagatgttcgagacaactatgagaggtgctaaacgaatggcgattctaggagacaccgcatgggactttggtagtttaggaggggtgtttacaagcattgggaaagcactacatcaagtctttggggcaatatatggagcagcttttagtggtgtatcgtggacgatgaaaatactcataggagtagtaataacttggattggtatgaactcacgaagtacatctctttccgtctctttggttctagtaggggtggtaactttatacctgggtgtaatggttcaagctgatagtggatgcgtcgtaagttggaaaaataaagaactcaagtgtggcagcgggatttttattactgataacgttcacacttggacagaacaatacaaatttcagccagaatctccctcaaaattagcatcagctatacaaaaggcacacgaagaagggatatgtggcataagaagtgtcacaagattggaaaatttgatgtggaaacaaattactccggaactaaatcacattctttcagagaacgaagtaaagctaacgataatgacaggggatatcaaaggaatcatgcaggcaggaaaaaggtcattacggccgcaaccaaccgaattaaaatactcttggaaggcttggggaaaagccaaaatgctatctacggagcttcataaccatacttttcttatagacggacctgagacagctgaatgcccaaacacaaaccgtgcatggaactcactcgaagtagaagattatggtttcggagtgtttaccacaaacatttggctcaaattaaaagaaagacaagacgtattttgtgattcgaaactcatgtcagccgccattaaagataatagagcagtacatgcagacatgggatactggatagaatcagctcttaatgatacctggaaaattgaaaaagcaagttttatcgaagtaaaatcatgtcattggcccaaatcgcatacgttatggtctaacggagttttagaatctgaaatgatcattcccaaaaatttcgcaggaccagtgagccagcacaactatcgaccaggataccatacacagacggcaggaccgtggcatcttggaaaattggagatggacttcgatttctgtgaaggtacaacagtagtggttaccgaagattgtgggaatagagggcctagtttacggactactactgcaagcggcaaattaataacagaatggtgctgtagaagttgtaccttacctccccttagataccgaggggaagacggttgctggtatggaatggaaattcgtccacttaaggaaaaagaagagaatcttgtcaattcccttgttacggctggacatggacaaatagataattttagtttgggtgttctgggaatggcccttttcctcgaagaaatgttacgaacaagagtaggaaccaaacacgcaatattattagtagccgtatcctttgtaactcttataacgggaaatatgtcatttagggacttgggacgagtaatggtaatggttggcgcaactatgacggacgacataggaatgggagtaacatatttggcactattagcggctttcaaggtaaggcctacgtttgcggctggtctacttctcagaaaactcacatccaaagaacttatgatgacaactataggtattgtactccttagccaatccactattccagaaacaatcttagagctcacagatgctctcgccctaggaatgatggtgctaaagatagtgagaaacatggaaaaatatcaattagcggtaactataatggcgattttatgtgtaccaaatgcggtaatcctacaaaacgcatggaaggtatcatgcacgatattagccgttgttagtgtaagccccttattattaacttcaagccagcagaaagctgactggattccactagcactgacaatcaaagggttgaatcctacagctatattcctaacaacattatcaagaacatcgaaaaagagatcctggccactcaacgaagcaatcatggccgtcggaatggtttcaatactggcaagttcattacttaaaaatgacatccccatgacaggaccgctagtagctggtgggttactaaccgtctgctacgtcctcacgggtaggagtgccgatttagaacttgaacgagcagccgatgtaagatgggaagaacaagcagaaatttcgggatcatctccaattctatctattactatatcggaagatggaagcatgagcatcaaaaatgaagaagaagaacaaacactaacgatcttaattaggacaggtttactcgttatatctgggctattcccagtaagtataccaattacagcagcggcctggtatttatgggaagtcaagaaacaacgggcaggagtattatgggatgtaccaagcccaccaccagtcggcaaagctgaattagaagacggggcctatcgtatcaaacaaaaagggattttaggatatagccaaattggtgcaggggtctacaaagaaggtactttccacactatgtggcacgttacacgaggagctgtacttatgcataaaggaaagcgtatagaaccaagttgggctgatgttaagaaagatctaatcagctatgggggaggttggaaacttgaaggtgaatggaaggagggtgaagaggttcaagtcttggcgttggagccaggcaagaatccgcgggcagtacaaacaaagccgggcctttttaagactaacacaggaactataggggctgttagtctcgatttctcaccaggcacatccgggagtcctatagttgacaagaaagggaaggttgttggattatacggtaatggagtggtcaccagatcaggtacatacgtatctgccatagcgcaaacagaaaagtctatagaggataacccagaaatagaagatgatatatttaggaagaaacgacttactataatggacttacatcccggtgctggaaagactaaacgatacctgccagcaatcgtacgggaagctataaagaggggactaagaacattgatattggctccaacacgggttgtggctgcagagatggaggaagcgttacgcggtctacctattaggtaccaaactcctgcgataagagcagagcataccggcagagagatcgtagacctaatgtgtcacgccacttttaccatgcggttactcagcccaatcagggtacctaactataacctaataataatggacgaggcacactttactgatccagcctcaatcgccgctcgaggctatattagtacaagggttgagatgggagaagcggcaggaatttttatgactgctactcctccaggctcacgggacccctttccgcagtcaaacgcaccgataatggatgaggaacgagaaatacccgaaagatcatggaactcggggcatgagtgggtaacagattttaaaggcaaaactgtatggtttgtgccgtctataaaagctggtaatgatatagccgcatgtctgcgaaagaatggaaagaaagtcattcaattaagtagaaaaacctttgacagtgagtatgtaaaaacccgtacaaatgactgggacttcgttgtaacaacagatataagtgaaatgggagcgaattttaaagcagaacgtgtaatagatcccagacgatgtatgaaacccgtgatattaaccgatggcgaggagagagttatactcgcagggccaatgccagtcacccactcttcggcagcgcaacgtagaggcagagttggacgcaaccccaaaaatgagaacgatcaatacatatatatgggtgaacccttagagaatgatgaagattgcgcacactggaaagaagctaaaatgttattagataatattaacactcctgaaggtatcattccatctatgttcgaaccagaacgcgaaaaggttgacgcaatagacggagaatataggttaagaggagaagccaggaaaacttttgttgatttaatgaggagaggcgacttaccagtctggctagcatatagagtggccgcggaaggaataaattatacagacagaaggtggtgcttcgatggtgtcaaaaataatcagatcctagaagagaacgttgaggtggaaatttggactaaggagggagagaggaagaaacttaaaccgaggtggttagacgcacgcatatactcagaccccctcgcactgaaagaatttaaggaatttgccgcgggaagaaaaagtctcactcttaatcttataacagaaatggggagactacctactttcatgactcagaaagctaggaacgcattagacaacctggcagtcttacacacagcagaagccggaggcagagcatataatcacgctctatccgaactccctgaaacacttgaaacattattattattgacattactagctacagttacaggaggcattttcttatttctaatgtcgggcaaaggaataggaaagatgacactaggcatgtgctgcattataactgcgtcagtattgttgtggtacgcacaaattcaaccccattggatagcagcaagtataatattagagttctttcttatagtactattaattccggaaccagagaaacagcgcacaccacaggacaaccagttaacgtacgtcgtaattgccatattgacagtcgtagctgcaacgatggctaatgagatgggttttcttgagaaaactaagaaggattttggcttaggaggcatcgcgacacagcagccagaatctaatatactagatatcgacctaaggcccgcgtcagcttggacgttatatgcggtggcaacaacattcataactcctatgcttcgtcactcaatagaaaattcctcagtaaatgtaagtttgacagcaatcgcaaaccaggcgacggtcttaatgggtttaggaaaagggtggccattatcaaaaatggacataggagttcctttattagcaattgggtgttatagccaggtgaatccaatcacacttactgcagcactactcctcctagttgcacattatgccattatcggacctggcctacaggcaaaagcaactcgagaggcacagaaaagagcagcagcgggtataatgaaaaaccccactgtagacggtataactgtaatcgatctagaccctataccctacgatccaaagttcgaaaaacaactcggacaagtaatgcttttagtactatgcgtaacacaggtgctaatgatgagaacaacgtgggcgctatgcgaagcgctcactttagccacgggacccattagcaccctctgggagggtaatcccggtaggttttggaataccacgattgcagtttctatggccaatatattcagagggtcctacctcgcaggagcaggtttactattttctataatgaagaacaccgccaacactcgtcggggtacaggaaatacgggtgaaacactaggagaaaaatggaaaaataggttaaacgcgcttggtaagtcagaatttcaaatttacaagaagtccggcatccaagaagtggatagaacactagcgaaagaaggcataaaacgaggcgagaccgatcaccatgccgtctcgcgtggttcagcaaaactaagatggtttgtagagagaaatctagtaacccccgaaggcaaagtaatggaccttggttgtgggagaggtggatggtcatattattgtggaggtcttaaaaacgtcaaagaagtgaagggcttgacaaagggagggccaggccatgaagaaccaatcccgatgagcacgtacggctggaaccttgtcagattgcagtcgggagtcgatgtattctttactccgcccgagaagtgcgatacattactttgcgatataggagaatctagcccaaacccaacggttgaagcaggaagaacattgagggtattgaacctagtagaaaactggttaaacaacaatacccaattctgcatcaaggtactaaacccttacatgccctcagtaatagagaaaatggaagctctacagcggaaatacggaggagccttagttcgcaacccactgagccgtaactctactcacgaaatgtactgggtttcaaatgctagtggcaacatagtaagctcagtcaacatgatctcgaggatgttgatcaatagatttactatgagacataagaaagctacttatgaaccggacgtggatttaggttctggaacgaggaacataggtatagaaagtgagacacctaatttagacattataggcaaaagaattgagaaaataaaacaagaacacgaaactagctggcattacgatcaagatcatccatataaaacgtgggcatatcatggttcatatgagacgaaacaaaccgggagtgccagtagtatggtcaatggagtagtacgcttattgacaaagccatgggatgtaataccaatggtgactcagatggcaatgacggacacaaccccattcgggcaacagagagtatttaaggaaaaagtcgatacaagaactcaggaaccaaaagaggggacaaagaaattaatgaaaataacagctgaatggttgtggaaagagttaggtaaaaagaaaacacccaggatgtgcactagggaagagttcacaagaaaagtaaggtccaacgccgcattaggtgcaatatttactgacgaaaataaatggaaaagtgcacgcgaagcggttgaagactcaggattctgggagctggttgacaaagaacgaaacctgcatttagaagggaaatgtgagacttgcgtgtataatatgatgggaaaacgcgagaagaaattgggagagtttggaaaagcaaaaggaagccgagctatttggtatatgtggctgggtgctagatttctagaatttgaagcattgggatttttaaacgaggatcactggtttagtcgcgaaaactctttatccggggtcgaaggcgaaggtttacataaattaggctatatacttcgtgatgtgagcaagaaagaagggggcgcgatgtacgctgatgatacggcaggatgggatacacggattacgttagaagatcttaagaatgaggaaatggtgacaaaccacatggaaggagaacacaagaaactagccgaagcaatattcaaactcacatatcagaacaaagtcgtaagagtccaaaggccaacacctagaggaacggtaatggatataattagtcgccgcgatcagcgaggttctggtcaggtagtcacatatggattaaatacttttactaatatggaggcacagttgattcgacaaatggagggcgaaggggtattcaaaagtatccagcaactcacagcgaccgaagaaatagcagtcaagaactggttggccagagtaggacgagagcgtctgtccagaatggcaatttcaggtgatgactgtgtcgtaaaaccactggatgatagattcgcctccgcattaaccgcattaaatgacatgggcaaagttcgtaaagatatccagcaatgggagcccagtcgggggtggaatgattggacgcaagtaccattctgttctcatcattttcatgaactaatcatgaaagatggtagggtattagtagtaccatgtcgaaatcaagatgaattaattggtagagcccggatttcacagggagcaggttggagtctcagggaaacggcctgcctcgggaaatcatatgcacaaatgtggtccttaatgtatttccatcgcagagatctacgattggccgcaaatgcaatctgtagtgcagtgccttcacactgggtccccacgtccagaacaacgtggtcaatccacgctactcatgaatggatgactacagaagatatgttaacggtgtggaacagagtatggatccaagaaaatccttggatagaagataaaacacctgtggaatcatgggaagaaattccatacctaggaaagcgagaggatcaatggtgtggtagtttaatcggtttaactagcagggccacttgggcgaagaatattcaaacggctataaaccaagtcagaagtttaataggcaatgaggaatatactgattacatgccatcaatgaaaagattcagaagagaagaagaggaagcaggggtactctggtaa

SEQ ID NO: 22956 - RNA, 9876 nt, synthetic construct
  misc_feature 1..9876: note = derived and/or modified CDS sequence (opt6) from DENV-2__DQ645552__SS-prME
  source 1..9876: mol_type = other RNA
acggctggtgttataataatgatgattcctactgtagtagccttccatttaactaccagaaacggtgaaccgcatatgattgtaagtcgacaggaaaaaggaaaaagcctcttgtttaaaacagaaaacggagtaaacatgtgtaccttaatggcgatggatttaggagagttatgcgaagataccataacatataactgcccgttattacgtcaaaatgaacccgaagacatcgactgttggtgcaactctactagcacgtgggttacgtatgggacttgcacagctacaggggaacacaggcgagaaaaacggagcgtagcgctggtaccacatgtggggatgggactcgagactagaacagaaacctggatgagcagtgaaggagcctggaaacatgcacaaagaatcgaaacctgggtactgcgacatccaggctttacaataatggcagcaattctggcttatacaataggcaccacatacttccaacgtgtattaatttttatactcctaacggctgtggcgccttcgatgacgatgagatgcataggtataagtaatagagattttgtagaaggcgtatcaggcggatcgtgggtcgacatcgtactagaacatggtagctgcgttacaacgatggccaaaaacaaaccgacattagattttgaattaataaaaaccgaagcgaaacacccagctactctgagaaaatattgcatagaggcaaaactaacaaacacaaccacagcttcacgctgtccaacgcagggtgaaccctcattaaatgaagaacaagataaacgcttcgtctgcaaacacagtatggtggatcgaggatggggcaatggttgtggtctattcggtaaaggaggtattgtaacgtgcgccatgttcacatgcaagaaaaatatggaaggtaaagtagtacagccagaaaatctagaatatacaatagtcatcacgccacattcaggcgaagaaaatgctgttggaaacgatacaggcaaacacggaaaagaaatcaaagtcacaccgcaatcatcaataactgaggcagaacttacggggtacggcacagtaacaatggagtgttctcctagaactggtctagactttaatgaaatggtattattacaaatggaagataaggcttggttagtccaccgccaatggttcttggatttaccactcccatggcttcctggcgcagatactcaaggttcgaattggattcaaaaagagacattggtaacgtttaaaaaccctcacgctaagaaacaagacgtagtagtattagggagtcaagaaggagcaatgcacactgccctaacaggggcaacagaaatacagatgtcaagtggaaatttgttgttcacgggacaccttaaatgtagacttcgcatggacaaattgcaattaaaaggaatgtcatattcaatgtgcacaggtaaatttaaagtcgtaaaagagatagcagaaacacaacacggaacaatagtcattagggttcagtatgaaggagacggttccccgtgtaaaattccatttgaaataatggatctagaaaaacgacacgtactaggccgattgatcacggtaaatccaatagtaactgagaaagattcacctgtaaacattgaagcagaacccccattcggcgattcatacatcattataggagtagaacccggtcagctaaaattatcatggtttaagaaaggatcctccattggccaaatgtttgaaacaacaatgaggggagccaaaaggatggcgatattaggagatacagcatgggattttggaagtttgggtggagtttttacaagtatcggtaaagccttacaccaggtatttggtgctatttacggcgctgctttttcgggtgtaagttggacaatgaaaatcctcattggggtagtaattacttggataggaatgaactcacgaagcacatccctctcagtatcgcttgttctagttggtgttgtcacattgtaccttggtgtcatggtgcaggctgactccggatgcgtagtcagttggaaaaacaaagagctcaaatgtggaagcgggatatttattaccgacaatgtacacacttggacggaacaatataaattccagcctgaatctccaagtaaactcgcgtcagctattcagaaagcacatgaagaaggtatctgtgggataagatcagttacgagactcgagaatctcatgtggaaacaaatcactcccgaactgaaccacatcttgtctgagaatgaagttaaattgaccatcatgacaggggatataaaaggtataatgcaggcgggaaaaagaagtttacgtcctcagccaacagaattgaaatattcatggaaggcttggggtaaagcaaaaatgctttctacagaactccacaaccacacattccttatcgatggacctgaaacagcggagtgtccaaacacaaatcgtgcatggaatagcttagaagtagaagattatggctttggtgtgtttaccactaatatctggctaaaattaaaagaacgtcaagatgtattctgcgacagtaaactaatgtcagcggcaatcaaagacaatcgcgccgtacacgccgatatgggatattggatagaaagcgctttgaacgatacctggaaaatagagaaagcgtcctttatagaagtaaaatcatgccattggccaaaaagtcacacattgtggagcaatggagttttagaatcagaaatgattataccgaaaaatttcgccggaccagtgtcgcaacataactatagaccaggttaccatactcagacagctggtccctggcacttaggtaagctagaaatggacttcgacttttgtgaaggaacaacggtggtggtgactgaagactgtggaaatcgaggcccatcactacgcacaaccacagcgagtgggaaattaataaccgaatggtgttgtagaagttgtacactaccacccttacgttataggggcgaagatggatgttggtatgggatggaaatcagaccgctaaaagagaaagaagaaaacctggtaaattctctagtaaccgccggacatggtcagatagacaacttctcgttaggcgtcttaggaatggcactcttccttgaagaaatgcttcgcacaagagttggaacaaaacatgcaatactccttgtggccgtaagtttcgtaactttaataacgggaaatatgtcatttagagatctcggcagggttatggtaatggtaggggctacgatgacagatgatattggtatgggtgtaacgtatctagcacttctggcggctttcaaagtacgccccaccttcgcagccggacttctattacgtaagctaaccagtaaggagctgatgatgacaacaatcggcatagtactattgagtcaatcaacaatcccagaaacaatccttgaactaacagatgcattagccttaggaatgatggtattgaaaatcgttagaaacatggaaaaataccagctcgccgtaacaataatggccattctgtgtgttccaaatgccgtgatactacaaaacgcttggaaagtgagttgcaccattcttgctgtcgtttcagtctcaccattattgctcacgtctagtcaacaaaaagcggattggattccccttgcgctcacgataaaaggtttgaatccgacagctatattcctgacaacactcagtcgtacgtccaagaaacgcagttggcctttaaatgaagcaatcatggcagtcggaatggtgagcattctcgcaagtagcctactcaaaaatgatataccaatgacaggccctctagttgccggcggtttactaaccgtctgctacgtacttaccggtcgaagtgctgatttagaattagaacgcgcagcggatgttaggtgggaggagcaggcagagatttcgggaagttcaccaatattatcaataacgatatctgaggatgggtcaatgagtatcaaaaatgaagaggaagaacaaactttaaccatactcataagaaccggcctattagtaataagtggactatttccggtgagtataccaattacagcagcagcatggtatctttgggaagtcaagaaacaacgcgcaggggttctttgggatgtgccaagcccaccgccagtgggaaaagcagagcttgaagacggcgcatatagaataaagcaaaaggggattcttgggtattcacaaataggagcaggcgtatacaaagagggaacttttcacacaatgtggcatgtaacgagaggtgcagtgttaatgcataaaggaaaaaggatagaaccgtcgtgggccgatgttaagaaagatctaatcagctatggaggcggctggaaattagaaggggaatggaaagaaggagaagaagtgcaagtgcttgcactagaaccaggcaaaaaccctcgcgcggttcaaactaaaccagggttatttaaaacgaacaccgggaccatcggcgcggtatctctagatttttcaccaggaacatctggttcacctatagttgacaagaaaggtaaagtcgttggtttgtatggtaatggtgtcgtaactcgatctggtacatacgtcagcgctatcgcccaaactgagaaaagcatagaagacaaccccgaaatcgaagatgatatattcaggaagaaacgacttacgataatggacctacatcctggagcgggtaaaacgaaaagatacttaccggctatagtcagagaagcaataaaaaggggattaaggacacttattctagcccccacaagagtggtggcggctgaaatggaggaagcacttagggggttaccaatcagatatcagaccccggcaattagggcagaacatactgggagggaaatagtggatcttatgtgtcacgcgacatttaccatgagactcttatcccctatcagggtacctaattacaatttgattattatggacgaagcgcactttactgatccggcaagtatagccgcacgagggtatatcagtacccgagtagaaatgggggaggccgcaggtatttttatgacggcgacacccccaggtagccgagatccatttccccaatcaaatgctccaataatggatgaagaacgggaaatcccagaaagatcatggaacagcggccacgagtgggttacggactttaaaggtaaaacagtttggtttgtgcctagtatcaaagcaggtaatgatattgcagcatgcttaagaaagaatgggaaaaaggtaatacaattgtcacgaaaaacgtttgatagtgaatacgtaaaaactcgaactaacgattgggattttgtagtcaccacagatatatccgaaatgggagcaaattttaaagcggaaagagtgattgaccctaggcgatgcatgaaaccagtaatattaactgacggagaagaacgggtcattcttgccgggcccatgcctgtcacccacagcagcgccgctcaacgcaggggccgagtcggaagaaatccgaaaaatgagaatgatcaatatatttatatgggggagccattggaaaatgacgaggattgtgcacattggaaagaagcaaagatgcttcttgacaacataaatacaccagagggtatcattccatctatgttcgaacccgagcgcgaaaaggtagatgcaatagatggagaatatagattacgaggtgaagccagaaaaacatttgtggatttgatgagacgaggagatttacccgtatggctagcgtacagagtagccgcagaaggtataaattacgcagacagacgttggtgttttgatggggttaaaaataaccagatattagaagaaaatgtagaagtggaaatatggaccaaggaaggagaaagaaagaaattaaaaccgagatggctcgatgctagaatatactcggatccactcgctctaaaggaatttaaggagttcgccgcaggccgaaagtctttaacccttaatcttataacagaaatgggcaggctgccaacgtttatgactcagaaagcaagaaacgcccttgacaacttagctgtattacatacggccgaggctggtggaagggcatataaccacgccctctcagaattaccagaaactttagaaacgttactattacttacgctattagctactgttacaggagggatttttctattcctaatgagcggtaaagggatcggcaagatgactcttggaatgtgttgcataataacagcgtcagtcctgctatggtatgcacagatacaacctcactggatcgctgcatccatcatcttagagttctttcttatcgttttactaattccagaacctgaaaaacaaagaactccacaggacaatcaactcacgtatgttgtaattgcaattttgactgtggtagcagcaacaatggcgaatgaaatgggcttcctagagaaaactaaaaaggacttcggattgggaggtatcgccacacaacaaccagaaagcaacatattagatatagacctacgtccagccagcgcatggaccctgtacgcagtcgccactaccttcataacaccaatgctaagacattctattgagaacagttccgtaaatgtatctttaactgccatcgcaaatcaggcgactgtactaatgggattgggaaaaggttggcccttgtccaaaatggacataggcgtcccgctcctcgcaattggatgttatagtcaagtgaacccaatcaccctaacagccgccctattgttacttgtagctcattacgcaatcataggaccaggtctgcaagcaaaagcgactcgggaagcacaaaaacgggctgctgccggaatcatgaagaatccaacagtcgatggtattacagtgatagatctagatccaatcccatatgacccaaagtttgagaaacaactgggccaagtcatgcttcttgttctatgcgtaactcaagtattgatgatgaggacaacatgggctctttgcgaggcactaacactagctactggaccaatatccaccctttgggagggaaaccccggcagattctggaatactactatagccgtctcaatggctaacatttttaggggatcatacttagctggtgccggacttctattcagcatcatgaaaaacactgctaatactcgacgagggaccggaaatacaggagagacacttggagagaaatggaaaaatcggctaaatgccctgggtaagagcgagttccaaatctataagaaatcagggattcaagaagtcgatagaacgctagccaaagaaggaattaaaaggggcgagactgatcaccacgctgtaagtcgtggctcagccaaactaagatggttcgtagaaagaaatttagtaactcccgaaggaaaagttatggacttagggtgtggacggggcgggtggtcttactattgtggtgggctaaagaacgttaaagaagtaaaaggattaaccaaagggggacccggacatgaggaaccgatacctatgagcacgtacggctggaatttagttagattacagagcggagtagacgtgttcttcacgcctcctgaaaaatgtgatacactattatgtgacattggtgagagttcccctaaccccactgtagaagccggtaggactctaagggtgttaaatctggtagaaaactggttaaataacaacacccagttctgtataaaagtcttaaacccgtatatgccaagcgtaattgagaaaatggaggcattacaacgaaaatacggaggagctctcgtgaggaaccccttgtctcgcaatagtactcacgaaatgtattgggttagtaatgcttcaggtaacatagttagctctgttaatatgatttcaaggatgcttataaaccgttttactatgagacacaagaaggcaacatatgaaccagatgtggatctaggatctggtacgaggaacataggaattgaatcggaaacacccaatcttgatattattggaaaacgaattgagaaaataaaacaagagcacgagacctcatggcactatgaccaagaccacccctataaaacatgggcatatcacggatcatatgaaacaaagcagaccggtagtgcgagcagtatggttaatggagtggttcggcttttaacaaaaccctgggatgttattccaatggttacccaaatggctatgacagatacaactccttttgggcaacagcgtgttttcaaagaaaaagtcgacacaagaactcaagagccaaaagaagggactaagaaactcatgaaaataacggcagaatggctatggaaagaattaggcaagaagaaaactcccaggatgtgtacgcgcgaggagttcacacgcaaggtgaggagtaacgcggcgctgggagctatatttactgacgagaataaatggaaatcagcaagagaagcagtggaagattccggattttgggagttggtcgataaagagagaaacctgcacctggagggaaaatgtgaaacttgtgtatataacatgatgggtaaacgcgagaagaaattaggggaatttggaaaagcaaagggtagcagagcgatatggtatatgtggctaggagcacggtttttggagtttgaagcgctgggatttttgaatgaagaccactggttctctcgggaaaatagcttatccggagtggaaggtgaaggcttacataaacttggatacatattgagagatgtttctaagaaagaaggaggggcaatgtacgccgacgacacagccgggtgggatacacgaatcacattagaagatttgaaaaacgaggaaatggtaactaaccacatggagggtgaacataagaaactagcagaggcaattttcaaactaacttatcaaaacaaagttgtacgggtccaaagaccaacctcgagaggcaccgtaatggacataatctcgaggcgcgaccaaagaggttcaggacaagtggtgacatacggactaaacacatttactaacatggaggcccaacttattagacaaatggaaggagaaggtgtatttaaatccattcaacaattgacagccaccgaagagattgcggtcaaaaattggttagcgcgggtcggacgtgagagattatctcggatggccatctccggagatgattgtgttgtaaaaccattagacgacagattcgcttcggcactcaccgccctcaacgacatgggaaaagttcgtaaagacatacaacaatgggaaccttctcgaggatggaatgactggacacaggtaccgttctgtagtcaccatttccacgaactcataatgaaagatggaagggtattagttgtaccatgcagaaatcaagacgaacttatcgggagggcgcggatctctcagggtgccggttggagtctacgtgagacagcctgcctaggcaagtcctatgcacaaatgtggtcgcttatgtacttccataggagagatcttcgattggcagctaacgcgatttgtagtgctgtgccatctcattgggtgcctacgagcagaacaacgtggtcaatacacgctacccatgaatggatgaccactgaggacatgcttaccgtttggaatagagtctggatacaagaaaatccatggatagaagataaaactcctgtggaatcctgggaagaaattccctacttgggaaagcgagaagatcaatggtgtggctctttaataggattgacaagtagagccacctgggccaagaacattcagacagcaataaatcaagtccgtagcctcataggaaatgaggaatatacagattacatgcccagtatgaagcggtttcgaagggaagaggaagaggcaggcgtattatggtaa

SEQ ID NO: 22957 - RNA, 9876 nt, synthetic construct
  misc_feature 1..9876: note = derived and/or modified CDS sequence (opt6) from DENV-2__DQ645553__SS-prME
  source 1..9876: mol_type = other RNA
acggcaggagttattatcatgatgatacctacagtagttgcttttcatcttacaacaaggaacggagaaccacatatgatcgtatcccgacaagaaaaaggtaaatcactactatttaaaacagaaaatggtgttaatatgtgtacactaatggcaatggatttaggggaactgtgcgaagatactataacgtataactgtcctcttttgagacaaaatgaaccagaagatatagattgttggtgtaacagcactagcacatgggtaacatacggaacttgtactgccacaggagaacataggagggagaaaaggtccgttgccctagtcccacatgtagggatgggcctcgaaacaagaacagaaacatggatgagcagcgaaggagcatggaaacatgcccaacgcatcgaaacatgggttctacgtcacccgggatttacaataatggcagcaatacttgcctacacaatcggaacgacatattttcagagggtgcttatattcatacttttaactgccgtcgctccatcgatgacgatgagatgtattggaatcagtaacagagattttgtagaaggggtaagcggaggtagctgggttgacatcgtactagaacatggcagctgtgtgacaaccatggccaaaaataaacctacactagacttcgagctcatcaaaactgaagcgaaacaccctgcaacactacggaaatactgcatagaggctaaattaactaacaccactaccgcttctagatgtcctacgcaaggagaaccctctttaaacgaagaacaagataaacgttttgtttgtaaacatagcatggtagaccgaggttggggaaatggttgcggtcttttcggaaaaggcggaattgttacatgcgcaatgttcacatgcaagaaaaatatggagggcaaagttgtccagcccgagaacttagaatacacgattgtgattacaccacatagcggagaagaaaatgcagtaggaaacgacactgggaaacatggtaaagaaataaaagttacgccgcagtcctccataacagaagctgaacttactggttacggcactgttacaatggagtgtagtccgcgaacaggacttgattttaatgaaatggttttattacaaatggaagataaagcctggttagtacatcgacaatggtttttagatctgcctttgccttggctacccggagcagatacccaaggcagtaactggattcagaaagagactctggttacattcaaaaaccctcatgcgaagaaacaagatgtagtagttctaggatcacaagaaggggcaatgcacacagcattaaccggagcgaccgaaatccagatgagctcaggcaatttactattcacaggccatctgaaatgcagattaagaatggataaacttcaattgaaaggaatgagctattcgatgtgtactggaaaatttaaagttgtaaaagaaatcgccgaaacacaacatggcactattgtaataagagtacaatatgaaggggatggttcaccatgtaaaatacccttcgaaatcatggatctggagaaacgccacgtccttggacggctcataacagtaaaccctatagtaactgaaaaagacagtccagtcaatattgaggctgagccaccctttggagatagttacataataataggtgtcgaaccaggacaattgaaactatcatggttcaagaaagggagtagcattggtcaaatgtttgaaactacgatgagaggtgcaaaaagaatggccatacttggagatacggcatgggatttcggctcacccggaggcgtctttacgtcaatcggcaaagcattgcatcaagttttcggtgcaatctacggagcggcattttcaggagtaagctggacaatgaaaatcttaataggagtagtaataacttggataggcatgaactcgcgctctacaagtctaagtgtatcacttgtgttggtaggtgttgtaaccctctatttaggggtaatggtacaagctgattcagggtgtgttgttagttggaaaaataaagaactaaagtgtggttcagggatatttataaccgacaacgtgcacacttggacagaacaatacaaatttcaaccggaatcccccagtaaactagctagcgctatacaaaaagcccatgaggaaggcatttgcgggattcgatccgtaactagattagaaaatctgatgtggaaacaaataacgcccgaattaaatcatattctttcagagaatgaggtgaaactaaccattatgacgggtgacataaaagggattatgcaagcaggcaagcgaagtctacgacctcaacctactgagttaaaatattcatggaaggcgtggggaaaagcaaaaatgttatctactgaattacataatcatacatttcttatcgacggtcctgaaacagccgaatgtccaaacacaaaccgagcgtggaactcactagaagtagaggattacgggttcggggtattcacaacgaacatatggttgaaactaaaagagcgacaagatgtattctgtgatagtaaacttatgtctgccgccataaaggataaccgtgcagtacatgctgacatggggtactggatagaaagtgcgttaaacgatacgtggaaaatagaaaaagcctcatttatagaagtgaagtcatgccattggccaaagagtcacacattgtggtcgaacggagtactcgaaagtgaaatgataattccgaaaaacttcgcaggacctgtttcccaacacaattacagacctgggtatcacacgcaaacagctggaccctggcatttaggtaaattagaaatggatttcgatttttgtgaaggaaccacagtagtcgttacagaagactgtggtaatagagggccgtcattgagaacaacaacagcaagtgggaaactaatcactgaatggtgttgtcgaagttgtacgcttccacctctgcgctataggggagaagatgggtgctggtatggtatggagatcagaccacttaaagagaaagaggagaatctagttaatagcttagtaacagcaggtcacggacaaatagacaatttctcattaggtgtgttaggaatggcactctttctagaagaaatgctcaggacaagagtcggaacaaaacacgcaatattattagttgcggtttctttcgtaaccctaattacggggaacatgagctttcgagacttaggaagggttatggttatggtaggagcaacaatgactgatgacatagggatgggcgttacttatttagcccttctcgcagcgtttaaagtccgaccaacatttgctgctggcttgttactgagaaaactaacatctaaagaactaatgatgaccactataggaatcgtactactaagtcaatcaacaattcctgagacgatattagaactgacagacgcgctggcgttaggcatgatggtgcttaagattgtaaggaacatggaaaaatatcagttagcagtaacaattatggcaattttgtgtgtacctaacgcggtgatacttcaaaatgcttggaaagtatcgtgtactatactggcagttgtttcagtgagcccactactcctaacaagttctcagcaaaaggcagattggatacctcttgcacttacaattaaaggattgaatccaacagctatctttttaacgaccttaagtcgcacatctaagaaacgcagttggcctctcaacgaggcaatcatggctgttggcatggtctccatcctagctagctcattactaaagaatgatatacctatgacaggccctctggtcgccggtgggctattaactgtttgttacgtgttaacgggaagatcagcagacctagaattagaaagagcagctgatgtccgttgggaggagcaggctgagatatcaggaagttctccaatattgagcattacaatttcggaagacggttccatgagcattaaaaatgaagaagaagaacaaactctaacaattctcatacgcacaggtctcctagtaatatcggggttattcccagtatcaataccaattactgcggcagcatggtacctctgggaagtcaagaaacagcgtgcgggtgtgctgtgggatgtaccttcacctccaccagttggaaaagcggagttggaggatggagcttaccgtataaaacagaagggcattctaggatattcacaaatcggcgctggagtttataaagagggaacattccacacaatgtggcacgtaactagaggtgccgtattaatgcacaaaggcaaacgcatagaaccgagctgggctgacgtcaagaaagatcttatatcgtatggcgggggttggaaactcgaaggagaatggaaggaaggagaagaagtacaagttttagctcttgaaccaggtaaaaaccctagagctgttcagactaagccgggtctcttcaaaacaaatacaggaacaatcggggccgtcagcttggacttctcacctggaacatctggaagtccgatcgttgataagaaaggaaaggtagtagggctttacggaaatggagttgttactcgttccggtacgtatgtgtctgcaatcgctcaaacagaaaaatcgatcgaggacaaccccgaaattgaagatgatatctttcggaaaaagagactaaccataatggatttgcacccgggggctggtaaaacaaaaagatatctaccagcaattgtgcgtgaggcaattaaaaggggactaagaacacttatactggcgccaactagagttgtcgccgctgaaatggaagaagcattacgtggtttgcccatacgatatcagacaccagcaataagggcagagcataccgggagagaaatagtagacttaatgtgtcatgcaactttcaccatgagattgttatcgccaataagggttccaaattacaatttaattataatggacgaagcacacttcactgacccagcgagtattgccgcacgaggatacattagcacacgcgtggaaatgggggaggccgctgggatctttatgaccgctactcccccaggttcaagagatccgttcccgcaatcgaacgccccgataatggatgaggaaagagaaatacccgagcgtagttggaatagtggacatgaatgggtcacagattttaaagggaaaactgtatggttcgtaccatcaatcaaagcaggaaacgatatagcagcatgtctacgtaagaatggaaagaaagtaatccagctatcgagaaaaacctttgattctgagtatgtaaaaacgaggaccaatgactgggactttgtagttacgacagacatttccgaaatgggagccaacttcaaagccgaacgagtaattgacccgcggagatgtatgaaaccagttatattaacagacggagaagaacgagttatcctggctggtccaatgcccgtcactcatagttcggctgcacaaagaaggggaagggttggtagaaatcccaaaaatgaaaacgatcaatatatctatatgggcgaacctctagaaaacgatgaagactgtgcacattggaaagaagcaaaaatgctactggataacatcaacactccggaaggtataattccgtctatgtttgaaccagaacgagaaaaggtcgatgccattgatggagaataccgactaagaggagaagctagaaaaactttcgttgatttaatgagaagaggagatctaccagtatggttagcgtatcgggttgctgcagagggaattaactacgcggatagacgatggtgctttgacggtgtcaagaataatcaaatattagaagagaacgtggaagtagagatatggactaaagaaggtgaaagaaagaaactgaaacccaggtggctagacgcacgaatatacagtgatccactggcactaaaagaatttaaagaatttgcagcaggtagaaaaagcctaacgctgaacctgatcacagaaatgggacgcctgcctacatttatgacacaaaaagcccgcaatgctttagataatctagcagttttacacactgcagaggccggcggcagagcatataaccatgctcttagcgaactacccgaaaccttagagacattgttgctgctcacactattggctactgtaacaggcggtatttttcttttcctaatgagcggaaaaggtattggtaaaatgacactaggcatgtgctgtataataaccgcatccgtccttttatggtatgcgcaaatacagcctcattggatcgcagctagtataatcttagagttcttcctaattgttcttttaatccccgaacccgaaaagcaaagaacaccccaagacaatcaactcacatatgtcgtcattgcaatcttaactgttgtggcagccactatggcgaatgaaatgggttttctcgagaaaaccaagaaagatttcggattaggaggcatcgcaacccagcaaccagaatctaatatcttggacattgatcttcgaccagcgtctgcgtggactctatacgcggtagctaccacatttatcacgcctatgttgcggcattccatagaaaacagttcagtcaatgtctcattaacagcaatcgcaaaccaggcaacagtcctcatgggcttaggtaaaggttggcccttgagcaagatggatataggagttcccttgcttgctattggatgttattcacaggtaaaccctattacgttaacggctgcattacttctcctagtagctcattacgcaattatcggtccgggactgcaggcaaaggcgacgcgtgaggcgcagaaaagggcagcagccggaatcatgaaaaatccaacggtcgacggaataacagtcatcgatctggaccccataccatatgaccctaaattcgagaagcagctaggacaggtaatgttattggtattatgtgtcacgcaagttcttatgatgcgaactacttgggctctctgcgaagcattaactttggcgacaggacccatatcgacattatgggagggaaatccgggtcgcttctggaacaccactatcgctgtaagcatggctaatatcttccgcggttcttatctagctggagccgggctactatttagtatcatgaagaacaccgcaaacaccagaagaggtactggcaacactggagaaacattaggtgaaaagtggaaaaatcggcttaacgcgttaggaaaatctgaatttcaaatctacaagaaatctggtattcaagaagtcgatcgtacccttgcaaaggaagggatcaagagaggggaaacggatcatcatgctgtgtcgaggggttcggcaaagttacgttggttcgttgaaagaaatctagtcacacccgaaggtaaagtaatggacttaggctgcggtcgtggcgggtggtcctattattgtggaggccttaaaaatgtaaaggaagtcaaaggactaacaaaaggaggaccaggccatgaggaacctataccaatgagcacatatgggtggaacttggtacgattacaaagtggggttgacgtattctttacaccgccagaaaaatgtgatactttgctatgtgacataggggaatcaagtcctaatcccacggtggaggcgggtcgaacgttacgcgtattaaatcttgtagaaaactggctaaataacaatacacaattttgtattaaagtgcttaatccttacatgcctagcgtaattgagaaaatggaagccttacaaagaaagtacggaggtgcgctagttagaaatccccttagcagaaattcaacgcatgaaatgtactgggttagtaatgcgagtggaaacatagtttcgtcagttaatatgataagccgcatgctaataaacaggtttacgatgaggcataagaaagcgacatacgaacctgacgtagatttaggatccgggacacgaaacataggaatagaaagtgagacacctaatctagatattataggtaaacggatcgagaaaatcaaacaagaacacgagacgagctggcactatgatcaagatcatccatataagacttgggcatatcacggatcctatgaaactaaacaaactggtagtgctagtagtatggttaacggtgtagtcagactcctaaccaaaccctgggatgttatacctatggttactcaaatggcaatgactgacacgacgccttttggacagcagagggtgtttaaggaaaaggtggacaccaggacacaagagccaaaagaaggtaccaagaaactgatgaagatcactgctgaatggctttggaaagaactggggaagaagaaaactcctaggatgtgtacgcgagaagagttcacacgtaaagtcagatcaaacgccgctttaggtgcaatatttactgatgaaaataaatggaaaagtgcacgagaagctgtagaagatagtggtttttgggaacttgtcgacaaagaaagaaaccttcacctagaaggaaagtgcgaaacatgtgtatataacatgatgggtaaacgagagaagaaacttggtgagtttggtaaagctaaaggcagcagggcaatctggtatatgtggttgggggctaggtttttagaatttgaagcacttgggtttcttaatgaggatcattggtttagccgcgagaactcattatctggagttgagggagaaggactacacaagctaggttacatattaagggacgttagtaagaaagaaggaggtgcaatgtacgcggacgacaccgctggatgggatacaagaatcactctagaagacctgaaaaacgaagagatggtcacaaatcatatggaaggcgaacataagaaattagcggaagcgatatttaaattaacgtatcaaaacaaagtcgttagggtacaaaggccaacacctagaggtacggtcatggacatcataagccggagagatcaacgcggctcgggacaagtagttacctatggtttaaatacttttacaaacatggaagcccaacttattaggcaaatggaaggcgaaggcgttttcaaatcgatccaacaactcaccgccacggaggaaatagctgtcaaaaattggctcgctagagtaggaagagagcgcctttcccgaatggctatatccggtgatgactgtgtggtaaaaccattagatgatcgatttgctagcgcgctgaccgcgctaaacgacatgggaaaagtgcgtaaggatatacagcaatgggaaccctcaagaggctggaacgattggacacaagtgccattttgctcacatcattttcacgaattaataatgaaagatgggagagtattagtcgtaccgtgcaggaaccaggacgaactaattggtagagcccgaataagccaaggcgctggctggtcactaagagaaaccgcttgcctaggcaaatcatacgcacaaatgtggtccttaatgtacttccataggagggatctaaggctcgcggcgaatgcaatctgtagtgcggtcccgtcgcactgggttcctacgagtagaacgacgtggtctattcacgcaacgcatgagtggatgactactgaagatatgctcgcagtatggaatagagtatggatacaagaaaatccatggatcgaagataaaacacctgtagaatcttgggaagagattccgtacctaggcaagcgtgaagatcagtggtgtgggtccctaataggattaacctctagagcaacctgggctaaaaacatccaaacagcgattaaccaagtgagatcattaataggaaatgaggagtatacagattacatgccgagtatgaaaaggtttaggcgcgaagaagaggaagcaggagtactatggtaa

SEQ ID NO: 22958 - RNA, 9876 nt, synthetic construct
  misc_feature 1..9876: note = derived and/or modified CDS sequence (opt6) from DENV-2__DQ645554__SS-prME
  source 1..9876: mol_type = other RNA
actgctggtgtaataatcatgatgataccaaccgtagtagcattccacttaacgactcgaaacggagaaccgcatatgatcgtatcccgacaagaaaaaggaaaaagccttctgtttaaaacagaaaacggagtgaatatgtgtactctcatggcaatggatcttggagaattgtgtgaagatacaataacctataattgtccattgctaagacaaaatgaaccagaagacatagactgctggtgtaactcgacatccacttgggttacctacggtacatgcacagcaacgggtgaacatcgacgagaaaaacgtagtgttgctttagtccctcatgttggtatgggtctggaaacacgaacggaaacgtggatgagctctgaaggtgcttggaaacatgcgcaaaggatagaaacatgggtgttaagacacccaggttttaccataatggccgccattctagcctatacaattggaacaacgtactttcaaagagtattaatatttatccttttgacagctgtagccccgagtatgacaatgagatgtatcggaatatccaaccgcgactttgtagaaggggtaagcggaggatcatgggttgacatagttcttgaacatggtagctgtgtaacgaccatggccaaaaacaaaccgaccctagattttgaactaataaaaaccgaagcaaaacatcccgcaacattaaggaaatattgtatagaggcgaaactaacaaatacgacgacggcttcaaggtgtccaactcaaggagagccatcacttaatgaagaacaagataaacgattcgtctgcaaacattctatggtggaccgagggtggggcaatggatgcggccttttcgggaaagggggaattgtaacgtgcgcaatgtttacctgcaagaaaaatatggagggcaaagtggtacaaccggaaaatcttgagtatacaattgtaataactcctcactcaggagaggaaaatgcagtagggaacgataccggcaaacatggtaaagagataaaagtcacacctcagtcgtctataaccgaagccgagcttactggttatggaacagttactatggaatgctcacctaggacaggcttagactttaatgaaatggttcttttgcagatggaagataaagcatggctcgtacatagacaatggttcctagatctaccgttaccttggctacctggagcagatacgcaaggctcaaattggattcagaaggaaacacttgtgacttttaagaatccccacgctaagaaacaggacgtcgtcgtattgggttctcaggaaggtgcaatgcacactgctctaacaggcgcaaccgaaattcaaatgtctagtggaaatttactttttacgggacatttaaaatgcaggctaaggatggataaactccagttgaaaggaatgtcatattctatgtgtacaggaaagtttaaagtagtaaaagagattgctgaaacgcaacacggaacaattgtaattcgagtgcagtatgaaggcgacggttcaccctgcaagataccatttgaaataatggatttagagaaacgccatgtgttaggtagattgataacagtcaatccaattgtaactgaaaaagattcgcccgtcaacatagaagcagaacctccctttggagacagctatataatcataggtgttgaaccagggcagctaaaattaagttggtttaagaaagggtccagtattgggcagatgtttgagactacaatgagaggagcgaaaagaatggctatactaggtgacaccgcttgggattttggcagcttaggtggagtattcacctcaattgggaaagcattacaccaggtttttggagcaatatatggggccgcattctccggggtgtcatggacgatgaaaatactaataggagtcgtaataacttggattggcatgaatagtagaagcacttctttatcagtgagtctagtattagtcggggtagtaactctttatttaggtgtaatggtccaagcagacagcgggtgcgtagtctcctggaaaaataaagaattgaaatgcggttcaggaatattcataactgacaatgttcacacatggactgagcaatacaaatttcaacctgaatccccctcgaaactcgcaagtgcgatacaaaaagcacatgaagagggaatatgcggtatcagaagcgtcacgcgacttgagaatctaatgtggaagcaaataactcctgagctgaatcacattctatcagaaaacgaagtgaaactaacaattatgactggagatataaaggggattatgcaagcgggtaaacggagcctaagaccgcaaccaactgaacttaaatattcatggaaagcctggggaaaggctaagatgttaagcacggaactacacaatcataccttcttaatagatggacccgaaacagcagaatgcccgaataccaacagagcatggaactctcttgaagtcgaagattatggtttcggggttttcacaactaatatatggttaaagttaaaagagagacaggatgtattttgcgattccaaactaatgagtgcagctattaaggacaacagagcagtgcatgctgacatgggctactggatagagtctgcccttaatgacacatggaaaatcgagaaagcatcatttatcgaggtcaagtcttgtcattggccaaaatctcatacattgtggagtaatggtgtgcttgaatcagaaatgataatacccaaaaattttgcagggccagtatctcaacataattaccgcccgggatatcacacacaaaccgctggtccctggcatcttggaaaattggaaatggattttgatttttgcgagggaactactgttgtagttacagaggattgtggtaatagaggaccatcactgcggacaacgactgccagtggtaagttaataacggaatggtgctgccgcagttgtactttacccccactacggtaccgtggtgaggatggatgttggtacgggatggagatccgacctttgaaagaaaaagaagaaaacttagtaaactccctcgtaacagcgggtcatggtcagatagacaacttttcactcggggtattgggaatggcactatttttagaggaaatgctacgaacgagggtaggtacaaagcatgcgatactattagtagcagtaagttttgtgacattaatcacagggaatatgtcgtttagagatctgggccgtgtcatggttatggtaggtgccacaatgaccgatgatattggtatgggtgttacatacctggcgctgctagctgccttcaaagtacggccaacgttcgccgcgggattattgttaagaaaactcacatctaaggagttgatgatgactacaattggaatcgtacttctcagtcagagtactattccggaaacaatactagaactaacggatgcattggctttaggtatgatggtgttaaaaatagtaaggaatatggagaaatatcaactggccgttacaataatggccatactttgcgtaccaaatgcagtaatattacaaaatgcatggaaagtatcatgtacaatactggcagtagttagcgttagtccgctcttactcacgtcaagccaacaaaaagcagattggataccactagcgttaacaataaaagggcttaacccaaccgctatctttttgactacactttcgagaacgagcaagaaaaggtcctggccactgaatgaagcaatcatggcggtcggtatggtgtcaatactagcttcttcattgcttaaaaacgacatcccaatgaccgggccgctagtagccggaggactactcactgtgtgttacgtactaaccggcaggagcgcggatctagaactagaaagagcagccgatgtcagatgggaagaacaggcagagatatcaggttcaagtcctatattaagtattaccatctctgaagacggcagtatgagcattaaaaacgaagaagaagaacaaaccctcacaattctaatacgtacgggattgctggtcattagcggactatttccggtttctattcctattaccgcagctgcctggtacctgtgggaagtaaagaaacaaagagctggtgtactttgggacgtcccatcgccaccgccagtcgggaaagctgagcttgaagatggagcatatagaatcaaacaaaagggaattttgggttactcacaaataggtgccggtgtttataaagaaggaacattccacacaatgtggcacgtaacgaggggagctgtgctcatgcataagggcaaaagaatcgagccaagttgggcagacgtcaagaaggatttaataagctacggaggaggatggaaattagaaggtgaatggaaagaaggtgaagaagtccaagttctagctttagaacctggcaaaaatcctagagcagtacaaacaaaaccaggcttattcaaaacgaatacgggaaccataggggctgtctccttagatttttccccgggtacgtcaggttcgcctatcgttgataagaaaggtaaagtggtcgggctatacggtaatggggtcgtcacgaggtcaggaacttacgtatctgctatagcacaaactgaaaaatcaattgaagacaatccagaaatcgaagacgacatattcagaaagaaaagactaactatcatggatttgcacccaggcgccgggaaaacgaaaagatacctacctgcaattgtcagggaggcaataaaaaggggattaagaacattaatcttggctccgacaagagttgttgcggcagaaatggaggaagcactacgtggactaccaatcagatatcaaaccccagctatcagggcagaacacacaggaagagaaatagtggatcttatgtgccacgcgactttcactatgcgtttactatctcctatcagagttcccaactacaatttaattataatggatgaagcccactttacggacccagcctccattgcggctagaggatatatctctacgcgagtcgaaatgggcgaagcggctggaatatttatgactgcaacaccacccggaagtcgtgatccctttccgcagagtaatgccccgataatggatgaggaaagggaaatacccgaaagaagctggaacagtgggcatgaatgggtgacagacttcaaaggtaaaactgtgtggtttgtgccatctattaaagctggtaatgacatagctgcgtgtctaagaaagaacggtaagaaagtgatccagctcagtagaaagacgttcgattccgaatatgtaaaaactagaacaaatgactgggatttcgtcgttacaacagatatatctgaaatgggtgctaactttaaagctgaacgtgtcattgacccgagacggtgtatgaagccagtgatactgactgacggtgaagagagagtcatcctggccggtcccatgcccgttacacactccagcgcggcacaaaggagggggcgagtaggaagaaaccccaaaaatgaaaacgaccagtatatatatatgggtgaaccgttagaaaacgacgaagattgtgcccattggaaagaagccaaaatgcttttagataatataaacacaccggaaggtataataccaagtatgtttgagcctgaacgagaaaaggtagatgccatcgacggtgaatacaggctaagaggtgaagcccgaaaaacctttgtagatctaatgagacgcggtgatcttcccgtatggctcgcttatcgcgtagcagcagaagggataaactacgctgaccgtcggtggtgctttgatggagtcaaaaataatcaaatcttagaagagaatgtagaagtcgaaatttggacaaaagaaggagaaaggaagaaattgaaaccccgttggctggatgcgcgaatatactcggatcctctagcgttaaaagaatttaaagaatttgcggctggacggaaatcgttaacactcaacctgataacagaaatgggcagattacccacattcatgacccaaaaagcacggaacgcattagataacctagcagtcctgcacacagctgaagctggaggcagagcatacaaccatgcattaagcgaactaccagaaaccttggagacgttactattactaacgttacttgcaacggtgaccgggggcatcttcctatttctaatgagcggaaaaggaatagggaaaatgaccttaggaatgtgctgtataatcacagctagtgtcttgctgtggtacgcacaaatacaaccgcactggatcgcagcatcaataatattggagttcttcctaattgtcctgctaatccccgaaccagaaaagcagcggacaccacaagacaaccagctgacttatgtcgtaatagcaatattaacagtagtagccgccactatggctaatgaaatggggtttctagagaaaactaagaaagactttggactagggggaatcgcaacacaacaacccgaatcaaatatcttagacatagacttacgtcctgcttccgcatggaccctttacgccgttgcaactactttcattactcctatgttaaggcactccattgaaaattcgtccgtaaacgtttccctcacagctattgcaaatcaggctactgttttaatggggctggggaaaggatggccattgtcaaaaatggacatcggagtacctctattagctatcgggtgctatagccaagtaaatcccatcacgctcacagcggccttgttgctcctcgttgctcattacgcaattattggacctggcttacaggctaaagcaacacgagaagctcaaaaacgagccgcagctggaatcatgaaaaaccccacggtagacggtataaccgttatagatctagatccaatcccatatgacccaaaatttgaaaaacagttaggccaggtaatgctattagtactatgcgtcacacaagttttaatgatgcgaactacctgggcattgtgtgaagcattaacgcttgcaacaggaccaatatcaaccttatgggaaggcaatcccggtaggttttggaacaccacaatagcagtgagtatggcaaatatctttagagggagctacctcgcaggagcgggattattatttagcattatgaaaaacacagccaacacaagaagaggaaccggcaatactggagaaacactgggtgaaaaatggaagaacagactcaacgcgttaggtaagtctgagttccaaatatataagaaatcaggtattcaagaagtagacagaacactcgccaaggagggaatcaagcggggagagaccgaccatcacgcggtcagccgtggttcagctaagttacgatggttcgttgaacgtaatttagtgacaccagagggtaaagtcatggacctgggatgtggtagagggggttggagctactactgcggcggactcaaaaatgttaaagaagtcaaagggttgacaaaaggaggtcctgggcacgaagaaccaattcctatgagcacttatgggtggaacctggttagattacaaagtggtgtagacgtattctttacgccgccagaaaaatgtgatactctactgtgcgacataggagaatcatccccaaaccccacagtagaagcaggaagaacgcttagagttctaaacttagttgagaactggttaaacaacaacacccaattttgcatcaaagttctcaacccgtatatgccgtctgtaattgaaaagatggaagcactccaaagaaaatacgggggtgcactggtaagaaaccctttgtccagaaatagtactcatgagatgtattgggtaagcaacgcatctggtaacatagtatcttccgtcaatatgatatcacgaatgttgataaatcggttcactatgaggcataagaaggcaacctatgaaccggatgtggatctaggcagcggcacaagaaacatcggaatcgaatccgaaacgccaaatttagacataataggtaaaaggatagagaaaattaaacaagaacatgagacgtcttggcattacgaccaagaccacccttacaaaacttgggcatatcacggatcctacgagacaaaacaaacaggaagtgccagcagcatggtaaacggcgttgttcgattattaacaaaaccgtgggatgttattccgatggtaactcagatggctatgacggataccaccccatttggtcaacaacgtgtgttcaaagagaaagtggacacacgtacacaagaaccaaaggaaggaacgaagaagttaatgaaaataacagcagaatggttgtggaaagaactaggaaagaagaaaacgccaagaatgtgtacacgtgaagaatttacaagaaaagtgcgcagcaacgcagcgttaggggctatttttaccgatgaaaacaaatggaagtcagcaagagaggcagtggaagattcggggttttgggaacttgtagacaaagaaagaaatttacatttagaaggaaagtgtgaaacatgtgtatacaatatgatgggaaaaagggagaagaaactcggagaatttggaaaagcaaaaggttcgagagcaatttggtatatgtggttaggtgcccggtttctagaatttgaggccttgggatttctaaatgaggatcactggttttctcgcgaaaacagcctgtcaggtgttgaaggagaaggactacacaaattaggatatatactccgggatgtgagtaaaaaggaaggcggagcaatgtatgctgacgatacagcgggttgggacaccagaatcactttagaagatctgaaaaacgaggaaatggtgactaatcatatggaaggagaacataagaaattagccgaggcaatttttaagttaacataccagaataaagtagtaagagtacaaagacccaccccacgaggaacagtaatggacataatctctagaagagaccagagaggaagtggacaagtagttacttatggtttgaacacgttcacaaacatggaggctcaactaatccggcaaatggagggagaaggagtattcaaaagcatacaacaattaacagccacagaagaaattgcagtaaagaactggctggctagagttggtcgtgagcggctatcaaggatggcgattagcggagatgattgcgtggtaaaaccactcgatgataggttcgcctcggccttaacagcgctcaatgacatgggcaaaattagaaaggatatacagcaatgggaaccttctagaggctggaatgactggacccaagtaccattttgctcgcaccacttccatgaattaattatgaaagatggccgggttctagtcgttccctgtcgcaaccaagacgaattaattggaagggcacgaattagtcaaggtgctggatggtcattaagagaaactgcttgtttaggtaagagctatgcacaaatgtggagtttaatgtattttcacagaagggacttgaggttggctgcaaatgcaatatgcagcgcagtacctagtcattgggttcctacgtcgcgaaccacatggagtattcacgcgactcatgaatggatgacaactgaagatatgctaaccgtatggaatagggtctggatccaagagaatccgtggatagaagacaaaacaccggtggaaagctgggaagaaataccttatttggggaaacgagaggatcaatggtgtggcagtctaattgggctaacaagccgagcaacttgggctaaaaatattcaaactgccatcaatcaagttaggagtttaatagggaatgaagaatatacggattatatgccttcgatgaaaagattcagaagggaagaagaggaagcgggtgtattatggtaa

SEQ ID NO: 22959 - RNA, 9876 nt, synthetic construct
  misc_feature 1..9876: note = derived and/or modified CDS sequence (opt6) from DENV-2__DQ645555__SS-prME
  source 1..9876: mol_type = other RNA
acagctggtgtcatcataatgatgattccaacagtcgtagcgtttcatttaaccacacgtaacggagaaccacatatgattgtaagtaggcaagaaaagggcaaatcattgctatttaaaacagaaaatggtgttaacatgtgcacgttaatggccatggacctgggggaactatgtgaagatacaataacctacaattgtccccttctgcgtcaaaatgaacctgaagacattgactgctggtgcaatagtacatccacgtgggtcacatatggaacatgtacggccactggagaacaccggagagagaagcggagcgttgcattagttccccatgtgggtatgggtttggaaacaagaacagaaacgtggatgagctcacagggggcatggaaacatgcccaaagaattgagacgtgggtacttcgccatccgggcttcacgataatggcagcgatacttgcatacactataggtacaacttactttcagagggtattgatattcatcctcctcaccgcagtagcaccaagcatgacgatgaggtgtattggaatttccaatagagattttgtggagggggtatcgggaggaagctgggtcgatatcgtactagaacacggttcttgcgtcacgaccatggcgaaaaataaaccaactttagactttgaattaataaaaacagaggctaaacacccggctaccttaagaaagtactgtattgaagctaaattgaccaatacaacaactgcaagtcgatgcccaacgcaaggtgaaccttcacttaacgaagaacaagataaaagatttgtttgcaagcacagtatggtcgatcgcggatggggaaacggatgtggattgtttgggaaagggggaatagtgacttgcgcaatgtttacatgcaaaaaaaatatggaaggaaaagttgtacaaccagaaaatttggaatacactatagtaatcaccccccatagtggcgaagaaaacgctgtcggaaatgacacaggaaaacatggaaaagagataaaagttacaccgcaatcgagtataacagaagcagagttgacagggtacggaacggttacaatggaatgtagcccgcgtactggattagactttaatgaaatggtattactacaaatggaagataaggcctggctggtacatagacaatggtttctagacttgcccttaccttggctaccaggtgcagacacacaaggaagcaactggatccaaaaagaaactttagttacgttcaaaaacccacatgccaaaaaacaagatgttgtggtgttagggagtcaagagggtgctatgcacactgcattaacaggcgctacagagattcaaatgtcaagcggaaacttgctttttaccgggcatttaaaatgccggctaagaatggacaaattacagctgaaaggaatgagttacagcatgtgtactggtaagtttaaagtcgtaaaggaaatagctgagacacaacacgggactattgttatcagggtccaatacgaaggggatggatcaccatgcaagatcccatttgaaataatggatttggaaaagcgacacgtgctcggtcgactgataacagtcaacccaatagttactgagaaagacagtcctgttaatatcgaagcagagccaccattcggagattcttatatcataatcggcgtagaacctggccaattaaagctctcgtggtttaaaaaagggagctcgattggacaaatgttcgaaactactatgcggggtgcaaaacggatggcaatccttggagacacagcgtgggatttcgggagcctaggaggcgtattcacaagtatcggaaaggcattgcatcaagtatttggggctatatatggggcggcgttttcaggggtctcttggacaatgaaaatactcataggagttgtaattacatggatcggtatgaactcacgatccaccagtctttcggtttcccttgtattggtaggagtagtcaccttgtatctgggtgtaatggtacaggcagactcaggttgtgttgtatcatggaagaacaaagagttaaagtgtggatctggtattttcattactgataatgtacatacgtggacagaacagtataaatttcagccagaatcaccgagcaaactggcaagtgcaatacaaaaagctcatgaagaagggatatgtgggatcaggtctgtgacaaggttggaaaacttaatgtggaaacaaatcactccagaactaaatcatatcttaagtgaaaatgaggttaaactgacaattatgacaggggacatcaagggaattatgcaggcgggcaagagaagtttaagaccccaaccaaccgaactaaaatactcctggaaagcttggggaaaagcaaagatgcttagtaccgaactccataaccacacatttttaatagacgggccagaaaccgcggaatgccccaatacaaacagagcgtggaatagtttagaagtagaggactacggctttggcgtttttactacaaatatttggctaaagctaaaagaacgacaagatgtcttttgtgattccaaattaatgagcgcggcaataaaagataatcgtgcagttcatgctgacatgggatactggatagaaagcgcgcttaacgatacctggaaaatagaaaaagcaagctttatagaggtaaaatcatgtcattggccaaaaagccacacgttatggagcaatggcgtgctcgagtcagaaatgatcataccgaaaaatttcgcaggccccgtgagtcaacataattatcgaccaggctaccacactcaaactgccggaccatggcacttgggaaaattagaaatggatttcgacttctgtgaaggaaccacggtggtagtcacagaagattgcggtaatcggggaccgtctttgaggactacaactgcgagcggtaaactaataacagaatggtgctgtagaagttgtactttaccaccgttacgttatagaggggaagacgggtgctggtatggaatggagatccgtccgttgaaggagaaggaagaaaatttagtaaattctttagtcaccgccgggcatggtcagatagataatttttctctaggagtgctaggaatggcactctttcttgaagaaatgcttaggactcgagtaggaactaaacatgctatattgttggttgctgtttcgtttgtaacactcattacaggtaacatgtcattcagagatctaggccgcgtgatggtaatggtcggagcaactatgacagatgacataggaatgggagtcacgtatttagcgctcctggcagcgtttaaagtgcggcccacgtttgctgccggacttctacttcgaaaattaacttccaaagaattgatgatgacaacaattggtatagtgttactatcccaatcgacaattccggaaactattttagaacttactgatgcgctcgccctagggatgatggttcttaaaattgtgcgcaatatggaaaaataccaactagcagttaccataatggcaattttatgtgttcctaacgcggttatactacaaaacgcatggaaagtttcatgtacaattttagcggttgtaagtgttagccctctactgctgacttcatcacaacagaaagcagactggataccactagcactaacaataaaaggattaaatccgaccgcaatcttcttaactaccctgagtcgcactagtaagaagagaagctggcctttaaacgaagccatcatggcggtaggtatggtaagtatcttggcatcctcattactaaaaaatgatattcctatgaccggtccattagtagcgggagggctgcttacggtttgttacgtgcttaccggacgttcggcggatctggaattggaaagagcggcagatgttcgttgggaagaacaggcagagatatctggaagtagcccaattctgagcataacaattagtgaagatgggagcatgtcgataaagaatgaggaagaggaacaaactttaacaattctaattaggactggacttctagtaataagtggactgttcccagtatcaattcccattactgccgcagcgtggtatttatgggaagtaaaaaaacaacgggccggtgtgttgtgggacgttcccagtccgccgcccgtaggtaaggcagaattggaagacggtgcatataggataaaacaaaaaggaatattagggtactcacaaataggcgcaggagtctacaaggaaggtactttccatacgatgtggcatgttacccgaggtgctgtcctaatgcataaaggaaaaaggatagaaccttcatgggcagatgtcaaaaaagacttaatatcttatggaggcggatggaaactagaaggtgaatggaaagaaggtgaagaagtccaagtcttggcattagaaccaggcaagaatccaagagcagtgcaaactaagcctggtttattcaaaactaatacagggactattggcgctgtttcattagatttcagtccagggacaagtggttcacccatcgtagataaaaaaggaaaagtagtaggattatacggaaacggagtagtcacgcgttctggtacctatgtctcagccatagctcagaccgaaaagtcaattgaggataatcctgaaatagaagatgacatatttcgcaaaaaaagattaactatcatggacttacacccaggggcgggtaaaactaaaagatatcttccagcaattgtgcgcgaggcaatcaaaagaggactaaggactcttatcttagccccgaccagggtagtcgcggcagagatggaagaagcactgcgcggtttaccaatcagataccaaacacccgcgataagagctgaacacactggaagagaaatagtagaccttatgtgtcacgctacttttaccatgcggctcctatcgcctattcgtgtacctaattataacctaataatcatggatgaagcgcattttactgatcctgcctctattgcagcaaggggatacatatcaactcgcgtagagatgggtgaagcagctggtattttcatgactgcgacacctcctggttctagggacccatttcctcaatccaatgcccctataatggatgaagaaagggaaatcccagaaagatcctggaattcgggtcatgaatgggtcactgattttaaaggcaagactgtatggtttgtaccatcaatcaaagccgggaatgatatagcagcctgtttgagaaaaaatggcaagaaagtcatccaattgagtcgaaaaacatttgatagcgaatatgtaaaaacaagaacaaatgactgggacttcgtagtaactacagatattagtgaaatgggagccaacttcaaagccgaacgggttatcgacccccgcagatgtatgaagccagtgatacttacagatggagaagaaagagtcatcctggctggaccaatgccagtgactcatagctcggcagctcaaaggcgcggaagagtaggaagaaacccaaagaatgaaaatgatcaatacatctatatgggtgaacctctcgaaaacgatgaagattgcgcgcattggaaagaagctaaaatgttgctcgacaacataaatacccccgaaggtataataccaagcatgtttgagccggagagggaaaaagttgacgcgatagacggggaataccggctacgaggcgaagcaagaaaaacattcgtggatttgatgcggcgaggagacttaccagtctggttagcctatagagtagctgctgaaggaataaactatgctgatagaagatggtgctttgacggagttaaaaacaatcagattcttgaagaaaatgttgaagttgagatatggacaaaggaaggcgaaagaaaaaagttaaaaccgaggtggttggacgctcgaatctactcagatccactcgccctgaaagaatttaaagaatttgcagctggcaggaaaagtttaactctaaacttgataacggaaatgggtagactcccaactttcatgacccaaaaggcaagaaatgcactagataacctagcagtattgcacacagcggaagccggaggacgagcctataatcatgccctgtcagagttaccagaaacactcgagacactactcctgttaaccctgctagcaactgtgaccggcgggatcttcttgtttttaatgtcaggaaaagggataggaaaaatgacgttaggcatgtgttgtataataactgcaagtgttttattgtggtatgcgcaaattcaaccacactggatcgcagcctccataattttagagttttttttgattgtacttctaataccagaaccagaaaaacagaggacgcctcaagacaatcaactgacatatgtggtcatagctatactcacagtggtcgctgcaactatggccaatgaaatgggtttcctagaaaaaactaaaaaagattttggacttggtgggattgccacgcaacaacctgaatcgaatatattagatatagacctacggcctgccagtgcttggacgttgtacgcggttgccacgacatttattacgcccatgttacggcactctatcgagaatagtagtgtaaacgtctctttaactgccatcgcgaatcaagcgacagtcctaatggggcttgggaaaggttggcccttgagtaaaatggatatcggagtcccattgctagctatcggatgctactcccaagttaatccgataaccctaacagcggcactgttattactcgtcgcacactacgcaataataggtcccggtcttcaagccaaggcgacacgtgaggcgcaaaagcgggctgcagctgggataatgaaaaatcctacagtagacggtattacggttatcgatttggatcctattccgtatgaccccaaatttgagaagcaactaggacaagtaatgctattagtactttgcgtaactcaggttttaatgatgcgtaccacatgggctctttgtgaagcgcttactctcgccacagggccaatttctacactctgggaaggcaacccggggcggttttggaatacaacaattgcagtctctatggctaacatatttagaggatcatacctagcaggggcggggttattatttagtattatgaaaaacacagccaatactaggaggggaacaggaaacacaggtgaaaccttaggagaaaaatggaagaaccggctaaacgcattggggaagagtgaattccaaatctataaaaaatcaggaatccaagaagtcgataggactctagcgaaagaaggaattaagcgaggagaaacagaccatcacgcagtctccagaggtagtgccaaattaagatggttcgtggaaaggaatctagtgacacccgaaggaaaagtgatggatcttgggtgtggcagaggaggatggtcttattactgcgggggcctcaaaaatgtaaaagaagttaagggattgacgaaaggcggtcctgggcatgaagaaccaatccccatgagtacatatgggtggaacttagtacgcctgcagagtggtgtagatgtgttcttcactcccccagagaaatgtgatactttgctttgtgatataggagaatcctcaccaaacccgacagttgaagcagggagaacattacgagtattgaacctagtggaaaattggctaaataacaacacccaattttgtattaaggttctaaacccgtatatgccaagtgttatagaaaagatggaagctctacaaaggaaatatggcggtgctctagtcagaaaccccctctcaagaaactctacccatgaaatgtactgggtgtctaacgcatcagggaatattgtatcttccgttaacatgattagtcgaatgctaatcaacaggttcacgatgaggcataaaaaagctacatatgaacctgacgttgatctagggagtggcactcgaaatataggcatagagtcagaaacacctaatttagatataataggcaaacgaatagaaaaaattaaacaagaacacgaaacttcatggcactatgatcaggaccacccatataaaacttgggcatatcacggaagctatgaaacaaagcaaactggctcggcgtcatcaatggtaaatggagtggttaggttgctaactaaaccttgggatgtgataccaatggtgacacaaatggcaatgactgatactacaccctttggtcaacaacgggtattcaaggaaaaagtagacacgcgcacacaggaaccaaaagaaggaaccaaaaagttaatgaagataactgcagagtggctctggaaagaactgggaaaaaaaaaaactccacgcatgtgtacaagagaagaattcactagaaaggtacgaagtaatgctgctttaggagccatattcactgatgaaaataaatggaaaagcgcgcgagaagctgtcgaggatagtggattttgggagctagttgataaagaacgaaatctccatctagaaggaaaatgcgagacatgcgtttataatatgatgggcaaaagagagaagaaactaggcgagtttggtaaagccaaaggctcaagagccatttggtatatgtggctaggagcgcgttttctagaatttgaggcattaggttttctaaatgaggatcattggttctctagagaaaatagcttatcgggtgtagaaggagaagggttacacaagcttggatacattttgagagatgtctccaagaaggaaggtggcgctatgtacgcagacgatactgcgggttgggacacacgaataacgttagaggatttaaaaaatgaagaaatggtaactaaccatatggaaggagaacacaaaaaactagcagaagcgatctttaaattaacatatcagaacaaagttgtaagggtacaacgacccacaccaagaggtacagttatggacataataagccgaagagatcaaagaggctccggtcaagtggtaacatacggactaaatacattcacaaacatggaggcgcaactaattagacagatggaaggggagggtgtgtttaaaagcatacaacaactaacggctactgaagaaatcgctgttaaaaattggttggcgagagttgggagagagaggctttcgagaatggcgataagtggagatgattgtgtagtaaagcctctagatgaccgatttgcttcagctttaacagcacttaatgacatggggaaggtaaggaaagatatacaacagtgggaaccttcaagaggttggaacgactggacacaagtgccattttgttcacaccatttccacgaattaattatgaaggacggacgtgtcctagtagttccatgtagaaatcaagacgaactaataggtagggcaagaattagtcaaggagcgggatggagtctacgagagaccgcatgtctaggaaaaagttacgctcaaatgtggagtttgatgtatttccatagaagggatctaagactagcagcaaatgcaatatgtagtgccgttccgagtcactgggtgccaacatctaggacaacatggagtatccacgccacgcatgagtggatgacgacggaagatatgctaactgtttggaatagagtttggatccaagagaatccatggatcgaagataaaacaccagtagaatcatgggaagaaataccatatcttggaaaacgtgaagatcaatggtgcgggtcacttattgggttaacgagccgagcaacatgggccaagaacatccaaacggcaattaatcaagtaagatcacttataggaaacgaagaatatacagattacatgccttcgatgaaaaggttcagacgagaagaagaggaagcaggagttctttggtag

SEQ ID NO: 22960 - RNA, 9876 nt, synthetic construct
  misc_feature 1..9876: note = derived and/or modified CDS sequence (opt6) from DENV-2__DQ645556__SS-prME
  source 1..9876: mol_type = other RNA
acagctggggtgataattatgatgatacccaccgtcgtggcttttcacttaacaacacgaaacggagaaccgcacatgatagtaagccgacaagaaaaaggaaaaagtttactttttaaaacggaaaatggagttaatatgtgtactttaatggctatggatcttggagaattatgcgaagataccattacatataattgcccactactaaggcaaaatgaaccagaagacatagattgctggtgtaatagcacgagcacatgggtaacctacggaacttgtacagcaacaggtgaacatagacgggagaaaaggagtgtagctctggtgccgcatgtcggtatgggattagaaacgagaactgaaacatggatgagttctgaaggagcatggaaacatgcacaaagaattgaaacatgggttcttcgtcatccaggatttacgataatggctgcaatcttggcatatactattggaacaacatattttcaaagagtattgatcttcatactgcttacagctgttgcaccgagcatgacgatgagatgtataggtatttctaaccgtgatttcgtggaaggtgtgtcaggaggaagctgggtcgacattgtcctggaacacggttcatgcgtaacaacaatggccaaaaataaacccactcttgacttcgaattgataaaaacagaagccaaacatcctgctacacttcgtaaatactgtatcgaagcaaaactgaccaacaccacaactgcgagtaggtgcccaacgcaaggagaaccttcactaaatgaagaacaagacaaacgttttgtatgcaaacattctatggtcgatagaggatggggaaacgggtgtggtttattcggaaaagggggaatagtaacctgtgcgatgtttacttgcaagaaaaatatggaaggaaaagtagtccaacctgaaaatttggaatatacaattgtaatcacaccacactcaggagaagaaaatgcagttgggaatgatacagggaaacatggcaaagaaatcaaagtcactcctcaaagtagtataactgaagcagaattaacaggctatggaacagtaaccatggaatgttcaccaagaacaggcttagatttcaacgaaatggtgctgctccaaatggaagataaagcatggctagtacacagacaatggttcttggatctcccattaccatggttaccaggagcagatactcaggggtctaattggatccaaaaagaaacattagtaacatttaaaaatccccacgccaagaaacaagatgtggtcgttcttggatcgcaagaaggagcaatgcacacagcactaactggtgcgactgaaatacagatgagttcaggcaatcttcttttcacgggtcatttaaaatgtagattaagaatggataaacttcagctaaaagggatgtcttattcaatgtgcacgggtaaattcaaagtagttaaagaaatagcagaaacacaacatggtactattgttatacgagtccaatatgaaggtgacggcagcccatgcaaaatcccatttgaaattatggaccttgagaaacggcatgtactgggaagattaatcacagttaaccctatagttactgaaaaagattctccagtaaatatagaagccgaacctccatttggggacagctatattataataggagtagaaccgggacaattaaaattgtcatggttcaagaaaggatcttctattggccagatgtttgagacaactatgcgaggcgcaaaacgaatggcaatactgggagataccgcttgggatttcggtagtctagggggagtattcacttcaataggaaaggctttacaccaagtctttggtgctatctatggagctgcttttagcggagtgtcttggactatgaaaattctaataggagtcgtaataacctggataggaatgaacagcaggtcaacaagtctgagtgtgagcttagttcttgttggcgtagtcacattatatttgggagtaatggtacaggcggacagcggctgtgttgtttcttggaaaaacaaagaattaaaatgcggcagtggaatatttataacagacaacgtacatacgtggacagaacagtataagttccagcccgaaagtccatctaaattagcttcagcaatacaaaaggcccatgaagaaggaatatgcggcattaggtctgtaacacggctagaaaatcttatgtggaaacaaatcacacccgaactaaatcatatcctaagcgagaacgaagtcaaactaacaataatgacaggtgatatcaagggtattatgcaagcaggaaagagatcacttagaccacaaccaacggaacttaagtacagttggaaagcatggggtaaagcaaaaatgctgtctacggaactacacaatcacacattccttatcgacggtcccgaaactgccgagtgtcctaatactaatcgtgcttggaactcccttgaagttgaggactatggctttggagtattcacgaccaacatatggttaaaactaaaagaaagacaagatgtattttgtgattctaaacttatgagcgcggcaataaaagataatagagcggtacatgccgatatgggatactggattgagagcgcgttaaacgatacatggaagatagagaaagcatcatttatcgaagttaagagttgtcattggccaaaatcacacacgctatggtctaatggagtactagaatccgaaatgattattccaaagaattttgcaggaccagtctcccaacacaattatcgacctggatatcacacccaaactgccggtccttggcatctaggaaaattagaaatggattttgatttttgtgaaggaacaactgtggtagttaccgaagattgtgggaatagggggccttccctaaggactacgaccgcatcaggaaaattaattactgagtggtgttgccgcagctgtaccttacctccactcagatacagaggggaagatggatgctggtatggaatggagataaggccattgaaagaaaaagaagaaaatctcgtaaattcgctagtcacagcaggacatggacaaattgacaacttttcacttggcgttttagggatggcattatttttagaagagatgcttaggactcgtgtaggtacgaaacatgctattctgttggtagcagtgagtttcgtcacgctaattacagggaacatgagctttagagatctaggtcgtgtaatggttatggtaggagcaactatgacagatgacattggtatgggtgtaacgtatctcgccctactggcagcatttaaagtcaggccaacatttgctgctggtttgttgctaagaaaactgaccagcaaagaactaatgatgacgacaataggtatcgttctactttctcagagtaccatacccgaaacaatactagaactgacggatgccttggccctcggaatgatggtcctcaaaatagtgagaaatatggaaaaatatcagctagcggttacaataatggcaatcttgtgtgtaccgaatgctgtcatattacaaaacgcttggaaggtaagttgtacgatcctcgctgttgtttcggtatcaccattgttactgacaagttcgcagcaaaaagctgactggatccctttagccttaactataaaagggcttaatccaactgctatattcttgacgacacttagcagaactagcaaaaagcgatcctggccgctaaatgaggcaataatggcagtaggcatggtctccatcctcgcatcatcgttactgaaaaacgatataccaatgactggacccttagtagcgggagggctcttaacagtatgttatgtccttacaggcagaagtgctgatctagaactggagcgagcagcagatgtccgatgggaggaacaagctgaaatctctgggtcctctcctatattatcaatcactatatcagaggatgggagtatgtcaatcaaaaatgaagaagaagaacaaacacttaccattttgattagaactggcctcttggtcatctccggattatttcccgtctccatccctattacagctgcagcatggtatttatgggaggtcaagaaacaacgcgccggagtattgtgggacgtacctagcccaccacccgtcggaaaagcggaattagaagacggcgcgtacagaatcaaacaaaagggaattttggggtattctcagataggtgctggagtatataaagaaggcacattccatactatgtggcatgttacaagaggcgctgtactcatgcataaaggaaagagaatagaaccttcttgggccgatgtcaagaaagatctaataagctatggaggaggatggaaattagaaggagaatggaaagaaggtgaagaagttcaagttctagcacttgaaccaggtaagaaccctcgggcagtacaaactaaaccaggattatttaagactaacactggaactatcggagcagtttccctagacttctctcctggtacttcgggctctccaatcgtcgataaaaaggggaaggtcgttggcttatatgggaacggagtagtcactaggtcaggaacgtatgtaagtgctatagctcaaacggagaaaagtatcgaagataatccggaaatagaagatgatatatttagaaagaaacgactcacaataatggatttacatccaggagcgggcaaaaccaagagatacctacctgcgatagttagagaggctatcaaaaggggtctaagaacgcttatactggcacctacaagagttgtcgcggctgaaatggaagaggctttgcgcggcttaccgattaggtaccaaacgccagcaataagagctgagcatacagggcgtgaaatcgtagacttaatgtgtcacgcaacatttacgatgagactactttcaccgatacgtgtacccaattataatttaattataatggacgaagctcacttcactgatccagcgtccatcgccgcccgaggatacattagcacacgtgtagaaatgggggaagcagctggtatatttatgacggctacgcctccagggtctcgagacccgtttccgcaatcaaacgctccaattatggacgaagaacgtgaaataccggaacgtagttggaactctggacatgaatgggttactgatttcaaaggaaagacggtctggtttgttccatcaataaaggccggtaatgatatagcggcctgtttacggaaaaatggcaagaaagttatacaactatctcgaaaaacgttcgactcggaatatgtaaaaacacgcactaatgattgggactttgtagttaccacagacatcagtgaaatgggtgccaattttaaagctgaaagggtaatagacccacgcagatgtatgaaaccagtaattctaacagacggagaggagagagtaattttagcaggtccaatgcctgtaacacactcgtcagctgcacagagaaggggaagagtcggacgtaatcccaaaaatgaaaacgatcaatatatatatatgggagaaccactggagaatgacgaagattgtgctcactggaaagaagctaaaatgctccttgataatattaatacaccggaagggataattcccagtatgttcgaaccggaaagggaaaaggtcgacgcaattgatggagaataccgtctaagaggtgaggcacgaaaaacttttgttgatttaatgcgaagaggggatttaccggtatggcttgcctatcgtgtcgcggcggaagggatcaattacgcggatagaagatggtgtttcgacggagtaaagaacaatcagatacttgaagaaaacgtggaggttgaaatctggactaaagaaggtgaacggaagaaactaaaaccgcgatggctggatgcgagaatatatagtgatccgctagcactaaaagaatttaaagaatttgctgcaggaagaaaatctcttacgctcaaccttattactgaaatgggaagacttccaacgttcatgacacagaaggcgcgaaatgcgttggacaatctcgcagttctgcacacagcggaagcaggaggacgtgcatacaaccatgccctaagcgaattacctgaaaccctggaaacattattactcctaacgcttttagcaactgtcacaggtggtatatttttgttcttaatgtcgggaaagggaattggcaagatgacactaggaatgtgctgcataataacagcaagcgtattactatggtacgcacagatacagccacattggatcgcggcatccattattctagaatttttcctaatagtcctattgattccagaacctgaaaagcaaagaactccccaagataatcaactaacttacgttgtcattgccattttaacagtggtagcggcgacaatggcaaacgaaatgggcttcttagaaaagaccaagaaagattttgggcttggaggaatagctacacaacaaccggaatcaaatatcttagacattgacctgaggccggcatcagcttggacattatacgctgttgctacgacttttataactccgatgctgcgccacagcattgaaaattcgtcagtcaacgttagcctcacagctatagccaaccaagcaaccgtcttaatgggtttaggtaagggttggcctttatcaaagatggatataggcgtgccattactcgcaattggttgttactcacaagtcaaccccatcacgttaaccgctgcactactactcctagtggcacactacgcaatcataggacctggcctccaagcaaaagctaccagagaggctcagaaaagggctgctgcgggcattatgaaaaacccaacggtagatggtatcacagtaatcgacttagacccgataccctacgatcctaagtttgagaaacaacttggtcaagtgatgcttctagtcctatgcgtgacccaagtactcatgatgaggactacatgggctttatgcgaagcgcttacgttagcaacaggcccgatctcgactctatgggagggaaatccaggaaggttctggaatactacaattgcagtcagcatggcaaacatatttagagggagttacctagccggggcaggacttctattctcaataatgaaaaatacagcaaatacaagacgtggaacaggtaatacaggagaaactctcggagagaaatggaaaaaccgactcaacgcgctaggcaaatcggagttccaaatttataagaaaagtggcattcaagaggttgatcgtactttggcaaaagaaggtataaaaagaggtgaaactgaccatcatgcagttagtcgtgggagtgcaaagctacgatggtttgtagaaagaaatttagttaccccagagggaaaagtgatggaccttggctgtggcagaggagggtggagctactattgtggaggtcttaagaatgtcaaagaggtgaaaggtttaaccaaaggcggaccaggtcatgaggaaccaataccaatgtctacttatggttggaacctagtacgccttcaatcgggggtagatgtgttctttacaccaccagagaaatgtgatacactattatgcgacataggagagtcatcgccaaaccccacagttgaggctgggaggacattacgcgtgctaaacttagtggaaaattggttaaataacaatactcaattttgcataaaggtcttaaatccatacatgccttctgttatagagaaaatggaggcacttcaacgaaaatatggaggtgccttggtaagaaatcccctaagccgtaacagtactcatgaaatgtattgggtatcaaatgcttcaggtaacatagtaagctccgtaaatatgattagccgaatgttaataaacaggttcactatgaggcacaagaaagcaacttatgaaccagacgtagatctaggttcaggtacgagaaatataggtatagagagcgaaacaccgaacctagatataataggaaaacgaatagagaaaataaaacaagagcatgagacctcctggcattacgatcaagatcacccttataaaacatgggcataccacggaagttacgaaaccaaacagacaggaagcgcatcatctatggttaatggagtagttcgattactaacaaaaccttgggatgttatccctatggtaactcaaatggcaatgactgatactactccattcggtcagcaaagggtgttcaaggaaaaggttgatacaagaactcaagagcctaaagaaggtactaagaaactaatgaagataacagctgaatggttatggaaagaattaggcaagaagaaaacacctcggatgtgtactagggaagaatttactagaaaagtcagatctaacgctgcacttggagcaatttttacagatgagaataaatggaaaagcgccagagaagcagtggaagactctggattttgggagctagtagacaaggaaagaaatttgcatttagaaggaaaatgtgagacttgcgtctataatatgatgggaaaacgggagaagaaattgggagagttcgggaaagcgaagggaagtcgtgcaatatggtatatgtggctaggggcacgctttttagagttcgaagctctgggatttttaaatgaagaccattggttctcgagagaaaattcgctttcgggggtagaaggggaaggacttcataaattaggttatatcttacgagatgtctctaaaaaggaagggggtgcaatgtatgcagatgatactgcgggatgggatacccgaattacactagaggatctcaaaaacgaagaaatggtgacgaatcacatggaaggagaacacaagaaacttgcagaagcgatattcaaattaacataccaaaacaaggtggttcgtgtccaacgccctactccgaggggtactgtcatggacatcattagtagaagggaccagagagggtcgggccaggtagtaacatacggattaaatacttttacaaatatggaagcgcaacttattagacaaatggaaggagagggcgttttcaaaaatatacagcagttaacggccactgaagagatagcagttaaaaattggctagcacgtgtgggaagagaaagactgagtagaatggccatatctggggatgactgtgtagtaaagccgttagacgatagatttgcaagcgcgctgactgcattaaatgacatgggtaaagtccgaaaagatgtccaacaatgggaaccgtcaaggggttggaatgattggacgcaagtaccattctgttcgcaccattttcatgaacttatcatgaaagatggaagagtactggttgtaccttgtcgaaatcaggatgaattaataggacgagcaaggatttcccagggagcagggtggtcactcagagaaaccgcttgtctcggtaaatcatatgctcaaatgtggtctttgatgtattttcaccgacgcgatttacgtcttgctgctaatgccatttgtagtgcagttccatcacattgggtgccaacaagtcgtacaacttggtctattcacgctactcatgaatggatgaccaccgaagatatgttaacagtgtggaatagagtttggattcaagaaaatccttggattgaagataaaacaccagtcgaaagttgggaagaaattccttatctaggcaaacgagaagaccaatggtgcggttcgctaattggattaacatctagagcgacttgggccaaaaatatacagaccgcaataaatcaagtcagaagtctaattggaaatgaagagtacactgactatatgccgagtatgaaacgattccgaagagaggaagaagaagcgggagtactatggtaa

SEQ ID NO: 22961 - RNA, 9876 nt, synthetic construct
  misc_feature 1..9876: note = derived and/or modified CDS sequence (opt6) from DENV-2__AF204178__SS-prME
  source 1..9876: mol_type = other RNA
accgcaggaatgataatcatgctaattcctactgttatggcatttcatttaactactagaaatggggaaccacatatgatagtgtctcgacaagaaaaaggaaagagcttattgtttaaaacgggggatggtgtaaatatgtgtacactgatggctatggatcccggagaactttgcgaagatacaattacctataaatgccctttactaaaacaaaacgaacccgaagatatcgattggtggtgtaatagtacaagcacttgggtaacttatggaacttgtacgaccaccggggaacatcgcagagagaaaagatcagttgctctagtgccacacgtgggaatgggattagaaacaaggactgaaacatggatgtcatccgaaggggcgtggaaacatgcacaacgaatagaaacgtggatattacgacatcccggattcacaatgatggcggcaatattggcttatacgatagggacaacccatttccaacgggccctgatcttcattctactgacggcagttgcaccctcgatgacaatgcgatgtataggaattagcaatcgagattttgtagaaggggtatcgggtggcagttgggtagatatcgttctggaacacggcagttgtgtgactactatggccaaaaacaaaccaacactggactttgaacttattaaaactgaagctaaacaaccagctacactacgtaaatattgtatagaagcaaaactaaccaatactacaacagattctagatgcccgactcaaggtgaaccctccctcaatgaagaacaggataaaagatttgtatgcaaacactctatggtagataggggttgggggaacggttgtggtctattcggtaaagggggaattgtaacatttgctatgttcacatgcaagaaaaacatgaaaggaaaggtcgtacaaccagaaaacttagaatataccattgtaatcacaccacacagcggagaggaacacgcagtagggaatgataccgggaaacatgggaaagaaataaaaatcacaccgcaatcatcaatcacagaagctgaattaactgggtatgggacggtcacaatgaaatgtagtcccagaacaggattggattttaacgaaatggttttattgcagatggaaaacaaagcctggttagtccaccgacaatggttcttagaccttcccctaccatggttaccaggagcagatacgcaaggatcaaattggatacaaaaagaaacattagtcacttttaaaaatccgcatgcgaagaaacaagatgtagtcgtgctcggttcacaagaaggggctatgcacacagcgttgactggagccacagaaatacaaatgtcctcaggaaatctactttttacgggtcatcttaaatgccgattaagaatggataaattacaattaaaaggaatgtcctattctatgtgcaccggaaaattcaaagttgtaaaagaaatagccgaaacgcaacatggtacaatagtcatacgcgtgcaatacgaaggggatgggtcgccatgcaaaatacccttcgagataatggatctcgaaaaacgacacgtattagggagactgataactgttaatcctatcgtcaccgaaaaagacagtccagtgaatatagaggctgaaccaccatttggagacagttatataataattggtgtcgaaccaggacagctgaaattaaattggtttaagaaagggtcctcgataggacaaatgttcgagactactatgaggggcgccaaaagaatggcgatactaggcgacaccgcatgggactttgggtcactaggaggcgtttttacgtcaataggcaaagctctacatcaagtttttggagcaatttacggtgccgcattttcaggcgtaagctggactatgaaaatattgataggggtgatcatcacttggataggaatgaactcaaggagcacatcattaagcgtttcgttagtgttggtaggtgtcgtaactctttacctaggagtgatggtacaagcagatagcggatgtgtggtttcctggaaaaataaagaattaaaatgtggttctgggatatttattactgatgacgtgcacacttggacagagcaatacaaatttcagcctgagtcaccttcaaaactagctagcgctatacagaaagcacacgaagaaggtatatgtggaataagaagtgtgaccagacttgaaaaccttatgtggaaacagattacgccagaactaaaccacatacttagtgaaaatgaagtaaaattaaccataatgaccggtgacataaaaggcattatgcaagcagggaaacgaagtctgcggccacaacccacagagctaaagtattcgtggaaaacgtggggcaaggctaagatgctctcaactgaaagccacaatcaaacgttcctaatcgatggacctgaaacagcagaatgtccaaatacaaaccgagcatggaactcactagaagtagaagattatgggttcggcgtctttactaccaatatttggttaaaactacgtgaaaaacaagatgtcttttgcgattcaaaactaatgtcagctgtaatcaaggacaatagagccgcacatgcggacatggggtattggatagagtcagccttgaatgatacttggaaaattgagaaagcatcttttatagaagtaaagtcttgtcactggccaaaaagtcataccctctggtctaatggggtattagaatcagaaatgatcatacccaaaaacttcgcaggccctgtgtcacagcataactacagaccaggatatcacacacagacagcagggccatggcatcttggaaaattggaaatggattttgacttttgtgaagggacaacagtagtagtaacagaggattgcggcaaccgtggaccgtcattgcgtacaaccacagcttcaggtaaacttattacagaatggtgctgccgttcttgcacattaccacccctacgttacaggggtgaagacggatgttggtatggaatggagatacgtccgctaaaggaaaaagaagaaaatctcgtaaattcactggtaacagccggacacgggcagatagacaattttagcctgggcgtccttgggatggccctctttctggaagaaatgttaagaacaagagtgggtacaaaacatgccattctcttggtagcggtaagtttcgttactttaattaccgggaatatgagttttcgtgatctagggagagttatggtaatggtaggagctactatgacagacgatattggcatgggagtcacctacttggcccttttagccgcctttaaagttcgaccaacatttgcggctggactattgctacgtaagttaacatctaaagagttgatgatgacaaccataggaatagttcttttatctcagtcgaccatcccagaaacgattctggaactaacggatgcattagccttaggcatgatggtattaaaaatggtacgtaagatggagaaatatcaactggcagtaacaattatggcgattctatgcgtgcctaacgcagtcatattacaaaacgcatggaaagtttcatgtacaatactagcggtcgtgagtgtatctcctctgtttattacatcgtctcaacaaaaagctgattggatacctttggcactaaccataaagggcctgaacccaaccgcaatattcttaacaaccctatcgaggacaaataaaaagaggtcatggcctttaaacgaagccatcatggctgttggaatggtaagtatcctcgcaagttcacttctcaaaaatgacatacctatgaccggtcccctggttgccggtggactcttgacagtctgttacgtacttactggcagaagtgccgatttagagcttgagagagctgctgatgtgaagtgggaagatcaagcggaaattagtggatctagtccgatcctatcaataactatatccgaagacggatcaatgagcattaaaaatgaagaagaagaacaaatcttaacaatattaattagaactgggttgctagtaatttcaggtctattcccagttagcatcccgataactgctgccgcatggtacttatgggaagtcaagaaacaaagagccggagtactatgggacgtcccatctcctcctcctgttggaaaagctgaattagaagatggagcatataggatcaaacagaagggcattctaggttattctcaaataggtgctggagtatataaagaaggcacattccacacaatgtggcatgtaaccagaggtgcagttctaatgcataaaggaaaaagaatcgaacctagctgggcagatgtaaagaaggatttaatctcatatggcggaggatggaagctggaaggcgaatggaaggagggagaagaggttcaggtattggcactcgaaccaggcaaaaatccacgagccgtacaaacaaagccaggattgtttaagaccaacgccggtactataggagcggtaagtcttgacttttcaccgggaacaagcgggagtccaattattgataagaaaggaaaggtagttgggctctatggtaatggagtggtgacacgatctggagcatacgtaagtgccattgctcaaacggagaaatcgatagaagataacccagaaattgaagacgacatattcagaaaaagaaaattgaccataatggacttacacccgggcgcgggtaaaactaaaaggtatctcccagcaattgtaagggaagccataaagagaggcctaagaacacttattctcgctccaacaagggtagtagcagccgagatggaggaggccctcagggggctacccatacgttatcaaacaccggcaattcgggccgagcatacgggaagagagattgtagacctgatgtgccacgctacttttacaatgcgacttttgagtccagttcgcgtgccaaattacaatttgattataatggatgaggcccacttcactgaccctgcgagtattgctgccagaggttacattagtactcgtgtagaaatgggtgaggcagctgggatatttatgactgcaacccctcccggtagccgtgacccctttcctcaaagtaatgctccaataatggatgaagaacgggaaataccagaacggtcatggtcaagcggtcacgaatgggtaaccgattttaaaggtaagactgtttggttcgtaccatccatcaaagccggcaatgacatcgcggcctgtctcagaaagaatgggaagaaagtaattcagttatcgcgcaagaccttcgactccgaatatgtaaaaacccgtacaaacgattgggacttcgtagtcacaaccgatattagcgaaatgggcgctaatttcaaggctgagagggtcattgatccgcgaagatgcatgaaaccagtgatcttaactgatggtgaagagagagttattctagctggaccaatgccagtaacacactcatcggcagctcagaggagaggccgtataggaagaaatcccaagaacgaaaacgatcagtatatatatatgggtgagcccctagagaacgacgaggactgtgcacactggaaagaggcaaaaatgttactagataacataaacacacctgaaggaatcataccctctatgtttgagccagagagggagaaggtcgatgcgatagacggcgaataccgattacgtggagaagcaaggaaaacttttgtggatttaatgaggagaggggatctacctgtttggttagcttatagggttgccgctgaagggataaactatgccgacaggagatggtgcttcgatggaatcaaaaacaatcaaatactcgaggaaaatgtagaagttgaaatatggacaaaagagggtgaaagaaagaagttaaaaccacgatggttagacgccaagatctacagtgatcccttagcgctaaaagaatttaaagaatttgcagcaggacgaaagagcttaacactcaatctcattacggaaatgggaagactacctacttttatgacacaaaaagcacgcgacgcgctggacaatctggctgtcctacatactgcagaagccggcggcagagcatacaatcatgcattgtccgaattaccagagacacttgagactttactactcttgacattactagcgactgtaaccggtgggatcttcctgtttctaatgagtggtagaggtatcggaaagatgaccctagggatgtgttgtataataacggcttccattttattatggtacgcacagatacagccacactggatcgcagccagtataatccttgagttcttcttaatagtattgttaattccagaacccgaaaagcaacgaacacctcaagacaatcagcttacgtatgtcgttatagcgatattaacggtagtcgccgctacaatggctaacgaaatgggatttctagagaaaaccaagaaggaccttggcctggggagtatcacgacacaacagcccgagagtaacatactggacatagacttgaggcctgcaagtgcttggacgttgtacgccgtcgctacaacattcgttacaccaatgctccgacactccattgagaatagtagcgtgaacgtgagcctaactgctatagctaatcaagccactgtcctaatgggcctgggaaaaggttggcctttaagcaaaatggatattggcgtcccacttctggcaattggttgttacagtcaagtaaatcccatcacactaacagcagcgttattcttattagttgcacactatgcaataattggtcctggattacaagccaaggctacacgagaagcgcagaaaagggcagcggctggcataatgaaaaatccgacggttgatggaattaccgtcatagatttagatccaataccgtatgacccgaaattcgaaaaacaattaggccaagtaatgttattggttctatgtgtaacacaagtgttaatgatgcgaacaacttgggcattatgcgaagcactgaccctcgccaccgggccaatatcgactttatgggaaggaaatccaggacgtttctggaacactacaatcgccgtttcgatggctaacattttccgaggatcatatctcgccggtgcgggcttattattttctattatgaaaaacactacgaacacgcgaaggggaactggaaatattggagaaactttaggtgaaaaatggaaaatacgattgaatgcactaggtaaatcagagtttcaaatctataagaaatcgggaatacaggaggtagacaggacattagccaaagaaggaataaaaagaggagaaaccgatcaccacgcggtaagtagaggcagcgccaaactgagatggttcgtagagcgaaacatggtgacgccggagggaaaagtcgtggacctaggttgtggaagaggaggatggagttattactgcggaggcttaaagaacgtacgagaagtgaagggtctaactaaagggggaccaggacatgaagaaccgatccctatgtcaacctatggatggaatttagtacggctacaatcaggggtcgacgtattcttcactcctccagaaaaatgcgacactctgctatgcgacataggtgaaagttccccaaacccaacagtcgaagccggccgaactcttcgagtgttaaatttggtagaaaattggttgaacaataatacgcaattttgtattaaagtcctcaatccgtacatgccaagtgttatagagaaaatggaaacattacaacgtaagtatggtggtgcacttgttggcaacccactaagtagaaactcgactcatgaaatgtactgggtttcgaacgcatccggtaatatagtctcctcggttaatatgatatcaagaatgttaatcaacaggtttacgatgagacataagaaagcaacttacgaaccagacgttgacttaggaagtggcacgcgaaatatcggaattgaatcagaaatcccaaaccttgatataataggaaaacggatagagaaaataaaacaggaacatgaaacatcatggcattacgaccaagaccatccatataaaacctgggcatatcatgggagctatgaaacaaagcaaacaggctcggcatctagtatggtaaacggagtagttcgtttgcttactaaaccgtgggatgtggttccaatggtaacccaaatggcaatgacagacacaacaccgtttggacaacaacgtgttttcaaggaaaaagtcgatacccggacccaagaacctaaagagggcaccaagaaacttatgaaaatcacagctgaatggctatggaaagaattaggcaagaagaaaacaccgagaatgtgtactagagaagagttcaccaggaaagtaagatcgaacgcagcattgggtgcaattttcacagatgaaaacaaatggaaaagcgcacgagaggctgtagaagacagtagattttgggagttagtagataaagagcgtaatctgcatctagaaggcaaatgtgaaacatgtgtttataacatgatgggtaaacgagagaagaaacttggtgagtttggaaaagcaaaaggctccagagctatttggtatatgtggctcggagcacgatttctcgaatttgaggcgcttggctttctcaacgaagaccactggttcagtagagaaaattccctaagtggcgtagaaggagaaggactatacaaattagggtacatactacgagatgtcagtaagaaagagggtggtgccatgtatgctgatgatactgccgggtgggacacgaggataacattagaagatctcaaaaatgaagaaatggtcacaaatcacatggaaggcgaacataaaaagctagcggaagcaatattcaagctgacgtaccagaacaaagtagtaagagtgcaaagaccgacacctcgaggcacagtcatggacataattagccgaagagatcaaagagggtcaggccaagtaggcacgtacggactaaatacgtttacaaacatggaagcccaattaataagacagatggaaggagaaggagtttttaaatcaatacaacatctaacggtaaccgaagaaatcgctgtccaaaactggctagctcgagttaggcgagaaagactatcgaggatggctatatcaggagacgattgtgtggtcaaaccacttgatgatagatttgcatcagcactaacagctctaaatgacatggggaaagtgagaaaagacatccagcaatgggaaccctccaggggatggaacgattggactcaagtccctttctgttcccaccacttccacgaattaataatgaaagacggccgagtcctagttgtaccgtgcagaaatcaagatgaactaataggacgtgctagaatatctcaaggtgctggatggtcgcttagagaaactgcgtgtctcggcaaatcatatgcacaaatgtggtcattaatgtatttccaccgaagagatttgcgccttgcagcaaacgcaatttgtagtgcagtgccaagtcactgggtaccaacttcaagaacaacatggtcaatacatgctaagcacgaatggatgactactgaagatatgttaactgtctggaacagagtctggattcaggaaaatccctggatggaagacaaaaccccagtagagagttgggaggaaattccataccttggcaaaagagaagaccaatggtgcgggtctcttataggtttaactagcagagcaacatgggccaaaaatatccaaacagctatcaatcaggtcagatctttaataggcaacgaagaatatacagattacatgcccagtatgaaacgattcagacgggaggaagaagaagctggagttctttggtga

SEQ ID NO: 22962 - RNA, 9876 nt, synthetic construct
  misc_feature 1..9876: note = derived and/or modified CDS sequence (opt6) from DENV-2__AF204177__SS-prME
  source 1..9876: mol_type = other RNA
acggcgggtatgattataatgttaatcccaactgttatggcattccatctaacaacacgcaatggagaaccacacatgatcgtctctcgtcaagaaaaaggaaaatctctattgttcaaaacgggagacggtgtaaacatgtgtacgctgatggctatggacttgggtgaactttgtgaagatacaataacatacaaatgtcctttactcagacaaaatgaacctgaagatatagactgttggtgtaattcaacaagcacatgggtaacctacggtacttgtacaactacaggggaacatagacgtgagaaaagatccgtagccttagtaccacatgtaggaatgggactagaaacgcggactgaaacatggatgtccagtgaaggtgcatggaaacatgctcagcggattgaaacttggattctgcgacatccaggattcacaatcatggcagctatacttgcttataccatcggaactacccattttcaaagagcgctaatatttattctcttaacagcagttgcaccgtcaatgacaatgaggtgtattggaatcagtaatcgagatttcgtcgaaggcgtaagtggcggttcatgggttgatatagtattagaacatggatcttgtgtaacaaccatggccaaaaataaaccaaccctagatttagaacttataaaaacagaagcaaaacagtctgcaacattacggaaatattgtatcgaagctaaactaactaataccactactgaaagccgatgtcccacacagggtgaacctagtttgaatgaagaacaagacaaacgattcgtatgtaaacattcgatggttgacagaggatggggtaacggatgtggactcttcggaaaaggaggtatcgttacttgcgctatgtttacttgcaagaaaaatatgaaagggaaagtggttcaacctgaaaatttagaatacaccatagtcattacaccccatagcggcgaagaacatgcagtggggaatgatactgggaaacatggtaaagaaataaaaatcacacctcaatcaagcatcaccgaagcagaactaacagggtacggaactgtcactatggaatgctcgccaaggacaggactggactttaacgaaatggtcttgttgcagatggaaaacaaagcgtggcttgtacacagacaatggttcctcgatctacccttaccctggttgcctggcgcagatacacaaggatcaaattggatacaaaaagaaacacttgtaacgtttaagaacccacatgcaaagaagcaagatgtggtcgttttaggttcgcaggaaggggcaatgcatacagctctgaccggagcgactgaaatacaaatgagcagtggaaatttattattcacaggtcatctaaaatgtcggctacgaatggataagttacaattgaaagggatgtcatattcaatgtgtacagggaagtttaaagtggtcaaagaaattgctgaaacacagcatggcacgatagtaataagagtacaatatgaaggcgatggtagtccttgtaaaattccattcgaaataatggatctagagaaacgacatgttctaggaaggctcataaccgtaaatcccatagtcaccgaaaaggattccccggtgaacatagaagcagaaccacccttcggcgacagctatataataataggagtagaacccggccagttaaaactaaactggttcaagaaaggaagttcaataggacaaatgttcgaaacaaccatgcgtggagcaaagcgtatggcaatcctaggggatacagcatgggactttggatcacttggtggtgtcttcacatctataggaaaagccttacatcaagtttttggagcaatatacggcgcagccttttcaggcgtgagttggactatgaaaatactaattggtgtaataattacctggataggaatgaactctcgtagcactagcctctctgtgagtctagtactcgttggagtcgtaactctttatttaggggtaatggttcaagctgattcgggctgcgtcgtatcttggaaaaataaggagttgaagtgtggtagtggaatctttattaccgataatgtacatacgtggactgaacaatacaaatttcaaccagaatcacccagcaagttagcctcagctatacaaaaagctcatgaagagggtatatgtggtataagatctgtcacgagactagaaaatttaatgtggaagcaaataacaccagagttaaatcatatcctatctgaaaacgaggtaaaacttacgattatgacgggtgatataaaaggtatcatgcaagctggaaaaagaagcctccggccacaaccgacggagctaaagtactcttggaaaacgtggggaaaggctaaaatgctcagcactgaaagccataatcaaacattccttatagatggtccagagacagcagaatgtcccaacacaaatagggcatggaactcgttggaggtcgaagattatggattcggagtattcaccacaaacatatggctaaagctccgcgaaaagcaggatgtattctgcgacagtaaattaatgagtgctgcgattaaagataatagagcggtacatgcggatatggggtactggatcgagtcagctctaaatgacacatggaaaatagaaaaggcatcttttatagaagttaagtcctgccattggcctaagtcccacactttatggagcaatgaagtcttagaatccgagatgataattcccaaaaatttcgccggtcctgttagtcaacataattatcgtcctggatatcatacacaaacagcagggccatggcatttaggaaaattggagatggactttgacttttgcgagggaacgacggttgtagtaacagaggattgtggtaatcgaggacccagcttacgaaccactacagcatctggcaaattaataacagagtgctgctgcagatcttgcacactaccgccccttcgatataggggagaagatggttgctggtacggaatggagataagacccctcaaagagaaagaagaaaatctagtaaacagcctggtcacggcaggtcatggtcaaatagacaacttttcattgggggttttgggcatggcgctattcctggaagaaatgttgagaacgagagtcgggaccaaacacgctatcctcctcgtggctgttagtttcgttaccttaattaccggtaatatgtcgtttagagacctgggtagagtaatggtaatggttggagcaacgatgaccgacgatatcggcatgggggtcacatacttggcacttttagcagcattcaaggtacgacccacattcgcagcaggtctcttattaagaaaattgacaagtaaagagctaatgatgacaactattggaatcgttctcctatcgcaaagtactatcccagagaccatattggaattgaccgatgctctagcgctaggaatgatggtattaaagatggtgcgaaaaatggagaaataccaacttgctgtcaccatcatggccattttatgcgtccctaatgccgttatcttacagaatgcgtggaaagtgtcctgtacaatcctggctgtcgtatctgtctcacccttattcctgacgagttcacaacagaaagcagattggattccactagcattaacaataaagggtctcaacccaacagcgatatttttaactacattaagcaaaactaacaagaaaagaagttggcctctcaatgaagcaataatggcggtgggtatggttagtattttagcatctagtttattgaaaaacgacatacctatgactggtcctcttgtagcaggaggcttactgaccgtctgttacgtattaacaggtaggtcagcagatctagaattggaaagagcggctgatgtaaaatgggaggatcaggccgagatcagtggaagttcaccaatcttatcaatcacaatatccgaagacggcagtatgagtattaagaacgaagaggaggaacaaatacttacgatattaatacgaacgggtttgctcgtgatctcaggactattcccagtttctataccaataacggcagccgcatggtatctttgggaagttaagaaacaaagagcgggagtactctgggacgtcccttctccacccccagtgggaaaagccgaattggaagacggtgcttacagaataaaacaaaaaggcatcttaggatatagccaaataggggccggtgtatataaggagggcactttccatacaatgtggcatgtcactagaggtgcagtcctaatgcacaagggcaaacgaatagaaccaagctgggccgatgtcaagaaagacttgattagctatgctggcgggtggaaacttgagggcgagtggaaagagggagaagaggtacaggtccttgcattagaacccggcaaaaatccaagggcagtccaaaccaaaccaggcttatttaaaactaatgctggtacaattggggcagtttcattagacttttcacctggaacgtctggttcacctataatcgataagaaaggaaaagtagtaggtttatacggcaatggtgtagtcacgaggagtggtgcgtacgtctctgctatagcacaaactgagaaaagtatagaagataatcctgaaattgaagacgatatatttagaaagagaaaactaactataatggacttacatccaggagcgggaaaaacaaaacgatatttacctgcgatcgtcagagaggcaattaagagaggactcagaacactaattttggcaccaacaagagtggtcgccgccgaaatggaggaagcactaagagggctccccatacgataccaaactcctgcaattagggccgagcacaccggacgtgaaatagtagacttaatgtgccatgcaactttcacaatgcgcctgttatctcctgtaagagttcccaattataatttaatcataatggatgaagctcattttacagatccagctagcatcgcggcacgtggatatatcagtaccagagtcgagatgggcgaagcagccggcatattcatgacagccaccccacccggaagtcgagatccattcccccaatcaaatgcacctataatggacgaggaaagagagattccagaaagaagttggtcatcgggtcatgaatgggtcacagacttcaagggtaaaactgtgtggtttgtaccctcaatcaaagcgggaaacgatatagccgcgtgccttcgaaagaatgggaaaaaggttattcagttatccagaaaaacgttcgacagtgaatatgtgaagaccagaacaaacgactgggactttgtggtaacaacggatatatctgaaatgggagccaattttaaagctgagagagtaattgatccaagacggtgcatgaaacctgttatcctaacagatggagaagaacgcgtcatactcgcaggaccaatgccagtcacacattcaagcgccgcccagaggagaggaagaatcgggaggaatccaaagaatgaaaatgaccaatacatctacatgggggagcccctcgagaatgacgaagattgtgcccattggaaagaagctaaaatgttacttgataatataaacactccggaaggtataatcccgagcatgtttgagccagagcgagagaaggtagatgcaattgacggagaatatcgactccgtggcgaagctagaaaaacattcgtagacttaatgagacgaggagaccttcccgtttggcttgcatatcgagtggcagcagaggggataaattacgccgatcgaagatggtgtttcgatggaatcaaaaacaatcaaattttagaagagaatgtcgaagtagagatttggacaaaagaaggcgaacgcaagaaattgaagcccagatggctagacgcacgtatctacagtgatccgttagctttaaaggaatttaaagaatttgcagccggtagaaaatcacttacgcttaatttaatcacagaaatgggtaggctaccgacattcatgacacaaaaagcaagagatgctcttgataatctagcagtattacacacggctgaagcgggtgggagggcctataatcatgcgctcagtgaactacctgagacactagagactctgttacttttaacattattagcaacggttacgggcggaatattcttattcctaatgtcgggaagaggaatcggtaaaatgactctggggatgtgttgtataataacagcttcaatacttctttggtatgctcaaattcagccgcactggatagctgcatcaataatactcgagttcttcttgatagtgttgctaatccctgaacccgaaaaacaacgtaccccacaggataatcaactaacgtatgtagtaatcgcaatactaacagtggttgcagcaactatggccaacgaaatggggtttctggagaaaacgaagaaagacttaggacttggctctattacaacacaacaaccggaaagcaacattttggacattgatctacgtcctgccagtgcctggacactatatgcagtcgcaaccacattcgttacccccatgttaaggcacagcattgaaaatagtagtgtcaatgtaagtctaacagccatcgcaaatcaagcaacagttcttatgggactagggaaaggatggcccctttctaaaatggacataggtgtaccattactagctataggatgttattcacaagttaaccctataacgctaacagcagctctatttctactggttgcacattacgcgataataggaccgggattgcaagcaaaagcaacaagagaggctcagaaaagggccgctgcaggtatcatgaaaaatcctacagtggatggcataacggtaattgatttagatcccatcccttatgatcctaaattcgagaaacaattaggacaagttatgctactggtcttatgtgtaacacaggtactaatgatgagaacaacttgggcattgtgtgaggctctaacgctcgccaccggacctatatcaacgttatgggaaggtaatcctgggcgattctggaacaccactatagctgtatcgatggccaatattttcaggggaagctacttagctggtgccgggctactattttcaattatgaagaacactacaaacacaagacgtggtactggcaatataggagagacgctaggagaaaagtggaaaagccgattaaatgctctcggcaaatcagagttccagatatacaagaaatcgggtattcaagaggtggaccgaacacttgccaaagaaggaatcaaacgtggggaaactgatcaccacgcggtgtccagaggttcggcaaaattacgatggtttgttgaacgaaatatggttactccggaaggtaaagtagtcgacctcggatgcggtcgaggaggatggtcttattattgcggaggactaaagaatgttcgcgaagtcaaaggtttaaccaaaagaggtccaggacacgaggaaccgatcccaatgtcaacttatggctggaatctggtaaggcttcaatcaggagtggacgtatttttcaccccgccagaaaaatgtgacacattactatgtgacatcggagagtcatctcctaaccctactgtagaagcaggaagaacattacgtgtactaaatttagttgaaaactggttaaataataacactcaattctgtatcaaagttctaaatccctacatgccaagcgtgattgagaaaatggaggctttacaacgaaaatacggaggggccctagttagaaaccctcttagtagaaattcgactcatgaaatgtattgggtttccaatgcaagcggaaacatagtctcatctgtaaatatgatttctagaatgttaatcaatagatttacaatgagacataagaaagcgacttacgaaccagatgtggatctcggtagtggaacaagaaatattggaatagaatcggagattccgaatctcgacattatagggaaaagaatagagaaaattaagcaggaacatgaaacgttatggcactatgatcaagatcatccgtataaaacctgggcatatcacggcagctatgaaaccaagcaaacgggaagtgcatcctctatggtcaatggcgtggtacgtctgctaacaaagccatgggatgttgttcccatggtaacccaaatggctatgactgatacaactcctttcggccagcaaagggtattcaaagaaaaagtagatacgcgaacacaggaacctaaggaaggtactaagaagttaatgaaaataacagctgaatggttatggaaagaattgggcaaaaagaaaactcctaggatgtgcacacgggaagagttcacaaggaaagtaagatctaatgctgctttgggcgcgatctttacagatgaaaataaaaggaaatcagctcgagaagcggtggaagatagtcggttttgggaattagtggataaggaaagaaatttgcacctcgaagggaaatgtgaaacttgcgtttacaacatgatgggaaaaagagagaagaaactgggagagttcggcaaagcaaagggaagtagagccatttggtatatgtggctaggcgctagatttctagagttcgaagccttgggatttttaaatgaagaccactggttcagcagagagaatagcctatcaggcgtagaaggtgaggggcttcataaactaggctatattctcagagacgtcagcaagaaagaaggtggagctatgtacgcagacgacacggcaggatgggatactcgcataacgctagaagatctgaaaaatgaagaaatggtaactaatcacatggaaggagaacataagaaattggccgaagcaatctttaaattaacttatcaaaataaagtggtccgcgtacaacgccctaccccacggggcacggtcatggatattataagtagaagagaccaaagaggttcaggccaggtcggaacatatggattaaatacattcactaatatggaagcgcaacttattaggcagatggaaggtgaaggagtatttaaatcaatacaacatctaactgtcacggaggaaattgctgtacaaaattggctggctagagtaggaagggaaaggttaagtcgaatggccattagcggagacgactgcgtcgtaaaaccgctcgatgaccgattcgcatctgctctaacggcattaaatgacatgggaaaggtgcgcaaggacatacaacaatgggaaccctcacgggggtggaacgactggactcaagtacccttttgcagtcatcattttcatgaacttataatgaaggatggaagagtcttggttgttccatgccgtaatcaaaatgaacttattgggagagcaagaataagccaaggtgcagggtggtcactccgagaaacagcatgtctaggtaagtcctatgcgcaaatgtggtcgttaatgtattttcatcgcagagaccttcgtttagcagctaatgcaatatgtagtgccgtcccatcacattgggtgccgacaagtagaaccacctggagcatacatgctaaacatgaatggatgactaccgaggatatgctaactgtttggaatagggtatggatacaagaaaacccatggatggaagataagacatccgtagaatcttgggaagagatcccctatttgggtaaaagagaagatcaatggtgtggtagcctaataggactaacaagccgagcaacgtgggccaaaaatatacaaactgcaatcaaccaagtgcgaagtttgatcggaaatgaggaatatacagactacatgccttcaatgaaacgatttaggagagaagaagaggaggccggtgtattatggtaa

SEQ ID NO: 22963 - RNA, 9876 nt, synthetic construct
  misc_feature 1..9876: note = derived and/or modified CDS sequence (opt6) from DENV-2__DQ645540__SS-prME
  source 1..9876: mol_type = other RNA
acagctggtgtaattattatgatgatacccacagttgtagcattccatctaacaactagaaatggtgaaccacatatgatagttagcagacaagaaaaaggaaaaagtttattgtttaaaacagaaaatggggttaatatgtgcacattaatggcaatggatctgggtgaactgtgtgaagatactataacttataattgtcctctgttaaggcaaaatgaacccgaagatatagactgttggtgtaactccacttccacatgggttacatacggaacatgtacagcaacaggtgaacataggcgtgagaaaagatctgtagctctcgttcctcatgtaggcatgggtctcgaaacaagaactgagacatggatgagctcagaaggagcatggaaacacgcccaacgaatagagacttgggttctacgacatccaggtttcactattatggcagcaatacttgcttatacaataggaactacatatttccagcgtgttcttatttttattcttctaacagccgtagcaccatccatgacaatgcgatgcattggaatcagcaacagggatttcgtagaaggagtctctggcggcagttgggtagatatcgttctagaacatggctcctgtgtaactactatggcgaaaaacaaaccaacattggattttgaacttactaaaactgaagctaaacatccagcgacacttaggaaatattgcatcgaagcaaaattaacaaacacaacgacagcatcaagatgtccaacgcaaggagaaccttcactaaacgaagaacaagacaaaagatttgtatgtaaacacagtatggtagacaggggctggggcaatggatgcggcctattcggtaaaggcggaattgttacgtgcgccatgtttacctgtaagaaaaacatggaaggaaaagtagtacaaccagaaaacttggaatatacaattgttattactccacactccggggaagaaaatgcggtcggtaatgacacaggtaaacacggtaaagagattaaagtaacgccccaatcaagcataacagaagcagagttaacgggctatggaaccgttactatggaatgtagcccccggacagggttagacttcaatgaaatggtattattacagatggaagataaagcatggctcgtccaccgacaatggtttcttgatctacctcttccatggctaccaggagctgatactcaaggatcaaattggatacagaaagaaactctggttacttttaaaaacccccacgctaagaaacaagatgtcgtggtactggggtcacaagaaggtgcgatgcacacagcacttacaggcgcgacagaaatacagatgtcctcgggaaatttactattcacaggacatctaaaatgtaggctaaggatggataaactacaactcaaaggcatgagttattccatgtgcacagggaaattcaaagttgtgaaagaaatagcagaaacacaacacggcacgatagtgatacgcgttcaatacgaaggagatgggtccccgtgtaaaattccatttgaaatcatggatttggaaaaacgtcacgtactaggaagattaattacagtaaatccgatagttacagaaaaagatagtccagtaaatatagaggcagagcctccgttcggagatagctatataattattggtgtagaaccaggacaactgaaattgagctggtttaagaaaggatcaagcattggacaaatgtttgaaaccacaatgaggggcgcaaaaaggatggctatactaggtgatacagcatgggacttcgggtcattaggtggcgtattcacctccataggaaaggctttacaccaagtattcggcgcaatatatggggcagcattttcaggtgtaagctggactatgaaaattcttatcggcgtggtaataacttggatagggatgaactccagatcgacatcattatcggttagtttggtcctcgtaggtgtggtaactctctacctcggtgttatggtacaagctgacagcggttgtgtagtatcttggaaaaacaaagaattgaaatgcggatcgggtatattcattacggacaatgtgcacacttggacagaacagtacaaatttcagcctgaaagcccatcgaaactagcaagcgcaattcagaaagcacacgaggaaggaatatgtgggattcggtcggtgactagactcgaaaatcttatgtggaaacagataacacccgaattgaatcacatactgagcgagaacgaggtaaaactgacgattatgacgggagatattaaaggaattatgcaggcgggtaaacgcagcttacgtccccaaccaacagaattaaaatactcctggaaggcttggggaaaggcaaaaatgctttccaccgaattgcataatcatacgtttcttatagatggtccagaaaccgctgagtgccccaacaccaatcgagcatggaactctttagaagtagaagactacggatttggggtttttaccactaatatatggttaaagttaaaagaacggcaagatgttttctgtgacagtaaacttatgtctgcagcaataaaagataatagagccgtacatgccgatatggggtattggatagaatcagctctaaatgacacatggaagatagagaaagctagttttatcgaggtaaaatcatgccattggccgaaatctcataccctctggagcaatggcgtacttgagtcagaaatgatcattcctaaaaattttgccggccctgtcagtcaacataattatcgaccaggctaccatacacaaactgcaggtccttggcacctcggcaagctcgagatggatttcgatttttgtgaggggacgacagttgtagtaacagaagactgtggcaatagaggcccatcattaagaacgacaacggccagcggaaaactgatcactgaatggtgctgtaggtcatgtactctaccccctttgagatacagaggagaggatggatgttggtatggtatggaaattagacctttgaaagaaaaagaagaaaatttagttaattcattggttactgctggccacggccaaatcgacaacttttcattaggtgtattgggaatggcgttattcctagaagaaatgttaagaactagagtcggaacaaaacatgccatattgctagttgcggtcagctttgtaacattgataactggtaatatgagctttagagacttgggaagagtcatggttatggtaggagccacaatgacagatgacataggcatgggagtcacgtacctggccttgttagcagcatttaaagtaagacccacatttgccgctgggctgttattaagaaaactaacgagcaaagagttaatgatgactacaattggtatagtgcttctatctcaaagtacgatacctgaaactattttagaattaacagatgcgcttgcactgggaatgatggtcctcaaaatagttagaaatatggaaaagtatcagctagcggtaacgattatggcaatattatgtgtacctaacgcagtaatattgcaaaatgcctggaaagtaagctgtaccatattggcagtggtatctgtgagcccgttattgctgacctcttcacaacaaaaagctgactggataccattagccttaactataaagggactaaaccccacagcaatatttctaaccacattgtcccggaccagcaagaaaagaagttggcccttgaacgaagctatcatggctgtaggaatggtttcaatactagcatcatcgctacttaaaaatgacatcccaatgacaggacctctagtagctggtggtttactaacagtttgttatgtactgactggccgcagtgctgacttagaactggagagggctgccgatgtccgatgggaagaacaagcagaaatctcaggtagttcgccaatactaagcataacaatttcggaggatggctcaatgagtatcaaaaatgaagaggaagaacaaacactaactatcttaataagaactggtctacttgtaataagtggactttttccagtcagtattccaattactgccgcggcatggtatttatgggaagttaaaaagcaaagagcaggagtgctgtgggatgtaccaagtccaccaccagttggtaaagcagaattagaggatggagcttatagaataaaacaaaagggcatattaggttactcacaaataggagcaggggtatataaagagggtacatttcacactatgtggcacgtgacaaggggagccgttctaatgcacaaagggaaaaggatcgagccatcgtgggcggatgttaagaaagatctgatatcgtacggaggcgggtggaaattagaaggcgagtggaaagagggggaggaagtacaagtgttagctcttgaacccggtaaaaaccctagagcagttcaaactaaacctggactctttaagacgaacactggtacaataggggctgtctctctagacttttcaccgggtacatcggggtcaccaatcgtagataagaaaggcaaagtagtaggactgtatgggaatggtgtagtaacccgatctggtacctatgtaagtgcaatagctcaaaccgagaagtcaatcgaagacaatccggaaatagaagacgatatatttcgcaagaaacggttaacaattatggatttacaccctggagccggtaaaacaaagcgatatctgcctgcaattgttagggaagctataaagaggggactgcgtactttaatattagcacccacaagagtcgtggccgctgaaatggaagaagcgttgagaggactacctatccgataccaaacccctgccataagagcagaacacacaggtcgggaaattgttgatttgatgtgccatgcaacctttacaatgagattattaagtcccattagagttcctaattacaacctcataatcatggatgaagcgcatttcacagatccagctagcattgcagctagaggctacatcagtacaagggtggaaatgggtgaggcggcgggtatattcatgaccgccactcctccaggaagtagagacccgtttccacagtctaatgccccaatcatggatgaagaacgtgagattcctgaaaggtcttggaactcaggtcacgaatgggttacggatttcaaaggtaaaacagtttggttcgttccgagcatcaaagccgggaatgacatcgcagcgtgtttaaggaaaaatgggaagaaagtgattcaacttagccgaaaaacgttcgattcggaatacgtaaaaacccgaacaaatgactgggatttcgtagtgacgacggacattagcgaaatgggcgctaattttaaggctgagagggttatcgatccccgacgctgcatgaagcccgttatcttaacagacggagaggagagagtgatattagcaggcccaatgccagtcacacactcaagcgccgcacagaggcgaggccgagtagggcggaacccgaagaacgagaatgaccagtacatatacatgggcgaacctttagagaacgacgaagactgcgcacattggaaagaagccaaaatgttactcgataacattaatacgccagaaggaataataccctccatgttcgaaccagaaagggaaaaggtagatgctatcgatggagaatatagactaagaggcgaagctcgaaaaacgtttgtagacttaatgagaagaggggatttgccagtatggctggcctatcgcgtcgcagctgaaggcataaactatgccgatagacgatggtgttttgatggagtcaaaaataatcagatactcgaggaaaatgtagaagtagaaatctggaccaaagagggtgagaggaagaaattaaaacccagatggctagacgcgcgaatatacagtgacccattggctttaaaagaatttaaagaatttgcagctggtcgaaagagcctcactttgaacctaattaccgaaatgggtaggttgccaacgttcatgacgcaaaaagctcgaaacgcattagacaacttagcagttttacatactgcggaagccgggggaagggcttataaccatgcgctgtcagagctaccagaaacacttgaaacactcttgctgctcacactcctagcaaccgtcactggagggatattcttgttcttaatgagcgggaaaggtataggaaaaatgacgcttgggatgtgttgcataattactgcgagtgtcctgctgtggtatgctcaaattcagccacactggatagcggcatcaataattcttgaatttttcttgatagtactactcatacccgaaccagaaaaacaacgtacacctcaagataatcagctaacttacgtagtcattgccatattgaccgttgtggctgccacaatggctaacgaaatgggattcctcgagaaaacgaagaaagacttcggcctaggtggtattgctactcaacaaccagaatcaaatatattagacatcgacttaagacctgcttccgcttggacgctatatgctgttgcgacaaccttcatcacaccaatgttgcgccacagcatagaaaactcgtctgtaaatgtttctcttacggcaatagctaatcaagcgactgtattgatgggtttgggtaaaggatggcctttatcgaaaatggatataggagtcccactgttagcgatcggatgctactcacaggttaatccgataactttaacagctgcactacttctgcttgtagcgcactacgcaataattggaccagggttacaggcaaaagcaactagagaggcacagaaaagagctgcagccggcataatgaaaaatccgacagttgatggaataaccgtaattgacctagaccctattccatacgatccgaaattcgaaaagcagctaggtcaagtaatgttgttagttctatgtgtcacgcaagtactaatgatgagaacgacttgggcgttatgtgaggctctaacgctcgcaacaggtcccatatcgacattgtgggaaggaaatccgggaagattttggaacactacgatagctgttagtatggcgaatatttttcgcgggagctatcttgcaggagcaggcttactgttttcaatcatgaaaaatacagccaatacacgaaggggaacaggaaacacaggggagactttaggagaaaaatggaagaataggctaaatgcgctaggcaagagtgaatttcagatatataagaaaagcgggatccaagaagtcgacaggaccctagctaaagaaggcataaaaaggggcgaaaccgaccaccatgcagtttcaaggggctcagcgaaactaaggtggtttgtggaaagaaaccttgtcacaccggaaggaaaagttatggatctcggttgtggccgtggaggctggagttactattgtggaggcttaaagaacgtcaaagaagtcaaagggttaactaaaggaggtcctggacacgaggaacccatacctatgagtacatacggttggaatctagtaagattacagagcggcgtagacgtctttttcactccaccggaaaaatgtgacacattgttatgtgatatcggagaatcatccccgaacccgacagtcgaagcaggaagaacgttgagagttcttaacttagttgagaactggctaaacaataatacgcaattttgcatcaaggtactcaacccatatatgccttccgtaattgaaaagatggaggcactacaaagaaagtacggaggagccttagtaagaaatcccctctcgagaaactcaacccatgaaatgtattgggtatcaaacgcaagcggcaatatagtgtcgtcggttaacatgataagtagaatgctaattaatagatttaccatgcgtcataaaaaggcaacgtacgaaccagacgtagatttagggtcaggcacacgcaatataggaatagaaagcgaaataccaaacttggatattatcggtaaacgaattgagaaaattaagcaagaacacgaaacatcatggcactatgaccaagaccacccatataaaacatgggcataccatggttcttatgagacaaaacaaacgggtagcgcatctagcatggtaaatggtgttgtgcgcttacttactaaaccttgggatgtaatccctatggttacacaaatggcaatgacagatacgacccccttcgggcaacaaagagtttttaaagtaaaagttgatacacgtacacaggaacctaaagaaggcacgaagaaattaatgaaaatcacagcagaatggttatggaaagaattagggaagaagaaaacaccgcgtatgtgcactagagaagagtttacacgcaaagtacgatcaaatgcagccttaggagcgatatttaccgacgaaaataaatggaagtccgccagggaagcagtagaagacagcgggttctgggaattggtagataaggaacgtaatcttcatctggaaggaaaatgtgaaacatgtgtttacaacatgatgggtaagcgtgagaagaaactaggcgaatttggaaaagcgaaaggaagccgagccatatggtatatgtggctaggcgctaggttcctagagttcgaggcattaggattcttgaacgaggatcactggtttagcagagaaaatagtctaagcggagtcgaaggtgaaggtctacacaaattgggctatatcctgcgtgatgtgagtaaaaaggaaggcggggctatgtatgcagacgacacagcaggatgggacacacgtataactttagaggatctaaagaatgaagagatggtaaccaatcacatggagggggagcacaagaaactcgccgaagctatttttaaattaacgtaccaaaataaggtagtcagagtacaacgaccgacacctaggggtaccgtcatggacataataagtcgtagagaccaacgaggatccggccaagtcgtgacttatggtctaaacacgtttactaacatggaggctcagttaattagacaaatggaaggagaaggtgtctttaaaagtatacagcaacttactgcaacagaagaaatagcagtgaaaaactggctagcaagagtaggaagggagaggctttctagaatggcaataagtggtgacgattgtgtggtaaaacctctagacgacagatttgcttcggcgcttacggcactcaatgatatggggaaagtcaggaaagatatacaacaatgggagcccagcagaggatggaacgactggacgcaggtaccattctgtagccaccatttccatgaattaattatgaaggatggacgcgtcctcgtcgtaccatgtagaaaccaagatgaactaatcggaagggcaagaatttctcaaggggcaggatggtccctacgagagacagcttgcttaggtaaatcttatgcacaaatgtggtcacttatgtattttcacagaagagacctccgattagctgcaaatgctatatgttccgctgtgcccagtcattgggtacccacatctagaacaacttggtcaatccacgctactcatgaatggatgacaacagaagacatgttgaccgtctggaatcgtgtgtggatacaagaaaacccgtggatagaagataagacgcctgtggagagttgggaagaaataccatatttaggaaaacgtgaagatcaatggtgcgggagtttaataggtcttacgtctcgtgcgacttgggcgaaaaatatacaaacagcgatcaaccaagtaagaagtctaataggaaatgaagaatatacagattacatgccaagcatgaaaagatttcgacgggaagaggaggaagccggagtactgtggtaa

SEQ ID NO: 22964 - RNA, 9876 nt, synthetic construct
  misc_feature 1..9876: note = derived and/or modified CDS sequence (opt6) from DENV-2__DQ645541__SS-prME
  source 1..9876: mol_type = other RNA
acagcaggtgttataatcatgatgatacccacagtcgtcgcatttcacctcacgacgagaaacggggaacctcacatgatagtctcacgtcaagaaaagggcaaaagtctactgtttaagacggaaaatggtgtaaatatgtgtacactaatggctatggatttaggagaactctgtgaagatacaataacctacaattgcccgctcctaagacaaaatgagcctgaagatattgattgttggtgcaactcgacatctacctgggttacttatgggacctgcacagctacaggagaacacaggagagagaagagatctgttgctttggtaccgcacgtcgggatgggactagagactagaactgaaacatggatgtcgagcgaaggagcatggaagcacgcgcaacgtattgaaacttgggtgttaaggcatcctggttttacgattatggcggcgatactagcctacaccataggaacaacatatttccaacgtgttcttattttcattctattaacggcggtagccccatcaatgacaatgcgttgcataggaattagcaatagagactttgtggagggcgtaagtggtggatcatgggtcgatatcgtcttagagcatggtagctgcgtgacgacaatggctaagaataaaccaactctagactttgaattgactaaaactgaagcgaaacatccagcgacactacgaaaatactgtattgaagcaaaattaacaaatacaactacggcctcccgttgccccacgcaaggagagccttccctgaacgaggaacaagacaaacgatttgtgtgtaaacatagcatggtggatcgaggttggggaaatggttgtggtctattcggtaaaggtggtatagtgacttgcgctatgttcacttgcaaaaaaaatatggaaggaaaggtagtgcaacccgaaaatctcgaatacacaattgtaataacgccgcactctggagaggagaatgcagtgggaaatgacaccggtaaacacggtaaagaaattaaagtaacaccgcaaagcagcataacagaagcagagctaacagggtacggtactgtcaccatggagtgttcacctagaacgggattagattttaatgaaatggttttgctacaaatggaggacaaagcatggcttgtccataggcaatggttcttagatcttcccctaccttggttacctggagccgacacccaaggtagcaactggatccaaaaagaaacgttagtaacatttaagaacccacatgctaaaaagcaagatgtagtagtcttaggttcccaagagggggccatgcatacagcacttacgggagcgacagaaatacaaatgagctctggtaatttgttatttacaggtcacttgaaatgcagattacgtatggacaaactacaattaaagggtatgagctactctatgtgcacggggaaattcaaagtagtaaaggaaatagctgaaacgcagcacgggacgatagtgatacgagtacaatatgagggcgatgggagtccatgcaaaataccttttgagataatggatttggaaaaacggcacgtattagggcggttaattacagtcaacccgatagtgacagaaaaagacagtccagttaatatagaggcagaaccaccctttggtgattcatatatcataattggagtcgaaccaggtcaactaaaactgtcttggttcaagaaaggttcaagtattggtcaaatgtttgaaactaccatgcgaggtgctaaacgcatggcaattctcggcgatacagcttgggattttggtagcctgggtggagtgtttactagtataggaaaagcactccatcaggtgtttggggctatatacggcgctgcatttagcggcgtttcatggactatgaagatcttaatcggagttgttattacatggatcggaatgaatagtaggtcgaccagtctaagcgtatcattggtattagttggagtcgtaacattgtacttaggtgttatggtccaagccgatagcgggtgtgtggtttcgtggaaaaataaggagcttaaatgtggctccgggatatttatcaccgacaacgtacatacgtggacagaacaatacaagttccagcctgaaagtccatcgaagcttgctagtgcgatccaaaaagcacatgaagaaggaatttgcggtattaggtccgtaacgcgacttgaaaatctcatgtggaagcagatcacaccggaactaaaccatattttaagcgaaaatgaagtaaaactaaccatcatgaccggggatatcaaaggaatcatgcaggctggaaaaagaagccttcgtccacaaccgacagaattgaagtacagttggaaagcatggggcaaagcgaaaatgctgtcaaccgaattgcacaaccacacgttcttaatcgacggtccagagactgcggagtgcccaaatactaacagagcctggaacagcttagaggttgaggattacggctttggtgttttcacgacaaacatatggctgaaactaaaagaaaggcaagatgtgttttgtgatagtaaattaatgtccgctgctatcaaagacaacagggccgtacacgcagatatgggatattggatcgagagcgcactcaatgacacctggaaaatagaaaaagctagttttatagaagtgaaaagttgccattggccaaaaagccacactttgtggtctaatggcgtcttagaaagtgaaatgattattcctaaaaatttcgctggccccgtcagccaacataattataggccaggataccacacgcaaacagcaggaccatggcatctaggaaagttagaaatggactttgacttttgcgaagggacaacggtcgtcgtaacagaggactgcggcaatcgaggcccttcacttaggacaacaaccgccagcggcaaattgataacggaatggtgttgccgatcctgtactttacccccattaaggtatcgaggtgaagatgggtgttggtacggaatggaaataagacccttaaaagaaaaagaggaaaaccttgtcaattccctagtgacagctgggcatggacaaatcgacaatttcagcttaggcgtcttaggcatggcgcttttcctcgaggaaatgcttagaactcgcgtgggaacaaaacacgcgatattattagtcgccgtatctttcgttacgctaataacagggaatatgagttttcgagatttgggaagggtaatggtaatggttggagctacaatgacagatgacattggaatgggagtaacgtatctagcactgttagctgcttttaaagtaaggcccacattcgcagcaggactattattaagaaaacttacgagtaaagaacttatgatgaccacaattggtatcgtattattgtcccaaagcacgataccagaaacaattttggagttgactgatgcacttgcactgggaatgatggtcctaaaaatagttagaaacatggaaaaatatcaattagcagtaacaattatggcgatcctatgtgtgcctaatgcagttattctacaaaatgcttggaaagtcagttgtacgattctggcggtagtgagtgtaagtcctttattgctcacgagcagtcagcaaaaggctgattggatcccattagctctaactattaagggtctaaacccgacagcaatatttttaactactctaagcagaacgtcaaagaagaggtcctggccactaaacgaagctataatggccgttggaatggtgtcgatattagcatcttcactattaaaaaacgatataccaatgacagggccattagttgccggagggttactcacagtatgttatgtacttactggtagatctgctgatctggagctagaacgagcagccgacgtgagatgggaagagcaagcggaaattagtggcagttctcccatattatctattacaatttcggaagatggatcaatgagcataaaaaatgaagaagaagaacaaactttgacaatactcattcgtacaggcttgcttgtcatatcagggctgtttccagtgagtatacctataactgcggcagcttggtatctatgggaggtcaaaaagcaaagagcgggtgtattgtgggatgtcccatcgcctcctccggtcgggaaagctgaacttgaagacggggcgtatagaattaagcaaaagggaatattgggatacagccaaatcggagcaggagtatacaaggaaggaaccttccacactatgtggcacgttacgagaggagcagtactaatgcataaaggcaagcgtatagaaccatcctgggcagatgtaaagaaagatctgattagctatgggggaggctggaagctagaaggcgaatggaaagaaggtgaagaagtccaggtactagcattagagcccgggaaaaaccctcgagctgtacagacaaaacccgggctttttaaaacaaataccggaacaataggggcagtcagtttagatttttctccgggcacctcaggtagcccaatagtcgataaaaaaggcaaggtagtgggtctctacggcaatggagttgtcaccagaagcggcacttacgtaagcgcaatagctcaaactgaaaaatctatagaagacaaccctgaaatagaagatgatatttttaggaaaaaacgactcacaataatggacctacatcccggggctggaaaaacaaaaagatacttacctgcaatagttcgagaagcaataaaaaggggtttacgcactcttatcttggcacctacccgtgtagttgccgctgaaatggaagaagctctacggggcttacctataaggtatcagactccggcaatacgagcagaacatacaggtagagaaattgtcgatctaatgtgtcacgccacattcactatgagattactcagtccaattagggttcccaattacaatctaataattatggacgaagcacattttacagaccctgcatcaatagcagcacggggatacatctcaacacgtgtggagatgggggaagccgctggtatatttatgacagcaactcccccaggatctcgtgatcctttcccgcagtcaaacgcacccataatggatgaagaaagagaaattcctgagcgaagttggaacagtggacatgaatgggtgactgacttcaagggtaaaacagtctggtttgttccaagtataaaggcgggtaacgacatagctgcatgtcttcgtaaaaacggcaagaaggtgatacaactatctcgtaagacctttgacagtgaatatgtaaaaacaagaaccaatgactgggattttgtagttacaacagacatttccgagatgggtgcaaatttcaaagcggagcgagtcattgaccctagacgctgtatgaaaccagtgatactaacggatggagaagagagagttatactagcagggcccatgcccgtaacccatagttcagcggcccaaaggagagggcgcgtaggacgaaacccaaaaaatgaaaatgatcagtatatatatatgggagagccattagaaaatgacgaggactgtgcccattggaaagaggccaaaatgctcttggataatataaacacaccagaaggaataataccgagtatgtttgagccagaaagggaaaaagtagatgctatagacggagaatacagattgagaggagaggcacggaagacattcgtagacctaatgaggcggggcgatttaccagtctggttagcatatagagtggcagcggaaggaataaattatgctgaccgacgttggtgtttcgacggagtcaagaacaatcagatactagaggaaaatgtggaggttgagatatggaccaaagagggggaacgaaagaaattaaaacctaggtggctggacgcacgaatatactcggatccactagcgcttaaagaattcaaggaatttgcggcagggagaaagagtctcaccctaaaccttataactgagatgggccgacttccgactttcatgactcaaaaagcacgtaacgcattagataatttagcagttttgcatacagcagaagcaggcggcagagcctataaccatgccttaagcgagttacctgagaccctagaaacattgctactcttaacactattagcaacagtaacaggcggtatatttctctttctcatgtcgggaaagggcataggaaaaatgactttaggaatgtgttgcataataacagctagtgttttactatggtacgcccagattcagccgcactggattgccgcatccataatccttgaattttttctaatagtattactcataccagaaccggaaaaacaaaggacgccccaggataaccaacttacttacgttgtgatagcaatactaactgtcgttgctgcgactatggcaaacgaaatgggtttcttagaaaaaacaaagaaagacttcggcttaggtggtatcgcaacacaacaacctgaatcaaacatacttgatatagatctgagaccggcatccgcctggacattatatgctgtggcaaccacatttataacgcctatgctacgtcatagtattgagaactcatcggtcaatgtgtctttgacagcaatagcaaaccaagcaacagttctaatgggactgggaaaaggttggcccttgagcaaaatggatattggggttcctctactagcaattggctgctacagccaagtaaaccctataacactaacggcggctttgctactactggttgcacattatgccataatagggccaggtttgcaagcgaaagcaactcgagaagcacaaaaaagggcagctgcgggtattatgaaaaatcccaccgtcgacggaataactgttattgatttagacccaataccatatgacccgaaatttgaaaaacagctggggcaagtcatgctgttagtgttgtgtgtaacgcaggttctaatgatgcgaacgacatgggctctatgcgaagccttaacattagctactggtccgatatcaaccttatgggagggaaaccccggaagattctggaacaccacgattgcggtaagtatggcaaatatatttagagggagttatttagcaggggctgggctactattcagtattatgaaaaacacagccaacaccagaaggggcacaggaaatactggtgaaactcttggagaaaaatggaagaatcggctgaacgcacttggaaaatcagaatttcaaatttataaaaagtccggcatacaggaggtagatcgtactttagcgaaagaaggaattaagagaggcgaaacagatcaccatgccgttagtcgtggcagcgcaaaactacgatggtttgtcgaaagaaacctagttactcctgaaggaaaagttatggatttaggatgcggaaggggaggttggagttattattgcggtggtttgaagaacgtaaaagaggttaaaggactaacaaaagggggacccgggcatgaggaaccgatccctatgagtacatatggttggaacctagtacgacttcagtctggcgtagacgtcttttttactccaccagagaaatgcgatacattgttatgtgacataggagaaagctctcctaacccaactgtagaagctggaagaacgttacgggtgctaaatcttgttgagaattggttaaataacaacactcagttctgtataaaagtacttaatccttacatgccatccgttatcgagaaaatggaggccctacaaagaaagtatgggggggcactagttagaaatcctctatcaaggaactccacccatgaaatgtattgggtatcaaatgcaagtggaaacatagtctctagtgtcaacatgattagtagaatgttaataaatcgatttacaatgaggcataagaaggccacatatgaaccggatgtggacttaggtagcggtacccgtaacatagggattgaaagtgaaacaccaaacctagatataatagggaaacgcatcgaaaaaataaaacaagaacacgagacatcatggcattatgatcaggaccacccatataaaacttgggcatatcatggttcctatgaaacaaagcaaacgggctcagctagttcaatggtgaatggagtggttcgtttattgacaaaaccctgggatgtgataccaatggtaactcagatggctatgaccgataccacgccgtttggacaacaacgggtattcaaagagaaagtagacactcggactcaagaacccaaagaaggaactaaaaaattgatgaaaataaccgcagaatggttgtggaaagaattaggaaaaaaaaaaacgccaagaatgtgcacacgagaagaatttacccgaaaagtaagaagtaacgctgcactcggtgctatatttacagatgaaaacaaatggaaaagcgctagggaggctgttgaagacagtggattttgggagttggtcgacaaagaacgcaaccttcacctagaaggtaaatgcgaaacatgtgtatacaatatgatggggaagcgggagaagaaactcggagagtttggaaaagccaaggggtctcgcgccatatggtatatgtggttaggagcgagatttcttgagttcgaagcgctaggtttcctaaacgaagatcattggttctcgagggaaaatagtctcagcggggttgaaggagaaggattacacaagttggggtacattctgcgagacgtctcaaaaaaggagggaggggcaatgtacgctgatgatactgcaggatgggacacacgtatcactttagaggatctaaagaatgaagaaatggttacgaatcatatggagggtgaacacaaaaaattagcagaagcaatttttaaactcacatatcagaataaggttgtccgagtccaaagaccgacacctagggggacagtaatggacataataagtagaagagatcaaaggggaagtggacaggtagtgacttacggtttaaacacattcacaaatatggaagcccaattaatccgacagatggaaggagagggggtatttaagtctatacaacaattaacagcaactgaggaaatagctgttaagaattggcttgctcgggttggtagagaacggttatctagaatggcgatatcaggtgacgattgtgttgtcaaaccactagacgatcgatttgcatccgctttgaccgcgctaaatgatatgggtaaagttaggaaggatatccagcaatgggaacctagtagagggtggaatgattggactcaagttccgttctgtagccatcattttcacgaactaattatgaaggacggaagagtactcgtagtcccctgtagaaaccaggatgagctcataggaagagcgagaataagccaaggtgcaggttggagcttacgagaaacagcatgtctgggaaaatcatacgctcagatgtggagcctgatgtacttccatagaagagatttacgtcttgcagctaatgctatctgctccgcagtgcctagccattgggttccaacatcgcgcacaacatggtcaatccatgcaacccacgaatggatgactaccgaagatatgttgactgtctggaacagagtatggatacaggaaaatccatggatagaagacaaaacaccagtggaaagctgggaagaaatcccgtatcttggaaaaagagaggaccagtggtgtggatcactgattggactgactagcagggcaacgtgggctaagaacatacagaccgcaatcaaccaggttcgttctttgattggaaacgaagagtatacggactacatgccttccatgaaaagatttaggagagaagaagaagaagcgggagtgctatggtaa

SEQ ID NO: 22965 - RNA, 9876 nt, synthetic construct
  misc_feature 1..9876: note = derived and/or modified CDS sequence (opt6) from DENV-2__DQ645542__SS-prME
  source 1..9876: mol_type = other RNA
acagctggagttatcataatgatgatcccaacagtagtggcattccacctaacaactcgaaatggtgaaccgcatatgattgttagtaggcaggaaaaaggaaaatcattattattcaaaaccgaaaacggcgtaaatatgtgtacacttatggctatggacttgggtgaattatgcgaagacactataacttacaactgccctctattgagacagaatgaaccagaagatatagattgctggtgtaactcgaccagcacatgggtcacttacggaacttgcacggctacaggtgaacatcgaagggagaaaagaagtgtggccttagtaccccatgtaggcatgggattagaaacgcgcacagaaacttggatgagctctgaaggcgcatggaaacacgcgcagagaatagaaacatgggtcctgagacacccaggattcacaattatggcagcaattttggcatataccataggaacaacctattttcaaagagtattaatttttatactattaaccgcggtcgctccgagtatgacaatgcgatgcattggtatctcgaatagagatttcgtcgaaggagtatccggagggtcctgggtagatatcgtgttagaacacgggagctgtgtgaccacgatggctaaaaacaaaccgaccctagactttgaactaaccaaaacagaagcaaaacatccggcaaccttgaggaaatattgcatagaagccaaacttactaacactacaacagcaagtcgatgtccaactcaaggtgaacccagtctaaatgaagaacaagataaacgatttgtctgtaaacatagcatggtagatagagggtggggcaacggttgtggcctatttgggaaaggagggatagtcacatgcgcgatgtttacatgtaagaaaaacatggagggaaaagtcgttcagccggaaaatctagagtatactatagtaatcacgccgcatagtggagaggaaaacgcggtaggaaatgataccgggaaacatggcaaagaaattaaagtaacaccccagtcaagtataacagaagcggaactgacgggatatggcacagttacgatggagtgtagcccacgaactggactggacttcaatgaaatggtgctattacaaatggaggataaagcatggctagttcatagacaatggtttttagacttacccctgccgtggttacccggagcggatacccaaggcagcaactggatacaaaaagaaacattagtaacatttaaaaacccgcatgctaagaaacaggatgtagtagttctcgggtcacaggagggggccatgcacactgctttaacgggtgcaacagaaatccaaatgtcatctggaaacttattatttacgggtcacctcaaatgtagactacgaatggataagctccaacttaaagggatgagttattcgatgtgcacaggaaaattcaaagttgtaaaagaaattgcagagactcaacatggtactatagtcatcagagttcaatacgaaggtgacggctcaccttgcaaaattccatttgaaattatggacctagaaaaacggcacgtactaggtaggctaataacagtgaatccaatagtaacagaaaaggactcacccgtaaatatcgaagccgaacccccttttggagatagttatataattatcggagtcgaaccaggccagcttaaattgtcatggtttaagaaaggtagtagcataggacaaatgtttgaaacgacaatgagaggggcaaagagaatggcgatattgggggacacagcttgggattttggttcactcggtggtgtgtttacttctataggaaaggcattacatcaagtgttcggagcaatatacggcgcagctttctctggagttagttggacaatgaaaatattaataggagtcgttatcacctggattgggatgaactcaagatcgacaagcctcagtgtgagcctggttctcgtaggtgtagtaaccctatatttgggcgttatggtacaggcagattcaggttgcgtcgttagctggaaaaataaggaactaaaatgcgggtcaggcatattcataaccgacaacgtacatacctggacggagcaatacaaatttcagcccgaatcaccaagtaaactagcgtcagcaatacaaaaagcgcatgaagaaggaatatgtgggattcgttcagtaacaagattagaaaatcttatgtggaaacaaatcacacctgagttaaatcacattctatcagagaacgaagtcaaattaactattatgacaggagatattaaaggaattatgcaagctggaaaacgttcattaagaccccagccaaccgagttaaaatactcctggaaggcatggggtaaagcgaaaatgttgtctaccgaactacataatcatacctttttgatagacggacccgaaaccgctgaatgcccaaatactaatcgagcatggaactcattggaggtcgaagactatggcttcggtgtgtttacaactaatatatggctcaaattgaaagaacgacaagatgtcttctgtgattcgaaactaatgtctgctgcgattaaggataacagagcagtacacgcagacatgggatactggatagagagcgccctgaacgatacatggaagatcgaaaaagcgtcgtttatcgaagtaaaaagttgtcattggccaaaatcgcatactctatggtcaaatggagtattagaatcagagatgattattccaaagaattttgctggacctgtttcacaacacaattatagaccaggctaccatacacaaacagcaggaccctggcacttaggcaaactagaaatggacttcgatttttgtgaaggtaccacagttgtcgttaccgaggattgtggaaacagaggtccaagcctaagaaccaccactgcaagcggcaagctcattacggaatggtgttgtagaagttgtacactgccaccattaagatatagaggcgaagatggctgctggtacggtatggagatacgaccactaaaagagaaagaggaaaatctagtaaattctttggtaaccgcaggtcatggccaaattgataattttagcctaggtgtactagggatggctctcttcttagaagagatgctgcgaaccagggtggggacaaaacacgccatactattagtggctgtcagctttgtcacactaataacaggaaatatgagctttagggatctgggccgagtaatggtcatggtaggagcaacaatgacggacgacataggtatgggggtgacctatttggccttattagcggcatttaaggttcggccaacctttgccgccgggctgctattaagaaaacttacaagcaaagaactgatgatgactacaatcgggatagtcttactatcacaatctactataccagaaacaattttggagctaactgatgcactagctttaggaatgatggtactaaagatcgtcagaaatatggaaaagtatcagctagccgtaacaataatggcgatcttatgcgttcccaatgcagtaatattgcaaaacgcatggaaagtaagctgtacaatattagctgttgtcagcgtaagtcccttgctactcacaagcagccagcagaaagcagactggattcccttggcattaacaatcaaaggcttaaaccctaccgctatttttcttactacacttagtagaactagcaaaaagaggagctggccccttaatgaggcgataatggccgtcggaatggtatcaatactcgcttcaagcctactcaaaaatgatattcccatgacagggcctttagtcgctggtggacttcttacggtttgttacgtgctaaccggtagatccgccgatttagagttggaacgagccgctgatgtacgatgggaggaacaagcagaaatcagcggaagcagtccgatactctcgatcacaatcagcgaggacggatccatgtcgatcaaaaatgaagaagaagaacaaacattgactatcttaattagaaccggtcttcttgttattagtgggctttttcccgtgagtatacctataactgcggcggcatggtatctgtgggaggtaaagaaacagagggctggagtgctatgggacgtgccgtcgccacctccagttggaaaagcagagctcgaagacggagcatatagaataaagcaaaagggaatcttaggctatagtcagattggggcaggggtctataaagaaggaacatttcatactatgtggcacgtgactagaggtgcagttctgatgcacaaaggaaaacgcattgaaccttcatgggctgacgtgaagaaagatttaatcagttatgggggtggctggaaacttgaaggagaatggaaagaaggagaggaagttcaagtattagctttagaaccaggcaaaaatccaagagccgttcaaactaaaccaggtttgtttaaaaccaataccggaactatcggggctgtgtccttagatttttcacccggaacatctggcagtcctattgtcgacaagaaaggtaaggtggtaggtttatatggaaacggcgttgtgaccagatcaggaacatatgtttctgctatagcacaaaccgagaaaagtattgaagataatcccgagatagaagatgatatattcaggaagaaaagactgacgatcatggatttgcaccctggagcaggaaaaacgaaaagatacttgcccgcaatagtccgagaggcaatcaaaagagggctaagaactttgatcctagcacctaccagagtggtggctgccgagatggaagaggccttacggggcctcccgattcgataccaaactcccgcaataagagccgagcacacaggcagggaaatagttgatctcatgtgtcatgctacattcacgatgagacttctctcccccattagagttccaaactataatttgatcatcatggatgaggcccattttacagatccagcaagcatagccgccaggggctacatatctactagagtagaaatgggagaggcagctggtatttttatgacagcaacacctccaggttcacgagatccgttcccacaatcaaatgcacccataatggacgaagaaagagaaataccagaacgatcatggaacagtggccatgaatgggttacagacttcaagggtaagactgtatggtttgtaccatcaataaaagccgggaatgatatagcagcttgcttgaggaagaacggtaagaaagttattcaactatcgcggaaaaccttcgattcagagtatgtgaagacccgaactaatgactgggatttcgtagtaacaactgatataagtgaaatgggagccaattttaaagcagaaagggtaattgaccccagacgttgtatgaaaccagtaattctaacagatggagaggaaagggttatactagccggaccaatgcccgtaacccattcctccgcagcacaaagacgtggacgagtaggtcgtaaccccaaaaatgagaacgatcaatatatatatatgggagaaccactcgaaaacgatgaagattgcgcgcattggaaggaggctaaaatgttactagacaacataaacaccccggaaggcataataccttcaatgttcgaacctgaacgagaaaaagtagatgcaatcgatggggaataccgacttcgtggtgaagcacggaaaacatttgtggacttgatgcgacgcggagatttgccagtatggctggcatatagggttgctgctgaaggtatcaattacgccgacagacggtggtgctttgacggagtaaagaataatcagatacttgaggagaatgtagaagtagaaatatggactaaagagggagaaagaaagaaattaaaaccaagatggcttgatgcaaggatatattctgatccattggcattaaaagaatttaaagaatttgcggcaggccggaaaagtttaacattgaacctaataaccgaaatgggaagactgccaacttttatgacacaaaaagctagaaatgcactagataaccttgccgtattacatacagcagaagcagggggccgcgcttataaccacgctctcagtgaactacctgaaaccttagaaactctcctattactaacgttattggcaacagtcactggtggaatctttttattcctaatgtctggcaaaggaataggtaaaatgacactaggcatgtgctgcatcattactgcttcagttctactatggtatgcacagatacaaccacactggatagcagcatccatcattttagagttctttctaatagtattactaattccagaaccggaaaaacaacgaactccacaagacaatcaacttacatatgtcgtcatagcaatactgactgtagttgcagctacaatggcgaatgaaatgggattcctcgagaaaactaagaaagactttgggctagggggaattgcgacacaacaaccagaatcaaacatattagatatcgatttacgacctgcatcagcctggaccctctacgctgtagcaactacgtttatcacacctatgctacgacatagtatcgaaaatagcagtgtcaatgtttcgcttacagccatcgcaaatcaggccactgtactcatgggacttggtaaaggatggccgctaagtaaaatggacataggagttccactccttgcgatagggtgctattcacaggtcaatccgataaccttaacagccgcccttttattattagtagcacattatgctataatagggccaggtctgcaagccaaagcaacaagagaagcgcagaagcgtgctgccgccggaataatgaagaatccaacagtggatggaatcactgttatagatttagaccctataccgtacgatccaaaatttgagaaacagctcggtcaagtaatgctgctagtcctatgtgtaacccaagtacttatgatgcgaactacatgggcactttgtgaagcattaacattggcaaccggaccaatttcaacattatgggaagggaatcccggaaggttttggaataccacgattgctgtatcgatggcaaacatttttagaggttcatatctggcaggagcaggactgctattcagtatcatgaagaacactgcaaatacaagaagaggaacgggcaacaccggagagacattaggcgaaaaatggaaaaatcgacttaacgcattgggtaaatctgagttccaaatatacaagaaaagcggcatacaagaggtagacagaacgctagcgaaggaaggaataaaaagaggcgagacggaccatcacgcagttagtcgtggcagtgctaaacttaggtggtttgtcgaacggaatcttgtaactccggaaggaaaggtaatggatttaggctgtggtcgcggaggatggtcttattactgcggtggactgaagaacgtaaaggaggtaaagggattgacaaaaggtggccccggtcatgaggaacctattccaatgtcgacatatgggtggaacctagtaagattacaatcaggagtagacgtattctttacaccacctgagaagtgcgacacactgttatgcgatatcggtgagtcgtctccaaatccaacagtcgaagcaggacgaacattgcgagttttaaatctagtagagaattggttaaacaacaacacgcagttttgtataaaagtattgaatccttacatgccttccgtaatagagaaaatggaagcattacaacgaaaatacggtggagccttagtaagaaatcctctaagcagaaactctacccacgaaatgtactgggtaagcaatgcatcgggcaacatagtttcatcggttaacatgattagccgaatgctaataaacagattcactatgcggcataaaaaggccacttatgaacccgatgtggatttaggttcaggtacacgaaacatagggatagaaagtgaaataccaaatctcgatatcataggtaagagaattgagaaaataaaacaagaacatgaaacaagttggcattatgatcaagatcacccctataaaacttgggcatatcatggttcgtatgaaacaaaacaaacagggtcggcatcatctatggtcaacggagtagtacgactattaactaaaccatgggacgtaattccgatggttacgcagatggctatgactgacactacacccttcgggcaacagcgagtatttaaagaaaaggttgacacgcgaacccaggagccaaaagaagggactaagaaattaatgaaaataactgcggaatggctgtggaaggaactcgggaagaagaaaacccctcggatgtgtacgagagaagagttcactcgtaaagtgcgttccaatgcagcgctaggagcgatattcacagatgaaaataaatggaaatcagcacgagaggcagttgaagactcaggattctgggagctagtcgataaggaaagaaacttacatcttgaaggaaaatgcgaaacgtgtgtttataatatgatggggaagagagagaagaaattaggtgaatttggaaaagccaaaggatctagagctatttggtacatgtggctcggagctcgattccttgagttcgaagctctcgggttcttgaacgaggatcattggttcagcagagagaatagtttgtctggagtagaaggcgagggattgcataagttaggatatatactcagagatgtaagcaaaaaggagggcggggctatgtatgcagatgacacagcaggttgggacactcgtataaccctagaagacctcaaaaacgaagaaatggtaacaaatcacatggaaggagaacataagaaactagcagaggcgatttttaagttaacataccaaaacaaagttgttagagtccagaggcccaccccacgcgggactgttatggatatcatttctcgcagggatcaaaggggaagtggacaagtagtaacttacggtctaaacacgttcaccaacatggaagcacaattaatccgacaaatggaaggggaaggagtttttaaatcgatccaacaattaaccgcaactgaagaaatagccgttaaaaattggttagctagagtgggtcgcgagagactatctcgaatggccattagcggcgacgattgcgtagtaaaaccgttggacgacagatttgcgagtgcactaacagcacttaatgacatgggaaaagtcagaaaagatatacaacaatgggaaccttcaagagggtggaatgattggactcaagtaccattttgtagtcatcatttccacgagcttataatgaaggacggaagagttctcgttgttccttgtcggaaccaagacgaacttattgggagagcacgcatctctcaaggggctggatggtcattaagggaaactgcatgcctgggtaagtcttacgctcaaatgtggtcgctaatgtacttccatcggagagacttaagactagcagccaatgcgatatgcagcgctgtcccctcgcattgggttcccacctcaaggactacatggagcatacacgccacacatgagtggatgacaactgaagacatgttaacagtttggaatagagtttggatacaagaaaacccatggattgaggataaaacgccggttgaaagctgggaggagatcccgtatttaggtaaacgtgaagatcagtggtgtggcagcttgataggtttaacatcgcgggctacatgggctaaaaatatccaaacagcaataaaccaagtccgttctctaataggcaacgaagaatacactgactatatgcccagtatgaaaagatttagacgcgaagaagaagaagctggtgtcctatggtag

SEQ ID NO: 22966 - RNA, 9876 nt, synthetic construct
  misc_feature 1..9876: note = derived and/or modified CDS sequence (opt6) from DENV-2__AY702036__SS-prME
  source 1..9876: mol_type = other RNA
actgcaggagtaattgtgatgctaatacctactgcgatggcatttcatcttacgactagaaatggtgaaccacatatgatagtaggccgacaagaaaaaggaaaaagtctattatttaaaacagaagatggggtgaatatgtgcacgctaatggcaattgatctaggcgaactgtgcgaagacactataacatacaaatgccctttgttacggcagaatgaacccgaagatatagattgttggtgtaattctacttccacgtgggttacgtacggtacatgtacaacaacgggtgaacacaggagagaaaaacgttctgtagctttagtgccccatgtagggatgggattagaaacaagaactgaaacgtggatgtcgtctgaaggggcgtggaaacacgttcaaagaatagaaacatggatattacgacatccgggtttcacaataatggcagctatcctcgcgtacaccattggaactactcacttccagagagcgcttatattcatattactgacagcggtagcaccgtccatgacaatgcgatgtatagggatttccaatagagactttgtagaaggagtatcgggtggatcatgggtggatatcgtactagaacatggaagttgtgtaacaactatggctaaaaataaaccaacgttggattttgaattaataaaaactgaagcaaaacaacccgcaacactacgcaaatattgtatcgaagcaaaactaactaacactacaacagaaagcagatgccctacccaaggtgaaccatcgttgaatgaagaacaggacaaaagatttatatgcaaacattccatggtggacagaggttggggtaacggatgtggattatttggaaaagggggcattgttacgtgtgcaatgttcacctgtaagaaaaatatggaagggaaagtcgtgcaacctgaaaatttagaatatactattgtgattacaccgcacagtggggaagaacacgcagtgggcaatgatactggcaaacatggtaaagaaataaaaatcacaccacagtcatcgataacagaagcagaattaactggatatggtacagtaactatggaatgttcaccgaggacaggtctggattttaacgaaatggtactattgcagatggaagacaaagcgtggctcgtacatcggcaatggtttcttgaccttcctctgccatggttaccaggggctgacacgcagggctcaaactggatacagaaagaaacgctggttacttttaaaaatcctcacgccaagaaacaggacgttgtagtcctagggagtcaggaaggcgccatgcataccgccttaacaggagctacggaaatccaaatgtctagcggaaacttactgttcactggtcatttaaaatgcagacttagaatggacaaattacaacttaaaggtatgtcctattcaatgtgcacgggaaaatttaaaattgttaaagaaattgccgaaacccaacacggtacaatcgtcataagggtgcaatatgaaggagacggatcgccgtgtaagatcccttttgaaatcacagacttggaaaaacgacatgtattaggccggttaataaccgttaatcccatagtaacagaaaaagatagtcctgtcaatatcgaagcagaaccacctttcggggattcttacataattattggggtagaacccggacaactaaaactaaattggtttaagaaaggatcaagtatcgggcaaatgttcgagaccacgatgagaggtgctaaaagaatggcaatattgggagatactgcatgggacttcggatctttaggaggtgtcttcacgtcaatcggtaaggctctacaccaggtctttggagctatatacggcgcagctttttcaggggtttcgtggacaatgaaaatactgataggtgtcattatcacatggataggaatgaatagccgtagtacgtcactatctgtatctctcgtacttgtaggcgtcgtaaccctttatcttggagcgatggtgcaagcggattcagggtgtgttgtatcctggaaaaacaaagaactaaagtgtggatcagggattttcattactgacaacgtccatacgtggacagaacaatataagtttcaaccagagagcccttctaagctagctagcgccatccaaaaagctcacgaagaaggtatttgcgggattcggagcgtcacccgattggaaaacttaatgtggaagcaaataactcctgaactgaatcacatattgtctgagaatgaggtgaaattaacaattatgacaggcgatataaaaggcataatgcaagcaggcaaaagatccctacggccacaaccaacagagctcaagtacagttggaaaacgtggggcaaagctaagatgttaagtactgaatcccacaaccaaacatttttgatcgatggaccggaaacggctgaatgcccaaatacgaaccgagcatggaactctcttgaggttgaggactacggctttggagtgttttcaacaaatatctggcttaaattaagagaaaagcaggatgtattttgtgacagtaaattaatgtcggcagcgattaaggataatcgcgctgtacacgccgacatgggttattggatagaaagtgcgctaaacgatacatggaaaatggaaaaagcctcttttatagaagtaaaatcatgtcattggccaaagtctcacaccttatggagcaatggtgttctagaaagcgaaatgattattcccaaaaactttgcaggccctgtatcacagcataactataggccagggtatcatacgcaaacagctggtccatggcatttgggtaaattagagatggactttgatttttgtgaaggtaccactgttgtagtaacagaagattgcggtaaccggggtcccagtctccgcaccaccacagcgagtggcaagttaataacagaatggtgttgtcggagctgtaccctcccaccactgaggtatcggggagaagatggatgctggtacggcatggaaataaggcctctaaaagaaaaggaagaaaatctagttaattccttagttacagcgggccatggtcagattgacaactttagtttgggcgtactaggaatggctttgttcctagaagagatgttgagaacgagagtaggaactaaacacgctatccttcttgtagcagtctctttcgtcacactgattacaggaaacatgtcgtttcgagatcttggccgagtgatggtaatggtaggcgcgacaatgacagacgatataggtatgggtgtaacatacttagccctgctggcggcgtttaaagttcgacccactttcgcagcaggattactattacggaaattaacaagtaaggagttgatgatggcaacaatagggatagctttgctgtcacaatctacaatgcccgaaacaatattggagcttacagatgcattagcgctaggtatgatggtactgaaaattgtgcggaatatggagaaatatcaacttgcagtgacaataatggctataagctgtgtacctaatgctgtaatactacagaatgcatggaaagtatcatgtacaatactggcggctgtatctgtttcccctctgttattaacaagttcgcaacaaaaagcggactggataccccttgcacttactataaaaggtctaaacccaacagcaatatttctaacaactttatcccgcacttctaagaaacgtagttggcctctaaacgaagcaataatggccgttggtatggttagcatacttgcctcgtcacttctgaaaaatgatattccaatgactggtcctcttgtagcgggaggtttattaacagtttgttatgttttgactgggaggtctgcagaccttgagctcgaacgtgcagcggacgttaaatgggaagatcaagcagaaatatcgggttcgagtccaattttatcaattaccataagcgaggatggcagcatgagcatcaaaaacgaagaagaagaacagacgttgacaatattgatacgaacggggctattagtaataagtggcgtattcccagttagcattccaattaccgcggctgcatggtatctatgggaagtaaagaaacaaagagcgggtgtattatgggacgttcccagtccgccgccggtaggaaaggctgagctggaggacggggcctatcgtataaagcaaaggggaattttagggtattcacagattggagcgggagtatataaagaggggactttccacactatgtggcatgtaacaaggggtgctgtgctcatgcataggggaaagcggattgaaccttcatgggctgatgtcaagaaagatctaattagttacggagggggatggaagctagaaggagaatggaaagagggcgaagaagtgcaggtcttagcacttgaaccaggcaaaaatccgagagctgtccaaaccaaacccggaatattcaaaactaacacaggtactataggagcggtttcattagacttctcaccgggtaccagtggatctcctatagttgatcgaaagggaaaagtagtaggactatatggcaacggtgtggttacccgctcaggagcctatgttagtgcaatagcgcaaacagaaaaatctattgaagataacccagagatcgaagatgatatattccggaaaaagagattaaccatcatggacctccacccaggcgctggaaaaaccaaacgctatctgccagcgatagtgcgcgaagcaataaatcgaggactaagaactctgattttagcacctactagagtagtagccgccgaaatggaagaagccctccgtggtctcccaatcagatatcaaactcctgcaattagagccgaacacacaggtagagaaatagtcgatctaatgtgtcacgcgacttttactatgagattactttcccccgtacgtgtaccaaactataacttgattatcatggatgaagctcactttaccgacccagcatccatagctgcaaggggatacataagtaccagagttgaaatgggcgaagcagcaggtatatttatgaccgcgactccacccgggtcaagagacccgttccctcaatctaatgctcctattatggatgaagaaagagagattccagaacgatcttggaactcggggcacgaatgggtaacagacttcaaagggaagaccgtatggtttgtaccgagcatcaaagcggggaacgatatagccgcatgcttaaggaaaaatgggaagaaagtaatacaactaagtaggaagacatttgactcagaatatgtaaaaacaagagcaaacgattgggattttgtagtaacgacagatataagtgaaatgggcgcaaacttcaaagctgaaagagttatagatccgcgcagatgcatgaaacccgtaattttgacagatggagaggagcgagtcattttagcaggaccaatgcctgtcacacactctagtgcagcacaacgccgaggtcggataggacgaaatcccaaaaatgaaaatgatcaatacatctacatgggcgaaccattagaaaacgacgaggattgtgcacactggaaggaagccaaaatgcttttagataatattaacacaccagaaggtataataccatctatgtttgaacctgaacgtgagaaagtcgacgcaatagacggcgagtatagactccgaggtgaggcaagaaaaacatttgtagatcttatgagacgaggcgacttacctgtatggctagcatacaaggtcgcagcggaaggaataaattatgctgacagaaaatggtgcttcgatggcatcaaaaataaccaaatattagaagagaacgtcgaggtcgaaatatggacaaaagagggagaacgaaagaaacttaagccaagatggttagatgctcggatatattctgacccattagctctaaaagagttcaaggaatttgcagccgggagaaagtccttaacccttaatcttattacagaaatgggtaggttacctacatttatgacccaaaaggctaggaatgctctggataatctagctgtgctacatacagcggaagcgggagggagagcgtataatcatgcattgtcagagttgcctgaaactttagaaactctgttgctattgactttgttagcaaccgtaacaggtgggattttcctcttcttgatgtccggaaaaggtatcggcaaaatgacattaggtatgtgctgtattattacagcttcgtctctattatggtatgcacagatacaaccacactggatcgcagccagcattatactagagttcttccttatagtgttattaattccggaacccgaaaaacaaagaacaccacaggacaatcaactaacatacgtcgttatagcgatattaaccgtggttgcggccacgatggctaatgagatgggatttttagagaaaaccaagaaagatttgggcctaggatccataacaacacaagaaagtgaaagcaatatacttgatatagacctaaggccagctagtgcttggacattatacgcggtagcaactacattcgtaacgccgatgttgcgacatagtatagaaaacagctccgttaacgtttcattaacagcgattgcaaaccaagcaacagttttaatgggattaggaaaaggctggccactatcaaaaatggatataggggtccccttattggcaattggctgttattctcaagtgaacccaattacgcttactgcagctctgctactattagtggcccattacgctataataggacctggactacaggccaaggcaacgagggaagctcagaagagagcagcagcaggtataatgaaaaaccctactgtagacggaattacagtcatagatttagaaccgataccctacgatccaaagtttgaaaaacagcttggacaagttatgttactgatattatgtgtgacacaagttctaatgatgagaacaacatgggcactctgcgaagccctcacactcgcaactggtcccatttcaactttgtgggaaggaaacccaggccgattctggaacacaaccatcgcagtttctatggcaaatatctttaggggatcgtatttagccggagcggggttactctttagtataatgaagaatacgaccaatacaagaagaggaacaggtaacatcggggaaacacttggagaaaaatggaaaagtagattaaatgcattgggcaaatctgagtttcaaatatacaagaaatccggtatacaagaggtagataggaccctagctaaagaaggcataaaaagaggagagacagaccaccacgctgttagtcgtggaagtgcaaaactgaggtggttcgttgaacgtaatatggttacacctgaaggcaaagtagttgatctagggtgcggaagaggaggatggtcctattattgtggagggttgaagaatgtccgcgaagtaaaaggtctaactaaaggagggcctggacatgaggaaccaataccaatgtcaacctatggttggaatttagtaagattacaatcgggtgtggatgttttctttacgcctcccgaaaagtgcgatacactattatgtgacatcggagagagttccccaaatcccaccattgaagcgggaaggacactaagggtattgaaccttgtagaaaactggctaaataacaatacacaattttgtattaaagttttaaacccttatatgccctcagtaattgagaaaatggagacgctacaaagaaagtatggaggcgctctagtgcggaatcccctatcacgtaatagcacacatgaaatgtactgggtgagtaacgcaacagggaacatagttagctcggtaaatatgatttccagaatgttgattaacagatttactatgaaacataagaaagcaacctatgaaccggacgtagatttaggatcagggacgcgaaatattggcatagaatctgaaattccaaaccttgacattatcggtaaacgaatagagaaaattaagcaagaacatgagacttcatggcattatgaccaagatcacccttacaaaacatgggcttatcacggaagctacgaaaccaaacaaacgggtagtgcgtcatcaatggtcaacggagtcgttagacttctaaccaagccatgggatgtcgttcctatggtaacccagatggctatgaccgacacaacccccttcggtcaacaaagagtctttaaggagaaggtagacacgaggacacaagaacccaaagaaggaactaagaaactaatgaaaataactgctgagtggttatggaaagagctaggcaaaaagaaaacaccacgtatgtgcacacgggaagagttcactcgtaaggtaaggtcgaacgctgcgctaggagcaatatttacagacgaaaacaaatggaaaagtgccagagaagcagtagaagacggacgattctgggaattagttgatcgagaaagaaatcttcatctagaaggaaaatgcgaaacttgtgtatacaacatgatgggaaaaagagaaaagaagttaggcgagttcggaaaagccaaaggctcgagggccatctggtatatgtggctcggagctagattcttagagttcgaagcccttggttttctaaatgaagatcattggttcagtaggggtaactcgctatcaggtgttgaaggagaaggattgcataggctcggctacatcctcagagaggtaggaaagaaagaaggaggagcgatgtatgctgacgatactgcaggatgggatactagaataaccttagaagatctcaaaaatgaagaaatggtaacaaatcacatgaaaggagaacataagaaattagcagaagctatttttaaacttacataccaaaacaaagtcgtacgagttcaacggcctactcctcgaggtacagttatggatataatttctaggagagaccaacgcggaagtggccaagtaggcacgtatggactaaacacattcactaacatggaagcacaactcattaggcaaatggaaggggaagggatttttaaaagtatccaacacttaactgcaaccgaagaaatagctgtacaaaattggcttgcccgagtaggcagggaacgactatcaagaatggcgatttccggtgatgattgcgtagtaaaaccaattgatgaccgcttcgccagtgcattaaccgctcttaacgatatgggaaaagttagaaaagacatccaacaatgggaaccatctcgtggttggaatgattggacacaagtaccgttctgttcacatcatttccatgaattagttatgaaggacggacgagtacttgtggtgccctgcaggaatcaagatgaattaattgggcgcgcaagaatatcacaaggcgctgggtggtctctcaaagaaactgcctgcctcgggaaatcatacgcccaaatgtggaccttaatgtacttccaccgtagagatttaagactcgctgcaaatgccatatgttccgcagtcccaagtcattgggtaccaaccagccgcacaacatggtccatacatgctaaacacgaatggatgactacagaggatatgctggcagtttggaatcgagtatggatccaagaaaatccatggatggaggacaaaactccggtagaatcttgggaagaagtaccatacctcgggaaacgtgaagatcaatggtgtggtagtttgataggtctgacgagcagagcaacttgggccaaaaatatacagaccgccataaaccaagtaagatccctcatagggaatgaggaatatacagattacatgccttcaatgaaaaggttccgacgtgaagaagaggaggccggtgtcttatggtaa

SEQ ID NO: 22967 - RNA, 9876 nt, synthetic construct
  misc_feature 1..9876: note = derived and/or modified CDS sequence (opt6) from DENV-2__AY702034__SS-prME
  source 1..9876: mol_type = other RNA
actgccggcgtaatagtgatgttgattcctacagcgatggcatttcacttgaccacccgaaatggagaaccgcatatgatagtcggacgtcaagagaaaggcaaatccttgctttttaaaacagaagatggagtaaacatgtgtacattaatggctatagacctgggggaactttgcgaagacactattacctacaaatgtccattacttagacaaaatgaaccggaagatatagactgctggtgtaacagcacctctacgtgggtgacatacggtacctgcacgactacaggagaacatcgaagagagaaaagatctgtcgccctagtaccccacgtaggcatggggctagaaactagaacggaaacttggatgtcatcagagggtgcatggaaacatgtccaaaggattgaaacatggattctaagacatcccggtttcacaatcatggctgcgatcctagcgtacacaatagggacaacccatttccagagagcacttattttcatattgttaacggcggttgcacccagcatgacaatgagatgcattgggataagtaatagagactttgtggagggagtatcaggtgggagctgggtagatatagtactagagcacggcagttgtgtcacaactatggctaaaaataaacctacactagattttgagttaatcaaaacggaagctaaacagccagccacattaaggaaatattgcatagaggcgaaactcacaaatacaaccacagagagcagatgtcctacacagggtgaaccgagccttaatgaggaacaagacaaaaggtttatttgtaaacacagtatggttgacagaggatggggcaacggatgcggattgttcggaaaagggggaatagtcacatgtgcaatgtttacgtgcaaaaaaaacatggaaggaaaagtggtgcagccagagaatcttgaatacacaatagtaataacaccacattcaggagaagaacatgctgtaggaaacgatactggtaagcacgggaaggagataaagattacaccacaatctagcataacggaagcggagctaacgggttacggaaccgttacaatggaatgctctccacgtactgggctagactttaatgagatggttctccttcagatggaagataaagcgtggttggtacaccgccaatggttcttagatctgcccttaccatggctgccaggtgccgatacacaaggtagtaattggatccaaaaggaaactctggttacattcaaaaatccacatgctaaaaaacaagacgttgtcgtactaggatcacaagagggagccatgcacactgctctgacaggcgccacagaaatacaaatgagttctggtaacttgctttttacagggcatttaaaatgtagattgagaatggataaacttcaactaaaaggtatgagctacagcatgtgtactgggaaattcaaaatagtaaaagaaatagccgaaacgcaacatggtactatagtgattcgcgtacaatacgaaggggacggatcaccttgcaaaattccatttgaaataacagatcttgagaagaggcatgtattagggagactaatcactgttaatccaatagttacagaaaaagattccccagtaaatatagaagcagagcctccgttcggcgactcgtatataataatcggcgtggagcctggtcaactaaagctaaattggtttaaaaaagggagttcgataggccagatgtttgaaactacaatgaggggagcgaagcgcatggcaatactaggagacacagcctgggacttcggcagcttagggggagtttttacgtctataggaaaagcgctgcatcaagttttcggcgcaatatacggagctgccttctcgggggtatcgtggaccatgaaaatccttataggtgtcataattacttggatagggatgaatagccgctcaacatcgctttcagtatccctggtattagtgggtgtagtaaccttatatctgggggcaatggtccaagcagacagcggatgtgtagttagctggaaaaataaggaattaaagtgtgggagtggaatatttatcacagacaacgtacacacttggacagaacaatacaaatttcaaccggaatctccaagcaaacttgctagtgcgattcaaaaagcgcacgaggaggggatctgcgggattagaagtgtgactcgccttgagaatttaatgtggaagcaaattaccccagaacttaatcacatactatctgaaaatgaggtaaagcttaccatcatgacaggggatatcaaaggcattatgcaggcaggcaaacgaagtcttcgaccacagccaacggagttaaaatactcttggaagacgtgggggaaggcaaaaatgttgtcaacggaaagccacaaccaaacatttttgatcgacggaccagagactgctgaatgtccaaatacaaatagagcatggaactccctagaggtggaagactatggatttggagtcttcactaccaacatttggctcaagctgcgtgagaagcaagacgtattttgcgatagtaaactaatgtcggcagcgataaaagataatcgtgctgtacatgccgatatgggatactggattgaatcggcacttaacgacacctggaaaatggaaaaagcgtcattcatagaggttaagtcgtgtcactggcctaaatcacacacactgtggtcaaatggggtcttagaaagtgaaatgataataccaaaaaatttcgcaggacctgtctcacaacataactatagaccagggtaccacactcaaactgcaggaccctggcatcttggaaaactcgaaatggattttgatttctgtgaagggaccactgttgttgtaactgaggactgtggtaataggggtccgagcctccggacgacaacggcctctggtaagctaataacagaatggtgctgtagaagttgtactctgccacctctaaggtatagaggggaagatggatgctggtatggaatggagatacggcccttaaaggagaaagaagaaaatcttgtgaatagtttggtaactgctggccatggacaaatagacaatttcagtctgggcgttctgggaatggctctttttctcgaagagatgttacgtacccgagtgggaacgaagcatgcaatactattagtcgcagtgagttttgtaaccctgataactggcaatatgagctttcgggatcttggtagagtaatggtgatggtgggagctactatgactgacgacataggtatgggtgtgacatacctcgctttactagcggcatttaaggttagacccacattcgcagcaggtttactattgagaaaattgactagtaaggaattaatgatggcaacaataggaatagcactactctcacagagcacgatgcccgagactatcctggaactcacagatgcactcgcactgggaatgatggttctgaaaatagtcagaaacatggaaaagtaccaactagccgtaacaatcatggcaatttcctgcgtaccaaacgctgttattcttcaaaatgcttggaaggtaagctgcactattctagcagctgtgtcagtgagcccattgctgctcacaagctcacaacagaaagctgactggataccattagccttgacaataaagggcctaaatccaaccgctatcttcctaacaactttaagtagaacatcgaaaaagcggagctggccattaaatgaagcgataatggcggttgggatggtttcaatacttgcttccagtttgttaaaaaatgatataccaatgaccgggccattagtggctgggggtttactaaccgtttgctatgtactcacaggcagaagtgccgacctagaacttgagagggcagcagatgtaaaatgggaagatcaagctgaaataagtgggagtagcccgatattaagtataacaatatcagaagatggaagcatgagtataaaaaatgaggaagaagaacagacattaactatattgattcgtactggcctgttagtaatatcaggagtatttccagtgagtataccgattacggctgcagcttggtacttatgggaagtaaaaaaacaacgcgcaggggtcctatgggatgtaccgtctcctccaccagtcggaaaagcagagcttgaagatggtgcgtatagaataaaacaaaggggcatattaggatacagtcaaataggcgctggagtttataaagagggcacgtttcacacaatgtggcatgtaacaagaggtgcagttctaatgcatcgtggtaaaagaatagagccttcgtgggccgacgttaagaaagatttaataagctatggtggagggtggaaactagaaggcgagtggaaggaaggtgaagaagtacaagtgctagcgttagaaccaggcaagaatcctagagcagtgcaaactaaaccgggtattttcaaaacaaacacgggaacaataggtgcagtctcgttagatttttctcctggaacctcaggatcgccaatagtcgataggaaaggaaaagtagtcggattatatgggaatggtgtggtaactagatcaggcgcttatgtttctgcaattgcacaaacagaaaagtcaattgaagataaccctgaaatagaagatgatatcttccgtaagaaaaggctaacaatcatggatttacatccgggggcgggtaaaaccaagcgatatttaccagccatagtcagagaagctattaatcggggtctgagaacactaattctggcgccaacgcgggtagttgccgctgaaatggaagaagcccttagaggcctgcccatacgttaccaaacgcctgctatccgagcagaacacaccgggcgtgaaattgtcgatttaatgtgtcatgctacattcacgatgcgattactaagtcccgtccgtgttcctaattataatttaatcatcatggatgaggcacattttacggatccagcctcaatagccgcgcgaggatatatatccacccgcgtagaaatgggtgaagccgctggaatattcatgacagcgactcctcctgggagccgtgatccatttccacaatctaacgctccgattatggatgaggagcgtgaaataccggagcgttcgtggaactctggacatgaatgggttactgacttcaaagggaaaacagtatggtttgttcccagtattaaagcaggcaatgatattgccgcatgcttgagaaaaaacggaaaaaaagtaatacaattgtcacgaaaaacattcgacagtgaatatgtcaaaacacgggcaaatgattgggattttgtcgtcacgacagacatttctgaaatgggggctaacttcaaagcagaaagagtcattgatccaaggcgttgcatgaagccagtcatattaacagacggagaagaaagagtgatcttagcaggtcccatgcccgtcacacactcaagtgcagcgcaacgcagaggacgcatagggagaaatcctaaaaacgaaaacgatcaatacatttatatgggagaaccactcgaaaacgatgaagattgcgcccattggaaggaagcgaaaatgctgttggataatataaatacgcctgaaggaatcattccatcaatgttcgaacctgaaagggaaaaagttgatgcgatcgacggcgaataccgtctaaggggagaagctcggaaaacgtttgtggacctcatgagaaggggagaccttcccgtatggctagcatataaagtagcagcagaagggatcaactatgcagacagaaaatggtgctttgacggaataaaaaataaccagatattagaagaaaatgttgaagtagaaatctggacaaaggaaggtgaacggaaaaaattaaagccaagatggcttgacgcccggatatattcggatcctttagcacttaaagaattcaaagagttcgcagcaggccgtaaatcgcttacacttaatctcataacggaaatggggagactacccacgttcatgacacaaaaggccagaaacgccttagacaacctcgcagttttgcacacagcagaggctggcggcagggcatataatcatgcactatcagaactcccagaaacactagagactttacttctactgacactcttagctacagttacaggtggtattttcctattcttgatgagtggtaagggaataggaaagatgacactaggtatgtgctgcatcataacggcatcaagtttgttgtggtatgcccaaatacagccccattggatcgctgctagtattatattggaatttttccttatagtattgctgatacccgaacccgaaaagcaacgaactccacaagataaccagttaacgtatgttgttatcgcaatattaacagtcgtagcggcgactatggcaaatgaaatgggattccttgaaaaaacaaaaaaagatctaggactcgggagtattactacccaagaatccgaaagtaatatactggacatcgatctaagaccagcatcagcctggacattatatgccgtagctacaacattcgttacacctatgctgagacacagtattgaaaactcaagtgtgaatgtttcattgaccgccatagcaaaccaagcaacggttttaatgggcttgggcaaaggctggccattatccaaaatggatataggggtgcctttacttgcaataggttgttactcgcaagtaaatcctatcacactaactgctgcactactcttgttggtagcacattatgcaattataggtcctggcctacaagccaaagccacacgggaagcacagaaacgagcagccgcggggatcatgaagaatccaaccgttgacggtataactgtaatagacttagaacctataccatatgacccaaagtttgagaaacaactagggcaagtgatgttactcatactttgtgtaacgcaagtcttaatgatgcgaacgacttgggctttatgtgaagcacttacattagcgacaggaccaatcagcacgctgtgggaaggtaaccccggacggttttggaatacaactatagcagttagtatggccaatatattccggggaagttatctagctggggcaggtttgctatttagcattatgaaaaatactactaatacaagacgaggcacaggaaatattggggaaacattaggagaaaaatggaaatcaagattaaacgcattggggaaaagtgagttccaaatctataaaaaatcaggtattcaagaagtggatagaacattagcaaaagaaggaataaaaagaggtgaaacagaccatcatgccgtctctagaggttccgcaaaactacgatggtttgtagaacgaaacatggttacaccagaaggaaaggtggttgatcttggttgtggccgaggcgggtggagctactattgtggagggctaaaaaacgttagagaagtaaaaggattaacgaaaggtggcccagggcatgaagaaccaatcccaatgagtacatatggatggaatttagttagattgcagagcggtgtagatgtgttttttacgcccccagaaaaatgcgatactctactgtgtgacataggagaaagctcacccaacccaactatagaggcaggaaggacacttcgtgtactaaacttggtcgagaactggttgaataataatacacaattttgtatcaaggtattaaatccatacatgccgtccgtaatagagaaaatggagacattacaaaggaaatacggaggtgctctcgtcaggaaccctctgtcgcgaaatagtacacatgaaatgtactgggtgtcaaacgcgaccggtaatatagtttcttctgtcaacatgatttcaagaatgttaatcaatcgtttcacgatgaaacacaaaaaagctacatacgaacccgacgttgacttgggttctggaactcgtaatataggaatagagtctgaaattcctaacctagatatcataggaaaacgcattgaaaaaataaaacaagaacatgagacttcatggcattatgatcaagatcatccctataaaacgtgggcgtatcacggatcgtacgagacaaaacagacaggatcggcatcaagcatggttaacggggtggtgaggttactaacaaaaccttgggatgtagtcccgatggtgacccagatggcaatgaccgatactaccccttttggccaacaacgcgttttcaaggagaaagtcgacacacgaacacaagaaccgaaagaaggcaccaagaaacttatgaagataactgctgaatggctgtggaaagaactaggaaaaaaaaaaacacctcgaatgtgtactagggaagagtttacccgtaaagtaaggagtaacgcagccttaggcgccattttcacggatgaaaacaaatggaaatctgctagagaagctgtggaagatggccgattctgggaactagtcgatagagagaggaatctccacctagaaggaaaatgcgaaacttgtgtttacaatatgatgggaaaaagagaaaaaaagcttggagaatttggaaaagccaaagggagcagagcgatatggtatatgtggttaggagctaggtttctagaatttgaagccttaggatttttaaacgaagaccattggttttcacgaggcaattcacttagcggagtagaaggtgaaggtctacataggctcggctatattctaagggaagtaggtaaaaaggaaggtggcgcaatgtacgcagacgatacagccggatgggacactcgaattacattagaggatttaaagaacgaggaaatggtcacaaaccatatgaaaggcgaacacaagaaactagcagaagcaatctttaaactaacttatcagaataaagtcgtcagggttcaaaggccaacgccgcgtggtacagttatggatataatatcaaggagggaccagcggggatcaggccaagtgggaacttatggacttaatacctttactaatatggaggcccaattaataaggcaaatggaaggagagggaatttttaaaagtatacaacacctgactgcgacagaggagattgcggtccaaaattggttagctagagtaggtcgtgaaagattgagccgtatggcaatatcaggggacgactgtgtggtgaaaccaatagatgacagatttgcatccgctttaaccgcattaaacgacatggggaaggtccggaaagacatccaacagtgggagccaagtcggggatggaacgattggactcaagtcccattttgttcacatcatttccacgagctagtcatgaaagatggcagagtattagtcgttccatgtaggaatcaggacgaattaataggcagagcgcgaatatctcaaggtgcgggctggtcattaaaggaaacagcgtgtcttggaaaaagctatgcccaaatgtggactttgatgtattttcatagaagagatctaaggttagcagctaacgctatatgctcagcagttccgagccattgggtcccaacatcaagaactacctggtccatacatgcaaaacatgaatggatgacaactgaagacatgttagcagtatggaacagggtgtggatccaagaaaacccatggatggaagataaaacaccggtcgagagttgggaggaggtcccctatctgggaaaacgcgaagaccagtggtgcggttctctaattggtctcactagtcgtgctacatgggcgaaaaacatacaaactgccataaatcaagtacgttctctgataggtaacgaagaatatacggattatatgccctcgatgaagagatttaggcgagaggaggaagaggcgggagtattgtggtga

SEQ ID NO: 22968 - RNA, 9876 nt, synthetic construct
  misc_feature 1..9876: note = derived and/or modified CDS sequence (opt6) from DENV-2__AF208496__SS-prME
  source 1..9876: mol_type = other RNA
actgctggtgtaatcgtaatgctaatacctacagcaatggcatttcatctgacaacacgaaacggagaacctcatatgattgttggacgacaagaaaaaggtaaaagcctattattcaaaactgaagatggggttaatatgtgcacattaatggcaatagatcttggtgaactttgtgaagacacaataacttacaaatgcccctttttgagacaaaacgaacctgaagacattgattgctggtgtaattttacaagtacatgggtcacatacggaacttgcacgacaacaggcgaacatcggcgcgagaaaagaagcgttgcactcgtaccccatgtcggtatgggactagaaacgcgcactgaaacatggatgagcagcgaaggagcatggaaacatgttcaacgtatagaaacatggattctaagacacccgggtttcacgataatggcagcgatacttgcgtacactattggtaccacacattttcagagagctctaatttttatattattgacagcagttgcgccatcaatgacgatgcgatgcattggcataagtaatagagattttgtggaaggggtttcaggaggtagctgggtcgacatagttttagagcacggaagttgtgttactactatggccaaaaataaaccaacattagattttgagttaataaaaaccgaagctaaacagccagcaaccttacgaaaatactgcatagaagcaaaattgacaaatacaacaacagagagcagatgcccaacccaaggagagccatctcttaatgaagaacaagacaaacgatttatatgtaaacacagtatggttgatcgtggatggggtaatggttgcggattgttcggaaaaggaggaattgtcacgtgtgctatgtttacatgtaagaaaaacatggaaggaaaggttgtgcagccggaaaacctagagtatacgatcgtaatcacaccgcacagtggtgaagaacatgcagttgggaatgatacaggaaagcacggtaaagaaatcaaaatcactcctcaatcatcaataacagaagcagagttaactggttacggtacggtaacgatggagtgttcaccacgcacaggcttagactttaatgaaatggtccttttgcaaatggaagacaaggcttggttagtacacagacaatggttccttgacctacctttaccatggttgccaggagcagatacacagggaagtaattggatacaaaaagaaaccctagttacgttcaaaaatccgcatgccaagaaacaagacgtggtagtactaggatctcaagaaggagctatgcatactgctttaactggagcgacagaaattcaaatgtctagtgggaacctgctattcaccggccacttaaagtgtcgtctgcgtatggacaagttacaactaaaaggaatgtcctatagcatgtgtactggtaaatttaagatagttaaggaaatagctgagacacaacacggcacaatagttatacgagtgcaatatgaaggagacggatcaccgtgtaagataccctttgaaataacagatctcgagaaaagacacgttttagggcgactcattactgttaacccaatagtaaccgaaaaagacagtcctgtaaatattgaagctgaaccaccttttggtgactcatatattataataggcgttgaacccggtcaactaaaattaaattggtttaagaaaggatcatcgatcggccaaatgtttgaaacgacaatgagaggagcaaaaagaatggctattctcggtgacacggcttgggacttcggaagccttggaggagtgttcactagcatcgggaaagcacttcatcaggtcttcggcgctatatacggagctgcattctcgggtgtttcttggaccatgaagatactcattggggtgataatcacgtggataggaatgaatagtagatcaacatcactatcggtatcccttgtcctagtaggtgtagtcacactatacctaggagcaatggtacaggctgattccggatgtgttgttagttggaaaaacaaagaacttaaatgtggatcaggtatctttatcaccgataacgtgcatacatggacagaacagtataaatttcaaccagaaagtccaagtaaattagcatctgcaatacaaaaagcgcatgaagaaggtatatgcggaatcagaagtgtaacgagacttgaaaatctaatgtggaaacagatcactccagagctcaaccacattttaagcgagaacgaagtaaaattaactataatgacaggggatattaaaggcatcatgcaagcagggaaaagatctcttcgcccacaaccaactgaacttaaatattcctggaaaacgtggggtaaagcaaagatgctttcgactgaatctcataatcagacttttctaattgacggccctgaaactgcggaatgtcccaacacgaatcgagcatggaatagtttggaggtagaagattatggatttggcgtcttcacaactaacatatggttaaaactcagagaaaaacaagacgtattttgtgatagcaagttaatgagtgcagcgattaaagacaaccgagccgtccatgcagacatgggatattggatagaaagtgcactgaacgacacatggaagatggaaaaggcttcttttatagaagttaagtcgtgccactggccgaaaagccatacactatggagtaacggagtcctggaatccgaaatgataattcccaaaaacttcgcaggacccgtaagccaacataactatcgcccgggctaccatacacaaacagcaggaccttggcacttaggaaaattggaaatggacttcgacttttgtgaaggtacaacagtagtggtaactgaagattgtggcaaccggggtccatcattacgtacaacaacggcttcaggaaaacttataactgaatggtgttgtcggtcatgcacactacctccattgcgatatcgaggagaagatggatgttggtatggcatggagattagaccgctaaaagagaaggaagaaaatctagtcaatagcttggtcaccgcaggacacggacaaatcgacaattttagcctaggcgttttaggcatggccctatttttagaagaaatgctaagaactcgcgttggaacaaaacacgcaatactgcttgtcgcagtatcatttgtaactctcattactggaaatatgtcttttcgcgacctcggacgcgtcatggtgatggtaggagcgaccatgacggacgacataggtatgggtgtcacttatctagctctcttagcggcattcaaagtgagaccgactttcgctgccggactattacttagaaagttaacgtcaaaggaactaatgatggctacgatcggtattgccttattaagtcaatcaactatgcccgagacaatcttagagctaactgacgctctagctcttggaatgatggtactaaaaatcgtccgaaacatggaaaaataccaattggctgtaactatcatggcaatatcgtgtgtgccaaacgcagtcatactgcaaaacgcatggaaggtgtcatgcacgatattagcagcggtaagcgttagtccattactgctaacatcaagccagcaaaaagcagattggataccattggccttaacaataaagggtttaaacccaaccgctatcttccttacaacattatcaagaacatccaagaaacgaagctggccattaaatgaagcaataatggccgtagggatggtatcaatattagctagttcattattgaaaaatgatataccgatgacaggacctttagtagccggcgggctactaaccgtctgctatgtactaactggcagaagcgcagatttagaactggagagagcggctgatgtcaaatgggaggatcaagctgaaatatctggctcaagcccaatactcagtattacaataagtgaagacggatcgatgagtattaaaaacgaagaagaggaacagactctcaccattctaataaggacaggactcctcgtaatatcaggagtcttcccggtatcaatcccaataaccgcggcggcctggtacttatgggaggttaaaaagcagagagcaggggtattgtgggacgtaccttcgccaccccctgtaggcaaagccgagttagaagatggtgcttatagaataaaacaaagaggcattcttggatacagtcaaataggggcaggggtgtacaaagagggtactttccacacaatgtggcacgtcaccagaggagcagttttaatgcataggggaaaacgtattgagccctcatgggcagatgtgaaaaaggacttaatatcatatggaggaggatggaaactggaaggtgagtggaaagaaggtgaggaagtacaagtactagcgctagaaccgggcaaaaacccacgagcggtacaaacgaagcctgggatattcaaaacaaatacgggcacaattggagcagtcagcttagatttttcccctggtacaagcgggtcacctattgttgacaggaaagggaaagtcgtcggtctatatggaaacggtgtagtaacaaggagcggagcttacgtcagcgccatagcacaaaccgagaaaagcatcgaagataatcctgaaatagaagacgatatttttaggaagaaacgtttaacaataatggatctacatccaggtgctggcaagacgaaaagatacttacctgctatcgtaagagaagccataaaacgaggcctaaggacccttatcttagccccgacgagagttgtcgcggctgaaatggaagaagcattaaggggcttgcctataagataccaaacgcctgctatacgagctgaacatacaggtcgagaaatagtagatttaatgtgccacgccacatttacaatgagattactgagtcctgtaagagtcccaaattacaacctaatcataatggacgaggcgcacttcacagatcctgcaagcattgcagcgagagggtatatatcaacaagggtagagatgggagaagctgccgggatatttatgaccgcgacacctccgggaagcagagatccatttccccaatcaaatgcgcctataatggacgaagaaagagagattccagaacggagctggaactctgggcatgagtgggtaacagacttcaaaggaaaaacggtatggttcgtcccttccataaaggcggggaatgacatcgccgcatgtctaaggaaaaacggaaagaaagttatccaattatcgaggaaaacgtttgactctgaatacgtgaaaacacgagccaacgactgggattttgtggtgacgacagacataagcgaaatgggtgctaactttaaagcagaaagagtcatagaccccagacgatgcatgaaaccagtcattttgacagatggtgaagaaagagtgatcctagctggcccaatgccagtaacgcactctagtgctgcgcagagaaggggcaggataggcaggaaccccaaaaacgaaaatgaccaatatatttatatgggagaaccgcttgagaacgacgaggactgcgcacactggaaggaagcaaagatgttattggataatattaatacgcccgagggtataatccctagtatgttcgaaccggaacgcgagaaggtggatgctatcgatggagaatataggttacggggcgaggcgagaaaaacgttcgtggacttaatgcgtagaggagatttaccagtttggttagcctacaaagtggctgccgaaggtataaattacgctgatcgaaaatggtgtttcgacggtatcaaaaataatcaaatactagaagagaacgttgaggttgagatttggactaaagaaggagaaagaaagaaactaaaaccaagatggttggacgcgcgcatatattcagacccactggcactgaaagaatttaaggaatttgcggcagggagaaaatcactgacacttaatttaataacagagatgggaagactgccaacattcatgactcagaaagcaagaaatgcattggataatctagccgtcttgcatacggcagaagccggaggacgtgcttacaaccatgctctttccgaactacccgaaaccctagaaacactgttattattaactctattagcgactgtgacaggcgggatatttttgtttctcatgtctggaaagggtattggcaaaatgacgttaggaatgtgctgtataatcaccgcatcttctttattatggtatgctcaaatccaaccccattggatcgcggcttctattatcctagagttctttttaatagtattactgataccagaacctgaaaagcaacgtaccccacaagacaatcaacttacttatgtcgtaattgccattttaacggtggtagcagcaacaatggcaaatgaaatgggatttttagagaaaacgaagaaagatttgggtttaggatcaattgctacacaagagagtgaaagcaatatccttgacatagatttacgcccagcgtcggcatggacactgtatgcagtagcaaccacctttgtaacaccaatgctcagacatagtatagagaactcgtccgttaacgtatcactcaccgcgattgcaaaccaggctacggtattaatgggcttaggtaagggttggccattatcaaagatggatattggagtgcctcttcttgccatagggtgttactcacaagttaatccaattacattaacagcagcattactgctacttgttgcacattacgcaattatagggcccggcctacaagctaaggcaaccagagaagcacaaaagagggctgctgctggaattatgaaaaacccgacagtggacggcatcactgtaattgaccttgaaccaataccatatgatcctaagttcgaaaaacaacttggtcaagtcatgctcctgatattgtgcgtgacgcaagtacttatgatgcggacaacatgggctctgtgtgaggcacttaccctggcaacagggccaatatcaacattgtgggaaggaaaccccggcagattttggaatactactatagccgtgagcatggctaatatatttagaggtagttacttggcaggcgcagggctcttgttttctattatgaagaatacgactaacacaagaagaggaactggtaacattggagaaaccctaggagagaaatggaaatctagattaaatgctctaggtaaatcggagtttcaaatttataagaagtcaggcattcaagaagttgatcgaactcttgcaaaagagggtattaagagaggcgaaacagatcaccacgccgtatctagaggaagtgctaaactaagatggttcgttgagagaaatatggttacaccggagggaaaagttgtagacttgggatgtggccgcgggggctggagttattactgcggtgggttgaaaaatgtacgtgaagtgaaaggtttaaccaagggcggtcccggacacgaagaaccaattcctatgtcaacatacggttggaatctagttcgtctacaatcaggtgtagatgttttctttacaccacctgaaaaatgtgataccctactatgtgatataggtgagagctcacccaatccaactattgaagcgggccggacactacgagtcctaaatctagttgagaattggctaaacaacaacacacagttctgtataaaggttcttaacccatacatgccctcagtcatagagaaaatggaaaccttacagagaaaatatggaggagctctagtacgcaacccgctttcgcggaacagcacccacgaaatgtactgggtctcaaatgctactggaaacatagtctcgagcgtcaacatgatcagtcgcatgctgatcaacagatttacaatgaaacataagaaagctacatacgaacctgacgtagatcttggaagtggaacgcgcaacattggaatagagtcagaaatacctaatttagatataatcggcaaacgaatcgagaagattaaacaagaacatgagacatcctggcactacgatcaagaccatccttataaaacatgggcttatcatggttcatacgaaactaaacaaaccggcagtgcgtcatcaatggtgaacggagtagtccggcttcttaccaaaccatgggacgtggtacctatggtaacacaaatggcaatgacggatacaactccatttggacaacaaagagtcttcaaggaaaaagttgacaccagaactcaggaacctaaagaaggtacaaagaaattaatgaaaataacggccgaatggctttggaaagaattaggcaaaaagaaaacacctcgaatgtgtaccagagaggaatttactcgaaaggttagaagcaacgctgcgttgggagcaatattcacagatgagaacaaatggaaaagcgctagagaagcagtagaagatggacgtttctgggaactcgtggatcgtgaacggaacctgcacctagaaggcaaatgtgagacgtgtgtgtacaacatgatgggtaaaagagaaaagaaacttggtgagttcggcaaggcgaaagggagtcgagcaatttggtacatgtggctgggagctagatttctagagttcgaagcacttggatttttgaacgaagatcattggttttctagaggaaattcccttagtggtgtagagggtgaaggactccatcgattaggatacatattaagagaagttggtaaaaaggaaggcggagctatgtatgctgacgacacagcagggtgggatacaagaattacactagaagacctgaaaaatgaagagatggttacaaatcatatgaaaggtgagcataagaaattagccgaggctatctttaaacttacatatcaaaacaaagtagtacgagttcaacggccaacacctaggggtacagtgatggacataataagcagacgggatcaacgtggctcaggtcaagttggcacatatggcttgaatacttttacaaacatggaagcacagctcataagacaaatggagggtgaagggatattcaaaagtatacagcatttaacagctactgaagagatagctgtccaaaattggttggcaagagtaggaagggaacgattatcacgtatggctatatcaggcgatgattgcgtggtgaagcctatagacgacagattcgctagtgcgttaacagcgctaaatgacatgggtaaagttaggaaagatatccaacaatgggaaccatcacgtggatggaacgattggacgcaagtaccattttgttcacatcacttccacgaattagtgatgaaagacggaagggttttggttgtcccgtgtcgaaatcaagacgaactgattggacgtgctagaatctcacaaggggccggatggtcactaaaagaaacagcctgcctaggaaaatcatacgcccaaatgtggacgctaatgtatttccacaaaagagatttacggttagccgcaaatgcgatttgttctgcagtacctagtcattgggttcctacttcacgtacaacgtggagcatacatgcgaagcacgaatggatgacaactgaagacatgctagctgtatggaatagagtctggatccaggagaatccgtggatggaagacaaaactcctgtggaatcgtgggaagaagtaccatatttgggaaaaagagaggatcaatggtgcggaagtttaataggactcacaagtagagcaacgtgggccaaaaacatacagaccgctataaaccaggtacgaagtttaataggtaatgaggaatacacagactacatgccaagtatgaaaagattcagacgagaagaagaggaggcaggagtcctatggtaa

SEQ ID NO: 22969 - RNA, 9876 nt, synthetic construct
  misc_feature 1..9876: note = derived and/or modified CDS sequence (opt6) from DENV-2__AY702040__SS-prME
  source 1..9876: mol_type = other RNA
accgcgggcatgataataatgctcattccgactgtcatggcatttcatcttactacgaggaatggcgaaccacatatgatagtttcaagacaagaaaaaggtaaaagcctactatttaaaaccaaagacggaaccaatatgtgtactcttatggcaatggatctaggagaattatgcgaagatacgattacttacaaatgtccgtttttaaaacaaaatgagcctgaagatatcgattgttggtgtaattctaccagtacttgggtaacctatggaacgtgtacgaccactggggaacatcgaagagagaaacgaagcgtagcactggtaccacatgttggaatgggattagaaaccagaacagagacatggatgtcatcagaaggagcctggaaacacgcccagagaatcgaaacttggatactaaggcacccgggcttcacaatcatggctgcaattttggcatacactatcggaacaacacatttccaacgagtattgatttttattttacttaccgcaattgcacctagcatgacgatgcggtgtattggtattagtaatcgagactttgttgagggagtatcaggagggagttgggtcgatatagtactagaacacggatcttgtgtcacaacaatggccaaaaataaaccgaccctagattttgaattaataaaaacggaagctaaacaaccagctaccctccgaaaatattgtatagaagcgaaattaactaacactacaactgattcaaggtgtccaacccaaggagagccaacactcaacgaagaacaagacaaacgctttgtatgtaaacatagcatggtagataggggatgggggaatgggtgtggacttttcggcaaagggggaatagttacctgtgcaatgtttacatgcaagaaaaatatggaaggaaaaatagtccaaccagaaaatttagaatacacggtagttataactccccattcgggtgaggaacacgcggtaggtaatgataccgggaaacatggaaaagaggtcaaaataacaccacaaagcagtattacagaggcagaacttacgggatatggtactgtgacaatggaatgttcaccgagaacgggtctggactttaacgaaatggtactattacagatggaagataaagcatggctagttcataggcaatggttcttagatctaccactgccttggctccctggagcagatactcaaggatctaattggattcaaaaagaaactcttgttacttttaaaaacccccatgcgaagaaacaagacgtcgttgtgctaggatcgcaagagggcgctatgcatacggctttgacaggagcaactgagattcaaatgtcgtcaggtaatctgttattcactggacacctaaaatgtcgtttaagaatggataaattacaattgaaaggcatgagttattccatgtgcacaggtaaatttaaaattgtaaaagaaatcgcagaaacacaacatggtacaatagtcatcagggttcaatatgaaggagacggttctccctgtaagataccatttgagataatggacttagagaaaagacatgtcctaggaaggttaattactgttaacccgatagtaacggaaaaagacagtcctgtaaacatagaagcagaaccacccttcggagactcctacattataattggagtggaaccaggccaactgaaacttgactggtttaaaaagggaagtagcataggacagatgtttgaaacaaccatgagaggcgcaaaaaggatggctatactaggggacaccgcatgggatttcggctcccttggtggagtatttacaagtattggaaaagcgctgcaccaagtatttggtgcgatttacggagcggcgtttagcggtgtaagctggactatgaaaatattgattggcgtaattatcacctggattggaatgaacagtaggtctacctcactgtccgtgagtctagttttagttggtatcgtaacgttatatttgggggttatggtacaggcggattctggatgcgtagtaagctggaagaacaaggaacttaagtgcggtagtggaatatttgtaactgacaatgtacatacgtggaccgaacagtacaagttccaaccagaaagtccctcaaaactcgccagtgcaattcaaaaagcccatgaggaaggtatatgtggcatcaggtcagtaactagactagaaaacttaatgtggaaacaaataactagcgaacttaatcatatactatcagaaaatgaagtaaaattgaccataatgacaggtgatattaagggaataatgcaggttggcaaaagaagcctgagaccacaaccgactgagctacggtattcgtggaaaacatggggaaaagccaagatgctgtccaccgaattacataatcaaacatttttaatcgacggaccagagaccgcagaatgcccaaacacaaacagggcatggaactctttagaggtagaagactatggattcggtgtgtttactaccaatatttggttaagactccgcgaaaaacaggacgcattctgtgacccaaaactaatgtcagcagcaataaaagataatcgcgcggtacatgccgatatggggtattggattgaaagcgctctgaacgatacttggaaaatcgaaaaagcgagtttcatagaggtcaaaagttgtcattggccaaagtcacacaccttgtggtctaatggcgtcctagaatccgagatggtaattcccaaaaattttgccggcccagtctcacagcataacaatcgtccaggatatcacacacagacagcaggaccatggcatcttggaaaattagaaatggatttcgacttttgtgaaggaacaacggtagtggttactgaagagtgtgggaaccgtggaccaagccttcgaacaactactgcatcaggaaaattaataacagaatggtgttgcagaagttgtactttacctcctttgaggtatagaggagaggatggatgttggtacgggatggagatacgacctctgaaggagaaagaagaaaatctagtttccagtttagttaccgctggacatggtcaaatagataacttcagtttgggtatcctcggtatggccctctttctagaggagatgttgcgcacgagggttgggactaaacacgcgatactattagttgcagtaagtttcgtcacactaattacaggaaatatgtcatttagagatctaggaagagttatggtaatggtgggagccaccatgactgatgacatcggtatgggcgtcacttatcttgcacttctagcagcttttaaagtaaggccaactttcgctgcaggacttctgctaagaaaacttacttcaaaagaattgatgatgacaaccataggaatagtattgctatctcaatcttcaattccagaaacgattttggaacttaccgatgctttggctttaggaatgatggtacttaaaatggtacgtaatatggaaaaatatcagttagcagtaaccataatggcgatattatgcgtaccaaatgcagtcatactacaaaatgcatggaaggtaagctgtaccatactagcagtagtttctgtgagcccgctattgctgacatcatcgcaacaaaaggcagattggattcctctagccttaacaataaaaggtctgaacccaacagctatattcctaacgactctgtcaagaacttccaagaaaagatcatggccattaaatgaagcaataatggctgtgggaatggtgagtatacttgcctcaagcctactcaaaaatgacattccaatgacggggccgttggtagcgggcggtctactcacggtatgttacgtactaacaggtcgatccgcagatttagaacttgaaagggccacagatgtaaaatgggatgatcaagctgaaattagtggttcaagtccgattttatcgatcataatttctgaagatggcagcatgtctatcaaaaacgaagaagaagaacagacactaactatactcattcggacaggactactggttattagtggtctttttccggtatccatcccaataacagcagcagcttggtatctctgggaagtgaagaaacaaagagcaggggtgttgtgggatgtacccagtccacctcctgtagggagagcagaattagaagacggagcatatcgcatcaaacagaaaggcatactcggctattcccaaattggagccggggtatataaagagggtacatttcatacaatgtggcatgttacccggggtgcagtattaatgcataaaggtaaacgcatcgagccatcgtgggctgacgttaagaaagatttaataagttatggaggaggctggaagctagaaggcgaatggaaagaaggagaagaagtacaggtactggcactcgaaccaggcaagaacccaagggccgtacagaccaaaccgggtctctttaggacaaatacaggcactatcggggcagtctcgctagatttcagcccagggacaagtgggtcccctatcgtagataaaaagggaaaagtagtagggctgtacggaaatggcgttgtaacaagaggtggcgcttacgtatctgccattgcacaaacggagaaaagtatcgaggacaaccccgaaatcgaggatgatatatttcgaaaaaggcggttaaccattatggaccttcaccctggtgccgggaaaacgaaaaggtatttaccagcaatagtaagggaagcaataaaaagaggactgaggacattaatacttgcccctacgcgtgtagtagctgctgagatggaagaggcgttgcgtggtttaccgatccgatatcaaactccagcaatcagggcagaacatacagggagagaaatagtagacttaatgtgtcatgccacgtttactatgcggctgctttcaccaatacgggttccaaattataatcttattataatggatgaggctcacttcactgatccagcgagcattgcagcgagaggttacattagcactagagtagaaatgggggaagccgcaggcatatttatgactgctacacctcctggatctagagatcccttcccacaatccaatgcgccaataatggatgaggaaagggagattccagaaagatcatggaactccggccatgaatgggtcaccgatttcaagggcaaaacagtctggtttgtaccgagtataaagacgggaaacgacatagctgcctgtcttagaaagaacggtaaaagagttatacagctgtcgagaaaaactttcgactcggaatatgtcaagacacgaactaacgattgggattttgtagtgaccacggatatatcagaaatgggtgctaacttcaaagcagaacgagtgatcgatccaagacgatgtatgaaacccgttatcttgaccgacggggaagaacgggtaatcttagcaggtccgatgccagtcacacacagtagcgctgcgcaaagaagagggaggatcggccgaaacccccgaaacgaaaacgatcaatatatttatatgggtgagcctttggaaaacgatgaagattgcgcacattggaaagaagcaaaaatgctattagataatataaatacgccggaggggataataccctcaatgttcgaacctgaacgagaaaaggtagacgcgattgatggtgaatacagattgaggggcgaagcgagaaaaacattcgttgatctaatgagaagaggagaccttcctgtatggctagcctataaagtagcggcagaaggcattaactatgcagaccgacgctggtgcttcgatggtacccggaataatcagatattagaagaaaacgtagaggtggaaatatggacgaaagaaggagagaggaagaaactaaaaccaagatggctagatgcgcgcatatactcagaccctctagctcttaaagaatttaaggagttcgcagcgggacgaaagagtctgacgttaaatttaataactgagatgggaagactgcccacatttatgactcaaaaggcaagggatgcactggataatttggcagtgttacataccgccgaggcaggaggtaaagcctacaaccatgcgttaagcgagctccccgaaacgttagaaaccttacttttactaaccttgttagcaaccgtaaccggcggaatctttctctttttaatgagtggaagaggaatagggaaaatgacattaggtatgtgctgcattataaccgcatctatacttttatggtacgctcaaatacagccgcattggatagcagctagtataatactagagttctttttgatagtcttacttatcccagaacctgaaaaacaaagaactccacaagacaaccaattaacttacgtgataatagcaatattaacagtcgtagcagcgaccatggccaacgaaatggggttcttagagaagacaaagaaagatttcggattgggacacatcgcaacccaacaacctgaaagtaatattttggatattgatttacgtccagctagcgcttggactctatatgctgtagcaaccacgttcatcacccctatgctaagacattcaattgaaaattcttcagtgaatgtatcactaacagcaatcgctaatcaagctacggtgttaatgggattaggaaaaggctggccactttctaagatggatataggcgtccctttactggcaattggttgctattcacaagttaatcctattacactcacagcagcgttattactactcgtagctcattacgctataataggacctggactacaagccaaagcaacgcgcgaagcacaaaaacgtgccgctgccggtataatgaaaaatcccacagttgacggaatcacagtaatcgatttggatcctatcccttacgatccgaaatttgaaaaacaattaggccaagtaatgttattagttctatgtgtaactcaagttctaatgatgcgaacaacctgggcactttgcgaagcgttgactctagcgaccggccccgttagcaccctctgggaagggaacccaggcagattttggaacaccacgatagcggtttcaatggccaatatatttcgaggatcttatctggctggggccggcctgctattttctattatgaagaatacaacaagtgctcgacgaggtacgggaaatatgggtgaaacattgggagaaaagtggaaatccaggcttaacgctttgggaaaatccgaatttcaaatatataagaaaagcggcattcaggaagtcgatagaacactcgctaaagaaggaataaaaagaggagaaacagatcaccatgcggtttccaggggaagtgcaaaactcagatggttcgtcgaacgcaacttagtcaccccagaaggcaaagtagttgacttaggatgtggacgaggcggatggtcttattactgcggaggactcaaaaatgttagggaagtgaaaggtctaacaaaagggggacctggccatgaggaaccaataccaatgtcaacctatggatggaacctagtcagacttcaatcaggagttgacgtcttctttgtaccgccagagaaatgtgatacattgctgtgcgatataggtgaaagttcaccaaaccccacggtagaagcgggaaggaccctacgagttctaaatttagtagaaaattggttaaataacaatacccaattctgcgtcaaagtactaaatccatacatgccctcggtaattgaaaggatggagactctccaacgtaaatatggaggagcgttagttaggaacccattaagccggaactccactcatgagatgtattgggtgtcaaatgcctcgggtaacattgtatcatcagtaaatatgataagccgaatgttgatcaatagattcacaatgagacacaaaaaggctacttatgaacctgatgtagaccttgggtcgggcacaagaaacatcggaatagagtctgaaaccccgaatttagacattatcgggaaaagaattgagaaaataaagcaagaacatgaaacatcgtggcactacgatcaagaccacccttacaaaacgtgggcataccatggctcttatgaaactaaacaaacaggatcagcttcctcaatggtcaacggagttgtaagactcctcacaaaaccatgggatgttataccaatggttacgcaaatggccatgacagataccacgccttttggtcaacaaagggtgttcaaagaaaaagtagacaccaggacacaagaacctaaagaaggcacgaagaaactaatgaaaataacagcagagtggttgtggaaagaattgggtaagaagaaaacgccaagaatgtgtacaagggaggaatttacgaagaaagttagatcgaatgcggccttaggagcaatatttacagatgaaaataaatggaaaagcgctcgtgaggcggttgaagacaatcgattttgggagttagttgacaaagaaagaaacctccatctcgaaggaaagtgcgagacgtgtgtgtataacatgatgggaaagagagaaaagaagttaggtgaatttgggaaagctaaaggaagtagggcgatttggtacatgtggttaggtgccagattcttagagtttgaagctctaggatttttaaatgaagaccactggttctcacgagaaaattcgctttcaggtgtagaaggcgagggacttcacaaattgggatatatcttgcgcgaggtaagtaaaaaggaagggggagctatgtatgctgatgacaccgccggatgggacacgcgaataacaattgaagatttgaaaaatgaggaaatgataacgaatcacatggccggtgagcataagaaactagcagaggccatctttaaattaacatatcaaaacaaagttgtaagagtacaacgtcctacaccacgggggacagtaatggacataataagtaggaaagaccaaaggggcagtgggcaagttgggacgtacggactaaatacatttaccaacatggaagcacaattgattagacaaatggaaggggaaggtatatttaaaagcatccaacatctgacagcttctgaggaaatcgcggtacaagactggctcgttagggtaggaagagaaagattatcgcggatggcaatttcgggagatgattgtgtcgtcaagccgttggatgaccgttttgctaaagcattaacagcgttaaacgatatgggcaaagtgcgaaaagatatacaacagtgggagcccagccgtggttggaacgactggacacaggtaccattctgtagccaccacttccatgaattgatcatgaaagatgggcgcacgctagtagtgccatgtagaaaccaagacgaattaatcggcagggctagaatatcacaaggagctggatggtccctaagagagaccgcatgtttaggaaaatcatatgcacaaatgtggagtttaatgtattttcatcgaagagacttaagattagcggcaaatgcaatttgctccgcggtacctagtcattgggtcccaacaagtagaactacctggtcaattcacgcatcacacgaatggatgacaacggaagacatgttaacagtgtggaatcgagtatggatccttgagaatccctggatggaagataagactccggtcgaaagttgggaggaaatcccgtaccttgggaagcgagaggatcaatggtgcggaagcctaatcggattaacttcacgagcgacatgggccaaaaatatacagacagctataaaccaggtgagatcattaataggtaacgaagaatatacggattatatgccatcgatgaagaggtttagaagagaggaagaagaagcgggcgttctttggtaa

SEQ ID NO: 22970 - RNA, 9876 nt, synthetic construct
  misc_feature 1..9876: note = derived and/or modified CDS sequence (opt6) from DENV-2__AY037116__SS-prME
  source 1..9876: mol_type = other RNA
acagcaggaataatcattatgatgataccgacggttatggctttccacttaacaacgcgaaacggagaaccacacatgatagtaagtagacaagaaaaaggtaaatctctactattcaaaacggaaaatggtgttaatatgtgtacattaatggcaatggatctgggtgaattgtgtgaagataccatcacctataattgcccgttgctacgacaaaacgaaccggaagatatagattgcgggtgccatagcacgagtacttgggtgacctatggaacatgtaccgcaacaggagaacaccgacgcgaaaaacgcagtgtggccttagttcctcatgtaggaatggggcttgaaactagaacagaaacatggatgagctcagaaggtgcctggaaacacgcacaacggattgaaacctgggtactgcgccatcctggctttacaataatggcggcaatattagcctataccataggaacaacgtatttccaacgagtcctaatatttattttactaacagctgtcaccccatcgatgactatgaggtgtataggtataagtaatagagattttgtagaaggagtttcaggaggaagctgggttgacattgtacttgaacatggttcttgcgtgacaacaatggccaaaaacaaaccaacgctcgatttcgaattagtgaaaaccgaagcaaaacacccggccacgttaagaaaatattgcatagaagcaaaactgacaaatacaactaccgcatcaaggtgtcccacacaaggcgaaccatctctaaacgaagaacaagacaaacgatttgtatgtaaacatagtatggtggacaggggctggggaaatggttgtggattatttggaaaagggggcatagtaacgtgtgctatgttcacttgtaagaaaaatatggaaggaaaagtcgttcaacctgaaaatctagaatataccatagtaataacaccacactcgggagaagagaacgcagtggggaacgacacggggaagcacggaaaagaaattaaagtaacaccccaaagctctataaccgaagcggaattaacaggatatggaaccgtgacaatggaatgtagtcctagaacgggattagacttcaacgaaatggtcttactacaaatggagaataaggcttggttagtacatagacaatggttcctggatctcccattgccctggctaccaggagcagacacccaaggatctaattggatccaaaaagaaaccctagtaacctttaagaacccacacgccaagaaacaagacgtagttgtgttgggatcccaagaaggggcgatgcatactgcattaaccggggcaacagaaattcaaatgagtagtggaaatttgctatttacaggccaccttaaatgtagattaaggatggataaactgcaacttaaagggatgagttacagcatgtgtacaggtaaattcaaagtcgtgaaagaaatagctgaaacccagcacggaacgatagtaatccgagtacagtatgagggagatggaagtccttgtaagatcccctttgaaataatggacttagaaaagcgtcacgtgttgggcagactgatcactgttaatcctatagttacagagaaagattcacctgtaaacatagaggctgagccaccgtttggagactcatatataattatcggggttgagccaggtcaactaaagctgtcgtggtttaaaaagggctcatccataggccaaatgtttgaaacaactatgcgtggcgcaaaaaggatggcaatattaggagatacggcatgggattttggctcgctaggaggtgttttcacgtccattggtaaagccctacaccaggtgtttggagccatttatggggctgctttttcaggtgtaagttggacgatgaaaatattaattggtgtagtaatcacatggattggaatgaatagcagatctacaagtctatcagtcagcctagtactcgttggagtagttaccctatatttaggtgtcatggtgcaagcggacagcggttgtgtggtgagctggaaaaataaagaactaaagtgtggaagcggcatctttataacagataacgttcacacttggacggagcaatacaaattccaaccagagagccctagcaagttggcaagtgcaatccaaaaggctcatgaggaaggaatatgtgggataagaagtgttacccgtttggaaaatcttatgtggaagcaaataacacccgaattaaaccatatactaagcgaaaacgaagtaaaactgacgataatgacaggcgacataaaagggattatgcaagctggtaaaagaagtctgcgaccccagccgacagagctcaaatacagttggaaagcgtggggaaaagccaaaatgttaagtacagaattacacaaccacacattcctaatagacggaccagagacagctgaatgccccaatacaaatagagcctggaactctctagaagtagaagactatggtttcggagtattcaccactaatatttggcttaagttgaaagaaaggcaagatgtattctgtgactctaaattaatgagtgcagcgataaaggacaacagagcagtacacgcagatatggggtattggattgagagtgctttaaacgatacctggaaaatcgagaaagcgtcgtttatagaagtaaaatcgtgccactggccaaaatcacatacattgtggtccaatggagtactggaaagcgaaatgataataccaaagaatttcgcgggtccggtcagtcaacataactatcgcccaggctatcatacacagaccgctggtccgtggcacttaggcagactggaaatggatttcgatttttgtgaagggacgacagtagtggtgacggaagattgtggcaatagaggaccttcactaagaacaaccaccgcatctgggaaactaattacagaatggtgttgtcgatcatgtacattaccaccactacgatatcggggagaagatggatgttggtacggaatggaaataagacctctgaaagaaaaagaggagaatctagtaaattcattagtaacggcggggcatggccagattgataactttagccttggagtacttggaatggcactattcctcgaggaaatgttgcgtacaagagtaggcactaaacacgcaatcttgctagtagcagtcagctttgtcactctaatcaccggaaatatgagcttcagggatctagggcgggtaatggtaatggtcggcgctacaatgacagacgacattggcatgggagtgacatacttagctttgttagctgcatttaaagtgcgtccaacatttgcagctggacttttacttaggaaattgacaagcaaagaattaatgatgacaacaattggaatcgtgctcctatcacaaagcacaatccctgaaacaatccttgaattaacagatgcctgggctctaggaatgatggtgttaaaaatcgtaagaaacatggaaaaatatcagttggctgttacgatcatggccatactatgtgtacccaatgcagtaatattacaaaatgcatggaaagtgagctgcacaaccttggctgtggttagtgtatcccccttgttattgacaagttctcaacaaaaagcagattggattcccttagcgttaacgattaaaggactaaacccaacagcaattttccttacaacgctatctagaacatcgaagaaaaggagctggcctctgaacgaagccataatggcagtgggtatggtaagtatcttagcctcttctctcctcaaaaatgatatcccaatgaccggtcctttagtcgctggaggattgcttacagtttgctacgtactcaccggcaggtctgctgatttagaactagagcgagcagcagatgtcagatgggaagaacaggctgagatatctggttcctcacccatactaagcataacgataagcgaggacggatcaatgtccattaaaaatgaagaagaagaacaaaccctcacgatccttattcgaaccggccttctggttataagtgggctatttcccgcatcgatacccataacagccgcagcatggtatctatgggaagtcaagaaacagcgtgctggtgtattatgggatgtgccatccccacctccagtcggcaaagcggaattagaggatggggcctatcgaataaaacagaaagggatattaggttattcccaaatcggagctggagtttataaagagggaacgttccatactatgtggcatgtaactaggggtgcagtacttatgcacaaaggaaagcgaatcgaaccatcatgggctgatgtaaagaaagatctgatttcctatggaggagggtggaaattggaaggagaatggaaagaaggagaagaagtccaggttcttgcacttgaaccagggaaaaatcctagagccgttcaaacaaaaccgggattatttaaaacaaacacaggaacaattggagccgtctccctcgatttttctccggggaccagcggaagcccaatagtagataagaaaggaaaagtagttggtctatatggaaatggagttgtaactcgtagcggagcttatgtttctgctatagcacaaacagagaaatccatcgaagataatccagaaatcgaagacgatattttcaggaagaaaaggttgaccatcatggacttgcatccaggtgctgggaaaaccaagcgttatctaccagctattgttcgggaggcaattaagagaggccttcgtacgttgatactagctccaactagagtagttgcagcggagatggaggaagccttgcggggtttaccaatcagatatcaaacaccggcaattagagcagaacatactggccgtgaaatagttgacttaatgtgtcatgcaacattcacgatgaggctattatctccgatcagggtgcccaactataatttgataatcatggacgaagcccattttactgatcctgcttcaatagcggctagaggctacattagcacgagggtagagatgggtgaagcagctggaatctttatgaccgctacaccacccggatctagagatccatttccacagtcaaacgcacccattatggatgaagaaagagaaattcctgaaaggagctggaactcaggacacgaatgggtgacagattttaaaggtaaaaccgtgtggttcgtcccatcaatcaaggcaggtaacgacattgcagcttgcctgagaaagaacgggaagaaagttatccaactgagtagaaaaactttcgatagcgagtacatcaaaactagaactaatgactgggattttgtcgtaaccacggacatttcggagatgggtgctaacttcaaagccgaaagggttatcgatcctcgacgatgcatgaaaccggtaatcctcacggatggagaagagagagtaattcttgctggacctatgccggtaacacattcgtcggcggcacaaagaagggggagagttggaagaaatcccaaaaatgagaatgatcagtatatatacatgggagagcccttggaaaatgacgaagactgcgctcattggaaagaagcaaaaatgttactggataatattaatacaccagaaggaattataccatcaatgtttgagccagagagagagaaagtggatgcaatagatggggaatacagattaagaggcgaagcacgaaaaacatttgtcgacttaatgcgaagaggggacctccctgtatggttggcatatagagtagcagctgaaggaataaactatgccgacagaagatggtgcttcgacggtgtgaaaaacaatcagatattagaagaaaacgttgaagtagaaatttggactaaagagggagaacgaaagaaactgaagccgaggtggctcgacgcgcgcatatactctgaccccctcgctctcaaggaatttaaagaatttgccgctggaaggaaaagtttaacgttaaatctcatcaccgaaatgggaagattacctacgtttatgacacaaaaagcaagaaatgcattagataacctggcggtgctacataccgcggaagcaggaggacgtgcatataaccatgcactaagcgaactacctgaaacgctagaaacgcttttattactcactctgctcgcgactgtaaccggtggtatctttctgttcttaatgagtggtaaaggtattggtaagatgacattggggatgtgttgtattatcactgcgagtatcttgttatggtacgctcagatacaaccacattggatagcagcaagtatcattttggagttctttttaatagtcttattaataccagaacctgaaaaacaacgtacaccgcaagataaccaattaacctatgtcgtgatagccatactcacagtggtagctgctaccatggcaaacgaaatgggatttttggagaagacaaagaaagattttggtctaggaagcattgctactcaacaaccagaatctaatattctcgatatagaccttcgaccggcatctgcctggacactatatgctgtggccactacctttataacaccaatgctcagacattctatagaaaatagttcagttaatgtctcactaacagctatagccaaccaagcaacagttctaatgggactagggaaaggatggccattgtctaaaatggacataggtgtccctctcctagcgatcggatgctattctcaagtcaacccaattacattaacggccgccctattattattagttgcacactatgcaataataggacccggtctacaagccaaagcgacgcgagaggcccagaaaagggcggccgccggaataatgaaaaatccgacagtagatggaatcactgtaatagatcttgaccccataccatatgacccaaaattcgaaaaacaactgggtcaagtcatgctactggtattatgtgttacacaggtactaatgatgagaacaacttgggctctctgcgaagccttaaccctcgccaccggaccaatcagtaccttgtgggaaggaaacccaggaagattttggaacaccaccatagctgtaagtatggctaatatatttagaggatcttacctagctggagcaggcctactattttcaataatgaaaaatactgcgaacactagacgcggaacagggaatactggggaaacactaggtgaaaaatggaaaaatagattaaacgcacttggtaaaagtgagttccaaatctataagaagtcaggtatccaggaagtcgataggacgttggcaaaagaaggaatcaagcgaggagaaacggatcaccacgcagtctcaagaggaagtgcaaaactccgctggtttgtcgagaggaacctagtgacaccagagggaaaggtagttgatttaggttgtggaaggggaggatggtcctactactgtgggggtttaaagaatgtcaaagaagttaagggactaactaaaggaggaccaggtcatgaagaacctattccgatgagcacctacggatggaacttagttcggctccaatcgggcgtagacgttttctttacaccgccagaaaagtgtgatactttattgtgtgatataggagaatcttcgcctaatccaacggtagaagccggcaggacgttaagagttcttaatttagtagagaactggctaaacaataacacgcaattctgcataaaagttttaaacccgtatatgccttcagtgatagagaaaatggaagcacttcaacgaaaatatggcggagctttggtcagaaatccactcagtagaaattccactcacgaaatgtattgggtcagtaacgcaagtggaaacatagtttcttcggtaaatatgatctcaagaatgctaattaacagattcacaatgagacataagaaagcaacgtatgaacctgacgtagacttaggcagtggaaccagaaacataggaatagagtccgagacacctaacttagatattatcggtaaaagaatagagaagataaaacaggagcatgagacttcttggcactacgatcaggaccacccatataaaacgtgggcttaccatggcagctatgagacaaagcaaacgggctccgcgtccagcatggtgaatggagtagtacgattattgacaaaaccgtgggatataatccctatggtaacacagatggcaatgactgatacaactcctttcggccaacaaagagtttttaaagaaaaagtagatacaagaacgcaagagccaaaggaaggtacaaagaaactcatgaaaattactgccgagtggttatggaaagaactaggcaagaagaaaacaccacgaatgtgcacacgagaagagtttactcgaaaagtaaggagtaatgctgccttaggggccatctttactgatgaaaataaatggaaaagtgctcgtgaagcagtcgaggatagcggattttgggagctcgtagataaagaacgtaacctccacttagaaggaaaatgcgaaacctgtgtgtacaatatgatgggcaaacgggaaaagaaacttggagagttcggaaaagccaaaggcagcagagcaatatggtatatgtggctaggcgcccggttcctcgagttcgaagcgttaggatttctaaacgaagatcattggttttcccgcgaaaattcattaagtggcgtggaaggagaaggtctacataaacttgggtatattctacgggacgtaagtaagaaagaaggcggcgcaatgtatgcagatgacacagcgggttgggacacacgtataacgctcgaagacttgaagaatgaggaaatggtaacaaatcatatggaaggtgaacataaaaagctggcggaggcaatatttaaactcacctaccaaaataaagtcgtgagagtacaaaggcccacccccagaggtactgtcatggacatcatcagtcgtagagaccaaaggggcagtggtcaggtagtaacatacggattaaacacctttacaaatatggaagcacaacttatacgtcaaatggaaggcgaaggcgtctttaaatctatacaacatttaacagtaactgaagaaatagcagtcaaaaactggttagttcgagtcggtcgagaacgattgtcacgaatggcgatatcaggtgatgattgtgtagttaaaccattggacgacaggtttgcatcagccttaactgctctaaacgacatgggtaaagtaagaaaagatattcaacagtgggaaccctcaagaggatggaatgattggacacaagtaccgttttgcagtcatcactttcatgagctgataatgaaagacggaagagtattagtagttccatgtcgaaatcaggatgagttaatagggagagcaaggatatcgcaaggtgcaggttggtccttgcgtgaaactgcttgtcttggaaaaagctatgcacaaatgtggagtctaatgtactttcatcgccgagatctacgtttggcagcaaatgctatatgcagtgctgtaccatctcactgggtcccaacaagtaggacgacttggtctattcacgctacgcacgagtggatgacgactgaagacatgttaacagtatggaaccgtgtttggattcaagaaaacccatggatggaagataagacacctgtagagtcgtgggaggaaatcccttatctcggtaaacgcgaagaccagtggtgcggttcattaataggacttacctcgagggcgacatgggcaaagaacatacagacagcaatcaaccaagtgagatcactaataggtaatgaagaatatacggattatatgccgtcgatgaaacggttccgaagggaggaagaagaagcaggggtattatggtga

SEQ ID NO: 22971 - RNA, 9876 nt, synthetic construct
  misc_feature 1..9876: note = derived and/or modified CDS sequence (opt6) from DENV-2__AF169678__SS-prME
  source 1..9876: mol_type = other RNA
tcagcaggtatgattataatgttaattccaacagttatggcattccatctaacgaccagaaatggggaaccacatatgatagtttcaattcaggaaaaaggaaaaagtttactttttaaaacagaagatggagtaaatatgtgcaccttaatggcaatggatttaggtgaattatgtgaagatactataacatataaatgtcctttattaaggcaaaatgaacctgaagacatagactgttggtgtaactccacaagtacatgggtaacctacggaacctgcacaacaacaggagaacatagaagagagaaaagaagcgttgcattggtacctcatgttggaatggggttagaaacgcgaacagaaacgtggatgtctagcgaaggagcatggaaacatgctcaacgtattgaaacatggatcttaaggcatccgggatttactattatggcagccatcctagcatatactattggaactacccacttccagagagccctgatctttatattactaacggctgttgcacccagcatgacaatgcgatgcattggaatatcaaatcgagatttcgtagaaggagtcagcggaggaagctgggtagatatagttttagaacatggatcctgtgtcacgaccatggccaaaaataaaccaacacttgacttcgaactgattaaaaccgaagcaaaacagcctgctacacttaggaaatattgtatcgaagccaaattaacaaataccaccaccgaaagcagatgccctacacaaggagaaccatcgctaaaagaggagcaggataaaaggttcgtttgtaaacattcgatggtggacagagggtggggaaacggatgcggcttgttcgggaaaggaggaatcgttacctgtgctatgttcacttgtaagaaaaatatggaagggaaaatagttcaaccagaaaacctagaatacacgattgtcgttactccccattcaggtgaagaacatgccgtggggaacgatacaggaaaacacggtaaagaaataaaagttacgccacaatctagcatcacagaagcagaactcaccggatatggcacagtaacaatggagtgtagtccccgcacagggttagacttcaacgaaatggttctcctacagatggaaaacaaagcatggctagtacatcggcaatggtttttagaccttccacttccatggctgcccggggcagatacgcaaggtagtaactggattcaaaaagagacgcttgtaaccttcaaaaacccacatgccaagaaacaagatgtcgtagttcttggatcccaagagggagctatgcatacagcattgacaggagcgacagaaatacaaatgagcagcggaaatttattatttacaggacatctaaaatgtagattgagaatggacaaattacaactaaaaggtatgtcatacagcatgtgcacgggaaaatttaaagtagtaaaagaaatcgcggaaacacaacatggaactattgtgattcgcgtgcaatacgaaggggacgggtcaccttgtaaaataccgttcgaaataatggatctggagaagcgttatgtgctgggaaggttgataacagtaaatccaatcgtgacagagaaagatagcccagttaacatagaagcagaaccaccatttggtgatagttacataataataggagtagaaccagggcaacttaaattaaattggttcaagaaagggtcaagcattgggcagatgttcgaaacgactatgcgtggtgcaaagagaatggcaatattaggagacactgcgtgggactttgggtcgctcggaggcgttttcacatctattgggaaagcactacatcaagttttcggcgccatatacggcgcagcattttctggagtatcttggaccatgaagattctgataggagtcataattacgtggataggaatgaactctagaagtacaagtctgtccgtatctttggtattggtgggaattgtaacactatacctaggtgtgatggtacaagctgattccggatgtgttgtaagttggaagaataaagagctaaagtgtggatctggaatttttataacggataacgttcatacgtggaccgagcaatataaattccaacctgaatcaccaagtaaactagcgtcagcaatccagaaagcacaagaggagggtatttgcggcattcgttcggtaacaagactagaaaatttaatgtggaaacagataactccagaattgaaccatatattagcagaaaatgaagtcaagctaactataatgacaggcgacattaaaggaataatgcaagcgggaaaaagaagtctaagaccacaaccgaccgaattgaaatactcctggaaaacgtggggcaaagcgaaaatgttgtctacagaatcccacaaccagactttcttaatagacgggcccgaaactgccgaatgccccaatacaaatcgtgcttggaactcgttagaagttgaagattacggcttcggggtgttcacaacgaatatatggctcaaacttaaagaaaaacaggatgcattttgcgattcaaagctcatgtcagccgcgataaaagacaatcgtgccgtccatgcagacatgggctattggatagagtcagcattaaacgacacctggaaaatagaaaaggcatcattcattgaagtgaaaaactgccattggccaaaaagccataccttatggagtaatggagtattggaatccgagatgataattcctaaaaaccttgcagggccggtgagtcaacataactacagaccaggatatcatacacaaatcgcaggcccttggcacctgggaaaacttgaaatggatttcgacttttgtgacggcacaacagttgtcgtgacagaagattgcgggaacagaggtccgagtcttagaacgaccacagcatccgggaaactgataactgagtggtgttgcagatcatgtacgttaccaccacttagatacagaggcgaagatggctgctggtatgggatggaaatcagacccttaaaggaaaaagaagaaaatttagtaaactctctagttacagcgggacatggtcaagtagataatttttctctgggggttttaggtatggctttgttcttagaagagatgcttagaacaagggtgggtactaagcacgctatccttctagtagccgtctctttcgtgactcttattactggaaatatgtcttttaaagacctgggaagggttgtagttatggtcggagctacgatgactgatgatattggaatgggagtaacataccttgctttactagcggcattcaaagtgagaccgactttcgctgccggactcttgttaagaaaactcacgagtaaagagctaatgatgacaacaattggaattgtattactctcccagtctacaatcccggaaacaatactggaattaactgacgcacttgcattgggaatgatggttctaaaaatagttaggaatatggaaaaatatcaattagctgtaaccatcatggcgatcctctgtgtaccaaatgcagtaatccttcaaaatgcatggaaagtatcatgcacaatccttgctgtcgtatcggtatcaccactgatattaacaagttcacaacaaaagacagattggataccactagccctaactataaagggactgaacccgaccgcaatttttctaactacactgtcgagaacgaataagaaacgatcatggcccttaaatgaagcaataatggcggttggcatggtctctattttagccagcagtctactgaaaaatgacataccaatgacggggccgttagtagccgggggattattaacagtctgttatgtattgacgggtaggtctgctgacctcgaattagaacgtgctgcagatgtaaaatgggaagatcaagctgaaatatcaggaagcagtcccattttatcaattactatatcggaggatggttccatgtcaattaaaaatgaagaggaagaacagacactaaccattctaataagaacaggtttgttagtgattagtggtctatttccagtgtcaataccgattacagccgcggcatggtatttatgggaagtcaagaaacaaagagcgggcgtcttatgggacgtccctagcccaccccctatgggcaaagcggaactagaagatggtgcctatcgaataaagcaaaagggaatcctaggctattctcaaattggcgcaggggtgtataaagaaggtacctttcacactatgtggcatgtaaccaggggagctgtcttaatgcacaagggaaagcgaatcgaacctagctgggccgatgtcaagaaggacctaatttcatatggaggtggatggaaacttgaaggcgagtggaaagaaggagaagaagtacaagtactagccttagagccgggcaaaaatcccagagcagttcaaaccaaacccggccttttcaaaactaatacgggtactataggtgcagtaagcctcgatttttcaccaggaacaagtggttctcccataatagataagaaagggaaagttgtaggtttatacggtaatggtgtagtaactagatctggtgcatacgtatcagcaatagcacaaaccgagaaaagtattgaggacaacccagaaatagaggatgatatttttaggaagaaacgcctgacgattatggacctacatccgggcgcgggtaaaacaaaaagatacctccctgcgatagttcgcgaagcaataaaacgtggacttcgtactctcatccttgcgccgacgagagtagttgcagccgagatggaagaggcactaagaggactccctataaggtaccagacgcctgcaattagggccgagcatactggccgggaaattgttgacttgatgtgccatgctacctttaccatgcggctactatcacccgtcagagtaccaaattataaccttataattatggatgaagctcactttaccgacccagctagtatagctgctagaggttacatatcaacgagagttgaaatgggtgaggctgcaggaatattcatgaccgcaacaccaccgggaagtagagatccgtttccccagtccaacgcgccaataatagacgaagagagagaaatcccggaaaggagctggaactcaggacacgaatgggtcacggatttcaaaggaaaaacagtgtggtttgttccatcgataaaggctggtaatgacatagcggcatgtctccgcaaaaatggcaagaaagtgattcaactgtcgagaaagacatttgattcagagtatgtaaaaactcggacaaacgactgggactttgtggtgacaacagatattagcgaaatgggagcaaactttaaggctgaacgagtaatagatccgcgtagatgtatgaaaccagtgatcttgacggatggtgaggaacgagttatactagcaggtccaatgccagtcacacattcatcagctgcacaacgacggggccgtataggacgtaatccgaaaaacgaaaatgaccaatatatttatatgggagaacctttagagaatgatgaggactgcgcacactggaaagaggcaaaaatgttgctggataatattaacactccagaaggaattatcccaagtatgtttgaacccgagagagaaaaagtagatgcaatcgatggggaatatagactaagaggggaagctcgtaaaacattcgtagatttgatgcgtcgtggagacttaccagtctggttagcttataaggtcgctgctgaagggattaactacgctgacaggagatggtgctttgatgggattcaaaacaaccagatcctagaggaaaacgtagaagtggaaatttggacaaaggaaggagaacggaagaaactcaaaccaaggtggttagatgcaagaatatactctgatcctctcgctcttaaagaatttaaagaatttgcggcgggaagaaaaagtctaactctgaatttaattacagaaatgggccgattaccaacatttatgactcaaaaggcgcgagatgccctcgacaacttagctgtacttcatacggcggaagcaggaggcagagcgtataaccatgcattatcagaattgccagaaacactcgaaacactattgctcctgactttactcgctacagtaacaggaggaatatttctattcttgatgagcggacgaggaatcggcaagatgacgttagggatgtgctgtataattactgcaagtatattgttatggtacgcacaaatacagccacattggattgctgctagcataatactcgagttctttttgatcgtattactgattcctgaacctgaaaaacaacggactccccaagataaccaattaacatatgtagttatagcgatactaactgtcgtcgccgccacgatggctaatgagatgggttttctagagaaaaccaagaaagatttaggatttgggtcaatcgcaacacaacagcctgagtcgaacatccttgatatagacctacgacccgccagtgcgtggacattatacgcagtagctacaacttttgtgactccaatgttaaggcattcaatagaaaacagtagtgtcaacgtatcattaacggcaatcgcgaaccaagctactgttttaatgggcttaggcaaaggatggccactcagcaaaatggatattggtgtaccattacttgcaattggctgttacagtcaagtaaatccaataacattgacagcagcactcctactattagtagctcactacgctataattggccctggcttacaagcaaaagccacccgagaggcccaaaagcgggctgcggctggcataatgaagaaccctacggtggatggaattactgtaatagacctcgatccaataccttacgatccaaaattcgaaaagcaacttgggcaagttatgcttctagtactgtgcgtaacacaagtattgatgatgcgcaccacatgggcattatgtgaagcattgactcttgcaacaggtccaatatcgaccctatgggaaggcaacccaggtcgcttttggaacacgaccatagcagtgagcatggccaatatatttcgaggatcatatctagcgggtgcaggtctactattttctattatgaaaaacactacaaatactcgtagaggtaccggcaacatcggcgaaacattaggagaaaaatggaaaagcagactaaatgcacttggcaaatccgaatttcaaatttacaagaaaagtggaatccaggaagtcgatcgaacactggccaaagaagggattaaaagaggcgaaactgatcaccatgctgtgagtaggggttcagctaaattaaggtggtttgtagagaggaatatgataactccagaaggaaaagttgttgatttaggctgtggcagaggagggtggtcatactactgtggaggtctaaagaacgtacgcgaagtaaaaggactaacaaaagggggcccaggccatgaggagccaatacctatgagtacttacggctggaatttagtccgattacagtcaggagtagacgtatttttcacacctccagaaaaatgcgacacgcttctatgcgacataggagagagtagccctaatccgacagtggaggcaggccgtaccctgagagtattgaatctcgttgaaaactggttaaacaataatacacaattctgtataaaagtgttaaatccctacatgccaagtgtaattgagaaaatggaagcattacagcgtaagtatgggggagcacttgtcagaaatccgttatctagaaatagcactcacgaaatgtattgggtcagtaatgcgtccggaaacattgtttcctcagtcaacatgatttcgagaatgttaattaataggttcaccatgaaacacaagaaagcaacgtatgaaccggacgtcgacctcggatcgggaactaggaatattggcattgaaagcgaggttccaaacttagatataataggaaaacggattgagaaaataaagcaggaacatgaaacatcttggcattatgaccaagaccacccatataaaacgtgggcttatcacggatcgtacgaaacaaagcagaccgggtcagccagctcaatggttaacggggtagtaagacttctgactaaaccgtgggatgtattacctacagtaacacagatggccatgacagacacgacccccttcgggcaacaaagggtttttaaggaaaaagtagatacgcgcacgcaagaaccgaaggaagggactaagaaattaatgaagataacagctgaatggttatggaaagaactgggcaagaagaaaacaccaagaatgtgcactcgggaagaatttacaagaaaggttagaagcaatgctgctctcggagcgatatttacagacgagaacaaatggaagagtgctagagaggctgtggaagatagcagattttgggaattagtcgataaagaaagaaatttacaccttgaaggaaaatgcgagacatgcgtgtacaatatgatgggaaagagggagaagaaattgggggaatttggaaaagcgaaaggctcgcgagctatttggtatatgtggttaggggcaagattcctagagttcgaggcactgggattcttaaatgaagaccactggttttcccgagaaaattccttgtcgggtgtagaaggtgaggggcttcacaaactcggctacatcctacgcgatgtatctaagaaagaaggaggtgccatgtatgcagatgatacggccggctgggacacacggataaccttagaagatctaaagaatgaggaaatggtaacgaatcacatggaaggagaacacaagaaactagcagaagcaatattcaaactaacttaccaaaacaaagttgtgcgggtccaacgacccacaccgcgaggaacagtcatggacattatcagcaggcgagaccaacgaggaagtggtcaagtagggacatacggattaaatacatttactaatatggaggctcaacttatacgccaaatggaaggagaaggagttttcaaaaatatacaacatttaacagccactgaagaaatagctgtacagaactggctcgctcgggttggaagagaacgtttgagcagaatggcgatctcaggggatgattgtgtagtgaaaccactagacgatagatttgctagtgctttgacggcactcaatgatatgggtaaagtgaggaaagatattcagcaatgggaaccatcccgaggatggaatgattggacccaagtaccattctgctcccatcattttcacgaattaatcatgaaagacggtcgcgttttagtcgtaccatgtaggaatcaggatgaattaataggtagggccagaatttcacaaggcgcaggttggtcattacgagagacagcatgtctaggaaagagctacgcacaaatgtggtccttgatgtattttcatcgcagagatttgcgattagccgcgaatgcaatttgtagtgccgttccatcacattgggtgccaacttccagaacaacatggtctattcatgccaaacatgagtggatgaccactgaagacatgctcacggtatggaacagagtttggatccaagagaatccatggatggaggacaaaacccccgttgagtcgtgggaagagataccatatttgggaaagagagaggatcagtggtgtggatctttaatcgggttaacttctcgagccacatgggccaaaaatattcaggctgctataaatcaggtgcgttcacttataggtaacgaggagtatacggactacatgccgagtatgaaaagattccgaagagaggaagaagaagctggagtattatggtaa

SEQ ID NO: 22972 - RNA, 9876 nt, synthetic construct
  misc_feature 1..9876: note = derived and/or modified CDS sequence (opt6) from DENV-2__AF169679__SS-prME
  source 1..9876: mol_type = other RNA
agtgcaggaatgataatcatgcttataccgacagtcatggcattccacctaacgacaagaaatggtgaacctcatatgatcgtatctatccaagaaaaaggtaaatcattactatttaaaacagaagacggagtaaacatgtgtacgcttatggcaatggacttaggtgaactgtgtgaagatactataacttataaatgtccacttctacgacagaatgaaccggaagatatagactgttggtgcaacagtacatcaacatgggtaacatacggtacttgtacaaccactggcgaacatcggcgtgagaaaagaagcgtcgccttagtgcctcatgtgggaatgggtctagaaactagaacagaaacgtggatgtcatcagaaggcgcctggaaacacgcacaaaggatagagacatggatactgagacatccagggtttacgattatggctgcaatattagcttatacaataggaactacacactttcaaagagcactgatttttatcttactaaccgcagtagccccaagtatgaccatgagatgcatagggatatcaaatagagactttgtagagggagtaagtggaggctcatgggtggatatcgtactagaacatggatcttgtgtaaccacaatggctaaaaacaaacccactcttgactttgaattgataaaaactgaagcaaaacaacccgcaactctaaggaaatactgtattgaagctaaactaacgaataccacaacagaatcaagatgtccaacgcaaggagagccgagtctaaaagaggaacaggataaaaggttcgtatgcaaacacagtatggtcgataggggatggggcaatggatgcggattgttcggaaaaggaggaatcgtaacatgcgcaatgttcacatgtaaaaagaatatggagggaaaaatagttcaacctgagaatctagaatacacgattgtagtcacgccccactcaggggaagaacacgcagttgggaacgacacgggtaaacatggcaaagaaataaaagttacaccacaaagttccataacagaggcagaattaacaggttatggcacagtaacgatggaatgttcaccgcgtacggggctggacttcaatgagatggtcttgttacaaatggagaataaggcttggctggtacacagacagtggttcttggacttgccattaccctggttaccaggtgccgacacccagggaagcaattggatacagaaagaaactttagtcacatttaaaaacccgcatgctaagaaacaagacgttgtggtcctaggaagtcaagaaggtgcaatgcatacagcattaacgggcgcaacggaaatacaaatgagttctgggaacttactattcacaggccacctaaaatgtagattgagaatggataaattacagctaaaaggcatgagctacagtatgtgcaccgggaaattcaaagtagtaaaagaaatagccgaaactcaacatggtacaatcgtaataagggtccaatacgaaggcgacggtagtccatgtaagatcccatttgaaataatggacctggaaaagagatatgttttgggccgattaattacggttaatcctattgtaacagaaaaagacagtccagtaaatatagaagccgaaccgcccttcggggacagttatatcattatcggtgtcgaaccaggacaactgaaattgaattggttcaagaaaggttcatcgattggacaaatgtttgaaactactatgagaggagccaaaaggatggccattcttggtgacactgcttgggattttggtagtctaggtggcgttttcacttcaatcgggaaggctttacaccaagtatttggggcaatctacggggccgcctttagtggggtaagctggacaatgaagatcctaataggggtaataataacgtggataggtatgaactctagaagtaccagtctatcagtatcattagtgctagtgggaatagtcaccctctatttaggagtcatggtacaggcggatagtggttgtgtagtgagctggaagaataaggaattaaaatgtgggtcaggtatattcattacagacaacgtacacacttggactgaacaatacaaatttcaaccggaatcgccaagcaaattagcctcggcaattcaaaaagctcaagaagagggtatttgtggcattagatccgtaacaagattagaaaacctaatgtggaaacaaattacaccggagttaaatcatatactagcagaaaatgaggttaaattgacaatcatgactggagacatcaagggcattatgcaagcaggaaagaggtcactacggccacaacctaccgaacttaagtatagttggaaaacttgggggaaagcgaagatgctaagtacggaatcccataaccaaacttttcttattgatggaccaaaaacggcagagtgcccaaacaccaatcgagcatggaactcattagaagttgaagactatggtttcggagtctttacaactaatatatggctgaaactaaaagaaaaacaggacgcattttgcgatagtaaattaatgtcagctgcgataaaagataatagagcagtacacgccgacatgggctactggattgaatcagctttaaacgatacatggaaaatagagaaagctagttttatagaagtcaagaattgtcactggcccaaatcccacacattatggtcaaatggtgtactagaatcagaaatgattatacctaagaatcttgcaggtccagtctcccaacataactatagacctgggtaccatacccaaatagctggaccatggcatctaggaaagttagagatggattttgatttttgtgatggaacaacagttgtggtaacagaggattgtggtaaccgaggtccaagtttaagaaccacaacggcctcaggaaaattaataactgaatggtgctgcagatcatgcaccctacccccattaagatatcggggtgaagatggatgctggtatggaatggaaatcagaccgttaaaggagaaagaagaaaatttggtaaactctctggtaaccgcgggacacggtcaggtagataatttttcgctgggagtcctcggtatggctctgttcctggaagagatgttaagaactagagttggtactaagcacgctatattgctagtcgcagtgtcattcgttacattaataaccggcaacatgtcgtttaaggacttagggcgggtagttgtcatggtgggggctaccatgaccgatgacattggtatgggggtaacatatctagcactattggcagcgtttaaagtgagaccgacatttgcagctggtttgctcttacggaaattgacaagcaaagagttgatgatgacgacaattggtatagtgttactaagccaatcaaccatccctgagacaatattagaactaactgatgcgttagcgttgggaatgatggttctaaaaattgtgcggaatatggaaaaataccaactagccgtgacaataatggcgatcttatgtgtaccaaatgcagtcattcttcagaatgcttggaaagtatcgtgtacaatattagcagtggtaagcgtttcacccttgattctaacctccagccaacagaaaacagactggattcccttagcactgacgattaagggccttaacccaactgcgatatttcttactacattgtctcgtacaaataagaaaaggtcatggccacttaatgaagcaatcatggcagttggcatggtttcaatattagccagctctttgctcaaaaatgatataccgatgacaggtcccctcgtagccggcggactacttacagtatgttacgtcttaactggtcgtagcgctgatcttgaacttgagcgcgcagctgacgtaaaatgggaggatcaagccgaaatatccggatcgtctcccattctaagtataactatctctgaggatggcagcatgtcaattaagaatgaagaagaagaacaaaccctaaccatacttatacgaactggtctgctagtaattagcggattattcccagtaagtatcccaattactgccgcggcgtggtatctttgggaagtcaagaaacagagagcaggagttttatgggacgtcccttcgccaccacccatgggtaaggccgaactggaagatggggcatacaggatcaagcaaaaaggtatactcggatattcgcagatcggagctggtgtctataaagaaggaacattccacaccatgtggcatgtaacaaggggagccgtattaatgcataaaggaaaaagaatagaaccgagttgggcagatgtaaagaaagatctaataagttacggaggtgggtggaaattagaaggtgaatggaaagagggtgaagaagtgcaagtgttggcattagaaccaggtaaaaaccctagggcagttcaaacgaaacccggcttattcaaaactaataccggaacaatcggtgcagtttctctcgatttctccccaggaacatctggcagtccaataatagataagaagggtaaggtagttggattatacgggaatggtgtagtcacacgtagcggagcctacgtctccgcaatagctcaaacagaaaaatccatagaagataacccagaaatcgaagatgatatatttcgcaagcgtagactaacaatcatggatttacaccccggggccggaaagacaaaaaggtacctgcccgcaatagtgcgagaagccattaagcggggcttaagaacactcattcttgccccaactagagtcgtagcagctgaaatggaggaggcactaagagggttgcccattcgttatcaaaccccagcgatcagggcagagcatacgggtcgagagatagttgaccttatgtgtcatgccacgttcactatgcgtttattgagtccagtacgcgtccctaattataatctaatcataatggatgaagcacattttaccgaccctgctagtattgctgcaaggggctatatttccacgagagttgaaatgggagaagcggccgggatatttatgactgcgacaccaccaggatctcgggatcctttcccgcagtcgaatgcaccaattatggacgaggaaagagaaataccagaaagaagctggaactcaggacatgaatgggtgacagatttcaagggaaaaacagtgtggtttgtcccaagcataaaagcgggaaatgatatagctgcttgtttaaggaaaaatggaaagaaagtaatacaactctctcgcaaaacgttcgatagtgaatatgtcaaaaccagaaccaatgactgggattttgttgtcacgacggacatcagtgagatgggcgcaaatttcaaagccgagcgagttatagatccaagaagatgcatgaaacccgtaattttaacggacggtgaagaaagagttatacttgccgggccaatgcctgtcacacattctagcgcagcacaaagacgcggccgaataggaagaaatcctaaaaatgaaaatgatcaatatatctatatgggagagccactagaaaacgacgaagattgtgcacattggaaggaagcaaaaatgctgttggataatattaacacaccggagggaataataccttcgatgtttgagccagagcgagagaaagtggatgccattgatggggaatatcgactgcgtggcgaagcaagaaaaacatttgtagatttgatgaggagaggcgatctaccagtatggctagcctataaagttgctgcagaagggataaattacgctgatagaagatggtgttttgatggcatcagaaataaccagatccttgaagagaatgtagaagtggaaatctggaccaaagaaggtgaaagaaagaaattgaaaccaagatggcttgacgcaagaatctatagtgatcccttagctctaaaagagttcaaagagtttgcggctggtagaaaatcattaaccctgaatctcatcacagaaatgggtcgtctcccaacatttatgactcagaaagctcgtgacgcacttgataatctagctgtattacatacagccgaagctggcggcagagcttataatcatgctttgtcggaactacctgagacattagagacgttattattgcttactttgttagcaacggttacaggaggtatctttttattcctaatgagtggaagaggtattggaaaaatgactctaggaatgtgttgtattataacagcatccatattgttatggtacgcacaaatccaaccacattggattgcagcctcaataatcttagaatttttcttgatagtgctactcataccagaaccagaaaaacaacggacccctcaagataaccaattgacatacgtggtaatagccatattgaccgtagtagcagccacaatggcaaatgaaatgggatttctagagaaaaccaagaaagacctcggattcggctcaatagctacacagcaaccagaatcaaatatactagatatagatttaagacctgcgtcggcctggactctttatgctgtggccacaacgtttgttacaccaatgctaagacacagtatagaaaattcctcagtcaacgtatcattaaccgccatagcaaatcaagcgacggtactaatgggactaggtaaaggatggccactatccaaaatggatatcggcgtgcctctattggctattggatgctattcccaagtcaaccctataacgcttacggcagccttgcttcttctagtagctcactacgcaataatcggacctggcctacaagcaaaagcaacccgtgaagctcaaaaacgagcagcagccggaatcatgaagaatccaacagtggacgggattacggttattgatttagaccctataccatacgatcccaagttcgagaaacagctcggacaggtaatgctcctagtattgtgcgtaacgcaagtcctaatgatgaggacaacatgggcactgtgcgaagcgctaacattagcaactggaccaatttctacattatgggaaggtaatccaggacgattctggaatactacaatagcagtctcaatggcaaatatctttaggggttcgtatttagcgggagctggattactgttttcgattatgaagaacactactaacacacgacgagggactgggaacattggtgaaactctcggtgaaaagtggaaatcaaggctcaatgctctgggaaaatctgaatttcagatctataagaaatctggtattcaagaagttgacagaactttagctaaggaaggaattaaaagaggtgaaactgatcatcatgctgtaagccgtggctccgctaaactaagatggtttgtagagagaaacatgattactcctgagggtaaagtagtagatctaggttgcggtagagggggatggtcgtattattgtgggggccttaaaaatgttagagaggttaaagggctaactaaagggggtcctggccacgaggagcccatccccatgtctacttatggttggaatttagtacggttacaatcaggagtagatgtattctttacgccccctgaaaaatgtgacacgttactttgcgatataggcgagtcctcccccaatccaacagtggaagcaggtcgcacgttgagggtcttgaacctagtggaaaattggcttaataacaatacacaattttgtataaaagtactaaatccatatatgccttctgtaatagagaaaatggaagcgctgcagcgcaaatacgggggcgcattagtaagaaacccattatctcgaaattcaacacacgaaatgtattgggtgtcaaatgcatctggcaatatagtatcaagtgtcaatatgatcagtagaatgttaataaataggttcaccatgaaacacaagaaagccacctatgaaccggatgtcgatcttgggagtggtacgcgaaatatcggaattgaatcagaagtaccgaacctagatatcatagggaaaaggatagagaaaatcaaacaagaacacgagacatcatggcattacgatcaagatcacccgtacaaaacttgggcatatcatggttcctatgaaacaaagcaaacaggatcagcgagcagtatggtaaatggagtggtacgtctattaaccaaaccatgggatgtacttccaactgttacgcaaatggcgatgaccgacacaaccccattcggacaacagagagtttttaaagaaaaagttgatacccgcacacaagaaccaaaagagggcacaaagaaactcatgaaaataactgcggaatggttatggaaagaattagggaaaaagaaaacgcccagaatgtgtactagagaagaatttacacggaaagttaggagcaatgctgctttaggtgcaatcttcacagatgaaaataaatggaagtcagcccgagaggcagtcgaggactcgagattttgggaattagtggacaaagagagaaacctccatctagaagggaagtgcgaaacatgtgtatataatatgatgggaaaaagggagaagaaactgggagaatttggtaaagctaaaggtagtcgggctatatggtatatgtggcttggagccaggtttcttgagttcgaagcacttgggttcctaaacgaggatcactggttcagcagagagaacagtctatcaggagtagaaggcgaaggcctccataaacttggttatatactaagagatgtcagcaagaaagaaggtggtgcaatgtacgcagacgataccgcggggtgggatacaagaattacgctcgaagatttgaagaatgaagaaatggtaactaatcacatggagggggaacacaagaaattagcagaggctatatttaaactaacctatcagaacaaggtggttagggtacaacgacctacaccacgaggcactgtaatggatattattagtcgacgagatcaaagaggaagtggccaagtaggtacttacggcttaaacacttttactaatatggaggcgcaactaattcgacaaatggaaggggaaggagtctttaaaaatatacaacacttaacagctacagaagaaattgcagtccaaaattggctagccagggttgggcgagaaagactatcgagaatggccatttcgggagatgattgtgtagtaaaacctttagacgaccgtttcgcgtctgctctcactgctcttaatgacatgggcaaggtaagaaaggacattcaacaatgggaaccaagcagaggttggaatgactggacacaagttccgttctgcagccatcacttccatgaacttattatgaaagacggcagagtgttagtagtcccgtgccggaaccaggatgaattaatcggacgggcacgtatctcacaaggcgcgggctggagtctacgagaaactgcatgtctggggaaatcgtacgcacaaatgtggtctttgatgtatttccatagaagagacttacgattagcggcaaacgcaatatgttctgcagtgccttcacattgggtaccgacctcgaggactacttggagcatacatgcaaaacatgagtggatgacaacagaggatatgttgaccgtgtggaacagggtatggattcaagaaaatccttggatggaagataaaactcctgtagaatcatgggaagaaatcccataccttggtaaaagagaagatcaatggtgtgggtctctgataggtctaacgtcccgagcgacgtgggccaaaaatatccaagccgcaataaatcaagtgcgaagtctaattgggaacgaagaatacactgattacatgccttctatgaaaagattcagacgcgaagaagaggaggccggggtcttatggtga

SEQ ID NO: 22973 - RNA, 9876 nt, synthetic construct
  misc_feature 1..9876: note = derived and/or modified CDS sequence (opt6) from DENV-2__AF169680__SS-prME
  source 1..9876: mol_type = other RNA
agcgcgggaatgattattatgctaattcccacggtgatggcatttcatcttacaactcgcaatggagaaccgcatatgattgtatcaatacaagaaaaagggaaatctttgttgtttaaaacggaagatggagttaatatgtgtacactaatggcaatggacctaggtgaactctgtgaagatactataacatacaaatgtccgctacttagacaaaatgaacctgaagatatcgactgctggtgtaattccacatcaacatgggtaacatacggtacatgtacaacaacaggagaacacagacgcgaaaaacgctcagtagcactcgtaccgcatgttggaatgggactggaaactagaactgaaacctggatgtcatcagaaggtgcttggaaacatgcccaacgtatagaaacatggattcttcgacatcccggttttactataatggcagccattttagcatatacgattgggacaactcattttcaaagagcattgatttttattttgttaaccgctgtcgcaccatctatgactatgcgttgtataggaatcagtaatcgagatttcgtagaaggagtatcaggaggtagttgggtcgatatagtactagaacatggatcctgcgtaacaacaatggctaaaaataaacccactcttgacttcgaattaataaaaaccgaagcgaaacaacccgctactttgcggaaatactgtattgaagccaaactcacaaacactacgacagaatcacgctgtccaactcaaggagaaccctctttaaaagaagaacaagataaaagatttgtatgtaaacactctatggtagatcgagggtggggtaatggatgtggattatttgggaaaggcggaattgttacttgcgcaatgtttacctgtaagaaaaatatggaaggaaaaattgtgcaaccagaaaatctagaatatactatagttgtcacaccacactcaggtgaagaacacgccgttggcaacgacaccggaaaacatggaaaagaaataaaagtaacaccacaatcgtcaatcactgaagcggaactaacaggctacggtacagttacaatggaatgcagccctagaacaggacttgatttcaatgagatggtgttgttacaaatggaaaacaaagcgtggttagtacatcgacaatggttcttagatctcccactgccctggttgccaggagctgacacccaaggttcgaattggatccaaaaagagaccctagtgacatttaaaaatcctcatgccaagaaacaagacgtagtcgtactaggatcccaggaaggagcaatgcatactgctttgactggcgccacagaaattcagatgtcaagtggaaacttgttgttcacgggtcatttaaaatgtcgactacggatggacaaactccagttaaaagggatgtcatattctatgtgcacgggcaaatttaaagttgtaaaagagatcgcagagacgcagcatggaaccatagtaattagggtacagtatgaaggagacggatctccatgtataataccttttgaaataatggacctagagaaacgatatgttttgggtcgactaataactgtaaaccctattgtgacagaaaaagattcgccagtaaacatagaagctgaaccaccatttggcgattcatatattattattggtgtcgaacctggacaattgaaactaaactggtttaagaaaggatcttcaattggccaaatgtttgagactactatgaggggcgccaaaaggatggctatacttggagacaccgcttgggactttggatctcttggaggagtcttcacgtcaataggaaaggcattacatcaggtgttcggtgccatttatggggctgctttcagcggtgttagctggacaatgaaaatactgataggcgtcataataacgtggatagggatgaacagtagatcaacctctctttctgtaagtctagtcctagtgggtatagtgacattatatctcggcgtgatggtacaagccgactcagggtgtgtagtcagttggaaaaataaggaactcaaatgtggtagcgggatatttattactgacaacgtacacacttggacagaacaatataagtttcaaccagaatcgccatctaaactagccagtgctatccaaaaagcccaggaggaaggtatctgtggaatacgctccgtcactagactggaaaacttgatgtggaagcaaataacaccggaattaaatcacattttagcagaaaatgaagtaaagctaaccattatgacaggagatatcaaaggaattatgcaagctgggaaacgaagtcttagaccacaaccaacagaattaaaatactcatggaagacttggggcaaggccaagatgctaagcacagaatcacataaccagaactttttaatagatggtcccgaaacagctgagtgcccaaacactaacagggcgtggaatagccttgaagtagaagactacggctttggggtctttacaactaatgtttggttgaaactcaaagagaaacaagatgcattttgcgacagtaaattaatgagcgcagctataaaggataaccgagcagtacacgctgatatgggatattggattgaatcagcactaaacgatacctggaaaatcgaaaaagcctctttcatagaagttaagaattgtcattggccgaaaagtcacactctatggagtaatggtgtgctcgagtccgaaatgattattcccaaaaacctcgctggtccagtctcacaacacaattatcggcccggctaccatacgcaaatagctggtccatggcatctcggtaaacttgaaatggatttcgacttttgcgatggcacaacggtcgtggtgactgaggactgtggaaacagaggtccatccttacgaaccaccaccgccagcgggaaattgataactgaatggtgctgtagaagctgcacactacccccactaaggtaccggggagaggacggttgctggtatggtatggagatccggcctttgaaagaaaaggaagaaaacttagtgaacagcctagtgactgccggtcatgggcaagtcgacaactttagcctaggagtactaggtatggcactcttcctagaagaaatgctcagaacaagggtaggcaccaaacacgcaatcctacttgtggctgtatcatttgtaactttaattacgggaaacatgagcttcaaagatttgggtcgggttgtggtgatggtcggtgctactatgaccgacgacataggaatgggagtaacgtatttagcactgctagcagcgttcaaagtgagacccacattcgctgccgggcttttattaagaaaattgacgtcaaaagaactcatgatgacaacaataggaatagtcctcttaagccaaagcaccataccggagactattctggagctaacagatgctttggcacttggaatgatggtgttaaaaatcgtcagaaatatggaaaaataccaattagcagtaactattatggcaatactttgcgttccaaatgcagtaattttgcaaaatgcatggaaagtcagctgtactatactagcggtagtatctgtatccccattaatattgacgagttcacaacagaaaactgattggataccgttagccctcaccatcaaagggctaaacccaacggccatatttttgacaacgttatcaagaacgaataagaaacgatcctggcctcttaatgaggcgataatggccgtagggatggtctcaattctagcctcaagtctattaaagaatgatatacctatgacaggacctttggtagcagggggacttttgacagtttgttatgtgttaactggaagaagcgcagatctagagctcgaacgagctaccgacgtaaagtgggaacgccaagcggaaatttccggatcaagcccaatactttccataaccatatcagaggacgggagcatgtcgattaaaaacgaagaagaagaacaaacactcactatattaattagaactggcctattagtaatctcagggctattcccagtatcgattcctataacggctgccgcatggtacctatgggaagttaaaaagcagcgagcaggcgtcctctgggatgtacctagcccacccccaatggggaaagcagagctcgaagacggtgcatacagaataaaacaaaaaggcattctaggttatagccaaatcggtgcaggcgtttataaagaagggacctttcatactatgtggcatgtaacacgaggcgcggtcctaatgcataagggcaagcgaatagaaccaagttgggccgacgtcaagaaagacttaataagctatggaggtgggtggaagctagagggtgagtggaaggaaggagaagaagtacaagtactagcactagaacccgggaagaatccgcgagctgtccaaactaaaccaggactctttaagacaaatactggaaccattggagcagtgagcttagacttttcgcccggcacttcaggaagcccaattatagacaaaaagggtaaggtagttggactttatggtaatggtgtagtgacacggagtggtgcttatgtaagcgcaatcgcacaaacagaaaagtccatcgaagataatccagaaattgaggatgacatttttcgaaaaagaaagatgacaattatggatctccacccgggagcaggtaaaaccaaaagatacttaccagcaatagttagagaagctattaaacgcggtttacgaacattaattttggcaccaacgagagttgtcgctgctgaaatggaggaagcgctgaggggattgcctatacgataccaaacccctgcaataagagcggaacatactggaagggaaatcgtagacttgatgtgtcacgcaacattcaccatgcgcttgctttcaccagttcgagtgccaaactataatttgattattatggatgaggcgcactttacggacccggcttctatcgcagcacgtggatatatatcaacaagagtggaaatgggtgaagccgcaggcattttcatgacggctaccccacccggctcaagagatcccttcccccaatcgaatgcacctataattgatgaggagagagaaatacctgagagatcgtggaacagtggacacgagtgggtgacagattttaaagggaaaactgtctggtttgtacctagcataaaagcgggaaacgatatcgcagcatgtctgaggaaaaatggcaagaaagtaatacaattatctagaaagactttcgatagtgaatatgtaaaaacaaggaccaatgactgggattttgtagttactactgatatttccgagatgggtgcgaatttcaaagctgagagggtaattgatccaagaagatgtatgaaaccggtaatactcacggatggagaagaacgcgtgattttggctggtcctatgcctgtcacacattcgtctgctgcacagaggcggggtagaatagggaggaaccccaaaaatgaaaatgaccaatatatatatatgggcgaaccacttgaaaatgatgaagattgcgcgcattggaaggaagccaaaatgctgttagacaatataaatactccagaaggtattataccatccatgtttgaaccagaacgagaaaaagttgacgcaattgacggtgaatatagactacgaggagaagcaaggaagacctttgttgacctgatgagacgaggcgacctacctgtatggctagcatacaaagtggccgcagagggtataaattacgcagacagaagatggtgcttcgacggcattcgaaacaaccagatcttagaggaaaatgtagaagttgagatctggactaaggaaggagaaagaaagaagttaaaacctagatggttagatgccagaatctatagcgacccgctagctttaaaagagtttaaagaatttgcagccggtcgaaagagccttacactgaatctaatcacagaaatgggaagattgcctaccttcatgacccaaaaagcacgagatgcgctagacaatctagcagttttgcacacggcagaggcgggaggtcgtgcatacaaccacgcattatctgaactccccgagactttagaaactctacttttactaacattacttgcgactgtaaccggtggaatatttttattcctaatgtcaggacgaggcataggaaagatgactcttggaatgtgctgtataattacagcctctattctactctggtacgcgcagatacagccacattggatagctgctagtataattttagagttctttctaattgtactgttaataccagaacctgaaaaacagagaacaccacaagataatcaattaacatatgtagtaattgctatcctaaccgtggtggctgcaactatggcaaacgaaatgggatttttagaaaagaccaagaaagacctaggatttggaagtatagccacacaacaacctgagtccaacatattggatatagatctgcgtcctgcaagtgcatggacattgtatgcagtagcgacaacgtttgttacaccaatgctcagacacagcatagagaatagctcagtaaacgtatcactaacggctatcgctaatcaggcaacagtcctaatgggactaggaaaaggttggccactatccaaaatggacattggagtgccactattagcgatcggatgttactcgcaagtaaatcctatcacactaacagccgccctgttactcctagtcgcacactatgctataattggaccaggtctacaggccaaagccacgcgggaagctcagaaacgggctgcagcgggaattatgaaaaatccctccgtggacggtatcactgtgatagacttggatcccataccctatgacccgaagtttgaaaaacaactcggacaagtgatgctattagtcctctgcgtgactcaagttttgatgatgaggacaacatgggcactttgtgaggctctcaccttggcgaccggacccatatcaaccttatgggagggaaatcccggacgattttggaatacgaccattgcagtctcaatggctaatatcttccgtggtagttacttagctggcgcgggcttgctcttttcaatcatgaaaaataccacgaacacaagaagaggtacagggaatataggagaaacacttggcgagaaatggaagtcacgacttaatgctttaggaaaaagcgaatttcaaatctataaaaagagcggaatacaggaagtggaccgtacacttgccaaagaaggaattaaaaggggagaaaccgaccatcatactgtatctcgaggaagtgcgaaattacgttggtttgtagagagaaatatgataacaccggagggaaaagttttagacttgggatgtggacgaggaggttggagttactattgtggaggtttaaagaacgtccgtgaagtaaagggactaacaaaaggtggtcctggtcacgaagaaccgattccaatgagcacatacggctggaatttagtaagattgcagagtggtgtggatgtctttttcactccaccagaaaaatgcgatactttgctttgtgatatcggagagagcagcccaaatcctacagtagaagcaggcaggaccttaagggtactaaatctagtagaaaactggcttaacaataatactcagttttgtataaaggttttaaacccatatatgccgagcgtaatagagaagatggaggctttacagcgcaaatacggaggagcacttgttaggaatccattatcacgtaactccacgcatgagatgtattgggtgtcaaatgccagtggaaatattgtaagttctgtaaacatgatatcaagaatgcttatcaacaggtttacaatgaaacacaagaaagctacatatgaaccagacgtcgatctaggttctggaacgcgcaacataggaatcgaatctgaagtgcccaatttagacattatcggaaaaaggattgagaaaataaagcaggaacatgaaaccagttggcactacgaccaagatcatccatacaaaacttgggcgtaccatggttcttacgaaacaaaacagacaggaagtgcatcttctatggttaatggtgtggtaaggctactcacgaaaccatgggacgtactaccaaccgtcactcaaatggcaatgacagatactacaccatttgggcaacagagagtatttaaagaaaaagtagacacacgtactcaagaacctaaagaaggaacaaagaaactaatgaaaataacggccgaatggttgtggaaagaattaggtaagaagaaaactccaagaatgtgcacgagggaagagttcacaaggaaagtaagatccaacgcagccctaggagcaatatttactgacgaaaataaatggaagtcagcaagagaagcagtggaagattcgcgtttttgggaattagttgataaagaaaggaatttacacttggaaggcaaatgcgaaacctgtgtatacaacatgatgggaaaaagagagaagaaattgggggagttcgggaaggcaaaaggctcacgtgcaatttggtatatgtggttaggagcaaggttcctggagttcgaggctttggggtttcttaatgaagaccattggttctcgcgtgaaaattccctatcaggtgtagaaggagaagggctacataagttaggatatatactacgagatgtaagtaagaaagagggcggagcgatgtatgctgatgacacagcaggttgggatacaagaataacattagaagatcttaagaatgaggaaatggttacgaatcacatggaaggagaacacaagaaactagctgaagctatattcaagctaacatatcaaaataaagtcgtcagagtacaaaggccgactcccagaggaactgttatggatataatcagtcgtagagatcaaagagggtccggccaagtaggtacatacggtctgaatacttttacgaacatggaagcacaattaatacgccaaatggaaggagaaggagtcttcaaaaacatacaacatctaacggctacggaggagatagcagtacaaaattggttagcacgagttgggagggaacgccttagtcggatggcaatctcaggcgacgactgtgtcgtcaaaccactagacgatagattcgcatctgccctgaccgctttgaacgacatgggaaaggtgcgaaaagacatacaacaatgggaacccagcagaggatggaatgactggactcaagtccctttttgctctcatcactttcatgagctaataatgaaggatggtagagtcctagtggtaccatgcagaaatcaagatgagctgataggtagagcaaggataagtcaaggagctggatggtcgttaagagaaacggcatgtctcgggaaaagttacgcacaaatgtggtctctaatgtacttccatagaagggatttacgactagctgcaaacgccatttgcagtgctgtcccttcacattgggttcccacgagtaggacaacatggtcaattcatgcaaaacacgagtggatgactacagaagacatgctgaccgtttggaacagggtctggatacaagaaaatccttggatggaagataaaacaccggtagagtcatgggaggaaataccctaccttggaaaaagggaagatcaatggtgtggtagcctaatcgggttaaccagccgtgctacttgggctaaaaatatccaagcagcaataaatcaagtacggagtttaataggcaacgaggaatacacagactatatgccaagcatgaaacgtttcagaagagaagaagaagaagcaggagttctatggtga

SEQ ID NO: 22974 - RNA, 9876 nt, synthetic construct
  misc_feature 1..9876: note = derived and/or modified CDS sequence (opt6) from DENV-2__AF169682__SS-prME
  source 1..9876: mol_type = other RNA
agcgccgggatgattattatgctcataccaacagtaatggcttttcatttgacgactcgaaatggagaaccacatatgattgtcagcatccaggagaaaggcaaaagcttgcttttcaaaactgaagacggtgtcaacatgtgtacattgatggcaatggatttaggagaactatgcgaagacacaattacatataaatgccctctactacgccaaaacgaaccggaggatatagattgttggtgtaattcaacgagtacatgggtcacttacggaacctgtacaaccacaggagagcaccgtagagaaaaacggagtgtggctctcgtgccacatgttggtatggggttagagactaggacagaaacatggatgtcatcagagggtgcttggaaacacgctcaaaggatcgagacatggattttaaggcatccaggattcacaataatggcagctatactggcttatactatcggaacaacacactttcaaagggcacttatcttcatattactcacggccgtcgccccttcgatgactatgagatgtataggaatttcaaacagagattttgtggagggggttagcggaggtagttgggttgatatagtactcgagcatggttcttgtgtaactactatggcaaaaaacaaaccaacacttgattttgaactgataaagacggaagcaaaacaaccggccacactaaggaaatattgtattgaagcaaaattaactaacacaacgaccgagtcccgatgcccgacacaaggagaaccatcacttaaagaagagcaggataagagatttgtctgtaagcattctatggtggacagaggatggggaaatggatgtgggctctttggaaaaggaggcatagttacatgcgcaatgttcacatgtaaaaaaaatatggaagggaaaatagtacaacccgaaaacttagaatatactatagtggttaccccgcattcaggtgaagaacacgctgttgggaacgatacaggaaaacacgggaaagagataaaggtaactcctcaatcaagtattaccgaagctgaactaacgggttatggaacggtaacaatggaatgtagtcctagaaccggcttagattttaatgaaatggttttgctccagatggaaaataaggcatggttggtacatcgacaatggttccttgaccttccattaccatggcttcctggggcagatacacaggggagtaattggatccaaaaagaaactttagttacgtttaaaaacccacatgccaaaaaacaagatgttgttgtgctaggtagtcaagaaggtgctatgcatactgctttaacaggcgcaacagaaattcagatgagttcaggcaacttactgtttaccggacatctaaagtgccgtttacgaatggacaaattgcaattaaaagggatgtcgtactcgatgtgtactggaaaattcaaagtagtgaaagaaatcgcggagactcaacatgggacaatagtcatccgcgtgcaatatgaaggagatggatcaccatgtcgtatcccctttgaaataatggatttagaaaaacggtacgtccttggacgtctaataaccgtcaatccaattgttaccgaaaaagactccccagtaaacatagaagcagaaccaccgtttggtgattcgtacataattatcggcgtagaacccgggcagttaaaactcaattggttcaaaaaaggatcctcaatcggtcaaatgttcgaaacgacaatgcggggagccaaacggatggcaatcctaggtgatacagcgtgggactttggatcacttggtggagtatttacaagtataggaaaagcacttcatcaagtctttggcgcaatatatggggccgcattcagcggggtatcgtggacgatgaaaatattaattggagtgattataacatggattggtatgaactcccgcagcacgagcctttcagtttctttggtcttagtgggtatagtaactctttacctcggagtgatggtgcaagcggactccggatgtgtagtgtcatggaagaataaggagttaaagtgcggatcgggtatttttatcactgataatgtgcatacttggactgaacaatataagtttcaaccggaaagtccaagtaaacttgctagtgccattcaaaaggcacaagaagagggaatatgcggtattcgttctgttactcgacttgagaatttaatgtggaaacaaataacacccgaattaaatcatatccttgcggaaaacgaagttaaattaactattatgacgggagatataaaaggtatcatgcaagccggaaaacgctcattaagaccacaacccacagaactaaagtactcgtggaaaacgtggggaaaagcaaagatgctctcaactgaatctcataatcaaactttcttaatcgatggacccgaaaccgcagagtgccccaacacgaatagagcatggaatagtttggaagttgaggactatggctttggagtgtttacaactaatatctggttaaaacttaaagaaaaacaagatgcattttgtgattcaaaactaatgagtgcagccataaaagataatcgtgcggtccatgcagatatgggttattggatagaaagtgctttgaatgacacttggaaaatagaaaaagcttcctttatagaagtaaaaaattgccactggcctaagtctcatacactgtggtcgaacggagtactcgaatccgagatgataataccaaaaaaccttgctggtcccgtatcacaacataactacagaccgggttatcatactcagatcgcagggccatggcacttgggtaagttagaaatggactttgacttttgcgatggaaccaccgtagtagtaacagaagattgcggaaacaggggtccctccttacgaacaacaacagccagcggaaaactcattacggaatggtgctgtcgttcatgtacactgccacccttgagataccgaggagaggatggatgctggtatgggatggaaatcagaccccttaaggaaaaagaagaaaatttagttaattccctagtaactgcgggacacggacaagttgataacttcagtctgggtgttttggggatggccttattcctagaagaaatgttacgcacacgtgtgggaacaaagcacgcgattctactcgtagcagtgtcttttgttaccttaataacaggaaacatgtcatttaaggacctaggcagagtcgtggtaatggtaggggcgacaatgacggacgatataggaatgggagtcacatatttagctctcttagcggcattcaaagttaggccaacttttgctgctggtctcctcctaagaaaacttacttcaaaagaacttatgatgactacaatcggaattgttttactatctcaatcaacgattcccgaaaccatcctagagctaacagatgccttagcgctgggtatgatggtactgaaaatagtacgtaatatggagaagtaccaactagcagtcaccatcatggccatcttatgtgtaccgaatgcggtaattcttcaaaatgcttggaaagtcagctgtacaatacttgcagtagtcagcgtgagtccattgatactaacctcatcacaacaaaagaccgactggataccgttagcattaactataaaaggacttaatccaactgctatatttctaactacactatcaagaactaacaaaaagaggtcatggccactaaatgaagccataatggcggtgggaatggtaagcattctagcgtcttcactgttaaaaaatgacataccaatgactggtccactagtggcaggtggtttactcaccgtttgctatgtattaactggtcgatccgcagatttagagttagagcgagccaccgatgtgaaatgggaagatcaagcagaaatctctggctctagtccttccctgagtataacaatatctgaagatggatcaatgtcaatcaaaaatgaggaagaagaacaaacactaaccatattaataagaacaggattacttgtaatatcaggactttttcccgttagtattcctattacagcagctgcttggtatctttgggaagtaaaaaaacaaagggccggcgtattgtgggacgtcccctcaccaccaccaatggggaaagctgaattagaagatggagcttaccgaataaagcaaaagggaatattgggatactcacaaataggagcgggagtatacaaggaaggtacattccatacaatgtggcatgtaacaagaggagctgtactaatgcataaaggcaaaaggatagaacctagctgggcagatgtaaagaaggacttaatttcatacggaggaggttggaaattagaaggggagtggaaagagggagaagaggttcaggtgttggcgttagaaccaggaaagaatcctagagctgtacaaaccaagccgggactgtttaaaactaatacaggaactataggagctgtcagcttagacttttccccgggtacctctggttcacctatcattgacaaaaaaggcaaagtagtcggtttgtatggaaatggcgtagttaccagaagtggcgcttacgtatccgccatcgcacaaactgaaaaaagtattgaagataatcctgaaatagaagatgatattttcagaaaaagacgactaactataatggatttacacccaggtgctggcaaaactaaacgttatttacctgctattgtaagagaagccattaagagaggtcttcgaaccttaatattagcgcctacacgagtggtggcagccgaaatggaagaagcgttacgagggttacctatccgttaccagactccagccatcagagcagagcacaccggtcgtgaaattgtagatcttatgtgccatgccacctttacaatgagactattgagtccagtacgagtccccaattataatctcattattatggacgaagcacatttcacagacccagcgagcatagcagctagggggtatatatcaaccagagtcgaaatgggagaggcagcgggaatatttatgacagctactccgcctggaagcagagacccatttccgcagagtaacgctccaataatagatgaggaacgtgaaataccagagaggagctggaattcaggtcacgaatgggttaccgattttaaaggaaaaacggtttggttcgtcccatcaataaaggccgggaatgacattgcagcgtgtctaaggaagaatgggaaaaaagtcatccaactatcgagaaaaacgttcgattctgaatacgtcaaaacgcggacgaacgactgggactttgtagtaactacagacatcagcgaaatgggcgccaatttcaaagcggaacgagtaatagacccaaggcgatgtatgaaacctgtgatactgacagatggagaagaacgggtaattctagccggaccaatgccagtaacgcactcaagtgccgcacaaaggagaggaaggataggcaggaacccgaagaatgaaaacgatcaatacatatacatgggtgagcctttggaaaacgacgaagactgcgcacattggaaagaggccaaaatgctcttagataacatcaataccccagagggaatcataccatcgatgttcgaacctgaacgagagaaagtcgatgcgatcgatggtgaatataggctcagaggcgaagctcgtaaaacttttgttgacttaatgcggcgcggagacttaccagtctggctagcgtataaagtagcggcagaaggtataaactatgcagatcgcagatggtgcttcgatggaataaaaaataaccagatattagaagaaaacgtcgaggtagagatatggaccaaggaaggagagagaaaaaaacttaagcctaggtggctggacgcacgaatatattcagaccctctggcgttaaaagaatttaaggaatttgccgcggggaggaaatctctggcattgaacctaataacagaaatgggacgactaccaacattcatgactcagaaaacaagagacgcactagacaatttggcagttttgcacaccgcggaagcagggggtagagcatataatcatgcattgtctgaattaccagaaacactagaaacactcttattgttgacactattagcaactgtgactggcggcatatttttatttttaatgtcagggcgaggtatcgggaagatgacccttggaatgtgctgcataataacagcgtcgatactgctatggtacgcccaaatacaacctcattggatcgctgcgagcattattttggtattttttctcatcgtgctattaattccagagccagagaaacaaaggacaccacaagacaatcaattaacatatgtcgttatagctatattaacggtagtagctgctactatggctaatgagatgggcttcttggaaaaaacaaaaaaagacttagggttcgggagtattgctactcaacaacctgaatctaatattttggatatagatctcagaccagcctcagcttggactttatatgccgttgccacaaccttcgtaacccccatgctaagacattcaatagaaaattcgtcagtaaacgtatcattaaccgccattgctaaccaagcaacagtactaatgggactaggtaaaggttggcccctgagcaaaatggatataggcgtccctttacttgcaattggttgctacagtcaggtcaatcctatcacactcacagctgctcttcttttactagtagcacactacgcgataataggacccggacttcaggctaaagccactagagaagcccagaaaagagccgcagctggaatcatgaagaacccgacagtcgatggaataaccgttatcgatcttgaccctattccttacgatcctaaattcgaaaaacaattgggacaagttatgctactagtactgtgtgtaacacaagtgttaatgatgagaactacctgggccctatgcgaagccttgacgttggcaacaggcccgattagtactttatgggaagggaatcccgggcgcttctggaacaccacgattgccgtttctatggcaaatatttttcggggatcgtaccttgcaggggccggactattgttttcgatcatgaaaaacacgacgaatacaaggagaggaacaggtaacataggtgaaacattgggtgagaagtggaagagtagattaaacgcacttggtaagtcagagtttcaaatctataaaaaatctgggatccaggaagtggatcggacattggcgaaagaaggcataaaaaggggtgaaaccgatcaccacgcggtatcacgtggaagcgcgaaattacggtggtttgtggagcgaaatatggtaactccagaaggtaaagtagtcgaccttggatgtgggaggggtggttggagttactattgtgggggattaaaaaacgtccgagaagtaaaggggcttacaaagggtggacccggtcacgaggaacctataccgatgtcaacatatgggtggaatctggtacgtttacaatcgggagttgatgtgttttttacccctcctgaaaaatgtgatacgttactatgtgacataggagagtcaagtccaaaccctactgttgaagccggaaggactctaagagtacttaatttagtggagaactggttgaacaataacactcaattttgcattaaggtactaaacccctatatgccatcagtaatagagaagatggaagccttgcaaaggaagtatggtggtgcattagtaagaaatcccctatcgcgcaacagcacacatgaaatgtactgggtatcgaacgccagtggtaacatagtgagttctgtaaacatgatatccagaatgttaataaacagatttacgatgaaacacaaaaaagccacctatgaaccagacgttgatttgggtagtggtacaagaaatataggaattgaaagcgaggtaccgaacttggatataatagggaagcgtatagaaaagatcaaacaagaacacgagacgtcatggcattatgaccaagaccatccctacaagacctgggcgtaccatgggagctatgaaacaaaacaaactggaagtgcttcttcgatggttaatggagttgtacggttgctcactaaaccatgggatgtgcttcctactgtgactcaaatggctatgacagataccactcccttcggacaacagagagtgtttaaagaaaaagtcgatactagaactcaagaacctaaggaaggtacgaaaaagttgatgaaaataacagcagagtggctgtggaaagaactaggtaagaagaaaacaccacggatgtgcacaagagaggaattcacgcgcaaagtgcgatcaaacgccgcattaggggcaattttcaccgacgaaaataaatggaagtccgctagggaagcagtcgaagactcaagattttgggaattagttgacaaagagagaaacttacacctagaagggaagtgtgaaacatgtgtttataatatgatgggaaaacgtgaaaaaaaattaggtgaatttggaaaagcaaaaggttcacgagcaatatggtacatgtggttaggtgcaagatttttagaatttgaagccctcggatttttaaacgaagatcattggtttagcagggagaacagtctcagtggagtagagggagagggcttacataaactagggtatatattacgagacgtatcaaaaaaagagggaggtgcaatgtatgctgatgacacagcaggctgggatactcgcataaccttagaagacctaaagaatgaagaaatggttaccaatcacatggaaggcgagcacaaaaaattggcagaagcaatatttaaactaacataccagaacaaagttgtaagggtgcaacgccccacgcctcgaggaactgtcatggatattataagccgaagagaccaaagaggaagcggacaagtaggaacgtatggccttaatacatttaccaacatggaggcgcaactaattcggcagatggaaggagaaggagtgtttaagaatatacaacacttaactgctaccgaagaaatagcagttcaaaattgccttgccagattaggaagagaaagactttcccggatggcgatttcgggtgatgattgcgtagttaagccgctcgatgatagattcgcaagtgcattaacagctttaaatgacatgggtaaaatcaggaaggacatacaacagtgggaaccctcaagaggttggaatgattggacacaagtcccattttgctcacaccatttccatgaattaatcatgaaagatgggagagtattagttgttccatgtagaaaccaagacgaattaatcggaagggcaaggattagccagggcgccgggtggtcccttagggaaactgcttgtctaggtaaaagttacgcacagatgtggtctctcatgtatttccatagaagagatttgagacttgcggcgaacgccatatgcagtgccgttccaagtcattgggtacctacaagtcgaaccacgtggtcgattcatgcaaaacatgagtggatgacaactgaggatatgctgacagtatggaatagagtctggatacaagaaaatccttggatggaagacaagacacctgtagagtcttgggaagaaataccttatttaggtaaacgagaagatcaatggtgtgggtcattaataggactaacttcgcgagccacatgggctaaaaacatacaggctgcaataaaccaagtcagaagccttataggaaatgaggaatatactgattatatgcctagcatgaaaagattcagacgggaagaagaggaagccggtgttctatggtga

SEQ ID NO: 22975 - RNA, 9876 nt, synthetic construct
  misc_feature 1..9876: note = derived and/or modified CDS sequence (opt6) from DENV-2__AF169681__SS-prME
  source 1..9876: mol_type = other RNA
tccgcgggaatgataattatgcttatacccacggttatggcttttcacttaacaacacgtaacggtgaaccccacatgatagtatcaatacaagaaaaaggaaaatctcttctgtttaaaactgaggacggagttaatatgtgtacactaatggcaatggacctaggagaattatgcgaagatacaataacttataaatgtcctcttctgagacaaaacgaaccagaggatatagactgttggtgtaactcaacgtctacatgggtaacatacggaacttgtaccactactggagaacatagaagagagaaaagaagcgtagcacttgtaccacatgttggaatgggcttagaaacgagaacggaaacctggatgtcatctgagggggcgtggaaacatgctcaaagaatcgaaacatggatactaaggcaccccggctttacgattatggcagcaatcctagcatatactatcggcacgacccacttccaaagagcactaatctttatactcctgacggcagttgctccgagtatgaccatgaggtgcattggtatatctaacagggacttcgttgagggagtatccggcggatcctgggtagacattgttcttgaacacggaagttgcgtgactacaatggccaaaaataaacccacacttgacttcgaactgataaaaactgaagcgaaacaaccagctacgctaaggaaatactgtatcgaagcaaaactcactaacacaactacggagtcacggtgtccaacccagggtgaaccttctttaaaagaagaacaagacaaacgattcgtgtgtaaacatagcatggtagaccgaggttggggaaacgggtgcggtttgtttggaaaagggggaatagtaacctgtgcgatgtttacctgtaagaaaaacatggaagggaaaattgttcaaccggaaaacttggaatacacgatagtagtcactccgcactcaggagaagaacatgcggtaggaaatgacacaggaaaacatggtaaagagataaaagtgacgccacagagtagtataacagaagcggaattaaccggttatggtaccgtaacaatggaatgttcgcccagaacgggattagattttaacgagatggttctattacagatggaaaacaaagcatggctagttcataggcaatggttcttagatttacctctaccttggcttcccggagctgatacccagggatctaattggatacaaaaagaaacgctagtaacgttcaaaaatccacacgcgaagaaacaagacgtagtagtattgggaagccaagaaggagcaatgcatacagccctaacaggtgcaactgaaatacaaatgagctcgggtaatctgttatttacagggcatttaaaatgcagattaagaatggataaattgcaattaaaaggaatgagttatagcatgtgtacgggaaaattcaaagttgtcaaggaaattgctgagacgcaacacggcacgatagtgatccgagtacagtacgaaggagatggatcaccttgtaggattccattcgaaataatggacttggaaaagcggtatgtacttggtcgactaatcacagttaacccaatagtcacagagaaagactcgccagtaaacattgaggcagaacctccattcggggactcctatattataataggtgtagaacctggacaattgaaattaaattggtttaagaaaggtagctcgataggccaaatgttcgaaaccaccatgagaggtgctaaaagaatggcaattttgggagacacggcttgggattttggatcactagggggagtctttacatcaataggaaaggcactacatcaggtttttggtgccatatatggggcagcttttagcggcgtgtcttggacaatgaaaatattaatcggtgtgattatcacatggatcggaatgaactcgaggtcaacaagtctatccgtttctctcgttctcgttggaattgtcacgttatatttaggtgttatggtacaggctgattcgggttgcgtagtgagttggaaaaataaagaactcaaatgcggcagtggaatttttataactgataatgttcacacatggactgagcaatataagtttcaaccggaatcaccctcaaaattagcttcagcaattcagaaagcacaagaagaaggtatctgtggcattaggagtgtaactagattggagaatcttatgtggaaacaaataactcctgaactcaatcacatactcgcggaaaacgaggtaaaactgacaattatgaccggagatattaaaggaataatgcaagcggggaaacgtagtttgaggccgcaaccgaccgaattgaaatactcctggaagacgtggggaaaagctaaaatgctaagtaccgaaagtcacaaccaaacgttcttaatcgatgggccgaagacagctgaatgtcctaacaccaatcgtgcatggaatagcttggaggtagaggactacggctttggagtgtttacaacaaatatttggctcaaactaaaggaaaaacaggatgctttatgtgattcgaaactgatgtcagctgccatcaaagacaacagagcggtccatgcggatatgggatattggattgaatcagcattaaatgatacctggaaaatagaaaaggccagttttatcgaagtcaaaaactgtcattggcctaaatcccataccctatggtcaaatggcgtcttagagtcagagatgattattcctaaaaacttagccggcccagtctcacaacataactacagacccggttatcatacacaaatagcgggaccatggcatctagggaaattagaaatggattttgacttttgcgatggaacaacggttgtagtcactgaagattgtggcaatagaggtccatctctacggacaacaacggctagtggtaagctaataacagaatggtgctgtagatcgtgtacacttcccccactgagataccgaggagaagacggctgttggtacggtatggaaataaggccgttaaaagaaaaggaagaaaatctcgtaaatagcctagttaccgcaggacacgggcaagtggacaacttctctttgggtgtactcgggatggcactttttcttgaggaaatgcttcggactcgagttggcacgaaacacgcgatcctattggttgccgtttcatttgtgacacttattactggaaacatgtcctttaaagacctaggcagggtggtagtaatggtaggagcaacaatgacggacgacatagggatgggtgttacttatcttgccttattagcagcttttaaagtacgaccgaccttcgcagctggtttattactaagaaaattaacaagtaaagaactcatgatgactacaattggtattgtactactctctcaaagtacgattccagaaacaatactagaacttacagatgcattagccttagggatgatggtactgaaaatcgttcgcaatatggagaaatatcagttagcggtaactataatggcaatcttgtgcgtacctaatgcggtcattttacaaaatgcatggaaagttagttgtacaatactcgcggttgtcagcgtgagccctttaatactgacgagctctcagcaaaagacagattggattccactagcactgacaataaaaggattaaatccgactgccatatttttaacaacattaagtcgtaccaacaaaaagagatcgtggccactaaacgaagcaataatggcagtaggtatggtatcaatcttggcaagtagcttactcaaaaatgatatacctatgactggtcccctggttgctggcgggctattgacggtttgttacgtactcacaggtagatcagctgacctggagctagagagggctacagacgtaaaatgggagaaccaggccgaaatctcagggagttccccgattttatctatcactataagcgaggatggttctatgagtatcaaaaatgaagaagaagaacaaaccttaactatattaattcggactggtcttttagtcatatctgggctattccccgtttcaattcctataacagccgcagcttggtacctatgggaagtcaagaaacaaagagctggggtactatgggatgtaccatcaccgcccccaatgggtaaggcagaactcgaggatggtgcgtatagaataaaacaaaagggcatcttaggttattctcaaatcggtgctggtgtgtacaaggagggtacatttcatacaatgtggcacgtaacaagaggagcagtcctaatgcacaagggaaaacggatcgaaccgtcctgggctgatgtaaagaaagatttaataagttacggaggtggatggaaactggaaggagagtggaaagaaggtgaagaggtacaagtgttggcactggaaccggggaaaaatccacgggccgttcagactaagccaggactctttaagacaaacaccggaaccataggtgccgtcagtctagatttctcccccgggaccagtggatccccaatcattgacaagaaaggtaaagtagtaggtttatatgggaacggagttgtcacccgaagcggggcatatgtgagcgcaatagcgcagaccgagaaatcaattgaagacaacccagaaattgaagacgatatatttaggaaaagaagattgaccatcatggatcttcaccctggggcaggtaaaacaaagcgatatctccctgcgattgttcgtgaagcgataaaaagaggtttgcgaactttaatcctagcaccaacacgcgttgtcgcagctgaaatggaggaagcgctcagaggcttaccgatacggtatcaaacccctgcaatcagagcagagcacactggtcgagaaatagtagacctaatgtgtcatgcaacctttacaatgcgcttactctccccagtcagggttccaaactataaccttataataatggacgaagctcactttaccgaccccgcgagtatagcagcaaggggatatattagcacacgagtcgaaatgggggaagcagcaggcattttcatgacagcaacgccgccaggatcccgggatccatttccacaatcaaatgcaccaatcatagacgaagaaagagagattccagaaagaagttggaactccggacatgaatgggtcacagactttaaaggaaaaactgtatggttcgtgcccagtataaaagccggaaatgacatagcagcttgcttaaggaaaaacggcaagaaagtaatacagctaagtaggaaaactttcgattcggagtatgttaaaacgcgaacaaatgattgggattttgtcgtaactacagacatttcagaaatgggagccaattttaaagcagagagagtcatcgatccacgaagatgtatgaaacctgtcatattaactgacggggaagaacgagttattttagccggcccaatgcccgttactcactcaagtgccgcgcaaaggcgcggaaggataggtagaaaccctaagaatgaaaatgaccaatacatttatatgggtgaaccattggaaaatgacgaagactgtgctcattggaaagaagcaaaaatgttattggataatatcaacacacccgaaggtataataccatcgatgtttgagccagaaagagaaaaagtcgacgcaatagatggtgaatacagactacgaggcgaggccagaaaaacatttgtagatctaatgcgaagaggagatttgccagtatggcttgcttacaaagtggccgctgaaggaattaattatgcggataggcgttggtgcttcgatggtatcaaaaataaccaaattctagaagagaatgtcgaagtagaaatatggactaaagagggtgagaggaagaaactaaagccaagatggcttgatgcgaggatctacagtgatcctttggcattgaaagagttcaaagagtttgctgctggacgtaaatcactcgctctcaacctaattacagaaatgggaagactaccaacatttatgacacagaaaacgcgcgacgcactcgacaaccttgcagtcctccatactgcagaagctggtggacgcgcctataaccatgcattatcagaattgcctgagaccttagaaactttattactactcaccttattagcaactgtaacaggaggtattttcctattcttaatgtcgggtagaggaataggcaaaatgacactcggaatgtgttgtataattactgcaagcatactcttgtggtacgcccaaatccaacctcattggatcgcagcttcaataatcctagtattctttttaatcgtgttactcatcccagaacccgagaaacaaagaacgccacaggataaccaacttacttacgtcgttatcgcaatactgactgtggtagctgcaacaatggctaacgaaatggggtttttggagaaaactaagaaagacttaggatttggttctatcgctacacagcaacctgaaagcaatattttagacatagatcttcgccccgctagtgcctggacgctgtacgcagtagcaactacttttgtcacccctatgctaagacatagtattgaaaatagttcggttaatgtgtcattaaccgcaatcgctaatcaggctaccgtattaatgggactaggaaaagggtggcctttaagtaaaatggacatcggggtgcctttgctcgcaataggttgttactctcaagtgaatcctataacattaacggcagcgctattattactcgttgctcactatgctataataggtcccggattgcaagcaaaggcaactagagaggcacagaaacgagcggcagctgggatcatgaaaaatcctacggttgatggtattaccgtgatagatttagatccaataccctatgatccaaaatttgagaagcaattgggtcaagtgatgctattagtactttgtgtcactcaagtgctaatgatgagaacaacgtgggctctttgtgaagccctgaccctagcgaccgggccgatatcaactctttgggaaggaaatcctggacgcttttggaacactacgatagccgtatcgatggcgaatatctttcgggggagctacttggccggtgcaggacttttgttttcaataatgaaaaatacgacaaacacaaggagaggaacaggaaacataggagagacactgggggaaaaatggaaaagccgtctcaatgccttaggcaagagtgaatttcaaatatacaagaaaagtggaatacaagaggtagataggacgctggcgaaagaaggaataaagcgcggtgaaacagatcaccacgcggtgtcaagaggtagtgcaaagttacgctggttcgttgagagaaatatggtcacaccagaaggaaaagtagtagacctaggttgcgggaggggtggctggtcttattactgtggtggccttaaaaatgtcagagaagtaaaagggttaacgaaaggtggacctgggcatgaagaaccaataccaatgagtacctatggatggaatctagtcaggctccaaagcggggtagacgtattcttcatcccgccagaaaagtgtgacactcttctatgcgacataggagagtcaagcccaaatcccacagtcgaagcaggaagaactctcagagtcctaaatctggttgagaattggctaaacaataacacgcaattttgtattaaggtcctaaatccttacatgccatcagtaatcgagaaaatggaagcattgcaaagaaagtacgggggtgccttagtaagaaacccattatctagaaattcaacgcacgaaatgtactgggtttctaatgctagtggaaatattgtttcaagtgttaatatgatctcgcgaatgttaataaacaggtttacaatgcgacacaagaaagcaacatatgaaccggatgtcgatttaggaagcggaacacgcaatatcgggatcgagagcgaaatacccaacctcgacataataggaaaaagaatagagaaaatcaaacaggagcatgaaacaagttggcattacgatcaggatcacccatataaaacttgggcttaccatggatcgtatgaaacaaagcaaacaggaagcgccagttcaatggtaaatggggtcgtacgattactaacaaaaccgtgggacgttctcccgaccgtaacacagatggcaatgactgacaccacaccattcggacaacagagagtctttaaggaaaaggtagacacaagaacgcaagaaccgaaagaaggcacaaagaaactaatgaaaattactgccgaatggttatggaaagagttaggtaaaaagaaaaccccgaggatgtgcactagagaagaatttacgaggaaagttaggagcaacgcagctctcggagcaatattcactgatgaaaataaatggaagtcagcaagagaagcagtagaagattcccgcttctgggagctggttgacaaagagcgaaaccttcacttagaaggaaagtgcgagacgtgcgtctacaatatgatgggtaaaagagagaagaaactgggtgaatttggaaaagccaaaggcagtagagcgatctggtacatgtggctgggagcccgcttcttagaatttgaggcgttgggtttcttgaacgaggaccattggtttagtagggaaaattctttatctggagtagagggggaagggctacacaagctccgctacatcctcagagacgtatctaagaaagaaggtggtgcaatgtatgctgatgatacagctggatgggacacacgaataacacttgaagacttaaagaacgaagaaatggtcacaaatcacatggaaggcgaacacaagaaactcgcagaagccatatttaaacttacatatcaaaataaagttgttcgcgttcagagacctacacccagaggtacagtgatggacataatctcgagacgtgaccaacgaggttcaggtcaagtaggaacttatggtctaaacactttcaccaacatggaagctcaattaatcaggcagatggaaggcgagggagtgtttaaaaatatacagcatctaacagcaacagaggagatcgctgtccagaactggcttgcgagagttggacgagagcgtcttagtcgaatggcgatatctggggacgactgtgtagtaaaaccattagacgatagattcgctagtgccttaacggcattgaatgatatgggcaaaatcagaaaagatatacaacaatgggaaccaagtagaggatggaacgattggactcaagtgcctttctgctcacaccattttcacgaactaataatgaaagatggacgagtacttgttgtcccatgtagaaaccaagacgaactaataggtcgcgcaaggatatcacagggggccggttggtcacttcgtgaaacagcttgcctgggaaagtcttatgcacaaatgtggtctttaatgtattttcatagaagggatttgcgactcgctgcgaacgcaatttgttcagcagttccaagccattgggttccaactagcagaacaacatggtccatccacgccaaacacgaatggatgactacagaagacatgcttacagtatggaacagagtgtggatccaagaaaacccctggatggaagacaaaacgccagtagaatcgtgggaagagataccctatttaggtaaacgagaagatcaatggtgcgggtctttaatcggtctaacatcacgagccacttgggccaagaacatacaggccgcaataaaccaagtaaggagcttaataggcaatgaagaatacaccgattacatgccctcaatgaaaagatttcggcgagaagaagaagaagctggtgttctatggtga

SEQ ID NO: 22976 - RNA, 9876 nt, synthetic construct
  misc_feature 1..9876: note = derived and/or modified CDS sequence (opt6) from DENV-2__AF169683__SS-prME
  source 1..9876: mol_type = other RNA
agtgccggaatgataattatgctcatcccaactgttatggcgttccacctaactacacgaaatggtgaaccacatatgatagtaagtatacaagaaaaaggcaaatcgttgttatttaaaaccgaagacggtgtaaacatgtgcacactcatggctatggatttgggtgaattatgcgaagatactataacttataagtgtccactattacgtcaaaacgaaccagaagatatcgactgctggtgcaattcgactagcacctgggtaacttatggaacatgtactacaacaggggaacatagaagggaaaagcgttcagtagctcttgtccctcacgttggaatgggcttagaaacaagaacggagacatggatgagctccgaaggggcctggaagcatgcgcaacgaatagaaacctggattctaaggcatcctggattcactataatggcggctatactagcgtatacaataggtacaacgcactttcaacgggccctaatattcatcctcctaacagctgtagccccatctatgacaatgcgatgtataggtataagcaatagagactttgttgaaggtgtatctggtggatcttgggtagacatcgttttagaacatggatcatgcgtaacaactatggcgaaaaataaacccacgctcgatttcgaattaattaaaactgaagcgaaacaaccggcgacattacgcaaatattgtattgaggctaagctgacaaacacgacaacagaatcacgatgtccgacacagggggagccatccctaaaggaagagcaagataagcgattcgtttgtaaacattccatggttgaccgtggatggggaaacggatgcgggctgttcggcaaaggcggcatcgtaacatgtgcaatgtttacttgcaaaaaaaatatggaaggaaagatagttcaaccagaaaatctcgaatatacaatagttgtgacccctcattcaggtgaagagcatgccgttggaaatgacactggaaagcatggcaaagagatcaaggtaacgcctcaaagtagcataacagaagctgagcttactggatacggaacagtaactatggaatgctccccccgcacaggattagattttaatgaaatggtacttttacaaatggaaaataaagcgtggctagttcatagacaatggttcttagacttgcccctaccttggcttccaggcgcagacacacagggatccaattggatccaaaaagaaacgcttgtgacttttaaaaatccacatgctaaaaaacaagacgtagtagtactaggttcacaagaaggagcaatgcacactgcacttacgggggctacagaaatacaaatgtctagtggtaatctcttatttactgggcatctaaaatgccggttaagaatggataaacttcaattaaaaggtatgtcatattcgatgtgcacaggaaaatttaaggtggtaaaggaaatcgcggaaacacaacacggaactatcgttatacgagttcagtatgaaggtgatggatctccctgccgtataccattcgagattatggatttagaaaagagatatgtattaggacgtcttatcacagtaaacccaatagtaaccgaaaaggacagcccagtcaacatcgaagccgagcctcccttcggtgattcctacattataataggggtcgaacctgggcaactcaaactaaattggtttaaaaaagggtcttctatagggcaaatgtttgaaacaactatgagaggggctaaacggatggcgatattaggggacacagcatgggactttggcagtttaggtggagtatttacaagtataggcaaggcactacatcaagtttttggggccatatacggtgccgccttcagtggtgtctcttggaccatgaaaattttaataggtgtgattatcacatggataggaatgaacagccgttccacaagtttaagcgtatcgttagtattggttggaattgttacgctttatctcggtgtaatggtacaggcagatagtggatgtgtggtttcgtggaaaaacaaagaacttaaatgtggctccggcattttcataactgataatgttcatacttggactgagcaatataaattccaacccgaatcaccatcgaaactcgcatcggcaatccagaaggcccaagaagaaggaatatgcggtattagaagtgtaacccgacttgaaaacttaatgtggaagcaaataacccctgaactcaatcacatcctagcagagaacgaggtcaaattaacgatcatgacaggtgatataaaaggaataatgcatgcgggtaaaagatcattgaggccgcaacccaccgaactaaaatatagctggaagacatggggcaaggcgaaaatgttgtctacagaatcgcacaatcaaaccttcttaatagacggtccggaaactgcagaatgcccaaataccaatcgagcttggaacagtctagaggttgaggattatggctttggagtatttacgacgaatatatggcttaagttgaaagaaaagcaagacgccttttgtgatagcaaattgatgagtgcagccattaaggataatcgtgcagtacatgcagacatgggatactggatagaaagcgctctgaatgatacgtggaaaattgaaaaagcaagttttatagaagtgaaaaattgtcattggcccaagtcacatacgctttggtctaatggagtcctggaatcagaaatgattataccgaaaaatctagcaggacctgtaagtcagcacaactatagaccgggttaccatacgcagatagcgggcccttggcatttaggaaaacttgaaatggacttcgatttctgtgacggaacaacagtagtagttacagaagactgtggaaaccgtggaccgagtttgagaacaactacggctagtggtaaactaataacagaatggtgttgtaggtcttgcacattaccaccactccgttatcgaggagaagacggttgctggtatgggatggaaataagacccttgaaggaaaaagaagagaacttagtaaacagtttagtaacggctggacatgggcaggttgataatttcagtctgggcgtgctaggaatggcattatttttagaggagatgcttagaactcgcgtaggaacaaaacatgctattctgctggtcgccgtaagtttcgtaaccctaatcacaggaaacatgtcattcaaagatttaggtagggtggtcgtgatggtaggagcaaccatgacagacgatattggaatgggagttacttacctagccctactagcggcattcaaagttcgtcctacattcgctgcaggtttactgctacgaaaattaacatcgaaagaattgatgatgacaaccataggaatagtccttcttagccaatccacaataccagaaacgatcttagaactaacagacgctcttgcattaggcatgatggtactcaagattgtcagaaatatggagaagtaccaactagcagtaacaataatggcgattttatgcgtaccgaacgcagtgatactacaaaatgcttggaaggtttcatgtacaatactagcagtagtttcggttagtccccttatccttaccagcagccagcaaaaaactgattggataccgctagctttgaccatcaaaggcttaaatcctacagcaatatttcttaccacattatcccgaacaaacaaaaaaaggagctggccattgaatgaagccatcatggcggttggtatggtttcaattctcgcctccagcctgttaaaaaacgatatccctatgactggacccctagttgcgggtggtttacttacggtgtgttatgtattaactgggagaagcgcagacttggaactagaaagagcaacagatgttaaatgggaagaccaagcggaaatttcaggcagtagtcctattctaagtattacgatatctgaagacggatcgatgtcgataaaaaatgaagaagaagagcagacacttactattttgatacggacaggactccttgtaatatcgggactatttccagtaagcatccccataacagcagcagcttggtacctatgggaagtaaaaaaacaaagggcgggagtcttatgggatgtaccatcaccgccgccaatgggtaaagctgagttagaggacggcgcctatcgtataaagcaaaaagggatcctgggctactcgcagattggagcaggtgtctataaagagggaacttttcatactatgtggcatgtaacgagaggagcagttcttatgcacaagggaaaacgaattgagccgtcatgggccgatgtgaagaaggatttaatttcttacggaggagggtggaagttagaaggtgaatggaaagaaggagaagaggtgcaagtattggcacttgaaccaggcaaaaatcctagagccgtacaaacgaaaccaggtctatttaagacaaatacaggtaccataggagctgtgtcattagacttttcacctggtacgtcagggtcaccaataatcgacaaaaaagggaaggtagttggcttatatggaaatggcgtagtcacgagaagcggtgcgtatgttagtgcaatagcacaaacagaaaagtccattgaagataacccagagatagaggatgatatttttagaaaacgcagactgacaataatggatttacatcccggcgcgggaaaaactaaaagatatcttcccgccatcgtgcgtgaggccataaaaagaggacttagaacactgatacttgcaccaacccgtgtcgtcgcagcagaaatggaggaggcacttagggggctaccaataagatatcaaacacctgcgattcgagcagagcacacaggaagagaaatagttgatcttatgtgtcatgcaacttttacaatgcggctcctatctccagtaagggtgccgaactataatctgattattatggatgaggcacattttacagaccccgcttcaatcgccgcacgtggatatataagcacaagagttgaaatgggagaagcagccgggatatttatgacggctactccaccaggctcgagagatccgttccctcaatcgaatgcaccgatcattgatgaggaacgagagatacctgaacgtagctggaattctggtcatgagtgggttactgacttcaaagggaaaactgtgtggtttgttcctagcattaaagcaggaaacgacattgcagcatgtctacgaaagaacggcaaaaaagttattcaattgagtagaaaaactttcgattcggaatacgtaaaaactagaacaaatgattgggactttgtcgttacgactgatattagcgaaatgggagcgaattttaaagcagaaagggttatcgatccaagacgctgcatgaagccagtaatacttacggatggagaagaaagggtaattttagctgggccaatgccggtaacacactttagcgccgcccagcgaagaggccgaattggcaggaatccaaaaaacgagaacgaccaatatatttatatgggagagccactcgagaatgatgaggactgcgctcattggaaagaggcaaagatgttactagacaacataaatacaccggagggaataatcccttcaatgtttgaaccggaaagagaaaaagtggacgcgatagacggcgagtatcgtttaagaggtgaagcacgaaagaccttcgtagatcttatgagaagaggcgatttacccgtttggttggcttacaaagtagcggctgaaggaataaattacgcagataggagatggtgctttgatggcatcaaaaataatcagatattagaagaaaatgttgaagttgagatatggacgaaagaaggtgaaaggaagaaactaaagccaagatggctagatgcacgcatatattctgatccattagctctaaaagaatttaaagaattcgcagccggacgaaaatctctggcccttaatttgattaccgaaatgggaagactaccgactttcatgactcaaaaaacgcgggacgccctagataatctagctgtactacacacagcggaagcgggcggtagagcttataaccacgccctaagtgaattaccggagacattggaaacactactacttttaacattactagcgactgtaacgggaggtatattcctctttctaatgtcaggtcgaggtattggtaagatgacactaggaatgtgctgcattataactgcaagtatattactatggtatgcacaaatacagcctcattggatagcggcttcaatcatattagtgttttttttaatagtactcctaataccagaacctgaaaaacagcgcacaccacaggacaatcagctaacctatgttgttatagcaatattgacggtcgtagcagcaaccatggcaaacgaaatgggatttttagaaaagacaaagaaagatctaggattcggtagcatcgcaacacaacagccagaaagcaatatattagatatagacttaagacctgcctcagcttggactctatatgccgtcgctacaacgttcgtaacacctatgctccgccactcaatagagaactccagtgttaatgtatcactaacagccattgcaaaccaagcaacagtacttatgggattgggaaaaggttggcctctaagtaaaatggatattggtgtgccactattggctattggctgttacagtcaggttaatccaataactttaacagctgcattattactcttggtcgctcattacgctataattggaccaggactacaagcgaaagccacaagagaagctcaaaagagagcggcggcaggaattatgaaaaacccaacagtcgatggaatcacagtgatcgacttagatccgatcccatatgatccaaaatttgagaaacaactgggtcaagttatgttgctcgtactatgtgtgacacaggtgttaatgatgcgaacaacctgggcactatgtgaggcactaacacttgccacaggaccgatatccacattatgggaaggaaatccaggtcgattctggaatactaccattgcagtttcaatggccaatatattcagaggcagttatctagcaggagctggcttactattttccataatgaagaacacaactaacacacgtcgaggtactggcaacatcggagaaacattaggtgaaaaatggaagagtcgactcaatgcattgggcaaatctgaaagccaaatctacaaaaaatcagggatacaggaagttgatcggaccttagctaaagaagggataaaacgtggggaaacagatcatcacgcagtaagtcgcggcagtgccaaattgagatggttcgtcgaaaggaatatggttacccctgaagggaaagttgtagatctaggttgcggaagaggtggttggtcctactattgtggtggaatcaagaatgtaagggaggtgaaaggattaaccaaagggggcccgggtcatgaagagccaataccgatgtctacatacggttggaacttggtacgcttgcagtcaggtgtggacgttttctttattccccccgaaaaatgcgatacactcctttgtgacataggagagagtagtccaaatccaacagtagaagccggtcgaaccttaagagtactgaacttagtagaaaactggttaaataacaatacacagttttgtataaaagtattaaacccgtatatgccaagcgtgatcgaaaaaatggaagcattgcaaagaaaatatggaggcgcgttggtcagaaatccacttagccgcaatagtacacacgaaatgtattgggtgagcaatgcgagtggaaatatcgtgagcagcgtgaatatgataagtcgtatgctaatcaatagattcacaatgaggcacaaaaaggcaacttacgagccggacgtagatcttggatcgggcactaggaacataggaatcgaatcagaaatccctaacttggacataataggtaaacgcattgagaaaataaagcaggaacatgaaacgtcatggcattacgatcaagatcatccttataagacatgggcttatcacggatcctatgaaacgaagcaaacaggcagcgcatcgagcatggtaaatggtgtagttcgactactgactaaaccatgggacgttctaccaaccgtgactcagatggctatgacagatacgactccctttggacagcaaagagtatttaaagaaaaggtcgatacaagaacccaggaacctaaagaaggaaccaaaaaattaatgaagataacggccgaatggctttggaaagaacttggcaaaaagaaaacaccacgtatgtgtacccgcgaggaatttactagaaaagtgcgaagcaacgcagcattaggcgcaatatttacagacgaaaacaaatggaagtctgctagggaggcagtagaagatagcagattctgggaacttgttgataaagaaagaaacctgcatctggaaggaaaatgcgaaacgtgtgtgtataatatgatgggaaaacgtgagaaaaaattaggggaatttggcaaggcaaaaggcagccgagcaatatggtatatgtggctgggagcgcgtttcttagaattcgaggctttaggattcttaaatgaagatcattggttctccagagaaaactccctaagcggcctagagggggaaggcttacataaattaggatatatactaagagatgtttcaaagaaggaaggaggagcaatgtacgcagatgatactgcgggatgggacacgagaataacactcgaggacttaaaaaatgaagaaatggtaacaaatcatatggaaggtgagcacaagaaactagcagaggcaatatttaaattaacttaccaaaataaagtggtaagggtacaaagaccaacaccacgtggcaccgttatggacataatcagcagacgagatcaacgtggatctggtcaggtgggtacctacggattaaacacgttcaccaatatggaggcacaactcatacgacaaatggaaggggaaggtgtgttcaaaaacatccaacatttaaccgctactgaagagattgctgttcaaaattggttagcaagggttgggagggaaaggctgagtcgaatggcgatatcaggggacgactgcgttgtaaaacctttagacgaccgatttgcttcagccttaacagcattgaatgacatgggaaaaatacgaaaagatatacagcaatgggaacccagtcgaggatggaacgactggacacaggtacccttctgttcccatcattttcatgaactaattatgaaggatggcagagttctggtagtcccttgtaggaatcaagatgagcttataggcagggcaaggatctcgcagggagctggctggtcattaagagaaacagcctgcttgggaaaatcatatgcacaaatgtggtcattaatgtacttccatcgacgggatctaagattagcggcgaacgccatatgcagtgcagtaccgagccattgggttccgacaagccgaaccacatggtctattcatgccaaacatgaatggatgacaacagaggacatgctaaccgtttggaaccgtgtctggatacaagaaaatccatggatggaagataagacaccagtagaatcatgggaagaaatcccttacctcggaaaaagggaagatcaatggtgcggcagtctaataggtcttacatctagagccacctgggcaaaaaatatacaagcagcaattaatcaggtgagatcgcttattggaaatgaggaatacacagactatatgcccagtatgaaaagattccggcgggaggaagaagaagctggtgtcctatggtga

SEQ ID NO: 22977 - RNA, 9876 nt, synthetic construct
  misc_feature 1..9876: note = derived and/or modified CDS sequence (opt6) from DENV-2__AF169684__SS-prME
  source 1..9876: mol_type = other RNA
agtgctggtatgataataatgttgattccaacagtaatggcgtttcatcttacaacgagaaacggagaacctcatatgatagtcagcatacaagaaaaaggaaaatctttattatttaaaacagaagacggtgttaacatgtgcacattaatggcaatggacttaggggaactttgcgaagatacaattacttataaatgtccgctacttaggcaaaacgaaccggaagacattgactgttggtgtaattccactagcacatgggtaacctatggaacatgtaccacaactggcgaacatcggagagagaaaaggagcgtggctctagtgccacatgttggcatgggtctggaaaccagaacagagacatggatgagctcggaaggagcatggaaacacgctcagcgtattgaaacctggatacttaggcacccaggttttaccatcatggcagctatccttgcatacactatcggcacaacacattttcaaagagcattaatattcattctgttgacggctgtcgcaccttccatgacaatgaggtgtataggaatcagcaacagagatttcgtagagggggtaagcggtggtagttgggtagacatagtacttgaacacggctcgtgtgtaacaacgatggctaaaaataaaccaactttggattttgaactaataaaaaccgaagcgaaacagccagctactttacgaaaatattgcatcgaggctaaacttacaaatacaactactgaatcacgttgtccgactcaaggagaacccagcttgaaagaagaacaagataaaagatttgtatgcaaacacagtatggtagatagaggctgggggaacggctgtggcttattcggaaaagggggtatagttacatgtgccatgttcacatgtaagaaaaacatggaaggcaaaattgtgcaaccagaaaacctagaatacacgatagtagtaacacctcactccggagaagaacatgctgtggggaacgacactgggaaacatggaaaagaaattaaagttaccccacaatcatccatcacagaagcggaacttacaggttatggtactgtaaccatggaatgctcaccaaggacaggtctggacttcaacgaaatggttttgttgcaaatggagaacaaagcctggttggttcacagacaatggttcctagatctacctttaccttggttgccaggcgctgatacacaaggttccaactggatacaaaaagaaacgttagtgactttcaaaaacccacatgccaaaaagcaagacgtggttgtgttaggctcacaggaaggagcaatgcatactgcgctcacaggagcgactgagatacaaatgtcatctgggaacttgttattcacagggcatctgaaatgtcgactgcggatggataaactacagctaaaaggcatgtcttatagtatgtgtacaggaaagttcaaagtcgtaaaagaaatcgccgagacacagcatggaacaattgtaattcgcgtacagtacgaaggtgatggatccccatgccgtataccattcgaaattatggatttagaaaagagatatgtactggggaggttaataacagtgaacccaatagtcacagagaaggactcacccgtgaatatagaagcggagcccccttttggtgactcgtatattataatcggtgtagaacctgggcaacttaaacttaactggttcaagaaagggtcaagtatcgggcaaatgttcgaaaccactatgcgaggggccaagagaatggccatactaggagacacagcatgggatttcggatccctagggggtgtctttacaagcataggaaaagcactacaccaagtctttggagcgatttatggagcagccttttcaggagtaagttggaccatgaaaatcctaattggcgtaattataacttggatcggtatgaacagtagatctacctccctctctgtaagtttagtactcgtaggcatcgtcaccttatacctcggagtaatggtccaagcagattcaggttgcgttgtaagttggaaaaataaagaattgaaatgtggatcaggcatattcataactgacaatgtacacacttggacagaacaatataaattccaaccagagtcaccatcaaaactagcatcagcgattcagaaagcccaagaagagggaatctgtggtataagaagcgtcacgcgtctagaaaatttaatgtggaaacaaataacccctgaattgaatcatatactcgctgaaaatgaagttaaattaacaataatgacgggtgacataaagggaatcatgcaagctggtaagcgttcactccggccacaaccgacagaactaaaatattcttggaaaacttggggaaaggcaaaaatgctaagcactgaatcacataaccaaacattcctaattgacggaccagaaacagcagaatgtcccaacaccaacagagcttggaactccttagaagttgaagactatggtttcggagtattcacaaccaacatctggttgaaattaaaagaaaaacaagatgcattttgcgactcaaaattaatgtcggcagccataaaagataatagagcggttcacgcagatatgggttattggattgaaagtgcactgaacgatacatggaaaatcgaaaaagcaagttttatagaagtcaaaaactgtcactggcctaaatcacatacattatggtcgaacggagttttagagagtgaaatgataatacccaaaaacctcgcgggaccagtatcacaacataactaccgtcccggttatcatacccaaatagcgggaccctggcatttaggaaaactcgaaatggactttgatttttgtgacgggacgacagtcgtggttaccgaagattgcggcaatcgtggtccatctctgcgaactacaacagcaagtggtaaactaataacagaatggtgttgtagatcctgtacgttacctcctcttcgatacagaggagaagacgggtgttggtatggaatggagattagaccactaaaagaaaaagaggaaaacttagtgaactctttagtaaccgctgggcatggccaagtagataattttagtctaggtgtattaggcatggccttgttcctagaagagatgttgagaacgagggtagggacgaaacacgcgattcttttggtcgcagtttcatttgtaacgctgattacggggaacatgagctttaaagatttgggccgcgtagtcgtaatggtcggcgcaacaatgacagatgacataggtatgggtgtaacatatctagctttgcttgcggcgttcaaagtaagacccactttcgcagctggcttacttttgagaaaactgacatccaaagaactcatgatgacaacaatagggattgtactgttatcgcaaagcacgatccctgaaacaattttggaattgacagacgcgcttgccctcggcatgatggtattaaaaatcgtcagaaatatggaaaaatatcaattagcagttactataatggcgatactgtgtgttccaaatgcagtaatactgcagaatgcatggaaagtttcttgcacaatcctagccgtggtgagtgtttcacctcttatattaacaagttcccaacagaagacagattggataccactagccttaactatcaaaggtctaaatcctactgcaatcttcctaacaaccttatcaagaaccaataaaaagcggtcttggccgttaaacgaagcaatcatggctgtaggaatggtctcaattcttgcctcatcactcctaaagaatgacatacccatgaccggacctctagtcgccggtggcctccttacagtatgttatgtactaacgggacgctcagctgatctcgaacttgaacgggcaactgatgtcaaatgggaagatcaagccgaaataagcagaagttcaccaatacttagcatcacaatatcggaagacggttcaatgtcgatcaaaaatgaagaggaagaacaaactctaacaatcctgataagaaccggattgctagttataagtggtttattcccagtgtcgataccaattacggccgcagcctggtatttatgggaagtcaagaaacaaagagcgggtgtattatgggacgtgccgtcaccaccacccatgggtaaagcagaacttgaagacggtgcataccgcataaaacagaaaggaatcctaggatattcgcagattggtgctggtgtttataaagagggaacttttcatacaatgtggcacgtgactcgtggagctgttttgatgcataaagggaaaagaatcgaaccatcatgggcagacgtcaagaaagatttaatatcgtatggtgggggatggaagttagaaggtgaatggaaggaaggggaagaagttcaagtactagcacttgaaccaggaaagaatccaagagcagtacagacgaaacccggcttgtttaaaactaatactggcactataggggcagtatcactagacttttcaccgggcacaagtgggtcaccaatcatagataagaaaggaaaagtggtagggctctacggtaatggagtagtgacaaggtcaggggcctatgtgtcagcgatagcacaaacggaaaaatcaattgaagataatccggaaatagaggacgatatctttaggaaacgccgcttaactattatggatctacatccaggggctggaaagactaagaaatacttgcctgccatagttcgtgaagcgatcaaaagaggactaagaaccctgatactggcaccgacacgagtggtagcagctgagatggaagaagcattacggggtttacctatcaggtatcaaacaccagctataagagctgaacacactggtagggaaattgtcgatttaatgtgccacgcaacgtttacgatgagattactatccccagtcagagtccccaactacaatctaataataatggatgaagcacatttcacggatcctgcttcgatagcggcacgaggatatatttcgactcgcgttgagatgggagaagctgctggaatatttatgacagctaccccacccggctcgagagacccattccctcaaagtaatgcccccattatagatgaggagagagaaataccggaaagaagttggaacagcggacacgaatgggttacagacttcaaaggaaaaacagtctggttcgtcccatcaattaaggcaggtaatgatatcgcggcttgcctcaggaaaaatggaaagaaagtaatacaattatctcgcaaaacatttgactcagagtacgtaaaaacgaggacaaatgactgggattttgtagtgacaactgatatttctgaaatgggagcgaatttcaaagctgaaagagtcatagatccacgacgttgtatgaagccggttatcctgacggatggagaagaacgtgtaatcctcgctggacccatgcctgttacacatttctccgccgcccaaaggagaggtcgaataggcagaaatcccaaaaatgaaaatgatcagtacatttacatgggggaacctttagaaaatgatgaagattgtgcacattggaaggaagctaaaatgttgcttgacaatattaatacacccgaaggaataatacccagcatgttcgaaccggaaagagaaaaagttgacgcaatagatggagaataccgtttaagaggagaagcacgaaaaacttttgtagacctaatgcgacgaggtgacctcccggtctggttagcatataaggttgcggcagaaggtataaattatgccgatagacgctggtgtttcgacggaatcaaaaacaaccaaatattagaagaaaacgttgaagtggagatctggaccaaagagggcgagcgtaagaaacttaaacctcgatggctcgatgctagaatttactcagaccccctggctttgaaagagttcaaagaatttgcagcgggtagaaaatcactagcgttgaatttgataactgaaatgggccgacttcccacattcatgacacagaaaacacgcgatgcactagacaacctcgcagtgttacatactgctgaagcgggaggcagagcatataatcatgccttgagtgaattaccagaaactcttgaaacattactattgttaacgttgctagcaacagttaccggaggtatatttctcttcctgatgtcaggtagaggaattggaaaaatgacattagggatgtgttgtataataaccgcaagcatcctcctatggtacgcccagatacagccacattggatcgcagcctctataatcttagagttcttcctgatttttctattaatacccgaacccgaaaaacaaagaacaccccaggacaatcaactaacttatgtagtaatcgccattttaacggtcgtagcagcgaccatggcaaatgaaatgggatttttggaaaagacgaagaaggatttaggatttgggagtatagctacccaacaaccagaatcgaatatattggatatagatctgagacccgctagtgcgtggacactttacgcggtagcaacaacttttgtaacaccaatgctaagacacagcatagaaaattcaagtgtgaatgtcagcctgaccgcaatagctaatcaagcaacagtactcatgggacttggtaagggttggcctctatcaaaaatggacataggcgtacctttgctagcgattggttgttatagccaagtgaatccgataactctcacagcagcgttattactcttggttgcacactacgctataatcggtcctggtctacaagcgaaagcaacgcgggaagcccaaaagcgagcagcagcaggcataatgaaaaatccaactgtagatggaatcacggtaatagatttagacccaattccatacgacccgaaattcgaaaagcaattagggcaagtcatgttgttagttctatgcgtcacacaggttcttatgatgaggaccacatgggctctttgtgaagcccttacattagccacgggaccaatatccacactgtgggaagggaatccaggacgattttggaacacaacaatagctgtttccatggccaacatatttaggggcagttatctagcgggagccggattactattctctattatgaagaacacaacaaatactagaagaggcactggaaatataggagagacgctgggagagaaatggaaaagtcgtctcaacgcattagggaaaagcgagttccaaatttataagaagtctgggatacaagaagtagacagaacgttagccaaagaggggatcaaacgcggagaaacggatcaccacgcagtgagtagagggagtgccaaacttagatggtttgttgaacgtaatatggtaacgcccgaaggtaaagtagtggacctagggtgtggtcgtggaggctggagttattactgtggtggtctaaagaatgtcagagaggtaaaagggcttacgaaaggaggacctggacacgaagaaccgattcccatgtcaacatacggttggaacttagtacgacttcaatcaggggtggacgtattctttataccacccgagaaatgtgatacactattatgtgatataggagaatccagtccgaatccaacagtagaagctggaaggactttgagggttttaaatttagtcgagaactggttaaataataacacacaattttgtattaaggtgcttaatccgtatatgccatcagtgatagagaaaatggaggcgcttcaaagacgatacggtggtgcattagtcaggaaccctctcagtcgaaattctacccacgagatgtattgggttagtaatgcttcgggtaatattgtaagttccgtcaacatgatctcgagaatgttgataaataggtttacgatgaaacataagaaagccacttatgaacctgacgtggatcttggatccggaacacgcaatataggaattgaatccgaagtgccgaatttggatattattgggaaaagaatagaaaagattaaacaagaacacgagacaagctggcattatgaccaagaccacccctataaaacatgggcgtaccatggatcctatgaaacaaaacaaacaggatcagcgtcctccatggttaacggagtagtacgattgctaacaaaaccttgggatgtactacctaccgtaacgcaaatggcaatgacggacacaacccccttcggacaacaacgggtatttaaagaaaaagtagataccagaacgcaggaaccaaaagaaggtactaagaaattgatgaaaattactgcggaatggttatggaaggaattaggcaagaagaaaactccacgaatgtgcactcgtgaagaatttacaaggaaagttagaagtaatgcggctttaggggctatatttactgatgaaaacaagtggaaatccgctagagaagcggtcgaagacagcagattctgggagttagtagacaaggagcgaaatttgcatttagaagggaaatgtgaaacttgtgtatataatatgatgggaaaaagagagaagaaactaggagagttcggtaaagcaaaaggatccagggcaatttggtatatgtggttaggagcccgattcttagagttcgaagcactaggtttcctaaacgaagatcattggttttctagagaaaattctctgtcaggtgttgaaggagaaggtctgcacaaactaggatacatattacgcgatgtgtccaagaaagagggcggcgcaatgtatgcagacgacacagcaggatgggacactcgtatcacgttagaagatttgaaaaatgaggaaatggttaccaaccatatggaaggtgaacataagaaattagctgaagccatcttcaaattaacgtaccaaaataaagttgtacgtgtacaacggccgacacccagaggcacggttatggatataatctcgcgaagagaccaacgaggttcaggtcaagtcggaacatacggattaaacacatttacgaacatggaagcacaattgatacgacaaatggagggtgaaggcgtcttcaaaaacatccaacacctaacggcaactgaagaaatagctgtgcaaaattggcttgctagagttggaagggaacgactctcaagaatggctatttctggagatgattgtgtagtaaagcccctcgacgatcggtttgcaagtgccctaactgccctaaatgatatgggaaagattcgaaaggatattcaacaatgggaaccatccaggggatggaacgactggactcaagtacctttttgctcacatcactttcatgaattaataatgaaggatggtagagtcttagtagtaccatgtcggaatcaagacgagttgattggtagggctcgtataagccagggtgctggatggtcgctccgagaaacagcatgcctaggaaaaagttacgcacagatgtggtccttaatgtattttcacagaagagacttacgattagcagctaatgctatatgctctgccgttccatcacattgggttccaacaagccgaacaacgtggtccattcacgcaaaacatgagtggatgacgactgaagatatgttaacggtatggaaccgcgtttggatccaagaaaatccttggatggaggataaaactccggtagagagttgggaagaaataccctacttgggaaagcgcgaggatcaatggtgcggatcattaataggtcttacatcgagagctacgtgggccaaaaatatccaagcggccattaatcaagtacgatcgttaattgggaatgaagaatatactgactacatgccatcaatgaaaaggtttcgtcgtgaagaagaagaagccggtgtcttgtggtaa

SEQ ID NO: 22978 - RNA, 9876 nt, synthetic construct
  misc_feature 1..9876: note = derived and/or modified CDS sequence (opt6) from DENV-2__AF169685__SS-prME
  source 1..9876: mol_type = other RNA
tctgcgggaatgataataatgttgatacctactgtaatggcgttccatttaactacgcggaatggtgaaccgcatatgattgtgagcatacaagaaaaaggtaaatcactacttttcaaaaccgaagatggagtaaacatgtgtaccctgatggctatggacttgggtgaattatgcgaagacactatcacgtacaaatgcccactattaagacaaaatgaaccagaagacattgactgttggtgcaactctacatctacatgggtaacatatggaacatgtaccacgacaggggaacatagaagagaaaaacgtagtgtagctttagtacctcatgtaggtatgggacttgaaacacggacagaaacatggatgagctctgagggcgcttggaaacatgcacaacgtatagaaacttggatccttagacatcctgggtttaccataatggcggcaatactagcatatacaataggaaccacccacttccaacgtgctttaatcttcattcttctcaccgcagtagcgccaagcatgactatgagatgtataggcatctctaatagagattttgtagagggtgtctccggtggctcatgggtcgatattgtgctagaacacggcagttgcgtaacaacaatggctaaaaataaaccaactttagattttgaattgatcaaaacagaagctaaacaacccgctacacttagaaaatattgtattgaggcaaaactaacgaataccaccaccgaatctcggtgtccaactcagggagagcccagcttaaaagaagaacaagacaaacgcttcgtatgtaaacattctatggtcgacagaggatggggtaatggttgcggcctatttggaaaaggaggaatagtaacatgcgctatgtttacgtgtaagaaaaatatggagggtaaaatagtgcaaccagaaaatctcgaatatacaatagtagtcacaccccactcaggtgaggagcatgcagttggaaacgacactgggaaacacggtaaagaaatcaaagtaacccctcagagctcgataacagaagcagagttgaccggatatggaactgtcactatggaatgttcacctagaactggactagatttcaatgaaatggttctacttcaaatggaaaataaagcatggttagtccatagacagtggttcctggatttacctctgccatggctgccaggtgcagatacacaaggaagcaactggatccaaaaagaaactctagttaccttcaaaaatcctcacgccaagaaacaagatgtggttgtattaggttctcaagagggagcaatgcacacagcattaacaggagcaacagaaatacaaatgtctagcggaaatttattatttacaggccacttaaaatgtcgattacgaatggataaacttcaactaaagggcatgtcttattccatgtgtacaggtaaattcaaggttgtaaaagaaatagctgagactcagcatggaacgattgtaataagggttcaatatgaaggtgatggatcgccgtgtagaataccatttgagataatggatttggagaaaagatatgttttggggcgattaataacagtcaaccctatcgtaaccgaaaaagacagtccagtaaatatagaagcagaaccaccttttggtgattcctatataataataggggtcgagccaggacaactcaaattaaactggttcaagaaaggatcatctatcggccaaatgtttgaaacaacaatgcgtggagcgaaaagaatggcgatcctaggagatacagcgtgggacttcggcagcttaggtggtgtttttacttctataggtaaggcacttcatcaagtgtttggcgcaatatatggtgctgctttctccggagtgtcgtggacaatgaaaatattaatcggtgtaattatcacatggattgggatgaactccaggagtacatctctgtcggtaagcctagtactggttggaattgtaacactctatttaggagtgatggtacaagcagactcaggctgcgtggtctcttggaaaaacaaagaactgaaatgtgggtccgggatattcattaccgacaacgtacacacttggaccgaacagtacaagttccaaccagagtccccttcaaagctcgcttccgcaatccaaaaagcacaggaagagggtatatgtggaatcagatcagtaacaaggttggagaatctaatgtggaaacaaataactcccgaattgaaccacatacttgcagagaatgaggtaaaactaacaatcatgacaggtgatataaaaggaataatgcaggcaggaaaaagatctctacgacctcaacctacagagttaaaatacagctggaagacatggggaaaagcaaaaatgttaagtactgagtcacataatcaaacctttttaatcgatggtccggagacagcagaatgtccaaatacgaaccgggcttggaatagtttagaagttgaagattatggattcggcgtttttacaactaacatctggctaaaattgaaggagaaacaagatgctttttgtgattccaaattgatgtcagcagccattaaggataatcgtgcagttcatgcggacatgggatattggatcgagtctgccttaaacgatacttggaaaatagaaaaagcatcatttattgaagtcaagaactgtcactggccaaagtcacataccctgtggtcaaatggagtccttgagtccgaaatgattataccgaagaatctagctgggcctgttagtcagcataattatagaccaggataccatacacaaatagccggaccttggcacctgggaaaattggaaatggacttcgatttttgtgacgggaccactgttgtagtaaccgaagactgtggaaatcgcggaccatctctcaggaccactacagctagtggtaaattaattacagaatggtgctgtaggtcatgtacccttcctcccttacggtaccgaggagaggacggttgttggtatggaatggaaatacgtccactgaaagaaaaggaagaaaatcttgttaatagcttagttactgcaggacatggacaagttgacaatttttcattaggcgtgttaggtatggcattattcctcgaagaaatgttgcgtacaagagtcgggacaaaacatgcgattctcttagtagctgtatcttttgtaacgttaataacgggaaacatgagttttaaggatttgggaagagtagttgtcatggtaggtgcaactatgaccgatgatataggaatgggggtcacctatttggcgctattagcggcgtttaaggtcagacccacattcgctgcgggtctactattgcgaaaattaacaagtaaagaattaatgatgacaacaatcggcatcgtattactttcgcagagtacgatcccggaaacaatactagaacttacagatgcgttggcattaggaatgatggtacttaaaatagtacggaatatggagaagtaccaactagctgtaaccattatggcaatactatgtgttcctaatgctgtaatactacaaaacgcttggaaagttagctgcactatattggccgtagtttctgtttcaccactcatccttacaagttcacaacagaaaaccgattggataccattagctttaactatcaagggattgaatccaactgcaatatttctaactacacttagtaggaccaacaagaaacgatcttggcccttaaacgaagcaataatggctgtaggtatggtcagtattcttgcttcaagtctactcaaaaatgatataccaatgactggacccttagtagccggaggcttactgaccgtatgctatgttctaacaggacgttctgctgatttggagttagaacgagctacagacgtcaaatgggaggatcaagccgaaataagcggttcatcacctatactatcaattaccattagcgaggatggtagcatgagtatcaaaaatgaggaagaagaacaaactttaactatattgataaggacaggacttctagtaatatcaggtctatttcctgtctcaataccaataacggcagcggcgtggtacctatgggaagtcaagaaacagagagcgggtgtactttgggatgtcccaagtccacctcctatgggaaaggctgaactggaagatggtgcttacagaataaaacaaaagggaattttgggttattctcaaataggtgcgggcgtctataaagaaggaacatttcatacaatgtggcatgtgacccgcggagcggtcttgatgcacaaagggaagaggatcgaaccctcctgggctgatgtgaagaaagatctgataagttacggcggtggctggaaactcgagggagaatggaaggaaggagaagaagtgcaagtactagcccttgagcctgggaaaaatcccagagcggtccaaacgaaacctggtctattcaaaacaaataccggaaccataggcgcagtaagtctagactttagtccaggaacctcaggaagcccaataattgataagaaaggtaaagtagtcggattatatggaaatggtgtagtaacacgctccggcgcttacgtaagtgctattgcacaaacagaaaaatctattgaggacaatcccgagattgaagatgatatatttcggaaaagacggttgactataatggatctacatccaggggcgggcaagacaaagagatatctaccagcaatcgtaagggaagcaataaaacgaggactgcgtactcttatcttagcgccaacacgggtagttgctgcggaaatggaagaagcactccggggcttaccaattaggtaccaaacgcccgcaattcgagcggaacacacggggagagaaatagttgatttgatgtgtcacgcaacttttactatgcggctattgtcaccagtacgtgtccctaactataatctgataataatggacgaagcacatttcacagatccagcgagtatagccgctagaggttatattagtacacgtgtagaaatgggagaagcagcagggatatttatgactgcaactcctccgggatcacgagatccatttccacaatctaacgcaccgataatagacgaagaaagagaaatcccagagcgatcatggaactcaggtcatgagtgggtcaccgacttcaagggcaaaactgtctggtttgtacccagtatcaaagcgggtaatgatattgctgcttgcttacggaaaaatggaaagaaagtaatacaactatcaagaaaaacattcgatagtgaatatgtgaaaacacgcacaaacgactgggattttgtagtaacaacggacataagtgagatgggtgcaaattttaaagcagaacgagttatcgatccacgtagatgcatgaaacccgtcattttaacagatggtgaagagagggtaatattggcaggtcctatgccagtaacccacttcagtgcagctcagcggcgaggacggataggtcgaaaccctaaaaacgaaaacgatcagtatatatacatgggcgaacccttagagaatgacgaagattgcgctcactggaaagaggcgaaaatgctactagataatataaacactcctgaaggcattattccaagtatgtttgagccagaacgagagaaggtagatgctattgatggcgaataccggctgcgaggcgaagctcgaaaaacgtttgttgacctaatgagaaggggcgatctaccagtttggttggcttacaaagtcgctgctgaaggaataaactacgcagacagaagatggtgttttgatggtattaaaaataatcaaatcctggaagagaacgtggaagtagaaatatggaccaaagaaggagagaggaagaaattaaaacctaggtggttagatgctcgaatctactccgacccattggcattgaaagagttcaaagaatttgctgccgggagaaagtcactagcgttaaatctaataacagagatggggcgtctacctacctttatgacccagaaaactagagacgcacttgataacctagctgtgctacacacggccgaagcaggcggtcgagcatacaatcatgctctatccgagttgccagaaaccctagagacactcctattattaacactattagcaacagtcacaggcggaatattcctatttttaatgagtggacgcggtataggaaaaatgacattaggaatgtgttgcatcataacagctagcatactattatggtacgcacaaatacagccacactggatagccgcaagcattatcttagtgttctttctcatagttctattgattcccgaacccgaaaaacagcgaacgcctcaggataaccagctcacttatgtagtgatagccattctgacagtagtggctgctactatggcaaatgaaatgggtttcctagagaaaacgaaaaaggacctagggtttggtagtatcgcgacacagcaaccagaatcaaatattctggatatcgacttaagaccagccagcgcctggacactgtatgcagtagcgacgacgttcgttactcccatgttaagacactcaattgaaaactcctctgtaaacgtctcgttaacagcgattgcgaatcaggcaacggtcttgatgggactaggcaaaggatggccactttctaaaatggacataggcgtcccattattagcaataggatgttactcgcaagtcaacccgataactctaacagctgcgctcttactcctggtagcacactatgcaatcatcggaccagggttacaagcaaaagctacacgtgaagcacagaaaagagctgccgccggaatcatgaaaaatccgacagtagacgggatcacagttatagacctagatccaattccatatgatcctaaatttgaaaaacaactcggccaagttatgctcttagtcctatgtgtaacccaagtgttaatgatgaggacaacgtgggcactgtgtgaagcactgacactagctacaggcccgatttcaacactatgggaaggaaatccgggcagattttggaataccaccattgctgtatcgatggcgaatatcttccgtggttcttatctagctggtgcaggtttattattctctattatgaaaaatactactaacacaaggcgaggtacaggtaatataggcgaaacgttaggtgaaaaatggaaatcacgattaaatgcattaggaaaatctgaatttcaaatatataagaaatcagggatccaagaagtggatcgcacgctcgcaaaagaagggataaaacgaggtgagacagaccatcacgcagtatcaagaggcagtgccaagttacgttggtttgtggagcgaaacatggtaacacctgaaggtaaagttgtggatctcggttgcggccgcggagggtggagctattactgtggtgggctgaaaaatgttcgtgaagtaaaagggttaacaaaaggtgggccgggtcacgaagaaccgatacctatgagcacatatggttggaacttggtcagattacagtctggcgtcgatgtatttttcatacctccagagaaatgcgacaccctactatgcgacattggcgaaagcagccccaatcccacagtagaagcagggcgaactttaagagtattaaatttggtcgagaattggctaaacaataatacacaattctgcatcaaagtacttaatccttacatgccatcagtaattgagaaaatggaggctttacaaagaagatatggtggagcattagttcgaaatcctttaagtagaaattccacgcatgagatgtattgggtgtcaaatgcaagtgggaatatagtgagctccgtcaatatgatatcacgcatgctaatcaatagattcacgatgaggcataagaaagcaacatatgagcctgatgtggatctcgggtcgggtacgcgcaacataggaatagagtcagaagttccaaacctagacataattggtaaacgtatagagaaaattaaacaggaacacgagacaagttggcactatgatcaggatcatccgtataaaacttgggcctaccatggttcatacgaaacaaaacaaactggatcagcgtcatccatggtcaacggtgttgtccgactcctcacaaaaccttgggatgtgctgcctactgttactcaaatggctatgacggacacgacgcctttcggacagcaaagagtattcaaagagaaagtagatacaagaacacaagagccaaaggaaggaacgaagaaacttatgaagattacagcggaatggttatggaaagaattgggcaagaagaaaacaccaagaatgtgtacacgcgaggaatttactaggaaagtaaggtcaaatgcagctcttggagccatattcacagatgaaaataagtggaaatcagctagggaggctgtggaagatagcagattctgggaattagtagataaagagagaaatctccatctagaagggaagtgcgaaacatgtgtatacaatatgatgggaaaacgtgagaagaaattaggagaatttggtaaagcaaaaggatcaagagcgatatggtatatgtggttaggtgcccgcttcttggagttcgaagctctggggttcctaaacgaagaccactggttttcgagagaaaattctctatcaggagttgagggggaaggattacacaaactaggttacattctaagggatgtatcgaagaaagagggtggtgccatgtatgcagacgatactgcagggtgggacacacggataactttagaagatctgaaaaacgaggaaatggtcaccaaccatatggaaggggaacataagaaactggccgaagctatatttaaattgacctaccagaataaagtggtaagagttcaacgtccaacaccaagaggtactgtaatggacataatatcccgacgtgatcaacgaggaagtggacaggttgggacatatggtctgaacacatttactaatatggaagcacaactaattcgacaaatggagggggagggagtatttaaaaacatacaacaccttaccgctacagaagaaatcgctgtccaaaattggttggctagggttggccgtgagcggctaagtaggatggcaatttcgggagatgattgcgtggtcaaacctctagacgataggtttgcaagcgcacttactgcgttaaacgacatgggcaagattagaaaagacattcagcagtgggaaccgtctagagggtggaacgattggacacaggtaccgttttgctcccatcatttccatgagctcataatgaaggatggcagggtgctagtagtcccgtgtcgaaaccaagatgagctaatagggcgagcgcgaatatcacaaggcgctggctggtctctaagagaaacagcatgtctggggaaaagttatgcacaaatgtggagcctaatgtattttcaccgaagagacttaaggttagcagcaaatgccatatgtagcgcagtcccaagtcattgggtgcctacttctcgcacaacctggtcaatacacgcaaaacatgaatggatgacaactgaagacatgttaactgtgtggaaccgtgtatggattcaggaaaatccttggatggaggataaaactccagtggaatcctgggaagagattccatatctcggcaaaagagaagaccaatggtgtgggagtctgataggactaacatcacgagcaacttgggccaaaaatatccaagcggctataaaccaagtgaggagcttaattggcaatgaggagtatactgattatatgccctctatgaaacgtttccgtcgagaagaagaagaagccggtgtactatggtga

SEQ ID NO: 22979 - RNA, 9876 nt, synthetic construct
  misc_feature 1..9876: note = derived and/or modified CDS sequence (opt6) from DENV-2__AF169686__SS-prME
  source 1..9876: mol_type = other RNA
tcagctggaatgataattatgttaataccaactgtgatggcatttcatttgacaacaagaaatggagaacctcatatgatagtttccatacaagaaaaaggtaaaagtcttctttttaaaaccgaagacggtgtaaacatgtgcactctaatggctatggaccttggtgaattatgcgaagatacgataacctataaatgcccattattaagacaaaatgaacctgaagatatagactgctggtgtaattccacaagtacatgggtaacatacggcacatgtacaacaacaggagaacaccgtcgtgagaaaagatcagtagcattggtaccacacgtgggcatgggattagaaacgcgaaccgaaacgtggatgagctcagaaggcgcatggaaacatgcgcaaagaatagaaacctggatactaagacacccgggatttacaataatggcagcaatattagcgtacactatagggactactcattttcagcgagcactcatatttattctcttaacagctgttgcgccaagcatgactatgaggtgcatcgggatcagcaacagagactttgtcgaaggggtgtcagggggctcttgggtggacatagtattggaacacggttcatgcgttactacaatggctaaaaacaaaccaacactagactttgagttaattaagacggaagcaaaacaacccgctaccttgagaaaatattgtatcgaagctaaacttacgaataccacaaccgaatcacgatgtccaacgcagggagaaccatctcttaaagaagaacaggataaaagatttgtttgcaaacacagtatggtggatagaggatggggcaatggttgcggacttttcggaaaaggaggaatcgtgacatgtgcaatgttcacatgtaagaaaaacatggaaggaaaaatagtgcagccagaaaacttggaatacaccatagtagttacaccacatagtggcgaagaacatgccgttggcaatgacactggaaaacatggaaaagagataaaggtgactccacagagttctattactgaagctgaactgacaggttatgggacagtcacaatggaatgttcaccaaggacagggcttgactttaacgaaatggttttgttacaaatggaaaacaaagcgtggcttgtacataggcaatggttcttggatctaccgttgccatggttaccaggagcagatacacaagggtctaattggatccaaaaggaaaccttagtgactttcaagaatccacatgcaaagaaacaagatgttgttgttcttggttctcaagaaggggccatgcacactgctctaactggggccacggagatacaaatgagcagtgggaacttgttattcacaggacatctgaaatgcagactccgaatggacaaactacaattaaagggaatgagttactctatgtgtacggggaaatttaaagtcgtgaaagaaatagcagaaacgcaacacggaactatcgttatacgtgttcagtacgagggagatggttcgccttgtagaataccatttgaaataatggatttagagaaaagatacgttttaggtagactaataactgtgaatccaatagtaacggagaaagattcaccagtcaatatagaagcggaaccaccatttggtgacagttacatcataatcggtgtggagcccggacaattaaaattaaactggtttaagaaagggtcgagcatcggacaaatgttcgagactacaatgaggggagcaaaacgaatggcgattttaggggacaccgcatgggacttcggatcattaggaggggtatttacatcaataggcaaggccttacatcaagtcttcggtgccatatacggtgccgcattctcaggagttagctggactatgaaaatattcataggggtaattataacgtggataggcatgaacagcagatcgacatcattatcagtgtctctagttcttgtaggtattgtaacgctttacctaggtgttatggtccaggccgactcgggatgtgtcgtatcttggaagaataaagaattaaaatgcgggagtggaatatttataacagacaatgtacatacttggacagagcaatataagttccaaccggaatcgcccagtaaactagcctcagccatccaaaaagcccaagaagaaggtatctgtggcataagatcggttacaagattagagaaccttatgtggaaacagatcacacccgaactaaatcatatcttagcggagaatgaagtaaaactaactataatgacaggtgacataaaaggcataatgcaagccggaaaaaggtccttgaggccacaacctactgagttgaagtactcgtggaaaacatggggaaaagctaagatgcttagcacagagtcgcataaccagacattcttgattgatggaccggaaacagcagaatgccccaatactaatagagcgtggaactccctcgaagtggaagattatggcttcggtgtatttacgacaaatatttggctcaagttgaaagaaaagcaagacgctttctgcgattcaaaacttatgtctgcagctataaaggataaccgtgccgtacatgccgacatgggatattggatagagtcagcattgaacgacacctggaaaatagaaaaagcatcctttatagaagtgaaaaattgccattggcctaaaagtcacacactttggtcaaatggagttctagagtcagagatgataattcccaaaaacctggctggtccggtatcccaacacaattaccgacctgggtatcatactcaaattgcgggaccgtggcaccttggtaaattagaaatggactttgatttttgtgacggtaccaccgttgtcgtcaccgaagactgcggtaatcgaggtccaagtctacgaacaaccacagcttcagggaaattaataacggaatggtgctgtcgatcatgtactcttcccccgctgaggtatagaggagaagacggttgttggtacggaatggaaataagaccccttaaagaaaaggaggaaaacctagtaaacagcttagttacggcagggcacggacaggtggacaatttttcattgggagtcctgggtatggcactattcctagaagagatgcttagaacaagagtaggtaccaaacatgcaatactactggtcgcagttagttttgtaacacttattaccggtaacatgagttttaaagatctaggaagagtagtagtaatggtgggagccacgatgactgacgatatagggatgggtgtcacttacttagcactcctagctgcatttaaagtacggcctacgttcgcagctggtctgttacttcgaaaattaacttcaaaagaattgatgatgactacaataggcatcgttttactaagtcaaagcacgattcccgagacgatcttagaattgacagatgcactcgcactgggtatgatggtccttaaaatagttcgcaatatggaaaaataccaactggctgttacaataatggcaattttatgtgttccaaatgctgtaatacttcaaaacgcctggaaagtctcgtgtacgatacttgcagttgtatctgtctcccctcttatattaacatcctcacaacagaaaactgattggatcccattagctttaacgatcaaaggattaaatcctacggccatattcctaacaacattatcaaggacaaacaagaaaaggagttggcccgtaaacgaggcaataatggcagtagggatggttagcatacttgcgagttcattacttaaaaacgacatacccatgactgggccattagtggccggagggttgctcacagtatgctacgtactgactgggcgctcagcagatctagaactggagcgagcgacagacgtaaaatgggaggatcaagcggagatatccggatcaagccctatattgagtataaccataagtgaagacggctctatgagtatcaaaaatgaggaagaagaacaaactttaactatacttatacgaacaggacttttggtcatatcaggattatttccagtatcaatccccattacagcagctgcctggtatctgtgggaagtcaagaaacaacgagccggtgttttatgggatgttcctagtccccctccaatggggaaagcagagttagaagatggagcttatcgtatcaaacaaaagggaatcctgggatacagtcaaatcggtgcgggggtttataaagaaggtacctttcatacgatgtggcatgtcaccagaggggcagttcttatgcacaaaggaaaacgcatagaaccttcgtgggctgatgttaaaaaggacctaattagctacggaggaggatggaaactagagggagagtggaaagagggagaagaggttcaagtacttgcgcttgaaccaggaaagaatcctagagcagtccagacaaaaccaggtttattcaaaactaatacgggaactatcggagccgtctcactagatttttcaccgggcaccagtggctcgccaataatagacaagaaaggaaaggtagtagggctgtacggaaacggcgttgtgacacgcagcggggcgtatgtatctgccatagcacaaacggaaaaatcaatagaagataatcctgagattgaggatgacatttttcgcaaacgccgtctaactataatggatttacatccaggcgcgggcaaaacaaagaagtatctgccggctatagttcgagaagctataaagcgcggattgagaactctcatactagcaccaaccagggttgtagcggccgaaatggaagaggccctacggggattgccaattaggtaccaaacaccggcaattcgggcggaacatacaggcagggaaatcgttgacctcatgtgtcatgccacatttacaatgcgtcttttatcaccagttcgggtacctaactacaatctgataatcatggacgaagctcattttacagatccggcttcaatagcagcacgaggatatattagtacacgggtggagatgggcgaagcagcaggtatatttatgactgcaactccaccaggttcgagggacccttttccacaatccaatgcaccgatcattgacgaggaaagagaaatacccgagaggtcatggaacagcggtcatgaatgggtcacagatttcaaaggtaagacagtttggttcgtgccctctataaaagcaggtaacgacatcgcagcatgcttacggaaaaatgggaagaaagtaattcaattaagtcggaaaaccttcgactctgaatatgtaaagactaggaccaatgattgggatttcgtcgtgaccaccgatataagtgaaatgggtgccaactttaaagctgaaagagtaatcgatcctagacggtgtatgaagccggtaattctaactgacggcgaagaaagagttatactagcaggtccaatgccagttactcatttttcagcagctcaaagacgcgggagaataggaagaaatccgaagaacgagaatgatcaatatatctatatgggagagccactggaaaatgatgaagattgtgcgcattggaaggaagcaaaaatgctcttggacaatattaatacacctgaaggaatcatcccctctatgttcgaacctgagagagagaaggttgatgcaattgatggcgagtataggttaagaggagaagcaagaaaaacatttgtagacctgatgcggcgaggagacctaccagtatggttagcatacaaagttgctgcagaaggaatcaattacgccgatcgaagatggtgttttgatggtatcaagaacaatcagatcttggaagaaaatgttgaagtcgaaatatggacgaaagaaggggaacggaaaaagttaaaaccaaggtggctcgacgccaggatttactctgatccgctagcccttaaagaatttaaagaatttgcagccggccgaaagagcttggctttgaatttaatcacggagatgggtagactgcctacttttatgacacagaaaacgagggatgccttggataatttagctgttctccatacagcggaggcgggaggccgagcatataatcatgcgttaagcgaattgcctgaaactctcgagacattacttctattaacattattagcaacggttacaggagggatttttctctttcttatgtcgggaagagggataggaaagatgacactgggaatgtgttgcattatcacagcctcgatattactttggtacgcgcaaatacaacctcattggatagcagcatcaataattttagtattctttttaattgttctattaattcccgaaccagaaaagcaaaggactccgcaggacaatcaactaacatatgttgttatagcaattttaacagtagtagcagctacaatggcaaacgaaatggggttccttgagaaaacaaagaaagatctaggattcgggtcaattgcaactcagcaacctgaaagtaatatattggacattgacttaaggccagcgtctgcttggaccctgtacgcagtggctacaacattcgtcacaccaatgttaagacattcaatagaaaactcaagcgtcaacgtgagtttaacggctatcgccaaccaagcaacagtcttaatgggactcggcaaaggatggccactttctaaaatggatattggtgttccgttgctagccataggttgttacagtcaagtaaatccaattacattgacggcagccttattattattagtagcacattacgctattattggtccaggattacaggcgaaggctactagggaggcacagaaaagagcagcggctggtattatgaaaaaccctaccgtagatggaataacagttattgaccttgatccaataccatacgacccgaaattcgaaaaacaattaggtcaagttatgttactcgtgctatgcgtaacgcaagttctaatgatgcgaaccacatgggcattatgtgaagcactaaccttagctaccggaccaatcagcacattatgggagggaaatcccggacggttttggaatacaacaattgctgtgtcgatggcaaatatatttagagggtcatatttggcaggggcaggattattattttcaattatgaaaaatactaccaacacgcggagaggaaccggtaatataggcgagacactgggagagaaatggaaatcccgattaaatgccttaggaaagagtgagtttcagatttataagaaaagcggtatacaagaagtagacagaaccctagcaaaagaaggtattaaaagaggggagacagatcatcacgcagtatcccgaggtagcgcgaaactaaggtggttcgtggagaggaatatggtaaccccagaaggaaaagtggttgatttgggatgtggaagaggcggatggtcatattattgtggaggccttaaaaatgtaagagaagtaaaaggactaaccaaaggtgggccgggccacgaggaacccataccaatgtcgacctacggatggaacttagttaggttgcaatcaggtgtggatgtcttctttaccccaccagagaaatgcgatacgttattatgtgatataggggaatcttcaccaaacccaactgttgaggccgggcgtacgctacgcgtcttaaatctggtagaaaattggctaaataataatactcagttttgcataaaagtgcttaacccttatatgccatcagtaattgagaaaatggaggctctacaaagaagatatggaggagcgctcgttaggaatcctctaagtaggaatagtacccatgaaatgtactgggttagtaacgcatcagggaacatcgtaagctcagttaatatgatttcaaggatgcttataaatagatttacgatgaagcataaaaaggcgacttatgagccggatgttgatttaggtagcggaactcgaaatattggcatagaaagtgaagtaccgaacctcgacatcattggaaaaagaatagaaaagataaagcaagagcatgagacaagttggcactacgatcaagatcatccatacaaaacctgggcgtatcacggatcatatgaaacaaaacagactggtagcgctagtagtatggttaatggcgttgtccgcttactaacaaaaccatgggacgtgctcccaacagtgactcaaatggccatgaccgatacaacgccctttggacagcaaagagtatttaaagagaaggtcgacacaagaactcaagagccgaaggaaggtacgaagaaattgatgaagataaccgccgaatggttatggaaggaactcggcaaaaagaaaactccacgtatgtgtacaagagaggaatttacacgtaaggtgagaagtaatgcagcactcggagcaatttttaccgatgaaaacaagtggaaatccgcacgcgaagctgttgaagacagtcgtttctgggaacttgtggataaggaacgcaatcttcatttggaaggtaaatgtgagacgtgtgtctataacatgatgggtaaacgggaaaagaaattaggagagtttggaaaggctaaagggtctcgtgctatatggtacatgtggcttggcgctaggttcctggaatttgaaactctaggattcttgaatgaagaccattggttttcgagagagaacagtcttagtggtgtagaaggagaaggtttacataaacttggatatattctaagagatgtaagtaagaaggagggtggggctatgtacgcggacgatacagctggatgggacactagaatcacacttgaggaccttaaaaatgaagaaatggtaacaaaccacatggaaggtgaacataagaaactagcggaagctatattcaaattaacttaccagaataaagtagtacgagtccaacggcccacaccgagaggaacagttatggacatcatatctcgtcgggatcaaagaggatctggtcaagtaggtacatacggattgaacacattcactaacatggaagcacaactaataaggcaaatggaaggagaaggtgtcttcaaaaatattcaacacctaacggctaccgaagaaattgcagtccaaaattggttagccagagttggtagagaacgattaagtcgcatggcgatatccggagatgattgcgttgtaaagccgttagatgataggttcgcgagcgctctcacagccctaaatgatatgggaaaaataagaaaagatatacaacaatgggagccatcacgcggatggaacgactggacccaggtaccattttgttcacatcattttcatgagctcattatgaaagatggcagggtacttgtagtaccttgccgtaatcaagatgaattaatcggccgagctcgcataagccaaggcgctggatggtcgctacgagaaactgcatgtctcggaaaaagttacgcacaaatgtggtccttaatgtatttccaccggcgggaccttagattagcggccaatgctatctgctctgctgtgccttcgcattgggtaccaactagccggacgacgtggagtatccatgcaaaacatgaatggatgacaactgaggacatgttagcagtttggaatagagtatggatacaagaaaatccgtggatggaagataagacgccggtagagtcatgggaagaaatcccatacctaggtaaaagagaagaccaatggtgtggttctttgataggcttgacgagtcgtgccacatgggccaaaaatattcaagctgcaataaatcaagtacgaagtttgataggtaatgaagaatacaccgactatatgccttcaatgaaacgatttcggcgagaagaagaagaagcaggagtgctttggtag

SEQ ID NO: 22980 - RNA, 9876 nt, synthetic construct
  misc_feature 1..9876: note = derived and/or modified CDS sequence (opt6) from DENV-2__AF169687__SS-prME
  source 1..9876: mol_type = other RNA
agtgctgggatgataatcatgctaattccaacagtgatggcattccacctaacgacgagaaatggcgaaccacacatgatcgtttcaatccaagaaaaaggaaaaagtcttctctttaaaacagaagacggtgtgaatatgtgcaccctaatggcaatggacctcggtgaattatgcgaagacactattacctataaatgtccactattaagacaaaatgaaccagaagatatagactgctggtgcaactcaacctctacttgggtaacttatggaacttgcacgacaactggtgaacatagaagggaaaaacgaagcgttgctctagtaccacacgttgggatgggtttagaaacgagaacagaaacctggatgagctctgaaggcgcatggaaacacgcacaaagaattgagacctggatcttaagacatcctgggtttactatcatggctgcgattctagcatacaccataggaacaacccactttcagagagcattaatttttatacttcttaccgcagtagccccgagcatgactatgcgatgtattggaatatctaatcgagactttgtagaaggtgttagtggagggtcatgggttgacatcgtattagaacacggtagttgtgtaacaacaatggccaaaaataaaccgacgctagactttgaacttataaaaacagaagctaaacaaccggcaacgcttcggaaatattgtatagaggctaaactcacgaatacaaccaccgaatcccgatgtccaacgcagggagagccaagcctaaaagaagaacaagataaaagatttgtttgtaaacatagcatggtcgacagaggctggggtaatgggtgcggattgtttggaaaaggagggatagttacttgcgcaatgtttacatgcaagaaaaatatggaaggtaaaattgtacaaccagagaacctagaatacactatcgtagtaactccgcactctggcgaagaacacgcagtcggaaatgacaccggcaaacacggaaaagaaataaaagtgacacctcaatcaagcattacggaagcggaactcacaggatacggaactgtaaccatggaatgttctccacgcaccggattagattttaacgaaatggtactcttacaaatggaaaataaagcgtggctagtacatcgtcaatggtttttagatttaccgttaccctggctaccaggggcggatacacaaggttcgaactggattcagaaagaaactttagtcacatttaaaaacccccacgctaagaaacaggacgtagtggtcctaggaagtcaagaaggcgccatgcatactgcattaactggagccaccgaaatacaaatgtcgagtggaaatttgttattcacagggcacctaaaatgcagactacgaatggataaactacagttaaaaggcatgtcatattcaatgtgtactggaaaatttaaagttgttaaagaaatagcagaaacccagcacggaacaattgttatcagagtacagtatgaaggtgatggtagcccttgtcgcattccgttcgaaattatggacctagagaaaagatatgtgttaggtagattaataaccgtaaacccaatagtaacagagaaagattcaccagttaatatagaagcagaacccccgttcggtgacagttacattattattggagtggagcccggccaactaaaactaaactggtttaagaaaggatcttcaatcggccaaatgttcgaaacaactatgagaggggctaaaagaatggctattctcggagacacagcttgggactttggatcccttggaggtgtctttacttctataggaaaagcactccatcaagtattcggggccatatacggagcagcgtttagcggagtcagctggacgatgaaaatactaatcggagttataataacatggatcggaatgaacagcagaagtacaagtcttagtgtttctttagtcttagttgggatcgtcacattgtatttgggagttatggtacaagctgattctggatgcgtggtctcatggaaaaataaagaactaaaatgcggaagtggaattttcattaccgataatgttcatacctggaccgagcagtacaaattccagcccgaatctccgagtaaattagcatctgcaattcaaaaagcacaggaagaaggtatttgcggtatcaggtcggtaacacgtctcgagaacctcatgtggaaacaaataacaccagaattgaaccatattctgagtgaaaatgaagtaaagttaacaataatgaccggtgatattaagggaattatgcacgctggtaaaagatccctaagaccccaacccaccgaacttaaatactcctggaaaacgtggggaatcgctaaaatgctatctacagagtcgcacaatcaaacattccttatagacggacccgagacagcggagtgtccgaatacgaatcgagcatggaactcccttgaggtagaagattatggttttggagtatttactacaaatatatggctcaagttgaaagaaaaacaagacgcattctgtgactcgaagttgatgagtgctgcaataaaagataatagggcagttcatgcggatatgggctattggatagaatccgcattaaacgatacatggaaaatagagaaagcaagttttattgaggtcaaaaattgtcactggccaaaatctcacactttatggtccaacggtgtactggaaagcgaaatgataatacccaaaaatttagcaggtcctgtgtcgcaacacaactacagaccaggttatcatacacaaatcgcgggaccgtggcatttagggaagctggaaatggactttgacttctgcgatgggacaactgtcgtggtaacagaagactgtgggaacagaggtccctctctacgaaccaccaccgcatcaggcaagctgattacagaatggtgttgcagatcatgtacattaccaccgcttcgctatcgtggtgaagatggctgttggtacggcatggaaatacgtccacttaaagaaaaagaagagaacctggtaaactcactcgttacagcagggcatggccaggttgacaacttctcacttggcgtactcgggatggccctatttttagaagaaatgctacgtacccgtgtaggaaccaaacatgcaatcctactggttgctgtttcattcgtgactttaataacaggaaacatgtcattcaaggaccttggaagagtagttgtcacagtcggtgccactatgacagacgatataggaatgggtgtgacatatctcgctttattagccgcttttaaagtccgtcctacatttgctgcaggattattgttgcgaaaattgacttctaaggaattaatgatgacgaccataggaattgttctgttatcccaatcaacaatcccagaaacaattctggaacttacggatgcattagctctagggatgatggtattaaaaatagtccgaaatatggagaaataccagctagcagttactataatggcgatcttatgtgtgccgaatgcagtaattttacaaaacgcgtggaaggtatcatgcacaatattggccgtagtttcagtatctcctttaatactaacaagcagtcagcagaaaactgattggatacctttagctcttacgataaaaggacttaatcccacagctattttcctaacaactttgtcaagaacaaacaagaaaagaagttggccgttaaatgaagcgatcatggccgtaggtatggtgagcatcttagcctcatcactcctcaaaaatgacattccgatgaccggacccctagtagctgggggattactaactgtgtgctacgtccttacaggacgcagtgccgatttagaactagagagagcaacagacgttaaatgggaagaccaagctgaaatatctggtagttctccaatactaagcataaccataagtgaagacggaagcatgagcatcaaaaatgaagaggaagaacagacgctcaccatactaatacgcacaggtctattagttatatcaggcctttttccagtatccatacctataacagcagctgcatggtacctatgggaagttaagaaacagagagcaggcgtcttatgggatgtaccttctcctcctcctatggggaaagccgaattggaggatggcgcatatcgaatcaaacaaaaaggaatactcggttattcccaaattggagctggagtatataaggaagggacatttcacactatgtggcatgtaactagaggtgcagttctaatgcacaaaggtaaaagaatagagccatcttgggctgacgtgaagaaagatcttatttcttacggaggcggttggaaattagaaggagaatggaaagaaggtgaggaagttcaggtgctcgcattagaacctggtaagaatccgagggctgtccagactaagccaggactcttcaaaacgaataccgggacaatcggagcagtatcacttgatttttcgcctggtacttccggatcccccatcatcgataagaaaggaaaggtggttggattgtatggaaatggtgttgtaacccgatcaggagcatatgtaagtgcaattgcgcaaactgagaagtcgattgaggataacccagaaatagaagatgacatatttagaaaaaggaggctaacaataatggacttacatcctggagcaggtaaaacaaaaaggtatctgccagcaatcgtcagagaagccataaagcgcggtcttagaactttaatcttggcgccaacaagggtcgtagcggctgaaatggaggaggcattaagaggattacccataagatatcaaacacccgcaatcagagcagaacatactgggagagaaattgtcgacctgatgtgtcacgccacatttacgatgagactcctatcacctgttcgtgtgccaaattataacctaataattatggatgaagcacacttcacggaccccgcatctatagcggccagaggatatattagcacccgagttgagatgggagaagcagctggaatattcatgactgctactcccccaggaagtcgagacccattcccacagagtaatgcaccaataatagatgaagaaagagagatcccagaaagatcttggaactctggtcatgaatgggttactgattttaagggtaagacagtttggtttgtaccctcaattaaggcaggaaatgatattgcagcatgccttcgtaagaatggcaagaaagtaattcaactgagtagaaaaacgtttgatagcgagtacgtcaagactagaacaaatgattgggattttgtggtcactaccgatatttcggaaatgggagcaaatttcaaagcagaacgggtaatagatcctagaaggtgtatgaaacccgtcatactaaccgatggagaagaacgcgttatcttggcaggaccaatgccggtaacacacttcagcgccgcccaaagaagaggcagaataggacgcaaccccaaaaacgaaaatgatcaatacatttacatgggagaaccgctagagaacgacgaagactgcgcacactggaaagaagcaaagatgctacttgataacataaacacaccagagggtataataccaagtatgttcgaaccagaaagagagaaagttgatgctatagacggtgagtataggttgcgaggagaagcaagaaagacttttgtggatttaatgcgtagaggggacttgcccgtatggctcgcctataaagttgctgctgagggaataaattatgcagataggagatggtgtttcgatggtataaagaataaccagatcctggaagaaaacgtggaagtagaaatttggaccaaggaaggtgagaggaagaaattgaagccaagatggctcgatgcaaggatttacagtgatccactagcacttaaagagttcaaagaatttgctgctggtaggaaatctctcgcactcaacctgataacagaaatgggacgactgccaaccttcatgactcagaaaactagagatgcactagataacttagccgtattgcatacagctgaggctgggggccgcgcttacaatcacgcactatcagagttaccagagacccttgaaaccctattgcttttgacactattagcaaccgttacaggtggtattttcttatttctaatgagtgggcgagggataggaaaaatgacgctcgggatgtgttgtatcattacagcttcaatcctgctatggtatgcgcaaatccaaccccattggattgcagcatcaataatattagtatttttcctaattgttctgctaataccagaacccgaaaaacaaaggacgccacaagataaccaattaacgtacgttgttattgcaatcctaacagtagtcgcggcaacaatggctaatgaaatgggattcttggagaaaaccaagaaagatcttgggtttggcagtatagcaacacaacagccagaaagtaatatccttgatattgatttaagacctgcgtcggcgtggactctttacgccgttgctacaacctttgtgacacctatgctacgacatagtatcgaaaatagtagtgttaatgttagtctaactgccatagctaaccaagcgacagtattaatgggtttgggtaaagggtggccactaagtaaaatggatattggtgttccacttcttgccattggttgctattctcaagtaaacccaataactcttacagcagctttattactgctcgtcgcacactacgcaattatcggacccgggctacaagcaaaagcgacacgagaagcacagaaaagggctgcggcagggataatgaaaaatcccacagttgatggaatcacagtaatagatcttgatcctataccttatgaccctaaattcgagaaacaactcggccaagtcatgcttctagtactttgtgtgacacaagtacttatgatgagaaccacatgggcgttgtgtgaagcattaacactggcgacagggccaatatcaactttatgggaaggaaatccaggtcgattctggaatacaacaatcgctgtatcgatggctaatatatttcggggatcttaccttgccggagctggactactttttagtattatgaaaaacactacaaacaccagacgtgggactggaaacataggtgagactcttggtgaaaaatggaagtctaggctaaacgcactaggtaaatctgaatttcaaatttacaagaaatcggggattcaagaagtagatcgcacactagctaaagaaggtataaagcgaggagaaacggatcaccatgccgtcagtagaggttcagcaaaactcagatggttcgttgaacgtaacatggttacgccggaaggaaaagtcgtagacctgggatcaggccgtgggggttggagttactactgtggtgggttgaagaacgtacgagaggtcaaaggattaacaaaaggtggccctggacacgaagaacccatacctatgtccacgtatggatggaacttagtgcggctacagtcaggtgttgatgtattctttataccgcccgaaaaatgtgataccttgctatgcgatatcggagaaagctcaccaaaccctacagtagaagcgggaagaaccctaagagtgttaaatctagtagagaattggctaaataacaacacgcaattttgtataaaggtactgaacccttatatgccttcagtcatagagaaaatggaggcactacaaagaaagtatggaggagcgctggtaaggaatcccttaagtagaaatagtacgcacgaaatgtactgggtttcgaacgcttctggaaatatagtaagtagcgtcaatatgatatcacgaatgttaataaatagatttacaatgagacataaaaaggcaacctacgagcctgatgtggacctaggttcgggaactcgtaacatcggaatagaaagtgagatacctaatctcgacataattgggaaaagaatagagaagataaagcaggaacacgaaacatcatggcattatgaccaggatcatccatataaaacctgggcttatcatgggtcgtatgaaacgaaacaaacgggaagtgcctcaagtatggtgaacggagtagttcggttgctaactaaaccctgggacgtcctcccgaccgtaactcaaatggctatgactgatactacacccttcggtcaacaaagagtatttaaggaaaaggtcgacactaggacacaagagccaaaagaagggacgaagaaactaatgaaaataaccgcagaatggttatggaaagaattgggtaaaaagaaaacgccgcgaatgtgcacgagggaggagtttacccgaaaagtcaggagtaatgctgccctaggagcaatctttacagacgaaaataaatggaaaagtgcccgagaagcggtcgaagactcgcgattctgggaattagtagataaagagagaaacctccaccttgaaggaaaatgtgagacgtgtgtatacaacatgatgggaaaaagggagaagaaactaggggagttcggaaaagcaaaaggaagtagagctatctggtacatgtggctgggggctaggttcctagagtttgaagcattaggctttcttaatgaggaccattggttttctagagagaatagtttatcaggcgtagaaggtgagggttcacataaactaggatatattctaagagatgtgagcaagaaagaaggaggtgctatgtatgctgatgacacagccggatgggacacgaggataactctagaagatctcaaaaacgaggaaatggtgactaatcatatggaaggagaacacaaaaagctagctgaagcgattttcaaattaacttaccaaaataaagttgttcgtgtgcaacgacccacacccagaggaacagtaatggatattatttcccgacgtgatcaaagagggtctggacaagtaggaacgtatggactaaacaccttcactaatatggaagcacagttaatccgacaaatggaaggcgaaggagttttcaaaaacatccaacacctcacggcaactgaggaaatagcagtacaaaattggcttgccagggtagggcgcgaaagactttcacgaatggcaatttcaggagatgactgtgttgtgaaaccactcgacgatagattcgcatctgcactaacggcgcttaatgatatgggtaagataaggaaggacatacagcaatgggaacctagtaggggctggaatgattggactcaggtacccttttgctcacatcactttcatgaactaataatgaaggatggcagggtcctagtagttccgtgccgcaatcaagatgagctgatagggcgtgcccggatatcacaaggagcaggttggagtctcagagaaacggcatgcctaggaaaaagctacgctcaaatgtggagcctaatgtattttcaccggagagacttacgcctcgcagcaaatgcgatatgctcagcagtaccaagtcactgggtaccaacgagccggaccacttggtcaatccacgcaaaacacgagtggatgacaacagaagatatgttaacagtatggaatagagtttggatacaggaaaatccatggatggaagacaaaacgcctgtagaaagttgggaagaaattccatacctcgggaaaagagaagatcaatggtgtggaagtctcataggtctgacttctagggcaacatgggcgaaaaatatacaagcagcaattaaccaagtacgttcattaataggaaacgaagaatatacagattacatgccatcgatgaagaggtttagaagagaagaggaagaagccggtgtattatggtga

SEQ ID NO: 22981 - RNA, 9876 nt, synthetic construct
  misc_feature 1..9876: note = derived and/or modified CDS sequence (opt6) from DENV-2__AF169688__SS-prME
  source 1..9876: mol_type = other RNA
tcggcagggatgattataatgttaataccaaccgtaatggcgtttcacctgaccacacgaaatggggaaccgcacatgattgtgagtatacaagaaaaagggaaatcattgttatttaaaacggaagacggagtaaacatgtgtacgttaatggcaatggatttgggtgaattatgcgaagatactataacatacaaatgtcctctactcagacaaaacgaacctgaagatattgactgctggtgcaattccacgagcacttgggttacatatggaacatgtacgaccacaggagaacatcgtagagagaaaagaagcgtcgctctggtgccacacgttggaatgggacttgaaacaagaacggaaacatggatgagttctgaaggggcatggaaacatgctcaacggatagaaacgtggatactacgacatccaggattcacgatcatggcagccattttggcatacactataggcaccacacactttcaaagagcactcatcttcatcttattgacagccgtagcaccgtcgatgacaatgaggtgtattggtattagcaatcgcgacttcgtggaaggcgtatccggaggaagttgggtagatatagtgttagaacacggtagctgtgtgacgaccatggccaaaaataaaccaactttagactttgaattaataaaaaccgaagcaaaacaaccagcgaccttgagaaaatattgtatagaagctaaactgacaaacactacaactgaatcaagatgtccaacacaaggcgaaccgtcattaaaagaagaacaggataaaaggtttgtttgtaaacattcaatggttgacagagggtggggaaatggatgtggcttatttggaaaagggggtatagtaacttgtgcaatgttcacttgcaagaaaaatatggaaggcaaaatcgtgcaacccgaaaatttagaatacaccatagttgtaactcctcacagcggagaggagcatgccgtagggaatgatacagggaagcatggtaaagaaattaaagtaactcctcaatcatctattactgaggcagaattgaccgggtatggtacagtgactatggagtgttcaccacgaacaggcttggactttaatgaaatggttttgctccaaatggagaataaagcatggttagttcatagacagtggttcttagatctccctcttccttggcttcccggagctgacacacagggatcaaactggatacaaaaagaaacgctggtaacgttcaagaacccacacgcaaagaaacaagacgtcgttgtactaggaagtcaagaaggcgctatgcatactgcactgacaggagcaacagagatacaaacctcttctggtaacttacttttcacaggacatctaaaatgtagacttcgaatggacaaactgcaactaaaagggatgtcgtatagtatgtgcaccggaaagttcaaagtagttaaagaaatagcggaaactcaacatggcacaatcgttataagggtccagtatgaaggggatggatccccatgcagaataccgtttgaaataatggacctggagaaaaggtatgttttgggacgcctaattactgttaacccgatcgtaaccgaaaaggattcgccagtaaacatagaagcagaaccgcccttcggagattcctacataattatcggggttgagcctggccaattaaaattgaattggtttaagaaaggatcttctataggtcaaatgtttgagaccacgatgagaggcgcgaaaagaatggcaatattaggggacacagcatgggatttcggtagcttaggcggtgtgttcacctccatcggtaaagctctgcatcaagtttttggagcaatatatggggcggctttctcaggtgttagctggacgatgaaaattttaattggagtgataattacctggatagggatgaatagcagaagcacatcattaagtgtaagtttggtgctagtaggtattgttactttatacctcggtgtcatggtgcaagcagattcaggttgcgtcgtgagctggaaaaataaagaactaaagtgcggaagtggaatatttattaccgataacgttcacacttggaccgaacaatataaattccaaccggaaagcccctcgaaattagcttccgccatacaaaaggcacaggaggaaggtatttgtgggatccgcagcgtaacaagactagaaaatcttatgtggaaacaaattactcctgagctgaaccacattctggccgagaatgaggtcaaacttacaataatgaccggagacataaaaggcataatgcatgctggtaagaggagcttacgtccacagcccacggagttaaaatactcatggaagacttggggaaaagccaaaatgctttcaacagaaagtcataaccaaactttccttatcgacggacctgaaactgctgaatgtccaaacacaaacagagcgtggaatagcctagaggtagaggattacggctttggggtattcacaacaaatatatggttgaaattaaaagaaaaacaagacgccttttgtgattcaaaactgatgtcggcggctataaaagataacagagcggtacatgcagacatgggatactggatagaatctgcactcaatgatacttggaaaattgaaaaggcatcatttatagaagtgaaaaattgccattggccgaaatcacacaccttatggtccaacggagtgcttgaatcggaaatgattataccaaagaaccttgcaggtcccgtcagccaacacaattatagaccagggtaccacacgcaaatagccggaccatggcatttagggaaattggagatggattttgatttctgtgacggaaccacagttgttgtcacagaagactgtgggaaccgaggaccatctttaagaaccactactgcttcaggaaaattaatcacagagtggtgctgtcgatcctgtaccttgcccccactacgatatagaggcgaagatggctgctggtatggaatggaaattaggccgttgaaggaaaaagaagaaaatcttgtaaattcccttgtaacagcgggtcatggacaagtcgacaatttcagtctaggggtactaggaatggctctcttcttagaagaaatgctaagaaccagagttggcactaagcatgcaatattattagtggctgtaagttttgtaacattgattaccggaaacatgtcatttaaggatttagggcgagttgtagtaatggtgggagcaaccatgacggatgatatcggaatgggcgttacatacctagcattgttagcagcattcaaagtcagacctacctttgctgccgggttattgctaagaaaattaactagcaaagaattaatgatgactactataggaatagtacttttgagtcaatctacaatcccagaaacgatccttgaattaacagacgcactagcactcggaatgatggtattgaaaatagtacgtaacatggagaaatatcaacttgccgttacaataatggcaatcctatgcgtacccaatgcagttattcttcaaaacgcttggaaagttagttgcacaatattagcagtagtgtcggttagtcccttgattttaacatcgagccagcaaaagactgactggatccccctggctctgactataaaggggttaaaccccacagctattttcttaacaacgttatcaagaacaaataaaaagagaagttggccccttaatgaggcaatcatggccgttgggatggttagtatacttgcgagcagcttattgaaaaacgatatccctatgaccggtccattagtagcaggaggcctcttaacagtatgttacgtcttaacaggacgatcggccgatctcgagttggagcgagcgacagatgtaaaatgggaggatcaagcagaaatctctggaagttcaccaattttgtcaatcacaataagcgaggacggttctatgtcaatcaaaaacgaagaagaagaacaaacccttaccattttaataaggaccggactattggtaatctcaggactttttcccgtatctattcccataactgccgcagcttggtatttgtgggaggtcaagaaacagagagcaggagttctttgggacgtaccgagtcctccaccaatgggaaaagcagaacttgaagatggggcttataggattaaacaaaagggtattttaggctatagccagataggagcgggagtttataaagaaggcacgtttcatacaatgtggcacgtgactagaggtgctgtgcttatgcataaaggtaagagaatagaaccctcgtgggctgatgtcaagaaagacctgattagctatggaggtggatggaagttagaaggagaatggaaagagggagaggaagtgcaagttctagccttggaacctggcaagaatccgcgcgccgtacaaactaaaccgggtctttttaaaactaatacggggacaattggcgcagtaagtttagactttagcccaggaacgagtgggtcaccaatcattgacaagaaaggaaaagttgtaggactgtacggtaatggtgttgtgacaagatccggagcttacgttagcgccatagcacaaacagaaaaatctatcgaggataacccagaaatagaagatgatatctttaggaagaggcgacttactataatggaccttcacccaggtgctggtaaaacaaaacgctatctacccgcaattgtaagggaagctataaaacgaggacttcgaactttaatattagcgccaacccgcgttgtcgccgccgaaatggaggaagctctaaggggattacctattcgttatcaaacaccagcaataagggcagaacacacggggcgagaaatcgtagacttaatgtgtcacgcaacgttcactatgcgattactctcaccggtacgtgtaccaaactataatttgattattatggatgaggcacattttaccgatccagcaagtattgcggcgcgaggttatatctcaacaagagtagaaatgggtgaagcagcaggcattttcatgactgcgacacctccaggcagtagagacccgttccctcaaagcaacgcgccgatcatcgatgaggaaagggagatcccagaaagatcatggaacagtggtcatgagtgggtcactgatttcaaaggcaagacagtctggttcgttccttcgattaaggcagggaacgatattgcagcatgtctcagaaagaatggcaagaaagtcatacagctctccaggaaaacatttgatagcgagtacgtcaagacgagaacaaacgattgggacttcgtagtaactactgacatttccgaaatgggagcaaacttcaaagctgagagagtcatagaccccagaagatgtatgaaacccgtaatactaactgatggagaagaacgagtgatattagctggaccaatgccagtaactcatttctcagcagcgcaaaggagaggaagaattggaagaaatcccaaaaatgagaacgatcaatatatatacatgggtgagccacttgaaaatgatgaagattgtgcacattggaaagaagccaagatgttactcgataatatcaacacccccgagggaataataccctcaatgttcgaaccagaacgtgaaaaagtagacgcaatagatggcgaatataggttgagaggagaagcacgaaaaacctttgtagacttaatgagaaggggtgatctcccggtatggctggcgtataaagtcgcagcagaggggataaattacgctgataggaggtggtgttttgatggtattaaaaataatcaaatactcgaagaaaacgtagaagtagagatatggacaaaagaaggcgaaaggaagaaacttaaacctaggtggttagacgcacgaatctatagcgaccctcttgcattaaaagaatttaaagagtttgcggcggggaggaaaagcctagctctaaacttaatcacggaaatgggcaggcttcccacgtttatgacccagaaaactcgagacgctttggacaatctggctgttttacatacagcagaagcgggagggcgcgcatataatcatgcattaagtgaactaccggaaaccctagaaaccttactcctgttaacactactagcaaccgtgactggtggtatatttctgtttttaatgtccggccgaggcataggcaaaatgacattgggcatgtgttgcataattaccgcaagcatcctattatggtacgcacaaatacaaccccattggatagctgcatccataatactcgtattctttctaatcgtactattgatacctgaacccgaaaaacagagaactcctcaagacaatcaattaacatacgtagttatcgccatattaacagtggtcgctgcgacaatggcgaacgagatggggtttttggagaaaaccaagaaagatcttggttttggcagcattgccacacaacaacctgagtctaacatactggatatcgacctacgaccagcgtcagcatggacactctacgcggtagcaacgacgttcgtaacaccaatgctaagacattcgatagaaaattcttcagttaatgtatccttgaccgcgatagcaaatcaagcgaccgtattaatgggtttaggaaagggatggcctctttcgaaaatggatataggagttcctcttttggcaatcggatgttactcccaagtgaacccaatcactctcacagctgctttattactattagtagcacactatgctatcatcggaccaggactacaagcgaaagctactcgggaggctcagaaaagagcagctgccggcattatgaaaaatcctactgttgacggaataacggtaattgatctggatcctataccttacgatccaaaattcgagaagcaattaggacaggttatgttgttagtactgtgtgtgacccaggtgctaatgatgcgaactacttgggctctctgtgaggcattgactttagcaactggaccaatatcaacgctttgggaaggcaaccctgggagattctggaatactactattgctgtgtctatggctaatattttcagaggatcatacctcgccggagccggattgctcttttcaatcatgaaaaatacaactaatacaagacgcggaacaggcaacattggtaaaacactcggggagaaatggaagtcacgtctcaacgcgctgggaaaaatcgaatttcagatatacaagaaaagcggcattcaagaagtcgaccgaactttggcaaaagaaggaatcaagaggggagaaaccgatcatcacgcggtctctagaggttcagcaaaattaagatggttcgtagaacgaaatatggtcacaccagaaggaaaagttgtggatctcgggtgtggcagaggtggatggagttactattgtggaggactaaagaacgtacgagaagtaaaaggattaacaaaaggtggccctgggcatgaagaacccatccctatgtcaacatatggatggaatctagtaagactacaatcaggcgtagacgttttctttattcccccggagaaatgcgatactctattatgtgacataggcgaatcaagcccgaatcccacagtggaagctggaaggaccttgagagttttaaatcttgttgaaaattggttaaataataacactcaattctgcataaaagtcttgaacccgtatatgccaagcgtaatagagaaaatggaagccctacagagaaagtatggaggcgccttagtgagaaatccactaagtaggaatagtacccatgaaatgtattgggtatcaaacgcatccggaaacatcgtgagttcggtaaacatgatatcacgtatgttaataaataggtttacaatgcgacacaagaaagccacgtatgagcctgacgtcgatctaggaagtggtacacgcaatataggcatagaatcagaaataccaaatttggacattatcggaaaaagaatagagaaaataaagcaggaacatgaaacatcatggcattatgaccaggatcacccttataaaacttgggcctaccacggatcttacgaaactaaacaaacaggatcagcatcttctatggtcaacggggttgtaaggcttttgaccaaaccctgggacgtattaccaacagttacacaaatggccatgaccgatacaactccattcggacaacaaagggtattcaaagaaaaagtggataccagaacacaggaacccaaggaaggtacaaagaaacttatgaaaataacagcagaatggctttggaaggaactcggcaagaagaaaacaccaagaatgtgcacaagggaagagttcacaagaaaagtgcggagtaatgcagcactgggtgcaatatttacagatgaaaataaatggaagtccgcgagagaagcagtggaagactccagattctgggagctagtggacaaagaaagaaatttacatctagaggggaaatgcgagacatgtgtgtataatatgatgggcaaaagagaaaagaaactaggagagttcggaaaagctaaaggtagtagggcaatctggtacatgtggctaggagctcgattcttggaatttgaagcgctaggctttctcaatgaagatcattggtttagcagggaaaattcactttcaggagtcgagggtgaaggattacataaactgggttatattttacgtgatgtgtccaagaaagaaggcggtgctatgtacgccgacgacactgccggatgggatacacgcataacactagaagatttgaaaaatgaggaaatggtaactaatcatatggaaggcgaacacaagaaactagcggaagcaatatttaaattaacttatcagaataaagtagtgcgtgtgcaacgtcccacacccagaggaacagtaatggatatcatatcaagaagagatcaaagaggatcaggacaagttgggacatacggactaaatacttttacaaacatggaagcgcaattaattagacaaatggaaggtgagggggttttcaagaatattcaacacctaacagctaccgaagaaattgcagtacaaaactggctggcacgagttggaagggaaagattatcaagaatggccatttcaggagacgactgtgtggtcaagccattagatgatcgatttgcgtcagctctaactgctctgaatgatatgggtaaaattagaaaagatatacagcaatgggaaccttcccgcggatggaacgactggacacaagttccgttctgcagtcatcatttccacgagttgattatgaaggatggcagagtattagtcgtaccttgtagaaatcaagatgaactgataggcagagcgcggattagtcaaggagcgggatggagtttgcgcgagaccgcatgtttaggaaaaagttatgcacaaatgtggagcctaatgtacttccacagacgagatcttaggttggccgccaacgcaatttgtagcgcggtaccatctcactgggtacctacctctcgaacaacgtggagcattcatgcaaaacatgaatggatgacgacagaggatatgttaaccgtatggaatagagtatggatacaagaaaacccatggatggaagacaaaacaccagttgaatcatgggaagagataccttacttaggcaagcgggaggaccaatggtgtggcagcttgatcggtttaacttccagagcaacctgggcgaaaaatattcaggcggcaataaatcaagtaagatcattaattggaaatgaagaatatacagattatatgccttccatgaaacggtttcggagagaagaagaagaggcaggagtgttatggtaa

SEQ ID NO: 22982 - RNA, 9873 nt, synthetic construct
  misc_feature 1..9873: note = derived and/or modified CDS sequence (opt6) from DENV-3__AB189125__SS-prME
  source 1..9873: mol_type = other RNA
acatctttatgcttaatgatgatgttacctgcaactctcgcatttcatttgacatcacgggatggtgaaccaagaatgatcgtgggtaaaaatgaaagaggaaaatctttgttattcaaaacagcaagtgggattaacatgtgcacattaattgcaatggatctaggtgaaatgtgcgatgatacagtcacgtataaatgtcctttaataaccgaagtagaaccagaagacatagactgctggtgtaacctgacgtccacttgggtgacatatggcacatgcaatcaagccggtgaacaccgccgggataaaaggtcggtggctttggcaccgcacgttgggatggggcttgatacaagagcacaaacctggatgtcggcggaaggggcttggagacaagtggaaaaagtagaaacgtgggccttcaggcacccgggcttcaccatactagctttgtttttagcgcattatattggaaccagcttaacgcagaaagttgttattttcatcttgctcatgctcgtgacaccttcaatgacgatgcgctgtgtaggggtaggcaacagagactttgtcgaaggcttatccggagccacctgggttgatgtggtattagaacatggagggtgtgtaacaacaatggctaaaaataaaccaacccttgatatcgaattgcagaaaactgaagcaactcaattagcaactctgcgaaaactttgcatagaagggaaaataactaacgtaacgacagactctagatgtccaactcaaggagaagcaatcttaccagaggaacaagatcaaaactacgtttgtaaacatacctacgtggatcgtggttggggaaacgggtgtggactcttcggcaagggaagtctagtaacctgtgcaaaatttcagtgtttagagctaatagaaggtaaagtcgtacaacacgaaaatttgaaatatactgtaataattacagtacacacaggtgatcagcaccaggtaggcaacgagacgcagggagttacagccgaaataaccccacaagcctcaactgtcgaagcaatactaccggagtatggtacactaggattggaatgttcaccaaggacaggcctagactttaacgaaatgattttgctaactatgaaaaacaaagcatggatggtccacaggcagtggtttttcgatttaccactcccttggacttccggcgctactactgaaactccgacatggaataagaaagaacttctagttactttcaaaaatgctcatgcaaagaaacaagaagtagtggtactaggtagccaggaaggtgctatgcacaccgcactcacaggagcaacggagatacaaacaagtggcggcacaagtatctttgccggacatttgaaatgtcgactgaaaatggataaacttgagttgaaaggcatgtcatacgcaatgtgttcgaatgcatttgtgttaaagaaagaagtatcagaaacacaacacggcacgatacttattaaagtcgagtataaaggagaagacgccccatgtaagattccttttagtactgaggacggtcaagggaaagcccacaatggcaggttgatcacagcaaatccagtagtaaccaagaaagaagaacccgtaaacatagaagctgaaccaccgttcggggagagtaatattatcataggtataggggataaagcgcttaaaattaactggtacaaaaagggcagcagtataggtaagatgttcgaggccaccgcgcgtggagcgcgaagaatggccatattaggagatacagcatgggattttggttcggtaggaggggtcttgaactcacttggaaagatggttcatcaaatattcggatcagcttacactgcgctattttcgggcgtgtcatggatcatgaaaatagggataggggtactcctaacatggatagggttaaacagtaaaaacacctcgatgagcttttcgtgtatagtgatagggattataactctttacttaggtgcggtagtacaagctgacatgggatgcgtcataaattggaaaggaaaggagttaaaatgcggatccggaatcttcgtcactaatgaagtccatacctggacagagcagtataagttccaagcagattccccaaagagattagctacagcaatagcaggggcatgggaaaatggagtttgtggtatacgtagtacaacgagaatggaaaacttactctggaaacaaattgcaaacgaacttaactacatattgtgggaaaataacataaagttaacggttgttgtaggggatataattggtattttagaacaggggaaaaggaccttgactccgcagcctatggaactaaaatactcgtggaaaacctggggaaaagcaaagatagtaacagctgaaattcaaaattcatcttttataattgatggcccaaatacgccggaatgtccaaacgcctcgcgagcatggaacgtatgggaggttgaggattatggatttggggtattcacaactaacatttggctaaaattacgagaaatgtatacacaactatgcgaccatcgcctaatgagtgccgcagtaaaagatgagagggcagtacacgcagacatgggatactggatagagagccaaaagaacggatcatggaagctcgaaaaagcatcactcatagaagttaaaacgtgcacctggccaaaaagccacacattatggagtaatggagtattagaaagcgatatgataataccgaaaagtctagcagggcccatctcacaacacaattataggccaggctaccatactcaaaccgcaggaccatggcatttggggaaattggagttagactttaattattgtgaaggcactacagttgttataacagaaaattgtggtacgcgaggtcccagtttaagaactacaacagtcagtggtaaattaatacacgaatggtgctgtaggtcatgtacactaccgccattgagatatatgggtgaagacggatgctggtacggtatggaaatcagacctataaatgaaaaagaggaaaatatggtaaaatccctagtatctgccggttccggaaaagtggataactttacgatgggggtactttgcctagctatattatttgaagaagtcatgagaggcaaattcgggaagaagcacatgatcgcaggcgtcctgttcacatttgtattattattatctggtcagatcacatggcgggatatggcgcgcaccttgataatgatcggaagcaacgcctcagatcgaatgggtatgggagtcacatatctggcattaatagcgaccttcaagattcaaccattcttagctctcgggttcttcctcagaaagttaacatcgagagaaaatcttctattaggggtaggcttagcaatggctacaactctgcagttacccgaggatatagaacaaatggccaacgggattgccttgggattaatggctctaaaactaataacacaatttgaaacataccaattgtggacagccttggttagtttaatgtgtagtaatacaatcttcaccctaacagtggcttggcgaacagcaactctaattttagctggaatctcattactcccagtctgtcagtctagttctatgagaaagactgactggttaccgatgaccgttgctgcaatgggtgtacccccattacctctctttatattttcactaaaagacacactcaaacggaggtcatggcccctaaacgaaggtgttatggccgtaggtttagtgagcattctagcttcctcattgttacgcaacgatgtaccaatggcaggaccacttgtagctggtggactacttattgcatgctatgtaattactggtacttctgccgatttgacagtggaaaaagctgcggatgtgacgtgggaggaggaagctgaacaaaccggggtaagtcacaatcttatgatcacagtagatgatgatggtaccatgagaataaaggacgacgaaactgaaaatatcctgacagtgcttttaaaaacagcgctcttaattgttagcggaatattcccttattcaatacccgcaacgcttttagtatggcatacgtggcaaaaacagacacaacgtagtggagtgctatgggacgttcccagcccaccagaaactcagaaagctgaactagaagaaggagtttatcgcatcaagcagcaaggaatttttggtaagacacaagttggtgtaggagttcaaaaagagggagtgtttcataccatgtggcatgtaactagaggagctgtcctcacatataacggaaagcgacttgaaccaagctgggcatcagtcaagaaagatctcattagttatggcggaggatggcgtctttccgcgcagtggcaaaaaggtgaagaagttcaagtgattgcggtagaacctggcaaaaatcccaaaaatttccaaacaatgccaggaatattccaaaccacaacgggcgaaatcggagccattgccctagacttcaaaccaggaacaagtggaagtcctataattaacagagaaggcaaagtagtcggactgtatggaaatggggttgtcaccaagaacggtggctatgtatcaggaattgcacaaactaatgctgaacccgatggtcccacaccagaattggaagaagaaatgtttaagaaacgtaacctgacgataatggatctccatccagggtctggtaaaaccaggaaatatttaccagccattgtaagagaagctatcaaaaggcgcctgagaactcttattctcgcaccaacgagagttgttgctgccgaaatggaggaggcgttaaaagggctccctataagataccagacaacagcaacgaaaagcgaacacaccggcaaggaaatagtagatttgatgtgccatgcgacattcacaatgcgtctactctcgccggtgcgagtaccgaactataacctgatcataatggatgaagcgcattttacagacccagcgagtatagcggcgcgtggatacataagtactagggtcggaatgggagaagctgccgctatctttatgactgccacacctcccgggacagcagacgcatttcctcaaagtaacgcacctatacaagacgaggagagagatattccagaacgtagctggaactctggtaacgattggataactgatttcgccggtaaaactgtgtggttcgtgccatcaataaaggcagggaacgatatagcaaactgcctaaggaaaaatggcaagaaagtaatccaattgtcacggaaaacatttgatactgaatatcagaagaccaaacttaacgattgggatttcgttgtcacaactgatatctctgagatgggggcgaactttaaagcggatagagtgatagacccacgccgttgcttaaagccagtaatattaaccgatggcccggaacgggtcatattagctggaccaatgcccgtcacagtagcaagtgctgctcagagacgcggaagggttggacgcaatccacaaaaagagaacgatcagtacattttcacaggccaaccacttaacaatgatgaagaccatgcacattggacggaggcaaaaatgcttcttgataatataaatacacccgaaggcatcatacccgcactgtttgaaccagaaagagagaaaagcgcagccattgatggtgaatataggctcaaaggagaatcgagaaaaacatttgttgaactaatgagaagaggcgatttaccagtctggctagcacacaaagtggcgtccgaaggaatcaaatatacagacagaaaatggtgtttcgatggggaaagaaacaaccaaatactagaggaaaatgtagatgtggaaatctggactaaagaaggcgagaagaagaaactgcgtccaagatggctagacgcccgcacttacagtgacccgttagcgctcaaagaatttaaagatttcgcagccggccgtaaatccatagctttagatctggttacggaaataggacgcgtcccttcccatttagcacacagaaccagaaatgcacttgacaatcttgtgatgctacatacatctgaacatgggggtagagcttaccgacatgcagttgaagaactgcctgaaaccatggagactctacttcttttaggcttaatgatcttactaaccggcggagtaatgctattcctgataagtggaaaaggagtaggaaagacatcaataggactgatatgtgtagtggcaagttctggtatgttgtggatggcagatataccattacaatggatagcttcggcgattgtgttggagttctttatgatggttctgttaataccggaacccgaaaagcagcgaactccacaagacaaccaattagcttacgtggtgattgggattctcacactggcagctattgtagcagcaaacgaaatgggattattagagaccacaaaaagggatctgggaatgtcgaaagaacctggggttgtatcacccacgtcatacctagatgtagatctccatcctgcatctgcgtggactctctatgctgtggcaactacagtgattacacccatgctacggcacacaatagaaaattcaacggcaaatgtctcactagcggcgattgcgaaccaagccgtcgttctaatgggactagacaaagggtggccaatatcaaagatggacctaggagtccctttacttgcactcggttgctattcacaggtaaacccattgacattgactgctgcggtattacttctagtaacacactatgctataataggaccggggctacaagcaaaagcaacaagagaagctcagaaaagaacagcagcaggaattatgaaaaatcccacagtcgatggcataatgacaatagatctcgaccctgtaatttacgatagtaaatttgagaaacaattaggacaggtgatgctattagtattatgcgctgtacaactacttctaatgcgtacttcctgggcgttctgcgaagcacttactctagcaactgggccaattactactttgtgggaagggagtcctggtaagttctggaatacaacgatagcggtgagtatggctaatattttcaggggttcgtacttagctggagccgggttagcattctcgataatgaaaagtgtcggtacaggaaagcgaggtactggtagtcaaggcgaaactctaggtgaaaaatggaaaaagaaacttaatcagttaagtagaaaagagttcgatctatataagaaatccggtataacagaagttgacagaacagaggcaaaagaaggtttaaaacgaggcgagatcacacaccatgcggtcagtcgcggatctgcaaaattacagtggttcgtagaaagaaacatggtaatccccgagggaagagtaattgacctcggttgcggacgaggtgggtggtcctactattgtgcgggactaaagaaagtaactgaagtgagaggatatactaaaggagggccaggtcacgaagaaccagttcccatgtccacatatggatggaacatagttaaacttatgagtggcaaagatgtgttctatctaccgcctgagaaatgcgacacattattgtgcgatataggagaatcgagtcccagtccaactgtagaggaatcacggacgattagggtcttgaaaatggtagagccatggcttaaaaacaaccagttttgcattaaagtattgaacccgtatatgcccgctgttatagaacatctagaacgactacaaagaaaacacggaggtatgttagtaagaaaccccctgtctcgaaatagcacacatgaaatgtactggatttcaaatggtacagggaacatagtaagtagtgttaatatggtatcaagactgctactaaacagatttactatgacttaccgaagacccacgatagaaaaagatgtagacttgggcgctggaacaagacatgtaaacgcagagccagaaacccctaacatggacgtaataggagaaagaataagacggataaaagaggagcactcaagcacttggcactacgatgacgagaatccatacaagacgtgggcttaccacggaagttatgaagtaaaagccactggaagtgcctcatcaatgattaacggagtcgtcaaactattaacgaaaccatgggatgttgtacccacggttacgcaaatggctatgacggacactactcctttcgggcaacagcgagtattcaaggaaaaggtagatacgagaacaccaaaaccaatgcctggaacgcgaaaagtaatggagatcaccgcggagtggctatggcgcacactgggtagaaacaagaggccaagactttgcacacgtgaagagttcaccaagaaagtgagaacaaacgctgctatgggtgccgtttttactgaggaaaaccaatgggactccgctcgtgcagcagtcgaagacgaggaattttggaaattggtagatcgcgaaagagaattgcataaacttggaaagtgcggaagttgcgtctacaatatgatgggaaaaagggagaagaaactaggtgagtttggtaaggcaaaaggatcacgagcaatctggtacatgtggttgggtgctaggtatctagagtttgaagccctaggatttttaaatgaagaccattggttttcaagagaaaattcctattccggtgtcgaaggagaaggtctacacaaattaggatacatactcagagatatatcaaaaatacctgggggagcgatgtacgcagacgacacagcgggatgggatactcgaataacagaagatgatctccacaacgaggagaagataacacaacaaatggatccagaacatcgtcaactggcaaatgcgatcttcaaattaacataccaaaataaggtagtcaaagtccaaagacccacacccaagggcacagtcatggacataatatcccgcaaagatcagcgagggtcagggcaagtcggtacatacggactgaacacttttacaaatatggaagcccaactgataaggcaaatggagggcgaaggtgtattatcaaagacggacttggaaaaccctcacttattagagaagaaaatcacccaatggctagaaacaaaaggagttgaacgtcttaagagaatggcaatctctggtgatgactgcgtagtaaaaccaattgacgatagattcgccaacgcccttcttgcacttaacgatatggggaaagtacgaaaagatattccacaatggcaaccaagcaaaggatggcatgactggcagcaagttcctttttgttcacatcactttcatgaattaataatgaaagatggtcgaaagttagtagtaccatgtagaagccaagatgaattgatcgggagagcgcgtatcagtcaaggtgcgggctggtctctaaaggagacagcatgtctcggtaaagcatacgcacaaatgtgggcattaatgtacttccacagaagagatttgagattagcctccaacgcgatatgttcagcggtccctgtacattgggtacctacatctcgaacgacttggagcattcacgcacaccaccaatggatgaccacagaagacatgttaaccgtatggaatcgagtttggatagaggacaatccttggatggaggacaaaacgccggtgactacttgggaggatgttccatatctcgggaaaagggaagatcagtggtgtggcagtttaataggtttaaccagtcgcgcgacctgggcgcagaacattttaacagccatacagcaagtacgttcgttaataggaaatgaggagttccttgattatatgccctctatgaaaaggtttagaaaggaagaagaaagtgaaggtgcaatttggtaa

SEQ ID NO: 22983 - RNA, 9873 nt, synthetic construct
  misc_feature 1..9873: note = derived and/or modified CDS sequence (opt6) from DENV-3__AB189126__SS-prME
  source 1..9873: mol_type = other RNA
actagcctctgtttaatgatgatgttacctgcaactcttgcgtttcatttaacaagtagagatggagaacctagaatgatagtaggtaaaaacgaaagaggaaaatccttactgtttaaaacagcatcaggcataaacatgtgcactttgatagcgatggatctgggagaaatgtgtgatgatacagtgacatataaatgccccctcataacggaagtcgaacccgaagatattgattgctggtgcaatttaacatcaacatgggtaacatacggaacttgcaatcaagccggggaacacagacgagataaaagaagcgttgcattagcaccgcacgttggtatgggattagacacacgtgcgcaaacatggatgtcggcggaaggagcttggcgtcaagtagaaaaagttgaaacttgggcatttcgtcatccgggattcaccatacttgcgctgttcttagcacattatattggtaccagtctaactcaaaaagtagttatatttattcttttgatgctagtaacaccgtccatgacgatgaggtgtgtaggtgttggtaacagagattttgtagaaggattgtctggagcaacctgggttgatgtggtgttggaacacgggggatgcgtaactaccatggccaaaaacaaaccgaccctagatatcgagctacagaaaactgaagccacgcaactagcaacgctccggaaattatgtatcgaaggaaaaattacaaatgtaacgaccgattctcgctgtccaacacaaggtgaagccatactaccggaagaacaagaccaaaactatgtgtgtaaacatacatatgtagataggggctggggaaatggctgcgggttgttcgggaaaggatcgttggtgacgtgtgccaaattccaatgtttagagttaatagaggggaaagtagtacaacacgagaatttgaaatatactgtaatcataacagtacacacaggagatcagcatcaagttgggaacgaaacacaaggcgtgactgcagagataacaccccaggctagcactgtggaggcgatactacctgagtacggcactcttggcctagagtgttcacctagaacaggattagacttcaatgaaatgattttgttaacaatgaaaaataaagcatggatggtacatagacaatggtttttcgacctacccttaccatggacatcaggggccactacggagacaccaacgtggaacaagaaggagctactcgtaacgttcaaaaacgcccacgccaagaaacaagaagtggttgtactaggttctcaagaaggagcaatgcataccgcactaaccggagccactgagattcaaacaagcggaggaaccagtattttcgctggacatctgaaatgcaggttgaaaatggataaactcgaactcaaaggaatgtcatatgcaatgtgctcaaatgcatttgtccttaaaaaggaagtgagcgaaactcaacacggaactatcttaataaaagtcgaatacaagggcgaagacgcaccatgtaaaatcccattctctacagaggacggacagggtaaagcacataatggcaggttaatcacagcaaatcccgtagtaactaaaaaggaggaacccgtaaatatagaagccgaaccaccgtttggtgaaagtaatataattattggcattggagataaagcactaaaaattaattggtataaaaagggctccagtataggcaaaatgtttgaggccactgcccggggtgcgagaaggatggcgatcctaggagacactgcttgggattttggaagcgtaggtggagttctaaattcactagggaagatggtccatcaaatttttggatcggcatataccgctctattttccggggtttcttggataatgaagataggcattggtgtcctattgacttggatcgggttaaatagtaaaaatacatcaatgtcattcagttgcattgtaataggaattataacactttatttaggtgccgtggtacaagcagatatgggatgtgtaatcaactggaagggaaaagaactaaaatgtggatctggaatattcgtcaccaacgaggttcatacgtggacagaacagtataaattccaagcggattctccaaagcgcttagcaacagcaatagccggagcatgggaaaatggggtctgcgggataaggagtacaactcgaatggaaaacttactttggaagcaaattgccaatgaactcaactatatactatgggaaaacaacataaaactaacagtggtggtcggtgacataattggagttttagaacaaggaaaacgtacccttacgccacaacctatggagctgaaatatagctggaaaacgtggggtaaagcaaaggttgtaactgccgaaatacaaaatagctcctttattatcgatggaccaaatactccagaatgtcccaatgcaagtagggcctggaatgtgtgggaagtggaagactacgggttcggagtttttactactaatatatggcttaaactacgtgaaatgtatactcaactatgtgatcacagactaatgagcgctgcagtaaaggatgagagagccgtacacgctgatatgggatactggatagagagtcaaaagaatggatcttggaaattagaaaaggcttcattgatagaagtaaagacatgcacatggcctaagtcacatacattatggtcaaatggagtactcgaatctgatatgattattccaaaatcattggcaggtccaatttcacagcacaattatcgaccaggttatcatactcaaacagcaggtccatggcacctaggaaaattagaactagattttaactattgcgaaggaactactgtggtaataactgaaaactgtggaaccagaggaccctcactccgtacaacgaccgtatcaggtaaacttatccatgaatggtgttgtcgatcatgtacactaccgcctctccgttacatgggagaagacggatgctggtatggaatggaaatacggcctataaatgaaaaagaagagaacatggttaaatctttagtatccgcaggatcgggaaaggtagacaacttcaccatgggcgttttatgccttgcaatattatttgaagaggtaatgagaggtaaatttgggaagaaacatatgatagcaggaatcctatttatatttgtactattattgagtggacaaatcacgtggagagatatggcaagaaccttaataatgataggatcaaacgctagcgacagaatgggaatgggcgttacatatcttgcactaatcgctacgtttaagattcaaccttttctagctctcggtttcttcttgaggaaattaacatcacgagaaaatttattactaggcgttgggttagctatggctacgacattacaactcccggaagatatcgaacagatggcgaacggaattgcgttgggacttatggcgcttaaattgataacccagtttgaaacataccaattatggactgcacttgtgagcctcacatgcagcaacacaatttttacccttacagtggcatggcgaacggcgaccttgattcttgcgggcataagtttgctccctgtatgccaaagttcatcaatgaggaagactgattggctaccaatgacagttgctgcaatgggcgtacctccactcccgttatttatattctctctaaaggacacattaaaaagacgaagttggccattgaacgaaggagtaatggccgtagggcttgtctccatattagcatcctcactgttaagaaatgatgtacccatggcaggaccattagtggcaggcggattgctaatagcatgttacgtaatcacaggtacttcagcagatttgaccgtagaaaaggccgcggacgtcacctgggaggaagaagcagagcaaacaggtgtttcccacaacctcatgataaccgtagatgacgatggaactatgcgcataaaagatgacgaaactgagaacattcttacagtactactaaaaacagccttgctaatagtcagtggaatatttccatacagtataccagctactctattggtatggcacacttggcaaaaacagacgcaaagatctggagtactgtgggatgtaccaagtccaccagaaactcaaaaagctgagctggaagaaggagtataccggatcaagcaacaaggaatattcggcaaaactcaagttggagttggagtacaaaaagaaggtgtatttcacactatgtggcacgtaactcgaggtgccgtacttacatacaatggcaagcgactagagcccaactgggcctcggtcaagaaagatctcatctcatatggaggtggctggcgacttagcgcgcagtggcaaaaaggagaggaagtacaggtcatagcagtagagcctgggaagaatcccaaaaattttcaaacgatgcccggtattttccaaacaacgacaggagagataggagcgattgccctagacttcaaacctggaacatctggaagtccaatcataaacagagagggaaaagtggtcggtctatatggtaatggcgtagtaactaaaaacggaggatacgtatctggaatagctcaaactaatgcagagccagacggacccacgcccgaacttgaggaagagatgttcaaaaagaggaacctcacaatcatggacttgcatccaggttctgggaagactcgtaaatatttaccagcgatagtgcgtgaagccattaaaagaagattgcgcactttaatattagctccaacacgtgtagtagctgccgaaatggaagaagcactaaaagggttgcctattagatatcaaactacagctacaaagagtgaacacactgggaaagaaatagtcgatttaatgtgtcatgcaacattcacaatgcgcctattgtcacctgttagagtcccaaattataatttaatcataatggacgaagcccactttacggatccagcgagcatagctgcaagaggatatatctcgactcgtgtaggtatgggtgaagctgctgctatattcatgactgcaactcctcctggtacagctgacgcttttccacaatcaaatgcaccaatacaagacgaggagcgggatattccagagaggagctggaatagcggaaacgactggataacagattttgcggggaaaactgtttggtttgttccatccataaaagctggaaacgatatagcaaactgcctcaggaaaaacggaaagaaagtgatacagttaagtaggaaaacattcgatacagaatatcagaaaacgaaactaaatgactgggatttcgttgtaacaacagacatttctgaaatgggagccaactttaaagcagatcgggtaattgatcctagaagatgcctaaagcctgttattctcactgatggccccgaaagagttatactggcaggtcctatgccagtgaccgttgcgtcagcagcacaacgacggggccgtgttgggcgtaatccacagaaagagaacgaccaatacatatttacgggacaacctcttaataacgatgaggatcatgcccattggacagaagcaaaaatgcttttagataatataaataccccagaggggataattccagcactatttgagccagaacgtgaaaaatcagctgccattgatggagaatacagattaaaaggggaaagtaggaaaacctttgtcgaacttatgcggcgcggtgacttaccagtatggctcgcccataaagttgcgagtgaagggataaaatacactgatcggaaatggtgctttgacggggaacgtaacaatcaaattctcgaagaaaatatggatgttgagatttggacgaaagaaggagaaaagaagaaacttcgaccaagatggttagacgctcgtacttatagtgacccgcttgccttgaaagagtttaaagactttgctgctggtagaaaatctatagcactggacctggtcacagagattggaagagtgcccagccacctcgctcataggaccagaaatgctttagacaatttagtaatgcttcatacaagtgaacatggtggccgcgcttatcgccatgctgttgaagaactacctgaaacaatggagactcttttattgttgggtctaatgatattattgacaggaggagccatgttattcttgattagcggaaaaggtgtcggtaaaactagcattggtttgatatgtgtcgtagctagctccggaatgctatggatggcagacatacccttacaatggatcgcaagtgctatcgtccttgagttctttatgatggtattactaatacctgaacccgaaaaacaaagaacacctcaagataatcagttagcatatgttgtaataggcatattaactttagcagcaattgtcgcagccaatgagatggggctattagaaactacaaaaagagatttgggtatgagcaaagagcccggggtggtaccacccacgagttatttggatgttgatcttcacccagccagcgcatggacattatacgctgtcgcaacgacagtgattaccccaatgctccggcatactatcgaaaattcaactgcaaatgtaagccttgcggccatagcaaaccaagctgtagtattgatgggacttgataaaggatggcctataagcaaaatggacctaggggtaccacttttggcgcttggctgctattcacaagttaaccctttaacattaactgcggcagtcctgctgttggtaacacattacgccataatcggacccggactccaagcaaaagcgacaagagaggcacagaaaagaaccgctgcagggataatgaaaaatccaacagttgacgggattatgacaatagatttggaccccgtaatttatgatagtaagttcgagaaacagttgggccaagtaatgctattagttctctgcgcagtacaactcttgctcatgcgaacatcttgggcattctgcgaggcactgacccttgcgactggtccgatcactactctgtgggagggctcgcctggtaagttttggaataccaccatagccgtctcaatggcgaatattttccggggatcatatcttgcaggagccggtctagcattttcaatcatgaaaagtgttggtactggaaagagagggactggcagccaaggtgagacactcggcgaaaagtggaagaagaaacttaatcaactatctagaaaagaatttgatctttataagaaatcagggatcacggaagttgatagaactgaagccaaagaaggactaaaacgaggcgagatcacccatcacgcggtttcacgaggttcagcaaaactacagtggtttgttgaacgcaacatggtaatccctgaaggacgcgtcattgacctaggatgcggtcgcggtgggtggagttactattgcgcagggctaaagaaagttacagaggtccgtggatataccaaagggggacctggacatgaagaaccggtacctatgtcgacatacggatggaatatagttaaactaatgagtggaaaagacgtattttatctaccaccggaaaaatgtgatactctattgtgcgatattggcgaatcaagtccctcgccgaccgtagaagaatcgagaacgataagagttctaaaaatggtagaaccatggttgaagaacaatcagttttgcatcaaggttttgaatccttatatgcctaccgtaattgagcacctagaacgtctacaaagaaaacacggtggcatgctagtcaggaacccgttatcaagaaactccacacatgagatgtactggatcagcaatgggactggaaatatagtaagcagtgtaaatatggtttctcggcttttgttaaaccgatttaccatgacacacaggagaccaacaatagaaaaagatgtggacctcggtgcgggaacccgtcatgtcaacgctgagccagaaactcccaacatggatgttataggagagagaatccgccgtataaaagaagaacacagctccacatggcactatgatgatgaaaacccatacaaaacatgggcataccatggaagttatgaagtgaaggcgacaggttcagcttcttcaatgataaacggagtggtaaaactcttaactaaaccatgggatgttgtcccaacagtaactcaaatggcaatgacggatactacaccgtttggacagcagagagtattcaaagaaaaagtagataccaggactcctaaaccgatgccgggcacacggaaagtaatggaaataacagctgagtggctctggaggaccttaggaaggaacaaacgtccacgattatgcacacgagaagaatttaccaagaaggtaagaacaaatgcagcaatgggagcagtatttactgaagaaaatcaatgggattcagcgagggccgcagttgaagatgaagaattttggaaattggtcgatagagaacgagagttacataaactaggaaaatgtggaagctgcgtctataacatgatgggaaaaagagaaaagaaattgggagaatttgggaaagctaagggcagtagggcgatctggtatatgtggttgggtgcaagatatctagaatttgaagccttgggttttcttaacgaagatcattggttttcaagagaaaactcctattcaggagtagaaggagaaggattacataaattaggatacatactaagagatatttctaaaattccagggggagcaatgtatgcggatgatacagcgggatgggataccagaattactgaagatgatttacacaacgaggagaaaataacacaacaaatggacccggaacataggcagttggcaaatgcaatattcaaactaacataccaaaataaagttgtcaaagtacaaaggccaactcctaaaggaacagtgatggatataatcagtcgtaaagaccagcgtggaagtggccaagtgggcacctacgggctaaatactttcacaaatatggaagcccaattaatacgacaaatggaaggcgaaggagtgctatcaaaaacagacctagaaaacccgcatctgctggagaagaaaattactcagtggctggaaacgaagggtgtggaacgattaaagagaatggcaataagcggagatgattgcgtagtgaagccaattgacgaccggttcgcaaatgctctactagcgctgaatgatatgggaaaggtaagaaaagacattcctcaatggcagccgagtaaaggttggcatgattggcagcaagttccattttgcagtcatcactttcacgaacttataatgaaggatggtcgtaagttagtagtcccatgtagaccacaagatgaacttatcggacgagcgcgaatatctcaaggcgcagggtggtcactaaaagagaccgcatgcctgggaaaagcatatgcgcaaatgtgggccctcatgtacttccatcgaagggacttaagacttgcatcaaacgctatatgctcagcggtcccagttcactgggtaccaacttctcgtacaacatggtcaatacatgcccatcatcaatggatgacaacggaagacatgctaaccgtttggaaccgtgtctggattgaagataatccatggatggaggataaaactccagttacaacatgggaggatgttccatatctcggaaagcgggaggatcaatggtgtgggagcttgatcgggttaacttctagagcaacctgggctcaaaatatcctaactgcaatacaacaggttcgttcactgataggcaatgaagagtttttagattacatgccatccatgaaacgtttccgaaaagaagaagaattggaaggagcaatctggtga

SEQ ID NO: 22984 - RNA, 9873 nt, synthetic construct
  misc_feature 1..9873: note = derived and/or modified CDS sequence (opt6) from DENV-3__AB189127__SS-prME
  source 1..9873: mol_type = other RNA
acatccttatgcttaatgatgatgctaccagcaacactagcgtttcatctaacgtcaagagacggagaaccccggatgattgtagggaaaaatgaacgcggaaaaagtttactattcaaaacagcatcaggcattaatatgtgtacgctaattgcaatggatttgggagaaatgtgtgacgatacagtaacatataaatgccctttgataaccgaagtcgaaccagaagacatcgattgctggtgcaatttgacaagcacctgggtaacatatgggacctgtaatcaagcaggagaacatcgtagagataaacgaagtgtagcattagctcctcatgtagggatgggactagatactagagctcaaacatggatgtccgccgaaggagcctggaggcaagttgaaaaagtagaaacatgggcttttaggcatccaggtttcactatcttagcgctattcttggcacattatataggaacgtctctaacccaaaaagtggtaatatttattcttttaatgctcgttactccatcaatgactatgcgatgtgtcggagttggtaatcgagactttgtagagggtctgtcgggtgcaacatgggtagacgtagttttagaacatggcggctgtgtcactacaatggcgaaaaataaaccgaccttggatatagaattacagaaaactgaggccacccaattagcaacactgaggaaactttgcatcgaaggtaaaataacgaatgtcacgacagacagtagatgcccgacacaaggggaggccatactaccggaagaacaagaccaaaattacgtatgtaaacacacatacgtggatcgaggctggggaaacggatgcggcttatttggaaaaggaagtctagtgacttgcgcgaaatttcaatgtctagagcttattgaaggtaaagttgttcaacacgagaacctaaaatataccgtaataataacggtgcatacgggcgaccagcatcaagtaggaaacgagacacaaggtgtcactgctgagattacccctcaagcgtcgaccgttgaagcaatcctaccagaatacggaaccttaggtctcgaatgtagtccgcgtacaggtcttgattttaatgaaatgatacttctgactatgaaaaataaagcgtggatggttcacaggcagtggttctttgatttaccacttccttggacaagtggcgctacaacagaaacccctacttggaataagaaagaactattggtgacgttcaaaaatgcacacgccaagaaacaagaagtcgtcgtcttaggaagtcaagaaggcgcaatgcacacagcacttacaggagcaacggaaatacaaacatcaggagggaccagtatatttgcaggacatctaaaatgtcggcttaaaatggataaattggaactaaaaggaatgagttacgcgatgtgctcaaatgcatttgtactaaagaaagaagtatcggaaacacaacacgggaccattttaataaaagttgaatataaaggagaagatgctccttgcaaaatcccattttcaacagaagatggtcaaggaaaagcacataatgggcgtttaattacagcaaatccagttgtgactaaaaaggaggaaccagtaaatatagaagcagaaccacctttcggtgaaagtaacataataattggaattggcgacaaggccctaaagataaattggtataagaaaggatcctcgataggaaagatgtttgaggcgacagctcgaggtgctagacgaatggccattcttggcgatacagcttgggattttggaagcgtcggaggagttttaaattcattaggtaagatggtgcatcaaatattcgggtcagcatatacggcgctattttccggagtctcttggatcatgaaaatcggaattggagtcttacttacttggataggattaaacagcaaaaatacaagtatgtctttttcatgtatagtaataggcataataaccttataccttggcgcagtagtccaagcagacatggggtgcgtaataaattggaaagggaaagaattaaaatgcggtagtggaatatttgtcactaatgaagttcatacgtggactgaacaatacaaattccaagcagactcgcctaaacgattagcaactgcgattgccggtgcatgggaaaatggagtctgcggaattagaagtactactagaatggagaacctgctctggaaacaaatagctaatgaacttaactatattctatgggagaacaatattaaactcacagttgtcgtaggcgatattattggggtcctagagcaaggaaaaagaactctaacgccacaacctatggaactaaaatactcctggaagacttggggaaaggcaaaggttgtaacagcagagatacaaaattcatcgtttatcatagacgggccaaataccccggaatgtccaaacgcatcacgagcatggaacgtatgggaagtagaagattacggattcggagtatttactacaaacatatggttaaaattacgggagatgtacactcaactttgtgaccatcgactcatgtccgctgctgtaaaagacgagcgcgccatacatgcggatatgggctattggatcgaaagtcagaaaaacggtagttggaaattagaaaaagcctcacttatcgaggtaaagacttgtacttggccaaagtcacacacactgtggagtaacggagttctggagtcagacatgattattccaaaatcactagcaggccctattagccaacacaattacagaccgggatatcatacgcaaacggcaggaccttggcatctaggcaaactggaacttgacttcaattattgcgagggtaccacagtcgtaataacagaaaactgcggcacaagaggaccttccttacgtacgacaactgtatctggaaaactgatacatgaatggtgctgtaggtcgtgtacactaccaccattgagatatatgggagaggacggttgttggtacggtatggaaattaggcctattaacgaaaaagaggaaaatatggtaaagtctttagttagcgcaggtagtggcaaagtagacaatttcaccatgggtgtcttatgtctcgctatactttttgaggaggtaatgcgtggcaaattcgggaagaaacatatgattgccggaattttgtttatgtttgtccttttactatcaggacaaattacttggcgagatatggctcgtacacttataatgataggttcaaatgcgagtgatagaatgggtatgggagtaacgtaccttgcgcttatagcaacatttaaaatccaaccattcctagcactgggatttttcctaaggaaactcaccagtcgagagaaccttctcctaggggtaggtctcgctatggcaacaaccttacaactgccagaagacatcgaacaaatggctaatggtattgcgctcggacttatggcgttaaaacttatcacccagtttgaaacgtatcaactctggacggccctagtatccctaacgtgctccaatacaatcttcaccttaacagtggcatggagaactgcgactttgatattagcaggaataagtctattaccggtgtgtcaatcatcatcaatgcgaaagaccgactggttaccaatgacagtagccgcaatgggggtaccgccgcttcccttgttcatcttttccctgaaagacactttaaaaagaagatcgtggcccctgaatgaaggagttatggccgttggcttagtaagcattttagcatcaagtttattgagaaatgatgtaccaatggcaggacccctagtagctggtgggctactcatagcatgttatgttatcacaggcacttcggctgatcttacagtagaaaaagctgctgatgtaacttgggaggaagaagcagagcagaccggtgtgtcacataacctcatgatcaccgtagacgacgacggaactatgagaataaaggatgatgagaccgaaaacattttaactgtcttgctaaaaacggcgctcctcattgtctcagggatatttccctattcgatacctgctaccctcctagtatggcacacctggcaaaaacaaactcaaaggagtggggtactctgggacgtaccttcaccaccagaaacgcaaaaagctgagttagaagaaggtgtgtatagaattaaacagcaaggtatatttggaaaaacgcaagttggagtaggagtccaaaaagagggagtatttcataccatgtggcatgttacacgaggggctgtcttgacctataacggaaagaggctggaaccttcttgggctagcgtcaagaaggacctaataagctacggtgggggatggcgcctatccgcgcaatggcaaaagggagaagaagtccaggtaattgcagtagaaccgggaaagaatccaaagaattttcaaacgatgcctggaatcttccaaaccaccacgggagaaattggtgccatcgcattggactttaaacctggaacgagtgggtcgcccataattaaccgggagggtaaagtagtgggattatatggtaatggtgtagtaactaagaacggaggttatgtctcaggtatagcccagacaaatgctgaaccggatggcccaacacctgagctggaagaagaaatgtttaagaaacgaaacttaacgatcatggacttgcatccgggatcaggtaaaactagaaaatatttgcccgccatagtaagggaagcaataaaaagacgtttacggacgctaattttggcgccaaccagggtggttgcagctgaaatggaagaagccttaaaaggtctaccaatccggtatcaaactacagctacaaaatcggaacatactggtaaagaaattgttgacctaatgtgtcatgcaacgtttaccatgagactactctcgcccgtacgtgttccgaattacaacctcattataatggacgaagcacattttacagacccggcatctatagcagcacgaggctatataagcacgcgagtcggcatgggagaggccgcagcaattttcatgaccgcaactccaccaggtactgcggatgcgttccctcagagtaacgctcctatacaagacgaggagagagatataccggaaaggtcttggaatagcggaaatgactggatcactgacttcgcagggaagacagtgtggtttgttccatcgatcaaagctggaaacgacatcgctaattgccttagaaagaacggcaagaaagtgatacaattaagccgtaagacatttgatactgaatatcagaagaccaaattaaatgactgggactttgtagtaacaaccgatatctctgagatgggtgctaattttaaagcagatagagtcattgatccaaggcggtgtcttaaacccgtcattctaacagacggccccgaacgagtaatactggctggaccaatgcctgtaacggtagcttcggcagcacaacgtaggggacgagttggacgtaatcctcaaaaagaaaatgatcaatatatcttcactggtcagcccttaaataatgacgaggatcatgcccactggacagaagccaaaatgctactggataacataaacacaccggaaggcattatccctgctctatttgaacctgaaagagaaaaatcggctgctattgacggggagtatcgcttaaaaggagaaagtagaaagacgttcgtagaactaatgcgaagaggagatctgccggtctggttagcacacaaggtagcgagtgaaggaattaaatacactgacagaaaatggtgttttgatggggaacgaaataatcagatactagaagagaatatggatgtagaaatatggaccaaagaaggagagaagaagaaattaagaccaagatggctcgatgcgcgaacttattctgatccgttagcattaaaagaatttaaagactttgcagcaggaagaaaatcgatagccctggatcttgttacggaaatcgggagagtcccttcacatctcgcgcatcgcaccaggaacgcactagacaatctagttatgttgcatacttccgaacacggaggccgagcatatagacatgctgtcgaagaactcccagaaacaatggagacattactcttactaggattgatgatattgcttacaggaggcgcgatgttattccttatttctgggaagggagtcggtaagacaagtataggtctcatatgcgttgtagcatcatcgggtatgctctggatggcggatatccctctacaatggatagcatctgctatcgtccttgagttctttatgatggtccttctgataccagaacccgagaaacaaagaacgccgcaagacaaccagttggcgtatgtagtgataggcattctcaccctggcggctattgtagcggcaaacgaaatgggtttactagagacaactaaaagagatttgggaatgtcaaaggagcctggcgtggttccaccgacatcttacttagacgtagacttacatccggcatcagcttggactctgtatgcggtcgctactacagttataactccgatgcttaggcatacaatagaaaatagcacggctaatgtctcattggctgccatagcgaatcaagcagtagtcctaatggggcttgataaaggttggcccatcagcaaaatggatctaggagtacccctattggctttggggtgttatagtcaagtgaaccctctgacactaactgcagcagttttactactggtaacacattatgcaattataggtcctggactacaggctaaagctaccagggaagctcagaagagaacagcagctggtataatgaaaaacccgacggttgatggtattatgaccatagatttagatccggtaatatatgatagtaaattcgaaaagcagctaggtcaggtaatgctcttagtactgtgtgccgtccagctactattaatgagaaccagttgggctttttgcgaagcattaactctggctacaggacctatcacaacattatgggaaggttcaccgggcaaattttggaatactacgattgcagtcagtatggctaatatattccgaggctcttatctagcgggagcaggactagcgttctccataatgaaatcagttggaactggaaaacgtggcacagggtcccaaggtgagactttaggggaaaaatggaagaagaaactcaaccaactgagtcgtaaggagttcgacttgtataagaaatccggaatcacagaagtggacagaacagaggctaaagagggacttaagcgaggtgagattacacaccatgctgtgagtagaggaagcgctaaattacagtggttcgtggaaagaaatatggtgataccagaagggcgcgttattgatttaggttgcggacggggagggtggagttattactgtgccggtttgaagaaagtaacggaagttaggggatatacaaaaggaggtccgggacatgaagaacccgtaccaatgtcaacgtacggctggaatatagtgaaacttatgtctggcaaagatgtattttacttaccaccagaaaaatgcgacactttattgtgcgatatcggtgaatcttctccttcaccaaccgttgaggagagtagaaccattcgagtactcaaaatggtggaaccctggcttaaaaacaatcagttttgtataaaagttctaaacccatacatgccaactgtaatagaacacctagaaaggctacagagaaaacatggcggaatgttagttagaaaccctttgtcgagaaacagcacgcacgaaatgtattggataagcaacggcactggaaatatcgtgagtagtgtcaacatggtgagtagactcttactaaatagattcacaatgactcataggcgtcctacaatagaaaaagatgtggatttaggagcgggaacaagacatgttaatgcagaaccagagacgccaaacatggacgtaatcggagagagaataaggcgaataaaagaagaacactcatctacctggcattacgacgatgaaaacccttataagacctgggcgtatcatggctcatacgaagtaaaagctacaggcagtgcatctagcatgataaacggagttgttaaactactaactaaaccttgggatgtagttccaacagttactcaaatggcaatgaccgatactaccccattcggacaacaacgggtattcaaagaaaaggtggacactagaacaccaaagcccatgccaggaacgagaaaagttatggaaataacagctgaatggttatggcggacattgggccgtaataaaaggccgaggctatgcacacgagaagagttcaccaagaaagttagaacgaacgcagctatgggcgctgtgtttacagaagaaaatcaatgggatagcgcacgtgctgctgtagaagatgaagaattttggaagttagtcgatagagagcgagaactacacaaactaggaaagtgtgggtcgtgtgtttataacatgatgggtaagagagaaaagaaattaggcgagttcggcaaagcaaagggtagcagagctatatggtatatgtggttaggtgctcgatatctagaatttgaagctctcgggttcttaaatgaggatcactggtttagtagagaaaattcgtattctggtgttgaaggggaagggttacacaaacttggttatattctaagagatatatcgaaaataccaggtggtgcaatgtacgcagatgatacagccggatgggatacgcgcataactgaggatgatttacacaacgaggagaaaatcactcaacagatggatcctgaacatcgccagctcgccaatgccatatttaaattgacatatcaaaataaagtcgtaaaagtacagcgacccacacctaaaggaaccgtaatggacatcatttcaaggaaagaccaaagagggagtggacaggtgggcacatacggtctaaatacgtttacaaatatggaagcacaactcattcgtcagatggaaggagagggcgtcttgagtaagacagacctggaaaatccccatttactagagaagaaaatcacacagtggctagagactaaaggagtcgaaaggctaaaaaggatggctatatctggtgacgattgtgttgttaaacctattgatgatcgtttcgctaatgctctcctagcattgaatgacatgggtaaagtgaggaaagacatccctcagtggcaaccaagtaaaggttggcatgattggcaacaagttcccttctgttcacaccatttccacgagcttatcatgaaagatggacgaaaattggtggtgccttgtagaccccaagatgagctcattggacgagctcgtatatcacaaggtgcggggtggagcttgaaggaaactgcttgtttaggaaaggcctacgcgcaaatgtgggcgttaatgtattttcatcgtagggatctaagattggcctcaaatgcaatatgtagcgctgtacccgtgcattgggtaccaacttcgagaactacatggtcaatccatgctcatcaccaatggatgacaactgaagatatgttgaccgtttggaatagggtttggatagaagataacccctggatggaagacaagaccccagttacaacttgggaagatgtaccatacttgggaaaacgtgaagaccaatggtgcggttctctaatcggtctaactagcagagcaacatgggcccagaacattttgactgcaatacaacaagtacgatcgctaatcggaaacgaggaatttcttgattatatgcccagtatgaaaaggttcagaaaagaagaagaattagaaggcgcgatttggtga

SEQ ID NO: 22985 - RNA, 9873 nt, synthetic construct
  misc_feature 1..9873: note = derived and/or modified CDS sequence (opt6) from DENV-3__AB189128__SS-prME
  source 1..9873: mol_type = other RNA
actagcttatgtttaatgatgatcctaccggcgacattggcattccatctaacaagcagagatggagaacctagaatgatagtcggcaaaaatgaaagaggtaaatctttattattcaaaacagcgagtgggattaatatgtgcacattaatagctatggacttaggggaaatgtgcgacgataccgtcacttataaatgtccactaatcaccgaagtcgaaccagaagacatcgactgttggtgtaatctaacaagtacgtgggttacatacggaacgtgtaatcaagcaggagagcaccgtagggacaaaaggtcagttgcattagcaccacacgtaggaatgggattagatacccgcacacaaacatggatgagtgcagaaggagcgtggagacaagttgagaaagtagaaacgtgggcattcagacatccgggatttaccgtcctagcattatttttagcacatttcatcgggacatcattaacacaaaaagtagtaatatttatcctcctgatgttagtgacaccctcaatgacaatgcgttgtgtcggggtaggaaatagagactttgtagaaggactttcaggagcaacatgggttgacgttgtactggaacacggtgggtgcgtaacaactatggctaaaaacaaaccgacattagatattgaattgcagaaaactgaggcaacgcaacttgcaacgctaagaaaattatgtatcgaaggcaaaataactaacgtcacaactgattcaagatgtcctacgcaaggagaagcgattttaccggaggaacaagatcaaaactatgtatgtaaacatacgtatgtggacaggggttggggcaatggatgtgggctgttcggaaaaggtagcttagtaacatgtgcgaaatttcaatgtcttgaaagcattgaggggaaagtggtccaacatgagaacctaaaatatacggttataatcaccgttcacacgggagatcagcatcaagtcggtaatgaaacacaaggggtgactgcagaaattacgccgcaagcaagtactgtggaagcaattttaccagagtatggtacgttaggtctagaatgctcgccccgaactggacttgattttaacgagatgatcctattaacaatgaaaaataaagcctggatggtgcatcgccaatggttctttgacttaccactgccgtggacatccggtgcaacaacggagacgccgacctggaacaagaaagaactgttagtcacttttaaaaatgcccacgccaagaaacaagaagtagtagtcttaggatcccaagagggcgcaatgcataccgctttaaccggtgcaacggaaatacaaacgtcaggaggtactagcattttcgcaggccatttaaaatgtagattaaaaatggacaaactagagttaaaaggcatgtcatatgctatgtgtttgaatgcatttgtccttaagaaagaggtttctgagactcaacatggaactatactaatcaaagtagagtacaaaggtgaagatgcaccgtgtaaaataccattctcaactgaagatggacaaggtaaagctcataacggacgacttataactgctaatccagttgtaactaagaaagaagaaccggtaaatatagaagcagaaccgccatttggcgaaagtaacatagtgatcggaattggtgataaagcattaaaaattaattggtacaagaaaggctcgagtatcggaaaaatgtttgaggcaacggctcgaggagcacgtagaatggcgattttgggagacacagcatgggattttggatctgttggaggggtcctaaatagtcttggaaaaatggttcatcaaatttttgggtcagcctatactgctctctttagtggcgtatcttggataatgaaaatcggtatcggcgttttattgacatggataggattaaatagtaaaaatacaagtatgagctttagctgtatagtaattggcatcataacactctaccttggagccgtagtacaagcagacacagggtgtgtaataaactggaagggtaaagaacttaagtgtggctcaggaatcttcgtgactaatgaagtccacacttggactgaacaatacaaattccaagcagactcgccgaaaagactcgctaccgccattgcaggagcctgggagaatggagtttgcggaatacgaagtacgaccagaatggaaaatttgttatggaaacaaatcgcaaacgaacttaattatatcctctgggaaaataatattaaattaacagttgtagtaggggacataattggcgttttagaacaaggaaaaagaacccttacacctcaaccaacagaattgaagtattcctggaaaacatggggcaaggcgaagattgtaaccgcggagacacaaaattcatccttcattatagatggcccaaatactccagaatgccccagcgcgagtagggcatggaatgtatgggaagtagaagaatacggatttggagtattcactacaaacatttggctaaaactccgagaaatgtatacacaattatgcgaccatcgattaatgagtgccgcagtaaaggatgaaagagctgtacatgccgatatgggatattggatagaatcacagaaaaatggcagttggaaattggaaaaagcgagcctaatagaggttaaaacatgtacctggccaaaatcacatactttatggagcaatggagttctagagtctgatatgataatacctaaatccttggctggccctatatcgcagcataattaccgtccaggctatcatacgcagacagcaggaccgtggcacctcggaaagctcgaattagattttaactattgcgaaggcacaacagtagtcataacagaaaactgtggaactcgtgggcctagcctaagaacgacgacagtttctggaaaattgatacatgaatggtgttgcagatcgtgcaccctgccacccttgcgctatatgggagaagatggatgctggtacgggatggaaataagacccataaatgagaaagaagaaaatatggtgaaatcgctggttagcgcggggagtggcaaagtcgataatttcacgatgggagtcctatgcctagcgatattatttgaagaagtaatgagagggaaatttggcaagaaacatatgatagcgggagtcttgttcacgtttgttttgttgttatctggtcaaatcacctggcgagatatggccagaacacttataatgattggatcaaatgctagcgatcgtatgggcatgggtgtgacttacctagcgttaatcgctaccttcaaaatacagccgttcctagcgttgggcttctttctacgaaaattgacatcacgagaaaatttactattgggggtaggcttagcaatggctacgacgctacaactgccagaagatatcgaacaaatggcaaatggaatagctctagggctgatggcgttaaaattgattactcaattcgaaacatatcaactctggacggctctagtaagccttatgtgcagcaatactatttttacactaacagtggcatggagaacagctactttgatactggctggaatatctctgcttccagtctgccaaagcagtagcatgcgaaaaaccgactggctacctatgacggtggcagcaatgggagtcccgcccctgccactttttatatttagcctaaaggataccttaaaaaggagatcctggcctctaaatgaaggtgtgatggccgtgggtcttgtatccattcttgcaagctcattgcttagaaatgatgtacccatggctggtccattggtcgctggaggcttacttatcgcgtgctatgtcatcactgggacgtcggctgatctgactgtcgagaaagctgcaaatgtcacatgggaagaggaagccgaacagacgggggtaagccacaacttaatgattaccgttgatgacgacggaacaatgcgaatcaaagacgatgaaacagaaaacatattaaccgttttacttaagacagcactattaatagtaagtggtatcttcccttattctatacccgccactctcttagtgtggcacacatggcaaaagcaaacacaaagatcaggcgtcctttgggacgtacctagtccaccggaaacacaaaaagctgagttagaagatggagtatacaggataaagcaacagggtatcttcggaaaaactcaagtaggagttggggtacagaaagaaggagtgttccatacgatgtggcacgtaacaagaggcgcggtattaacacacaacggaaaaagattagaacccaattgggcgtcagtaaagaaagatttaatatcttatggaggtgggtggaggctcagtgctcagtggcaaaaaggagaagaagttcaagttattgcggttgaaccaggaaagaatccgaaaaatttccaaacaatgcctgggatcttccaaacaacgactggagaaattggggctattgccttggacttcaaaccaggtacatccggcagccccataataaatcgagaaggcaaggtagtgggactttatggtaatggagttgtaaccaagaatggtggttatgtatcaggaatcgcgcaaactaatgcggaaccagatggccccactcccgagctcgaagaggaaatgtttaagaaaagaaatctcacaataatggatttgcacccaggatcaggaaaaacgagaaagtatttaccagctattgtgagggaagctataaaaagacgattgcgtacactaattctggctccaacaagagtcgttgctgcagaaatggaagaagcgctaaaaggactaccaatacgctatcagactactgctacgaaatcggaacataccggcaaagagatcgttgatctaatgtgtcacgctacgtttactatgagactattgtccccagtacgtgtaccgaactataatctaataataatggatgaagcgcactttacggacccggcttccattgctgcacggggatatatatcaactcgcgtcggtatgggagaagcagcggcgatctttatgacggcaactccgccaggaacagcagatgcattccctcaatcaaatgccccaatacaagacgaagaacgtgatatacctgagcgaagctggaatagcgggaatgaatggattacggactttgcgggaaaaaccgtttggtttgttccttcaatcaaggcgggaaatgatatagcaaattgcctccgtaagaatggcaagaaagtcattcaactttctagaaaaaccttcgacaccgaataccagaaaacaaaacttaacgactgggattttgttgtgacaaccgacatatctgaaatgggcgccaattttaaggcagaccgggtaatagacccccgtcggtgcttaaagccggtgatacttaccgacggacccgagagagtcatactagccggtccaatgccggtgactgtcgcatccgcggcccagcggagagggcgcgtcgggagaaatcctcaaaaggaaaatgatcaatatatatttacgggccaacctctaaacaatgacgaggatcacgcccattggacggaagccaaaatgctattagataacatcaacacgccagaaggaatcattcccgcacttttcgagccagaaagagaaaagtcagcagcaatagatggtgaatatcggttaaagggagaatctcgaaaaacattcgtagagcttatgcgacgaggggatctaccagtctggctagcacataaagtggccagcgagggcataaaatatacagacaggaaatggtgttttgatggtgagagaaataatcaaatcttagaagaaaacatggatgtcgagatttggacaaaagaaggtgaaaagaagaaattaaggcctcgctggcttgacgctagaacctactcagacccacttgctttgaaggagttcaaagattttgctgcgggaaggaaatcgattgccctagacctagtaacagaaatcggccgggtaccatcacatctagcccaccgaacccggaatgctctcgacaacttggtaatgcttcatacatcagagcacggaggaagggcttaccgacacgcagtagaagagttgccagaaaccatggagacattactactgttaggactgatgattctcttaactggtggtgcgatgctgtttctcatatctggtaaaggtatcggaaaaacgtcaataggcttaatctgtgtcgtggcaagctcaggtatgctctggatggcagacgttccattacagtggatagcatctgcgatcgtgttagaatttttcatgatggtgttattgattcctgaaccggaaaaacagagaactccacaagataatcaattagcatatgtggtcatcggcatactaacattagcggcaatagtagccgcgaacgaaatgggcttactagaaactactaaaagagatttaggaatgagtaaggagccaggtgtggtgtctccaatatcttatctagacgtcgatctgcatcctgcaagtgcttggactttatacgctgtagctacgacagttatcacgcctatgctaagacatacgatcgaaaattcgacagctaatgtatccctcgcagcaatagcaaatcaagcagtcgtcctcatgggcttggataaaggatggccaatatcaaaaatggaccttggtgtaccgcttctagcgctcggatgttactcacaggttaatccattgacactaactgctgcagttttacttctggttacacattatgcaattataggacccggcttacaagctaaagcgactagggaggcgcaaaagagaacagcagcaggtatcatgaaaaacccaactgtggacggaatcatgacaatagatttggacccggtaatatatgattcaaagtttgaaaaacagttaggacaagttatgttattaattttatgtgccgtacaactactacttatgagaacgagttgggccttttgtgaagccctcacattagcaactgggcccatcactactttatgggagggctcaccagggaaattttggaatacaacaatcgctgtttcaatggccaacatctttaggggaagctacttagcgggcgctggactggccttttcgataatgaaatcagtgggtacaggtaaacgaggaaccggtagtcaaggagaaacactgggcgagaaatggaagaagaaactgaatcagctatcaagaaaggaatttgacttatataaaaagtcaggtataacagaagtagatagaactgaggccaaagaaggtctgaaaagaggagaaataactcatcatgcagtttcccgaggaagtgccaaactacaatggttcgtagaaagaaatatggtaataccagaaggtcgcgtaatagacttgggatgcggcaggggagggtggtcatattattgtgctgggctaaagaaagtaacggaagtacggggttatacaaaaggaggtccgggtcatgaggaacctgtcccgatgtccacctatggctggaacatcgtaaaattaatgagtgggaaagacgtattttatctgccgccagaaaaatgtgatacactgctatgcgacatcggtgaatctagtccgtctccgacggttgaagagtcccgaactatacgtgtgctcaaaatggtagaaccatggctgaaaaacaatcaattttgtatcaaagtcctaaacccatacatgccaacggtcatagaacatctagagagactacaaagaaaacacgggggtatgttggttagaaatcctctctccagaaattcaacacacgaaatgtattggatatctaatgggaccggtaatatagtatcgagcgtaaacatggtatccagactattactaaacagatttacaatgacacacagacgtcctactattgaaaaggatgttgacttgggggctggaactagacatgttaacgcagaaccagaaacacccaacatggacgtcataggagagcgaattaggagaataaaagaagaacattcttcaacatggcattatgacgatgaaaatccatataagacatgggcttatcacggaagttatgaggtcaaagcaacaggttcagctagcagcatgataaatggagtcgtaaaactattaacgaaaccttgggatgtcgtaccaaccgttacacagatggccatgactgatacgactccatttggacagcagagggtgttcaaagagaaagttgatacaagaactccgaggccaatgccaggcacacgcaaggtaatggaaataactgcagagtggctatggaggacactagggcgaaataaacggccacgtctgtgtacaagagaagagttcaccaagaaagttcgaactaatgctgcaatgggtgctgttttcacggaagaaaaccagtgggacagcgctcgtgctgctgtagaggacgaagaattttggaagttggtagacagagagcgtgagctccacaaattaggcaagtgtggttcgtgcgtatataacatgatgggcaaaagagagaagaaacttggtgagttcggcaaagctaaggggtcaagagcgatatggtacatgtggttaggcgcacggtatttagaatttgaggcattagggtttcttaatgaagatcactggtttagtagggaaaattcatactctggtgttgaaggagagggtttacacaagctcggttatatactcagggatataagcaaaataccgggaggtgcgatgtacgctgacgatacagctggatgggataccagaataacagaagacgacttacataacgaggaaaagatcacacaacaaatggatccagaacatcgtcaattagcgaacgccatcttcaaactaacgtatcaaaacaaagtagtcaaagttcaaaggccaacacctaagggtacggtcatggatattatatcacgcaaagaccaaagagggtcaggacaagtagggacctacgggctcaatacatttacgaatatggaagctcaattaattcgacaaatggagggggagggcgtgctgtcgaaagcagacttagaaaatccccatttgttagagaagaaaataacacaatggctggaagcggagggagtggagcgattaaaaagaatggcaataagtggggacgattgtgttgtaaaacctatagacgaccgattcgcaaatgcattattagcattgaacgatatgggaaaagttagaaaagacattcctcaatggcagcctagcaaaggatggcatgactggcagcaggtccccttttgctctcatcacttccatgaattaattatgaaagatggccgaaaactcgtagttccatgtcgtccacaagacgaattaattgggagggcccgtatatcacaaggagcaggatggtcattaaaagaaactgcatgtcttggtaaagcatacgcacaaatgtgggccttaatgtatttccacagacgagatcttcgactagcttcaaatgccatatgttctgcagtccctgttcattgggttcccacttctcgcacaacatggagtatacacgctcatcatcaatggatgactaccgaggacatgctgacagtgtggaatagagtctggatagaagataacccttggatggaagataaaactcccgtaacaacctgggaagacgtaccatacttgggaaagcgggaggatcaatggtgtggatctctaattggacacacatctcgagccacttgggctcaaaatattttaacagcaatacaacaagtcagatcactcataggaaatgaagaatttctagattatatgccctccatgaagcggtttaggaaagaggaagagagtgagggagcaatctggtaa

SEQ ID NO: 22986 - RNA, 9873 nt, synthetic construct
  misc_feature 1..9873: note = derived and/or modified CDS sequence (opt6) from DENV-3__AB214879__SS-prME
  source 1..9873: mol_type = other RNA
acatccctatgcctaatgatgatgctccctgcaacattagcatttcacttaacatcacgtgatggagaacctagaatgattgtaggaaagaacgaacgaggaaaatcgttactgtttaaaactgcatcaggcataaatatgtgtactttaatagctatggatttgggagaaatgtgcgatgatacggtaacttataagtgtccactaattactgaagtagaacccgaagacatagattgctggtgtaacctaacaagcacgtgggtaacgtatggaacgtgcaaccaagcaggggaacatagaagagataaacgaagcgtcgcattggcacctcatgtagggatgggacttgacactcggactcaaacgtggatgtccgctgaaggagcttggcgccaagtagaaaaagtagaaacgtgggcgtttcgacaccccgggttcacgatcctagctttgttcttagctcattacatcggaacatctttaacacagaaagtagtaatattcattttgttaatgctagtaaccccctcaatgaccatgagatgcgttggtgtaggaaatcgtgatttcgttgaaggattgtcaggggccacatgggttgacgttgttcttgaacacggcggatgtgtgacgacaatggctaaaaacaaaccaacactagatatagaactgcagaagacggaagccacacaactggccacactaaggaagctgtgcattgaaggtaaaatcacaaatgtaacaactgactcgagatgccctacacaaggagaagcaattctaccagaagaacaagatcagaattatgtttgtaagcacacatacgtggaccggggttggggaaatggatgtggattattcggaaaaggatcactcgtcacttgcgctaagtttcagtgcttagaatctatcgaaggaaaagtagttcaacacgaaaacttgaagtatacggtcatcataaccgtccatacgggtgatcaacatcaagtcggaaatgaaacacaaggagttaccgcagaaataacaccacaagctagcaccgtagaagcggtgttaccagaatatggtacgctcggtctcgaatgttcaccacgaactggattggactttaacgaaatgatacttcttacaatgaaaaacaaagcgtggatggtgcatcggcaatggttctttgacttaccactcccatggacgagtggagcaacaactgaaacgccaacgtggaataagaaagaattattagttacatttaaaaatgcacatgctaagaaacaggaagttgtcgtattggggtcacaggaaggagctatgcacaccgccctaacgggagctactgaaatacaaacatcaggcggaacgtccgttttcgcaggccatttgaagtgccggcttaaaatggataagctcgaactcaagggaatgagttatgctatgtgttccaatgctttcgtactaaagaaagaagtctcagaaacacaacacggaacgatattaataaaggtagaatacaagggagaggacgctccctgcaaaataccattcagcacagaggatggacagggcaaagcccacaatggccgcctgatcacggcaaatccggtcgtaactaagaaagaagaaccagtcaacattgaagctgaaccacccttcggtgaaagcaatatcattataggaattggagataaggctcttaaaataaattggtacaagaaagggtctagcattggaaaaatgtttgaagcgacagcacgtggagcccgaagaatggcgatattaggggacaccgcttgggatttcggaagcgtaggaggagtcttaaattcattaggaaagatggttcaccaaatttttgggagtgcatataccgcactcttcagtggagtctcatggataatgaaaattggtattggagtactattaacatggattggacttaattcgaaaaatacctccatgagcttttcttgtattgtaatcggcataataacactttatttaggtgccgtagtccaggcggacatgggatgcgttataaactggaaaggaaaggaactcaaatgcggaagcggcatattcgtcacgaatgaagtacacacttggacggagcaatataaatttcaagcagatagccctaaaagattagcaacggctattgctggagcatgggaaaatggtgtatgcggaataaggtcgacaacaagaatggaaaatctactctggaagcaaatagcgaatgaattgaactacatactgtgggaaaataatattaaattgacggttgtagtgggtgacataataggggtactagaacaaggtaaaaggactctgacaccccagccgatggagctaaaatattcatggaagacgtggggtaaagcaaaaatagtgaccgcagaaacgcaaaactcgtcttttataattgatggaccgaataccccagaatgcccgtccgcaagccgagcctggaatgtatgggaagtagaggactatggttttggagtttttacgaccaatatttggttaaaattaagggagatgtatacacaactctgtgatcatagactaatgtcagcggccgtaaaagacgaaagagcagttcatgctgatatggggtattggatcgaatcgcaaaagaatggaagttggaaactagaaaaagcatcgttgatagaagttaaaacctgcacctggcccaagtctcacacactatggtccaatggggttcttgaaagcgacatgataataccgaaatcattagcgggtccgattagtcaacacaattacagaccagggtatcacacacaaaccgcaggtccctggcatctaggtaaattagaactagattttaactattgcgaagggactaccgtggttataactgagaattgtgggacccggggaccaagccttagaacaacgacagttagtggaaaattaatccacgagtggtgttgcagatcctgcaccttacctcctctcaggtatatgggcgaagacggatgttggtacggaatggaaataagacctataaatgagaaggaggaaaacatggtaaaatctctagtatctgcaggcagcggaaaagttgataattttacaatgggtgtactatgtttagccattctttttgaagaggtgatgcgtggaaaatttggtaagaaacatatgatagctggcgttctgtttacctttgtactcctactgagcggtcaaattacatggcgagacatggccagaaccttgataatgataggatctaatgcctccgataggatgggaatgggcgttacttatttagcgttaatagctacgttcaaaattcaaccgtttcttgcattaggcttctttctccggaaactgacttctcgagaaaatctacttttaggagtagggttggcaatggccacaacactacagctacccgaagatattgagcaaatggcaaacggaatcgcattaggattgatggctttgaaacttattactcaattcgaaacgtaccagttgtggaccgctctaacttcattaatgtgttctaatacgatttttacgttgacagtagcttggcgaactgcgacactcattctagctgggatttcactgttaccggtgtgtcaatcatcatctatgagaaaaacagattggctccctatgaccgtagctgctatgggagttcctccgttacccctgtttatattctcacttaaagatacactaaagcgacggagctggccactgaacgaaggggtaatggcagttgggttagtaagcatactcgcaagttcattattgcgaaatgacgtcccaatggctggacctttagttgcaggaggtttgttaattgcttgctatgtcattacaggaacaagtgccgatctgacggtggaaaaagcagctgacgtaacatgggaagaagaggcggaacaaaccggagtgagtcacaatttaatgataaccgtggatgacgatggaactatgcggataaaagacgatgaaaccgaaaacatacttactgtactactaaagacggcactccttattgttagcgggatatttccctattcgattccagccacgttattagtatggcacacatggcaaaagcaaacgcaaagatcaggagtactgtgggatgttccttcacccccagaaacacaaaaggccgaattggaagaaggcgtttatagaatcaaacaacagggaatatttggtaagactcaagtgggagtcggagtacagaaagaaggagttttccatactatgtggcacgtaacgcgcggagcagtgctaacacacaatggcaaacgtctcgaacccaactgggcgtctgtcaagaaagatttaattagctacggtggaggttggcgcctcagtgcacaatggcaaaaaggcgaagaagtgcaagtcattgccgtcgaaccaggaaagaaccccaaaaattttcaaactatgccagggatatttcaaacaactactggagagattggtgccattgcactggactttaaacctgggacatccggttctccaatcatcaatagagaagggaaggttgtcggactttatgggaatggtgttgtgactaaaagtggaggctatgtatctggaatagcgcaaacaaatgcagagccagacggtcctacacctgaactcgaagaagagatgttcaaaaagagaaacttaacgattatggacctgcatcccggaagcggtaagacgcggaagtaccttccggcaattgttagagaagcaataaagagaagactaaggacactaattttagctccaacacgagtagtagctgcagaaatggaggaggcactcaaaggcctcccgattcgctaccagacaactgcgacaaaatctgagcatacagggaaagaaatcgtagatctaatgtgccatgcgacctttacgatgaggttactaagtcctgtacgcgtacctaactataacctaatcataatggacgaggcccatttcacagatcccgcgagcatagcagctaggggttatatatcaactcgagtaggaatgggagaagcagccgctatttttatgacagcaacaccgcctggaactgcagacgcgttcccacaatcaaacgccccaatccaagacgaagaaagagatattcctgaacgctcctggaactcagggaacgattggattactgattttgccggaaagactgtatggtttgtaccatctataaaggctggtaacgatatagcaaattgcttgcgcaaaaacggcaagaaagttatacaactatccagaaaaacatttgatacagagtatcagaaaacaaaactaaatgattgggattttgtagttactacagacatttcagaaatgggcgctaatttcaaagctgatcgagttatagacccacgaagatgcctaaaaccagttatcctcacggatgggccggaacgggtaatattagcaggcccaatgccggtcactgtggcatcagctgcccaaaggagaggaagagtaggtcgcaaccctcaaaaggaaaatgatcagtacatatttaccggacaaccactcaataacgacgaggaccatgctcactggacggaagctaagatgctattagacaatataaacactccagaagggataattcctgcactatttgaaccagagcgagaaaaatccgctgcaattgacggtgaatacaggttgaagggtgaatcacgtaaaaccttcgttgagctgatgcgtagaggcgatttgccggtctggttagcgcataaagttgcgtcagagggaataaagtataccgaccgaaaatggtgcttcgacggagaacgaaataatcaaattctggaggagaatatggatgtcgaaatatggactaaagaaggagagaaaaagaaactaagaccccgctggctagatgcccgtacctacagtgatcctttagcactaaaagaatttaaagactttgccgcgggtcgaaagagcatcgcattcgatttggtaacagaaataggacgagtaccatcacaccttgctcaccgaaccagaaatgcacttgataacctagtaatgttgcatacatcagagcacggaggccgtgcctacaggcacgcagtagaagaattacccgaaactatggaaacacttctactattgggtttgatgatcctcctgacgggaggcgcaatgctattcttgattagcggcaaagggataggaaagacaagtattggattgatttgtgtagtcgcaagttctggcatgctatggatggctgacataccgttacaatggattgcgtccgccatcgtcctagaatttttcatgatggtactcttgatcccagaacctgaaaaacaaagaactccacaagacaaccagctagcgtacgttgtgataggaatcctaacgttagcagcgattgttgctgccaatgagatgggacttctggagacaactaaaagagatttgggcatgagcaaggagcccggagtagtatcccccacaagctatctcgatgtggaccttcatcctgcaagcgcatggacgttatatgcggtcgctactacagtaataacaccaatgttaagacataccatagaaaattcaacggcaaacgtgagtttagcggccattgctaatcaggctgtggtattaatgggactagataaaggttggcccattagcaaaatggatctaggcgttccccttctagcactagggtgctatagtcaagtaaatccacttacgcttaccgcagccgtactgctattagtcacacattacgcgataattggtccaggactacaagccaaagccaccagagaggcacagaaaagaaccgccgctgggattatgaagaatccgaccgtcgatggaataatgactatcgatttagatccagtaatttacgattccaaatttgagaaacagcttgggcaagtaatgctcctagtgttatgtgcagtacaactacttttaatgagaactagctgggccttttgtgaggcactaacacttgcaacaggccccataacaaccctatgggaagggtccccaggaaaattttggaatacaacaatcgcagtaagcatggctaacatttttaggggttcgtacttagccggggccgggttagcatttagtattatgaaaagcgtaggcacaggcaagagaggaactggcagtcaaggggagacactaggggaaaaatggaaaaagaaactgaatcagctatctcgtaaagaatttgatctatataagaagtccggaattaccgaagtagataggactgaagcgaaggaaggtctcaagcgaggcgagataacacatcacgcagtttcacgaggttccgcaaaactacaatggtttgttgaaagaaatatggtaatcccagaaggaagggttatagacttaggatgtggcagaggtggttggtcttattattgtgcaggacttaaaaaggttactgaagtcagagggtatacaaaaggtggtccagggcacgaagaacctgtacctatgagtacctacggatggaacatcgttaaactaatgtcgggtaaagatgtcttctatttaccgccagaaaaatgcgatactttactatgcgatattggagaaagctcgccgtcgcctaccgtagaagaatcacgaacaatccgagtactgaaaatggttgaaccgtggctcaagaataatcaattttgtatcaaggtattaaacccctatatgccgacagtcattgagcacctagagagattacagcggaaacatggtgggatgctagttagaaacccattgagtcgtaattcaacacatgagatgtattggatatctaatggaacgggtaatatagtatcctcagttaatatggtaagtcgactacttctaaaccgttttacaatgacttataggagaccaaccattgaaaaagacgtcgatttaggagccggtacaaggcatgttaatgcagaaccagagactcctaatatggacgttataggggagagaatacgaagaataaaggaagaacacagttcgacgtggcattacgatgatgagaatccatataagacctgggcataccacggatcatatgaagtaaaagcaactggatcagcctcttccatgataaacggagtagtcaagttattgacaaaaccatgggacgtagtccctactgtaacacagatggcgatgacagatactacgccatttggccaacaaagggtttttaaagagaaggtagacacaagaacgcctaaacctatgccgggaacgagaaaggtgatggaaataactgcagagtggctatggagaactttgggacgaaacaagagaccaaggttatgtactagagaagagttcactaaaaaggtacgaacaaacgcagcaatgggtgctgtgttcactgaagaaaaccagtgggatagtgccagagctgcagtcgaagacgaagagttctggaaattagtagaccgagaacgtgaattgcataagttaggaaaatgtggcagttgtgtttataatatgatggggaagagggagaagaaactcggggaatttgggaaagcgaaaggatcaagggcaatatggtatatgtggttaggagctaggtatctagagttcgaagccttaggatttttaaacgaagaccactggttttcacgggaaaattcatatagtggagtagaaggcgagggtctacataaacttgggtatattctaagggatataagtaaaataccaggcggtgctatgtacgcagacgataccgcgggatgggatacgcgaataactgaggatgatctacataatgaagagaaaataacacaacaaatggacccggaacatcgacaactggctaatgctatctttaaactaacataccaaaataaagtagtcaaagtacaaaggccgacgccgaaaggtaccgtcatggatatcattagtagaaaagatcagagaggcagcggtcaggtaggcacttacggactgaatactttcactaacatggaagcacaattaataagacaaatggaaggagaaggagtcttgtcaaaaacagatttggaaaatcctcatctgcttgaaaaacgcattacacagtggttagaaaccaagggagttgaaagactcaagcgtatggccattagtggtgacgactgtgttgttaagccgatagacgatagatttgcaaatgccttacttgcgctaaacgatatgggtaaggtaagaaaagatataccgcaatggcagccatcaaagggatggcatgattggcagcaagtacccttttgtagccaccactttcacgagttaataatgaaggacggacgaaaattagtagtaccttgtaggcctcaagatgaactcattggccgagcccgcattagtcaaggagccggctggtcattaaaagagacagcctgcttaggaaaggcttacgcacagatgtgggctttaatgtatttccatagaagagatcttagacttgccagtaacgctatatgtagtgcagttcctgtgcactgggtcccaacatcgcgtacaacttggtccatccatgcccaccaccaatggatgacgacagaggatatgcttacagtgtggaatagagtatggattgaggacaatccatggatggaggacaaaacaccagtaacaacatgggaagacgtgccgtatctaggaaaaagagaggaccagtggtgtgggtctttgattggcttgacaagtagagcaacatgggctcagaacatactaacggctattcaacaagttcgtagtcttatcggaaacgaggaatttttagactacatgccatctatgaaacgcttccgtaaagaagaggaatctgaaggcgcaatttggtag

SEQ ID NO: 22987 - RNA, 9873 nt, synthetic construct
  misc_feature 1..9873: note = derived and/or modified CDS sequence (opt6) from DENV-3__AB214880__SS-prME
  source 1..9873: mol_type = other RNA
accagtttatgcttaatgatgatgttgccagcaaccttggcattccatttaacaagtagagatggtgaaccccgaatgatcgtaggcaaaaatgaacgaggtaagagcttactttttaaaacagcatcaggaataaacatgtgtaccttaatagccatggatttgggagaaatgtgtgatgatactgtcacttacaaatgccctctaatcactgaagttgaaccagaggacatagattgttggtgcaatcttacatcaacttgggttacttatggcacatgtaatcaagcaggggaacacagacgagataagagatccgttgctctagcacctcacgtcgggatgggactggataccagaacacagacatggatgtcagccgaaggagcatggagacaggttgagaaagttgaaacctgggcgtttagacaccctggatttaccattttagcactctttttagctcattatataggaacgagtttaacgcaaaaagtcgttatatttatactacttatgttagtaactcctagcatgacaatgcggtgtgtcggagttggaaatcgtgattttgtagaaggtttgagtggagctacttgggtggatgttgtactagagcacggaggctgcgtgactaccatggctaaaaacaaaccaacccttgatattgaactccagaaaacagaggcaacacagctagcaaccttgagaaaattatgcatcgaaggaaaaattaccaatgtcactacggacagccgatgtccaacccagggtgaggcgattcttccagaagaacaagatcaaaactatgtatgtaaacatacatatgtggatcgcggatgggggaacggttgtggattatttggcaaaggatcactggtcacatgcgcaaaatttcaatgcttagaatccattgagggaaaagtagttcaacacgagaatctaaaatatactgtaattattacagtgcacaccggggatcaacaccaggtcggtaatgaaacacaaggcgtaacggcggaaataacaccacaagcatctaccgttgaagctgtactaccagaatacggaacattgggattagagtgttccccacgaacaggtcttgattttaacgaaatgatactgctaaccatgaaaaataaagcatggatggtacaccgacaatggttctttgatctacccctaccgtggacatccggtgcgactaccgaaacaccaacttggaataagaaagaactactggttacctttaagaacgcgcacgctaagaaacaagaagttgtcgtattaggttctcaagaaggagccatgcatactgcacttacaggagcgactgaaattcaaaccagtggtggaacttccatcttcgctgggcacctaaagtgtcgccttaaaatggataagctagagctcaaaggaatgagttacgctatgtgttctaatgcttttgtacttaagaaagaagtgagcgaaacacagcatggaacaattctgataaaagttgaatataagggagaggatgcaccttgtaaaattccatttagtacggaagacggccaaggaaaagcccataatggacgtttaataacagctaaccccgtagtaacaaagaaagaagaaccagtaaatatagaagcggagccgccttttggagaaagtaatataatcataggaatcggtgataaggctttaaaaataaactggtacaagaagggtagctcaataggaaaaatgtttgaggctacagcaagaggggcgagaagaatggctattctcggagacaccgcatgggattttggatcagttggaggcgtcttaaactcattaggaaaaatggttcaccaaattttcggaagcgcatataccgctctcttttcaggagtttcttggatcatgaaaataggtataggtgtactattaacatggatcggccttaattctaaaaatacatcaatgtcattctcttgtatagtaattgggattataacactatacttaggagcagtcgtacaggctgatatgggatgtgtcattaattggaaagggaaagaactaaagtgtgggtctggaatattcgtgacaaatgaagttcacacgtggacagaacaatataaatttcaagcagacagtcccaagcgtctagcaactgctatagctggagcgtgggaaaatggagtctgcggtatcagaagtacgactagaatggagaatctactatggaaacaaattgccaatgaactaaactatattctatgggagaataatatcaaattaacggtagttgttggtgacataataggagtcctggaacaaggtaagagaacactaactccacagccgatggaactaaaatattcatggaaaacctggggtaaggcaaaaatagtcacggctgaaacacaaaatagcagtttcatcatcgatgggcccaacactcctgaatgcccttctgcgagtcgtgcatggaacgtttgggaagttgaagattacggatttggcgtattcacgacgaacatatggctaaaattacgcgagatgtacacacaactatgcgatcaccgcctaatgtccgcagctgtaaaagatgaacgcgctgttcatgccgatatgggctactggatagaatcgcagaagaacggttcatggaaattagaaaaagcatccttgattgaagtaaaaacatgcacatggccaaaatcccacacgctctggagcaatggagtactggaaagtgacatgataattccaaaatcacttgcagggcccatatcccaacataactacagacctggatatcatacacaaacagcgggaccgtggcatctcggtaaactcgaattagacttcaactactgtgaagggaccactgtagtaataactgaaaattgtggcacaagaggtccatctcttaggacaactacggtgagtggtaaacttatacacgaatggtgttgtcgttcttgtacattgccgccattaagatacatgggagaagatggctgttggtacggtatggagatacgaccgattaacgaaaaagaagaaaatatggtaaagtcccttgtatctgcaggttctggtaaagtcgataacttcacaatgggagttttgtgtttagctatattgttcgaagaagtgatgagaggtaagtttggcaagaaacacatgatagctggtgtattatttacatttgtccttctgctttcaggacagatcacatggcgtgatatggcacgcacattaatcatgatcggttctaacgcatccgacagaatggggatgggagtgacctatctcgccttgattgccacgttcaaaattcagccatttttagcattagggttctttctgagaaagttgacttctcgtgaaaaccttttactaggagtaggtttagctatggcaaccaccctacaattaccggaagatatcgaacagatggcgaatggaatagccctggggctgatggcactaaagttgattacccaatttgaaacgtatcaattatggaccgcattggcgtccttaatgtgttcgaacaccatatttacactaaccgtggcttggcgaacagcaacccttatactggcggggatctcacttttgccagtatgtcaaagctcctcaatgcgaaaaactgattggctaccaatgactgtagctgccatgggagttccaccattacctcttttcatattctccctaaaagatacgttgaagcggcggagttggcccttaaatgaaggcgtgatggctgttggcctggttagtattttagcatcgagcctactgagaaacgatgtacccatggctggtccgctggtcgccggaggactattaatagcatgttatgtgatcacgggtacctcagctgatctgacagtggaaaaagctgctgacgtaacctgggaagaagaagccgaacagactggcgtaagtcataaccttatgataaccgtagatgacgacgggaccatgagaataaaagatgatgaaactgaaaatatcttaaccgtactattaaaaaccgcgctacttatagtctcaggtatttttccatactcgattcctgctacactactcgtatggcatacctggcaaaaacaaacacaaagaagtggcgttctctgggatgtaccatcgccccctgaaacacaaaaggcagaacttgaggaaggggtatacagaataaagcaacaagggatatttggcaagacccaagtgggcgtaggtgttcaaaaggaaggagtctttcacacaatgtggcacgtaacgagaggagcagttctgacgcataacggaaaacgcttagaaccaaactgggccagtgttaagaaagacttaataagctatggaggaggatggcgtctaagtgctcaatggcaaaaaggcgaagaagttcaagtcattgctgtagaaccaggcaagaaccccaaaaatttccaaactatgccgggaatttttcaaacgaccacaggagagataggagctatcgctctagatttcaaacctggcacaagcgggtcacccataatcaacagagaaggaaaggtagtgggcttatatggtaatggcgttgtcactaaaagcggtgggtatgtctcaggaatcgcgcagacaaatgcagagcctgatgggccgactcctgaattggaagaagagatgttcaaaaagcgaaacttaactataatggatttacatccggggtctggcaaaacgcgtaaatatctacctgcaatagtccgtgaagcaataaagagacgactaagaacattaatattagcaccaacccgtgtagttgctgcggaaatggaagaagccttgaagggactgccaatacgttaccaaacaactgctacaaaatccgagcacaccggaaaagaaatagtagacctcatgtgccatgcaacgtttacaatgagattactttctccagtaagggtcccgaattacaacttaatcataatggatgaagcccactttacagaccccgctagtatagcagctcgcggatacattagcacaagagttgggatgggggaagctgcagctatattcatgaccgcaacgcctcctggaactgccgacgcttttccacagtccaatgcgccaatacaggatgaagaacgagatatccctgagcgttcctggaactccggaaatgactggattactgattttgctggtaaaacggtctggttcgtaccgtcgattaaagcaggcaatgacattgccaactgccttcgtaaaaatggcaagaaagtcatacaactttcgagaaaaacattcgatacagaataccagaaaacaaaactaaatgattgggactttgtagttaccacagacataagtgaaatgggagcaaattttaaagctgaccgagtaatcgatcccaggcgatgcctaaaaccagtaattttgacagacggaccagaaagagttatcctagcaggaccaatgcctgtaacagtagcttccgcagctcaacgacggggtagagtaggaagaaacccacaaaaagagaatgaccaatatattttcactggtcaacctctaaataacgatgaagatcatgctcattggaccgaagcaaagatgttattagataacataaatactccagaaggtataatacctgcattatttgaacctgaacgagagaagagtgcggcgatagacggggaataccgtcttaagggggaaagtaggaaaacgttcgtagaattaatgcgccggggtgacctcccggtatggctagcacataaagttgcgtctgaaggaatcaaatatacggacaggaaatggtgcttcgatggagagcgtaacaaccaaatactcgaggaaaacatggatgtagaaatctggacaaaggaaggcgagaagaagaagctccgtcctagatggctcgatgcaagaacgtattctgaccctctcgctctaaaagaatttaaagattttgctgcagggcgaaagagcatagctttcgatctagttacagaaattggaagagttccatctcatttagctcacaggacacgaaatgcattagataatttagttatgctgcatacatcagaacatggaggaagggcttatagacatgcagtggaagaacttccagagacgatggagacactattacttctgggcctcatgatcctcttaaccggaggcgcaatgttgtttctcattagcggtaagggaattggaaaaacttcgataggtcttatttgtgtggttgcatcaagcggtatgttgtggatggcagatattcccctacaatggatagcatcagctatcgtcttagagttctttatgatggtactactaatccccgaaccagaaaagcagcgaacaccacaggacaatcaactagcgtacgtagtaattggaatacttacactagcagcgatcgttgcagcaaatgaaatgggtttacttgaaacaacaaagcgcgatctaggcatgtcaaaggaaccaggggtagtgtctccgacgagctatttagacgtggatctccacccggcttccgcatggactttatacgcagtggccacgacagtgatcacccccatgctaaggcatacaatagaaaattcaacagcaaacgtctctctggcagctatagcaaatcaagcagtagtattaatgggcttggacaaaggatggcctataagtaaaatggatctcggcgtgccattattagcgctcggatgctatagtcaagtaaatccattaactttgactgcggccgtcttattacttgtcactcattatgccataatcgggccaggtttgcaggcgaaagctacgagagaagctcaaaagaggactgctgcgggtattatgaaaaatccgacggtagatggtataatgacaattgatctagacccagtgatttacgattcgaaattcgaaaaacaattgggtcaagttatgctattagttctatgtgcagtccaattgttactcatgagaacttcctgggctttttgtgaagccttaacactagcaactggtcctataacgactttgtgggagggatcacctggaaagttctggaacactactatagccgtaagtatggcgaatatattcaggggcagttatcttgccggtgcaggcctcgcgttttcaataatgaaatcagttggcaccgggaagcgaggaacaggatcacagggtgaaactctaggagaaaaatggaaaaagaaacttaaccaattatcccgcaaagaatttgacttgtataaaaagtcaggaataactgaagttgatcgtacggaagcaaaagaagggctaaaaagaggcgaaataacacaccatgctgtctctagaggatctgcgaaacttcaatggttcgtagaacgtaatatggttattcctgaaggtagagtcattgacctaggttgcgggcgaggtggttggagctattattgcgctggcctaaagaaagttactgaagtaagaggttacacaaagggaggtccgggtcatgaggaacctgtaccaatgagtacatatgggtggaatatagtcaaactaatgtccggaaaagatgtgttttatttacctccagaaaaatgcgacactctcctatgcgatatcggtgagtcgagcccaagtcctacggttgaggagagtcgaacgattcgagtgttaaagatggttgagccatggttgaaaaacaaccaattttgtataaaggtactaaacccatatatgccaacggtaatagaacatcttgagaggctacaacgaaaacatgggggaatgttagtaagaaaccctttgtcgaggaactcgactcacgaaatgtattggattagcaacggtactggtaacatagtaagtagcgtaaatatggtctcgcggttattgcttaatagattcactatgacatacagacgccccaccatagaaaaagacgtagatttaggggcaggcactagacatgtcaatgcagaacccgaaacgccaaacatggatgttataggagaacgaataagacgtataaaagaagaacactcaagtacatggcattacgatgatgaaaatccatacaaaacatgggcataccatgggtcttacgaagttaaagcaactggctcagcatcctccatgataaatggtgtagtaaaactacttacaaagccctgggatgtggtaccaacagttactcaaatggcaatgactgatacaacacccttcggacaacaaagagtttttaaagaaaaggttgatacacgaaccccaaaacccatgcctggcactagaaaggtaatggaaattacagcagaatggctatggcgtacactcggaagaaacaaaagaccaagactatgtactcgagaggagttcacaaagaaagtaagaaccaacgcggctatgggagcagtattcaccgaagaaaatcaatgggactctgcaagggcggcagtcgaagacgaggagttttggaaattagtagatagagaacgcgagttgcataaacttggaaaatgtggttcctgtgtttataacatgatgggtaaaagagagaagaaactcggagaatttggaaaagccaaaggcagtcgggcgatatggtacatgtggctaggagctcgatatctcgaatttgaagcactaggattcctcaatgaggaccattggttttcaagagagaacagttactccggagttgagggtgaaggtctgcacaaacttggatacatattacgtgatatatctaaaataccaggaggcgcgatgtatgcagacgacaccgcaggttgggatacaagaataaccgaggatgaccttcacaatgaagagaaaataacgcagcaaatggaccccgaacaccgacagctggcaaacgcaattttcaaacttacatatcaaaacaaagttgtaaaagtccaacggccaacgccaaaggggacagtaatggacatcatttcccgtaaagatcaacgaggctcaggacaagttggaacatatggtttaaacacattcacaaatatggaagcacaacttattaggcaaatggaaggtgaaggagtcctaagtaaaacagatttggagaacccgcatttgttggaaaaacgtataacacagtggttggaaacaaagggcgtagaacgactaaaacgcatggccataagtggggacgattgcgtcgtcaagccaattgatgacagattcgcgaatgccttgttggccttaaatgatatgggcaaggtaagaaaagacattcctcaatggcaaccatccaagggttggcatgactggcaacaagtaccgttctgttcacatcactttcatgagttaatcatgaaagacggaaggaagttagttgtaccttgtcgacctcaagacgaactaataggtagagcaagaataagtcagggtgcaggctggtccttgaaagagacagcatgtcttgggaaagcctacgcacaaatgtgggcgttaatgtactttcataggcgagatctcaggcttgcatctaacgctatatgctcggcggtaccggtacactgggtacctacgagtcgaacaacttggagtattcatgcgcatcatcaatggatgacaactgaggatatgctcacagtatggaatagagtttggatagaggataacccatggatggaggataaaacaccagtaacaacatgggaagatgtaccatacctaggtaaaagagaagatcaatggtgcggaagtttaattggtctcacatcaagggctacgtgggctcaaaatatattaacagcgatacaacaagtgagatccttgattggaaacgaggagttcttagactacatgcctagtatgaaacgattcagaaaggaagaagaatcggaaggagcaatatggtag

SEQ ID NO: 22988 - RNA, 9873 nt, synthetic construct
  misc_feature 1..9873: note = derived and/or modified CDS sequence (opt6) from DENV-3__AB214881__SS-prME
  source 1..9873: mol_type = other RNA
acatccctgtgtttgatgatgatgttaccggctaccttagcttttcacctaacaagtcgagatggggaacctcgcatgattgtaggtaaaaatgaaagaggtaaatcattattattcaaaaccgcctcaggcattaacatgtgtacacttatagcgatggacttaggagaaatgtgcgatgacactgttacttataaatgtccgctaataactgaagtggaaccagaagatattgattgctggtgcaatttaacctctacatgggttacttatggaacctgtaaccaagcaggggaacatcgcagagacaaaagatcggtggccttagctccgcatgtcggcatgggactagatacgcgaacacagacatggatgtcagctgaaggagcatggcgacaagttgagaaagtggaaacatgggccttccgacatccaggattcacaatattggctttattcttggcacattatattggcaccagccttacacaaaaagtggtgatatttattttgctgatgttagtgactccttcaatgactatgagatgcgttggtgttggcaatcgggattttgtagagggattatccggggcgacttgggtagatgtggttttagagcacggtggatgcgtgacaacgatggcgaaaaataaaccaacactagatatcgagcttcagaaaacggaagccacacaactagcaactttaaggaaattgtgcatcgagggcaaaataacgaacgttacaacagattctagatgtcccactcagggagaagctatattacccgaggaacaagaccagaattatgtatgtaaacacacatatgtggataggggttgggggaacggctgtggtttattcggaaaaggcagtctggtaacctgtgctaaattccagtgcctagaaagtattgaaggaaaagtagtacagcatgaaaatttaaaatacacagtaataataaccgttcacacaggggatcagcatcaagtgggcaacgaaacccaaggagttacggctgagataacaccccaggcgtccacagtagaagctgttcttcctgaatatggaacgcttggcctagaatgtagtccgcgaacgggcctcgatttcaatgagatgatactattaacaatgaaaaataaagcatggatggtgcacagacagtggttctttgatctgcctttaccttggacatccggcgcaacaaccgaaacaccaacatggaataagaaagaattattagtcacattcaaaaacgcgcatgccaagaaacaagaagtggtggtcctcgggtcgcaagaaggtgccatgcataccgcactgaccggagcaacggagatacaaacttccggaggaacttcaatattcgccgggcatctgaaatgtagattaaaaatggacaaattagaacttaaaggaatgtcatacgcgatgtgtagtaacgccttcgtattaaagaaggaagtgagcgaaacccagcatggaacgatcttaatcaaggtagaatataagggagaagacgcaccctgcaagattccattttcaactgaagatgggcaaggaaaagctcataatggaaggttaataacggcaaatcccgtcgttacgaagaaagaagaaccagttaacattgaagctgaaccaccttttggtgaatcaaatattataataggaattggtgacaaagcattaaaaataaactggtataagaaaggatcgtctatcggtaagatgtttgaggcaacagctcgaggggctcgtaggatggcaatacttggagatacagcatgggatttcggtagtgtgggcggggtattaaatagtttagggaaaatggttcatcaaatatttggaagtgcgtatactgctctattttccggagtatcttggattatgaagatcggaataggagttcttttaacgtggataggcttaaatagtaaaaacacaagcatgagcttttcatgtatagttatagggataataacattatatttgggcgcagtcgtgcaggcagatatggggtgtgtcataaactggaaaggaaaggaacttaaatgtggtagtggtatattcgtcactaatgaagtccatacatggacagagcaatataagttccaggcagattcgccaaagaggttagcaactgccatcgcaggagcctgggaaaatggagtatgcgggattcgtagtacgacacgaatggaaaacctgttatggaaacaaatagcaaatgaattaaattatattttgtgggaaaataatattaaattaacggtcgtagttggagatattataggtatattggaacaagggaaacgcaccctcactccgcagccgatggaacttaagtacagctggaagacatggggcaaagctaagattgtaacagctgaaacgcaaaatagtagttttataatagatgggccaaatactcctgagtgtccaagtgccagtcgcgcttggaatgtttgggaagtagaagattatggtttcggggtatttacaacaaacatatggttgaaacttagagagatgtatacccaactttgtgatcacagactcatgtcagcagctgttaaggatgaacgagctgtacacgcagatatgggttattggatcgaatcacagaaaaatggtagctggaaacttgagaaagcgtcactaatagaagtcaaaacatgtacttggcccaaatcacatactttatggagtaatggagtattagaaagtgacatgattatccctaagtctttagcaggcccaatcagccagcataattacaggcccggataccatactcagacagctggaccttggcatttgggaaaattggaattagattttaattactgtgaaggaacgacagtggtcataacagaaaattgcgggactcgaggaccctcactgagaaccacaactgtaagtggtaaattaattcatgagtggtgttgtcgcagttgtaccttacctccactcaggtacatgggagaggatggttgttggtacggtatggaaatacggccaataaatgagaaagaagaaaacatggttaaatccctagtttcagcaggatccggtaaggtggacaactttacaatgggagtactatgccttgccatcctgtttgaagaagtaatgagaggaaaattcggcaagaaacatatgattgccggagtgctctttacatttgtattgttactgtcaggacaaattacttggagagatatggcacgtaccctaattatgataggtagtaatgcatcagaccggatgggaatgggagtaacttacctagcattaatagctacatttaaaatccaaccttttctggctttaggattctttttgcgcaaactaacatcgagagaaaacttgcttttaggagttggactagccatggctacaacactccagttacctgaggacatcgaacaaatggcaaacgggatagccttaggattgatggcgttgaaactcataacgcaatttgaaacttaccaactttggactgcgcttgcaagtctcatgtgtagtaacacgatcttcacgctgactgtagcttggaggaccgcgacgttgatactggctggaatatcattattaccagtatgtcaatcgtcatcaatgagaaaaacagattggctgccaatgactgttgcagccatgggcgtgccccctttgcctctatttatcttttccttaaaagacacattaaagagaagaagctggcccctgaatgaaggggtaatggctgttggtttagtatcaattttagcgtcaagtttacttagaaatgacgtgccaatggcagggcccctggtagcgggcgggttgctaatcgcgtgctatgtgatcacgggtacatcagctgacctcactgtagaaaaagccgctgacgtaacatgggaagaagaagccgaacaaactggtgttagccacaacttaatgattaccgtggatgacgatgggacaatgcgtattaaggatgatgaaacagagaatatactgactgtattgctgaaaacagcgcttctgatagttagcggaatcttcccttacagtattccggcgaccttattggtttggcacacctggcaaaaacagacacaaagatccggagtgttatgggacgttccaagtccaccggaaacacagaaagctgagctagaagaaggggtttatcggattaaacaacaaggtatattcggtaaaacacaagtcggagtcggagtgcaaaaagaaggagtatttcacacgatgtggcacgttactaggggcgctgttctaacccataatggcaagagacttgaaccaaattgggctagcgttaagaaagacttaataagttatggcggagggtggagattatcggcacaatggcaaaagggagaggaagtacaagttattgcggtcgaacccggaaagaatccaaagaactttcaaacaatgccgggcattttccaaactactacaggggaaattggagccatagctctagactttaaacctgggactagcggaagccctataataaatagagagggtaaagtagtagggctttatggcaatggcgttgttactaaaagtggaggatacgtgtctgggatagctcagacaaacgcagaaccagacggcccaactccagaattagaagaagaaatgtttaagaaacgaaatcttacgataatggacctacacccaggctccggtaaaactcgcaaatatttgcctgcaattgtaagagaagcgattaaaaggagattacgtacgttaatacttgctccaacaagagttgtagcagcagaaatggaggaggccctcaaagggttgcctataagatatcaaacaacagcaaccaaatctgaacacacaggaaaagaaattgtcgacctaatgtgccatgcaacctttactatgcgtctgcttagtcctgttagagttcctaattataacctcatcattatggatgaagcacatttcaccgatccggcaagcatcgcagcgagagggtacataagtaccagggtaggaatgggagaagcagcagccatcttcatgacagcgacacccccagggactgccgacgcatttcctcaatcaaatgctccgatacaggatgaggaaagggacatacctgaacggagttggaactctgggaacgattggatcacagatttcgccggtaaaacagtatggtttgtaccgtcaataaaagcgggtaatgatatagcaaattgcttaagaaagaacggtaagaaagtcatacaactatctcgaaaaacatttgatactgaataccagaaaactaagctgaacgattgggattttgtcgttactacagatatatctgaaatgggagcgaatttcaaggctgatcgcgtcatagatccaaggagatgcctaaaaccggtaatattaacggacggtccagaaagagtaatattggctggccccatgcctgtaacggttgcttcagctgcacaaagaaggggtagagttggccgtaacccacaaaaagaaaatgatcaatacatatttacgggtcaaccgttaaataatgatgaagatcatgcccactggactgaggcaaaaatgttattagataacataaatacgccagagggaataataccggcactattcgaaccggaacgagagaaaagtgcagcaatagacggcgaatatagattaaaaggggaaagtcgaaagacttttgtagaactaatgcgaagaggcgatttgccagtttggttagctcacaaagtagcatcagaaggcataaaatatacggatcgaaaatggtgttttgatggagagcgaaacaatcaaatattagaagaaaacatggatgtggaaatatggactaaagaaggagaaaagaagaagctaagaccaaggtggttagatgcgagaacctacagtgatccactagctctcaaagagttcaaagattttgcggcgggcagaaaatcgatagctttcgacctcgtaactgaaataggtagagtcccaagccatcttgcacatagaacgagaaatgctttagacaatttggtaatgttgcatacgtctgaacatggtggccgtgcttaccgacatgcagtcgaagaacttcccgagacgatggaaacgttactgctacttggcttgatgatactattaaccggaggggctatgctatttctaatttcaggaaaggggattggcaaaacatctattggattaatctgtgtagtagctagttccggtatgctatggatggcagatatcccgttacaatggatagcatcggctatcgtattggagttcttcatgatggttctccttatacctgaaccagaaaagcaaagaacgccacaagataaccaacttgcgtatgtagtgataggtattttaacgttagcagccatagtagcagcaaatgagatgggactacttgaaacaactaaacgagacctaggcatgtcaaaggaacctggagtagtttcaccaactagctaccttgatgtcgacttacatcccgccagtgcttggacactctatgctgttgccacaacagttataacaccaatgcttcggcacactatagaaaattcaacagcaaacgtatccttagcggcaattgccaatcaagcggtggtcttaatggggctagataaagggtggccaatatcaaaaatggatctgggggtgcctctattagccttgggatgctatagccaagtaaaccctttaactttgactgctgcggtactgctgcttgtaacacactatgcaattatagggccaggcctacaagctaaagctactagagaagcccaaaaacgcacagcagcggggattatgaagaatccgacagtagatggaatcatgacaattgacctggatcccgtcatatatgacagcaaattcgaaaaacaactcggccaagttatgctactggtcttgtgtgccgtgcagttactacttatgcgcacttcatgggccttttgcgaagcgctaacattagctacaggcccgataacaacactatgggaaggctctccgggtaagttttggaatacaacaatagcagtaagtatggcaaacatctttcgaggaagttatcttgccggggccggcttagcattttcgataatgaagtctgtgggaacaggcaaaagaggaactgggtctcaaggagagacgcttggcgaaaagtggaagaagaaattgaatcaattaagccgaaaagaatttgacctgtataaaaagtcaggtatcaccgaagttgaccgaacagaagcaaaagaagggctcaaaaggggtgagataacgcaccatgcagtgtcacgcggctcggctaaactacaatggtttgtggaacgaaacatggttattcccgagggtcgagtaattgatctcggctgcggccggggtggctggtcatactattgtgctggactaaagaaagtaacagaagtaaggggttatactaagggtggaccaggacatgaagaacctgtcccgatgtcaacttatggctggaatatagtaaaattgatgtccggaaaagacgtgttctatctaccaccagaaaaatgcgatacacttttatgtgacataggcgaatcaagcccatcaccaacagtagaggaaagccgtacaataagggtattaaaaatggtggaaccgtggctaaagaataaccaattttgtataaaagtcctaaatccatatatgccaacggtaatcgaacacttagagcgtctccagaggaaacatggaggtatgctagtaagaaatcctctcagtaggaatagtacacacgaaatgtattggatttccaatggaacaggtaacatagtttctagtgtaaacatggtaagccggctactgttaaatagatttacaatgacctaccgtaggccaactatagaaaaagacgttgacttgggagccggcacacgacatgtgaatgcagaaccagaaactccgaacatggatgtcattggagaacgcataagacgtataaaagaagaacattcgtcaacgtggcactatgatgacgaaaatccttataaaacgtgggcgtaccacggtagttatgaagtaaaagcaactgggtctgcttcatcaatgattaatggcgtggtcaaattattaacaaaaccttgggatgtcgtacctaccgtaacccaaatggcaatgacggatacaacgccatttgggcaacaaagagtatttaaagagaaagttgataccagaacacccaaaccaatgccaggtactaggaaagttatggaaattactgcggaatggctctggagaacactcgggcggaataaacgtcctagactatgcactagagaggaatttactaagaaggtacgtacaaacgcagcaatgggagcagtgttcacagaagaaaatcaatgggatagcgcgcgagcagcagtagaagatgaggaattttggaaattagtcgatagggaaagagaactccataaactaggcaaatgcggcagctgtgtgtataatatgatgggcaagcgggagaagaaactaggcgagtttggcaaagcaaaaggtagccgcgcaatttggtacatgtggctaggtgctagatatttggaatttgaagcactgggcttcttaaatgaagaccattggtttagcagggaaaactcgtatagtggcgttgaaggagaaggactacataaacttggatatatacttcgcgatattagcaaaataccaggcggtgcaatgtatgcggacgacaccgcaggttgggacacgcgtataacagaagatgacctacacaatgaggaaaagataactcaacagatggacccagaacaccgacagctagctaatgccatatttaaattgacctatcaaaacaaagtagtgaaagtacaaaggccaacccctaaaggaactgtgatggacattatatcacgcaaagatcaacgtggatccggccaagtaggaacctatggacttaatacattcacgaacatggaggcgcaactcataagacaaatggagggcgagggagtgctttctaaaacagaccttgagaacccccatttacttgaaaaacgaattacacaatggctggaaacgaaaggagtagaacgtttaaagcgcatggcgatcagtggagacgactgtgtagtaaaaccaatagatgaccgatttgctaatgccttactagcactgaacgatatgggtaaagtacgtaaggacattccccaatggcagcccagcaaaggttggcatgattggcaacaagtgccgttctgctcacatcactttcatgaactaattatgaaagacgggaggaaacttgttgttccgtgcagacctcaagatgagttaattggtagagcacgaatatcgcagggagctggttggagcctcaaagagacagcttgtttgggaaaagcatatgcccaaatgtgggcgcttatgtactttcataggcgcgacttaagactcgcaagcaacgcaatctgttccgccgttcctgtacattgggtcccaacatcgagaactacttggtctatacatgcccatcatcaatggatgacaacagaggatatgttgacagtatggaatagagtctggatagaagataacccatggatggaagataagacaccggtcaccacctgggaagacgtaccttacctaggaaaaagagaagaccaatggtgtggctctctcatagggctaacatcaagggcaacctgggcacagaacatactaacagcgatccagcaggttagaagtttaataggaaatgaggaatttttggattatatgccaagcatgaagcggtttcgtaaagaggaagagttagaaggagccatatggtaa

SEQ ID NO: 22989 - RNA, 9873 nt, synthetic construct
  misc_feature 1..9873: note = derived and/or modified CDS sequence (opt6) from DENV-3__AB214882__SS-prME
  source 1..9873: mol_type = other RNA
acaagtctttgccttatgatgatgctcccagcaacattagctttccatctcacctccagagatggagaaccaagaatgattgtagggaaaaatgaaagaggcaaatccttattattcaaaaccgcaagtggtataaatatgtgcactttaatagcaatggatctaggggaaatgtgtgatgacactgtaacatacaaatgtcctttaataaccgaagtggaaccggaagacatagattgttggtgcaatttaacaagcacatgggtcacttatggtacgtgcaatcaagcaggcgagcatcgtcgagataaacgtagcgttgcactggcccctcacgttggtatgggattagacacgagaacgcaaacgtggatgtctgcagagggagcatggagacaagtagaaaaagtagagacatgggcattccggcatccgggatttaccatactggctctttttctggcccattatattggcacctctttgactcaaaaagttgtaatctttattctacttatgctagtgaccccgagcatgactatgagatgcgttggggtaggcaatagagattttgtagagggactatcaggagcaacatgggtagatgtagtattagaacacggaggatgtgtcacaacaatggcgaaaaacaaaccgactctagacatagaacttcagaaaactgaagcaactcaattggcaacattaagaaaattatgcatcgaagggaaaataacaaacgtaactacagatagtagatgtcctactcaaggcgaggcaattcttccagaagaacaagatcaaaactatgtctgtaaacatacgtacgtcgatcggggttggggaaatggatgtggtttattcggtaaaggatctctagtaacatgtgcaaaatttcaatgtttggaatcgatcgaaggcaaagtcgtccaacatgaaaatctcaagtatacggttattataactgtacacacgggagaccaacaccaagtcggtaacgaaactcagggtgtaaccgctgaaattacgcctcaggcgagcactgtcgaagctgtactaccagagtacggtactttaggactcgaatgttctccgaggacagggttggattttaacgagatgatcctattaactatgaaaaataaggcctggatggtccatcgtcaatggttctttgatttaccactaccttggacttccggagccacaactgagacccccacatggaacaagaaagaattattagtaacctttaagaacgcacacgcgaagaaacaggaggtcgtcgtgctcggttcccaagaaggggcaatgcacacagcattaacaggagcaacagaaatacaaacgtcaggtggaacaagtatatttgccggacatctgaaatgtcggcttaagatggataaattggaattaaaaggaatgagctacgcaatgtgttcaaatgcattcgttttgaagaaggaggtgtctgaaacccagcacggtaccattctaataaaagtagagtataaaggtgaggacgcgccttgtaaaatcccattcagcacagaagatggtcaaggaaaagcgcacaatggtcgacttataacagcaaacccggttgttactaagaaagaagaaccagtgaacatcgaagccgaaccaccttttggagagtcaaacataataataggaataggtgataaagctctaaaaatcaactggtataagaaagggtctagtatcgggaaaatgtttgaagcgacagctagaggagctagaagaatggcaatattaggtgacactgcatgggactttggaagtgtcggcggagttttaaattcgcttgggaaaatggtacatcaaatattcggaagtgcatatactgcattatttagtggtgtttcctggattatgaaaatagggataggagtcttactaacatggataggcctaaacagtaagaacacatctatgtctttcagttgtatagtaataggaattattacactttatttaggagcagtagttcaagccgatatggggtgtgttataaactggaaaggcaaagaacttaaatgtggaagcggaatttttgtaactaacgaagtccatacatggactgaacagtataaatttcaagcagactcgccaaaacgcctggcgaccgccatagctggcgcttgggagaatggagtatgtggaatcagaagtactacaagaatggaaaaccttctatggaaacagatagcaaatgaactcaactatatcttgtgggaaaacaacattaaattgactgtcgtggtcggggacataacaggcattctcgagcaaggaaagaggacattaacacctcagccaatggaactcaaatactcttggaaaacatggggtaaagcgaaaatagtaactgcagagacacaaaatagttcattcattattgatggaccaaatacccccgagtgtccttctgctagcagagcgtggaacgtatgggaagtcgaagactatggtttcggagtcttcaccaccaatatatggttaaaactgcgtgaaatgtatactcagctctgcgaccataggctcatgagtgcagcggttaaagatgaacgagccgtgcatgcagatatgggctactggattgaaagtcaaaagaatggtagttggaaactggaaaaagcaagtctgattgaagttaaaacttgtacgtggcccaaaagtcacactctatggagcaacggagtattagaatctgatatgattatccctaaatcactagccggccccatatctcaacataattatagaccaggttatcacacacaaactgcaggcccatggcatttaggcaaactagaactagatttcaattactgcgaaggaacaacagtagttatcactgagaattgtggcactagaggtccctctctaagaactacaaccgtttcaggcaagctcatccatgaatggtgttgtagaagctgtacattgccaccattacgttatatgggagaagatggctgctggtacggaatggagataagacctattaatgaaaaagaggagaatatggtgaaaagtttagtttcagccggtagtggaaaggttgacaactttacaatgggagtactgtgtttggctattctttttgaagaggtaatgcgtgggaaatttggaaagaaacacatgatagctggtgtattgtttacttttgtactattactatcaggtcaaattacatggagagatatggcgcgtaccttaattatgataggaagtaacgcctccgatcgcatgggcatgggcgtcacatatctcgcgctgattgccacatttaagattcaaccctttttagctctagggttctttctaagaaagctgacatctagagaaaacttgctattgggtgttggtttggctatggccacaactctacagctacctgaagatatagaacagatggccaacggcattgctttgggattaatggcattaaaactgatcactcaatttgaaacctatcagctatggactgctttagcaagtctcatgtgctcgaatacaatttttactcttacagtagcatggcgaaccgcaaccttaatattggcaggtatatcattgcttccagtatgtcaaagcagttctatgaggaagacggattggttacctatgacagttgctgcaatgggggtcccacccttacctttatttatattctctctaaaagacacattgaagagaaggtcgtggccattgaacgaaggtgtaatggcagtaggcttagttagtatattagcaagctctttactacgtaacgacgtgcctatggcagggcctctcgtggcagggggtttactgatcgcatgttatgtaattacgggaacttccgcagatttaacagtggaaaaagcagcggatgtaacatgggaagaagaagctgagcagaccggtgtaagtcataacctaatgattacagtagacgatgacggaactatgcgtattaaggacgatgaaactgaaaatatactcacggtgctgttaaagacggccttgcttatcgtttccggaatatttccttacagcatcccagcaactctccttgtctggcatacttggcaaaagcagactcaaaggtcaggagtactttgggacgtaccttcaccacctgagacgcagaaagcagaactagaggaaggagtgtacagaattaaacaacagggaatatttggcaaaacccaagtaggcgtaggtgtacaaaaggaaggagtcttccacactatgtggcatgttaccagaggcgcagtgctaacccacaatggtaaaagattagaacctaattgggcatcagtcaagaaagacctaatcagttatggcgggggatggcgcctcagcgcacagtggcaaaaaggtgaagaggtacaagtaatcgcagttgaacctgggaaaaaccctaaaaactttcagacaatgcctggtattttccaaaccacaacaggcgaaataggagctatagccctggactttaagcctggaacgtctgggtctcctattataaatcgagaggggaaggtagttgggctatatggaaacggagtcgtaacaaaaagtggcggatatgtaagtggcattgctcaaactaacgctgagccagacggaccaacaccagagctagaagaagaaatgtttaagaaacgaaacctaaccataatggatttacatccagggtccggcaaaacacgaaaatatcttcctgcaatagttcgcgaagctataaagcggcggttacgcacattgattttagcgccgacccgagtagttgcggctgaaatggaagaagcattaaaaggcttgcctatccgatatcaaacgacagcaaccaaaagtgaacacacaggaaaagagatcgtagatctaatgtgccacgcaacattcacaatgcgtctactaagcccagtaagagtcccaaattacaatctgatcataatggacgaagcgcattttactgatccagccagtatagctgcaagaggatacataagcacaagagtaggtatgggggaagccgcagcaatatttatgacggcaactccgcctgggacagcggatgccttcccacagtcaaatgccccaattcaagatgaagaacgagatataccagagaggtcatggaatagcgggaacgattggattaccgacttcgctggaaagacagtctggttcgttccgtcgataaaagcaggaaatgacatagcaaactgcttgaggaaaaacggcaaaaaggtaatccaactttcgagaaagacgttcgacacagaatatcagaaaacaaaactaaatgattgggatttcgtcgtaacaactgatatcagtgagatgggcgccaattttaaagcagatcgtgttatcgacccgagaagatgtctaaagccggtaatactcacagatgggcccgagagggtgatactagccggaccgatgcctgtaacggttgccagtgcggcacagcggagaggtagagtaggacgcaatccgcaaaaagagaatgatcaatacatctttactggccaacctcttaacaacgacgaagatcatgcacactggaccgaagccaaaatgcttttagacaatataaatactccagaaggcataatacctgccttgttcgaaccggaaagagaaaaatctgcagcaatagacggtgagtatcggcttaagggcgaaagcaggaaaacctttgttgaactaatgagaagaggcgatcttcccgtatggttggcgcataaagtggctagtgaaggcataaaatatacagacagaaaatggtgtttcgatggagaaaggaataatcagatattagaggagaatatggacgtagaaatctggacaaaagaaggagagaagaagaaattacgaccgcggtggttagatgcccgtacctattcagacccattggcactcaaagaatttaaggatttcgctgcaggacgcaaaagcatagcgttcgaccttgtaacggaaataggaagggtcccctcacaccttgctcatagaacgcgaaatgctcttgataatttagtaatgctccatacgagtgaacacggaggtcgtgcctataggcatgcggtagaagagttaccagaaactatggagacactactactgcttggcctaatgatcttactaactggaggagctatgctgttccttatatcaggaaagggaataggtaaaacatcgattggattgatatgcgttgtagcctcttccggaatgttatggatggctgacattcctcttcaatggattgcaagtgcgatagtccttgaatttttcatgatggtactattaattcccgagccagaaaaacaacgaactccacaggacaaccaactagcttatgtggttattgggatactaacccttgcagcgattgtagctgcgaatgaaatgggattattagagaccactaaacgtgatctcggtatgagcaaagaacctggcgtggtctctcctacatcatatttagatgtcgatcttcatcctgcctcagcttggactttatatgctgtagctacaaccgtaattaccccaatgctaagacacactatcgaaaacagtactgcaaacgtgagcctggctgctatcgccaaccaagcggtcgttttaatgggtttggacaaaggttggcctatttcaaaaatggacctcggcgttcccttgttagcgcttggatgttatagtcaggtgaatcctttgacactaactgcagctgtattactcctggttacacattatgccatcataggaccaggtttacaagctaaagctacaagagaagctcaaaaacgtacagcagcaggtatcatgaaaaatccaaccgtggacggaataatgacaatcgatttagaccctgtgatctacgactctaaatttgagaagcaattgggtcaagtcatgttactcgttctatgtgctgtacaattattactgatgagaacgtcatgggcgttttgcgaagcactgaccttggctactggtccgatcaccacgctatgggaggggtcccctggcaaattttggaatacaactatagctgtcagcatggcaaacatctttagaggatcttatctagccggtgcagggttagccttctcaattatgaaatccgtgggaacagggaaaagaggaacaggatcccagggggaaactttgggcgaaaaatggaagaagaaactgaatcaattaagccgaaaggagtttgatctctacaagaaatccgggataaccgaagtagatcgcacggaagctaaagaaggcttaaagcgaggtgaaataacacatcatgctgtctcacgaggctctgctaaactacaatggtttgtcgagcgaaacatggttattccggaaggtcgggtaatagatttaggatgcggtcgagggggatggagttattactgcgcagggctaaagaaagtgacggaagttaggggctacacaaaaggaggtcctggtcacgaagaacccgtacctatgagtacctacggatggaatatagttaaactaatgagtggaaaagatgttttctatttacctcccgaaaaatgcgacacacttttatgcgatattggcgaatcttcgccaagtccaactgttgaagaaagtcgtacaatacgtgtattaaaaatggtggaaccttggttgaaaaacaaccaattctgcattaaggtactaaacccatacatgccgaccgtcattgaacatttagaacgtctacaacgcaaacacggaggaatgttagtcagaaatccactgtcacgtaacagtacacatgagatgtattggatttcaaatggaaccgggaatatcgtaagtagtgtaaacatggtctctagattactattaaatagatttacgatgacatacaggaggccaactatcgaaaaagatgtagacctaggcgctggaactcgacatgtaaatgccgaacctgagacacccaatatggatgtgataggggaacgtattaggcgtataaaagaagaacattctagtacatggcactatgatgacgaaaacccttataaaacatgggcttatcacggatcttacgaagttaaagcgacgggctcagcaagcagtatgatcaacggcgtagtaaaactgcttacaaagccatgggatgtagtacctactgtaacccaaatggccatgacagacactactccatttggacaacaaagggttttcaaagaaaaagtagatacaagaacaccaaaaccaatgcctggtactagaaaagtaatggagatcactgccgaatggttatggcgaacgctcggaaggaacaaaagaccaaggctatgtacacgagaagagttcacgaagaaagtacgcactaatgcggctatgggagcggtcttcacagaggaaaaccaatgggattccgcaagagcggctgttgaagatgaagagttctggaagttagtagaccgcgagagggaactccacaaattaggcaaatgcgggtcatgcgtttataatatgatgggaaaacgggagaagaaattgggtgaatttggtaaggcaaaggggtcaagagcaatttggtacatgtggctcggagcacgatatcttgaatttgaagcgttaggtttcttgaacgaagatcactggttctcaagagaaaatagctactcaggggttgaaggagaaggacttcataaacttggctacatattacgtgatatttcaaagataccgggtggagctatgtacgctgacgataccgctgggtgggacacgagaataacagaagatgatttacataatgaagagaaaataacacagcaaatggatccggaacacagacagttagcaaatgccatattcaagttaacctatcaaaataaagtggtaaaagttcaacggcccacgccgaaagggacggtaatggatataatctcccgtaaagaccagcggggtagtggccaggtaggtacttatgggctaaacacattcactaatatggaagctcaactaataagacaaatggaaggcgaaggcgttttgtcaaaaacagatttagaaaacccccacctattagaaaaacgaatcacccaatggctagaaacaaagggcgtagaacggttaaaacgtatggccatatccggcgatgactgtgtagtaaagccaatcgacgatcgttttgcgaatgcactcttggctttaaatgacatgggaaaggtaagaaaggatataccccaatggcaaccaagcaaaggctggcacgactggcaacaagtacctttctgtagtcaccacttccatgaactaataatgaaggacggccggaaattagtggttccatgtaggcctcaggatgaacttatcggcagagcaaggatatcccagggggccggatggtcattgaaagagactgcctgccttggaaaggcgtacgcacaaatgtgggctttaatgtatttccaccgtagggatttacgactcgcaagtaacgcaatatgctcagctgtcccagttcactgggtaccaacaagtcgtactacttggtccattcatgcacaccaccaatggatgacaaccgaagatatgttaacagtttggaacagagtatggattgaggataacccttggatggaagataaaacccccgtaacaacttgggaggacgttccatatctagggaaaagggaagaccaatggtgtggtagcctaataggactgacctccagagcaacatgggctcaaaatatcctaacagcaatccaacaagtgcgcagtttaatcggaaacgaagagtttctagattatatgccgagtatgaaacgatttaggaaggaagaagaatcagaaggggcaatatggtag

SEQ ID NO: 22990 - RNA, 9873 nt, synthetic construct
  misc_feature 1..9873: note = derived and/or modified CDS sequence (opt6) from DENV-3__JX669489__SS-prME
  source 1..9873: mol_type = other RNA
acaagtctatgtctaatgatgattctacctgcagcgctagcttttcacttaacaagtagagatggggaacctaggatgattgtaggcaaaaatgaaagagggaaatcattactatttaaaaccgccagtggaataaatatgtgtactctcatcgccatggacctaggagagatgtgtgacgacaccgttacgtataaatgccctcacataacagaagtagaaccagaagatatagattgctggtgtaatttaactagcacatgggttacttatggcacttgtaaccaagctggagagcgcaggagagataaacgttcagtcgctttggcaccccacgtagggatgggtctagataccagaacgcaaacatggatgtcggcagaaggagcatggcgccaagttgaaaaagtcgagacttgggctctaaggcatccaggatttaccatattagcattgtttttagcacactacataggtacgtctctaacacaaaaagtcgttatatttatacttctaatgctagtaacacccagcatgaccatgcgatgtgttggagtaggtaacagagatttcgtcgagggtctaagtggggcgacatgggttgatgtagttttggaacatggtggatgcgtaacaacgatggccaaaaacaaaccaacactagatatagaattgcagaaaactgaagctacacaactagccaccctacgtaaattgtgcatagaaggtaaaataactaatattacaacggatagtagatgcccaacgcaaggagaagcggtacttccagaagaacaggatcaaaactacgtatgcaaacacacttacgtagacagagggtggggtaatggttgtgggttatttgggaaaggatctctagtaacctgtgccaaatttcaatgcctggagccaatagaaggtaaagtcgtgcaatatgaaaatctaaaatatacagtaattataaccgtacacaccggtgaccaacaccaagtagggaatgagactcaaggggtcacagcagaaatcactccacaagcatcgactacggaagccatattaccagaatatggcacgcttggtctagaatgctcgcccagaacgggcctcgattttaatgagatgatcttactaaccatgaaaaataaggcttggatggttcataggcaatggtttttcgacttaccgttaccttggacttcaggggccacaaccgaaacgcccacctggaacagaaaagaactccttgtcacattcaaaaacgcacatgcgaagaaacaagaagttgtagtacttggctcccaagaaggtgcgatgcacaccgctttaacgggtgctaccgaaatccagaatagtggaggtacatctatcttcgccggccacctaaaatgcagattaaaaatggataaactcgagctaaaagggatgtcttacgcaatgtgtacaaatacatttgtgctcaagaaagaagtaagtgaaacccaacacggaactatattaattaaagtggaatatagaggggaagatgctccctgtaaaataccatttagcactgaagacggccagggaaaagcacacaatggaaggctaatcacggcaaatccggttgttacgaagaaagaagaacctgttaacatcgaagccgaaccgccctttggagaaagtaacatcgttatcggtatcggagataacgctttaaaaataaattggtacaagaaaggaagcagcattgggaaaatgttcgaagcaaccgctaggggcgcaagaaggatggcgatattaggagataccgcatgggacttcggcagcgtaggcggagtactaaattcgctgggaaaaatggtacaccaaatatttggatcggcttatacagctctattttcaggagtctcatgggtgatgaaaattgggataggggtattactcacttggatcggattaaatagtaaaaatacctcgatgagcttctcgtgcatagcaattggaattataactctctatctcggcgcagtagtacaggccgacatgggatgtgtgattaattggaaaggaaaagaactgaaatgcggaagtggaatatttgttacaaacgaggtgcacacatggacagagcagtacaaattccaagcagatagccctaaaagattggcaacggcaatagcaggcgcctgggaaaatggcgtttgtgggattcgatcaacaacgagaatggaaaatttactgtggaaacaaattgcaaatgagctcaattatatcctttgggaaaataacatcaaactaaccgtagttgttggggacattataggcgttctggaacaaggaaaacgaactttgacgcctcaaccgatggagcttaaatacagctggaaaacatggggaaaagctaaaattgtaactgctgaaactcaaaacagtagcttcataatagacggtcctaacacgccggaatgtccctcagcatctagggcttggaacgtgtgggaagtagaggattatggtttcggagtgttcacaacgaatatatggctaaaattgagggaagtttatacacaattatgcgatcatcgattaatgtcagctgccgtgaaagacgaaagggccgttcacgctgatatgggatactggatcgaaagccagaaaaatgggtcctggaaactggagaaggctagtctcatcgaagttaaaacgtgcacttggccaaaatcgcatacactgtggtcgaacggagtgctcgaatcagatatgattataccaaaaagtctcgccggtccgatttcacaacataaccacaggccgggatatcatactcagacagccgggccttggcacttgggcaaacttgaactagattttaattattgcgaaggcactacagtagtaataacagaaaattgcggtacacgtggtccctctcttcgaacaacaactgtatccggcaaattaattcatgagtggtgctgccgctcctgcactctacctcccttgagatacatgggcgaagatggatgttggtatggaatggaaatacgacccatttctgaaaaagaggaaaacatggtgaaatcgcttgtcagcgcgggaagcggaaaggtcgataacttcacgatgggggtactatgtttagcaattttgttcgaagaagtgatgcgcggcaaattcggcaagaaacatatgatagcgggggtgttgtttacatttgtgctacttctatcaggtcaaataacctggagagatatggctcacactctaattatgataggatcgaacgcgagtgaccggatgggaatgggagtaacttatctcgctctcatcgccacttttaaaatccaaccctttttggcgttgggattcttcttacgtaaattaaccagtagggaaaatctactcttaggtgtaggcctcgcgatggctacaactctgcaactaccggaagatatagaacagatagctaatggaattgcgttaggattaatggccctcaaacttataacacaatttgaaacataccaattgtggactgcattaatttcactcacttgctcaaatacgatgttcactttgactgttgcatggcgaacagcaacacttattttggctggagtgtccttattaccggtctgccaaagttcttcaatgagaaaaacggactggttacctatggcagttgccgctatgggggtaccaccattaccattatttatatttagcttgaaagacacattaaaacggagatcatggccactcaacgagggagtaatggcggtaggcctagtttcgatacttgcgagctcattactaagaaatgatgttccaatggcgggacccctagtagctggtggattactaatcgcatgttatgtgattacaggaacttccgcagatctgacagtcgaaaaagcggcggatataacttgggaggaagaagctgagcagacaggagttagtcataacctaatgattacggtcgatgatgacggaactatgcgaataaaagacgacgaaacagaaaacattttaacagttttgttaaaaaccgcacttctaatagttagcggcgtattcccgtattcaataccagccacgctcttagtgtggcatacttggcaaaaacaaacgcagaggagcggagttttatgggacgtaccaagtccacctgaaacacaaaaggctgaattagaggaaggagtatatcgaataaaacaacaaggaatatttggtaaaacccaggtaggtgtaggagtacagaaggaaggagtcttccacacaatgtggcatgttactagaggtgctgttcttacgtacaatggtaaacgtcttgagccgaactgggcgtctgtaaagaaagatcttatttcatatggtggtggatggagattaagcgctcaatggcaaaaaggagaagaagtacaggtaattgcagtggaaccagggaaaaacccgaaaaactttcagaccatgcccggaacatttcagactacgacaggagagatcggagcaatcgcgttagattttaagccaggcacgtcaggttcgcctataataaatcgcgaaggaaaagtggtaggactgtatggaaatggggtagtaacaaagaatggaggatacgtaagtgggatagcgcagactaacgcagaaccggatggaccaactccggaactagaggaagaaatgttcaaaaagagaaatctaacaatcatggatctgcatcccggatcaggaaaaacaagaaaatatctacccgccatcgtccgtgaagctataaaacgaaggctaaggacactaattctagctcccaccagagtcgtagccgctgaaatggaagaagctctaaaaggtctgcctataagataccaaactactgcaacaaaaagtgaacatactggacgggaaatagtcgatttaatgtgtcacgcgacgttcactatgcggttactttcacccgttcgagtaccaaattataatctaataatcatggatgaggcacattttacggatccagcttcgatagcagcaagaggatatattagcacacgagtaggaatgggagaagcagcagcaatattcatgacagcaacgccgcccggaacggcagatgcgttcccccagagtaatgccccaatacaagacgaagaaagggacattccagagaggagttggaactccggaaatgaatggatcactgatttcgcgggtaaaacagtatggttcgtaccctcaattaaagcaggaaatgacatagcaaattgcttgcgaaagaacgggaagaaagttatacaactaagcaggaaaacttttgacacggaataccagaaaacaaaactcaatgactgggatttcgtggtaacaacagatataagtgaaatgggagcaaactttaaagcggatagagtgatcgatccccgacgatgcttaaagcccgttatattgacggacgggcctgagagggttatccttgctgggcctatgccggtaacggcagcatctgctgcacaacgaaggggaagagtaggtcgaaatccgcagaaggagaatgaccaatacatatttactggtcaaccacttaataatgacgaagaccacgcgcactggactgaagctaaaatgcttctggacaatataaacacaccggaaggtatcatccccgccctatttgaaccagaacgggagaaatctgcagccatagacggggagtacaggctaaagggggagtcgaggaaaactttcgtggagctcatgagacggggtgatctacccgtttggttagctcacaaagtagcgtccgagggtattaaatatacagatcgaaaatggtgcttcgatgggcaaagaaataatcaaatactagaggaaaatatggacgtggaaatatggacaaaagaaggcgagaagaagaaactgagaccgagatggcttgatgcgcgaacttatagcgatccactagctctaaaagaatttaaagactttgcagcagggagaaaaagcatagcgcttgacctagtaacagagataggcagagtaccatcccacttggcccaccgtacaagaaatgctttagacaatctagtaatgctacatacaagcgaacatggaggacgagcatacagacacgcggttgaagaactaccagaaacaatggaaacattactattgctagggcttatgatactattgacaggaggagcaatgctctttctaatatctggtaaaggtataggcaaaacgtcaattggcctaatatgtgttatagcgagctcaggaatgttatggatggcagagattccccttcaatggatagcaagtgcgattgtactcgaatttttcatgatggtactattaataccggagccagagaaacaacgaacgccacaggacaaccagttagcttatgtagtcattggtatattgacgctggcagccataatagctgcgaacgaaatgggcctacttgaaacaactaaaagggatttaggaatgtctaaagagccgggtgtagtctcgcccacttcgtacctcgatgtggatctacacccagcatcagcatggaccctttatgccgttgcaacaaccgttataacaccgatgttaagacataccatcgaaaattcaacagcaaatgtatcgcttgccgctatagcaaaccaggcagtggttttaatggggttggataaaggatggccaatttctaaaatggatttgggtgttccactgttagcgctaggatgttatagccaagttaacccattgactttaactgccgctgtgttgctattaataacccactatgcaataattggaccagggttacaagcgaaagctacacgagaagctcaaaagcgcacagcagcgggtatcatgaaaaatccgacagttgatggtataatgacaatagatttggatccagtcatctatgatagtaaattcgaaaagcagctaggacaagtaatgttattagtactatgcgcggtacagctacttcttatgaggacgtcttgggctttatgcgaagctctcacacttgcgacagggccgataaccacgctatgggaaggctctcctggaaaattctggaatactacgatagctgtgtccatggctaacatctttagaggatcatatctagcaggggccggtctcgccttcagcataatgaaaagtgttggaaccggaaagagaggaactggcagccaaggagaaactttaggagaaaaatggaagaagaaattaaatcagctatctaggaaagagttcgatctctataagaaatctggtatcacggaagttgacagaacggaagcaaaagaaggcttaaaacgtggggaaataacacaccatgctgttagcagaggtagcgccaaattacagtggtttgtagagcggaatatggtgatacccgaaggacgggtaatagatctcggttgcggacgaggaggttggtcgtattactgtgcagggttgaagaaagtaacggaagttcgcggttacacaaaaggagggccaggacatgaagaaccggtacctatgtctacgtacgggtggaacatcgtaaaactcatgagtggtaaggacgtattttatctcccacctgaaaaatgtgacacattattatgtgatatcggagaatcgagccctagtccgacagtagaagaatcgagaacaatacgagtactaaaaatggtcgaaccgtggctcaaaaacaaccaattctgtataaaggtcctaaacccttacatgcctacggtgattgaacatttagaaagacttcaaagaaaacatggtggaatgcttgtacgcaacccattaagtcgaaactcgacccatgaaatgtactggattagcaacggtacaggtaatatcgtcgcgtccgtaaatatggtttctagacttttgctcaatcgatttacaatgactcatagaagacccacaatagaaaaagatgtagaccttggagctgggacacggcatgtaaacgccgaaccagagacgcctaatatggatgtaattggggaaagaataaagagaattaaagaggaacacaatagtacatggcactatgacgatgaaaacccatacaaaacatgggcataccacggcagctatgaagttaaagctacgggcagcgcaagcagcatgatcaacggggtagtaaaactattaacaaaaccttgggatgtagttcctatggtaacgcaaatggctatgacggatactactcctttcggacaacaacgggtatttaaagaaaaggtggatacaagaacaccacgttcaatgcctggtactagaagagtaatgggaattacggctgagtggctgtggcgaacactaggtcgtaacaagaaacccagactatgtacaagggaggaatttactaagaaagttagaacaaacgcagcaatgggcgcagtattcacagaagaaaaccaatgggatagcgctaaagcggcagttgaagatgaggatttctggaagctagtagacagagaacgtgaactacataaactaggaaaatgcggcagctgtgtatacaatatgatgggaaagcgagagaagaagctaggagaatttggcaaggcaaaaggaagtcgagcaatttggtacatgtggttaggggcgagatatctggagtttgaagcgctaggctttctaaacgaagatcactggttcagtcgagaaaattcatattctggagtagaaggtgaaggcctacacaagttaggatacattctacgagacatcagcaaaattccaggtggagctatgtatgcagatgatactgccggatgggacacaagaatcacagaagatgaccttcacaatgaagaaaagataactcaacaaatggatccagaacaccgacaattagctaatgccatttttaaactgacataccaaaataaggttgtaaaagttcaacgcccaactccaactggtactgtaatggacattataagtagaaaggaccaaaggggttctggtcaggtcggcacatatggcctaaacacttttacaaacatggaagctcaattgattagacaaatggaaggggagggagtcctctcaaaagctgatttggagaatccacatcttccggagaagaaaatcacgcaatggctagaaactaaaggtgtagaaagattaaagcgtatggcaatttcgggagatgattgcgtagtaaagccaattgatgataggtttgcgaatgcattgttagctttaaacgatatgggaaaagtgagaaaagatataccgcaatggcaaccctcaaaaggatggcatgattggcaacaagtacccttctgcagccaccattttcacgagttaataatgaaggacggccgaaaattggtagtaccttgtagaccccaggacgaactaattggtcgggcaaggatttcacaaggtgccgggtggagtttaagggaaacagcatgcctaggcaaagcctatgctcaaatgtggtcattgatgtattttcatagacgagacctcagacttgcgtccaacgcaatatgctctgcagtccctgtacattgggtgccaacatcaagaacaacatggagcattcacgctcatcaccaatggatgaccaccgaagatatgctaacggtatggaatcgggtatggatcgaagacaacccatggatggaggataaaaccccggttacaacctgggaaaatgtgccctatttaggcaaaagagaagatcaatggtgcggatcgttgatagggcttacatcaagagcgacatgggcccaaaatatacctacagcaattcaacaggtccgcagcttaatcggaaacgaggagtttttagattacatgcctagtatgaagcgattcagaaaagaagaggagtccgaaggtgcaatttggtga

SEQ ID NO: 22991 - RNA, 9873 nt, synthetic construct
  misc_feature 1..9873: note = derived and/or modified CDS sequence (opt6) from DENV-3__JX669498__SS-prME
  source 1..9873: mol_type = other RNA
acatcgctatgcctaatgatgatactaccagcagcattagcgtttcacttgacttcaagagatggtgaaccaagaatgatagtgggcaaaaatgaacgcggaaaatccctactcttcaaaaccgcatcaggaataaatatgtgcacactaatagctatggaccttggcgagatgtgcgatgatacagtcacttataaatgtccacacatcacagaagtggaacccgaagatattgattgttggtgcaatctcacgtctacctgggtaacatatggtacctgcaatcaagcgggggagcgtagacgcgacaaacgttctgtggctttagcaccacatgtaggtatgggcctagatacaagaacgcaaacgtggatgagtgcagaaggagcatggcggcaagtagagaaagtagaaacatgggctttaagacaccccggttttacaattttggctctatttcttgcccactacattggcacaagtttaacccaaaaagtcgtaatttttatactattaatgttggtaactccgagtatgacaatgaggtgcgtaggtgtaggtaaccgggactttgtcgaaggcctctctggggccacctgggttgatgttgtattagaacacggaggttgtgttaccacaatggctaaaaataaaccaacattggatattgaattacagaaaacggaggctacacaattagcgacgctaaggaaattatgtatagaaggaaaaatcaccaatataacaacagactcacgatgtccaacacaaggtgaagccgtactgccagaagaacaagaccaaaactatgtctgcaaacatacctacgttgatcgtggatggggaaacggatgtggtctgtttggcaaaggcagcttagtaacatgtgcaaaatttcagtgcttagaatcgatagaaggaaaagtggtacaatatgagaacttgaaatatactgtaattattaccgtacacacaggtgaccaacaccaagttggtaacgaaacgcaaggcgtaactgcagagataacaccacaagcgtcgactactgaagcaattctcccagaatacggtacattaggattagagtgtagcccaagaacaggattggattttaacgaaatgattcttttaacgatgaaaaacaaagcctggatggttcataggcagtggttctttgaccttccacttccatggaccagtggcgcaacaacagaaacacctacctggaatagaaaagaacttcttgtcacgttcaaaaatgctcacgccaagaaacaagaggtcgtggtcctgggttcgcaagaaggagccatgcacacggcattgaccggtgccacagagattcaaaacagtggagggacatcgatctttgcaggccacttaaaatgccgactaaaaatggataaacttgagttaaagggcatgagctatgctatgtgcactaatacatttgtactcaagaaagaagtaagcgaaactcaacacggcacaattctgataaaagttgaatacaaaggtgaagatgctccatgtaaaataccattttcaacagaagatggccaaggaaaagcgcataacggaaggttgataacagctaatcctgtagttactaagaaagaagaaccagtgaacatagaagcagaacccccatttggcgaatcaaatattgtgataggtacaggagataacgcccttaaaattaattggtataagaaaggcagctcaataggcaaaatgttcgaagctacggcaagaggagcccgaagaatggctattttgggagacacagcttgggactttgggagtgttggaggagttcttaattcgttaggaaaaatggtacatcaaatattcggctcggcctacacagcactattcagtggagtaagttgggtaatgaaaataggaataggagtattgttgacttggataggactaaacagcaaaaatacttctatgtcattctcatgtatagccatagggattataacgctttacttgggtgctgttgtacaagcagacatgggatgcgtcattaattggaaaggtaaagaactgaaatgcggatcgggaatctttgttaccaatgaagtgcatacatggaccgagcagtataaattccaagctgattctcccaaacgccttgcaactgctattgcaggagcgtgggaaaatggcgtatgtggtataagaagcaccacccgaatggaaaacttgttgtggaaacagattgcaaacgaactaaattacatactttgggaaaataacataaaattaacagtcgttgtaggtgatatcataggcgtattagaacaaggaaaacgcacattgacgccacagccgatggaactcaaatactcgtggaaaacgtggggaaaagctaagatagtcactgccgagacacaaaattccagcttcataatagacggaccaaacacaccagagtgtccatcagctagtcgtgcttggaatgtctgggaagtagaagattatggattcggggtgtttaccacgaatatatggctgaaattgagagaagtgtacacacaattatgtgatcacaggcttatgtctgcagccgtcaaagatgaacgagctgtccatgctgacatgggttactggatcgagagccagaagaatgggtcatggaaactggaaaaggcatctcttatagaggtaaaaacttgcacgtggcctaagtcacatacgctctggagtaatggggttttagaaagcgacatgattatacctaagagtctagctgggcctatatcccaacacaatcacagacctgggtaccatacacagactgcagggccatggcatttgggtaaactagaattagattttaattattgtgaaggaacaacggtagtaataacagaaaattgtggtacaaggggcccatcattgagaacgaccacagtgtctggaaaacttatacatgaatggtgttgtcgatcatgtacactaccgccactaaggtacatgggcgaagacgggtgttggtatgggatggaaatacgacctataagtgaaaaagaggaaaacatggtaaaatcccttgtatccgctggttccggtaaggtggataatttcacaatgggagtactttgtttagccattttatttgaggaggtaatgagggggaagttcggaaagaaacatatgattgcaggagtgtttttcacctttgttcttttgttatcaggtcaaatcacatggagagacatggcgcacactcttataatgataggatctaatgcatcagatcgaatgggaatgggcgtgacctatttagcccttatagctacattcaaaatacagccattccttgctctggggttctttctaagaaaactaacctctagagaaaatcttctattaggagtcggacttgcaatggcgacaacattacaattacctgaagatatagaacaaatggccaatggaatcgccttaggcctgatggcattgaaactaataacacaattcgaaacatatcaattatggacggccttaatatcacttacatgtagtaacaccatgtttacactaacagtagcatggcgaaccgcgactttaatcctagcgggcgtatcgttattgcctgtctgtcaatcatcgtctatgcggaagacagactggttacccatggcagtggcagcaatgggggtgccacccttaccgttatttatattttcattgaaggatactctaaaacgaaggtcttggccccttaatgagggagtaatggcggtagggctggtttcaattctggcatcgagcttgttaagaaatgatgttccaatggccgggccattggtagcaggcggtttattaatagcatgttatgtgattacgggaacctcggcggatctcacagtagaaaaagcagcagacattacatgggaagaagaggcagaacagacgggtgtaagtcacaatttaatgataacggtagatgacgacgggacgatgcgaatcaaagacgatgaaaccgaaaacatactcacagttcttcttaagacagcgctgctaattgtcagtggcgtatttccttacagtatacctgcaacattgctagtgtggcatacatggcaaaaacaaacgcaacgatccggcgtgttatgggatgttcctagccctccagaaactcaaaaagcagaactggaagagggagtgtaccgaataaaacaacagggcatctttggaaaaacccaagtcggtgtgggggttcagaaagagggtgtgtttcacacaatgtggcatgtaacaagaggagcagttctaacgtacaatggtaaaagactagagcccaattgggcgtccgtgaagaaggaccttattagttatgggggcggatggaggttatccgcacaatggcaaaaaggagaagaagtgcaagttattgcagtcgaacctggcaagaaccccaaaaattttcaaacgatgcctggcacattccaaacaacaacgggagaaattggtgcaatagcattggatttcaagccaggaacgtccggtagccctataattaacagagaaggtaaagtggtcggcctctatggaaacggagtagttaccaaaaacggcggttatgtatctggcatagcacaaacaaatgctgaaccagacggaccgacgccggagttagaggaagaaatgtttaagaaaagaaatctaacaattatggatcttcatcccggatccggcaagacccgtaaatatcttccggcaatagtaagagaggcaattaaacgcagattaaggactttgatcttagcccccacaagggtagttgcagcagaaatggaagaagccctcaaagggcttcccatcagatatcagacgacagcgacaaaaagcgaacatactggtagggagattgttgacctgatgtgtcacgcgactttcacaatgcgcttattgagtccggtgcgtgtccctaattataaccttataattatggatgaagcacacttcacggacccagcgagtatagctgcacgaggatatatttctactagagttggaatgggagaagcagcagcgattttcatgacagcaaccccaccagggacagctgacgctttcccacaatcaaatgcacccatccaagatgaagaacgtgatatcccagaaagatcatggaactccggaaacgaatggataaccgattttgccggaaaaacagtatggttcgttccctccattaaggcgggaaatgatatagcaaactgcctacgtaaaaacggaaagaaagtcatacaattatcgcgaaaaacctttgatacggaatatcagaaaacaaaacttaatgattgggatttcgtggtaactacagatatttccgagatgggagcaaattttaaagcagatcgagtgatagacccaagaagatgtctaaaacctgtaatactcactgacggacctgaacgcgttatcctagcaggaccaatgccagtaactgctgctagtgcagcacaaagaagagggagggtcgggaggaacccacaaaaggaaaacgatcaatacattttcactggccaaccgcttaacaatgatgaagatcatgcgcactggaccgaagcaaaaatgttactagacaatatcaacacacccgagggaattattccagcgctatttgaaccagaaagagaaaaatcggcagccatagatggcgaatatagactaaaaggagaaagccgtaagacattcgtggagctaatgagaagaggcgacttacctgtgtggctagcacataaagtcgcgagtgaaggaattaagtataccgaccgaaagtggtgcttcgatggccagcgaaataatcagatacttgaggaaaacatggacgttgagatctggacaaaggaaggggagaagaagaaattacgtccgagatggttggacgccaggacctactctgaccccctcgcattaaaagaatttaaagacttcgctgcaggacgaaaaagtattgctctagacctagtcactgaaattggccgtgtaccctctcaccttgcacatagaacacgcaacgctttagataatctagttatgttacatacaagtgaacatggaggcagggcttatagacacgcggtagaagaattgcctgaaactatggaaaccttactcctattaggattgatgatattactgacgggaggagctatgctatttctcatctcaggtaaaggcataggaaaaactagcataggcttaatatgtgtcatagctagttccggtatgttatggatggctgaaattcctttacaatggatagcatctgcaattgtattagaatttttcatgatggtactgttaatccctgaacccgaaaagcagagaacgccacaagacaaccagctggcatatgttgtaattggcatattaacactggcggccatcattgctgctaacgaaatgggcctcttagagacaacgaaaagagatttgggtatgtcaaaagagcctggggttgtaagccctacgtcatacttggatgttgatcttcatcccgcctcagcatggacactatatgcagtagcgaccacggtaataacaccaatgctccgtcataccatagaaaatagcacagctaatgtaagtttagctgcaatagccaatcaagcagtggtactaatgggcttagacaagggctggccgatttcaaagatggatctcggagtacctttactagcattagggtgctattcacaggtaaacccattaacattaacagcggcagtactcttattaattacacactatgcgataatcggacctggtttacaagcaaaagcaacacgagaggcccagaaaaggacagcggccggaattatgaaaaatccaacagttgatggaatcatgaccatagatctcgaccccgtaatttatgattcaaagtttgaaaagcaattaggccaagtaatgttgctagtgctatgtgcagtccagctgctattaatgcgtacatcctgggcattgtgtgaggccttaacacttgctacaggccctatcaccacattgtgggaaggaagcccgggaaaattctggaatacaacaattgcagtaagcatggcaaatatctttagaggctcatacttagcgggcgccgggctagcattttcaatcatgaaatcagtagggaccggtaagagaggaacaggctcacaaggtgagacactaggagaaaaatggaagaagaaattgaatcaactgtcaaggaaagagtttgacctctataagaaatccggtataactgaggttgacaggacggaagctaaagagggtctaaaacgtggtgaaataacgcatcatgcagtttcacgggggtctgccaagttacagtggtttgtcgaaagaaatatggtaatacccgagggaagggttatagatctcggctgtggccgtggaggatggagctattactgtgccggtttaaagaaggtaacagaggtccgtggttacacaaaaggaggacccggccatgaggaaccggttccaatgtcaacttacggatggaacattgttaaactgatgtccggaaaagacgttttctatttaccaccggagaaatgtgatacactcctatgtgatatcggcgaaagttcaccatcaccaactgtcgaggaatcccgaacaattcgcgttttaaagatggttgagccatggctgaaaaacaaccaattttgtattaaagttctcaacccttatatgccgacggtaatagaacacttggaaagattgcaacgaaaacatggcgggatgttagtaagaaatccgcttagcagaaactctacgcacgaaatgtactggatatctaacggcacaggcaatatagttgcaagtgtaaatatggtcagcagattactgttgaataggttcacgatgacgcatcgacgccccacgattgaaaaagatgtagacttaggagcagggacaagacacgtaaatgccgaaccagaaacgccaaacatggatgttattggagaaagaattaaacgaataaaggaagaacataactcaacatggcactacgatgacgagaatccatacaagacatgggcctatcatggaagttatgaagtaaaagcgacagggagtgcctcatcaatgattaatggagtagttaaactcctcacgaaaccatgggatgtagtaccaatggtcacccaaatggcaatgacagataccacacctttcggacaacaacgtgtatttaaagaaaaagttgataccagaaccccaagaagtatgccgggcacacgaagagtcatgggcatcactgcagaatggttgtggcgtacgttaggtcgaaataagaaacctcgtctatgcacccgagaggaatttaccaagaaagtcagaacaaacgctgcgatgggggcagtcttcacagaggaaaatcaatgggatagcgctaaagcggcagtggaagatgaggatttctggaaacttgtagatcgagaaagagaattacataagctgggaaagtgtggaagttgtgtatataatatgatgggaaagcgggaaaagaagttgggtgaatttggaaaggccaaaggatcaagagcaatatggtacatgtggcttggcgcacgatacttggaatttgaagcactaggatttctgaacgaagatcattggttttctcgagaaaactcgtattctggagtcgagggtgaaggtctgcataaattaggatacatactccgcgatatcagtaagattccgggcggtgcgatgtacgcagatgatacagctgggtgggacacccggatcacagaagacgacttacacaatgaagagaaaatcacccaacaaatggacccagagcacagacagctggcgaacgcgatatttaaattaacctatcaaaataaagttgttaaagtacaacgcccgacgcctactggaacagttatggatataatatctaggaaagatcagagagggtcaggacaggttggtacctacgggctcaacacatttaccaacatggaagcacaactcatcagacagatggagggagagggcgttttaagtaaagccgatctagaaaacccccaccttccagaaaagaaaatcacacaatggcttgaaacaaaaggtgtcgaacgactaaaacggatggcaatttcgggtgacgactgtgtggtcaaacctatagatgatagatttggaaatgcactgctcgcactcaacgatatgggtaaagttcgcaaagacatacctcaatggcaaccaagcaaaggctggcacgactggcaacaagtaccgttctgtagccatcatttccatgaactaataatgaaagacggacgaaagctagttgtcccatgccgcccacaagatgaattaattgggagggcacggataagtcaaggagcaggttggagcttgcgtgaaacagcctgcctaggaaaagcatatgctcaaatgtggtctttaatgtactttcaccgaagagacctgagattggcatcaaatgcgatttgtagtgcagtaccagtacattgggtaccgacaagtaggacaacctggtctatacatgctcatcatcaatggatgactacagaagatatgttgaccgtctggaatagagtatggatcgaggacaacccatggatggaagacaaaacaccggtcacaacctgggaaaacgtaccatacctcggaaaaagggaagatcagtggtgtggatcattgattggtctcacctctcgagcaacctgggcacaaaatataccgacagccatacagcaagtacgctccttaattggaaatgaagagttcttggattatatgccttcaatgaagcgatttaggaaagaagaggaaagtgaaggggcgatttggtaa

SEQ ID NO: 22992 - RNA, 9873 nt, synthetic construct
  misc_feature 1..9873: note = derived and/or modified CDS sequence (opt6) from DENV-3__KF954946__SS-prME
  source 1..9873: mol_type = other RNA
accagcttatgtttaatgatgattctaccagcagccttggcatttcacttaacatcaagggacggagaaccgcgaatgatagtaggtaaaaatgaaaggggtaaatcattactttttaaaactgccagcggtataaatatgtgtacattaattgcaatggatttaggagaaatgtgtgatgacactgttacttataaatgtcctcacattactgaagtagaaccagaagacatagactgctggtgcaatttaacatcgacatgggtgacatatggaacgtgtaaccaagcaggagaacatagaagggacaaaaggagtgttgcgttagccccacacgttggcatgggccttgacacacgcacgcaaacctggatgtctgccgaaggagcgtggaggcaagtagaaaaagtagaaacttgggcgctgagacaccctgggtttaccatattagcgctctttctagcacattatatcggaactagcttaacgcaaaaagtagtaatatttattttgttgatgttggtgacaccaagtatgactatgagatgtgtaggagttggaaatcgagacttcgtagaaggcttaagtggtgccacatgggttgatgtagtactggaacatgggggatgcgtaactactatggccaaaaataaaccaactttggacatagaacttcagaaaaccgaagctacgcaacttgcgatattgagaaaattatgcatagaaggcaaaataactaacataacgactgattctaggtgcccgacacaaggcgaagcggttctacctgaggaacaagatcaaaattacgtctgcaaacacacatatgtagatagaggttggggtaatggttgtgggctgtttgggaaagggtctttggtgacatgtgcaaaatttcaatgccttgagccaattgaaggaaaagtagtacaatatgagaatctaaaatataccgttatcataacagtccacaccggagatcaacatcaagttgggaacgaaactcaaggaataacagctgagattacgccgcaagcctccactacagaagcaatactgccggaatatggcacactggggttagaatgttcaccaaggactggtttagattttaatgagatgattcttctcacaatgaaaaataaagcctggatggtgcatagacaatggttctttgatttgccacttccctggacatctggagcaactacagagacacctacttggaataggaaagagctattggtaacctttaaaaatgctcatgccaagaaacaagaagttgtggtacttggaagtcaagaaggagctatgcacacagccctcacgggcgcaactgaaatccaaaactccggcggaacttcgatctttgctgggcatttaaaatgtagattaaaaatggacaagttagaactcaaaggtatgagttacgcaatgtgtacaaacacctttgttctaaagaaagaagttagtgaaactcaacatggaactattctaataaaagtagaatacaaaggggaagacgccccctgtaaaatacctttttccactgaggatggtcaaggaaaagcacataacggtagactgataacagccaacccagtggttactaagaaagaagaacctgtcaatatcgaagcagaacctccgtttggagaatccaatatcgtcataggaattggtgacaacgctttgaaaatcaattggtataaaaagggaagctcaataggcaaaatgttcgaagctaccgctcgaggtgcccggcgaatggcaattctaggcgacacagcttgggattttggatcagtgggcggggtattaaactcactgggaaaaatggtacatcagatttttggaagtgcctatacagcattgttttctggggtatcatgggttatgaagataggaatcggcgttttattaacctggattggactaaactctaaaaatacatccatgtccttcagctgcattgccataggaattattaccttatacttaggtgccgttgttcaagctgacatgggctgtgtaataaattggaaagggaaagaattgaaatgcggaagtggaatttttgtaacaaacgaagttcatacttggaccgagcaatataaatttcaagccgactctccaaaacgtctagctactgcaatagtcggtgcgtgggaaaatggagtgtgtggaatacgaagtacaaccagaatggaaaatttactttggaaacaaatagcgaacgaattaaactatatcttatgggaaaacaacattaaattaacagtagtagtaggagatacaattggtgtattagaacaaggaaagagaacactcacaccccaaccaatggagctgaagtattcctggaaaacttggggaaaagcaaaaatagtaacggcagaaactcaaaacagttccttcattattgatggacctaatactccagaatgcccttccgctagcagggcttggaacgtctgggaagtagaagattatggcttcggggtattcacaactaatatatggttgaagttgagagaggtatacacgcaaatgtgcgatcatagattgatgagtgctgctgtcaaagatgaacgagcagttcacgcagatatgggctactggatcgaaagccagaaaaacggatcgtggaaactagagaaggcgagccttatagaagtaaagacctgtacgtggccaaagtcgcacaccctttggtcgaacggcgtgctagaatcagatatgataataccaaaatcattggcaggtccaattagccaacacaactacagaccaggatatcatacccagacagctggtccttggcatcttggaaagctagaactagatttcaattattgtgaggggacaacagtcgttattacagagaattgcggaactcgcggaccaagtctaaggactaccacggtatctggaaagctcatacatgaatggtgttgcagatcctgcactttgccaccacttcgatacatgggagaagatggatgttggtatggcatggagatcaggcctatcagtgagaaagaggaaaatatggttaagtctttggtgagtgcaggttctggtaaagtagacaattttaccatgggcgttctatgtctcgccattctttttgaagaagtaatgagggggaaatttggtaagaaacatatgatagcaggagtattcttcacttttgttctactcctatcgggacaaattacatggcgggatatggcacacactttaattatgattggtagtaatgcatcggatagaatgggtatgggagtgacctacttagctctaatcgcgacgtttaaaattcaaccttttcttgcccttggcttctttctaagaaaacttacctctagggaaaatttattactcggtgtaggtttggcgatggccacgaccttacaactaccagaagacatagagcaaatggcaaatggaatagctctaggtctaatggcacttaaactcatcacacaattcgagacataccagttatggaccgcacttatttccttgacatgtagtaatactattttcacactaaccgtggcgtggaggactgcaaccttaatcctagccggagtttctctcttacctgtatgtcaatctagtagtatgcgtaagaccgattggctgcctatgacagtggcagcgatgggagttccaccactaccgttatttatatttagtttgaaggacactctcaaaaggagatcctggccattaaacgaaggcgtaatggctgtaggtcttgtatcaatgcttgcgtcatctttattaaggaatgacgtgcccatggccggacccttagtagcgggaggcttacttatagcatgttacgtaataactggcaccagtgcagatctaacagtagaaaaggcagctgatgtaacgtgggaagaggaagccgaacaaaccggagtgtcccataatcttatgataactgttgacgatgacgggacaatgcgtataaaagatgacgaaacagaaaatatattaaccgttttgctcaaaactgcactgctaattgtgagtggaatcttcccttacagtatccccgccacgcttctagtatggcacacatggcaaaaacaaactcaacgttcaggagttttatgggatgtacctagccctcctgaaacccaaaaagcagaattagaggagggcgtatacaggattaaacaacaaggtatattaggaaaaacacaagtaggcgtaggagtgcaaaaagacggtgtatttcataccatgtggcatgtcactcgaggcgccgtattaacgcacaatggaaaacgtcttgagccgaattgggcgtcagtcaagaaagatctaataagctatggaggaggctggaggttgtctgctcagtggcaaaaaggtgaagaagtccaagtcatagctgtagaacctgggaagaaccccaaaaatttccaaaccatgcccggaacttttcaaacgaccactggtgaaataggtgcaatagcattagacttcaaaccaggaacgagtggttctccgattattaatagagaagggaaagtcgtaggattatatggcaatggagtagtaactaaaaatggcggctacgtatcaggaatagcacaaacaaacgcagagccagatgggccaacaccagaattggaagaagagatgtttaagaaaaggaatcttacaatcatggatttacatccaggaagcgggaaaactaggaagtatttacccgcaatagttcgggaagcaataaagaggaggttgcgtacgttaattttagcccccactcgagtagttgctgcagaaatggaggaagcattgaaaggattgccgattcggtatcagactacagcaactaaatcagaacatactggtcgcgagatagtcgacttaatgtgtcacgcgacatttaccatgagactattaagcccagttagggtcccaaattataatttgattatcatggatgaagctcattttactgatcctgcttccattgccgcaagaggttacataagcacgagggttggaatgggagaagccgccgccatctttatgacagccacgcctccagggactgcggacgcatttccacaatctaatgccccaatacaggatgaagaacgtgatatacccgagagatcctggaacagcggaaacgagtggataacagatttcgcaggaaaaacagtatggtttgttccatcgattaaagctggtaacgatatagccaactgccttcggaagaacggaaagaaagtaattcaattaagccgaaagacatttgacacagaataccagaaaacaaaactaaacgattgggatttcgtggtaacaaccgacatttcagaaatgggagccaacttcaaagcggacagagtcattgaccctcgccgatgtttaaaaccagtaattctcaccgacggtcccgaaagagtcatactcgccggtccgatgccggtcacagcagcatcagcggcccaaaggaggggacgtgtgggccgaaacccgcaaaaggaaaacgaccaatacatctttacaggtcaacccctaaataacgatgaagatcacgcccattggaccgaagccaaaatgttacttgataacattaatacacctgaaggcattatacccgcattattcgaacctgaacgcgaaaagtctgctgctatagacggagagtaccgcttaaagggggaaagccggaaaacttttgtagaactcatgagaagaggggacttgccagtgtggttagcacataaagtagcgagcgagggcataaaatatacagatcgtaaatggtgcttcgacggtcaacggaataatcagatattggaagaaaatatggacgtggaaatttggacaaaagaaggtgagaagaagaaacttcgtcctagatggttagatgctagaacatattcagacccactcgccttaaaagaatttaaagacttcgcagccggccgcaaatccatcgctctagacctggttacagaaataggtcgcgtaccttcgcatctcgctcaccgtacgagaaatgcgctggataatttagtaatgcttcatacaagcgaacatgggggacgtgcttatagacatgcagtagaagaactaccggaaacgatggaaacacttctactcttgggcttaatgatcttactgacaggcggtgcaatgttatttctcattagtgggaaaggaatagggaaaacaagtattggcctgatttgtgttatagcatcctctggaatgttatggatggcagaaattcccttacaatggatagcaagcgccatagtcttagagttcttcatgatggtacttttaattccagaacccgaaaaacaaaggactccgcaagataaccaactagcctatgttgtgataggtattttaactatggcagcaatcattgctgcaaatgagatgggtctactagaaacaactaaaagagatttaggaatgagcaaggaacctggagtcgtctcaccgacttcatacctggatgtagatcttcatccagcttccgcctggacattgtacgcggtcgccacgacggtcataacacctatgttaaggcatacaatagaaaactctaccgccaacgtctcgctggctgctatagcgaatcaagcagttgttttacttgggctggataaaggttggccgatatctaagatggacttaggcgtgccactgttagctcttggttgttactcccaagttaacccgttaacattaacagctgctgttctattactggtaactcactatgctataattggtcccggcctccaggcgaaggcaacgcgggaagcgcaaaaacgcacagcggcaggaattatgaagaatcccaccgttgacgggattataactatagatttagatcccgtaatctatgacagcaaattcgaaaagcaactagggcaggtaatgctacttgtcctatgtgccgtccaactattactcatgagaacaagctgggcactctgcgaggcattaactttagccaccggtccaatcaccacactttgggaaggatcgccaggtaagttctggaatacgactattgcagtctcaatggcaaatatatttcgaggcagttatctcgcgggggctggtctagcattcagtataatgaaatcagttggtacaggtaaacggggcacaggaagccaaggagaaacactaggtgaaaaatggaaaaagaaattgaatcaattaagtagaaaagagttcgacctatacaagaaaagtggaataactgaggttgacagaaccgaagcgaaagagggcttgaaaagaggggaaacaactcaccatgcggtaagtcggggtagcgcaaagttgcaatggttcgtggagcgcaatatggtaatccccgaaggccgagtaatcgatttgggatgtggtcggggaggctggtcctattattgtgcaggcctgaagaaagtgacagaagttagaggctatacaaaaggaggccctggccatgaagaaccagtgcctatgagcacctacggctggaatatagtaaaactgatgtcaggcaaagatgtattctatttaccaccggaaaaatgtgatacgctattatgtgacattggtgaatctagccctagtcccacagtagaggagtcacgaactattcgagtccttaagatggtagaaccatggcttaaaaataatcagttttgtattaaagtattaaacccatatatgccagcagttattgaacacttagagcgactgcaacgaaagcatggaggaatgctggtcagaaatccactaagcagaaattctacccatgagatgtattggatttcgaatgggacggggaacatagtttctagcgtcaacatggtaagtaggttattgttaaatagatttacgatgacacatagaagaccgacaattgaaaaagatgtagacctcggagccggaacaagacatgtaaatgccgaacctgaaacacctaatatggatgttattggtgaacgaataaaaagaataaaggaagaacataattcaacatggcattatgatgatgaaaatccatacaaaacatgggcttaccacggaagctacgaagttaaggctacaggctcagcctcgtccatgataaatggtgtagtaaaattattaaccaagccctgggatgtagtcccaatggttacccaaatggccatgacagacacaacaccatttgggcagcaacgagtattcaaggagaaggtcgatacaagaacaccaaggccaatgccaggaacaagaaaagttatggaaataactgcagaatggttgtggaggaccctgggacgaaacaagagacctcgtttatgtacacgggaagagtttactaaaaaggttcgtacaaatgctgcaatgggagcagtattcacggaagagaaccagtgggacagtgcaaaagcagcggtagaggacgaagagttctggaaactggtggaccgcgaaagggagctacataaactaggtaaatgtggatcatgcgtatataatatgatgggtaagagagagaagaaactcggtgagttcggaaaggcaaaaggatcgagagctatttggtacatgtggttaggggcacgatatctagaatttgaagccctaggatttttaaatgaggatcattggtttagtcgcgaaaatagctactctggggtagaaggcgaaggtcttcataaattagggtatatattaagagacattagtaaaatacctggaggtgccatgtatgctgacgatacagctggctgggatacaagaataacggaagatgatttacacaacgaggagaaaataacacaacaaatggatccggaacatcgtcttctcgcaaacgcaatattcaagctaacttatcagaataaggtggttaaagtacaaagaccgacgccaacaggaactgtaatggatataatatcaaggaaagatcaaagggggtctggacaagtagggacttacggactgaataccttcacaaatatggaagcacagctagtacgacaaatggagggagaaggagttctgagtaaaaccgatttggaaaacccacatctgcccgagaagaaaattacacagtggcttgaaacgaagggagtggaacgactgaaaagaatggcaatatctggtgacgactgtgtggtgaaaccaatagatgataggttcgctaatgctctgctagcccttaatgatatggggaaggttcgaaaggatattccacaatggcagccatccaaaggatggcatgattggcaacaagtaccattctgctcacatcatttccacgaactaatcatgaaggatggaaggaaattagtggtgccttgcaggccacaagatgaactaatcggacgagcgcgaataagtcaaggcgccggatggtctctaagagaaaccgcctgccttggaaaagcctacgcccaaatgtggagcttaatgtattttcatcggcgcgatctaagattagcatcaaacgctatttgttccgctattccggtacactgggtaccgacttcacgcactacttggagcatacatgcacatcaccagtggatgacaacagaagatatgttaactgtgtggaacagagtgtggatagaggataatccttggatggaggacaagacacctataacaacatgggaaaatgtgccttatttaggaaaaagagaagatcaatggtgcggctccttaataggattaacgagtagagcgacctgggctcaaaacataccaactgccatacaacaagtacgtagtttgataggtaacgaggagttcctagattatatgccatccatgaaacgcttccgaaaagaagaagaatcagaaggtgcaatttggtag

SEQ ID NO: 22993 - RNA, 9873 nt, synthetic construct
  misc_feature 1..9873: note = derived and/or modified CDS sequence (opt6) from DENV-3__KF954947__SS-prME
  source 1..9873: mol_type = other RNA
acaagtttatgcctaatgatgatactaccagcagccttggcttttcatctaacttctcgagacggagaacccaggatgatagtaggtaaaaatgagagaggaaaatctctattatttaaaacagcctcgggaatcaacatgtgcactctaattgcaatggatttaggagaaatgtgtgacgatacagtaacttataagtgtccacatattacggaggtcgaaccagaggatatagattgttggtgtaatctaacaagtacatgggtgacgtacggaacatgtaaccaagcgggtgaacatcggcgggacaaacgaagtgttgctcttgcacctcatgtaggaatgggattagatacaagaacacaaacatggatgtcagcagaaggtgcttggcgacaagtagagaaagttgaaacatgggctctcagacatcctggattcacaattttagcattattcttagcacattacattggtacgtctttaacacagaaagtggtcatctttattctcttaatgttggttacgccatcgatgactatgaggtgtgtcggagtcggcaatagagatttcgtagaaggattatctggagcaacatgggtagatgtggtcctcgaacatggtggatgtgtcacaactatggccaagaacaaaccgactctcgatatagagttacaaaagacggaagcaacacaattggcaacccttcgaaaactatgcatcgagggaaaaataaccaacatcacgaccgattctcgctgtccaactcaaggcgaggcagtcttacctgaggaacaagatcaaaattatgtatgtaagcatacatatgtagacagaggatggggtaatggatgcgggttattcgggaaaggtagtctcgttacatgtgcaaagttccaatgcttagaacctatagaaggaaaagtggtccagtacgaaaacttgaaatatacagttatcatcactgttcacacaggggatcaacaccaagtaggtaatgaaacacaaggcattactgcggaaatcacccctcaagccagcacgactgaggctattctacctgaatacggaacattagggctcgaatgtagcccgagaacgggattggatttcaatgaaatgattttattaacgatgaagaacaaggcttggatggtgcatcgccaatggttcttcgatctacctctcccttggacatcaggcgcaacaactgaaacaccgacctggaatagaaaagaattattggttacatttaagaacgcacacgccaagaagcaagaagtagtagtcttaggctcacaagaaggggcaatgcatacagcgttaacgggtgcaacagaaatacaaaacagcggaggaacatccatttttgcaggccatctgaagtgcagattaaaaatggataagttggagttaaagggtatgagttatgccatgtgtacgaatacattcgtcctaaagaaagaagtctctgagactcaacacggtacgatcttaattaaagtggaatataaaggtgaggacgctccctgtaaaattcccttctcaaccgaagacggacaagggaaagcacacaacgggagactgatcacggctaacccagtagtgactaagaaagaagaacccgtaaatatagaagccgaacctccatttggggaatccaatatagtgattggaatcggagataacgctctcaaaatcaactggtacaagaaagggagtagcattggaaagatgttcgaagcaacagctagaggagccagacgtatggcgatactgggcgacactgcttgggacttcggaagtgtaggtggcgtattaaattcacttggaaaaatggtacatcaaatattcggtagcgcatatacagctctattttccggagttagctgggtaatgaagattggcatcggtgtcttgttaacttggataggcttaaatagcaaaaatacctcaatgtccttctcttgtatcgcaataggaataataaccctatatctaggcgccgttgttcaagccgatatgggctgtgtcattaattggaagggtaaggaactaaaatgtggtagtggcatatttgtaactaatgaggtacacacatggaccgagcagtataaattccaagccgattcgcctaagcgattagcaacagcaatcgtgggagcatgggaaaatggtgtgtgtggtattcgctcaactacccgtatggaaaacttgttgtggaaacaaatcgctaatgagttaaattatattctatgggaaaacaacataaaattaacggtagttgtcggagataccatcggcgtcctcgagcaaggcaaaaggactttaactccgcagccaatggaattaaagtatagctggaagacttggggaaaagcgaaaattgttactgcggaaacgcaaaattcttctttcattatagatgggccgaatacccctgagtgtcctagtgcctcaagggcctggaatgtgtgggaggtggaagactacggtttcggtgttttcacaaccaatatctggctgaaactaagagaggtttatactcagatgtgcgaccataggcttatgtctgcagctgtaaaggacgaaagagctgtacatgccgatatgggatactggatcgaatcacagaaaaatggttcatggaaactagaaaaggctagtctcattgaagtcaaaacgtgtacatggccaaaatcacacacactatggagtaatggagtgcttgaaagcgatatgattattcccaagagtctcgcagggccgatttctcaacataattaccgaccagggtaccacacccaaactgcaggcccttggcatctcgggaaacttgaacttgactttaattattgcgagggaaccaccgtagtgattacagaaaattgcggaacgcgtggcccaagtttacgaacaacgacagtgagtggcaaattaatccacgaatggtgctgtcgctcctgtacactgccacctctccgctatatgggagaggatggctgttggtacgggatggaaattcgtcccatatccgaaaaagaagaaaatatggtcaaatctctggtctcagcaggctcaggcaaggtagacaattttaccatgggagtattatgcttagcaatcctatttgaagaagtaatgaggggaaaattcggcaagaaacatatgattgcgggtgtgttctttacttttgtactattactatctggtcagataacatggagggacatggcccataccctaataatgataggatcaaatgcatcggaccgcatgggcatgggtgtaacgtaccttgcgttaattgcgacgtttaaaattcaaccttttcttgcacttggatttttcttaagaaaactcacatcccgcgaaaatttattattaggagttgggcttgctatggctactacattacaacttccagaagatatcgagcaaatggcgaacggaatagccctaggactaatggcactgaagctaatcactcaattcgaaacttatcagctctggacggcactaatatcgctaacatgttctaacaccattttcacactaacagttgcatggagaaccgcaacactgattctagctggtgtaagtttactacctgtatgtcaaagctcgtccatgcgtaaaacagattggcttccaatgaccgtggcagcaatgggagtacctcctctaccacttttcatattcagtttaaaagatacattaaaacgacgttcatggccgctcaatgaaggagtaatggctgtcgggttagtaagtatgctcgcttcttctctcttacggaatgacgttccaatggcaggacctctcgtcgcaggaggcttactaattgcgtgttacgtcataacagggacaagcgcagatcttaccgtagaaaaagcggctgacgtaacttgggaagaagaggctgaacagaccggtgttagccataatctaatgataacagtagacgacgacggaaccatgagaataaaagatgatgagaccgaaaatattttgactgtattgctaaaaaccgcgcttttgattgtgtcaggcatattcccatattccataccagctactttacttgtatggcatacatggcaaaagcaaacgcaaagatctggagttttgtgggacgtaccatctcctcctgaaacacaaaaagcagagttagaggaaggcgtatatcgaataaaacagcaggggatactgggaaaaacacaagttggagttggagtacaaaaagatggagtatttcacacaatgtggcatgttactcgaggtgcggtcttaacacataacggcaaaagacttgaacctaactgggcatctgtcaagaaagacttaatttcttacggagggggatggaggttatcagcccaatggcaaaaaggagaggaagtacaagtaattgcagttgaaccaggcaaaaatcctaaaaacttccagacaatgccgggcacatttcaaacaaccaccggtgagatcggtgctattgctctagacttcaagccaggtacatcaggatcaccaataataaacagggagggcaaggtagttggactatatggaaacggggtcgttaccaaaaatggcgggtatgtctcaggaattgcgcaaacaaacgctgaacctgacggcccgacacctgaactagaggaagaaatgtttaagaaaagaaacctcactataatggatttacatcccgggtcgggaaaaactagaaaatatctacccgcaattgtaagggaagcaatcaaaaggaggcttaggacgctcattttagcaccaacacgcgttgtagcagccgaaatggaagaagcccttaagggcttgcccataaggtatcagacaaccgcaacaaagagtgaacatactggccgggagatagtcgacttaatgtgccatgccacatttactatgaggttactgagcccagtgcgagtacctaattataatttgattataatggacgaggcacacttcacggaccctgcttctattgcagcaagaggatatattagtactcgcgtaggaatgggtgaggcagcagctatttttatgactgctacaccacccggaacagctgacgcttttcctcaatctaatgctcctattcaggatgaagaaagagatatacccgaaaggtcttggaactctggtaacgagtggataacggacttcgcaggcaaaacggtttggtttgtaccatcaataaaagcgggcaacgatatagccaattgcttaaggaaaaatggcaagaaagttattcaactaagcagaaagacctttgatacagaataccaaaagacaaaactaaacgattgggattttgttgtaacaacggatatcagtgaaatgggggcaaactttaaagcagaccgtgtaatagaccccagaagatgtctgaaaccggtaattctaacggacggcccggaaagagtgatactagcaggacctatgcccgtaactgcagcgtctgccgctcaaagaagaggtagggtcggaagaaatccacaaaaagaaaacgatcaatatatttttacaggccagccacttaacaatgatgaagatcatgcgcattggacagaagccaagatgctacttgataatattaatacacctgagggaataatccctgcgctttttgaacctgaacgcgaaaaatcggcagcgattgatggagaataccgactaaaaggggagtcaagaaaaacttttgtagaacttatgagaaggggagacttaccagtgtggctagcacacaaagtggctagtgaaggcatcaaatataccgaccgaaaatggtgttttgatggacaacggaataatcagatattagaagagaacatggatgttgaaatctggaccaaagaaggagagaaaaagaaacttagaccaagatggttagacgcaagaacctattcagacccactagccctaaaagaatttaaagattttgccgccggcagaaaaagcatcgcattagacctagtgacagagattggaagggttccgagtcacctcgcacatcgaactagaaatgcgctcgataacctagtcatgctacatacctcggagcatggcggacgagcatatcgtcacgcggtcgaagaacttcctgagacaatggaaacgttattactattagggttaatgattctcttaacaggaggtgcaatgttatttctcatctcaggcaaggggataggtaaaacctcgataggtctaatatgtgtcatagcgtccagtggtatgttatggatggctgaaattcccttacaatggatagccagcgctattgtactcgagttctttatgatggtactactgatcccagaacctgaaaaacaaaggacccctcaagacaaccagctagcatatgtcgttataggtattcttaccatggcagctattatcgcagctaacgaaatgggtctattagagacgacaaaacgggatctagggatgtcaaaagaaccgggcgtagtttcccccacttcgtacttagacgtagacctacacccagcttcagcctggactttatatgcagttgcaacaactgttataacaccaatgttgaggcacactatagaaaactcaactgcaaacgtcagcctagcagcaatcgcaaatcaagccgtagtcctaatgggattagacaaaggctggcctataagtaaaatggaccttggagtgcctctattagcactaggatgttatagccaagtgaacccgctgactcttacggctgcagtcctattactcgttactcattatgcgattattggcccggggttgcaagctaaggcaactcgagaagcccagaaaagaaccgcagccggcattatgaagaatcctactgtagatggtattatcactattgatctagaccccgttatatatgactcaaaatttgaaaaacagctaggacaagttatgttgctcgttttatgcgcggtccaattactactcatgcgaacgtcatgggcgctctgtgaggcgttaaccctagcgacagggcctataacaaccctatgggaaggatcaccaggtaaattctggaatactaccattgccgtatcaatggcaaacattttccgaggaagttacctagccggtgccggactagccttcagcataatgaaatctgtagggacaggaaaaaggggtacaggttctcaaggtgagactcttggagaaaagtggaaaaagaaattaaatcagttgtctagaaaagaatttgatttatataagaaatcgggaattactgaagttgataggacagaggcgaaagaaggactgaaaaggggagaaactacacatcacgctgtatcacgtggaagcgcaaagctccaatggtttgtcgagagaaatatggtaattccagaaggaagagtgattgacttaggatgtggtagaggagggtggtcttattattgcgcagggttgaagaaagtaactgaggtacgcggttatactaaaggaggtccaggtcatgaggaaccagtaccaatgtcgacatacggatggaatatagtaaaacttatgagtggaaaagatgtattttatttgccaccggaaaaatgtgatactctactctgcgatattggtgaatcatctccaagtcctacagttgaagaatcacgtacaatacgcgtacttaaaatggtagaaccctggttaaagaataaccaattttgtataaaggtattgaatccctatatgccagcagtgatagaacatctggaaaggttgcagcgaaagcatggtggtatgttagttcgtaatccattgagtagaaattcgactcatgaaatgtattggatcagcaatggaaccgggaatatcgtatcatcggttaatatggtcagtcgtctactactcaatagatttactatgactcatcgccgaccaaccatcgaaaaagacgtggatctgggggcgggcacaagacatgtaaatgctgaacctgaaactccaaacatggacgtaataggcgaacgcattaagaggattaaagaagaacacaatagcacttggcactacgatgatgaaaatccatataaaacatgggcctaccacggaagttatgaggtcaaggcaacaggcagtgcttcatcaatgataaacggagtagtaaaacttctaacaaaaccatgggatgtagtgccgatggtgactcaaatggctatgacagacacaactccttttggacaacagcgggtcttcaaggaaaaagttgatactagaactccaagacctatgcccggaacccggaaagtaatggagataaccgctgaatggctttggcgaacactgggaagaaacaaaaggccgcgtttgtgtactcgggaggaatttaccaagaaagtcaggacaaatgcagccatgggtgctgtatttacagaagagaaccaatgggattcagcgaaagcagcagtcgaggatgaggaattttggaaacttgtagacagagaaagagaactacataagttaggtaagtgcggttcttgtgtttataacatgatggggaaaagggagaagaaacttggagaatttggcaaagcaaaaggatctagagcgatatggtatatgtggttaggggcccgatacctagaatttgaagcattagggttcctgaacgaggatcactggtttagtcgagaaaatagttattcgggagtggaaggagaagggcttcataaattagggtatattctaagagatatttctaaaatacctgggggagcaatgtacgcagatgatactgcaggctgggatacaaggattacagaagatgatttacacaatgaagagaaaattactcaaagaatggatccagagcaccgactgctggcaaatgccattttcaaacttacctaccagaacaaggtcgtcaaagtccaaagaccgacgccaacaggaactgtgatggacatcatatcgcgaaaagatcaaagaggatctggtcaggttggtacatacggactaaatacttttacaaatatggaagcccaactggtgaggcagatggaaggagaaggggtactatcaaaaacagaccttgaaaatcctcatctcccagagaaaaagattacacaatggctggaaactaaaggagtagaacgattaaagagaatggcgatatcaggagatgattgtgtggtcaaaccaattgatgatagatttgctaacgcattgctcgcactcaacgacatgggtaaagtacgcaaagatataccgcagtggcaaccgtccaagggttggcacgactggcaacaagtaccattctgtagccatcacttccatgaattaataatgaaagacggtcgtaaactcgtggtgccatgcagacctcaagacgaactaattggacgagcaagaatatcccagggagcagggtggtcattgcgagagacggcgtgtttaggtaaggcttacgcccaaatgtggagtttaatgtactttcataggcgtgatctgagattagcatcaaatgctatatgcagcgcgataccggttcactgggtgccaacgagcagaacaacttggtcaattcacgcccatcatcaatggatgacgacagaggatatgctcaccgtatggaatagagtctggatagaagataatccttggatggaagataaaacccctataactacttgggaaaacgtgccctatctgggaaaaagggaagatcaatggtgcggatctctgataggcttaacgtctcgcgcaacatgggcacaaaacatacctacggcgattcagcaagtacgatcattgatcggcaatgaagagtttctagattatatgcctagcatgaagagatttcgaaaagaggaggaatcagaaggggcaatctggtaa

SEQ ID NO: 22994 - RNA, 9873 nt, synthetic construct
  misc_feature 1..9873: note = derived and/or modified CDS sequence (opt6) from DENV-3__KF954945__SS-prME
  source 1..9873: mol_type = other RNA
acttcattgtgcttaatgatgattcttcctgcggcactcgcatttcatttaacttcccgcgacggagaaccacgcatgatagtagggaaaaacgaaaggggtaaaagtctactatttaaaacagctagcggaataaatatgtgtactctaattgcgatggaccttggggaaatgtgtgacgacaccgtaacatacaaatgtccgcatattactgaagtcgagccggaagacatagattgctggtgcaatttaacctccacttgggtcacttatggaacgtgcaatcaagcaggggaacatagaagagacaaaagaagtgtagctctggcgccgcacgtaggaatgggattagacacaagaacacaaacttggatgtcggctgaaggagcatggaggcaggtcgaaaaagttgaaacatgggcattgcgacatccgggatttacaattctcgctctattcctggctcactatataggaacaagtctgacacaaaaagtggtaatattcattctgctcatgctcgtaaccccaagtatgactatgcgatgtgttggtgtcggaaatcgcgacttcgtagagggattgtcaggagctacatgggtcgatgtagtacttgagcacgggggttgtgtcactacaatggcgaaaaataaaccaacgcttgatatagaattacagaaaaccgaagctacgcaattagcaatcctgcgtaaactatgtattgaaggaaaaattactaatataactacagattcacgttgcccaacgcaaggcgaagcagttctacccgaagaacaagaccaaaattatgtatgtaaacacacttacgtcgacaggggatggggcaatggatgtgggttattcgggaaaggatcccttgtaacttgtgcaaaatttcaatgcctcgaacctatagaaggtaaagtagtacaatacgaaaatttaaaatacaccgtgatcataaccgtgcacacgggcgaccaacaccaagttggcaatgaaacacagggaattacagcggaaataacaccacaggcatcaacaacagaagcaatattacccgagtacggtacgcttggactagaatgttcaccaagaacgggacttgattttaacgaaatgattttattgactatgaaaaacaaagcctggatggtacataggcagtggttctttgaccttcctttaccatggacatcaggagcaaccactgaaacgccaacatggaacaggaaagagctgttagttacgttcaaaaatgctcatgctaagaaacaggaagtggttgtccttggctcacaggaaggcgcaatgcatacagcactaactggtgcaaccgaaatacaaaattcaggaggaacgagtatatttgcgggccaccttaaatgtaggcttaaaatggacaaattagaactgaaaggaatgagctatgcaatgtgcaccaatacgtttgttttaaagaaagaagtatccgaaacccagcacggcactattctaataaaagtggagtataaaggagaagatgcgccatgcaaaataccattcagcacagaagatggtcagggaaaagcgcataatggcaggttaatcacagccaatccagttgtgacgaagaaagaagaacctgtgaatatagaggctgaacctccgttcggtgaaagcaacattgttatcgggatcggagataatgcgttaaaaataaattggtataagaaaggaagttcaatagggaaaatgtttgaagcgacggctcgtggcgcacgacgaatggcaattcttggtgacactgcgtgggattttgggagtgtgggaggagtacttaattctttgggtaaaatggtccatcagatttttggctcagcatataccgcactattttccggcgtaagttgggtcatgaaaattggtataggagtactcttaacgtggataggtcttaacagcaaaaatacatccatgtcatttagctgtatagcgattggaataataaccttatatctaggagcagtagtccaggctgatatgggttgcgtaataaactggaaggggaaggaactcaaatgtggaagtgggatatttgtcactaatgaagttcatacatggacagaacagtacaaattccaagcagatagtcctaaacggctcgccacagctattgtaggagcctgggagaacggagtctgcggtattcgcagcaccactcgaatggagaacctactatggaaacaaatcgcaaacgaactaaactatatcttatgggaaaataatataaaactcacagtagtggtaggggacactattggtgtcttggagcaaggcaaaagaacattgacgccgcaaccgatggaattaaagtattcttggaaaacgtggggcaaggctaaaatcgtaacagctgaaacccaaaattcctcattcataattgatggacctaatacacctgagtgtccatcagcatctagagcatggaatgtttgggaggtagaggactacggtttcggagtatttactactaatatttggctaaaactaagagaagtgtacacacaaatgtgtgatcatcggctgatgagcgccgcagttaaagacgagcgtgcagtacatgctgatatggggtattggattgaatctcagaaaaatggttcgtggaaactagaaaaagcctctctcatagaagtcaaaacttgtacatggcccaaatcacacaccttgtggagcaacggtgttttagagtcggatatgataattcctaaatcacttgcgggcccgatttcccaacacaactaccgtccaggttatcatacacagactgcaggaccatggcacttaggaaaattagaactagatttcaattattgtgaaggtaccacggttgttattacagaaaattgcggtacgcggggaccatctctaaggacaacaacggtatcagggaagttgatacatgaatggtgttgcagaagctgtacgctacctccgctacgttatatgggagaagatggatgttggtatggaatggagatacgaccgatcagcgaaaaggaggaaaacatggtaaagagcttagtgtcggccggttcgggaaaagttgataactttacgatgggagtactatgcttagctatattatttgaggaggttatgagaggaaagttcggtaaaaagcacatgattgccggagtcttctttacttttgtacttctactaagtggacaaatcacttggcgcgatatggcccacacactaataatgattgggagcaatgcgtcagatagaatgggtatgggggtaacctatttagcactaattgcaacttttaagatccagccattcctagcactaggattctttttacgaaaactgacaagccgggaaaacttattattgggagtaggattagcgatggcaacgaccctgcaacttccggaggatatagaacaaatggcaaatggcatagcacttgggttaatggctttaaaactcatcacacagtttgaaacttatcaattgtggacagcactaatatcattaacctgtagtaacactatttttacactaacagtagcttggagaacagccacgctaattttagccggtgtatcactacttcctgtttgtcaatcaagtagcatgagaaagacagattggcttccaatgacagtcgcagcgatgggcgtaccaccgttacctttgttcatttttagtctgaaagataccctaaaaagacgcagttggccactaaatgaaggagtgatggcggtaggattagtcagtatgcttgcttctagtctgttaaggaacgatgtaccaatggcaggtccgttagtagccggtggattgttaatagcatgttatgtcataaccggaactagcgcagatttgactgttgagaaagcagctgatgtgacttgggaagaagaagctgaacaaactggcgtatcacacaatcttatgattacagttgacgacgacggaacaatgagaataaaggatgatgagacagaaaatatactaacagtacttttaaaaactgcgttacttatagtttctgggattttcccatacagtattccagcgacactacttgtatggcacacatggcagaagcagacacaaagatcgggtgtactatgggatgttccatcaccaccagaaacacaaaaagcggagttggaagaaggtgtatacaggatcaagcaacaagggatacttggtaaaacacaagtaggtgttggtgttcaaaaagatggtgtctttcatacaatgtggcatgtaacacgcggagccgtgctaacacacaatggaaaacgtctcgagcctaactgggcttccgtgaagaaagacttaatatcttacggtggtggatggcgactaagtgcacaatggcaaaaaggggaagaagtgcaagtgatcgctgtagaacccggcaaaaatccgaaaaattttcaaacaatgccaggcactttccagacaacaacaggtgaaattggggcaatcgcactagattttaaaccaggtacaagtgggagtccaatcataaatagagaaggcaaagtggtcggattgtacgggaatggagtcgtaaccaagaatggaggatacgtcagcggaatagcacaaacaaacgccgagcccgacggacctactcctgaacttgaagaagagatgtttaagaaacgtaacttaactataatggatcttcacccaggaagcggcaaaactaggaaatacctacctgccatagtcagagaggccataaaacgtagattaagaaccttaatattagcaccaacccgagtagtcgccgcggaaatggaggaagcattaaaaggactaccaataagatatcagacgactgcaactaaaagtgaacatacgggcagagagatcgttgatcttatgtgtcacgcaacctttacaatgaggttattatcgcctgttcgagttcccaattacaatctcataataatggacgaggcacacttcaccgatccagcgtctattgcagccagaggatatatttcaacccgcgttggtatgggtgaagcagcagcaatatttatgacagcaacaccgccaggaacagcagatgcattcccacagagtaatgctcccatccaagatgaggagagggatataccagagagaagttggaatagtggaaatgagtggataacagactttgctggaaaaactgtttggtttgtacctagtattaaagcaggcaatgatatagctaactgtctccgtaaaaacggtaaaaaggtgatacaactttcgagaaaaactttcgataccgagtaccaaaagacaaagctaaatgattgggattttgttgtaacaaccgatatatcagaaatgggagcaaactttaaagcagacagggtcatagaccctagaaggtgcctaaaaccagttatattaacagacggacccgagcgagtaatactggcaggacccatgccagttaccgcggcttccgcagcgcaaagacgaggtagagtcgggcgcaatccgcaaaaagaaaatgatcaatacatttttacaggccagcccctcaacaatgatgaggaccacgcgcattggaccgaagctaaaatgctgctcgacaatattaacacaccagaagggataattcctgcattatttgagcccgaacgagaaaaatctgcagcaatagacggtgaatatagattaaaaggtgagagtagaaagacatttgttgagctaatgcgaagaggagacttacctgtgtggcttgcacacaaggtcgccagcgagggaataaaatacactgacagaaaatggtgtttcgatggtcaacgaaataatcagattctagaagaaaatatggacgttgaaatttggactaaagaaggcgagaagaagaaactacgtccacgatggctggatgcccgtacctatagcgaccccttggcactaaaagagtttaaagatttcgctgcaggcaggaaatcaatcgctttagacttagttacagaaataggaagggtaccaagccacttagcacacagaacacgcaacgcacttgacaatctggtaatgttacacaccagtgaacatgggggccgagcatatagacatgcagtggaggaactacctgagactatggagacattacttctacttggcttgatgatacttcttactggcggagcgatgttattcttaatttccggaaaaggtattggtaagacttcaatcggactcatatgtgtaatagcgagctctggtatgctctggatggcagagataccgcttcagtggattgcaagcgcaattgtattagagttctttatgatggtgctcctcataccagagccagaaaaacagagaacaccccaggacaaccaattagcttatgtagtaattggaatattaacaatggctgctataatagcagcaaatgaaatgggcttgttagaaacaacgaagcgggaccttggtatgtcgaaggaacctggagtggtatcaccaaccagttatttagatgtagatttacatcccgcgtccgcctggacactgtatgcagtggcaaccacagtaatcacacctatgttgcgacatacaatagaaaattcaactgcaaacgtgagtcttgcagcaattgccaatcaagctgtggtactgatgggccttgataaaggttggccaatctcaaagatggatctcggggtacccctattagcactggggtgctattcgcaagtaaacccgctgacacttacagctgctgtcctacttttggtcacacactacgcaatcatcggcccaggcttacaggctaaagctacaagagaagcacaaaaacgtacagctgcaggaataatgaaaaatccgacggttgacgggataattactatcgatctagatccagtaatctacgatagcaagtttgaaaaacaattaggacaggtaatgctacttgtcttatgtgcagtccagctcttgttaatgagaacgagctgggcgctatgtgaagctcttacactagccactggtccaataacaactctatgggaaggctccccaggaaagttttggaacacaacaatagctgtttctatggccaacattttcagagggagttacctagcaggagccgggttggcgttcagcataatgaaaagtgtgggtacaggaaaaagaggtacaggtagccaaggtgaaacgttaggagagaagtggaaaaagaaattaaaccaactatcaagaaaagagttcgatttatataagaaaagtggtatcacagaggtagacagaacggaagctaaagaaggtttaaaacgcggtgagacaactcatcatgcagtatcacgaggctcggccaaacttcagtggtttgttgagcggaatatggttattccagagggaagggtgatcgacctaggttgtgggcgcggaggatggtcatattattgtgctggtcttaagaaagttacagaggtcaggggttacacaaagggtgggcccggacatgaagaacccgttcccatgtcaacatatgggtggaatatagtaaaattaatgtccggtaaagatgtattctacctaccaccggagaaatgcgatacactgctttgtgatattggcgagagtagtccgtccccgacagtggaagaatccagaacaataagagttttaaaaatggtagagccgtggctgaagaacaatcaattttgtataaaagtcctaaatccttacatgccagctgtgatagaacacctagaaagactacaaagaaaacacggaggaatgttggtaagaaatcccttaagcagaaacagtacccatgaaatgtattggattagtaacggaacaggaaacattgttagttccgtaaacatggtgtcacgcctgctgctaaatcggtttactatgacacaccgccgaccaacaatagagaaggacgtagatcttggcgcgggcacaagacacgtaaatgcggagcctgaaactccaaacatggatgtaataggtgagaggattaagagaataaaagaggaacataacagcacatggcactacgatgatgagaatccttataagacatgggcatatcacgggagttatgaagtaaaggccaccgggagtgcctcgagcatgatcaatggtgtagtaaaattactaacaaaaccatgggatgtagtacccatggtaactcaaatggctatgacggatactaccccatttgggcagcaacgagtatttaaagagaaagtagatacaagaacaccgaggcccatgcccggaacacggaaggttatggagataactgccgaatggttatggcgaaccctaggcagaaataaaagaccaagattatgtacaagagaggagtttactaagaaagtaagaaccaatgcagcaatgggagccgtattcacggaggaaaaccaatgggatagcgccaaagcggcagtagaagatgaagaattttggaaattagtagaccgtgaacgggaacttcacaaacttggtaagtgtggaagttgcgtctataatatgatgggaaaacgggaaaagaagctcggagaatttggaaaggcaaaaggaagtcgtgcaatttggtatatgtggctcggcgcacgctacttggaatttgaagccctaggctttctaaatgaagatcattggttctctagagagaactcctatagcggagttgaaggagaaggactacataaattaggctatattctacgagatatcagtaaaatccctggtggtgcaatgtatgctgatgacacagccggttgggacacacgaatcacagaagatgatctccacaacgaagagaaaattacacaacaaatggatcccgaacacagacttttagcaaatgccatatttaagttaacataccagaacaaagtagttaaagttcaacgcccaactcctactggaactgtaatggatattatatcccgaaaagatcaacgaggttccggacaagtgggaacctacggacttaacacattcacaaatatggaagcccaactcgtcagacagatggaaggtgaaggggtcttgtcaaagacagacttggaaaatccacatttgcctgagaagaaaataacacaatggttagaaacgaagggagtagaaagattaaagcgaatggcaatatctggagatgattgtgtagtgaagcctattgacgatagatttgcaaatgcactactggcattaaatgacatgggaaaagtgcggaaggatataccacaatggcaacccagtaaaggttggcacgattggcaacaagtgccattttgcagtcatcattttcatgaattaattatgaaagacgggcgtaagctggtagtaccttgccggccacaagacgaattaattggtcgagcaagaataagtcagggagcgggatggtctctacgagaaacggcatgcctagggaaggcatatgctcaaatgtggagtttaatgtattttcataggagagatctaagattagcatccaacgctatctgtagtgctatcccggttcactgggtcccaacctctagaactacatggtctatacatgctcaccaccagtggatgacaacagaagatatgttaactgtttggaatagggtgtggatagaagataacccgtggatggaggataaaacacctatcaccacctgggaaaacgttccctatttaggaaaacgagaagatcaatggtgcggcagtctaattgggctaacatcacgagctacttgggcacaaaacatacctaccgcaattcaacaagttagatctctaataggaaatgaagaatttcttgattatatgccctcaatgaaacgctttagaaaagaagaagagagtgaaggcgctatttggtaa

SEQ ID NO: 22995 - RNA, 9873 nt, synthetic construct
  misc_feature 1..9873: note = derived and/or modified CDS sequence (opt6) from DENV-3__JX669495__SS-prME
  source 1..9873: mol_type = other RNA
acatcattatgtttgatgatgatattacctgcagctttggcatttcacctgacatctagggatggagaacccagaatgatcgttggtaaaaacgaaaggggtaaatcgttactgttcaaaactgcatcgggaataaatatgtgcacgctaatagcaatggacttaggtgaaatgtgtgacgatacagtaacatacaaatgtccacacataacagaagtcgaaccagaagacatcgattgttggtgtaatttaacgtcgacatgggtaacatatgggacatgcaaccaagcaggagaaagacgaagagacaaaaggagtgtagctctagctccacacgttgggatggggcttgatacaaggactcaaacatggatgagcgccgaaggagcctggagacaagtagaaaaagttgaaacctgggcattaagacatccaggctttacgattttagccttatttctagcacactatataggaacttctttaacccaaaaagtagtaatctttatacttctaatgttggtaaccccgagcatgactatgagatgcgtaggagtaggaaacagagacttcgtagaaggactgagtggtgcaacatgggtcgacgtggtgttagaacacggagggtgtgttacgactatggccaaaaataaaccgacgctcgacattgagcttcagaaaacagaagctacgcaactagccacactacgaaaattatgcatagaaggcaaaatcaccaatataacaacagattcgagatgccccacgcaaggagaggcggttctaccagaagaacaagatcaaaactatgtctgtaaacacacatatgtcgaccgcggatggggtaatggatgcggactcttcggaaaagggtctttagtcacgtgtgcaaaatttcaatgtctcgaaccgatagaaggcaaagtagtgcaatatgagaatctcaaatataccgtaatcataacagttcacaccggagatcaacaccaagtaggaaatgagacacaaggcgtgacagcagaaatcacaccacaagcgtctaccacagaggccatattacctgagtacggtacgttaggtttagaatgctcgccaaggacaggtttagactttaacgaaatgattctcctgactatgaaaaacaaagcctggatggtccatagacaatggttcttcgacctccctttaccatggacgagtggggcaactactgaaactcctacgtggaataggaaagaactattagtaacgtttaaaaacgcacatgccaagaaacaagaggtcgtcgtgctaggaagtcaagaaggcgctatgcatacagctttaacaggagcaacagaaatacaaaattccggcggaacgtcgatctttgcaggccatttaaaatgcagactaaaaatggacaaactagaacttaaaggtatgagttacgcaatgtgtaccaacacattcgtcctaaagaaagaagtgagcgaaactcaacatgggaccatattaataaaagttgaatataaaggtgaggatgcgccttgtaaaatccctttctcgacagaagacggacaaggtaaagctcataatggacgattaataactgccaatccagtagtaaccaagaaagaagaacctgtaaacattgaagcagaacccccatttggggaaagcaatatagttattggaatcggcgataacgcccttaaaattaactggtataagaaaggctcgtcaattggtaaaatgtttgaagctactgcaagaggggcgagacgaatggcaatcttaggtgacacagcatgggactttgggagcgtaggtggagtactaaacagtctgggaaaaatggtacatcaaatttttggatcagcctacacagccttattctcaggagtatcatgggtaatgaaaattggtataggggtattactaacctggattggcttaaatagcaaaaacacctccatgtcgttttcctgcattgcaattggaataatcacattgtatttaggcgctgttgtacaagcagatatgggatgcgtaataaactggaaaggaaaagaattaaaatgcggctcgggcatatttgtaacaaatgaagtgcatacctggaccgagcaatacaaatttcaggcagacagccctaaaagactagctacggccatagccggtgcatgggaaaatggagtatgtgggattagatctacaacgcggatggaaaatcttttatggaaacagatcgcaaatgaattaaattatatattatgggaaaacaatataaaactaacggtcgtagtaggcgatataatcggagtattggaacaaggaaaacgcacgctaactccacaaccaatggaactaaaatacagttggaaaacctggggtaaagccaaaatagtcaccgcagaaacgcaaaatagcagcttcatcatcgacggtcccaacactcctgaatgcccctcagcttcaagggcttggaatgtctgggaagtagaagactacggctttggagtctttacgacaaatatatggttaaaattacgagaagtatatactcagttgtgcgaccatcgtttaatgtctgctgccgtaaaggacgaaagagcagttcacgcagacatgggatactggatagaaagtcagaaaaatgggagctggaaattggagaaggcaagtttaatagaagtcaaaacatgcacatggccaaaaagtcataccttgtggtcaaatggcgtcctagaaagcgatatgataattccaaaaagtctggcgggacctatatcacaacacaaccaccgacctggataccacacacaaacagcggggccgtggcatcttggtaagttggaactggattttaattattgtgaaggaacgacagtagtgataacggaaaactgtgggactaggggaccctctttgcgtaccacaaccgtatcaggaaaactaatacacgaatggtgctgcaggtcttgtactctacccccattgagatacatgggggaagacggttgttggtacggaatggaaatcagacctataagcgaaaaggaagagaatatggtcaaatccttggtatccgcaggtagcgggaaagtggacaacttcaccatgggcgtcctgtgtcttgcaattctttttgaagaggtaatgagagggaaatttggaaagaaacatatgatagcgggcgtcttctttacgttcgtattgttgctatcaggccagattacgtggagggacatggcacacacccttataatgattggctcaaatgcatctgatagaatggggatgggagtaacttatctagcacttatagcaacgttcaaaattcaaccatttttagcattgggattcttcctaagaaaattgacatcccgtgaaaacttattattaggagttgggttagcaatggccaccacactgcaattgcccgaagatatagaacaaatggctaatggcatagctctgggcctaatggctctaaaacttatcacccaattcgaaacatatcagttatggacggccctaatatccctaacgtgttcaaacactatgtttactttgacagttgcttggagaacagcgacgctaattctagcaggagtaagtctattaccggtctgccaaagcagctcaatgagaaagactgattggctgcctatggcggtagcggcaatgggggttcccccactaccactatttatattttcattgaaagatacgttaaaaagacgatcctggccgcttaatgagggggtgatggccgtaggcctcgtgtcaatcctagcctcgtctctactacgaaatgatgtgccgatggccggcccattagttgctggcggactattgatagcgtgctatgtaataacaggaacgtcagcagatttaactgtagagaaagctgctgatattacatgggaggaagaagcagagcaaacaggggtttctcataatctcatgattactgttgatgatgatggtacaatgcggataaaagacgatgaaactgagaatatacttactgtattactaaaaacagcattactgatagtgtcaggagtgttcccttattctataccagctactttattggtatggcatacctggcagaaacaaactcagagatcgggagttctatgggacgtaccctccccacctgagacacagaaagcagagctcgaagaaggagtctacagaataaagcaacaaggaatatttggaaaaacacaggtgggagtaggcgtacaaaaagaaggagtttttcatacaatgtggcacgtgacaagaggagcagtactgacatataacggaaaaaggttggaacccaactgggcaagtgttaagaaagatttaattagctacggagggggctggcgtctcagtgcccaatggcaaaaaggagaagaagtacaagtcattgcggtcgaaccaggtaaaaatccgaaaaacttccaaacaatgccaggtacattccaaactacaaccggggaaattggtgccatagcactagacttcaagcccggaacctcaggcagtccaataatcaaccgggaagggaaggtagttggattgtatggcaatggtgtggtaaccaaaaatggtggctatgtttcagggatagcgcaaactaacgcggagccggacggaccgacacccgaattagaggaggaaatgtttaagaaacgcaacttaacaataatggatctacatcccggatcagggaaaacacgaaaataccttccagccatagttcgggaggccattaaacgtcgactaagaaccttaatattagcaccaacacgagtggtcgcagcagagatggaggaggctttaaaaggactaccaatacgataccaaaccacagctactaaaagcgaacacacagggagggaaatcgtagatttaatgtgtcacgccacttttacaatgagactactatcaccagtacgagtaccaaattacaatttaataattatggatgaggcccactttacggatccagcaagtatcgcggctcgaggctatatctcgactagagtcggaatgggagaggcagctgcaatattcatgacagcaacgcctcctggcacggcagacgcatttccacaaagcaacgctccaattcaggatgaggaacgcgatatacccgagaggagttggaacagtggaaatgaatggatcactgattttgctggaaaaaccgtctggtttgtgccttctataaaagcaggtaatgatatcgccaactgtttacgtaagaacggcaagaaagtaatccaattatcaaggaaaacttttgacacagagtaccagaaaacaaaattaaacgattgggactttgtcgtaacaactgatattagtgagatgggcgccaattttaaagcggaccgagtcattgatcccaggagatgtttgaaacccgtaatattgacggacggtcctgaaagagtaatactagctggaccgatgccagtcacagcagcatctgcggcgcaacggagaggaagagtcggcagaaatcctcagaaagaaaacgatcaatatattttcactggtcagccactcaataatgacgaagatcatgcacactggactgaagccaaaatgctcttagataacatcaatacaccagagggtatcatccctgcgttatttgagcctgaacgtgagaaaagtgcggcaatagacggagaatatcggctaaaaggcgagtcccggaaaacttttgttgagctaatgagaaggggagatttaccagtctggctagcacacaaagtagccagtgaaggaataaaatacacggatagaaagtggtgctttgacggccaaagaaataatcaaatattagaagagaatatggatgtagaaatatggaccaaggaaggagagaagaagaaactcagacctcgatggttagatgctaggacatattcagaccctttagcactcaaggaatttaaggacttcgcggccggtcgaaaatcgattgcccttgacttagtcactgaaatagggcgggtaccatcacacctagcacatagaacccgcaatgccctggataaccttgtaatgttacacactagcgaacatggcggacgtgcgtatcggcacgctgtcgaggagttacctgaaaccatggagactctattattactaggactaatgattttattgacaggcggagcaatgctatttttaatcagtggcaagggaattggaaaaacaagtatcggactcatatgcgtgatagcgtccagcggtatgttgtggatggccgaaatcccactccagtggattgcgtcagccatagtactcgagttctttatgatggtcctgttaattccagaaccagaaaagcagagaacaccacaagacaatcaattggcatatgttgtcataggtatcctgacattagctgccataattgcagccaatgaaatgggattactggaaactactaaaagagatctcggaatgtcaaaagaacccggagtagtatcccctacctcatatctggacgttgatcttcacccagcctcagcatggacattatacgcggtggctacaaccgtaataacgccaatgctaagacacacaattgaaaacagcactgcaaacgtcagtttagcagcaattgcaaatcaagcagtagtcttaatgggacttgataagggatggcccatctcaaaaatggatctcggtgtaccccttttagcgttaggttgttactcacaagtaaacccattaactctgactgccgcggtactattattaattactcattatgcaatcatcggtccaggtttacaagcaaaagcaacaagggaagcacagaaaaggacagctgctgggatcatgaaaaacccaaccgttgatggaatcatgacgatagatttagatccagtaatatatgactcaaagttcgaaaaacaactaggccaggtaatgcttctagtactatgtgcagtacagttactgttgatgagaacgagctgggctttgtgtgaagctctaactctagcaacaggacccataactaccctatgggaaggttcccctggcaaattttggaacactaccatagcagtgagtatggccaacattttcaggggaagctatctggccggtgcaggtctagcattcagtatcatgaaatccgtcggcactggtaaacgtggcacaggaagccagggagagacattgggagaaaaatggaagaagaaactaaatcaattatctcgaaaagagtttgatctttataagaaatccggaattacagaagttgaccggaccgaagcaaaagaagggttaaagagaggcgagatcactcatcatgccgtaagcagaggatccgcaaaactacaatggttcgtagaaagaaacatggtcataccagaaggtcgggtaatcgatttagggtgcgggcgaggcgggtggtcatattactgtgcgggtctaaagaaagtaactgaagtacgtggctacacaaagggtggaccagggcatgaagaacccgtcccaatgagcacatacggatggaatattgttaaacttatgagtggaaaagatgtattctaccttccgcctgagaaatgtgacacacttttgtgcgacataggagaatcaagtccctcacctaccgtcgaagaatctagaacaattcgtgtactaaagatggtagaaccatggctgaaaaacaaccaattttgcataaaagtgttaaatccatatatgccaacggttattgaacatttagaacgactacaacgaaagcatggaggaatgttggtaagaaatccattatcaaggaacagtacacatgagatgtactggatttcgaacggcacgggtaatatagttgctagtgtaaacatggtatcacgattacttttaaatagattcacgatgacacacagaaggccaactattgaaaaagatgttgacctcggtgctggaaccagacacgtaaatgctgaaccagaaacgccaaatatggatgttataggtgaaaggataaagagaataaaagaagaacataacagtacctggcactacgatgatgaaaatccgtacaaaacgtgggcatatcatggtagttatgaagtgaaggcaaccggtagtgcttcatctatgataaatggcgtagtaaaacttttaacgaaaccatgggacgtagtgccgatggtcacacaaatggcaatgaccgacaccactccttttggccaacagcgtgtatttaaagagaaagttgacacgagaacgcctcggtcaatgcctgggactaggagagtgatgggaataaccgcggaatggctttggcgtacactgggaagaaacaaaaagccacgactttgtacaagagaagagtttacaaagaaagtgcgaacaaatgctgcaatgggagctgtattcactgaagaaaaccaatgggatagcgcaaaagctgcagtcgaagacgaagacttttggaaattagtcgaccgagaacgcgaactccacaaactgggtaaatgcggctcctgcgtgtacaatatgatggggaaacgagagaagaaactaggtgaatttggaaaagccaaaggtagtcgggcgatttggtacatgtggttaggagctagatatttagaatttgaggccttgggctttttgaacgaagaccattggttcagccgtgaaaattcctattcgggcgtagaaggcgaaggactgcacaaacttggctatatattacgtgatatatctaaaattccaggtggagcaatgtatgccgacgatactgctggctgggacacgcgcataaccgaagatgacctacataacgaggagaaaatcacacaacaaatggatccagaacatagacagttggcaaatgccatttttaaacttacgtaccaaaacaaagttgtaaaggtccagaggccaactcccacagggactgtcatggacataatatcacgaaaagaccagagaggaagcggccaagtgggcacctatgggctaaatacttttacaaacatggaagcccaattaatacgtcaaatggagggcgaaggcgtcctgtcgaaagcagatttagaaaacccccatttaccagagaagaaagtcacacagtggcttgaaactaaaggtgtagaacggttgaagcggatggcaataagtggagacgattgtgttgttaagccgatagacgatagattcgcgaacgcattgctagcactgaatgatatgggtaaagtaagaaaggatattccacaatggcaaccatcaaaaggatggcacgactggcagcaagtcccgttctgctcacaccattttcatgaactaataatgaaagacggtagaaaattggtcgtgccatgtcgtccacaggatgaactaataggcagagcgagaatttcgcaaggagcaggatggtcattgagagaaacagcatgcctcggaaaagcatacgcgcaaatgtggtcattaatgtatttccatcgtagggatcttcggttggcatccaatgctatatgctctgctgtacctgtacattgggtaccgacaagtcgaactacttggtctatccatgcacaccaccagtggatgactacagaggacatgcttacggtatggaatcgggtctggatagaggacaatccgtggatggaagataaaacacctgttactacctgggaaaatgtaccctatctagggaaacgcgaagaccaatggtgcggctccctgataggattgacgtctagagcaacgtgggcccaaaatataccaacggctattcaacaagtaagatctctcattggaaacgaggaatttttagattatatgccaagtatgaaaagatttcgtaaagaggaagaaagtgaaggtgctatatggtag

SEQ ID NO: 22996 - RNA, 9873 nt, synthetic construct
  misc_feature 1..9873: note = derived and/or modified CDS sequence (opt6) from DENV-3__JX669499__SS-prME
  source 1..9873: mol_type = other RNA
acaagcctttgcttaatgatgatattgcctgcagcactggcttttcatcttacgtctcgagacggtgaacctagaatgattgtagggaaaaacgaacgaggaaaaagtcttttgtttaaaactgcaagtgggataaatatgtgtactctaatagcaatggacttgggagaaatgtgtgatgatacggtgacttataaatgtccacatattacagaggtcgagccagaagacatagactgctggtgtaacttaacttcaacatgggttacttatggtacatgcaatcaagctggggaacgtcggagggataaacgatcagttgcattggcgccacatgtaggtatgggcttagatacaaggacacaaacctggatgtccgctgagggagcgtggagacaagtggagaaagtagaaacatgggcattacgccatccaggcttcacaatcctagcattatttcttgcccactatattgggacgtcccttacgcaaaaagtagtaattttcatactgctcatgttagtgacgccaagtatgaccatgagatgtgtcggagtaggaaatagggactttgtcgagggactttctggtgcaacatgggtcgacgtggtcctagaacacggtggttgcgtaaccacaatggctaaaaataaaccgactcttgatatagagttacagaaaacagaggctacgcaactagctacgctaagaaaactgtgcatagaaggaaaaattacgaatataacaacagactccagatgcccaacacaaggtgaagctgtactaccagaagaacaggatcaaaattacgtctgcaaacatacgtacgtagatcggggatggggaaacggctgcggactgttcgggaaaggaagtttagtaacatgcgcaaaatttcaatgcctagaacctatagaaggtaaagttgtacagtatgaaaatttaaagtataccgttataattacagtacatacaggagaccaacatcaggtaggtaacgaaactcaaggagtcactgccgagatcacaccgcaggcttcaacaactgaagcaattctgcctgaatatggtacattgggtctggaatgcagcccaagaactggcttagatttcaatgaaatgatattattaacgatgaaaaacaaagcatggatggtacacaggcaatggttctttgatcttccactcccttggacaagtggtgccacaacagaaacaccaacttggaatcgaaaagaactacttgtgacattcaagaatgcccatgcaaagaaacaggaagtcgtggttctagggagtcaagaaggagcaatgcatacagcattgacaggagcaacagaaatacaaaattcgggaggaacatcgatatttgctgggcatctaaaatgtcgccttaaaatggataaacttgaacttaaaggtatgagttatgctatgtgtactaacacattcgttctaaagaaagaggtcagcgaaacacaacacggaacaattctaataaaagtggagtacaaaggtgaggatgcaccttgtaaaattccattttcaacagaagatggccaaggcaaggcacataatggccgtttaattactgcaaaccctgtagtgaccaagaaagaggaaccagtgaacatagaagcagaaccaccctttggtgaatcaaacatagttataggaattggagacaatgcattaaaaataaactggtataagaaaggatcttccataggaaaaatgtttgaggcaaccgccaggggagcaaggaggatggccatcttgggcgatactgcatgggacttcgggtctgtcggaggggttttaaatagtctgggtaaaatggtacaccaaatcttcggttcggcgtacacggcattattctctggggtttcatgggtgatgaagattggcataggcgtgctattgacatggatcggtcttaattccaagaacacaagtatgtcctttagctgtatcgctatcggtataataacattatatctcggtgctgtagtacaagcagatatgggctgcgtgattaattggaagggaaaagaattaaagtgtggttcaggcatatttgttacaaatgaggtccatacttggacagagcaatacaagttccaagccgatagtcctaaacgactggccactgctattgcaggggcatgggaaaacggtgtatgcggcatacgcagtaccaccagaatggaaaacctattgtggaaacaaatcgcgaacgaactcaactatattctttgggaaaacaatatcaaactaactgtcgtagtaggggatataataggcgttcttgagcaaggaaaacgaacactcactccacagcccatggagctaaaatactcatggaaaacgtggggtaaagcgaaaatcgttaccgctgaaactcaaaatagcagcttcattatagatgggcccaacacccccgaatgcccatctgccagtagagcatggaatgtgtgggaagttgaagactatgggtttggcgtgtttacaacgaacatttggctaaagttacgtgaagtatacacgcaattatgtgatcacaggttaatgagcgctgctgttaaagacgaacgcgctgtgcatgcagacatgggttattggattgaaagccaaaagaacggatcatggaagctggagaaagcatcccttatagaagttaaaacttgtacatggccaaagagccataccctatggtctaatggagtattagaaagcgatatgatcataccaaaatcattagcgggacctatatctcaacataatcatagaccagggtaccacacccaaacagcgggaccctggcacttaggcaaattggagctagatttcaactattgtgaagggactaccgtagtaataacagaaaattgtggcacccggggcccatctttacgtacaaccacggtctcaggaaaactaatacacgaatggtgttgtcgtagctgtactttaccgcctttaagatacatgggtgaggatggttgttggtacggtatggagatacgaccaattagtgaaaaagaggaaaatatggttaaatcccttgttagcgcggggtccggaaaagtagataacttcaccatgggggttttgtgcctcgcaattctattcgaagaagttatgagaggaaaattcggtaagaaacatatgatagccggggtcttcttcacattcgtcctattactaagcggacaaataacatggcgagatatggcacacacattaattatgataggaagcaacgcatctgatcgaatgggtatgggaatcacctacctagccctgattgcgacattcaaaatacagccgtttttggcgttagggttctttctgcgaaaactgacaagtagagaaaatttgttacttggggtaggcctcgcaatggcaacaacactgcagttgcccgaagacattgaacaaatggccaacggaatagcgctcggattaatggcattaaaattaatcactcaatttgaaacataccagttatggacagctttaatctcgttaacctgcagtaacacgatgttcaccctcaccgtggcatggagaacagctactcttatattagctggggttagtcttttaccggtgtgtcaatcttcctcaatgcgaaaaacagattggctccctatggcagtggctgcgatgggtgttcccccattaccactttttatctttagccttaaagacacgctgaaaagaagaagttggccactaaatgaaggcgtcatggcagttggtttagtatcaattctagctagctcacttttgcggaacgacgtccctatggcaggaccattagtagcagggggattactgatagcctgctacgtgataaccggaacgtcagctgacttaacagtggaaaaagcggcagacatcacatgggaagaagaggcagagcaaacgggtgtgtcacataacctgatgataaccgttgatgatgacggcacgatgcgcataaaagacgacgagacagaaaatattctaacagtactacttaaaacagcacttttaatagtaagtggtgtatttccatattcaatcccggcaactctattagtttggcatacgtggcagaaacaaacacaaagaagcggcgtattatgggatgttccaagtcccccggagactcaaaaagccgaattggaggaaggtgtctatcggataaagcaacaaggtatatttgggaaaactcaagtaggagttggagtgcaaaaagagggtgtctttcatacaatgtggcatgttacaagaggtgcagtacttacttataatggcaaacgtctagaaccaaactgggcatcagttaaaaaggaccttatcagttatggaggcggttggcgtctgagtgcacaatggcagaaaggtgaagaggttcaagtgatcgccgtggaaccaggaaagaacccgaaaaattttcagacaatgcccggaacctttcaaacgacgacaggagaaattggggccattgccttagactttaaaccaggaacatctgggtcacctatcattaacagagaaggtaaagtggttggcttgtatggaaatggtgttgtcacaaagaatggaggatacgtaagtgggatagctcaaaccaatgcagaaccagatggccctactcctgaactcgaggaagaaatgtttaagaaacgtaacctcacaataatggatctgcatcccgggtcaggaaaaacaagaaaatacctccctgctatcgtaagagaggccattaaaagaagactgcggacattaatattagcaccaacacgcgtagtagctgcggaaatggaggaggccctaaaaggtctccctatacgttatcaaacgacagcgactaagtcagagcacacggggagagaaatagtagatctaatgtgtcatgccacattcaccatgcgcttgttatctcccgtccgagtaccaaattacaatctaataatcatggacgaagcacattttacagatccggctagtatcgctgctagaggctatatatcaacacgggttggcatgggggaagcggcagctatttttatgacagctacaccacccggaacagcagacgcatttcctcagtcaaatgcacctatacaggatgaggaacgggatattcctgaaagaagctggaatagtgggaatgaatggattaccgacttcgccgggaaaacggtatggtttgttccaagcattaaagctggaaatgatatagcaaattgtttgagaaagaacggcaagaaagttatacaactttcccgcaagacatttgatacggaatatcagaaaactaagctaaatgactgggactttgtcgtgacaacagatataagcgaaatgggggcgaattttaaagcggatagagtaattgaccccagaaggtgtttgaaaccagttatcctaaccgatggacctgaaagagtaatattagcaggcccaatgcctgtcacagccgcgtcagctgcacagcgtagaggaagagttggtagaaatccacaaaaggaaaatgaccaatatatatttacaggccaaccactaaacaatgacgaagatcacgcccattggaccgaggcaaagatgttattagataatattaatacacccgaaggaatcattcctgccctatttgaacccgaaagagaaaagtcagcagctatagatggagagtatagactgaagggtgagagcagaaagacgtttgtggagctcatgagaagaggagacctgccggtctggcttgctcacaaagtagcatcagaaggtattaaatatacagatagaaaatggtgctttgatgggcaaaggaataatcaaatcctagaagaaaatatggatgttgaaatctggacgaaagaaggtgagaagaagaaactgcgtccaagatggctagatgcacgaacctattcagatcccttagcactaaaggaatttaaggatttcgctgctggtcggaagtcgatcgcactagacctggtaacagaaatagggcgcgtgccctcccatttagcacatcggacgagaaacgcgttggataatttagttatgctgcatacgtctgaacacggtgggagagcatatagacatgcagtcgaagaattgccagaaacgatggaaacgctactcttgttaggtttaatgatactgttgacaggtggagcaatgctatttttaatcagtggaaaaggaattggaaaaacaagtattggattaatctgtgtaatcgcaagcagtgggatgttgtggatggcggaaatacctcttcaatggatagcatcagctattgtacttgagttctttatgatggttcttttaataccagaaccggagaaacaaaggacccctcaagataatcagctagcttatgtggtaattggcattctaacattagctgcaataattgcagcaaatgaaatgggcttactggaaacgacaaaaagagatttaggaatgtcgaaagaaccaggagtagtgtcaccaacaagctatttagatgtcgaccttcaccccgcatcagcttggacgttatacgcagtagcaaccacagtgattacacccatgttacgtcatacaatagaaaacagcacggctaatgtaagtctcgctgcaatagcaaatcaagccgttgtcttgatgggactagacaaaggatggcctatttccaaaatggatctgggggtccctttattagctttgggttgttacagtcaagtaaacccactaacactaacagcagcagtgttgctactgatcacacactacgcaattattgggccaggactacaggcgaaagccacaagggaggctcagaaaagaactgcagctggaataatgaaaaatccaacagtagacgggataatgacaatcgacctcgatcctgttatctacgatagtaaattcgaaaagcagttggggcaagtgatgctcctagtcctctgtgcagttcaattactgctaatgcgtacatcctgggcactatgcgaagcactaaccttagcaactggacctattacgacactctgggaagggtcaccaggaaaattttggaatactactattgctgtatcaatggctaatatatttagggggtcatatttggccggtgctggtcttgccttctccataatgaaatcagttggtacaggtaaaagaggtaccgggagccaaggtgagaccttaggagaaaaatggaagaagaaactaaaccagctatccaggaaggagtttgatttatacaagaaatccggaattacagaggtagacagaacggaagctaaagaaggcctaaaacgaggtgaaattactcatcatgcagtatcacgaggtagcgcgaaattacaatggtttgtagagcgtaacatggttatcccagaaggaagggtaattgacctaggttgcggaagaggcggatggtcctattactgtgcaggtctcaagaaagtaacggaagtaagaggatatacaaaaggaggacctggtcatgaagaaccggttccaatgagtacttacggttggaatatcgtaaaacttatgtccggaaaggatgttttctatttacccccagaaaaatgcgatactctgttatgtgatatcggagaatccagtccctcacccacagtagaagaatcacgaaccattcgagtgctgaaaatggtagaaccctggctcaaaaataatcagttttgtattaaagttcttaatccttatatgccaacagtaatagaacatttagaacgcctacagaggaagcacggcggaatgcttgtccgaaaccctctatcgagaaatagtacccatgaaatgtattggatatccaatggaacaggcaatattgtggcaagtgtaaatatggtatcaagactcttgctaaaccgattcacgatgacccacaggaggccgacgatagaaaaagacgtcgacctgggggctggaaccagacacgtcaatgcagagccagagacacctaatatggacgtgataggcgagaggataaagagaataaaagaagaacacaattcaacatggcattatgatgacgaaaatccctataaaacatgggcttaccacggatcatacgaggtgaaagcaactggtagtgcgtcttcaatgataaatggagtagtaaaactactaacgaaaccttgggatgtagtacctatggtaacacagatggctatgaccgatacaacaccatttggacaacagcgtgttttcaaagaaaaagttgatacacgtactccccgaagtatgcctggaacgcggcgtgtgatgggtatcacagccgagtggctctggagaacattaggaagaaataaaaagccgagactgtgtactagggaagaatttactaaaaaggttaggacaaatgccgcaatgggtgcagtatttacagaggagaaccaatgggacagtgcaaaagcagcagtggaggacgaagatttttggaagctagtcgaccgcgaaagagaattacataaacttggaaaatgtggatcctgtgtctataatatgatggggaagcgcgagaagaaattgggagagttcggcaaagctaaaggcagtagagctatatggtatatgtggctaggagccagatacttagagtttgaagcattaggatttttgaatgaagatcattggtttagtagagaaaattcttactctggtgttgagggcgaagggttacataaactgggatatattctacgagatataagtaaaataccgggcggagcgatgtacgcagacgatacagccggttgggatacaaggattacggaagatgacctccataacgaagagaaaattacccaacagatggatcctgaacaccgtcaattagcgaatgcaatatttaaactgacttatcaaaataaagttgttaaagtgcaacgccccacgccaacaggcaccgtaatggatatcattagtagaaaagaccagagagggagcggtcaagtaggaacttacgggctcaacacttttacaaatatggaagcccaacttataaggcagatggagggtgaaggagtcctctctaaagctgacttagagaacccgcatttacccgaaaagaaaattacccaatggttagaaacgaaaggagtcgaaagattaaaaagaatggccatttcaggggatgattgtgtagttaaaccaatagatgaccgtttcgcaaatgcattattggcgttaaacgatatggggaaagtaagaaaagatattcctcagtggcaacctagcaaaggctggcatgattggcaacaagtcccattttgctctcaccattttcatgaattaataatgaaggatggcagaaaacttgtcgtgccttgtcgaccacaagatgagttaataggacgggcaagaataagccaaggagctgggtggtccttacgagaaactgcatgccttggcaaagcatacgcccaaatgtggtctttaatgtattttcatcgaagagatttaagactcgcttctaatgcgatctgcagtgctgtgcctgttcactgggtaccgacatcaaggacgacttggtctatacacgcgcaccaccaatggatgacgaccgaagacatgctgacggtctggaacagagtatggatcgaagataatccttggatggaagataaaaccccggtaacgacatgggaaaatgttccatacttaggaaagagggaagaccaatggtgcggaagtcttataggtttgacatcaagagctacatgggctcaaaatatcccgaccgcaatacaacaagtaagatcgttaattggtaatgaagagttcctcgactacatgccaagtatgaaaagattccgaaaagaagaagagtcagagggcgcaatatggtaa

SEQ ID NO: 22997 - RNA, 9873 nt, synthetic construct
  misc_feature 1..9873: note = derived and/or modified CDS sequence (opt6) from DENV-3__JX669492__SS-prME
  source 1..9873: mol_type = other RNA
acctccttttgccttatgatgatattacccgccgcacttgcattccatctgacgtcaagagacggtgaacctaggatgatagtaggcaaaaatgaacgaggaaaatcactcttgtttaaaacagcaagtggaattaatatgtgtacgttaatcgctatggacctcggagaaatgtgcgacgatacggtgacatacaaatgtcctcatataactgaagtagaacctgaagacattgattgttggtgcaatttaactagcacttgggttacatatggtacctgtaaccaagcaggagaaagacgacgagacaaaagaagcgtagccttagcgccacatgtcgggatgggactagatacaaggactcagacatggatgtcagctgaaggtgcttggagacaagttgaaaaagtcgaaacatgggccttgcgacatccgggattcactatattagccctatttcttgcccattatataggaacttcgctcacccaaaaagttgtaatatttattctgttaatgttagttacaccaagtatgacgatgagatgtgtaggagttggtaacagagatttcgtggaaggtctttcgggagctacgtgggtagatgtcgttctggaacacggaggatgtgtcacaacaatggcgaaaaacaagccaaccttggacatagagcttcagaaaacggaggccacacaattagcgacattacgaaaactgtgtattgaagggaaaataactaatataacaactgatagtcgctgtccaactcaaggcgaggctgtcctcccagaagaacaggatcaaaattacgtctgcaaacacacatacgtagatcgtggctggggtaacggttgtggacttttcggcaaagggtccctcgttacatgcgcaaaattccagtgtttagaaccaattgaagggaaagtagtccaatacgaaaaccttaaatacacagtaattattaccgtccatactggggaccagcatcaagtaggaaacgagactcagggagtaacggcagaaatcacaccgcaagcaagtaccactgaagcaatacttcctgagtatggaacgcttggtttagaatgcagtccaaggacaggattggattttaatgaaatgattttattaacaatgaaaaataaggcgtggatggtacatcgtcaatggttctttgacctccctctaccatggacgtccggcgcgacaacggagacaccaacttggaatagaaaagaattgttagttacttttaaaaacgctcatgctaagaaacaagaagtcgttgtcttaggctctcaagaaggcgcgatgcataccgcacttaccggtgcaactgaaatacaaaactcgggtgggaccagcatatttgctgggcacttgaagtgtagactcaaaatggataaattggaattaaaaggcatgtcgtatgccatgtgtactaatacgtttgtactcaagaaagaagtcagcgaaacacagcatggaaccatactgataaaagtagaatataaaggggaagacgcaccatgtaaaataccatttagcacagaggacggacaaggaaaagcgcataatggacgccttattactgctaatccagtagtgactaagaaagaagaaccggtaaacatagaagccgaacctccttttggagagagcaacattgtcattggaatcggagacaatgcactcaaaattaactggtacaagaaagggtcaagcattggaaaaatgtttgaagctaccgcacgcggggccaggaggatggcgatattaggtgatacagcttgggattttggtagcgtaggtggagtactaaattcacttggcaaaatggtccaccaaatatttggatctgcctatacagccctgttcagtggtgttagttgggttatgaaaataggaataggagtactccttacttggataggactcaacagtaaaaatacgtctatgagtttcagctgtatagcaataggcattattacgctctatctcggagcagtagttcaagcagacatgggttgcgtaataaattggaaggggaaagaactaaaatgcgggtcaggaatctttgtaaccaacgaagtacatacttggacggaacaatataagtttcaagcggattcaccgaaacgattagcaaccgccatagccggggcttgggaaaatggggtatgcggtatccggtcgaccacacgtatggaaaacctgctatggaaacagattgctaatgaactcaactatatactatgggaaaataatataaaactcaccgtggttgtaggagatataataggagtattggaacaaggaaaaaggacattgacaccacaaccaatggaactaaaatattcttggaaaacctggggaaaagctaaaatagtcacggcagaaacgcagaatagctccttcataatagatggacctaacaccccagaatgtccaagcgcaagtagagcctggaatgtttgggaagtagaagactacggatttggagtgtttactactaacatatggctaaaactaagagaggtatatacccagttatgcgatcatcgtctaatgtcggcggctgtaaaagatgaacgagccgtacacgctgatatgggatattggattgagtctcagaaaaacggttcctggaaattggaaaaggcctcattaatcgaagtgaaaacatgcacatggccgaaaagtcatacgctatggagtaacggggtattagagtctgatatgataatacctaaaagtctagccgggccaattagtcaacataatcatcgaccggggtatcatacacagactgccggtccatggcatctagggaagttagaactagacttcaattattgtgaaggtacaacagtagttataaccgaaaattgtggtacaaggggaccgtcattaagaacaaccacagtttcgggtaaactaattcacgagtggtgctgcagaagctgcacattaccaccactcagatatatgggggaagacggatgctggtatggaatggaaataagaccgatatctgaaaaggaagaaaacatggtaaaatcgctggtttccgccggatcaggcaaggtcgacaatttcactatgggcgtactgtgcctggctattctattcgaagaagtaatgaggggtaaattcggcaagaaacacatgatagccggtgtattcttcacattcgttctattgctctcaggacaaataacttggcgtgatatggctcacaccctcatcatgataggaagcaatgcatccgatagaatgggtatgggggtcacctatcttgcgttaatagctacgtttaaaatccaaccatttttagcactgggtttctttttgcgaaaactaacaagtagagaaaacttgttactgggcgtagggcttgctatggcaacgactttacaattacctgaagacatagaacaaatggccaatggaatagctttaggtttaatggcgctgaaactaataacccagtttgaaacataccaattatggacggcattaatatctttaacctgtagtaatacgatgtttaccctcacagttgcttggaggaccgccactttaatcctagctggggtaagtctactgcctgtttgtcaaagcagctccatgcgcaagactgattggcttcctatggcagtggccgcaatgggagtaccccctctaccattatttatatttagtctaaaagatacgctaaagagaaggtcatggcctctaaacgaaggcgtgatggcagtagggttagtatctattttggcttcgagcttattgcggaatgacgtaccgatggcaggtccccttgttgctggtggtctactcatagcttgttatgtcattacaggaacatctgccgatttaacagtcgaaaaggcggcagacatcacgtgggaggaagaagcggaacaaaccggagttagccataaccttatgataactgtagatgacgatggaacaatgcgaataaaagacgatgagacagaaaatattcttaccgtcctattgaagactgcacttctcatagtgtcgggtgtttttccatacagcatccccgccaccttattagtatggcacacctggcaaaagcaaacgcagagatcaggcgttttatgggatgtaccatcaccaccagaaactcaaaaggccgaactcgaggagggagtttatcggataaaacaacaaggaatatttggcaaaacacaagtaggcgtaggagtacaaaaggaaggtgtatttcacaccatgtggcacgtgacacgcggagctgtattaacttacaacggaaaacgactagaacccaattgggcttcagtcaagaaagatctgatatcatatggaggcggatggagactaagcgcacaatggcaaaaaggcgaagaagtacaggtaatagcagtagaaccggggaaaaacccgaaaaacttccagacaatgcccgggacattccaaaccacaaccggagaaatcggcgctatagcactcgactttaaacctggcacgagcggatcaccgatcattaatagggaagggaaagtagtcggcctatacggcaatggggtcgttactaagaatggtggatatgtgagtggaattgcacaaacgaatgcggaacccgatggcccgactccagaactagaggaagagatgtttaagaaaaggaacctaactattatggatttacatcccggctcaggcaaaactcggaaatacttaccggctattgttcgagaagccataaaaagaagattgaggacactgatactcgcaccaaccagagttgtcgctgctgaaatggaagaagcattaaaaggtttgccaatcaggtaccagaccacagcgacgaaatctgaacatacgggaagagagatcgtggaccttatgtgtcatgcaacgttcacgatgcgcttgctatctccagttagagtgcccaactataatttaattataatggatgaagcacatttcacagaccctgcatccattgcagcaagaggatatatctcaactagagttggaatgggagaagccgcggccatattcatgacggcaactcccccaggaacggcagatgccttcccccagtcaaatgcaccaatacaagatgaggaaagggacattccagaaaggtcatggaatagtggaaatgagtggattacggatttcgcgggaaagactgtttggtttgttccttctattaaggcaggaaatgatatagcgaattgcctcaggaaaaacggaaagaaggtgatccaactctcacgtaagacctttgacactgaataccagaaaactaagctcaatgactgggattttgtagtaacaacagatatatcggaaatgggagctaatttcaaagcagaccgagttatagatccacgtaggtgtttgaaaccggtaatactaacagatggtccagaaagagttattctggctggtcccatgccagttactgccgcttcagcagcgcaaagacgtggtagggtgggaagaaatccccaaaaggagaacgatcaatacatatttaccggccaacccctaaataatgatgaggaccacgctcactggactgaggcaaaaatgcttttggacaatataaacactcccgaaggaataataccagcgcttttcgaacctgaaagggaaaagtcggctgctatagatggagagtatcgccttaaaggcgagtcgcgaaagacctttgttgaattgatgcgacgtggagatttgccggtatggctagcgcataaagtggcaagtgaaggcataaagtatacagaccgaaaatggtgttttgatggtcaacgaaataaccaaatattagaggaaaatatggacgtggaaatatggacaaaagaaggcgagaagaagaaactaagaccccgatggttagatgcgcgcacatactcggacccactagccctcaaagagttcaaagatttcgccgccggaagaaagtccattgcgctggatctagttactgaaataggtagagtgccgagccacttagcacacaggactcgaaatgcgcttgacaatctggtaatgctacacacatctgaacacggcggcagagcttaccgacacgcggtggaggaacttccagagactatggagactctcctactgctagggttaatgatattattaactggtggagctatgttatttcttatcagtggtaaaggcattggaaaaacgtcaattggtttaatatgtgtaatagcttctagtggaatgctttggatggcagagatacctctacaatggatagcatccgccatagtattggagttcttcatgatggtattactcatacctgaacccgaaaaacaacgcactccacaagacaatcagcttgcatatgtcgttattggaattttaaccttagcagcaataatcgccgcaaacgaaatgggccttttggaaacaactaagcgtgatttaggaatgtcgaaagaacccggagttgtttcacctacgagttatttagatgttgatctgcatccagctagtgcttggaccctatatgccgttgcaaccacagttataactcccatgcttagacatactattgaaaactctactgcgaatgtgtcgttagcagcaatagcaaatcaggcggttgtcttaatgggtttagacaaagggtggcctatatcaaaaatggatttaggagtgcctctattagcgttaggatgttattcacaagtgaacccattaacactgacagcggcagtattactattaataacacactatgcaataataggccccggccttcaagcgaaggctacacgagaagcacagaaaagaactgcagcaggaattatgaagaatccaactgtcgacggcatcatgaccatagacttagatccggtaatctatgactcaaaattcgaaaaacaactcggccaggtaatgcttctagttttgtgcgcagtacaattgttacttatgagaacaagttgggcgttgtgtgaggctctaacattagccacgggtccaataaccaccttatgggagggcagtcccgggaagttctggaatacaacaattgcagtttctatggccaatattttcaggggtagttaccttgcaggagccggtctagcgtttagtataatgaaatccgtcggaactggcaagcgaggaactggtagccaaggcgaaaccctgggagaaaaatggaaaaagaaactaaatcagctatctagaaaagaatttgatttatataaaaagagtggaattactgaagtcgatcgtacagaagcgaaagaagggttaaagcgtggcgagataactcaccacgcagttagtagaggaagtgcgaagttacagtggtttgtcgaacggaacatggtcatacccgaagggcgcgttatagatcttggatgtggcagaggaggatggtcatactactgcgctggactaaagaaagtaaccgaagtgagaggatacactaaaggcggtccagggcatgaagaacctgtgcctatgtccacatacgggtggaatatagttaaattaatgtcagggaaggatgtgttctatttacctcctgaaaagtgcgacacgttattatgcgacataggtgaaagctcacctagtcctacggttgaagaatcaaggactatcagggtcttaaaaatggtcgaaccttggttgaaaaataatcagttttgcataaaggttctaaacccttatatgccgactgtaatagaacacttagaaagactacaacgaaaacatggaggcatgttagtacgcaatcccctgtcgagaaacagtacacacgaaatgtattggataagtaacggaacgggtaatatagtagcatctgttaatatggtatcaaggttgttattaaatcgatttacgatgacacatagacgtcctaccatagaaaaagacgtagacttaggcgcgggtacaaggcatgtaaatgcagaacctgaaacaccaaacatggatgtcataggagaaagaataaaacgaataaaagaagaacataactcgacttggcactacgacgacgaaaatccatataaaacatgggcataccacggctcatatgaggtcaaagctactggttctgcatcatcaatgatcaatggtgtagtgaaattgttaacaaagccatgggatgtcgtccctatggtaacacagatggcgatgacagatacgacaccgtttggacaacaacgcgtttttaaagaaaaagttgatacccggacgccgaggtcaatgccagggacacggagagtaatgggtatcacagccgaatggctatggagaacgttggggcgcaataaaaagcccaggctctgcactagagaggagttcacaaagaaagttaggactaatgcagcaatgggtgcagtgttcactgaggaaaatcaatgggacagcgcaaaagcagcggtagaggatgaagatttctggaaattagttgatagagaaagagaactacataagctggggaaatgcgggagttgtgtatataatatgatgggaaaaagagagaaaaagttaggagagttcggaaaggcaaaaggatcaagagcaatatggtacatgtggttgggagctagataccttgagttcgaagcgctaggtttcctaaacgaagaccattggtttagtagagaaaactcatattcgggtgtcgaaggagagggactgcacaaactgggctatattttacgagacatatcgaagatacctggaggtgcgatgtatgcggatgacactgcagggtgggataccaggataacagaagacgacttacataacgaagagaaaataacacaacagatggaccctgaacatcggcaacttgccaatgcaatttttaagctgacgtaccagaataaagtagttaaagtacaacgaccaacacccacaggtacagtaatggatattataagtcgaaaggaccaaaggggtagtgggcaggtaggaacatacggattaaacactttcaccaatatggaagcacaactaatacgacagatggaaggcgaaggagtccttagtaaggcagatctagaaaatccacacctaccggagaagaaaattacccaatggctagagacgaaaggagttgaaaggcttaaacgaatggctataagtggagatgattgtgtagtgaagcctatagacgataggttcgctaatgcattgctagcacttaatgacatgggtaaagtaagaaaggatataccacaatggcagccaagcaagggatggcacgattggcaacaagtaccattttgctctcatcatttccacgaattaataatgaaagacgggagaaaattagtagttccttgtagaccccaagatgaattaataggaagggcaaggatttcccagggggccggatggtcactgagagaaacagcttgcttaggaaaagcgtatgcccaaatgtggagccttatgtatttccatcgaagagatcttaggctagcatccaacgccatatgtagcgcggtcccagtacattgggtaccgacaagtagaacaacatggagtatacatgcgcatcaccaatggatgacgactgaggatatgctaacagtatggaatcgagtgtggatagaagataacccttggatggaagacaaaacgcccgttacaacctgggaaaacgtgccatacctgggaaaacgtgaagatcagtggtgcggatcattgatcggcctaacatccagagccacatgggctcaaaatataccaaccgcaatccaacaagtccgtagtttaataggaaatgaagagtttctagattatatgccatctatgaagagattcagaaaggaagaagaaagcgagggcgcaatatggtaa

SEQ ID NO: 22998 - RNA, 9873 nt, synthetic construct
  misc_feature 1..9873: note = derived and/or modified CDS sequence (opt6) from DENV-3__JX669500__SS-prME
  source 1..9873: mol_type = other RNA
acgagtctctgtctgatgatgattttaccagcagcattagcgttccatttaacttcacgcgatggtgaaccacgaatgatagttgggaaaaatgaacgcgggaaatccttactgtttaaaactgcgtcaggtataaacatgtgtacattgatcgctatggacctaggagaaatgtgtgatgatacagtcacgtacaaatgtcctcatattactgaagtcgagcctgaagacatagattgttggtgtaatttaacttcgacttgggtaacctatgggacttgcaatcaagcaggggaacggcggagggataaacggtccgtggctctagcaccacacgtagggatgggactggatactagaactcaaacttggatgtctgctgaaggagcatggagacaagtagaaaaagttgaaacatgggcattaagacatccggggttcaccattctcgcactattccttgctcactatataggtactagcctaacacaaaaagtcgtaatattcatattattgatgttagttactccatccatgacaatgaggtgtgtaggtgttggaaaccgagactttgtagagggattatcaggagcgacatgggtagatgtagtcctagaacatggaggatgtgtcaccacaatggctaaaaataaacccacattagacattgaactccagaaaacggaagcaacccaattagcaacgttacgtaaactatgtatcgaaggtaaaatcaccaatataacaactgactcgcgttgtcctacacaaggtgaggctgtgttacccgaagaacaagaccaaaactatgtctgtaaacatacatatgtagatcgcggatggggtaatggatgcggattatttggaaaaggttcattagttacatgtgcgaaatttcaatgcttagaaccaatagaaggaaaagtagtccaatatgaaaatctaaaatacaccgttataattacggtacacactggtgatcaacatcaagtcggaaatgaaacccaaggtgttactgccgaaattacaccgcaagcatcgactaccgaagccatactgccagaatatggaacgctaggactagagtgcagcccaagaactggattggatttcaatgaaatgatcttactaaccatgaagaacaaagcctggatggttcaccggcagtggttctttgatctgcctctaccatggacatccggagcaactactgaaacacccacatggaataggaaagaattattggtaacttttaaaaacgcacatgccaagaaacaagaggtggtggtcttagggagccaggaaggtgcgatgcacactgcgctgactggagccacggaaattcaaaacagcggtgggacaagcatatttgcaggccatttgaaatgtaggctaaaaatggataaattagaattaaaaggaatgagctacgccatgtgcaccaacacgttcgtcctaaagaaagaagtgtctgaaacacaacatggtactatattaataaaagttgaatacaagggtgaagatgctccctgtaaaatccccttttctacggaggatggccaaggtaaagctcacaatggaaggttaattacagcaaatccagtggttaccaagaaagaagaaccagttaatatagaagcagaaccaccattcggagaatccaacattgtaataggtatcggagacaatgcactaaaaataaattggtacaagaaaggtagttcaataggtaaaatgtttgaagcaacagcaagaggagccagaagaatggcaattttaggggataccgcatgggattttggaagtgttggcggtgttcttaattcgttaggaaaaatggtacatcagatatttggttcagcttacacagcactatttagtggcgtttcctgggtcatgaagataggcatcggcgttttgcttacttggattgggcttaactctaaaaatacgtcgatgtctttttcttgtatcgcgataggaatcattacactatacttaggcgcagttgtacaagctgacatgggatgcgttataaactggaaaggcaaggaacttaagtgtggatccggcatttttgtgacgaatgaagtccacacgtggaccgagcagtacaagtttcaagccgacagtcctaagagattagcgacagcaatcgccggagcgtgggaaaatggcgtttgcggaatacgaagtactactagaatggaaaacttattgtggaaacaaatagccaacgagttaaattacatattgtgggaaaacaatataaaattaactgtggtagttggcgacataatcggtgttttagagcaaggtaagaggacacttacgccacagccaatggaattaaaatattcgtggaaaacatgggggaaagcaaagatagttaccgccgaaacacagaatagcagttttattatagacggaccaaacacaccagaatgtcccagcgcaagcagagcctggaacgtctgggaagtggaagattacggatttggcgtgttcacaactaacatctggctcaaattaagagaggtctacacccaactttgtgatcacagactcatgtctgctgcagttaaagatgaacgcgcagttcacgctgatatgggctattggatagaatcacagaaaaacgggtcatggaaattagaaaaagctagcctaatagaggtgaaaacgtgcacctggccaaaatcacacactttatggtcgaatggtgtcttagagtcggatatgatcattccaaaatcattggctgggcctatatcacaacacaatcataggccgggttaccacactcaaactgcaggcccttggcacttaggcaaacttgagctagactttaactattgcgaagggacgaccgtcgtaatcacagagaactgtggtactagaggaccgtctttacgaacgaccactgtcagtggaaaattaatccatgaatggtgttgtcgttcctgcacgcttcctccgctacgatacatgggagaagacggctgctggtatggtatggaaataagaccgatatccgagaaggaagagaacatggtaaaaagtttggttagcgctgggagtggaaaggttgataatttcaccatgggtgtcctatgtcttgcgatattattcgaagaagtaatgcgagggaaatttggcaagaaacacatgatcgctggcgtattctttacatttgtattactactctccgggcaaataacctggagagatatggcacacacccttataatgatcggcagtaatgcaagtgatcggatgggtatgggcgtaacctatctagctttaattgctacttttaaaatacaacctttcttggcactaggattctttttgcggaagttaacttcaagggaaaatctattacttggggtggggttagctatggcaacaacattacaattaccggaggacatcgaacaaatggcaaatggcatcgcccttggattaatggcactaaaacttataacacaattcgaaacataccagctgtggactgctctgataagccttacttgttctaatactatgttcacgctcacagtagcatggcgtacagccacattgatattggcaggcgtgagcctgctgcccgtttgtcagagctcgagtatgcgaaaaacagactggctaccaatggcagtagccgcaatgggcgtcccgccactcccgttattcattttcagtctaaaagacacattaaagcgtagatcttggccactgaatgaaggtgtaatggcagtaggcttagtaagtatattagcttcctccttgttgaggaatgacgtacccatggcaggacctctagtcgcagggggtttattgatagcatgttacgttatcaccgggacgtcagcagatttaaccgtagaaaaagcagcagacattacttgggaagaagaggctgaacaaacaggagtaagtcacaacctaatgattacagtcgatgatgacggtacgatgagaatcaaggacgacgaaacagaaaacatattaaccgtgctcctaaaaacagcattattaatagtatcgggagtattcccttactccatacctgcaactttattagtatggcatacctggcaaaaacaaacacaacgttcaggagtattgtgggacgtaccgagtccaccggaaacacaaaaagcagaattagaagaaggggtttatcgcataaaacaacaaggtatattcggaaaaacgcaagtaggggtgggtgttcaaaaagaaggagtattccacacaatgtggcacgtaacaagaggagctgtattaacgtacaatggaaaacgattggaacccaactgggcttcagttaagaaagatctgatcagctacggaggcggctggcgtctttcagcacagtggcagaagggagaagaggtacaagtaatagccgtagaaccgggcaaaaacccgaaaaacttccagacaatgcctggtacctttcaaacaactactggtgaaataggagcaatagcattagattttaaacctggtacgagtggttcacccataataaatagagaaggaaaagtagtaggattatatggtaatggggtagtaaccaaaaatggtggatatgtatcaggtatcgcccaaacaaatgcagaaccagatggtccaactccggaactagaagaagaaatgttcaagaaaagaaacttaacaattatggacctacacccaggtagcggtaaaactagaaaatacttacctgccatagttcgagaggccataaaaagaagattacgaaccttaatattagcgcccacacgtgtcgttgccgcagaaatggaggaagcactgaaaggactaccaataaggtatcagaccacagcgacgaaatcagaacacactggacgagaaatagtcgacctaatgtgtcacgccacgtttacaatgaggctcttatcgccagtacgggtccctaattacaacttaataatcatggatgaagctcatttcacagacccagcaagtatagcagctaggggctatataagcaccagagtaggcatgggcgaagcagctgcaatatttatgaccgcaacacccccaggaacagctgacgcatttccccaaagtaatgcacccatacaggatgaagaaagagatataccagagcggtcttggaatagtggtaatgaatggattaccgactttgctggtaaaacagtatggtttgttcctagtattaaagctggaaatgatatagccaattgtcttcgcaaaaatggcaagaaagtaatccaacttagccggaagacatttgatacagaatatcagaaaactaaactcaatgactgggactttgttgttacgaccgacatatctgaaatgggggccaactttaaggctgacagagtaattgatcctagaaggtgcctaaaaccggtgatattaacagatggcccagaacgcgttatattagccgggcctatgccagtaaccgctgcttcagcagcacaaaggcgcggtcgagtcggtaggaaccctcaaaaagaaaacgatcagtatatttttacaggccaaccattaaataatgatgaagatcacgcgcattggacagaggcaaaaatgttattagacaatataaatacacctgaagggataattccggctttatttgagcctgaaagggagaaaagcgcagcaatagatggagagtaccgactcaaaggagagtctaggaaaacatttgtggaactgatgaggagaggggatctaccagtttggctagcacacaaggtagcatctgaaggaatcaaatatactgatcgcaaatggtgcttcgatggtcagcgaaacaatcaaatattagaggagaacatggacgtagaaatttggacaaaagaaggagagaaaaagaaactccgcccgcgttggctagacgccagaacatacagcgaccccttggccctaaaggaatttaaggattttgcggcagggcgaaaaagtattgcgcttgacttagtaacagaaatcggaagagttcctagccacttagcacatcgtacgagaaacgctctagataatctagttatgctacacacctctgagcatggaggaagggcttaccgacatgcagttgaggagctaccagaaacaatggagactctcctacttttaggtttaatgatactacttacaggaggggcaatgcttttcctcatctcaggaaagggtatcggaaaaacttcaattggcctgatctgcgtaattgcaagttcgggtatgctatggatggccgaaattccactccaatggatagcttcagctatagttctcgaatttttcatgatggtactcctcattcctgagcccgagaaacaaagaacaccacaagataatcaattagcgtatgtagtaattggtatactcactctggcagcaatcatagcagccaatgagatgggtctcttagaaaccacaaaacgagacctcggaatgtcgaaagagccaggtgtggtaagcccgacttcatacttagatgtagacctgcatccagctagtgcctggaccctttatgcagtggcaactactgtcattacaccaatgctacgtcatactatagaaaattcgacagcgaacgtcagtctggctgctatagcaaatcaagcggtagtactgatggggttggacaaaggttggccaatatctaagatggatcttggcgtgccactattagcattaggatgctattctcaggtaaatccccttaccttaactgccgcagtactgttactcataacacactacgcaatcattggccctggtctacaagctaaagccacgagagaagcccaaaaacgcactgcagcgggaattatgaagaatccaaccgtagacggaattatgactatagatctagatcctgtcatatatgattcaaaattcgaaaaacaactagggcaagttatgctcttagtactttgcgctgtacagttgctgcttatgcgaacatcttgggccttatgtgaggccttaacgttagcaactggaccgattacaacgttgtgggaaggatcaccaggtaaattttggaatactaccattgcagtatcgatggcaaatatattcagaggaagttatttagcaggagctggtctagcttttagtataatgaaaagtgtcgggaccgggaaaaggggtacagggtcccaaggagaaacattgggcgaaaagtggaagaagaaattgaaccaattaagtcgcaaagaatttgatctatataaaaagagcggtataacggaagtagacagaactgaagccaaagagggtttaaaaaggggtgaaataactcatcatgcagtatcacgtggaagcgccaagttacaatggttcgtagagcgtaatatggtcataccagaaggccgtgtcattgacttaggttgcggaagaggcggctggagttactactgtgcaggattgaagaaagttacagaagtaagagggtatacaaaaggaggaccaggacatgaagaacctgtacctatgagcacatacggatggaatatagttaaactcatgagcggaaaagatgtattttatttaccaccggaaaaatgcgatactctcctttgcgatattggcgaatcatctccgtccccaactgtagaagagtctcgcaccattcgagtattaaaaatggtagaaccgtggttaaagaataatcaattctgcataaaagtcttgaatccttatatgccaactgtgatagagcatttggagcgattacaacgtaaacacggtgggatgctagttagaaacccactctcccgaaatagtacccacgagatgtactggataagtaacggcaccggaaatatagtagcgagcgttaacatggttagcaggctactattaaacagattcacaatgacgcacagacggccaactatagaaaaagatgtggatctaggcgcaggaaccagacacgtaaacgcagaaccggaaacgccgaatatggatgtcataggagaaagaataaaaagaatcaaagaagaacataatagtacctggcactacgacgatgagaacccgtataaaacatgggcttaccatggatcatacgaagttaaagcgactggcagcgctagttccatgataaacggggtagtgaaacttctaacaaaaccatgggatgtggtcccaatggtaacccaaatggcaatgactgacaccaccccctttgggcagcaaagagtgtttaaggaaaaagttgacaccagaacacctaggccaatgcctggaaccagacgagtaatgggaataaccgcggaatggctctggcgcacattgggacgtaataagaaacctagactgtgtacacgggaggaatttacaaagaaagttaggactaacgcagcaatgggagctgtgttcacagaagaaaaccaatgggattccgcaaaggcagctgtcgaagacgaagatttttggaagttggtcgatcgagaaagggaactacacaaattaggaaaatgcggctcctgcgtctacaatatgatgggaaaaagagagaagaaacttggagaatttggcaaagccaaaggaagccgagccatttggtatatgtggcttggtgctagatatctggagttcgaggctttgggtttcttaaacgaagatcactggttctcaagagagaacagctattcaggtgtagaaggagaaggattacataaactagggtacatattacgcgacatcagtaaaattccaggcggagctatgtatgcggacgatacagccggctgggatacgagaattactgaagacgacttacataacgaagagaaaatcacccagcagatggacccagagcatcgacaattggcaaatgcaatcttcaaacttacttaccaaaataaagtcgtaaaagttcaaagaccgactccaactggaactgtcatggatataatctcaaggaaggaccaacgcggttccggacaagtgggtacctatggtctaaatacatttacgaatatggaagcccaattaataagacaaatggagggtgaaggtgtactcagtaaagctgatctggaaaatccgcacctccccgagaagaagataacacagtggttagaaacgaaaggagtagagaggctaaaacgtatggcaatatctggtgacgattgcgtagtcaaaccaatagatgacagattcgcaaatgcattactcgctctaaatgatatgggaaaggtaaggaaggatattccccaatggcaaccctctaagggatggcacgattggcaacaagtacctttctgttcacaccatttccacgaactaatcatgaaggatggcagaaaattagtcgtgccttgtcgaccgcaagatgaattaatagggcgggcaaggatatcccaaggagctggttggtctctaagagaaaccgcttgtttaggaaaggcatacgctcaaatgtggtcactcatgtattttcatagacgcgacttacgactcgcatcgaatgcaatttgcagcgctgtacctgtgcattgggtccccacaagtcgaacgacttggtcgatacacgcgcaccatcagtggatgactacagaggacatgctcacggtctggaaccgagtttggattgaagacaacccatggatggaagacaaaaccccagtgactacttgggaaaatgtaccttacctaggaaaacgtgaagatcaatggtgtggatcattaataggtctaacaagccgagcaacctgggcacaaaatatacctacagctattcaacaggtaagaagtctaattgggaacgaagagttcctggattatatgccttcgatgaaaaggtttagaaaggaagaagaatcggaaggtgctatttggtga

SEQ ID NO: 22999 - RNA, 9873 nt, synthetic construct
  misc_feature 1..9873: note = derived and/or modified CDS sequence (opt6) from DENV-3__JX669497__SS-prME
  source 1..9873: mol_type = other RNA
actagcttatgtctgatgatgatacttccggcagcacttgcatttcatttaacgagcagagacggtgaacccagaatgatagtagggaaaaatgaacgaggaaaaagtttgctctttaaaacagctagtggtataaatatgtgcaccttaattgccatggacttgggagaaatgtgtgacgacacagtaacttataaatgtccccatattactgaagtagaaccagaggatatcgactgctggtgtaatctcacctcgacatgggttacatatggaacctgcaaccaagctggtgagagaaggagggataaacgatcagttgctctagccccacatgtaggaatgggacttgatactagaacgcaaacatggatgagtgcagaaggtgcctggcgacaagtagaaaaagtagaaacttgggcgttgagacatcccggttttactatactggccttattcttagcacactacataggcacttcgctaacacaaaaagttgtaatattcatactacttatgttagttacaccctctatgacaatgcggtgtgttggtgttggcaatagagactttgttgagggtctcagtggagcgacctgggtagatgtagtattggagcatgggggctgtgtgacgactatggccaaaaataaaccgacattagatatcgaactccagaaaacagaagctactcaactggcaacccttcggaaattatgtatagaaggcaagataacaaacatcacaactgacagtaggtgtccgacccaaggtgaagctgtgctgcccgaggagcaagaccaaaattacgtatgcaagcacacatatgtggacaggggttggggtaacggatgtgggttattcggaaaagggagcctggtgacatgcgccaagttccaatgtttagaaccaattgaaggaaaagtagttcagtatgaaaatctaaaatataccgtaatcatcacagtacatacgggtgaccaacaccaagtggggaatgaaactcaaggcgtcacggctgaaataacgccccaagcatctaccaccgaggcaatccttccagaatacggtacactcggcttagaatgcagtcctcgaacagggttagactttaatgagatgatacttctaactatgaaaaataaagcatggatggttcaccgccaatggttctttgatctaccgttgccctggacaagtggggcaacgaccgagacccccacgtggaatagaaaagaattactggttacgttcaaaaatgcacacgcgaagaaacaggaagtagtagttttaggatcacaggaaggtgcaatgcacaccgctttgaccggtgctactgaaatccaaaacagcggtggtacctcaatcttcgcaggacatctgaaatgtagacttaagatggacaaattagaactaaaaggtatgagttatgcaatgtgtaccaataccttcgtgctaaagaaagaagttagcgaaacacagcatggtactatactaataaaagtggaatataaaggagaggatgccccgtgtaagattcccttcagtactgaagatgggcagggaaaagcccacaacggacgcctcataacagctaaccctgtagttacaaagaaggaagaacctgttaacatagaagcagagccgccattcggtgaaagtaacatagtcataggaataggtgacaatgcgagtaaaattaattggtataaaaagggttcctcaataggaaaaatgttcgaggcaacagctagaggagcgagacggatggccatacttggtgacacagcctgggacttcggatctgtaggtggcgtattaaatagtttaggaaaaatggttcatcaaattttcggtagcgcctatacagcacttttctccggggtatcatgggtaatgaaaattggaataggcgtgttactcacttggatcggactaaatagcaaaaatacctctatgtctttctcttgtatcgcaataggcattatcacactatatcttggtgcagtcgttcaagcagacatgggttgtgttataaattggaagggcaaagaactcaaatgcggctcagggatatttgtaactaatgaggtccatacctggacagaacagtacaaatttcaagcagactcacctaagaggcttgctacagcgattgcaggagcatgggaaaatggagtatgtgggatcaggtctaccacgagaatggaaaatttactatggaaacagatcgcaaacgaattgaattatattctatgggaaaataatataaaactcacagtagttgtcggtgatataatcggagttctagaacagggaaaacggacactaacacctcaaccaatggaactaaaatattcttggaaaacatggggaaaagctaaaatagtcaccgccgagacacaaaactcatcatttattattgacggtcccaacacgccggagtgtccgagcgctagcagagcctggaacgtatgggaggtagaagattatggattcggagtcttcacgacaaacatctggctaaaactcagagaggtatacactcaactatgtgatcataggttgatgagtgcagcagttaaagacgaaagagccgtacatgcagacatgggatattggatcgagagtcagaaaaatggttcttggaaattagagaaggctagtttaatagaggttaaaacatgcacatggcccaagagccatacactttggtcaaatggagtattggaatcagatatgataataccaaaatcattagcaggacctatatcgcagcataatcatagacccggataccatactcaaacagccggtccgtggcatttaggcaaactcgagttagatttcaattactgtgagggcacgaccgtagttatcaccgaaaattgcggcacacggggacctagtcttagaaccacaaccgtctcaggaaaacttatacatgagtggtgctgcaggtcatgcaccttacccccgttacgatatatgggagaagatggatgctggtacggcatggaaataagaccaatctccgagaaggaagaaaatatggtaaaaagtttggtttccgcagggagtggtaaggtagataactttaccatgggagtcctctgtttggcaattctattcgaagaagtaatgcgagggaaattcggcaagaaacacatgattgcaggggtattctttacatttgttttacttcttagtggacagataacatggcgcgatatggcacacacattaattatgataggtagcaatgccagtgatcgtatgggcatgggtgtgacatacttagcactaatagcaacattcaaaatacagcctttcttggcactcggattctttttgagaaaacttacgagtagagaaaatcttcttttaggtgtaggcttagcaatggcgactacgctccaactaccggaggacatagaacaaatggccaatggcattgcgcttggattaatggctctcaagttaataacacaatttgaaacgtaccagctttggaccgcacttatatcgcttacatgctctaatacgatgtttacattgacggtagcatggcggactgcaacgctgattttggctggggtaagtcttctacctgtctgccaatcaagcagtatgcggaaaactgattggttgcccatggcagtagcagcaatgggtgtgcctccattacctctatttatatttagtctcaaagatacacttaaaaggagatcctggcccttgaacgaaggtgtgatggcggtgggtctagtcagtatcctagcatccagccttctccgcaatgatgttccaatggcaggaccgctagtcgctggtggtctattaatagcgtgttatgtaattacagggacatccgcagacctcaccgtagaaaaagcagcggatataacgtgggaagaagaagcagaacaaacgggagtgagccacaatctcatgattacagttgacgatgacggtaccatgagaattaaggatgatgaaaccgagaacatactcactgtcttactcaaaaccgcgctattaattgtatcaggggtctttccctattctataccagcaaccttactcgtctggcacacctggcagaaacaaacacaaaggagtggagttctctgggacgtacctagcccaccagaaacacagaaagcagaattagaagagggcgtgtacagaatcaagcaacaaggcatattcggaaagacacaggtgggagtaggagtacagaaggaaggtgtgtttcacactatgtggcatgtcactagaggagcagtactcacatataatgggaaacgattagaaccaaactgggcaagcgtcaagaaagatttaatatcatacggtggaggatggagattatcagcacaatggcaaaagggcgaagaagttcaagtcatagcagtggaaccaggaaagaaccctaaaaactttcaaacgatgcccggcacatttcaaacaacaactggagagataggagctattgctttggactttaaacctggaacgtccggctccccaataattaaccgtgaaggcaaagttgtagggctttacggcaacggcgtcgtaactaaaaacggagggtatgtgagtggcattgcacaaacgaatgcagaaccggacggtccaacaccagaattagaagaagagatgttcaaaaagcgcaatttaacgattatggatctgcatcctggatctggaaaaacacgcaaatatttgccggcaattgtaagagaagctatcaaaagacgacttagaactctgatattagctccaacgcgggttgtagccgcggagatggaagaggcattaaagggtttacctatacgatatcaaactacggcaacaaaatctgaacataccggtcgagaaattgtggaccttatgtgtcatgcaacgttcacaatgcgcttgctatctcccgttagagttcccaattacaacctaatcataatggatgaagcgcatttcacagatcctgcaagcatagcagcaagaggatatatatctactagggtaggaatgggtgaagcagccgcaatattcatgactgccacaccgccgggtacagctgatgcatttccacaaagcaacgcaccgatacaggacgaagaaagagatataccagagcgaagttggaactctggaaatgagtggatcacagactttgcggggaaaaccgtttggttcgtacctagcataaaagcggggaatgatattgcaaattgtttacgaaagaatggaaagaaagtgattcaactaagtagaaaaaccttcgatacagaataccagaaaacaaaacttaatgattgggactttgttgtaacaacggacatttctgagatgggcgcaaactttaaagcggacagagtaatagatcctagacgatgtctgaaaccagtcatactaacagacggtcctgaacgtgttattttggcagggccgatgccagttacagcagcaagtgcggcacaacgaaggggtagagtaggtcgaaatcctcaaaaagaaaacgatcaatatatctttaccggacaaccactgaataatgatgaagatcacgcacactggaccgaagcaaaaatgctcctggacaacattaacactccagagggtatcattccagcactattcgagccggaacgtgaaaaatcagcagcaatagatggagagtaccggctgaaaggagaaagccggaaaactttcgttgaattgatgagaaggggagacctcccagtatggctagcacataaagtggcaagtgaaggaataaaatatactgatcgcaagtggtgctttgatggtcaacgaaataatcaaatattagaagaaaacatggatgttgaaatctggactaaagaaggcgaaaagaagaaattacgtcctagatggcttgacgcaagaacatattcagatccattggcactaaaggaatttaaagatttcgccgccggtagaaagtctatagctctagatctcgtcacggagattggaagggttcctagtcatctcgctcatcggactcgaaacgccttggataacttggtaatgctacatacaagtgagcatggtgggagagcatacagacacgccgttgaagaactaccggagacgatggaaactttactattgcttggactaatgatattattaactggaggtgctatgctttttctcataagcggcaaaggaattgggaaaacaagcatagggttaatttgcgtaatagcatcgtccggcatgctatggatggcagaaattcctttacaatggattgcttcagctatagtcttagaatttttcatgatggttctgctaattccagaacccgaaaaacagagaacaccccaggataatcaattggcgtacgttgtgattggtatattaaccttagccgcaataattgccgctaatgaaatgggcttattagaaaccacaaaacgcgatcttggaatgagcaaagagcctggtgtcgtaagtccaacctcataccttgatgtcgatctacatcctgcgtctgcatggaccttgtacgccgtagctacaaccgtcataactccaatgctaaggcacactatagagaactcgaccgcaaatgtcagcctagcagctattgcaaaccaagcagtagtattgatgggcttggataaggggtggccaatctccaagatggatttaggtgtaccactactggcccttgggtgttattctcaagttaaccccttaacgctcactgctgccgtgttattactcattactcattatgcaataataggacctgggctacaagctaaagctactcgggaggcgcagaagagaacggccgcaggtatcatgaaaaatccaacagtcgatggtataatgaccatagaccttgatccagttatttacgacagtaagtttgaaaagcaacttgggcaagtaatgcttctagtcctctgtgcagtacaattgttattaatgcgaacatcatgggccttgtgtgaagctctcactttagcaacgggcccaataacaaccctctgggaaggatcaccaggaaagttttggaacactacaatagctgtctctatggcaaacatatttcgagggtcatatttagctggggcaggcctagcatttagcattatgaaaagcgtggggacagggaagcgagggactggatctcagggggaaaccctcggagaaaagtggaagaagaaacttaatcaacttagtcgcaaagaatttgatctttataagaaatctggaattacagaagtcgatagaactgaagccaaagaaggattaaaaagaggggagatcacccaccacgcagtgtctagaggaagtgccaagttacaatggtttgttgaaagaaatatggtcatacccgagggccgcgtgattgatcttggttgcggacgaggaggttggtcttattattgtgctggacttaagaaagtaactgaggtaaggggttatacaaaaggcggccccggtcatgaagaacctgttcctatgagtacatacggatggaatatcgtaaaactaatgtcgggtaaagacgtattctatctaccaccagagaaatgcgatactttgctttgtgatatcggcgaatcatcccccagccccaccgttgaggaatccagaaccattagagttctaaaaatggtggaaccatggcttaaaaataatcaattctgcataaaagtactaaatccgtatatgccaactgtaattgaacaccttgagcgactacaaagaaaacatggtgggatgttagtaagaaacccactgagccgcaattctactcacgaaatgtattggatttcaaacggaacaggcaatatagtagccagcgtaaatatggttagccgtctgctattaaacaggtttacaatgactcatagaagacctacaatagaaaaagatgtggacctaggtgctgggaccaggcatgttaatgccgaacctgagacacctaatatggatgttataggtgaaagaatcaagagaattaaggaagaacataactcaacatggcattatgatgatgaaaacccctataaaacatgggcgtaccacggaagctatgaagtcaaggcgacgggttcagctagttctatgatcaatggagtagtgaaattgttaactaaaccatgggatgtagtccctatggtaacacaaatggctatgacagacacgacgccgtttggtcaacagcgtgtattcaaagaaaaagtagacaccagaaccccacgatcaatgccgggtaccagaagggtgatggggattacagcagaatggttgtggaggacattaggtaggaacaagaaaccaagactttgcacaagagaagagtttaccaaaaaggtaaggacaaatgcagcgatgggggcggtctttaccgaagaaaaccaatgggatagtgccaaggcggctgtagaagatgaagacttctggaaattagttgatcgcgaacgagaattacacaaactgggtaaatgtggaagttgcgtttacaatatgatggggaaaagagagaagaaactgggtgaatttggcaaagccaaaggctcgcgcgctatctggtatatgtggctgggtgctcgttatctagagtttgaagcattgggctttttgaatgaggatcattggttttcaagagaaaattcctactctggtgttgaaggggaaggacttcataaattgggatatatattacgagatatctcaaaaatcccaggtggcgccatgtatgcagatgatacggccggatgggacacccgtataacggaagatgacttgcacaatgaagagaaaattacacaacaaatggacccagaacatcgacagttagccaatgcaatttttaaactaacctatcaaaacaaagttgtaaaagtacaaaggccaacccctacaggaactgttatggatatcatatcaagaaaagatcagaggggcagtggtcaagttgggacatatggtttaaataccttcacaaatatggaagcccaattgataaggcagatggaaggcgaaggagtattgtctaaggccgatttagaaaatcctcacctcccagaaaagaaaataactcaatggcttgaaactaaaggagtagaaagattaaaaaggatggctatatcaggcgacgattgtgtagttaaacctatagatgatcgattcgcaaacgcattactagcattaaatgatatgggcaaagtaagaaaagacattccacaatggcaaccttcaaagggatggcatgattggcaacaagtaccattttgttctcaccatttccacgaattaataatgaaagatggaagaaaattagtcgtaccatgccggccgcaagatgaattaataggtcgtgctcgaatcagccaaggagctgggtggtcattacgagaaaccgcctgtcttggcaaggcttatgcccagatgtggagtcttatgtacttccatagaagagacctaagacttgcaagtaatgctatttgcagcgctgttcctgtccattgggtaccaacctcaagaacgacttggtcaattcatgcacaccatcagtggatgactacagaagatatgctaaccgtttggaacagggtgtggattgaggataacccatggatggaagacaaaactccggtaacgacatgggaaaatgtgccatatttaggtaaacgggaggatcagtggtgtggatcattgataggacttacttccagagcgacatgggcccaaaacatacctactgcgatacaacaagtaagaagtttaatcgggaatgaggagttcctcgattatatgccatccatgaaaagatttcgaaaagaggaagaaagcgaaggtgctatatggtaa

SEQ ID NO: 23000 - RNA, 9873 nt, synthetic construct
  misc_feature 1..9873: note = derived and/or modified CDS sequence (opt6) from DENV-3__JX669501__SS-prME
  source 1..9873: mol_type = other RNA
acatcattatgcttgatgatgattctgccagcagcactagccttccacttaacaagtcgagatggtgaaccaaggatgatcgtgggtaaaaacgaacgaggaaaatcattactgttcaaaactgcctcgggtattaatatgtgcacactcattgcaatggacttaggggaaatgtgcgacgatacagtcacgtacaaatgtcctcacatcacagaagttgaacctgaagatatagactgttggtgtaacttaacgtccacatgggtgacatatggaacatgtaatcaagcaggagaaaggagaagggacaaaagatcagtggcactagcacctcatgttggtatgggtctagataccaggacgcagacgtggatgagcgcagaaggagcttggagacaagtcgaaaaagtagaaacatgggcacttagacatcccggtttcacaatactagctttatttctagcccattatatcggaacctctttaacacagaaagtagttatctttatacttttgatgctggtcactccatctatgacaatgagatgtgtaggggttggaaacagagattttgtcgaaggtctatctggagcaacatgggttgatgtagttttagaacacggtggttgtgtcacgacgatggctaaaaataaaccaaccctggatatagaactacagaaaaccgaagctacgcaattggcaactctgcgcaaattatgtatagaaggcaaaataactaacataaccacagacagcagatgccctacacagggagaagccgtactgcctgaagaacaagatcaaaactacgtatgcaaacatacctacgtcgatcggggttgggggaacggttgtggactgttcggtaaagggtctttggtaacatgtgctaaattccaatgtttggagccaatagaaggcaaagtagtacagtacgaaaatttgaaatatacagttatcattacagtacacactggggaccaacatcaagtcggcaatgaaacgcaaggtgtgactgctgaaataaccccgcaggcttcaacaactgaagcaattttgcccgagtacggtaccctgggacttgagtgttcaccaagaacaggcctagattttaatgaaatgatattactgactatgaaaaacaaggcttggatggttcataggcagtggtttttcgacctcccgctaccttggacatcaggagcaacgacagagactcccacatggaatcggaaagagcttttggtaactttcaaaaatgcgcacgccaagaaacaagaggttgtcgttctcgggagtcaagagggggccatgcataccgctttaaccggcgccacagaaatccaaaactcgggaggaacaagtatctttgcaggccatcttaaatgccggcttaaaatggataaactagaactaaaaggaatgtcttacgctatgtgcacaaatacatttgttcttaagaaagaggtaagtgaaacacaacacgggacgatactaattaaagtagagtaccgcggagaagatgcgccctgtaaaatcccattttccactgaggatggccaagggaaagcccacaacggaagactgatcacagcaaacccagtcgtaaccaagaaagaagaaccggtaaacatagaggctgaacctccttttggagaaagtaacattgtaatcgggatcggagacaatgctttgaaaataaactggtacaagaaaggatcctccattggaaaaatgtttgaagcaacggcacgtggagcaagaagaatggccatcttaggtgatacagcgtgggattttggctcagtgggtggcgtactcaactccctaggcaaaatggttcatcaaatatttggatctgcctacacggcgctgtttagtggtgtatcatgggttatgaaaataggcataggagttttattaacttggataggtctaaactcgaaaaatactagcatgagtttttcatgcattgcaataggtataataacactctatctgggcgcagtagtacaagcagatatgggttgtgtagttaactggaaaggtaaagaactgaaatgcggatcaggtatctttgttaccaatgaagtacacacatggaccgaacaatacaaattccaagctgattcgcccaaacgactagcaactgccattgccggtgcgtgggaaaatggtgtctgcggtataagatcaaccacacgcatggagaacttgctatggaaacagatagcaaacgaacttaattatatcctttgggaaaataatataaaattaaccgttgtggtaggagacattataggggtgctcgaacaaggaaaaaggacacttacacctcaacccatggaactgaaatattcatggaaaacatggggaaaagctaaaatagttacggctgaaacccaaaactcatcatttatcatagatggcccaaatactcccgaatgtcctagcgcttctcgtgcatggaatgtatgggaagtcgaagattacggattcggagtatttacaacgaacatttggttaaaattaagggaagtatatacacagctatgtgaccatagattaatgtcagctgcagtaaaggatgaacgcgctgttcatgccgacatgggttactggattgaaagtcagaaaaatggcagctggaaattagaaaaggcaagtctaatagaagttaaaacctgcacctggcccaaatctcacacattatggtcgaacggagttttagaatccgatatgattatacccaaaagcctcgcagggccaatctcccaacacaaccaccgcccgggatatcatacacaaacggctggaccgtggcatcttggaaaacttgaattagatttcaactattgtgagggtactaccgttgtgataacggaaaattgtggcacgcggggtcctagtcttcgaacaaccacggtatccggtaaattaatccacgaatggtgttgcaggagttgcactcttccacctttaagatacatgggggaagatggatgttggtacggcatggaaattagacccataagtgaaaaagaagagaatatggtcaaatcattagtctctgcaggctctggaaaagtagataatttcacaatgggagtcctctgccttgccattctcttcgaggaagtaatgaggggtaaatttggcaaaaagcatatgattgcaggagtcttctttacctttgtgcttttattgtcaggccaaataacgtggagggacatggctcacacactcactatgattggatccaatgctagtgatcgtatgggcatgggagtaacctatctagcgctaatagctacttttaaaatccaaccattcttagctctaggattctttctgagaaaattgactagcagggaaaatttacttttaggtgtgggactagctatggcgacgaccctacaacttccagaggatatagaacagatggccaacggaatagcactgggactgatggcactcaaattaatcactcagtttgaaacgtatcaactatggactgccttaatctcgctaacctgctctaacaccatgttcacacttaccgtggcgtggagaacggctacactaatactcgctggtgtgtccttgttacccgtatgtcaatcaagtagtatgcgaaagacggactggcttcccatggcagttgcagcgatgggagtaccgccattaccacttttcatattttccctcaaagacaccctaaaaagacgatcttggcctttaaatgaaggagtaatggcagtaggcctagtgagcatattagcttcctcgctactaagaaatgatgtacctatggcgggaccattagtagctgggggacttctaattgcatgttatgtaatcacaggaacgtccgccgacctcacagttgaaaaagctgccgatattacctgggaagaagaagccgaacaaactggcgtttctcacaacctgatgataaccgtagacgatgatggaacgatgcggataaaagatgatgaaaccgaaaacatactcactgtattattaaaaactgctctcctgatagtttctggagtttttccttattcgattccagctacgttgctagtctggcatacgtggcagaagcaaactcaaagatctggagttttatgggatgtaccttctcctcctgagacccaaaaagctgagctcgaggaaggagtctacagaatcaaacaacaaggaatctttggcaaaacacaagttggggtaggtgtgcagaaggagggcgtgtttcatacaatgtggcatgttacaagaggggcagtcctcacgtacaacggcaaacgattagagcccaactgggcatccgtgaagaaagatttaatctcttatggtggaggatggcgattaagtgcccagtggcaaaagggggaagaagtacaggtcatcgcagttgaacctggcaaaaaccccaaaaattttcaaacgatgcctggaacttttcaaaccaccactggagaaatcggcgcaatcgccttagattttaaaccaggaacgtccggaagtccaataatcaacagggagggaaaagttgtaggactgtatggaaatggtgttgtaaccaaaaatggtggttacgtatcgggtatagcacagacaaatgcggaacctgatggcccaacgcctgaattagaggaagaaatgtttaagaaaagaaacttaacaatcatggatttacatccgggaagtggcaaaacaagaaaataccttccagcaatagtccgggaagctattaagcgtagactaagaactttaattttggcacccacaagagtagtcgctgctgaaatggaagaagcactaaaaggactcccaattaggtatcagactactgcaactaaaagcgagcatacaggaagagagatcgttgatttaatgtgccacgcaacttttactatgagactacttagccccgtacgcgttccgaattacaacctaataattatggatgaagctcactttactgatccggcttcgattgctgctcgagggtatatatctacaagggtgggcatgggcgaagccgccgcaatcttcatgacggcaacacctccaggaaccgctgatgcatttccacaaagtaatgctcctatccaagacgaagaaagagacataccagaaagaagctggaactcagggaacgaatggataaccgacttcgccggtaaaacggtatggtttgtacctagtataaaggccggaaatgatatagctaactgcctcaggaaaaacggtaagaaagtaatccaactatctagaaaaaccttcgatacagaataccagaaaacaaaactgaatgattgggatttcgtagttacaactgatatatcagaaatgggtgcaaactttaaagcggatagggtaatagacccacgaagatgcctaaagccagtaatcttaaccgacggaccggaaagggtcattttagcagggcccatgccagtgactgcagcctctgcagcccaaagacgagggagagtaggtcgaaatccacaaaaagaaaacgaccaatacatttttacaggacaacctttaaacaatgatgaagatcatgcccattggacagaagccaaaatgttactagacaatataaatacaccagaaggcatcatcccagccctattcgaaccagaaagagaaaaatcagcagcaatcgatggagaatatagactgaaaggggaaagtagaaaaacatttgttgaattaatgagaagaggcgacctgcccgtgtggctcgctcataaagtagctagcgagggaataaagtatactgatagaaaatggtgtttcgacggccaaagaaataaccagatattagaggaaaatatggacgtcgagatttggactaaggagggtgagaagaagaaattacgaccaaggtggttagacgctagaacttacagtgatccacttgcgttaaaggagttcaaagattttgccgccgggcgcaagtctatagcactggatctagtgacagagattggacgcgtaccctctcacctggcacacaggacgcgaaacgccttagataatttagtaatgttacacaccagcgagcatgggggaagggcgtacagacacgctatggaggaattaccagaaactatggaaacattactattattaggattaatgattctactcaccggaggcgcgatgctatttttaatatctggaaaggggattggtaagacatcaattgggctcatttgcgtgatagcaagtagtggtatgttgtggatggctgagatacctcttcagtggatcgctagtgcaatcgtattagagttctttatgatggtattattaataccagagccagaaaaacagaggacccctcaagataaccaactagcatatgtagttataggtatactaaccttggcagcaataattgcagctaacgagatgggtttattagagacaacaaaacgagatctgggtatgtcaaaagaacccggcgtcgtttcccctacatcgtatcttgacgtggatttgcatcctgctagtgcatggactttatatgcggttgccacaacagtaataactcctatgcttagacacactattgaaaatagtacagcaaatgtgtcattggccgcaattgcaaatcaagctgttgtgttaatgggcttggacaaggggtggcctatatcaaagatggatttaggagtaccccttttagcattaggttgctattcacaagttaatccattaacattaaccgcagcagtcttattactgatcactcattatgcaataatcgggcctggattacaagcaaaagctactagggaagcccaaaagaggactgccgctggaattatgaaaaatcctactgtggacggaatcatgacgatagatttggatccagttatgtatgactctaaatttgaaaaacagttaggacaagtaatgcttttggtattgtgtgcagtccaactattattaatgagaacatcctgggcattgtgtgaggctctaacactcgcaacaggcccaataacgacattgtgggaaggttctccagggaaattttggaacacaactatagccgtaagcatggctaatatttttagaggttcatatctagcaggagctggcttagcgttcagcataatgaaatcagtcggcacggggaaaagaggaacaggatcgcagggagaaactttgggtgaaaaatggaagaagaaattaaatcaattgagccgtaaagaatttgatctgtacaagaagagtggcatcactgaagttgatagaactgaagcgaaagaaggactaaaacgaggggagattacacatcacgcggtatccagggggagcgcaaaactacaatggtttgtagaaaggaacatggtaattccagagggacgcgttattgacttgggttgcggacgtggtggctggtcttattactgtgcaggccttaagaaggtaactgaagtacgcggttatacaaagggcggtcccggtcatgaagaacccgtcccgatgagtacttatgggtggaatatcgtcaaactgatgtcaggaaaagatgtgttctatctccctccggagaaatgcgatacactactctgtgacatcggtgagagctcaccgtcgcctacagtagaggagagcaggacaattagagtcctaaaaatggtggaaccatggctcaaaaataatcaattttgcatcaaagtccttaatccatacatgcccacggtaattgaacacttagagcgattacaaaggaaacatggcgggatgttagtgcggaatccgctaagcagaaattctacccacgagatgtattggatctcaaacggcactggaaacattgtagcatcggtcaacatggtatcccgattgcttcttaatagatttactatgacacatcgaaggcctacaatagaaaaagatgtagatctgggggcaggcacaagacatgtcaacgcagaaccagaaactccaaatatggacgttattggtgaaagaattaagaggatcaaagaagaacacaactcaacatggcattatgacgatgaaaatccttataaaacatgggcgtaccacggatcgtacgaagtaaaggccaccggtagtgcctcatcaatgataaatggggtcgttaaattattgaccaaaccctgggacgttgtgccgatggtaacacagatggcgatgaccgacacaacaccgttcggtcaacaaagagtattcaaagagaaggttgatacaagaacacctagatctatgccgggaacaagaagggtaatgggcataacggcagaatggctgtggcgaactctaggaagaaacaagaaaccaagattatgtacaagagaagagtttactaagaaagtacggaccaatgctgcaatgggagcagtttttacggaggagaatcaatgggattcagcaaaagctgcggttgaagacgaggacttttggaaacttgtagatagagaaagagagttacacaaactggggaaatgtggttcatgtgtatataacatgatgggaaaaagagagaagaaactaggtgaatttggtaaagcaaaaggaagcagagctatctggtatatgtggcttggggcacgatatttagaatttgaagcgttaggtttcttgaatgaagatcactggttcagtagagaaaacagttattctggtgtagagggggaaggtctgcataaactaggttacattttaagagatatatcaaaaatacctggtggggctatgtatgcagatgacacagctggttgggacacgcgaataactgaggatgacttgcataatgaagagaaaattacccaacaaatggacccggaacaccgacaacttgcaaatgcaatatttaagttaacatatcaaaataaagtagtgaaagttcaaagaccaacaccaacaggaaccgtaatggatatcataagcaggaaagatcaaagaggttcaggacaagtcggcacttatggattaaacacatttacaaacatggaagctcagctaataagacaaatggagggcgaaggagtactttccaaagctgacctcgaaaatcctcatctgcctgagaagaaaataactcaatggttagaaacaaaaggtgttgaacggttaaaaagaatggccataagcggtgatgattgtgtcgttaaacctattgatgaccgcttcgccaatgcgttattagcgttaaatgatatgggtaaggtgcgaaaagacattccacaatggcaaccctcaaaaggatggcatgactggcaacaagttccattttgtagccatcatttccatgaactaataatgaaggatggccgtaagctagtcgtgccgtgccgaccccaagacgaactaataggtagggctagaatatctcagggtgcaggatggagtctacgagaaaccgcatgtctaggtaaagcctatgcacaaatgtggtcgctaatgtattttcatagaagggatttacgcctagccagtaacgctatttgcagcgctgtcccagtacattgggtaccaacatctagaaccacgtggtccatccatgcacatcaccagtggatgacaacagaagatatgctaactgtttggaacagggtatggatagaagacaatccttggatggaggataaaactccagtgacaacttgggaaaacgttccatacttgggtaaaagagaagatcaatggtgtggctcgctaattggactgacatctagagccacatgggcacaaaacattcctacagcgattcaacaagtccgatcattaataggtaatgaagagttcctcgattatatgccgtcgatgaaaaggtttcgcaaagaagaagaaagcgagggcgctatctggtaa

SEQ ID NO: 23001 - RNA, 9873 nt, synthetic construct
  misc_feature 1..9873: note = derived and/or modified CDS sequence (opt6) from DENV-3__JX669494__SS-prME
  source 1..9873: mol_type = other RNA
acaagtctttgtcttatgatgattcttccagctgctttagcttttcacttgacatcacgtgacggagaacctcgaatgatagtagggaaaaacgaaaggggaaaatcgcttctcttcaaaacagcatctggtacaaacatgtgcactctaattgctatggatctaggtgaaatgtgtgatgatactgttacttataaatgcccccatataacggaagttgaacccgaggatatagattgctggtgtaatttaacttcaacatgggttacctacggaacttgtaatcaagcaggcgagcgccggcgagataaaagatcggttgcactagcaccacatgttgggatggggttagatacaaggacacaaacttggatgtcagcagagggagcttggagacaagtcgaaaaagtcgagacttgggcattacggcatcctgggttcactattctagcactttttctagcccattacattggaacttcgttgacgcaaaaagttgtgatcttcattttactaatgttggtcaccccctcaatgaccatgcggtgcgtcggtgtaggtaacagagattttgtagaaggcctatctggtgctacatgggtcgacgttgtactagaacatggaggatgtgtgacaaccatggcgaaaaataaacccactttagatattgaattgcagaaaactgaagccacacagttagccaccctcagaaaattatgcatcgaaggaaaaattactaacattacgacagattcacgatgtccgacccaaggagaggctgtactaccagaggaacaagatcaaaattatgtttgtaaacatacttacgtagatcgaggatgggggaacggttgtggtttatttggtaaaggaagtttagtgacatgcgcaaaatttcaatgtctagaaccaatagaaggaaaagtagtccaatatgaaaacttaaaatacacagtgatcatcactgtacacacaggtgatcaacatcaagttggaaatgaaacccaaggagtcacagctgagattactccccaagcatcgacaacagaagccatccttcctgaatacggcactcttggcttggaatgtagtccacggactggtctcgactttaatgaaatgatccttctaactatgaaaaacaaagcctggatggtacacaggcaatggttctttgatttaccccttccgtggacgagtggagcaacaacagaaacaccgacttggaataggaaagaactcttagtaacatttaaaaatgcgcatgctaagaaacaagaagtagttgtcttaggctctcaggaaggagcgatgcacactgctttaactggagctacagaaattcaaaattctggcggaacatcaatatttgcaggacatttaaaatgtcgattaaaaatggacaaattagaacttaaagggatgtcatacgctatgtgtacaaatacgttcgttttgaagaaagaggtaagcgaaactcagcatggaacgatattgataaaagttgaatatagaggggaagacgcaccttgcaaaatacctttttccactgaagatggacaaggcaaagcgcacaacggccgtctcattacagcaaatccggtcgtaactaagaaagaggaaccagtgaatattgaagcagaaccacctttcggagagagtaacatagtaatcggcatcggggataacgccttaaaaattaattggtacaagaaaggttcatccataggcaaaatgtttgaagccactgctcgaggagcaagaagaatggcgatcttaggcgatacagcgtgggatttcggctctgttggaggagttcttaactctctaggtaaaatggtacatcaaatttttgggagcgcttacactgcattgttttcgggagtctcttgggtgatgaaaattggtattggagtcttattaacctggataggtttaaacagcaaaaatacaagtatgagcttctcgtgcatagcaatcggcatcatcacgctctacttgggcgctgtagtccaggctgatatgggatgtgttattaattggaaaggaaaagaactaaaatgtggatccggaatatttgtaacgaacgaagtgcatacatggaccgaacaatataaatttcaagcagatagtccaaaaagattagctacggcgattgctggagcctgggaaaacggagtctgcgggataaggtcaacaacaaggatggaaaacttgctctggaaacaaatcgcaaatgagcttaactacatactttgggaaaacaatatcaaactcacagtggtagtgggcgacattattggtgtcttagaacagggtaaacgaactttgacaccccagccaatggaactaaaatattcatggaaaacatgggggaaagcaaaaatagtgaccgcagaaacacaaaatagttcatttattatagacggaccaaacacgccggagtgtccgagcgcgtctagagcatggaatgtttgggaagtagaagattatggctttggagtttttaccacgaatatctggctcaaattaagggaagtttacacccaactgtgtgatcatcgtttaatgtcggccgcagtaaaggatgaaagagccgtacatgcagatatggggtattggatcgaatctcagaaaaatggaagttggaaattagaaaaggcttcgctaatagaagtcaaaacatgcacatggccaaagagccatacattgtggagcaatggagtcctagaaagtgatatgatcattccaaaatcgctagcaggtcccatcagtcaacacaaccacaggccagggtatcatacacagacggccgggccctggcatctaggtaaactcgaattagactttaattattgtgagggaacaacagtagtcatcaccgaaaactgtggcacacggggcccttctcttcgaaccacaacagtatccgggaaactgatccacgaatggtgttgcagatcctgcacacttccacccttgcgctatatgggggaggatggctgctggtacggaatggaaattcgcccaatatcagaaaaagaagaaaacatggttaagagcctagttagcgctggatctggcaaagttgacaatttcacgatgggagtactatgcttagctatactatttgaagaagtaatgagaggaaaatttggcaagaaacacatgatagcgggagtactttttacgtttgtattattattatctggccaaattacctggcgagatatggcacatacattaattatgattggttcaaacgcgtcagatcgtatgggtatgggagttacatatttagctctaatcgcaacttttaaaatacaaccgtttctagctttgggattctttcttagaaagctcaccagcagggagaatcttctactaggagtcggactagcaatggcgacaacgctccagcttccagaagacatagaacaaatggctaacgggatagcattaggattaatggcattaaaacttataactcagttcgagacataccaactatggacagccttaatttccctcacgtgtagcaacaccatgttcactttaacagtagcatggcgaactgctactttaatcctagcaggagtatcactattgccagtttgtcaatcctcctcaatgaggaaaacagactggctacctatggcggtggcagctatgggcgttccaccgctacccctatttatcttttcactaaaagacacactaaagagaaggagctggccgctcaatgaaggtgtgatggcagtaggtttagtaagtattttggcttcaagtctactaaggaacgatgtaccaatggcaggaccattagtggccggtggtttacttatagcctgctatgttatcacgggaacttcagctgatttgacagtagagaaagcggcagatataacatgggaagaagaagccgaacagactggggtgagccacaatcttatgataactgtagatgatgacggtaccatgcgcataaaggacgatgaaacagaaaatattttaaccgtattattgaaaacagctttgctaatcgtttctggcgtcttcccgtatagcattccagcgacgttacttgtatggcatacatggcaaaaacaaacacagagatcaggcgtcctatgggacgtgccttcaccaccagaaacccaaaaggccgaactcgaagaaggtgtatataggattaaacaacaaggtatcttcggaaaaacccaagtgggagttggcgtacaaaaagaaggggttttccataccatgtggcacgtaactagaggggcagtactaacctacaatggaaaaaggctagaacctaactgggcatctgttaagaaagatctcatttcatatggaggagggtggaggttatccgctcaatggcaaaaaggtgaggaagtccaggttatcgctgttgaacccggcaaaaatcccaaaaattttcaaaccatgcctgggaccttccagacgactaccggagagataggagcgattgcattagattttaaacccggtacgagcggtagccccataattaaccgtgaaggaaaagtggtaggtctgtatggaaatggggtagttaccaaaaatggtggctatgtatccggaatagcacaaacaaatgcagaaccagatggacctacacccgaactcgaagaggagatgttcaagaaaaggaacctaacgatcatggacttacacccaggatccggcaagactagaaaatatttaccagccattgttagggaggcgataaaacggaggttgcgaacgttgattttagcgcccacaagagttgtggctgcagaaatggaggaagcactgaaaggtctaccaatccgatatcaaaccaccgcaacaaaatctgagcacacagggcgtgagatcgtcgaccttatgtgccatgcaacattcactatgaggttactgtctccagttcgagtgccaaattataatttaataataatggacgaagctcacttcacagacccagcatcgatagctgcgcgagggtatattagcacgagagtgggaatgggggaagcagccgctatatttatgactgcgacaccgcctgggacagcggacgcttttccacaatccaacgcgcccatccaagacgaagagagagacatacctgagcgttcttggaactcagggaatgaatggataacggattttgcaggaaaaactgtgtggttcgtaccttcaattaaagccggcaacgatatagcaaattgtcttaggaaaaatgggaagaaagtgatacaacttagcagaaaaacctttgacacggaatatcaaaagaccaagctaaatgattgggattttgtagtaacgactgatatatccgaaatgggtgcaaactttaaggccgaccgagtcatagatccgagacgatgccttaaacctgtaatacttactgacggtccagagcgtgtcatcttggcaggtccgatgcctgtaactgcagcttcagcagcccaaaggcggggaagagttgggagaaatccccaaaaggaaaatgatcaatatatattcacggggcaaccgctaaataacgacgaagatcatgcacattggacagaagcaaaaatgcttctcgataatataaataccccagagggcattattcccgcattattcgagccagaaagggagaagtcagccgcaatagatggggagtatcggctaaaaggagaatcccgtaaaacttttgttgaattaatgaggagaggcgatctacctgtttggctagcccataaagtggcctccgaaggaattaagtataccgatagaaagtggtgtttcgatggtcaaagaaataaccagattttagaagagaacatggacgttgagatatggaccaaagagggtgagaagaagaaattaagaccaagatggctggatgcgagaacctattctgatccgttagcactaaaagaatttaaggatttcgctgcgggtaggaaaagtatagcgcttgacttagttactgaaatcgggcgggtaccatcgcatttagcacatcgaacacgcaacgcattagacaacttagttatgctgcatacatcagagcatggtggtcgagcgtacaggcacgcagtagaagaacttccagagaccatggaaactttactactgttggggttaatgattttactaacaggcggagcgatgctattcctaatctcggggaagggtattggcaaaacaagtattggattaatctgtgtaatagcttctagtggtatgttatggatggctgaaattcctctgcagtggatagcatccgcaatcgtcctcgagttctttatgatggttctgctcataccagaaccagagaaacagcgcacaccacaggataaccaattggcatacgttgttatagggattcttacgctagcagcaataatagcggcgaatgagatgggattgttagaaacaacgaaacgggatcttggaatgtcaaaagaacctggtgtagtatcacctacatcatacctcgatgtcgatctccaccccgcctcagcatggacgctatatgcagttgcaacgacagtaataacacctatgcttcgtcacacaattgagaactcgactgctaacgtaagccttgcagcaatagcaaaccaggcggtcgttcttatgggacttgacaaaggatggccaatctcaaagatggacttaggagtgccattgttagcattgggatgttatagtcaggtgaatcctcttactttaacggcagcggtacttctcctaatcacgcattacgcgattataggcccaggacttcaggcgaaagcgacaagggaagcccagaaacggacagcagcgggaatcatgaagaacccaacagtggacggcataatgactatagacttggatccggtaatatacgattcaaaatttgagaaacaactaggccaggtcatgcttctagtgctctgtgcggtgcagttgctacttatgcgcactagctgggccttatgtgaggctttaacgctcgcaacaggtcctatcactactttatgggaaggctctccaggaaaattctggaacacaacgatagcagtgtcaatggcaaatatatttagaggctcatacctcgccggtgcgggtttggcctttagtataatgaagtccgtcggaactggtaaacgaggaacaggttcgcaaggtgaaacattaggtgagaagtggaagaagaaactaaaccaactgtcacgaaaagaatttgatttatacaaaaagagtggaataactgaagttgataggacagaagcgaaagaaggacttaagagaggtgaaatcacacatcacgccgtatcaagaggtagtgctaaacttcaatggtttgttgaaagaaatatggtaatcccagagggaagagtaatagatctaggttgtggcagaggtggatggtcttattactgcgcaggtctaaagaaagtcacagaagttcgcggatatacgaaaggaggtcctgggcatgaagaacctgtaccgatgagcacatatggctggaacatagtgaaattaatgtcaggcaaagacgtcttctatctaccaccggaaaaatgtgacactttgttatgtgacatcggagaaagttctccaagtcctactgttgaggaatcgcggacgatacgcgttctaaaaatggtagaaccttggctcaaaaataatcaattttgtataaaagtactaaatccctacatgccaactgtcattgagcatctcgagaggctccaaagaaaacacggtgggatgttagtgaggaatccattaagtcgcaattcaacacatgaaatgtattggatttcaaacgggacaggcaatatcgtagcttcagtcaacactgtatcacgcttacttttgaatagattcacaatgactcataggagacctacaacagaaaaagacgtcgacctcggtgctggaacaagacatgttaatgcagaacctgaaacgcccaacatggatgttatcggagaaagaattaaacgcataaaagaagaacataactcaacctggcactatgatgacgaaaatccatataaaacatgggcgtaccatggaagctatgaagtaaaggctacaggatccgcatcgtcaatgataaatggtgtggttaaactcctcaccaaaccctgggatgtagtaccaatggtgacacaaatggctatgaccgacacaacaccatttggtcaacaaagagtatttaaagaaaaggtcgatacaaggactcccagatcaatgccgggaacaaggcgtgtcatgggaatcactgcagagtggttatggcgtacactgggacgaaacaagaaaccccgattatgtaccagagaagagttcactaagaaagtacgaacaaacgcagcaatgggggcggtatttactgaagaaaaccaatgggactcagcgaaagctgctgtggaggacgaagacttctggaagctagttgatcgtgagagggaactccataaattagggaaatgtggcagctgcgtatacaatatgatgggaaaacgagagaagaaattgggcgaatttggtaaagctaagggaagccgagcaatatggtacatgtggttaggcgctcgctatctggaatttgaagcattaggttttctaaatgaggaccattggttttcgagagaaaattcatatagcggcgtggaaggtgaaggactgcataagttaggctacatccttcgagatataagtaaaataccgggtggagctatgtacgccgacgatacggcaggatgggacacgcgcattacagaagacgacttacataatgaagagaaaattacacagcaaatggacccggaacaccgtcaactagctaacgcgatatttaagttgacttaccaaaataaagtagtaaaagttcaacgcccaacgcccacaggtaccgtaatggatatcatatcaaggaaagaccagcgaggatctggccaagtcggtacttatggcttaaacacgttcacaaatatggaagcccagttaataagacagatggagggggaaggtgtcttatcaaaggcagaccttgaaaacccacacttacccgagaagaaaataacacaatggctggaaaccaaaggagtggaacgattaaaaaggatggcaatctcaggcgacgattgcgtggtaaaacctattgatgacaggttcgctaatgccttattagccctaaacgatatgggcaaagtgcgtaaagatattccacaatggcaaccctccaaaggatggcatgattggcaacaggtccctttctgttctcaccattttcatgaattgataatgaaagacggaagaaagttagtggttccatgtaggccacaagacgaattaatagggcgtgcaagaatatcacaaggtgcaggttggagcttacgagaaacagcgtgcctcggaaaagcatatgctcaaatgtggtcgctgatgtactttcaccgaagagatttgagactagctagcaacgcaatatgttctgcggtcccagtacattgggtaccgacaagtagaactacttggtcaatacatgcgcaccatcaatggatgacaacagaagatatgcttacggtgtggaatcgagtatggatcgaagacaatccgtggatggaagacaaaaccccggtcacaacatgggaaaacgtcccctatctcggcaaacgcgaagatcaatggtgcggctctcttattgggctcacctcgagagcgacatgggcacaaaatatacctacagcaatccaacaagtaagaagtttgataggtaatgaagaatttctggattacatgccttcaatgaaaagattcagaaaagaagaggaaagtgaaggggctatatggtaa

SEQ ID NO: 23002 - RNA, 9873 nt, synthetic construct
  misc_feature 1..9873: note = derived and/or modified CDS sequence (opt6) from DENV-3__JX669503__SS-prME
  source 1..9873: mol_type = other RNA
acatctttttgcctaatgatgatactgccagctgctctcgcattccatttaacaagtagagatggtgaacctagaatgatagtcggtaaaaatgaaagaggaaaaagtttactttttaaaacagcaagcggaatcaatatgtgcacgctgatagcaatggatttgggagaaatgtgtgacgatacagtgacgtataaatgccctcacataactgaagtggaaccggaagatatagattgttggtgtaaccttaccagtacatgggtaacttatggaacatgtaaccaagcaggagaaagaagaagagataaaagaagtgtagctctcgcacctcacgttgggatgggactagatactcgcacacagacttggatgagcgcagaaggtgcttggcgacaggtagaaaaagtcgaaacttgggcattaaggcaccccggattcacaattcttgctttgtttttagcgcattatataggcacatccctcacccagaaagttgtaattttcatcttgttaatgctggtaaccccatcaatgacgatgcgttgcgtaggggtcggtaatagagatttcgtggaaggtctgtcaggagctacatgggtcgatgtcgttctggaacacgggggctgcgtaactacaatggcgaaaaacaaaccaacattagacattgaattgcagaaaacggaggcgacacagcttgctaccctacgaaaactgtgtatagagggtaaaataactaatataactacagatagtagatgtcccactcagggcgaagcagtcttaccagaagaacaagaccagaactatgtatgtaaacacacgtacgtagatcgaggatggggaaatgggtgtgggcttttcggaaaaggatcattagtaacatgtgcaaaatttcaatgcctagaacccatagaaggaaaagttgtacaatacgaaaatctaaaatacaccgttatcataacggtgcatactggtgaccaacatcaagtaggaaacgaaactcaaggcgtaactgcagaaattaccccacaagcaagcaccacagaagcaatacttccggagtatggcactttgggattagaatgttcacctaggaccggtttagattttaatgaaatgatattgctaacgatgaaaaacaaagcctggatggtccatagacaatggttctttgatttaccattaccatggactagcggtgcaacaactgaaactccaacatggaatcgtaaagaactattagttacatttaagaatgcgcacgcgaagaaacaagaagtagtcgtgttaggatcgcaagaaggcgcaatgcacacagcattaaccggtgcgacagaaatccaaaactcaggaggtacatccatatttgcgggtcatttgaaatgcaggctaaaaatggataagttagaattgaaaggtatgagctatgcaatgtgcactaacacgtttgtcctaaagaaagaagtcagcgaaacccaacatggtacaatactcataaaagtggaatataaaggcgaagacgcgccctgtaaaattccatttagcaccgaggatggacaaggaaaagcgcataacggacggttaataacagcaaatcctgttgtgactaagaaagaagaaccagttaacatagaggccgaacctccattcggcgaatcgaacatagttataggtatcggagataacgctttaaaaatcaactggtataagaaaggatcgagtatcgggaaaatgttcgaggcaaccgcgaggggagcccgaagaatggcaatccttggagataccgcttgggatttcggaagcgtgggcggcgttctgaatagtctcggaaaaatggtgcatcagatattcggaagcgcgtatacagctctattttctggggtttcatgggttatgaagatcggaattggagtcctacttacttggataggccttaacagtaagaatactagcatgagcttcagttgcatagctattggtataattactctttatctgggggcagtggttcaagcagacatgggttgtgtaattaattggaaaggaaaagaactgaaatgtggctcaggcatttttgttactaatgaagttcatacgtggacagaacaatacaaattccaggccgactctcccaaacgactcgccaccgcgatagctggtgcgtgggaaaatggagtctgtggaattaggagcaccaccagaatggagaatcttctatggaaacagatagcaaatgagcttaactatatactctgggaaaacaatataaaattgactgtcgtggtaggcgacataatcggcgtattagagcaaggcaagagaaccttaaccccacaaccaatggaacttaaatacagttggaagacgtggggcaaagcaaagatagtcaccgctgagacacaaaattcaagtttcataattgacggtccaaatacaccagaatgtcccagcgcgtcacgggcatggaatgtatgggaagtagaagactacggtttcggcgtatttacaactaacatctggctaaaactaagagaggtgtacactcaactgtgcgaccatcgccttatgtcggctgcagtaaaagatgagcgtgccgtgcacgcagatatgggctattggattgagagccagaaaaatggatcgtggaagctggaaaaagcgagcttaattgaagtaaaaacgtgcacttggcccaaaagccacacattatggtcaaacggcgtactcgaatctgacatgataatcccaaagtcattagctggacctatatcccaacataaccatcgtccgggttatcacacccaaacagccggtccatggcacttgggaaagctcgaattagattttaactactgcgaaggtaccaccgtagtaataacagaaaattgcgggacccgaggtccgtcgctaagaacaacaacagtatcaggtaaacttatacatgaatggtgctgtcgttcatgtacattaccaccacttagatacatgggcgaagatggatgctggtacgggatggaaataagacctatcagcgaaaaagaagaaaacatggtaaaatcattagtatccgcaggttccggaaaagtcgacaattttacaatgggcgtactatgtctggccattctgtttgaagaggtaatgcgaggaaaattcggaaagaaacatatgattgccggagtatttttcacctttgtattactactcagtggacaaataacttggcgggatatggcacatacgttaattatgatcggaagcaatgcatctgatcgcatgggcatgggagtaacttacttagcactgatagccacattcaaaatacaaccttttctagccttaggatttttcctcagaaaactaacatcgagggaaaacttgctattgggagttggtttggcgatggcaacgacgttacagttaccagaagacatagaacagatggcgaatggtatcgccctaggacttatggctttaaaattgattacacaatttgaaacttaccaactatggacggcgcttatttcattaacatgcagcaatacaatgttcacgttaactgttgcctggcgtaccgcaaccttaattctagcaggagtatcattgcttcctgtatgtcaaagttcatcgatgcgtaagactgattggctccctatggccgtagcagctatgggggtgcctccgctaccacttttcatttttagtttgaaagataccttaaaaagaaggagctggccactaaacgaaggtgttatggcagtaggtttagttagcatattagcatcatctctgctccggaacgatgtcccaatggcaggaccgctcgttgctggcggtcttttaatcgcatgttatgttatcaccggtacatcagctgatttaaccgtcgaaaaagcagccgatattacttgggaagaagaagcggaacaaaccggcgtaagccataatttaatgataacagttgatgatgacgggacgatgcgtataaaagacgacgaaaccgagaatatattaaccgtgctacttaagaccgcacttctgatagtatcaggagtatttccatatagcataccggcaacacttttggtatggcacacatggcaaaaacaaacacaaagatcaggggtattatgggacgtaccatcacccccagagacacagaaagccgaattagaagaaggtgtgtacagaataaagcagcagggcatatttggtaaaactcaagtgggggttggggtacaaaaagaaggagtatttcatacaatgtggcatgtaacaagaggtgcagttctgacctacaacggtaaacggttggaaccaaactgggcatcagtaaagaaagacctaatctcctacggcggtggttggaggctatcagcacaatggcaaaagggggaggaagtgcaagtgatagcggtagaaccaggtaaaaaccccaaaaattttcaaacgatgcccggaactttccagaccacaacgggagaaataggagcgatcgcattagattttaaaccagggacctcaggcagccccattataaacagagaggggaaagtggtagggctttacgggaatggtgtagtgaccaagaatggaggatatgtgtcaggtatagcccaaaccaatgcagaacctgatggtccaacacccgagctcgaagaagaaatgttcaaaaagagaaatttaacaatcatggacttgcaccctggatcaggtaaaacgagaaaatatctacccgccattgtacgggaagctataaaacgcagactacggacgctaatattagcacctaccagagtcgtggcagctgaaatggaagaagcattaaagggattaccaatccgttaccagacaacagcaactaaatcagaacatactggaagagaaattgtagatctcatgtgccacgccacgtttacaatgcgcctcttatccccagtccgtgttccgaattacaatcttataataatggacgaagcgcactttacagacccggctagcatagcagcacgagggtacattagcacacgcgtaggaatgggcgaagctgctgcaatatttatgacagcaactccaccaggtactgcagacgcctttccgcaatcaaatgcacctatccaggacgaagaacgagacataccggaaaggagttggaactcagggaatgaatggattacagacttcgcaggaaagacagtatggttcgtaccttctattaaagcaggtaatgacattgcaaattgccttaggaaaaacgggaagaaagtcatccaattatcgcgcaagacatttgacactgagtatcagaaaaccaagctaaacgattgggatttcgtagtaacgacggatatttcagagatgggtgcaaattttaaagcagatagggttatagacccaagaaggtgtttaaaaccagtaatacttactgatgggcctgaaagagtagtcctcgctggcccaatgccagtaaccgccgcctcagcagcacaacgacgaggcagagtaggacgcaatccacagaaagaaaacgatcaatatatctttacaggacagcctctaaataatgacgaggatcacgcacattggaccgaggcaaaaatgctcctagataatataaacactccagagggaatcattccagccttatttgaaccagagagagaaaagtcagctgctatagacggtgaatataggctaaagggagagagccgcaaaacttttgtcgaattaatgaggagaggggatttacccgtttggttagcccataaggttgcatccgaaggaattaaatatactgatcgtaaatggtgttttgacggtcaaagaaataaccagattttggaggaaaatatggacgtggaaatctggacgaaagaaggagagaagaagaaattacgaccacgctggctagatgccagaacttattccgacccattagcattaaaagaatttaaagattttgccgctggacgtaaaagtatagcactagatcttgtcacagagataggtcgcgtgccaagccatttagcacacagaacgcggaacgcacttgataatctagtgatgttacacacaagtgagcacggcggccgtgcctacagacacgctgtagaagaactaccagagacgatggaaaccctcctcctgctaggattaatgatcttactcacgggaggagcgatgctctttttaattagtggtaaaggaatcggtaaaacaagcattggtctaatttgcgtgattgcaagctcaggaatgctgtggatggcggaaattcccctgcaatggattgcgagtgccatcgtattagagttctttatgatggtacttttaattccagaaccagaaaaacaaagaacccctcaagataaccaactggcttatgtagtaataggcatcttgacgctggcggccatcatagccgcgaatgaaatgggcctattagagacaacaaaaagggatttagggatgtctaaggaaccaggcgtcgtgtctccaacatcgtacttagatgtcgatctgcaccctgcatcggcgtggaccttatacgccgtagccactactgtaataacaccaatgttaagacataccattgaaaactccacagcaaatgtcagtcttgcagccattgcaaatcaagcagtagtgttaatgggccttgataaagggtggccaatatccaaaatggacctcggcgttcccctccttgctctaggttgttatagccaagtaaatcccctaactctaacagctgcagtgttattactgataactcattacgcaattattggaccgggcttacaagccaaagctacccgtgaagctcaaaaacgaacagcggcgggaataatgaaaaaccccaccgtcgatggaataatgaccattgatcttgatcctgtgatatatgattcgaaatttgaaaaacaacttggtcaagtaatgcttttagtactatgtgccgtccagcttcttcttatgcgaacatcctgggccctctgtgaagctcttaccctcgctacgggaccgattaccaccctctgggaaggatcaccaggaaaattctggaatacaactattgcggtttcgatggcaaatatatttcgcggaagttaccttgcaggggctggattagcatttagtatcatgaagtcagtagggaccggaaaaaggggtactggatcgcagggggaaactctcggtgagaaatggaagaagaaattaaatcaattatctagaaaagaatttgatttgtacaagaaatcgggtattacagaagtcgacagaacagaagcaaaagaaggattaaaacggggtgagattactcatcatgcagtaagtagaggatcagctaaactacagtggtttgtagagaggaatatggttataccggaaggccgtgtcatcgacttgggttgtggacgaggtggctggtcatactattgtgcaggtttaaagaaagttaccgaggtcagaggttacacgaaagggggcccaggtcacgaggaaccagttccaatgagtacctacggctggaatattgttaaattaatgagcgggaaagatgtcttttacttaccgcctgaaaaatgtgacacgctcttatgcgatataggggaatcttcaccatctcctacggtagaggaatctagaacaataagagttcttaagatggttgaaccttggctcaaaaataaccaattctgtataaaagtcttaaatccgtatatgccaacagtaatagaacatctggaacggttacaaaggaagcacggaggaatgctagtacgtaatcctttatcaaggaatagcacgcatgaaatgtattggataagtaatggaaccggcaatatagtagcaagcgtaaacatggtttctcgtttactattaaatagatttacaatgacccaccgacgaccaaccatcgagaaggacgttgacttaggagccggtacaagacacgtaaatgccgaacctgaaaccccgaacatggatgtaataggtgaacgcatcaaaagaataaaagaagaacacaattctacctggcattatgacgacgaaaacccctataagacgtgggcataccatggatcatatgaggtaaaagctacaggctcggccagtagcatgatcaatggagtagtaaagctcctaacaaaaccctgggatgttgtacctatggtcacgcaaatggctatgactgacacgacgccatttggacaacagagagtgtttaaagaaaaagttgatactcgcacaccgcgctcgatgcccggaactcgacgtgtaatgggtataaccgcagaatggttgtggcgtactcttgggcgaaataagaaaccgagattatgtacaagagaagagttcactaagaaagtaagaacaaatgccgcaatgggagcggtatttacggaagagaatcagtgggattcagcaaaagcggctgtagaagacgaggatttctggaaactcgtggaccgtgaacgtgaactacacaaattaggaaaatgtgggtcctgcgtttataatatgatggggaaaagagagaagaaacttggagaatttggaaaagcgaaaggaagccgcgcaatatggtatatgtggttaggggctagatacttagagttcgaggctctcggatttcttaatgaggatcactggtttagccgtgaaaattcttacagcggtgtcgaaggtgaaggattacataaactaggatacatattaagagatatatcaaaaattcctggaggcgctatgtatgctgatgacacagcaggttgggatacaaggattacagaagatgacttgcacaatgaggagaaaataacccaacaaatggatccggagcaccgccaattagcaaacgctatttttaaattaacatatcaaaataaagttgtgaaagtgcaacggcctacaccgacgggaactgtgatggatataatttctcggaaagatcaaagagggtcgggacaagtcggtacttatgggttgaatacgttcaccaacatggaagcgcaactaattagacaaatggaaggcgaaggagtattatcaaaggccgacctagaaaatccacacctcccagagaagaaaataactcagtggctagaaacaaaaggggtcgaacggctcaaacgtatggctatctctggtgacgactgcgtagtaaaacccattgatgaccgtttcgcaaatgcgttactagccttgaacgatatgggtaaagtaaggaaggatattccccaatggcagccatctaaaggatggcacgattggcaacaagttcctttctgtagtcatcactttcatgagttgattatgaaagacggacgtaagttagttgtaccttgtaggccacaagacgaattaataggcagagcgaggatatctcaaggcgccggctggagtctcagagaaacagcgtgtctcggcaaagcgtatgcgcaaatgtggtccttaatgtatttccatagacgagatttaagattagcatccaatgcgatatgctccgctgttcctgttcactgggtcccgacgagtagaaccacatggtctattcatgcccaccatcaatggatgacaactgaagacatgctaactgtatggaatagggtttggatagaagacaacccatggatggaagacaaaacacccgtaacaacctgggagaacgtgccttatctcggtaaaagggaagatcaatggtgcgggtcattaataggcttaacttcccgagcaacctgggcacaaaatattcccacggcaatccaacaagtgcggtcccttatcgggaatgaagaatttctcgattatatgccttcgatgaaacgatttaggaaagaggaagaaagcgaaggagcgatatggtaa

SEQ ID NO: 23003 - RNA, 9873 nt, synthetic construct
  misc_feature 1..9873: note = derived and/or modified CDS sequence (opt6) from DENV-3__JX669493__SS-prME
  source 1..9873: mol_type = other RNA
acatccttttgcttaatgatgattcttcctgcggcattagcgtttcacttgaccagtagggatggtgaaccgcgcatgatagtcgggaaaaatgaaaggggaaaaagcctcttgtttaaaacagcctctggaataaatatgtgcacgttgatcgcaatggacttaggcgaaatgtgtgacgacactgtaacgtataaatgtccgcatataacggaagttgaaccagaagacatagactgttggtgcaatttaacatctacttgggttacatatgggacctgtaatcaagccggagaaagaagacgagacaaacgaagcgtcgcgttggctccccatgtgggtatgggcttggacacacgcactcaaacatggatgtcagcagaaggggcatggcgacaagtagaaaaagtcgaaacatgggcattaaggcacccaggattcacgattcttgcacttttccttgctcattacattggaacttctctcacgcaaaaagtggtcatcttcatcttactaatgctggtaaccccgtcaatgaccatgcgttgcgttggcgttggaaaccgtgactttgtagaaggattaagtggggccacgtgggtcgacgtcgtcctagaacatggagggtgcgtgaccacgatggccaaaaataaaccgacgcttgacattgaattacagaaaacagaagctacacaattagctactcttagaaaattatgtatagaaggaaaaataactaatataacgacggattcacgatgtccgactcaaggcgaggccgtactgccagaggaacaagatcaaaattacgtgtgtaaacacacgtatgtcgaccgcggatggggaaatggatgtggattattcggaaaaggatctctcgttacttgcgcaaaattccaatgcctcgaaccaatagaaggtaaagtagtacaatacgaaaacctcaaatacacagtaatcataacagtacatacaggcgatcagcaccaagttggtaacgagacccaaggtgtaacggctgagataactccacaagctagtaccaccgaagcgattttaccagaatatggtactctcggtttggagtgttcccccaggacaggattggattttaacgaaatgatacttttaacaatgaaaaataaagcatggatggtacacagacaatggttcttcgatttgcccttaccatggaccagcggagctactacagaaacacccacgtggaatagaaaagaattgttagtcacatttaaaaatgcacatgcaaagaaacaagaagttgttgtattaggaagtcaggagggagctatgcatactgctttaacaggagccacagaaatacaaaatagcggtggaacatcaatcttcgccggacacttgaaatgcagactcaaaatggataaattagaattgaaaggtatgtcttatgcaatgtgtacaaatacatttgttttgaaaaaggaggtatcggaaacccaacatggcacaatattaataaaggtagaatataagggagaggacgctccgtgtaagatacccttcagtacagaagacggtcagggaaaagcccataatggacgcctgatcactgctaatccagtagttacgaagaaagaagaaccagtaaacatagaagcagaaccaccatttggggaaagcaacatcgtcatcggaattggagacaacgcattaaaaataaactggtataagaaagggagctccattgggaaaatgtttgaagctacagcaaggggagcacgaagaatggcaatattgggtgacactgcgtgggactttggtagcgtagggggagtactaaattcattggggaaaatggtgcatcagattttcggctcagcatatactgcgttattctccggggtaagttgggtcatgaaaatcggaatcggagtactactaacgtggattggtttgaactccaaaaatacttcgatgtcattctcttgcatagcaattggaataataactctatacctaggggcagtggtccaagccgatatggggtgcgtgataaattggaaaggcaaggaattgaaatgtgggtctggcatttttgtcacaaacgaagtacatacatggactgagcagtataaattccaggcagacagtcctaaaagactcgcaaccgctatagccggagcatgggaaaatggtgtatgtggaatccgcagtacaacacgaatggaaaacttattatggaaacaaattgcaaacgaactcaattacatactatgggagaataatatcaaacttacggtagtggtaggcgatataattggagtactcgaacaaggaaaaagaaccctgacaccacagcctatggaacttaaatattcgtggaaaacttggggaaaggctaaaattgtaactgcagaaacacaaaattcaagttttatcattgacggtccaaatactcctgagtgtccgtccgccagtagggcctggaatgtttgggaagtagaagattatggtttcggggtattcacgacaaatatatggttaaaactgcgtgaagtatacacgcagctttgtgaccaccgactcatgagcgctgcggtaaaggatgaaagggctgtgcatgctgatatggggtattggattgaatcgcaaaagaatggaagttggaaactagagaaggcaagtttaatcgaagtaaaaacatgtacatggccaaaaagccatacactatggagtaacggagtgttagagtcggatatgataatacccaagtccttagcaggtccaataagtcaacacaatcataggcccgggtaccatacacaaactgcaggtccctggcacctcggcaaactagaattagattttaactattgcgaaggaaccacagtagtaataacagaaaattgcggtacgcgtggcccttcactacgtacgacgacagtgagtggaaaactaatacatgagtggtgctgcagatcttgcaccctacctccattaagatatattggagaagatggatgctggtatggcatggaaataagacccatctcggaaaaagaagagaatatggtgaaatctttagtttcggcaggaagcgggaaggtggacaactttactatgggagtactttgtttagcaatcctattcgaagaagttatgagaggtaaatttggcaagaaacatatgatagctggcgtcttctttacattcgtccttctgctatctggacagataacatggagagatatggctcatacactgattatgataggatcaaacgcctcggatagaatgggaatgggagttacctacctcgcgttaatagcaacattcaaaatacaaccatttttggctttaggattctttcttcgaaaactcacaagccgcgaaaatctattattaggagtcggactagctatggcaacgacattacaattaccagaagatatagagcaaatggcaaatggaatcgcccttggattaatggcattgaaattaataacccagtttgaaacatatcaactatggacagcccttatatcgttaacttgtagcaacactatgtttacattaactgtcgcctggcgaacggcaactctaatattagcaggagtaagtcttttacccgtctgtcaatcgtcatcaatgaggaaaacagattggttacctatggccgtagccgcgatgggggttcctcccttacctctgttcatatttagcctaaaggatacgctaaagcgacgtagttggccgctgaacgagggcgtcatggccgtaggcttggtgtctattttggctagttcactattaagaaatgatgttccaatggcaggtcccctagttgcaggcggtcttctaatcgcatgttacgtcattactggaacgagcgcagatctaactgtagagaaagcggcagacattacttgggaagaggaagcggagcaaactggagtaagccataacttgatgattactgttgacgacgacggtacgatgcgtattaaggatgacgagacagaaaacatactaactgtcttgctaaagacagccttactgatcgtaagtggagtctttccctattcaatccccgcgacacttttagtatggcacacgtggcagaaacagacacaaagaagcggagtactctgggatgtccctagtccacctgaaacgcaaaaagcagaactagaagaaggagtatatagaatcaaacaacaaggtatattcggaaaaacccaagtaggagtcggagtccaaaaagagggagtgttccacacgatgtggcacgtcacgagaggggcagtactaacctacaatgggaagaggctagaaccaaattgggccagtgtgaagaaagatctaatttcctatgggggaggatggcgcttatctgcacaatggcaaaagggagaagaggtacaggtgatagcagtcgaaccaggtaagaacccgaaaaattttcaaacaatgccaggcacctttcaaacgaccactggtgaaataggagccatagcactggacttcaaaccaggcacaagtggcagccctataataaatagagaaggcaaagtagttggattatatgggaacggagtagttactaaaaatggaggatatgtctccggtatagctcaaacaaatgctgaacctgatgggcctacaccggaattggaagaagaaatgttcaagaaacgtaatctaactattatggatttacatcccgggtctggaaagactcgaaaatatttgccagctatagtcagagaagctatcaagcgaagattacggactcttatccttgcaccaacgagagtcgttgcagcagagatggaagaagcactaaagggattaccaataagatatcaaactacagctacgaagagtgaacatacgggacgggaaatcgttgatcttatgtgccacgcgacatttaccatgcgattactttcgcctgtacgcgtaccaaactataaccttataattatggatgaagctcactttactgacccagccagtatagcggcaagaggatacatttcgacacgagtcggtatgggcgaagcggcagcgatatttatgaccgcaactccaccgggaacagcggatgcatttccccaatcaaatgcgccaattcaagatgaggaaagagacataccagaacggtcatggaactccggtaacgagtggataacagatttcgcaggaaaaacggtgtggttcgtgccatcaataaaagctggtaatgacatcgcaaactgtttgcgtaagaatggaaagaaagtaatccaattatcgagaaagacattcgatactgaatatcagaaaacaaaactaaacgattgggactttgtggtgactaccgacatttcagaaatgggagccaacttcaaagcagaccgtgtaatagatcctagaagatgtctaaaacctgtgattcttactgacggaccagagagggtaatactagccgggccaatgccggtaactgcggcatcagccgctcaaagaagaggtagggtcgggaggaacccgcaaaaagagaatgatcaatacatctttactggacagccgcttaataatgacgaagatcacgctcattggacggaggctaaaatgttgctggacaatataaatacgccagaagggataattcctgcattatttgaaccagagagagagaaaagcgcagccatagatggagaatacagattaaaaggtgaaagcaggaaaactttcgtagaactcatgcgcaggggcgatttgccagtatggcttgcacataaagtagcaagtgagggcattaaatatacggacagaaagtggtgcttcgacggtcaaagaaacaaccaaatcttagaagaaaatatggacgttgaaatatggaccaaggaaggagagaagaagaaactaagaccgcgttggttggatgcaagaacatactcagacccattagcactcaaagagtttaaagacttcgcagccggtaggaaaagtatagctttggatctggttactgagataggacgagtgccatcacacttagcacatagaacaagaaatgcattggataatttagtgatgctgcatacttcagaacacggtgggcgcgcatatcggcatgccgtggaagaactgcccgaaacaatggaaacactcctcttactaggactcatgatattattaacaggcggcgccatgctatttctcatatcaggaaaggggataggaaaaacatcaatagggcttatttgcgttatagcttcaagcggaatgttatggatggcagaaatacccttacagtggatagcatcagcgatagttcttgagttcttcatgatggttttgttgataccagaaccagaaaagcaaaggacaccacaagataatcaactggcgtatgtcgttataggaatcctaaccctggctgcaataatcgcagcaaacgaaatgggcctattggaaaccacaaagcgtgatttaggaatgagcaaagaacccggggtagtgagccctacttcttatttagatgtcgacctgcacccggcatctgcatggactctgtatgcagtagctacaactgtgattactcccatgttacgccacacaatagaaaacagcacagcaaacgtctcgctcgcagctatagcaaatcaggcagtagtgttaatgggtttagacaaaggttggcctatctccaaaatggatttaggagttcctctactggctctgggttgctacagccaagttaatcctctgacattgacggcggctgtcctattacttattacccactatgcaataattggaccaggtctccaagcaaaagcgaccagggaggcccagaagaggacggcagccgggattatgaagaacccaacagtagatggaatcatgacaatagaccttgatcctgtaatttatgacagtaaatttgaaaagcagttaggtcaggtaatgctcctagtattatgcgcggttcaattgttacttatgcgcacatcttgggcattatgtgaagcattaacgttagcaacaggcccaataacgactttatgggagggttcacctggcaaattctggaatacgacaatagcagtatcgatggcaaacatattccgaggatcatatctcgctggagccggtttagcattctctattatgaaaagcgtaggaacgggtaagcgaggcacaggcagccaaggagaaacattgggcgaaaagtggaagaagaaactgaatcaactatccagaaaagagttcgatctatataagaaaagtggaataaccgaggtagatagaacagaagcaaaagaagggctgaaaaggggagaaataacgcatcatgccgtaagccgaggcagcgctaagttacaatggtttgtcgaaagaaacatggtaattcccgaaggtagagtgatcgatttgggatgcggcagaggtgggtggtcctattattgtgcaggtttaaagaaagttactgaggttcgaggatatactaaagggggacctgggcacgaagaaccggtacctatgtctacatacggatggaatatcgtgaaacttatgagcggaaaagatgtcttttatttacctcccgaaaaatgtgatacgctactatgtgatataggtgaaagctcgccatcgccgaccgtcgaagaaagccgaacaattagagttttaaaaatggtagaaccgtggttgaaaaataaccaattctgtataaaagttttgaacccatatatgccaacagtaatcgaacacctcgaaaggttacaaaggaaacacggtggaatgcttgtaagaaatccattatccagaaattcaacacacgaaatgtattggatttctaatggtactggaaacattgtcgcatctgtgaacatggtttcacggttattattaaatagatttacgatgacacatagaagaccaacaatagagaaagatgtagatttaggcgcagggacaagacatgttaacgccgagcctgaaacaccaaatatggacgttatcggagaacgaataaaacgaataaaagaagaacacaactcaacctggcattatgacgatgaaaatccatacaaaacatgggcttatcatgggtcgtatgaagtaaaggccacaggttctgcttcgagtatgataaatggagtcgttaaactactaacgaaaccgtgggatgtagtacccatggtcacgcaaatggccatgacagatactacaccttttggtcaacagagagtatttaaagaaaaagtggacactcgaaccccgagaagtatgcccggtaccaggcgagtaatgggaataacagccgagtggttgtggcgaacattaggtcgcaacaagaaacctaggctatgcactcgcgaagaatttacgaagaaagttcgtacaaacgcagcgatgggagccgttttcacagaagaaaatcaatgggattccgccaaggcagccgtagaagatgaggatttttggaagctagttgaccgagagagagaattacataaattgggtaaatgtggatcttgcgtatacaacatgatggggaaacgtgagaagaaattaggtgaatttggaaaagcaaaagggtcacgggccatttggtacatgtggcttggagcaagatacctagagttcgaagccttaggatttctgaacgaggatcactggtttagtcgtgaaaattcttattcgggtgtagaaggcgagggattacataagttaggatatatattaagagatattagcaaaattccaggaggggctatgtatgctgacgatacggccggctgggacacaaggataactgaagatgacctacacaatgaagagaaaataacccagcaaatggatcccgagcacagacaattagctaatgctatatttaaactaacttatcagaacaaagtagtgaaggtacaaaggcccacacccaccggaacggtcatggatataatatcgcgaaaagatcaaaggggaagtggacaggtggggacatatggactgaacacctttaccaacatggaagctcaacttatacgtcaaatggaaggagagggggtgctatcgaaagccgacttagaaaatcctcatctcccagagaagaagatcacacaatggttagaaactaagggtgtagagagacttaagcgtatggcaattagtggagatgactgtgtagtaaagccaatagacgatagatttgccaatgcgctactcgcactaaacgacatggggaaagtaagaaaagatattccacagtggcagccatccaaagggtggcacgactggcagcaagtccctttttgttcgcatcacttccacgagttaataatgaaggatgggagaaaattagtagttccttgtagaccacaggatgaactaataggaagggcaagaattagtcaaggtgccggttggtctttacgcgaaactgcctgcctaggtaaggcttatgcgcaaatgtggagtctaatgtattttcatcgccgagatttacggttagccagcaacgctatttgtagtgctgtaccagtacactgggtcccgacatcaagaacaacttggtctatacacgctcatcatcaatggatgacgacagaggatatgctcactgtctggaaccgtgtttggattgaagacaatccctggatggaagataaaacacccgtaacaacatgggaaaacgtaccatacctcggcaagagagaagatcaatggtgtggttcattgataggactgacgtcaagagcaacctgggctcaaaacatccctacagcgattcaacaggtacggagtcttattggaaacgaagagttcctggattatatgccttctatgaagagatttcgtaaagaggaggaaagtgaaggagcaatatggtag

SEQ ID NO: 23004 - RNA, 9873 nt, synthetic construct
  misc_feature 1..9873: note = derived and/or modified CDS sequence (opt6) from DENV-3__JX669504__SS-prME
  source 1..9873: mol_type = other RNA
accagtttatgcctaatgatgatacttccggcggcgttagcttttcatctaaccagtcgtgatggagaaccacgaatgattgtcgggaaaaatgaaagaggaaaatcattgctatttaaaactgcaagcggaaccaacatgtgtactttgattgcaatggatttgggagaaatgtgcgatgatactgttacctataaatgcccacatataacagaagtagaaccggaagacattgactgctggtgtaacctcacaagtacctgggtcacttatggaacctgtaatcaagcgggagaaagaagaagagacaaaagatcagtcgcgctagctccacacgtgggaatgggactcgacacgcgaacacaaacttggatgtctgcagaaggggcttggagacaagtggaaaaagtagaaacatgggcgttacgacatccaggatttaccattttggcgttgttccttgctcattatattgggacctcacttacccaaaaagtcgtaatattcatattattgatgcttgtcactccgtcaatgacgatgcggtgcgtaggagtggggaatcgggatttcgtagaaggactaagcggcgccacatgggtcgatgtagtattagagcatggaggttgtgtgacaacaatggccaaaaataaaccaactcttgatatagaattacagaaaactgaggcaactcaattagcgaccttacgcaaactatgcatagaaggaaaaataacaaacattacgactgactctaggtgcccaacccaaggagaggcagtactacctgaggaacaagatcaaaactatgtctgtaaacatacgtatgtagataggggttggggaaatggttgtggtttatttggcaaagggagtttggtcacatgtgcaaaattccaatgcctagaacccattgaaggtaaagtagtccaatacgaaaacctcaaatatacagtaataataacagtccacacaggggatcaacatcaggtaggaaatgagactcagggagttactgctgaaataacaccacaagctagtaccactgaagcaatattaccggaatatgggacattaggattagagtgctcccctcggacaggtcttgactttaatgaaatgattttgctcacaatgaaaaataaagcctggatggtccatagacagtggtttttcgatctacctctaccctggacgtctggagctaccacagaaacgccgacatggaatagaaaagagttattagtcacttttaaaaatgctcacgcaaagaaacaggaagttgtcgtactcggaagtcaagagggtgccatgcacacggcattaacaggtgcaacagaaatacaaaattctggtggcacctctattttcgccggacatctcaaatgtcgattaaaaatggataaactagaattaaaagggatgagctatgcaatgtgtactaatactttcgttttgaagaaagaagtctcagaaacacaacatggaactatactgatcaaagtagaatacagaggggaagacgctccctgtaaaataccattcagtacagaagacggtcaagggaaagcccataatgggcgcttaattacagcaaatccagtagttacgaagaaagaagaaccagtaaatatagaagccgagcctccattcggcgagtccaatattgtaatcggaataggagataatgctttaaaaataaactggtacaagaaaggatccagcatcggaaaaatgtttgaagcaacggcacgaggcgccagaagaatggcgatactcggggatactgcctgggacttcgggagtgttggtggggttctcaatagtttgggaaaaatggtgcatcaaatttttgggagtgcatacacagcactgtttagtggagttagttgggtgatgaaaattgggattggagtcctactgacgtggattggactaaatagcaaaaatacttctatgtcattcagttgtatagcgatcggcattataacactatacctgggagcagttgttcaggcagatatgggatgtgtaattaattggaaaggaaaagaattaaaatgtggaagcggaatattcgtgacaaacgaagtgcatacatggacggaacaatataaatttcaagcagactctccgaaacgattagctaccgccatagctggagcatgggaaaacggtgtttgtggaatcaggtcgacaacgagaatggaaaatttgctctggaaacaaattgcgaatgagctaaactacattttatgggaaaacaacattaaattgacagtagtagtaggcgatatcataggcgtgttagagcaaggaaaacgaactttaacccctcaaccaatggaactcaaatactcatggaaaacatgggggaaagcgaaaatagtaaccgcagaaactcaaaattcctcatttatcattgatggtcccaataccccggaatgcccatcagcaagcagggcgtggaatgtatgggaggttgaagattatggatttggagtatttaccacaaacatatggcttaaactcagagaagtttatactcagttatgcgatcatcgtttaatgagtgctgccgtcaaggacgaaagagcagttcacgcagacatggggtactggatagaaagccagaaaaatggatcttggaagctagaaaaagcaagtttgatcgaagttaaaacttgcacatggccaaaatcgcatactctgtggtctaacggggtcttggagtcagatatgataatacccaaatcactagcaggtcctatttcacaacataatcaccgaccgggataccatactcagactgccggaccttggcatctaggtaaattagaattagactttaattattgtgaaggaacgacagtggtaataaccgaaaattgcgggacacgagggccttccttacgaactacgacagtaagtggcaaactaattcacgaatggtgctgcagaagttgcacattgccgccactccgctatatgggtgaagatggctgttggtatggaatggaaatacgacctatatctgaaaaagaagaaaacatggtcaaatcactcgtcagcgctggttcaggtaaagtagataacttcaccatgggagtgctatgtttagctatattgtttgaagaagttatgagaggtaaatttgggaaaaagcatatgatagcaggcgtattcttcacattggtattattgctttccggacaaatcacatggcgagatatggcccacacgctaataatgataggaagcaatgctagcgatagaatgggaatgggggtgacgtaccttgcactaattgctacattcaaaatacaaccatttttagctcttggattctttctacgcaaattaacttcaagagaaaatctattattaggcgtcgggctagcgatggctaccactctacaactacctgaagacatagaacaaatggccaacggcatagccctaggtttaatggcactaaaactcattacacagtttgaaacttaccaactatggacagctttaatttcattaacttgtagcaatacaatgttcacacttacagtcgcatggcgcacagcgaccctaatcttagcaggggtgtcattgttgccggtatgtcagagctcctcaatgagaaaaactgattggttaccgatggcagtagcggccatgggggtaccacccttacctctgtttatattttcattaaaggataccctaaaacgaagatcttggccactaaatgaaggtgttatggccgttggtttggtttctatattggcgagttcgcttctaaggaacgatgtgcccatggcaggacctctcgttgcaggagggctacttattgcatgttatgtaattacaggcacaagtgcagatcttacggttgagaaggccgctgacattacttgggaagaggaagcagaacaaactggagtttcccataatcttatgatcacagtagatgacgacggtacaatgaggattaaggatgacgaaactgaaaatatattaacagtcctattaaagacagcgctattaattgtatcaggagttttcccttatagtataccagcaactctgcttgtttggcacacgtggcaaaaacaaacgcaacggtctggagtcctttgggacgtgcccagccctccagaaacccaaaaggctgaattagaagaaggagtataccgcataaaacagcaaggaatattcggaaagacccaggtaggagtcggtgtacaaaaagaaggcgtatttcacacaatgtggcacgtgacacgaggggcagttctgacttacaacgggaaacgattagaaccaaactgggcttcagttaagaaagatctgatatcatacggaggaggatggaggctctcagctcagtggcaaaagggggaagaggtccaagtaatagcagtggaaccgggtaaaaatcctaaaaatttccaaacaatgcccggtacttttcaaaccactaccggagagatcggcgctatagcgttagacttcaaacccggaacctccggttctcctatcataaatcgcgaaggtaaagtagtcgggttatatggtaatggagttgtcactaaaaatggaggttatgtctcaggaatcgcgcaaactaatgcggaacctgatgggcctacccctgaacttgaagaagaaatgttcaagaaacgaaacttaacaataatggatttacacccaggatcgggcaaaacaagaaaatatcttccagccattgtccgggaagcgattaagagacgattgagaactcttatattagccccaacgcgagtcgtcgccgccgaaatggaagaggctttaaagggcctaccaattaggtaccaaacaacggcaactaagtccgaacacacggggcgtgaaatagtcgatttaatgtgtcacgccacgtttaccatgcggctgttatctccagtcagagttccaaactacaacttaataatcatggacgaggcacactttacagatccagctagtatcgccgcaagaggttatataagcacgcgtgttggtatgggggaagcagcagcaatttttatgacggcgacacctccaggtacagctgacgctttcccgcaatcaaacgctccgatccaagacgaagaaagagacattcctgaaaggagttggaactcgggaaatgagtggataacagatttcgctggaaaaacagtgtggtttgtaccatcaataaaggctggtaacgatatagctaactgtttaaggaaaaatggcaagaaagtgatacagctttcaagaaaaactttcgataccgaataccagaaaactaaattaaatgattgggattttgtagtcacaacggatatttcagaaatgggagctaattttaaggcagaccgggttattgacccaagacgatgcttgaagcccgttatattgacggacgggccggaacgtgtaatcttagcaggccccatgcctgtaacagcagctagcgctgcgcaaagacggggtagggtaggacgaaacccacagaaggagaatgaccaatacatattcactgggcaacctttaaataatgacgaagatcacgcacactggaccgaagctaaaatgttattggacaacataaatacgcctgaaggaataatcccagcactattcgaaccagaacgtgagaaaagcgccgcaattgatggagaatatcgtttgaagggcgagagccgtaaaacctttgtggaacttatgcggagaggagatcttccagtatggctcgcgcataaagtagcctctgaaggcattaaatacaccgacagaaaatggtgcttcgacggacaaagaaacaatcaaatattagaggagaatatggatgtagaaatatggacaaaagaaggagagaagaagaaattaagaccacgttggcttgacgcacgaacttattcagacccactagcattaaaagaatttaaggattttgcagccgggaggaaatcaatagcattagacctagttaccgagataggaagagtcccatcccacctggcacacagaacaagaaacgctctagataacctagttatgttgcatacgtcagaacatggagggagggcgtatagacatgcagttgaggaattaccggaaaccatggagactttgttattactagggttgatgattttattaacaggcggcgctatgttattcttaattagtggaaagggcataggaaaaacaagtataggtttgatctgtgtaatagctagctccggtatgctatggatggcggaaatacctctacaatggatagcatcagcaatagtccttgagttcttcatgatggtacttctaataccagaacctgaaaaacaaagaactcctcaagacaaccaacttgcatacgtcgtgattggcatcttaacattagctgctattatagcagctaacgagatgggattattggaaacaacgaaacgagatttaggaatgagcaaagaaccaggagttgtctctcccacttcatatctagatgtcgatctacaccctgcctcagcatggacattgtacgcagtggcgaccacagtcataactcccatgctacgacataccatagaaaattcgacagcgaacgtttctttagcagctatcgcgaaccaagcagtagtcttaatgggacttgacaaaggatggccgatcagcaagatggacctaggtgtccctttattagcactaggatgctactctcaagttaatccattaacgttaacagcagcagtattgcttctaataacacactacgcaattataggtccaggactacaagctaaagcaacccgcgaagcgcagaaaaggacggctgctggtattatgaagaatcccacagtagacggcataatgacaatcgacttagatccagtaatatatgactcaaaattcgaaaaacaattaggccaagttatgcttctagtattatgtgcagttcaactactactaatgcggacaagctgggctctttgtgaggcccttacactagcaaccggaccgataaccaccttatgggaaggttcaccaggcaaattctggaatacaacaatagctgtgtcaatggcaaatatcttccgtggaagttacttagctggagcaggcttagccttcagcattatgaaaagtgtgggtaccggaaaacgaggaactggaagccagggtgaaactctgggcgaaaagtggaagaagaaactcaatcaactttcacgaaaagaatttgacctctataagaaatcaggaataaccgaagttgatagaacagaggccaaggaagggcttaagcgaggtgaaattacgcaccacgctgtaagccgaggctcagcaaaactacaatggtttgtcgaaagaaacatggtaatcccagaaggtagggtgatcgacttagggtgtgggcggggcggttggagttattattgtgccggattgaagaaagtaactgaggtgagggggtacacaaaaggaggacccggccacgaggagccggttcccatgtcaacatatggttggaacatagtcaagctaatgtctgggaaggacgtattttacttgcctccagaaaaatgcgatacgttattatgcgatatcggagagtcgagcccaagtcctactgtcgaagaatcaaggacgatacgggtacttaaaatggtagaaccttggctaaagaataaccaattctgtataaaagtactaaacccgtacatgcccaccgttatagagcacctagaaagattacagcggaaacacgggggaatgctagtaaggaatcctctctcgaggaactcaacacatgaaatgtattggattagtaacggaacaggaaacatagtagcttcagtcaacactgtgagcagacttttacttaataggtttacaatgacacataggcgtccgacgactgaaaaggacgtagatctaggggcgggaactagacacgtcaacgccgaaccagaaacaccgaatatggacgtaattggagaacggataaagcggatcaaagaagaacacaactctacatggcactatgatgacgaaaatccctataaaacctgggcatatcatggttcatacgaagtgaaggcaacggggtcagcgagctctatgattaacggagtggtgaaactgttgacgaaaccttgggatgtggtccctatggtaacacaaatggcgatgacagacacaacgccttttgggcaacaaagagtgttcaaagaaaaggtcgatacgagaacaccgagaagtatgccgggaacccgaagagtaatgggcattacagcggagtggttgtggaggaccctcggtcgaaataagaaaccacgactatgtacccgtgaagagttcactaagaaagtgcgtaccaatgcagcgatgggcgctgtcttcaccgaagagaaccaatgggattcagcaaaagcagctgtagaagatgaagacttctggaagctagtcgacagagagcgagagttgcataaattaggaaaatgtggaagttgtgtgtataacatgatgggaaaacgagagaagaaattaggggaatttggaaaagcaaaaggctcgcgagcaatttggtacatgtggttaggagcccgataccttgagtttgaagcacttggcttcttaaatgaggaccattggtttagtcgtgaaaatagctatagcggcgtcgaaggtgagggattgcataaacttggatacattctcagagatatatcgaaaatcccgggtggggccatgtatgctgatgacactgccggatgggataccagaattaccgaggacgatcttcataacgaagagaaaatcacacaacaaatggatccagagcatagacaattggcaaatgctatcttcaaattaacgtatcaaaataaggtagttaaggtacagcgtccaacacctacgggaacagttatggacataatctcaaggaaggaccaaaggggtagcggccaggtaggtacgtacggattaaacaccttcacaaatatggaagcgcaactaatccgacagatggaaggtgaaggtgtacttagtaaagcagatctcgaaaacccacatctgcccgagaagaaaattacacaatggttagaaacaaaaggtgtcgaacgcctaaaacgcatggctataagcggagatgattgtgtggttaaacccattgacgacaggtttgccaatgctctgctggcattaaatgatatgggaaaagtaagaaaagatatcccacaatggcaaccctcaaagggatggcatgattggcaacaggtacccttttgctcgcatcacttccatgagttaattatgaaggacggacgcaaattagtggttccgtgccgtccacaggacgaactaatagggagagccagaataagccagggagctggttggagcctaagggagacggcatgtctagggaaagcatatgcacagatgtggagcctcatgtatttccataggagagatttacgcttagcatctaacgcaatatgctctgctgtgccagtccattgggtaccgacatcaagaacgacttggtctatacatgcacatcaccagtggatgacaacagaggacatgctaaccgtctggaatcgtgtgtggatagaagataatccatggatggaagataagacacctgtcactacatgggaaaatgtgccgtatctgggtaaacgtgaagaccaatggtgtggatccctgattggtttaacatcacgagcgacatgggctcagaacattcccacagcaatccaacaagtaagaagtctcataggtaacgaagagttcctggattacatgccttcgatgaaaaggtttagaaaagaagaagaatctgaaggagctatctggtaa

SEQ ID NO: 23005 - RNA, 9873 nt, synthetic construct
  misc_feature 1..9873: note = derived and/or modified CDS sequence (opt6) from DENV-3__JX669506__SS-prME
  source 1..9873: mol_type = other RNA
actagcttctgcctaatgatgattctacctgctgcactagcatttcacctaacaagtcgagatggagaaccacgcatgatagtaggcaaaaatgaacgaggaaaatcactcctatttaaaacagcatctggaataaacatgtgtaccttaatagcaatggacctaggtgaaatgtgtgacgatacagttacatacaaatgcccacatataactgaagttgaaccagaagatatagattgctggtgcaacttaacatccacctgggttacatacggaacgtgcaaccaagctggtgaaagacgtagagataaaagatcagtggcactagcgccacacgtgggaatgggactagatacacgtacacaaacatggatgagcgccgaaggggcatggcgccaagtagaaaaagtcgaaacttgggcacttcgtcatcctggttttacaatattagctttatttttggcacactacatcggaactagcttaacccaaaaagttgttatatttatattactaatgctagttacaccatctatgacaatgcgatgtgtaggtgtaggaaatcgagattttgttgaaggattaagtggagcaacatgggtcgatgtggtactcgaacatgggggatgtgtaactactatggctaaaaataaaccaacattagatatagaacttcagaaaactgaagctactcaactcgccactcttcggaaactatgtattgaaggaaaaattacaaacataacaacagatagtcgatgtcccactcaaggagaagctgtgctaccggaagaacaagatcaaaattacgtgtgtaaacacacctacgttgatagaggctggggaaatggatgtgggctattcggaaaaggaagtcttgttacatgtgctaaatttcaatgtttagaaccaatagaaggcaaagtggtacaatacgagaatctgaaatatactgtaataatcactgtacatacaggggatcaacaccaagtcggcaacgagacgcaaggagttaccgctgaaataacaccacaagcgtcaacaactgaagcaatattgccggaatatggtacattaggattggaatgctctccaagaacgggattagatttcaatgaaatgatcctattaaccatgaaaaacaaagcatggatggtacacaggcaatggtttttcgacctacccttaccatggacctctggggcaactactgagaccccaacgtggaacagaaaagagctattagtgacttttaaaaatgcgcacgctaaaaagcaggaagtcgttgtactaggatcacaagagggcgcaatgcatactgctctcacaggtgccaccgagatacaaaatagcggtggtacatctatttttgctggccacttaaaatgcagattaaagatggacaagttggagttaaagggaatgtcatatgcaatgtgcacaaatacattcgtgttaaagaaagaagtcagcgaaacacaacacggaacaatattgataaaagttgaatataagggagaagatgccccatgtaaaattcccttctccactgaagatggacaagggaaggcttataatgggagactaatcaccgccaacccggtagttacgaagaaagaggaacctgttaatatagaagctgaaccaccctttggagaaagtaacatagtgataggtatcggagacaatgcactaaagataaattggtataaaaagggaagcagtataggtaaaatgtttgaagctactgcaagaggtgcaagaagaatggccattcttggggatacagcatgggacttcggaagtgttgggggcgtcttaaatagtcttggcaagatggtccaccaaattttcgggtcagcatacacagctctcttttctggcgtaagctgggtaatgaaaataggaataggcgttttattaacatggataggtttaaattccaaaaatacatcgatgtctttcagttgtatagccataggaataattaccttatacctcggtgcagtagttcaagctgatatgggatgcgtgattaactggaaagggaaagaattaaaatgcggatctggaatttttgtgacaaatgaggtgcatacgtggactgaacaatacaaatttcaagcagacagccccaaaaggctagcgacggcaattgcaggagcctgggagaacggggtttgtggcattcgttctactacacgtatggaaaatcttttatggaaacaaatagccaacgaactaaattacatattatgggagaataatataaaactaacagtggtagtcggtgatataatcggtgttttagaacaaggaaaaagaacgctcacaccacagccaatggaattaaagtatagttggaagacctggggaaaagcaaagattgttacagcagaaacacagaactcatcattcataatcgatggacctaacacaccagagtgtccatccgcttctagggcttggaatgtttgggaagtagaagattatggtttcggagtttttacaacaaacatttggctcaagttaagggaggtttatacccaattatgtgatcatagattaatgtcggcagctgtaaaagatgaaagagcggtacacgcagacatgggttactggattgagtcacagaaaaacggttcgtggaaattagaaaaagcctctctaattgaagtaaaaacctgtacatggccgaagtcgcatacattgtggtctaacggagtattagagtccgatatgatcattcctaaaagtctcgcaggccccatatctcagcacaatcataggccaggctatcatacgcagacagcgggcccttggcacttggggaaattagagttggattttaactattgtgaaggaactaccgttgtaataacagaaaactgcggaacaagaggccctagcctacgaaccacaacagtatcagggaagctcattcatgagtggtgttgtagatcatgtacacttcctccacttcgatatatgggcgaagatggatgttggtacggaatggaaataagaccgatcagtgaaaaagaagaaaatatggtcaagagcttagttagcgccggatcaggaaaggttgataattttactatgggtgttttatgcttggctatcttgtttgaagaagtgatgcgtggaaaatttggcaagaaacacatgattgcaggagtattctttacatttgtcctcttgctctctggtcagattacctggagagatatggcgcacacattaatcatgataggaagcaatgcaagtgatcgaatgggaatgggtgtaacgtatttagcgcttatagcaacgtttaaaatacaaccattcttagcattaggattcttccttagaaagttaacctcgcgagaaaacttgctactgggggtaggtctggcgatggcaacaacactacaactaccagaagatattgaacaaatggccaacggaatagcacttggactgatggcacttaaactaataactcaattcgaaacctaccaattatggactgctcttatctcgctcacttgcagcaacacaatgtttacattaaccgttgcatggagaacagccacacttatattggctggtgtttcgctgcttccagtttgccaatcttcatctatgcgcaaaacagactggttacccatggcggtagccgcaatgggtgtcccaccattgcctttgtttatattctcattaaaggatacattaaagagaagatcgtggccactcaacgaaggggtgatggccgtaggattagtatcaatattagcaagctccctcttaagaaatgacgtccccatggctggaccattagtagccggtggactgctaattgcctgttatgttatcactggaacaagcgccgatcttacagtagaaaaagctgcagatattacctgggaagaagaagctgaacagacaggtgtatctcataatttaatgataacagtggatgatgatggcactatgcgaattaaggacgatgaaacggagaacattttaacagtactattgaagacagcccttttgatagtatcaggagtattcccatacagtataccggcgaccttattagtttggcacacatggcagaaacagacacaaagaagcggagtactatgggatgtgccatctccacctgaaacgcaaaaagcagaactcgaagaaggagtatatcggataaaacaacaaggaatatttgggaaaacacaagtaggggtaggggtccagaaagaaggagtattccatactatgtggcacgtgacacgaggagctgtactaacatataatgggaagcgattagagccaaactgggcatcggttaaaaaggatctgataagctacggtgggggatggagactaagcgcacaatggcaaaaaggagaagaagtacaagttatagctgtcgaaccgggcaaaaatcccaaaaactttcagaccatgccgggaacattccagactactaccggtgaaataggagctattgcattggattttaaacccggcacatcaggatcgcctattatcaatcgggaagggaaagttgttggcctatatggcaatggcgttgtcaccaaaaatggtggttatgttagcggtattgcacaaaccaacgccgaaccagatggtccaactccagaattagaggaagaaatgtttaagaaacggaacctaaccataatggacttgcatccaggaagcggaaaaactcgaaaatacttacctgccatagtacgggaagctattaaacgcaggctaaggactctaatacttgcacctaccagagtagtagcagctgagatggaggaagccttgaaaggactacccatacgttaccaaacaaccgccactaaaagcgagcataccggacgggagatcgttgacttaatgtgccatgccacgttcacgatgagattgttatcaccggtcagggttcccaattataacttaatcatcatggatgaagcacattttaccgatcccgcgtcaatagctgctagaggttacataagtactagagtaggcatgggtgaggctgcagcaatctttatgactgcaacaccaccaggaacagctgatgcatttccgcaaagtaatgccccaattcaagatgaggaacgcgacattcccgaacgtagttggaatagcggaaatgaatggataactgattttgcaggcaaaactgtatggttcgtaccaagtataaaagcagggaacgacattgctaactgcctacgcaaaaacggaaagaaagttatacaactctcgcggaaaacgtttgatactgaatatcagaaaacaaagttaaatgactgggattttgtagttacaaccgacatatcagaaatgggggcgaatttcaaagctgacagggtaatagacccaagacgttgtttgaaacctgtaattctcacagacggaccggaaagagttattctagctggccctatgccagttactgccgcaagtgctgcacaacgacgcggcagagttggaagaaatccgcaaaaagagaatgaccaatacatattcactgggcaacctttaaataacgacgaagaccatgcacactggactgaagctaagatgttgctcgacaatatcaatacccctgagggtatcatacccgcattatttgagccggaaagagagaaatcagctgcaatagacggtgaataccgcctcaagggtgagtcacgaaagaccttcgtagaattaatgagacgaggcgatttaccagtatggctggcacataaagtcgcctcagaagggataaaatatacagaccgcaaatggtgcttcgacggccaaagaaataatcaaattcttgaagaaaacatggatgtagagatttggacaaaagaaggcgagaagaagaaattacgaccaaggtggctagatgcaagaacctacagtgaccccttggcattaaaagaatttaaagattttgcggcgggtcgaaaaagcatcgctttggatttggttacagagattggaagagtaccaagccatctagcacatagaaccagaaatgcactagataacttagtcatgctgcatacatcagaacatggcggcagagcatatcgacatgctgttgaggagctacccgaaacaatggaaacattattactattgggtcttatgatactgttaacaggaggagctatgctttttctcatctcggggaaaggaatagggaaaacttccataggtctgatatgtgtaatagcgagttcgggaatgttgtggatggccgaaatacccttacagtggatagcaagtgcgatagtcttggaatttttcatgatggttctcttgatcccagaacccgaaaagcaacgcacgccccaggataaccagctggcatacgtagttatcggcatcctcacactagcagcaatcatagcagcgaacgaaatgggccttttagaaacaactaaacgtgacttaggaatgagcaaagaaccaggtgtagttagtccaacatcctatttggacgtagatttacacccagcctcagcatggactttatacgcagtggcaacaaccgtcatcaccccaatgctgaggcatactattgagaatagcactgcgaacgtgtcacttgcagcaatagcgaaccaagccgtcgtactaatggggctagacaagggatggccaatatcaaaaatggatttaggtgtgcccctgcttgctttaggttgttattcacaagttaaccctctaacactaactgcagcggtactgctgctgattacacactatgctattatagggcctggactccaggctaaagcaacacgtgaagcgcaaaagcgcaccgctgcgggaataatgaaaaaccctacagttgacggcatcatgacgatagaccttgatcccgttatatacgactcaaaatttgagaaacaactaggacaagttatgttattagttctatgcgccgtacaattattactaatgagaacctcttgggctttatgcgaggccctcacgctagctacaggacccattactacattgtgggaaggttcgccgggaaaattctggaacaccaccatcgcggtatcaatggcaaatatttttcgtgggtcctatctagcgggagcaggtctagcattttcgataatgaaatcagtaggcaccgggaaaagaggaacgggtagccagggtgagactttaggagaaaaatggaaaaagaaacttaaccaactatcacgcaaagaatttgacttatataaaaagagcggaataacagaagtggatagaacagaagcgaaagagggattaaaaaggggcgaaataacccatcatgctgttagcagaggttcggccaagctacagtggtttgttgaacgtaatatggtaattccagaaggaagagttatagatctgggatgtggtagaggcgggtggtcctattactgtgccggtttgaagaaggtaactgaagtgagaggatatactaaaggtggtccagggcatgaagaacctgtaccaatgtctacatacggttggaatatagtaaagttgatgtccggtaaagacgtattttatctgcccccagagaagtgcgatacccttctctgtgacattggcgaatcgtcgccaagtcctacggtggaagaatcaaggacaataagggtactaaaaatggtagaaccttggctcaaaaacaatcaattttgtatcaaagttctaaacccctacatgccaaccgtgatagaacatttagaacgcctacagagaaaacatggaggaatgttagtgaggaaccctttatccagaaattcaactcacgaaatgtactggatatccaatggcacaggtaacatagttgcaagtgtaaatatggtaagtcgtctattattgaatagatttacaatgacccaccgtcgacctacaattgaaaaggacgtggatttaggggcaggtaccagacatgttaatgctgaaccggaaactcctaacatggatgtcatcggcgaaagaattaaaagaatcaaagaagaacacaattcaacctggcactatgatgatgagaacccctacaagacatgggcataccatggatcctatgaagttaaggccacgggttccgcaagctcgatgattaacggggttgtcaaattgttaacgaaaccatgggatgtcgttcctatggtaacacaaatggcaatgacagacactacaccatttgggcaacaaagggtatttaaagaaaaagtcgatacgagaacgcctcgtagtatgccaggtacgagacgagttatgggtataaccgccgaatggttatggcgaactctgggccgcaataagaagcctagactttgtacacgagaagagttcacaaagaaagtaagaactaatgccgcaatgggggcggttttcacagaagaaaatcagtgggacagtgctaaagcagcggtcgaagatgaagatttctggaaactcgtagaccgagaacgagaactacacaagttaggaaaatgtggaagttgcgtctataatatgatgggcaaaagagagaagaaactcggagagttcgggaaagcaaaggggtcaagagcaatttggtacatgtggctaggagccaggtacttagagttcgaggctttagggtttctaaacgaggatcattggttttctagggaaaattcctatagcggtgtggagggagaagggttgcataaactaggatatatactacgagacatatctaaaattccaggaggagcgatgtacgcagacgatacagcaggatgggatacacgaatcaccgaagatgatcttcacaatgaagagaaaattactcagcaaatggaccctgaacatagacaattggctaacgcgatattcaaactaacataccaaaacaaagtagtaaaagttcaaagaccaaccccgacagggactgtaatggacattattagtagaaaagatcagagaggctcaggtcaggtcggtacatatggccttaacacattcacgaatatggaagcccaactcataagacaaatggagggagagggtgtcttatcaaaagctgatctcgaaaacccccatctaccagagaagaaaataacgcaatggctagaaacaaaaggtgtagaaagactcaaacgaatggctattagtggggacgactgtgttgtaaagcccatagacgatagatttgcaaatgcgctactagcgttaaatgacatgggcaaagtcagaaaagatataccacaatggcaaccttcaaaagggtggcacgactggcaacaagttccattttgcagccatcatttccacgaattaattatgaaggacggaagaaaattagtagtaccgtgcagacctcaggatgagttaataggacgtgcgaggatatcgcaaggagccgggtggagccttagagaaacagcatgtttaggcaaggcgtatgcacaaatgtggtcattaatgtattttcaccgtcgggatcttcgactcgcgagtaacgcgatatgtagtgcggtgccggttcattgggtaccaacaagtagaactacgtggagcatacatgctcatcatcaatggatgaccacagaggacatgctcacagtatggaatagggtgtggattgaggataacccttggatggaagataaaactcctgtgacaacatgggaaaatgtgccgtacttggggaaaagggaagaccagtggtgtggatcgttaattggccttacatcacgtgccacatgggcacaaaacataccaacagcgattcagcaagtaaggtcactaattggcaatgaagagttccttgattatatgccctcaatgaaaaggtttcgtaaagaagaggaaagcgaaggagctatctggtag

SEQ ID NO: 23006 - RNA, 9873 nt, synthetic construct
  misc_feature 1..9873: note = derived and/or modified CDS sequence (opt6) from DENV-3__JX669496__SS-prME
  source 1..9873: mol_type = other RNA
accagtttatgtttaatgatgatattaccagcggcattagctttccacctaacatctagagatggtgaaccaagaatgatagtggggaaaaacgaaagaggaaaatccctgctattcaaaactgcatcaggaacaaacatgtgtacactaatcgcaatggatttaggggaaatgtgtgatgataccgttacatacaaatgtccgcatatcactgaagtagaaccggaagatatcgactgctggtgtaacctaacatccacttgggtgacgtacggcacttgcaatcaggctggagagcgtcgtcgggataagagatccgtggcattagctccacacgtgggaatgggactggacacaaggacccaaacctggatgagtgctgaaggagcctggcgacaggtggaaaaagtagaaacctgggctttacgtcacccaggctttacaatattagcattatttctagcacattacattggaacctcactaacacaaaaagtagtgatttttattttgttgatgttagttaccccttccatgaccatgcgatgcgtaggagtgggaaaccgagactttgtagagggtctatcaggcgcaacttgggtggacgtggtattggaacatggaggttgtgtgacaacgatggctaaaaacaaacctaccttggacatcgaattgcagaaaacagaggctacgcaattagccacactaaggaaactatgtatcgagggtaaaataactaacataaccacagactcgagatgtcccacacaaggagaagcggtattgcctgaggaacaagatcaaaattacgtctgcaaacatacgtacgtagatagaggatggggaaacggatgcggactatttggtaaaggaagtttagtaacatgcgcaaaatttcaatgtctagaacctatagaaggaaaagtcgtacaatatgaaaatctgaaatatactgtgattattactgtccatactggtgaccaacatcaagtaggtaatgagacgcaaggggttacggcggaaataacaccccaagcatcaacaacggaagcgatcttaccagaatacggaacactcggtctcgagtgttctccgcgaacgggattagatttcaacgagatgatactactaacaatgaaaaataaagcatggatggtgcacagacaatggttctttgatttaccactaccatggacgagtggggccacgacagaaactccaacttggaaccgaaaagaacttctcgttacctttaaaaatgcgcatgcgaagaaacaagaagtagttgttttaggatcccaggaaggtgctatgcacacggcacttacaggtgctacggaaatacaaaattctggtggtacctctatattcgcgggtcatctaaaatgcagattgaaaatggataagttggaactaaaagggatgagttacgcgatgtgcgcaaatacattcgtcctgaagaaagaagtatcagagacacaacacggaacaattctgatcaaagttgaatatcgtggtgaagatgctccatgcaaaatacctttcagtacagaggacggccaaggaaaagctcataatggacgtctaatcactgcaaacccagttgttacaaagaaagaagaacctgtaaatatagaggcggaacctccgtttggagaaagtaatatagtcatcggaattggtgataatgcattaaagataaattggtacaagaaagggtcgtcaattggaaaaatgtttgaggcaacagcccgtggtgcacgaagaatggcaattctcggggatactgcttgggatttcggctcagtcggtggggtattaaacagcttaggaaaaatggtacatcaaatttttggatccgcatacacagctttattctcaggagtttcttgggttatgaaaattggaattggagtgttattaacctggataggactcaatagcaaaaatacgagcatgtcctttagttgtatagcaattggcattataacgttatatctgggagcagttgttcaagctgacatggggtgcgtcataaattggaagggaaaagagctaaaatgtggatcgggaattttcgtaacgaatgaagtacatacttggacggaacaatacaagtttcaagcggatagtcctaaaagactcgctactgccattgccggtgcgtgggaaaacggtgtatgtgggattagaagtacaacaaggatggaaaatttattatggaaacaaatagctaatgaattaaactatattttgtgggaaaataatattaaactaacggtagtagtaggggacataataggagttcttgaacaaggaaagaggacgctaacaccccaaccaatggagttaaaatattcatggaagacctggggaaaagctaaaattgtcacagctgaaacacaaaattcctctttcataatcgacggcccaaacactcctgaatgcccgtctgcatcacgagcatggaacgtctgggaggtagaggattatggctttggggtatttacgaccaatatctggttgaaactaagagaggtatatactcaactttgtgaccaccgcttaatgtcagcggcggtcaaagatgaaagagcagtccatgctgatatgggctactggattgagtctcaaaagaatggcagctggaaattagaaaaagcgtcacttattgaagtaaaaacttgtacatggcctaaaagccacactttatggtcaaacggtgtccttgaatcagatatgataatcccaaaatcgctagcaggacccattagccagcacaaccaccgtcccggttaccatacccaaacagccggaccatggcatttgggtaaactcgagctagattttaattattgcgagggtacgactgtcgtaattactgagaattgcggaactagaggtccgagtctacgaactaccacagtcagcggaaaattaatacatgaatggtgttgtagaagttgtactttaccccctctacgctatatgggcgaggatgggtgttggtatggaatggagatacgccctatatcagaaaaagaagagaacatggtgaaatctttagtttcagcaggttctggaaaagttgacaactttacgatgggggttctttgtctagcaatactatttgaagaagtgatgcggggtaagttcggcaagaagcatatgatagcgggcgtcttatttacgtttgtactcctgttaagtggacaaataacttggagagatatggcccatacactaataatgataggatcgaacgcctcggatcgaatgggcatgggcgtcacttacctagcgctaatagctacttttaaaattcaaccttttcttgcgctagggttctttttacgcaaactaacaagtagggagaatctattgttgggagtcggtctcgcaatggctacaaccctccaattacctgaagatatagaacagatggctaacggaatcgcgttaggtttaatggcattaaaattgattacgcaattcgaaacttatcaactgtggactgcattaatctcactgacatgttccaatacaatgtttacactaaccgtagcctggagaacggctacccttattctagctggagtatcattattacccgtatgccaaagctcgtcaatgcgcaaaaccgattggctgccgatggcagtggccgcaatgggtgtacctccactgcccttattcatattttcgctaaaagacacgttgaaaaggagatcgtggcctcttaacgaaggagttatggctgtcggccttgtctctattctagcgagtagtttactaaggaacgacgtacctatggctggaccactggtagcaggaggattactaatagcatgttatgttattacaggaacatctgctgatctaaccgttgaaaaagcagctgacattacatgggaagaggaagccgaacaaacaggggtgtcacataatttgatgataacagtggatgatgatggaaccatgcgcataaaagatgacgaaactgagaacatcttgactgtccttctgaaaacagcattgttaatagtaagcggcgtttttccgtactcaatcccagcaacgctcctagtatggcatacatggcagaaacaaacgcaacgaagtggcgtactatgggatgtcccttcacctccagaaacgcaaaaagcagaactggaagaaggcgtatacagaatcaagcaacaagggatcttcggtaaaacccaagtcggggtaggagttcaaaaagaaggggtctttcatacgatgtggcatgtcacacgtggagctgtgctaacgtataatgggaagcggcttgaaccaaattgggcctctgttaagaaagatttaataagttatggaggaggatggagactgagtgcccagtggcagaaaggagaagaagtacaagttatagcagtagaacctgggaagaatcctaaaaactttcaaaccatgccaggcacatttcaaacaactacaggagagataggcgcaatagctctggatttcaaacctggaacatctggcagcccaatcattaatcgtgagggaaaagtcgtaggcttatacggtaacggtgtagttacaaagaatggaggctatgtatcgggaatagctcaaactaacgcagaacctgatgggcctacaccagaacttgaagaggaaatgttcaagaaacgtaacttaactattatggatttgcatccaggtagcggaaaaacaaggaaatatctaccggcaatagtaagggaagccataaagcgtcgtttacgtacactaattctagctcctacacgcgtagtagcagcagagatggaagaagcactaaaggggttgcccatccgatatcaaaccaccgctactaaatccgaacacaccggcagagaaatagtagatttaatgtgtcacgcaacatttaccatgcgtttattatccccagtacgagtccctaattataatctcatcattatggatgaagcacattttacggatccagcgtcaattgccgcgaggggatatattagtacacgagtaggtatgggcgaagcagcagcaatattcatgactgcaactccgccaggaacagctgacgcgttcccgcaaagtaatgctccgatccaagatgaagagagagacattcctgagcggtcatggaacagtggcaatgaatggataacagactttgccggcaaaactgtatggtttgtgccgagcataaaagctggcaatgatatagccaactgcctccggaagaatggtaagaaagtaatccaattgtcaagaaagacattcgacacagagtatcagaaaaccaaacttaatgattgggacttcgtggtcaccactgatatttcggaaatgggcgctaattttaaggcagatagagtaatagacccaagacgatgcttaaaacctgttatacttacggacggtccggaaagagtaattttggcgggtccaatgccagttacggcagcgtcagctgcgcagagaagaggacgggtaggaagaaacccacaaaaagaaaatgatcagtatatatttacaggccaaccactaaacaatgatgaggatcacgcacactggactgaagcaaaaatgttactcgacaatattaatactccagaaggtattataccagcattgtttgaaccagaaagagaaaagtcggccgctatagatggagagtatcgactaaaaggtgaatctagaaagacatttgttgaactaatgagaaggggagacttaccagtgtggctcgctcacaaagttgcatcggaaggaataaagtatacagatcgtaaatggtgttttgatggtcaacgcaataatcaaatattagaagagaatatggatgttgaaatctggaccaaagagggagagaaaaagaaattaagacctagatggctggacgcaagaacttatagtgaccctttggcattaaaagagttcaaagattttgccgcgggacgaaagtccatcgcgcttgacctggttacagaaatcggacgagttccaagtcacttagcccaccgaacgaggaatgctctagataacttggtaatgttacacacttcggaacatgggggcagagcatatcggcatgccgttgaagaactccccgaaaccatggagacactactactacttgggcttatgattttactaactggaggtgcaatgttatttttgattagtggaaaaggaattgggaaaacgagcataggcttaatatgtgtcattgcatcttcaggaatgttatggatggctgaaatcccactacaatggatcgcatcagctatcgttcttgagtttttcatgatggtattattgatcccggaaccggaaaaacagcgtacgccacaggacaatcaattggcatatgttgttataggaatcttaactttagcagcaattattgctgcaaacgaaatgggtcttctagagacaacaaaaagggatctaggaatgagtaaggagcccggagtggtgtctccgacctcgtatcttgatgtagacctacacccagcaagtgcatggacactatacgcagtagcaacaacagtaataacacccatgctacggcacacaatagaaaattcaactgcgaatgtctctttggctgccattgcgaaccaagccgtagtactgatgggcttagataaaggttggcccatttctaaaatggatcttggcgtacccttactcgcacttggctgctatagtcaggtaaatccattaaccttaacggcagcggtcctactcttgattacccactatgcaatcataggtccaggacttcaggctaaggcaacaagagaagcgcagaaacgaacagcagcgggcattatgaaaaacccaactgttgatggcatcatgactatagaccttgatcccgtcatctatgactcgaaattcgaaaagcagctagggcaggttatgcttttagtactctgcgcagtgcaactcctactaatgaggacatcatgggcactgtgtgaagcccttacattggccacaggcccaattacgactctatgggaaggaagtccgggaaaattctggaatacaaccatagccgtctccatggcgaacatatttcgaggatcttatttggctggagcaggtttagcgttctccattatgaaaagcgtaggcaccggaaagagggggacagggtcgcagggtgaaacactcggagaaaaatggaagaagaaacttaatcaattatcgagaaaagagttcgacttatataagaaaagtggcatcacagaagtcgaccgcactgaagcaaaagaaggtttaaaacggggagagattactcatcatgccgtttccagaggcagcgccaaattacagtggtttgtagaaagaaacatggtaatacccgaaggccgagttattgaccttgggtgtggccggggaggttggtcctattattgtgcaggcctaaagaaagtgacagaagtaagaggatataccaagggaggaccaggccatgaagaaccagtgcctatgtcaacgtatggttggaacattgtgaaactaatgagtggtaaagatgtattttacctcccaccagaaaaatgtgataccctactatgcgatattggcgaatcaagtcctagtccaacagtagaagaatctaggactataagggtattaaaaatggtagagccttggctaaagaacaatcaattttgcataaaagtactaaatccttatatgcctacagtaatagaacacctcgaaagacttcagcgcaaacatggaggaatgctagtccgtaatccactaagtaggaatagcactcatgaaatgtattggataagtaatgggaccggaaacattgttgcatctgtaaatacagtaagcagacttctgttaaatcgatttacaatgacacaccgacgtccaactactgaaaaagatgttgacttaggagctgggacaagacatgttaatgctgagccagaaacaccaaacatggatgttataggtgaacgaatcaaaagaattaaagaggaacataacagtacatggcattacgacgatgaaaatccctataagacttgggcgtaccacggaagttacgaagtaaaagccacaggtagcgcatcatctatgataaacggagtcgtaaaattattaactaaaccatgggatgttgtaccgatggtcactcaaatggcaatgacagacacaacaccattcggacaacaaagggtgttcaaagaaaaagtagacacgagaaccccacgcagtatgcctggaactcgtcgagtaatgggaatcaccgctgaatggttatggagaacacttggacggaataagaaacccagattatgtactagagaagagtttactaagaaggtcaggacaaatgcggcaatgggtgcggttttcacagaagagaatcaatgggactcggcaaaagcagcagttgaagacgaagatttttggaaattagttgatagggagagggaactacacaaactaggcaaatgcggcagttgtgtttataacatgatgggtaagcgcgagaagaaactaggggaatttgggaaagcaaaaggatctagagcgatttggtacatgtggttgggagcccgttacctagagtttgaagctcttggtttcctgaatgaagatcactggttctctcgagaaaattcatattccggagtagagggagaaggtttgcacaaattaggttatattcttagagacatatctaaaatcccagggggcgcaatgtacgcagacgatacggctggatgggatacccgaataacggaagatgatctacacaacgaagagaaaattacccaacaaatggatccagagcatcgtcaactagctaatgctatcttcaaactaacctaccaaaacaaagtcgtaaaggtacaacgtcctactccaacgggaacggttatggatatcatatctaggaaagaccaacgtggaagtggtcaagttggtacttacggtctcaatacctttacaaatatggaagcacagttaataagacaaatggagggagaaggtgtattaagtaaagcagatttagaaaatccccacttaccagagaagaaaatcacacaatggctggaaacaaagggagtggaacgtctgaagcgtatggccataagcggggatgattgtgttgtcaagccgattgatgataggtttgcaaacgcacttctagcattgaatgacatgggcaaggtcagaaaggatatccctcagtggcagccatcaaagggatggcatgactggcaacaagtaccgttttgcagtcaccattttcatgagttaattatgaaagatggacggaagctagtcgttccgtgtagaccacaagatgaattgattgggagagctagaatatcacaaggagcagggtggtctctaagagaaacggcttgtttaggtaaggcatatgcacaaatgtggtccttaatgtactttcatagaagggatcttagactcgcctcgaatgccatatgctcagccgtacctgtacactgggtgccgaccagcagaacaacatggtcaatccatgctcaccaccaatggatgacaacagaagatatgctcacagtgtggaatagagtatggatagaagacaacccgtggatggaggacaagacccccgtaacgacttgggaaaatgtaccataccttggaaagcgagaagaccagtggtgtggctctctcatcggattgacatcgcgagcaacgtgggcccagaatataccgacggctatacaacaagtccgatctttgataggaaatgaagaatttctagactatatgccaagcatgaaacgtttccggaaagaggaggaatctgaaggagcaatttggtaa

SEQ ID NO: 23007 - RNA, 9873 nt, synthetic construct
  misc_feature 1..9873: note = derived and/or modified CDS sequence (opt6) from DENV-3__JX669490__SS-prME
  source 1..9873: mol_type = other RNA
acgagtctctgcttgatgatgatactgcctgcagcactagcgtttcatttaacttctcgtgatggcgaaccccgcatgatagtaggcaaaaacgaaagaggtaaatccctgctctttaaaactgcgtctggtattaatatgtgcacgctaatagcaatggacttaggtgaaatgtgtgatgacacagttacatataaatgtccacatattactgaagtagaacccgaagatattgactgctggtgtaatttaacaagtacttgggtgacatatggcacatgcaaccaagcgggggaacgaagacgggacaaacgatcagttgcattagcaccacatgtaggcatgggactagatacacgaacccaaacatggatgtcggcagaaggggcttggagacaagtcgaaaaagtggagacctgggctttaagacaccctggatttaccatactagcgctctttctggcgcactatattggaacaagtctaacacaaaaagtagtgatattcatattgttaatgttagtaaccccttcaatgacaatgagatgtgttggcgtaggaaatagagactttgtagaaggactttctggcgcaacttgggtcgatgtagtattagaacatggcggatgtgttactaccatggccaaaaataaacccactcttgacatagaactacagaaaacagaagcaactcaattagctacactacgaaaactctgcatagaagggaaaattactaatattacaaccgattccagatgcccaacacaaggagaagcagtattaccggaggagcaagaccaaaactatgtatgtaaacatacgtatgtggatcgaggatggggaaatggatgcggcctattcgggaaaggttcattagtaacatgcgcaaaatttcaatgcctagagccgatcgaaggaaaagttgtccaatacgaaaacctaaaatatactgtaataatcacagttcacacaggagaccagcatcaggtcggaaacgaaacccagggcgtaactgcagaaataacgccacaggcatcaacgaccgaggcgattttaccagaatacgggacgcttggactagaatgcagccccaggactggactcgacttcaatgaaatgatcttgctcacaatgaaaaacaaagcatggatggttcatcgccaatggttcttcgatctgccattaccatggacctcgggagcaacaacagagactccgacgtggaaccgaaaagaactcttagtaacttttaaaaacgcacacgccaagaaacaagaagttgtagtcctcggatcacaggagggagcaatgcacaccgctttaacgggagcgaccgaaatccagaacagtggtggcacaagtatttttgcaggacatctaaaatgcaggttgaaaatggacaaattagaactcaaaggaatgtcctatgctatgtgcacaaatacatttgtgctcaagaaagaagtcagtgaaacccaacacggtactatcctgataaaagtagagtatcggggagaagacgctccatgtaaaataccatttagcactgaagatggccaaggcaaagctcacaacggacggctaattaccgcaaatccagtagtaaccaagaaagaagaacccgtaaatattgaagcggaacccccattcggtgagagtaatatagtaatagggataggagacaatgcgttgaaaattaattggtataagaaaggatcttctatcgggaaaatgtttgaggcaactgcgagaggagcgagacgtatggccatcctcggtgacactgcatgggacttcggatcggtgggaggagtccttaattcattagggaaaatggtacatcaaatatttggaagtgcatacacggctttattctctggcgtgagctgggtaatgaaaatcggcataggagtacttttgacgtggatcggccttaattctaaaaacactagcatgtcattctcgtgcatagcaataggaattataacactttatctaggagcagtagttcaagcagatatgggatgcgtaataaattggaaagggaaggaattgaaatgtggttcaggaatatttgtaacaaatgaagtacacacttggacagaacagtataaattccaagctgattcccccaagcgtttagccacagcgatcgcaggagcttgggaaaacggagtatgtggtataagaagtactactagaatggaaaacttattatggaagcagattgctaacgaattaaactatatattatgggaaaacaacataaaactcactgttgtagtcggagatatcataggagtattagaacaaggtaaaagaactttgactcctcaaccaatggaattaaagtattcctggaagacctggggaaaagcaaaaatcgttactgctgaaacacaaaacagctcttttattatagatggtccgaatactcctgaatgtccctccgcatccagagcgtggaatgtttgggaagttgaggattacggtttcggcgtattcaccactaacatctggttgaaattacgggaagtctacactcaactttgtgatcatcgcttgatgtcagcagcggtaaaagatgaacgagcagtacatgctgatatgggctattggatcgaatctcagaaaaatggcagctggaaacttgaaaaagcatctctaattgaagtaaagacatgcacgtggccgaaaagtcataccctctggtcaaacggtgtgctagagagtgatatgataataccaaaatctctagcagggcctattagtcaacataatcacaggccaggttatcatactcaaactgcaggaccctggcaccttggaaaactggaacttgactttaactattgtgagggaactacagtggtaattacagaaaactgtggtacgcgaggaccttcacttagaaccacgacagtaagcggaaaattgattcacgaatggtgttgtagatcttgcacccttccaccgctccgttatatgggcgaagatggatgttggtacggcatggaaatacgacccattagtgaaaaagaagaaaatatggtaaaatctttagtttccgctggttcaggtaaagtggataatttcactatgggtgttctctgcctagccatattattcgaggaagtcatgagaggtaagttcggtaagaaacatatgatagcaggggtattcttcacatttgtcttacttttatcaggtcaaatcacgtggcgagacatggctcacactttaataatgataggaagcaatgcgtcagacagaatgggaatgggcgtcacttatctagctctcatagcaacgtttaaaatccaacctttcctcgcattaggattctttcttagaaaattaacctcacgcgaaaatctattactaggagtaggtttagcaatggcgaccacgctccaactcccagaggacatagaacaaatggcgaatggcatagcgttaggattaatggcactaaaacttataactcaattcgaaacttatcaattgtggactgctttaatatcactcacatgctctaacacaatgtttaccttaactgttgcatggcgaacagcgaccttaatcttagccggtgttagtttactaccagtttgccagtcttcatctatgagaaaaacagactggctaccaatggcggtagctgcaatgggtgtaccacctttgccattattcatattcagcttgaaagacactttgaaaagacgaagttggccacttaatgaaggagtgatggctgttggtcttgtatctattttagcttcaagcctgctgcgaaacgatgttcctatggcaggtcctctggtcgcaggaggattactaatcgcatgctatgttattactggaacctcagctgatctaactgtagaaaaagcagctgatattacatgggaagaggaagctgagcagacgggagtctcacataatctcatgattactgtcgatgatgacggaactatgagaataaaagatgatgaaacggagaacattttgacagtactcctgaaaacagctttattaatagtaagtggggtttttccttatagtattcctgcaactctcctagtatggcatacttggcagaaacaaactcaaaggagtggtgtattatgggacgtcccttcaccgccagaaactcaaaaggcagaattagaagaaggagtctatcgtattaagcaacaggggatcttcggaaaaacccaagtgggcgtaggagtacaaaaagaaggagtgttccacacaatgtggcacgttaccagaggggcagtattgacctataatggcaaacgtttagaaccaaactgggctagtgtcaagaaagacctcatcagctatggtggaggttggcgattatcagcccagtggcaaaaaggcgaagaagtgcaagtcattgcagtagagcccggcaaaaatcccaagaatttccaaaccatgccaggaacatttcaaactacaacgggcgagattggcgccatagcccttgactttaaaccaggaacatctggatcaccaatcatcaacagggaaggaaaggtagtagggctatatggcaatggagttgttaccaaaaacggaggatatgtttcaggaatcgcacaaacaaacgcggaaccagacggacctacacccgaactcgaggaggaaatgtttaaaaagcgtaacctcacaattatggacttacatcctggtagtggaaaaaccagaaaatatttacccgcaatagtaagagaggccatcaaacgcagactacgtacactaattctggcacccacaagggtagttgctgctgagatggaagaagccttaaaaggtctgcctataagataccaaaccacagctaccaaatctgaacacaccggacgagaaatagtagacctcatgtgtcacgctaccttcactatgagattactgtcaccagtaagagtgccaaattacaatttgatcataatggatgaggcacacttcactgatccggcgtcaatagcagcacggggatatatttcaacacgtgttggaatgggagaagcagctgctatttttatgactgcaactcccccaggcacggctgatgcatttcctcaaagtaatgcaccaatacaggatgaagaaagagatatacctgaaagatcatggaactctggtaacgaatggatcacggacttcgctggaaaaaccgtatggtttgtaccctcaattaaagcaggaaatgatatagcgaattgcttaaggaaaaatggaaagaaagtaatacaattgagcagaaaaacttttgatacggagtaccagaaaactaaactgaatgattgggattttgtagtaacgacagacatctcagaaatgggggcgaatttcaaagctgatcgcgtaatagatcctagacgatgccttaaaccagtcattctgacggacggaccggaacgagtaatactagcaggacccatgccagttaccgccgctagtgcggctcaaagacgtggaagagtaggtagaaaccctcagaaagaaaatgatcaatacattttcacagggcaaccactaaacaatgacgaagatcatgctcattggacagaagcaaaaatgcttcttgataatataaatacccctgaaggtattattcctgccctctttgaaccagagcgtgaaaaatctgcggcgatagatggcgaatacagactaaaaggagaatcccgtaaaacgttcgtagaactaatgcggaggggagatttacctgtttggttggcgcacaaggtcgcatccgaaggaatcaaatacactgacagaaaatggtgctttgacggccaaagaaacaaccaaatattagaagagaacatggacgtagaaatatggacaaaagagggtgagaaaaagaaactgaggccacgatggctagatgccaggacatatagtgaccctctagccttgaaagaatttaaagattttgctgcaggcaggaagtcaatagcattggacctagtcactgagataggtcgagtgcctagtcacctggcacatagaacccgtaacgcacttgataacctagttatgttacatacaagtgaacatggtggccgtgcgtatcgtcacgcggtggaagaattaccagaaaccatggaaaccttactattactaggtttgatgatacttctaacaggaggagcaatgttatttttaataagtggtaaaggtataggaaagacatcgataggtcttatctgcgtgattgctagtagtggaatgttatggatggcggaaattcctttacaatggatagccagtgcaatagttctcgagttctttatgatggtccttttaattcctgaacctgaaaaacaaagaacaccccaagataatcaattagcgtacgttgttataggtattctcacattagcagccataatagccgcaaatgaaatgggattattagagacgacaaaacgcgatttaggaatgtcgaaggaaccaggtgtcgtcagccctacatcatacctagatgtcgacctgcatccagcgtctgcatggactttatatgctgttgctactacagtaattactccaatgctaaggcacaccatagaaaattccactgcaaacgtatcattagctgcaattgcaaaccaggccgtagtgcttatgggattggataagggatggccgatatcgaagatggacttaggggtgccattgcttgccctcggctgttacagtcaagttaaccccttgaccctaactgcagcggtgttgttgcttataacacactacgcaattattggacccggactacaagccaaggcgacaagagaggcacaaaagcgaactgctgcagggataatgaaaaatccaaccgtcgatggcattatgacaatcgatcttgacccagtaatctacgatagtaaattcgaaaagcaattaggacaggttatgctactggtcctatgtgcagtccaattactactaatgagaacgtcttgggccctatgtgaagcattaactctagcaaccggtcccattacaaccctctgggaaggaagcccaggaaaattttggaatacgaccatagcggtttcaatggcgaacatttttagaggttcctacctagctggagcagggttggctttttcaataatgaaatccgtaggtactggcaaacgtggaactggatctcaaggagaaaccttgggcgaaaaatggaagaagaaacttaaccaactaagtcgaaaagaatttgacctgtataaaaagtcaggaatcaccgaagtcgatcggactgaggcaaaagagggcctaaaacgcggcgagattactcaccacgcagtatcgcgaggatctgccaagttacaatggttcgtagaacgaaatatggtcataccagaagggcgagttatagacctaggctgcgggcgtggcggatggtcatactattgtgccggactaaagaaagtaaccgaagtaagaggttatactaaagggggacctgggcacgaagaaccagttcctatgagtacctacggatggaacatagtgaaattaatgagtgggaaggatgtcttttacttgcctccggaaaagtgtgatactctgctgtgcgacatcggtgagtccagcccctctccaactgttgaagaaagcagaaccattcgcgtcctcaaaatggtagaaccctggctgaaaaacaaccaattttgtattaaagtattaaacccatatatgccaactgtcatcgaacatcttgaaaggttacaacgaaaacatggaggtatgctagtcagaaacccattaagtagaaactcaactcatgagatgtattggatcagtaatggaacgggaaacatcgtagcgtcagtcaatatggttagtcgactgcttttgaatagatttacgatgactcatcgtcggccgacaatcgaaaaagacgtagatcttggagctgggactagacacgtaaatgcagaaccggaaacgcctaacatggatgtaatcggcgagagaataaaaagaataaaggaagaacataacagtacttggcactatgatgacgaaaatccctataaaacatgggcatatcatggttcatatgaagtaaaagccaccggatcggcgtcatcaatgatcaatggcgttgtaaagttactcacgaaaccgtgggacgtcgtaccaatggtaactcaaatggcgatgactgatactacgccattcggacaacaaagggtcttcaaagaaaaggttgacactagaaccccgagaagtatgcccgggacacgaagagtaatgggtattacggcggaatggctctggcgcactctgggcagaaacaagaaaccacgtctatgcacacgtgaagaatttacgaagaaggtgcggacaaacgccgctatgggagcggtgtttacagaagaaaatcaatgggattcagcaaaggcagctgttgaggatgaggacttctggaaactcgtcgaccgcgagagagaattacataaactgggtaaatgcggaagctgcgtgtataacatgatgggtaaacgggagaagaaactaggagagtttggaaaagcaaaggggtcaagagcaatatggtatatgtggctaggcgcgagatacctggagttcgaagctcttggattcctaaacgaggatcactggtttagtagagaaaattcttactcaggagtggagggcgagggccttcacaagctgggttatatactaagggatatatctaagatacctggtggggctatgtatgcagatgatacagcagggtgggatactcgcatcacagaagacgatctacataatgaagagaaaattactcaacaaatggacccggaacataggcaattggcaaacgcaatattcaaactgacctaccaaaacaaagtggtaaaagtgcaacgaccgactccaactggtaccgttatggatataattagtcgtaaggaccaaagaggatccgggcaagtaggtacatatggcctaaatacattcacaaatatggaagctcaactaataaggcagatggaaggggaaggtgttttatcaaaggccgatcttgaaaatcctcacttacctgaaaagaagataacccagtggttggaaacgaaaggggttgagcgactgaaacgaatggccataagtggtgacgattgtgtagtcaagcctatagatgatcgtttcgctaatgccttattagcattaaacgacatgggaaaagtaagaaaagacatcccacaatggcaaccttccaaaggttggcatgattggcaacaagtgccgttttgtagtcatcatttccatgaattgatcatgaaagatggaagaaaactcgtagtgccttgcagacctcaagacgaactaattgggagggcccggataagtcaaggcgcaggctggagtcttagagaaactgcctgcttaggaaaagcatatgcccagatgtggagtctcatgtacttccatagacgggatttgagattagcaagcaatgctatctgctcagctgtcccagtgcattgggtaccaacgagcaggaccacatggtcaatccatgcgcatcaccagtggatgactacagaagacatgcttacagtgtggaatagagtatggatagaggacaatccctggatggaagacaaaacgcccgtcaccacgtgggaaaatgttccataccttggaaagagggaagaccaatggtgcggatcactaattggactgacatcccgagcaacttgggcccagaatataccaacggcaattcaacaagttcgatcactgatagggaatgaagagttccttgactatatgccttcaatgaagaggtttcggaaagaggaagaatccgaaggagctatatggtaa

SEQ ID NO: 23008 - RNA, 9873 nt, synthetic construct
  misc_feature 1..9873: note = derived and/or modified CDS sequence (opt6) from DENV-3__JN406515__SS-prME
  source 1..9873: mol_type = other RNA
acgtccctctgcttaatgatgatgctacctgcaaccctggcatttcatttaacttctagagacggtgaacccagaatgattgttgggaaaaatgaacgaggaaaaagtcttctattcaaaactgctagcggaataaatatgtgcacacttatagcaatggatttaggagaaatgtgtgacgacactgttacatataaatgccctctaataacagaagtagaaccggaagatatagattgctggtgtaatctcaccagtacttgggtaacctatggtacctgcaaccaagcaggagaacaccggagagacaaaaggtcagttgcgctcgcacctcacgtaggcatgggactggacaccagggctcaaacatggatgtcagcagaaggcgcatggcgacaagtagaaaaagttgaaacttgggccttcagacatcctggattcacaattctagccttattccttgcacattacattggcacatcgcttacgcaaaaagtagtaatattcatattactcatgttagtgacaccctctatgacaatgaggtgtgtgggagtaggcaatcgagatttcgttgaaggattatctggcgcgacttgggtggacgttgtcctagaacatgggggatgcgttacaacaatggccaaaaataaacctacattagatatagaattacagaaaactgaagcaacgcaattggcgactctacgtaaattatgtatagaaggaaaaatcacaaatgtcacaacagactcgagatgtcctacacaaggagaagccatactgccagaagaacaagatcaaaattacgtgtgcaaacatacatacgtagacagaggatggggtaacggttgcggactttttggcaaaggatctttggtcacctgtgcgaaatttcaatgccttgagttaatagagggtaaagtagtacaacatgaaaatttaaaatatactgtaattataacggttcacactggagaccaacatcaagttggcaatgaaacacaaggagtcactgctgaaattacccctcaagcgagcacagtcgaagcaattcttcctgaatacgggacactaggactagaatgttctccacgtacgggacttgattttaatgaaatgatactgctaactatgaaaaataaggcttggatggtacatcgtcaatggttctttgatcttccacttccatggacttcaggggccacgaccgagactcccacctggaacaagaaagaattactcgttacttttaaaaacgcccatgccaagaaacaagaagtagtcgttctaggttcccaagaaggggcgatgcatactgctcttacaggcgctacggaaatacaaactagcgggggaacctcgatttttgcagggcatttgaaatgcagattaaaaatggataaacttgaacttaaaggaatgagttatgctatgtgctcaaacgcctttgtactaaagaaagaagtatcagagacccaacatggaacgatcttgataaaagttgaatacaaaggagaggatgctccatgtaaaatcccatttagcacagaggatgaacaaggaaaagcacataatggtagattaataacagcaaatccagttgttacgaagaaagaagaaccagtaaatatagaagccgaacctcctttcggggagtcaaatattattattggaatcggtgataaagctctcaaaataaattggtataagaaagggtcttcaatcggtaaaatgtttgaagcgacagcacgtggtgctcggcgtatggccatcctaggtgacaccgcctgggactttggatcagttggcggagtcttaaactcactcgggaaaatggtacatcaaatatttggttccgcttatactgctctattttcaggagtctcatggatcatgaaaatagggataggagttttactgacatggatagggcttaactctaaaaatacttcgatgtcgttctcttgtatagtaataggaataataactttatatttgggtgcagttgtgcaagctgatatgggttgcgtaataaactggaaaggtaaagagctgaagtgtggatcaggaatctttgttacaaatgaagttcatacgtggacagaacagtataaattccaagccgatagtccaaagcggcttgcaaccgctattgcaggagcatgggaaaatggagtgtgcggaatcagaagcactacaagaatggaaaaccttctttggaagcagatcgctaatgaactaaactacatactttgggaaaacaacataaagctcacagtcgtagtcggagatattatcggcgtactcgaacaaggcaagagaacgttaactcctcaaccaatggaattaaaatatagttggaaaacgtggggtaaggctaaaattgtaactgctgagacgcaaaatagttcttttataattgacggaccaaacactcccgaatgtcctaacgcatctagagcatggaatgtttgggaggtagaagactacggctttggagtttttacaacaaatatctggttaaagttacgagaaatgtatactcaattgtgtgaccacagacttatgtcagcggcagtaaaagatgaaagagctgttcacgctgatatgggatactggatcgaatctcagaaaaatggcagttggaaacttgaaaaagctagcttgatagaggttaaaacctgtacatggccaaaatcacatactctatggagtaatggtgttctggagtcggacatgataataccaaaatccttagctgggccaatatcacaacataattatagaccagggtatcacacccagacagcaggaccatggcacttgggaaaattagaattggactttaattattgtgaagggaccacagtggtgattactgaaaattgtgggacaagaggaccaagtttgagaacgacgacagtgtctggtaagctcatccacgaatggtgttgccgttcttgcacattaccaccattacgttatatgggtgaagatggatgttggtatgggatggaaattagaccaataaacgaaaaagaggaaaacatggtaaagtccctagtatctgcaggctcgggcaaagtcgataactttactatgggagtcctctgcttagctatactattcgaagaagtaatgagaggaaaatttggcaagaaacacatgatcgccggtgttttgtttacgttcgttctcctattatctggacagattacatggagagacatggctcgaacacttatcatgatcggatctaacgcatctgaccgaatgggcatgggcgttacttatctggcccttattgctacatttaaaattcaaccttttctagctttgggcttctttcttcggaaattaacgagcagggaaaacttattacttggagttggtttagccatggcaacaactctacaattacccgaagatgtggagcagatggcaaatggcattgcattaggattgatggctctaaaacttataacccaattcgaaacttaccagttatggactgctctagtttcactcatgtgtagtaacactattttcacacttacagtcgcttggcgtacggcaacactaatcttagctggtatctctttattcccagtctgtcaatccagttcaatgagaaaaactgattggttgcccatgacagttgcagctatgggggtaccaccattacctttatttatatttagtttaaaagatacacttaaacgaagatcatggccccttaacgaaggtgtcatggctgtaggacttgtttccatattggcctcatctttattgcgcaatgatgtacctatggctggtccgctagttgccggtgggctactcatagcatgttatgtaataacaggcacatcagcagacctaactgtagaaaaggcggcagatgttacttgggaagaagaggctgaacaaacgggtgtatcgcataacctaatgattacggtcgacgacgatggtacaatgcgaatcaaagatgatgagacggagaatattctgacagtactactaaagaccgcattactaatagtttcgggaattttcccctattccatacccgcaaccttattagtctggcacacgtggcaaaaacagacccaacgttcaggagttctgtgggatgtgccaagtcctcctgaaacgcaaaaagcagaattagaagaaggtgtttaccgtattaaacaacaagggatatttggaaaaactcaagtgggcgtaggagtccaaaaggaaggagtatttcatacgatgtggcatgtcaccaggggagcagtcttaacatacaatggcaaaaggttggagccaaactgggcaagtgtcaagaaagacttaatatcatacggaggcggatggagattatcagcccaatggcagaaaggagaagaagtacaggtaatcgcagttgaaccaggcaaaaatccgaaaaattttcaaacaatgccgggaatatttcagacaacaacgggggaaatcggggccattgcattagattttaaacctggtacaagtggaagtccaatcataaatcgtgaaggaaaggtcgtcggattatacgggaatggagtcgtaactaagaatggagggtatgtatctggaatcgcccaaactaatgctgaaccagatgggccaaccccggaacttgaagaggaaatgtttaagaaaagaaatctaacaatgatggacttgcatcctggaagtgggaaaacacgtaaatatctacccgctatagtacgagaagcaatcaaacgaagactgagaactctaatcttagccccgacaagagttgtagccgctgagatggaagaggctttaaaagggcttcctatacgttatcagactaccgctaccaagtccgaacatacagggaaagagattgtagacctaatgtgccacgccacatttacaatgaggttgttatcgcccgtaagagtgccaaactataatctcattataatggatgaggctcactttactgatccggcaagcatcgcagcacgaggctatattagcacgagagtgggcatgggggaagcagctgctatctttatgacagcaacaccccctggaactgctgatgccttcccacaaagcaacgctccgatacaggacgaggaaagggacattccagagaggagttggaactcaggtaacgattggatcacagactttgctgggaaaaccgtatggtttgtaccaagtataaaagcaggcaatgatatagcaaattgtttgaggaaaaatggaaagaaagtaatccaattaagcagaaaaactttcgatactgaataccagaaaacgaaactaaatgattgggatttcgttgttacgacagatatctctgagatgggtgctaacttcaaggcggaccgtgtcattgacccgagaagatgtctaaagcccgttatacttacagatggaccagaacgtgtaatacttgccggtccgatgcctgtcacagtagcatctgcagcccagagacgaggaagggttggaagaaatccgcagaaagaaaacgaccaatatatattcactggtcaacccctaaacaatgacgaagatcatgcccattggaccgaagcgaaaatgttactagacaatattaatactcctgagggaatcatacccgctctcttcgaaccagaaagagagaaaagtgccgctatagacggggaataccgcttaaaaggtgaaagcaggaaaactttcgttgaactaatgcgtcgtggggacttacccgtttggcttgcccacaaagttgccagtgagggaataaagtatactgacagaaagtggtgttttgatggcgaacgcaataatcaaattttagaagaaaatatggatgtcgaaatctggactaaggaaggcgagaagaagaaattaaggcctagatggctcgacgctcggacatatagcgatccgctagccctaaaggaatttaaggattttgcagcgggacgcaaatcaatcgccctagacctagtaactgaaatcgggagagtgccgagtcacctagcccataggacacggaacgcattagataacctagttatgttacataccagcgagcacgggggtagagcataccgccatgcagtggaagaacttccggagaccatggaaaccctcttgctactgggcttaatgatcctcttaactggtggagcaatgctttttcttatcagtggtaagggagtaggaaaaacatccataggattaatatgtgtcgtcgcctcatctggtatgctttggatggctgacattcctttgcaatggatagcaagtgcgattgtattagagttctttatgatggtactactaattccggaacctgaaaaacagcgaactccacaggacaatcaattggcgtatgtggtcatcggaattttaacattggctgcaatcgtggcagctaatgaaatgggcttattggaaacaacaaaaagggatttgggtatgagtaaggaaccaggcgtggtgtcaccgacgagctacctggatgtggatctccatccagcttcagcatggacattatatgcagtagcaacaaccgtgataacaccaatgttacgacataccatagagaatagtactgcaaatgtcagcttggcagctatagctaaccaagcggtagtactgatgggattagacaaaggatggcccatctccaaaatggatttaggcgtacctttactagctcttgggtgttattctcaagttaacccacttacgttaacagcggctgttttgctattagttacacattacgcaattataggtcccgggttacaagcaaaggcaacccgcgaagcccagaaaagaacggcggcgggtattatgaagaaccccacggtagatggtataatgactatagatcttgaccccgttatatacgatagtaaatttgagaaacaattgggtcaagttatgcttttagtgttatgtgctgtacaacttctcttaatgcgaacttcgtgggcattttgtgaagccctaacactagcaactggtccaataacgacactatgggaggggagccccggtaaattctggaatacaactatagccgtgtcgatggcgaatattttccggggatcctatttagcgggagctggattagctttttcaattatgaaatctgtcggaacaggaaagcgggggaccggttctcaaggtgaaactctgggagaaaaatggaagaagaaattaaaccaactatcaaggaaagagttcgatctatacaagaagtctggtataactgaagtagataggacagaagcaaaggaaggactgaaacggggtgaaataactcaccacgcagtctctagaggtagtgctaagttacaatggtttgttgaacgtaacatggtgattcccgaaggtcgagtcatcgatctaggttgtggccgaggtggttggtcttactactgtgctggtctaaagaaagttactgaagtgcgcgggtacacaaaaggtggacctggacatgaagaacccgtacccatgtccacgtatggttggaacatagttaaattgatgagcggtaaagatgtattttacctaccaccagagaaatgcgatacgctcctatgcgatataggtgaatctagtccgagcccgacagtagaagaatcaagaacaattcgtgtacttaaaatggtagaaccgtggttaaagaataatcaattttgtataaaagtactaaatccatacatgcctacagttatcgaacacctggaacgtttacaaagaaaacacggaggaatgttagttagaaatcctctcagtcgcaattcaacccacgaaatgtattggatatctaacggaactggcaacatagtaagttcagtcaatatggtatctagactgttattaaatagattcacaatgacttatagacgcccgactatcgaaaaggacgtggacttaggtgcaggaacaagacacgttaacgccgaacctgaaacacctaacatggacgttattggtgaaagaataagacggatcaaagaagaacattcatcaacatggcactatgatgatgaaaatccatataaaacatgggcctatcatgggtcctatgaagtaaaagcaacaggctcagcatcatcgatgatcaatggcgtagtcaaattgttaaccaaaccctgggacgtcgtacccacagtgactcaaatggcaatgaccgacacaacaccatttggacaacaaagagtattcaaagagaaagtagatacaagaacccctaaacccatgccaggaacaagaaaagtgatggagataactgcagaatggctgtggcgaacattaggacgaaataaacgtccaagactttgtacgcgtgaagaatttactaagaaagtgcgtactaacgccgcaatgggggcagtcttcactgaagaaaatcaatgggatagtgcaagagcagcagtagaagatgaggaattttggaaacttgtagatcgcgaaagagaattacacaagttaggcaagtgtggtagttgtgtatataatatgatgggaaaacgtgagaagaaactgggcgaatttggaaaagcaaaaggatcacgcgctatatggtatatgtggcttggtgcaagatatctggaatttgaggcacttggatttttaaacgaggaccactggttttctcgtgaaaattcatacagcggagtcgaaggtgaaggcttacacaaactaggatatatcttgagagatatatctaaaataccaggaggagcgatgtacgcggatgataccgcgggatgggacacaaggattacggaagatgatttgcataatgaggagaaaatcacacagcagatggatccagaacatagacaacttgctaacgctatatttaaattaacttatcaaaacaaggttgtcaaagtgcaaagaccaactccaaaaggaaccgtgatggatataatcagtagaaaggaccaaagaggttccggtcaggttgggacatacgggctcaacaccttcacaaatatggaagcacaactaattcggcaaatggaaggtgaaggagtattaagtaaaacagatttagaaaacccgcatctattggagaagaaaatcactcaatggttagaaacgaaaggcgttgaaagattgaaaagaatggccatttcaggcgacgattgtgtagtaaaacccatagacgacagatttgcaaacgcattgttagctctgaatgatatgggcaaggtccgtaaagatataccgcagtggcaaccaagcaaaggttggcacgattggcagcaagtccctttttgttcacaccattttcatgagctaataatgaaagatggaagaaagctagtggttccttgtagaccccaagacgaactaatcggacgtgcaagaatatcacaaggcgcaggttggtctttaaaggaaacagcttgtttaggaaaggcttatgcacagatgtgggcactaatgtacttccatcggagagatctaaggcttgcatcgaatgctatttgttctgccgtacctgtgcattgggttccgacctcaaggacaacgtggtcaatacacgctcaccaccaatggatgacaactgaagacatgcttactgtatggaatagagtgtggattgaggataatccatggatggaggataaggctcccgtaacaacctgggaagatgttccatacttaggaaagcgagaggaccaatggtgcggttctttgataggcttaaccagccgtgccacctgggctcaaaacatattgactgcaatacagcaagtccgatctttgattgggaatgaggagttcttagattatatgcccagtatgaaaagatttcgaaaagaggaggaatcggaaggggcgatatggtga

SEQ ID NO: 23009 - RNA, 9873 nt, synthetic construct
  misc_feature 1..9873: note = derived and/or modified CDS sequence (opt6) from DENV-3__JN406514__SS-prME
  source 1..9873: mol_type = other RNA
acaagtctgtgtttaatgatgatgctaccagcaactctagcgtttcacttaacctcgagggatggagaaccgagaatgatagttggtaaaaatgaacgtggaaaatcattactatttaaaacagcatctgggattaatatgtgtaccctcatcgctatggatctcggagaaatgtgtgatgatacggtgacatataaatgtccactaattgcggaagttgaaccggaagatattgattgttggtgtaatttgacatcaacatgggtaacatacgggacttgtaatcaagctggcgaacatcgaagagataaaaggagcgtggctttagcccctcacgttgggatggggctagatacaagaacacaaacttggatgtcagcggaaggcgcatggcgacaagttgaaaaagttgaaacatgggcacttcgtcacccaggctttaccatcctggctttgttcttagcgcattatataggtacaagtttgactcaaaaagtggtaatattcattttgctcatgcttgttaccccgtctatgacgatgagatgtgttggtgtgggtaatcgtgattttgttgaaggactaagcggagcaacctgggtcgacgtagtattagaacacggtggatgcgttactaccatggctaaaaataaaccaactttagatatcgaattacagaaaaccgaagcgacacaattagctactctgagaaaattgtgtatcgaaggtaaaataactaacattacgacagactctagatgtcctactcaaggggaggcaatactcccggaagaacaagatcaaaattatgtttgcaaacatacctatgtagataggggttggggcaatggatgcggactatttggaaagggtagcctagtgacttgtgcaaaatttcagtgccttgaaccgatcgaaggaaaagtcgttcagtatgaaaatcttaaatacaccgttattatcacagtgcacacaggtgatcaacatcaagtaggaaacgatactcaaggagtaacggtggaaataactccccaagctagtacagttgaggcagtcctacccgaatacggaaccctaggcctagaatgttcaccaagaaccggactggattttaatgaaatgatattattaaccatgaaaaataaggcatggatggtccaccggcaatggttcctggacttgcccctaccgtggacatcaggtgctaccactgaaagaccgacgtggaacagaaaagagctattagtcactttcaaaaatgcgcacgcgaagaaacaagaagttgtagttctaggcagccaagagggcgcaatgcatacagctttaacgggagcgacagagatccagaactctggcggtaccagtatctttgcagggcatctaaaatgcagactcaaaatggacaaattagagttaaaaggaatgagttatgccatgtgcctaaacacatttgtactcaagaaagaagtgtccgagacacaacatggtaccatactcataaaagtagaatacaaaggtgaggatgctccctgcaagatcccatttagcacagaggatggacaaggtaaggcgcacaacgggagactcatcaccgcaaatccagtcgtcactaagaaagaggagccagttaatattgaagcagagcctccattcggagaaagtaacatagtaataggcattggagacaaagcgctgaaaatcaactggtacaaaaagggtagttcaattggcaaaatgtttgaagctaccgccagaggagcgcgtaggatggctatattaggagatacagcatgggatttcggcagtgttgggggagtactaaactctctaggaaagatggtccatcagatattcggttcagcttatacggccctctttagtggcgtctcctggataatgaaaataggaattggggtacttctaacatggataggattaaatagcaaaaatacctcaatgagcttttcctgtatagtgataggcatcataaccttatatcttggagcggtagttcaagctgatatgggatgcgtcataaactggaaaggaaaagagcttaaatgcggctccggcatttttgtaacaaacgaagttcatacctggacagaacagtataaatttcaagccgactcacctaaaaggctagccacggctatagcgggtgcatgggaaaatggagtgtgtggaatacgatcaaccacaagaatggaaaatcttttatggaagcaaatcgcaaatgaactgaattatattttatgggagaataatattaagttaacagtggtagtaggcgatacaataggagtactggaacaaggaaagagaaccctaactccacaaccgatggaactaaaatattcatggaaaacctggggtaaagccaaaattgttacagctgagacacagaactctagttttattatagatggtcccaacacgccagaatgtccatctgcttcacgcgcatggaatgtttgggaagtggaagattacggattcggcgtgttctcaaccaatatatggctaaaactacgagaggtttatactcagtcatgcgaccatagacttatgtcagccgcgattaaagatgaacgtgcagtgcatgctgacatggggtactggattgaatcacagaaaaacgggtcttggaaacttgaaaaagcatcatttatagaggttaaaacatgcatatggccaaaatcacataccttatggagcaatggtgtgttggaaagtgatatgataattcctaaatctctcgccggcccgatatcacaacacaatcacagaccaggataccatacacaaacagctggtccttggcatctaggaaaactagaattggactttaattactgcgagggaacgacagtagttattacggaaaattgcggcactagaggaccatcgctcagaaccacaactgtctctggtaaactcatacatgagtggtgttgtagatcttgtactttaccaccactgagatacatgggggaggatggctgttggtacggaatggaaatcagacctataaatgaaaaagaagaaaatatggtcaaatcactggtttctgctgggtctggtaaagttgataattttacaatgggtgtattatgtttagcgatactttttgaggaagtaatgagaggaaagttcggcaagaaacatatgatagctggtgtactatttacctttgtactgcttctatcaggtcaaatcacttggcgagacatggctcatacattaattatgattggaagtaatgcgtcagacaggatgggaatgggtgtaacttatcttgcattaatagcaacatttaaaatacaaccgttcttggcgttgggattctttcttagaaaactaacttcacgcgaaaacctcttattaggtgttggcctggcgatggcaacgactctacagctaccagaggacatagaacaaatggcgaacggaattgcattagggcttatgactcttaaattaataacacaatttgaaacttatcagctttggactgctttagtgagtcttacctgctctaatacgatcttcactttgaccgtggcctggcgaacagcaaccttaatcttggctggggttagcttactacctctatgtcaatcgtctagcatgcgcaaaacggattggcttccaatgaccgtcgccgctatgggtgtacctcctttaccactgtttattttctcactaaaggatactccaaagagaaggtcatggccactaaacgaaggcgtaatggccgttggcttagtctccattttggccagcagtttactaaggaacgatgttcctatggctgggcccctcgtggccggaggcttacttatagcgtgttacgtaataacaggaacctcagcagatttaacggttgaaaaagcagcagatgtaacatgggaagaagaggccgagcagaccggagtttcacataacctaatgataacggtagacgacgacggcacaatgcgaattaaagacgatgagactgagaacatactaaccgtacttctaaaaactgccctactgatagtcagcgggatttttccatacagtataccagccacattgttggtttggcacacgtggcaaaaacaaactcaacggtctggagtgctatgggatgtaccttctccacctgaaacgcaaaaggccgaactagaagaaggagtatatagaataaaacaacaaggaatctttggaaaaacccaagttggagtgggggtacaaaaagaaggcgtgtttcacactatgtggcatgttacgcgaggtgcggtcctaacacacaatgggaagagactggagccaaactgggcaagcgtaaagaaagacttaataagttatggaggaggatggcgactttcagcacagtggcagaaaggcgaggaagtccaagtaatagcagtcgaaccaggtaaaaaccccaaaaattttcaaacaatgcccggaatattccaaactaccacgggtgaaattggtgctatagctctagattttaaaccgggaacttcggggagcccaataattaatagagaaggtaaagtagtaggattatacggtaatggtgtggttaccaaaaacggaggctatgtatctgggatcgctcagaccaacgccgaacccgatgggccgactccagagctggaagaagaaatgtttaagaaacgaaacctaactataatggatctacatccaggctccggaaaaactcgtaagtatctcccagctattgttagagaggcgataaaacgcagactaagaacactaatcttagctccaacacgtgtagtagccgctgagatggaagaagcactaaaagggctacccataagataccaaacaacggcaacaaaatccgagcatacgggaagagaaattgttgacctcatgtgccatgccacatttactatgaggctattaagcccggtgcgtgtaccaaattacaacttgattatcatggatgaagcacattttactgatccggcaagcatagcagcaaggggatacatttctacgcgcgtcggcatgggcgaggccgctgctatatttatgacagcgaccccaccaggcacagcagaagcgtttccccaatcgaacgcacctattcaggatgaagaaagagacattccagaaaggagttggaactcaggtaacgaatggattacggattttgtaggtaaaacggtatggtttgtaccaagtataaaagcaggtaatgacatagcgaattgtttgcgcaaaaatggaaagaaagtaatacaattatctagaaaaacctttgacactgaatatcagaaaacaagactaaatgattgggatttcgtcgtaaccactgatatatcggaaatgggcgccaacttcaaggccgacagagttatagacccgcgaagatgtctcaaacctgttatattaacagatggaccagaaagagtaattctagcgggtcccatgcctgtgacagctgcctctgcggcacaaagacgagggagagtaggcaggaatcctcaaaaagaaaatgatcagtacattttcacaggacaaccgttgaacaatgatgaagatcatgctcactggacagaagcaaagatgctactagataatataaacacacctgaagggataatccctgctcttttcgaaccggaacgagagaaaagtgctgcaattgacggggaataccgacttaaaggtgaatcaagaaaaacatttgttgaactaatgagaagaggagatctacccgtctggctagcacataaagtagcttcggaaggaataaaatacacagacaggaagtggtgctttgacggagaacgtaacaaccagatattggaggaaaacatggacgtagagatatggactaaagaaggagaaaggaagaaattaagaccgcggtggttagatgcaagaacttattctgacccgttagctctaaaggagtttaaagatttcgctgctggtagaaagagcatagctctcgacctagtaacagaaataggtagagtaccttcccatctcgcccaccgaacaagaaatgctctcgacaatctcgttatgctacatacttccgaacacggaggtcgagcctatcggcatgcggttgaagaattaccagagacgatggaaacccttttgctattgggccttatgattctgctcactggcggagctatgctatttttaatatctggaaaaggaattggaaagacttctataggtcttatatgcgttatagtcagttcaggtatgctctggatggcagacgtgccattacaatggatagccagtgcgatcgttttagagttctttatgatggtcctcctcattcccgaaccagaaaaacaaaggactccacaggataatcagttagcgtatgttgtaataggaatactaactctcgcagcaatcgttgctgctaatgaaatgggattattagaaactacaaaacgggacctaggaatgtctaaagaacccggagttgtttccccgacgagctaccttgatgtggacctccatccagcgtctgcctggactctgtatgctgttgctaccacggttataacacctatgctaaggcatacaatagaaaattccacggccaatgttagtctcgctgcaatagctaatcaagccgtagttttaatgggattagacaaaggatggcctatttcaaaaatggatctaggcgtccctttattagcacttggctgttacagtcaggtaaacccactaacgttaacggctgcagttcttctcttggtcacacattacgccatcataggaccgggattacaggctaaagctactcgagaagcgcagaaaaggaccgctgccggtataatgaaaaatcccactgtagacggcataatgacaatcgacttagaccccgttatatatgactcaaagtttgaaaagcagctaggacaggtaatgcttctcgtgttatgtgcggtacaactattattaatgcgcacaagttgggcactatgtgaggcattaacattagctaccggacctataactactttgtgggaaggctccccaggtaaattttggaatacaactatcgcagtatcgatggctaatattttccgagggagctatctcgctggtgccggattagctttcagcattatgaagtccgtaggtacaggcaggagaggaacaggatctcagggagaaacactaggagagaaatggaagaagaaattaaaccaattaagccggaaagagttcgatctttataagaaatctgggataacagaagtagacagaacagaggctaaggaaggcctaaaaagaggggaaacaactcaccatgctgtctcaagaggctcagctaaactccaatggttcgtagaacgaaatatggtaatacctgaaggacgggttatagatttaggatgtggaagaggtggttggtcatattattgtgcaggattaaagaaagttacagaagtgagaggatacacaaaaggcggcccgggccacgaggaacctgttccaatgtctacatacggctggaacatcgtaaaactaatgtcgggaaaagacgttttctatttgcctcccgaaaagtgtgatactttactatgcgacataggagagtcctccccttcgcccactgttgaagaatcccgtactatacgagtgttaaaaatggtcgaaccatggcttaaaaacaaccagttctgcataaaagtcttaaacccatacatgccaacggttattgagcatttagagcgcctacaaagaaagtacgggggaatgttagttcggaaccccctatctagaaattccacgcatgaaatgtactggatttcgaatggcaccggtaatatagtatcaagcgtcaacatggtttcaaggttacttttaaaccgttttaccatgacccaccggaggcccacgatcgaaaaagatgttgacctgggtgccggcacgagacacgtaaatgccgaacctgagacaccgaatatggacgtgataggagaacgtattaaacgaattaaagaggaacacagcagtacttggcactacgacgatgaaaatccatataaaacttgggcatatcatggatcgtatgaagttaaagcaacaggatcagcaagttcaatgatcaatggtgtagttaagttgttaactaaaccatgggatgtagttccaatggtaacacaaatggcgatgaccgatacgacaccctttggacaacaaagagtgttcaaagaaaaagtagatacacgaacaccaaggcctatgcctggaacaagaaaagtgatggaaataaccgcagaatggctttggcgaacactaggcaggaataagaaacccaggctctgcacgcgagaagaatttacaaagaaagtaaggacaaatgctgctatgggtgcagttttcacagaagaaaatcagtgggactcagcacgagcagcagtggaggatgaagaattttggaaacttgtagacagagaaagagaactacacaaactcgggaaatgcggcagttgtgtatacaatatgatgggaaaaagggagaagaaactgggagaatttggaaaagcaaaaggaagtagagccatctggtatatgtggttaggagcacgttacttagaatttgaggctttaggattcctgaacgaagaccattggttttcacgcgaaaattcatacagtggggtcgagggggagggactccataaactaggatacattctgcgcgatatttcaaaaattccgggtggtgcaatgtatgctgacgatacagcgggatgggatactcgcataacagaagatgatctacataatgaagagaaaatcacacaacagatggatcctgaacataaacaactcgcgaacgctatttttaaacttacttaccagaacaaagtagtaaaggttcaaagacctacacccaaggggaccgtaatggacattatctctcgtaaagatcagagaggctccgggcaagttgggacatatggacttaatacatttacaaacatggaggctcagcttgttcgacagatggaaggggaaggagttctaagtaaagccgatctagaaaatccacaccttttagagaagaaaataactcaatggctggaaacaaaaggagttgagaggttaaaacgaatggctatatccggagacgactgcgtagttaaaccaatagatgatagatttgctaacgctttacttgctctgaatgatatgggcaaggttcgaaaagacattcctcaatggcaaccttccaagggatggcatgactggcaacaagttccattctgctcccaccactttcatgaattgatcatgaaggatgggagaaagttggttgtcccatgtagaccacaagatgaactaataggtcgagcacgaatatcacaaggggcaggatggtcattaaaagagactgcctgtttagggaaagcgtatgctcaaatgtggtcactaatgtactttcatcgcagggatttacgtcttgcttccaacgctatttgcagcgcagtacctgtacactgggtgcctacatcacgaacaacgtggtctatacacgcacaccatcagtggatgacaactgaggacatgttaacagtatggaatcgagtatggatagaagacaatccttggatggaagataaaacgccagtcacaacatgggaggacgtaccctatctaggaaaaagggaagatcaatggtgcgggtcattaataggccttacaagccgcgctacatgggcacaaaacatactgacagcgatacagcaagtcaggtcgctaattggagacgaggaatttttagactatatgccaagtatgaaacgatttagaaaagaagaggaatccgaaggtgctatttggtaa

SEQ ID NO: 23010 - RNA, 9873 nt, synthetic construct
  misc_feature 1..9873: note = derived and/or modified CDS sequence (opt6) from DENV-3__KT726340__SS-prME
  source 1..9873: mol_type = other RNA
actagcttatgcctgatgatgatactaccagcggctctcgcattccatttaacgtcgcgagacggggaaccgcgaatgatcgtcggcaaaaatgaacgtggaaaatcgctattatttaaaacagccagtggaataaatatgtgtactttaatcgcaatggacttgggagaaatgtgtgacgatacagtgacatataaatgtccccatataactgaagttgaaccagaagatattgactgctggtgcaatctcacaagtacgtgggttacttatgggacttgcaatcaagctggtgaacatagaagggataaacgtagcgtggcattagcaccacacgtaggaatgggactagatactagaacgcagacgtggatgagcgcagaaggtgcttggcgacaagttgaaaaagtagaaacatgggcactcaggcatcccggatttacaatactcgcactatttctagcacactatataggaaccagtctcacgcagaaagtagtaatctttattttgctcatgttagtcacacccagtatgaccatgcgttgtgtaggggtgggcaatagagactttgtcgaaggactcagcggcgcaacatgggtagatgtggtgctagaacacggcggatgtgttaccacaatggcgaaaaacaaaccaaccttagatatagaattacagaaaactgaagcaacccaactagcaactttaaggaaattgtgtattgaaggcaaaataacaaacataacaactgattcaagatgcccaacacaaggtgaagcggtgctgcccgaagaacaagatcagaattacgtatgtaaacatacatatgtggatcgaggttggggaaacggttgcggactttttggtaaaggtagtctcgtaacgtgtgcgaaatttcaatgtttggaacccatagaaggaaaagtagtacaatatgaaaatctaaaatacacagtgattatcactgttcacaccggagaccaacaccaggttggaaatgaaactcaaggagttacagctgaaattacgcctcaagcaagcacgacagaagccattctacccgaatatggcacactgggacttgaatgtagtccgagaactggcctagatttcaatgaaatgatattattaacaatgaaaaacaaagcatggatggtacatcgacaatggttctttgatttacctctcccttggacaagtggagcaactacagaaacgccaacatggaatcggaaagaactgctagtaacatttaaaaatgcacatgctaagaaacaagaggtagtagtgctaggatcacaagaaggagccatgcacacggctttgaccggtgctacagaaatccaaaatagtggagggacaagtatctttgctggacatctcaaatgccgactaaaaatggacaaactagaactaaaaggaatgtcttatgccatgtgtaccaatacatttgtgctgaagaaagaagtgtctgaaacgcaacatggtacaatcctgataaaagtagaatataaaggagaagacgtgccttgcaaaatcccattttcaaccgaggacggtcaaggtaaagctcacaacgggcgtttaattactgcaaacccggtagtaactaagaaagaagaaccggtaaacatagaagcagagccaccatttggggagtctaatatagtaatcggtataggggataatgcacttaaaataaactggtacaagaaagggtcatcgataggcaaaatgttcgaggccacggcaaggggcgcaagacgtatggcaattttaggagatacggcatgggacttcggcagcgttggaggcgtattaaacagtctaggaaaaatggtacaccaaatatttggttctgcatatacagctctatttagcggcgtatcctgggtaatgaaaatcggaattggggttcttttaacctggatcggacttaacagtaaaaatacgagcatgagtttctcttgtatcgcaattgggattattacactttacttaggagcagtagtacaggccgatatgggatgcgtaataaactggaaaggtaaagaattaaaatgtggctcaggaatattcgtaacaaacgaagtacacacatggacggaacagtataaatttcaagcagatagcccaaaacgccttgctacagctatagccggtgcatgggaaaacggggtctgcggcattcgaagcactacaagaatggaaaatttactctggaaacaaattgccaacgaattaaattatatactatgggaaaataacataaaattaacggttgtcgtaggagacatcataggcgttttagaacaaggaaaacggacgctcacgccacaacccatggagttaaaatattcgtggaaaacctggggtaaagcaaaaatcgttacagctgaaacgcagaactcaagtttcattattgatggacctaacaccccggagtgcccctcagcaagtcgggcttggaatgtatgggaagtagaggattacggatttggcgtatttactacaaacatctggctaaaattacgagaagtgtacacccagctctgtgaccaccgattaatgtcggctgcagtaaaagatgaacgagctgtacacgcagacatgggttattggatagaaagtcagaaaaacggatcttggaaattagaaaaggcttccctcattgaagtcaaaacgtgcacttggccaaaatcacatacactgtggagtaatggcgtcctagaatcggatatgattatacctaaaagtctcgctggcccaatatcgcaacataactacaggccaggataccatacacaaacggcaggaccatggcatctgggtaaattagaacttgattttaattattgcgaaggaacgacagtagtaattacggaaaactgtgggactagagggccatcacttaggacaacgacagtctcaggaaaattaattcatgagtggtgctgccgcagttgtacccttcccccgcttcgatatatgggtgaagatgggtgctggtacggaatggaaattcgacctatttcggagaaggaggagaacatggttaaatcacttgtttcagcagggtctggagaggttgataatttcaccatgggggtactatgtctcgcaattctgtttgaagaggtgatgcgaggaaagtttggaaagaaacatatgattgcaggcgttttcttcacatttgtattacttctcagcggccaaataacatggcgagatatggcgcacacattgataatgatagggtcaaatgcaagcgaccgaatgggaatgggagtaacatacttagcgctcatagcaacgtttaaaattcaaccatttttggcgttagggtttttcctcaggaaacttacatcccgtgaaaacctattacttggggtcggattagcaatggcgacgaccctacaattacccgaggacatagaacaaatggcaaacggtatcgcattagggctaatggcgttaaaactaatcactcaatttgaaacatatcaactctggaccgctttaatatcactgacttgttctaacacaatattcaccctaaccgtagcttggcgaacggcaactttaatattagcgggtgtgtccctactacccgtatgtcaaagtagttctatgaggaaaacagactggttgcctatgaccgttgcagcgatgggtgtaccccctttaccactatttatattttcattaaaagacaccttaaagcgtaggagttggccacttaatgaaggtgtaatggctgttggtctagtcagcattctcgcaagctcactattaagaaacgatgtgccaatggcagggcctctagtagcaggcggcttactaatagcttgttatgtcataacaggaacttccgccgatctcactgtagaaaaggcagctgacgtaacatgggaagaagaggcagagcaaactggtgtttctcataatctcatgataacagtagacgatgatggaactatgcgaataaaagacgacgagacagaaaacattctaactgtactactaaaaacagctctcttgatcgtcagtggaattttcccttactcaataccggccaccttactcgtatggcacacttggcaaaagcaaacgcaacgctctggcgttctctgggatgtaccaagtccgcctgagacacagaaggctgaacttgaagaaggcgtttatcgtattaaacaacagggtattttcggaaaaacacaagttggggttggcgtccaaaaagaaggagtatttcatacaatgtggcatgttacgcgaggtgctgtcttgacatacaatggtaaacgactggaacctaactgggcgagcgttaagaaagacctaatatcatacgggggaggatggaggttatcagcccagtggcagaaaggagaggaagtgcaagttattgcggtagaaccgggtaagaaccctaaaaactttcaaacaatgcctggcaccttccaaacaacaacgggtgaaattggagccatagccctagattttaaaccaggtacaagtggaagtcctataataaatcgagaagggaaagttgtgggactgtatggtaatggcgtaatcacaaagaatggaggatacgttagcgggattgcccaaacaaacgcagaaccagatggacctacaccagaactagaagaagaaatgtttaaaaagagaaacctcacaatcatggatttacatcctgggagcggaaagacacgaaaatacttacctgctattgtaagggaagcaataaaacggcggctaagaacccttatattggcccctacaagggtagtagctgctgaaatggaagaagcattaaaaggcctaccgattaggtatcaaactacagcaactaagagcgaacataccggtcgggaaatcgtcgacctcatgtgccatgccacgttcacaatgagacttctaagtcctgtaagagttccaaattataatctaattatcatggatgaagcacattttacagatcccgcttcaatcgcggctcggggatatatatcgacccgtgtgggaatgggcgaagcagcggcaattttcatgacggcaaccccaccaggcaccgccgacgcgttcccgcaaagcaacgccccaattcaggatgaggaacgagacataccggagagaagttggaactctggcaatgaatggataaccgacttcgccggcaaaactgtgtggtttgtgccatccattaaagccggcaatgatatagctaactgtttaaggaagaatgggaagaaagtaatccagttaagcaggaagacatttgatacagagtaccagaaaactaaacttaatgactgggatttcgtagttactacggatattagcgagatgggcgccaattttaaagcagatagagtgatcgatcctcgaaggtgcttaaaaccagtaattcttacagatggtcctgagcgcgtaattctagcgggacctatgccagttacagcagcatcagcagctcaacgaagaggtcgggtaggacgcaacccacaaaaggaaaacgaccagtatatattcacaggtcaaccacttaataatgacgaagaccacgctcattggacggaagcaaaaatgcttcttgacaatattaatacgccagaaggtataatacctgccttattcgaaccagaacgggaaaaatcggctgcaattgacggagaatatcgtttaaaaggagaatctagaaaaacctttgtagagctaatgcggagaggcgatcttccggtatggcttgcacacaaagttgcaagtgagggaatcaaatatacagatagaaaatggtgctttgatggacaaagaaataatcagatactagaagagaacatggatgttgaaatatggacaaaagaaggagagaagaagaaactaagaccccgatggttagatgctaggacatacagtgatccgttagctttgaaggaatttaaagacttcgcagctggtcgaaaaagcattgcacttgacttagttacagaaattggtagagtaccgtctcatctagcccataggacaaggaacgcacttgacaatctagtaatgctccatacttcagagcacggcgggaaagcctatagacatgcggttgaagaattaccagaaaccatggaaacattgttgctactggggcttatgatattgcttaccggtggggcaatgctattcttaataagcggaaaagggataggtaaaacaagtatcggactcatctgtgtaatagcgtcttcaggtatgttatggatggcagaaattccattacagtggattgctagcgcaatcgttctggaatttttcatgatggtacttttaataccagaacctgaaaagcaacgaacgcctcaagataaccagctagcatatgtagtcattggaatcctcactctcgcagcaataatagcggcgaatgaaatgggtctgctagaaacgaccaaaagagaccttgggatgtctaaggaaccgggcgttgtttccccaacttcatacctagatgtagacctccaccccgctagcgcttggacactttatgcagttgcaacaacagtaattactccaatgttgcgacatacaattgaaaattcgacagcaaatgtaagtctagccgcgattgctaaccaagctgttgtattaatgggtttagataaaggatggcccatatctaaaatggatctaggagtaccactgcttgctctaggatgttactcacaagtaaatccattgacacttactgcagccgtcttactgttaataactcattatgccatcattggtccgggactacaagcaaaggccacgcgagaagctcagaaacggaccgcagcaggaataatgaagaacccaaccgtcgatggaatcatgacaatagatctcgacccagtcatatacgactccaaatttgaaaagcagctaggtcaagtaatgttattagtgttatgtgcggtccaactacttctaatgagaacatcttgggcgttatgtgaggctcttacactagcaactggacctataactacattgtgggaaggtagcccaggcaagttttggaatactacaatagccgtttctatggcgaatatatttagaggaagttatttagctggagctggtctcgcgttctctattatgaaatctgtaggtacagggaaacggggtacgggatcacaaggagaaactttaggtgaaaagtggaagaagaaactcaaccaattatcacgaaaagagttcgacctttataagaaatctgggatcactgaggttgatagaacagaagcaaaagaaggactaaaaaggggcgaaataacccaccacgccgtatcaagaggctccgcgaaacttcaatggtttgtggaaagaaacatggtaattcctgagggtagagtaattgacctcggctgcgggcgaggcggatggtcatattattgtgcgggactcaaaaaggtcacagaagtaagaggatatacaaaaggtggccctggacatgaagaaccagttcctatgtcgacatatggttggaatattgtaaaattgatgagcggaaaggatgtattttatctcccacccgaaaaatgcgacacgctactgtgtgatataggcgaatcaagtccatctccaacggtagaggaatcgagaactattagagtcttaaaaatggttgaaccttggctcaaaaataatcaattctgtataaaagtactaaacccatacatgcccacggtagtcgaacatctagagagattgcagcgtaaacatggcgggatgttggttcgtaatccacttagcagaaatagtacacatgagatgtactggatctccaatggaaccggaaatatagtagcatcagtaaacatggttagtcgcttacttttaaatcgcttcacaatgacacacagaaggccaacaatagaaaaggatgttgacttaggtgcagggacgcgtcatgtcaacgccgaacctgaaacgcccaacatggacgtgataggtgaacgtatcaaaagaataaaagaagaacataacagcacatggcactatgacgatgaaaacccatacaaaacctgggcctaccatggatcatacgaagtcaaggcgacaggttcagcctcatccatgatcaatggtgtcgtaaaactacttactaagccgtgggacgtagtacccatggtaacacagatggctatgacggatacaacgccgtttgggcagcaaagagtgtttaaagaaaaagtcgatacacgaacccccaggtctatgccaggaacaaggcgtgtgatgggcataactgcagaatggctctggaggacccttggacgaaataaaaagcccagactgtgcaccagggaagagttcacgaagaaagtgcggacaaatgcggcgatgggcgcagttttcaccgaagaaaatcagtgggatagtgccaaggcagcagtggaagatgaggatttttggaagttggtcgaccgtgaaagggaattacataaattaggaaaatgcggaagttgcgtctacaatatgatgggaaaacgggaaaagaaactgggtgaatttggtaaagccaaaggaagcagagctatctggtatatgtggcttggtgcacgctatttagagttcgaagcacttggattcttaaacgaagatcactggttttcgcgtgaaaacagttacagtggagtagaaggcgaaggattacataaattagggtatatattacgagacattagtaagatacctggcggagccatgtatgcggacgacacagcaggctgggatactcgtataaccgaagacgacctacacaacgaagagaaaattacacaacaaatggaccctgaacataggcaattggctaatgctatttttaagctgacttatcaaaacaaagtcgtaaaagtgcaacgaccaaccccaacagggacagtcatggacataatttcaagaaaagatcagcgaggttctggacaagtcggaacttatggactaaatacttttactaatatggaggcccaattaatccgacagatggaaggagaaggtgtactttcgaaagctgatttagaaaacccgcgactaccggagaagaaaatcacccagtggctcgagacgaagggagttgaacgacttaaacgaatggccataagcggcgatgattgcgttgtaaaaccaatcgacgaccgttttgccaacgctttgcttgcacttaacgacatgggtaaagtacgaaaagacataccgcaatggcagcctagcaaagggtggcacgattggcaacaagtacctttttgttcccatcacttccatgaattaataatgaaagatggtcgaaagttagtcgtcccttgtcgcccccaggatgagttaataggcagagccagaatatcacaaggggcaggttggtccctaagggaaacagcatgtttgggaaaggcttatgcacaaatgtggagcctgatgtactttcatagaagagatctaagattggcatcgaacgcaatttgcagcgcagtcccggtgcattgggtcccaacaagtcgcacaacgtggtcaatacacgcacaccatcaatggatgacaacagaagatatgttaacagtatggaatagagtttggatagaagataatccttggatggaagacaagacacccataacaacgtgggaaaatgtaccctatctaggcaaacgtgaagaccaatggtgcgggtcactcataggacttacttcaagagccacgtgggctcaaaacataccaacagctattcagcaagtcaggtcattaataggtaacgaagagtttcttgattacatgcctagtatgaagagatttcggaaagaagaagaatcagaaggtgcaatatggtag

SEQ ID NO: 23011 - RNA, 9873 nt, synthetic construct
  misc_feature 1..9873: note = derived and/or modified CDS sequence (opt6) from DENV-3__KT726345__SS-prME
  source 1..9873: mol_type = other RNA
acgagcctctgtttaatgatgatattacctgcagcattagcatttcatttaacatcgagggatggagaaccgcggatgatagttggtaaaaacgaaagaggaaaaagtctactttttaaaacggcctctggaatcaacatgtgcaccctaatagctatggatttaggggaaatgtgcgacgatacagtaacttataaatgtcctcatataaccgaagtcgaaccagaagacatagactgttggtgcaatttaacatctacatgggtgacctacggaacttgcaaccaagcaggggagcatcgtagggacaaaagatcagtagctctagcacctcatgtagggatgggtctggatacaagaacacaaacatggatgagcgctgaaggggcttggaggcaagtggaaaaagttgaaacatgggcattacgccaccctggatttactattttagcgttattcctagcccattacataggaacatctctaactcaaaaagtcgttatctttatcctcctgatgttagtaacgccttcaatgacaatgaggtgtgtaggtgtaggtaaccgcgattttgttgaaggactgtcgggcgctacttgggtagatgtagtccttgagcatggtgggtgtgtgacaacaatggccaaaaataaaccaacgcttgacatagagctgcagaaaacagaggctacacaattagccacattacgaaaactatgtatagaaggcaaaattactaatataacaaccgactcaagatgtcccacacaaggtgaagctgttttacccgaggaacaagatcaaaactacgtatgtaaacatacatatgtagacagaggttggggaaatggatgcggattatttgggaaaggctccttagttacttgtgcgaaattccaatgcttagaaccaatagaaggaaaagtagtacaatatgagaatctgaaatatactgttataataactgttcacactggtgaccaacatcaagtcggaaatgaaacgcaaggagttactgcagaaataaccccacaagcatccactaccgaggccatcctaccagaatatggtacgttgggcttggagtgctccccaagaactggattagactttaacgagatgatattattgaccatgaaaaataaagcctggatggtccacagacaatggttctttgatttaccactaccttggacatcaggagcaacaactgaaaccccaacttggaatagaaaagaactattagtaacttttaaaaatgcacatgccaagaaacaagaagtagtcgtactgggttcacaagaaggtgcgatgcacaccgcactaactggtgctacagaaatccagaactcaggcggaacgagtatctttgcaggtcacttaaaatgtagactaaaaatggataaattggaactaaaaggtatgtcatatgctatgtgtacaaataccttcgtattaaagaaagaagtcagtgaaactcaacatggcacaatactaataaaagttgagtataaaggggaggacgtaccctgtaaaattcctttctccacagaagacggacaaggaaaagcacataacggaagattaataacggcaaacccagtcgttactaagaaagaggaaccagtgaatatcgaagctgagcctccctttggcgaaagcaatatagtaataggtatcggagataatgcactaaaaataaactggtataagaaaggatcgagtatcgggaaaatgttcgaagcaacagcaagaggagccaggaggatggcaattctcggagatacagcttgggactttggttctgtcggaggtgttctaaatagcttgggaaaaatggtacatcaaattttcggaagtgcttatacggcattgttttcaggtgtctcgtgggtcatgaaaataggaataggcgtgttgttgacctggatagggttaaacagtaaaaatacaagtatgtcgtttagctgtatcgccattggcatcattacactatatttaggtgcagtagtacaagcagacatgggttgtgtaattaactggaaaggtaaagaattaaaatgtggaagcggcatttttgtaactaatgaagtccacacatggaccgagcaatacaaattccaggccgattccccaaagcgcttagctacagctatagccggagcgtgggagaatggggtctgcgggataaggtcaacgactcgtatggagaatttattatggaagcaaatagcaaatgagctaaactacattctgtgggaaaacaacatcaaactaacagtagttgtaggagatatcataggagtactcgaacaaggaaagagaactttaacaccccaacccatggagctaaaatatagttggaagacatggggtaaagccaaaatagttacagctgagacgcaaaactcgtccttcattatcgatggacctaatactcctgaatgcccaagcgcgagtagagcgtggaacgtatgggaggtggaagactacggatttggagtatttacaacaaacatttggttaaaacttagagaagtatatactcaactctgcgaccacaggcttatgagtgccgcagttaaagacgaacgtgccgtacacgcagacatgggttactggatcgaaagtcagaaaaatggcagctggaaattagaaaaggcttcccttatagaagtaaaaacatgtacttggcctaaaagtcatacgctttggagtaatggagtgcttgaaagtgatatgataatacccaaatcacttgcgggacctatttctcagcataatcatagacctggctatcacacccaaaccgcagggccctggcatctaggaaaattagaattagatttcaattactgtgaaggcactacggttgtgatcactgaaaattgcgggaccagaggtccatcgttgcgaacgacaactgtttctggtaaactgatacatgaatggtgttgccgaagctgtactttgccaccgttaagatatatgggagaagacggctgttggtacggaatggagattaggccaatttcagaaaaagaagaaaacatggtaaagtcattagttagtgcaggttcgggtaaggtagataatttcaccatgggggtgctttgcctggcgatcctatttgaagaagtaatgcgtggaaagttcggcaagaaacacatgatagcaggagtcttctttacattcgttctcttattatcagggcaaatcacctggagggacatggctcacacgctaatcatgataggtagtaacgcgagcgaccgaatgggtatgggtgtgacgtatctagcacttattgcaacatttaaaatacaaccctttctcgcacttggcttcttcttaagaaaactcacgtcgcgagagaatctgttattgggagttggtctagctatggcgacaacccttcaacttcccgaagatatagagcagatggcaaatgggatcgcattaggattaatggcattaaaactaataacccagtttgaaacgtatcagttgtggactgcgttgatatctctgacatgttcaaatacaatattcacattaacagtggcatggcgaacggcaacactaatacttgccggtgtttctttactcccagtctgtcagtcatcttctatgcgaaaaacagactggcttcctatggcagtagcagctatgggcgtacctccacttccactattcatattctcccttaaagatacactaaaacgtaggagctggccccttaatgaaggagtaatggcagtaggcttagtctcaattctagcttcttcgctacttcgaaacgatgttcctatggcaggcccgcttgtagcgggaggactattaatagcatgttatgtcataacgggtacgtcggcggatttaactgtagaaaaagcagcagacataatatgggaagaagaagcagaacaaactggagtaagccacaatttaatgataaccgtcgatgacgacggtacgatgcgtatcaaagatgacgagacagagaatatactaacagttctattgaaaactgccctactaatagtgtcaggtattttcccgtattcaatacctgcaacattacttgtgtggcacacatggcaaaaacaaacacaaagatccggtgtattatgggacgtaccctcgccacctgagacacagaaagcagagctcgaagaaggtgtatacagaataaaacaacaaggcatttttggtaaaacacaggtaggggttggagtacaaaaagaaggagtgtttcacaccatgtggcatgtcactagaggggcggtattaacacacaatggaaaacgattagaacccaattgggccagtgttaagaaagacttaattagttatggtggcggctggagactatctgctcaatggcaaaaaggagaagaagtgcaggtcatagccgttgagcccggaaagaatcctaaaaacttccaaaccatgcctgggacttttcaaacgacaacaggcgaaataggagcgatagcattagactttaagccaggtacaagtgggagtccaatcataaatagggaaggaaaagtagtcgggctatacggtaatggtgtagtaaccaaaaatgggggatacgtatctggaatagcccagactaacgctgaacctgatggaccgacgcctgaattagaagaggagatgtttaagaaacgaaacttaactattatggatctccatccggggagtggtaaaacaaggaagtatttaccggcaatagtacgagaagctataaagaggcgcttgaggacacttatattggcaccaactcgagtagtcgcagcagagatggaggaggctttaaaaggtcttcccataaggtaccagacaacagccacaaaatccgaacataccggtagagagatagtcgacctcatgtgccacgcgacttttacgatgagactattgagtcctgtaagggtccctaattataacctaatcataatggacgaggcccattttactgaccctgcctctatcgcagcaagaggttatatatcaacccgggtaggtatgggagaagcagcagcaatcttcatgaccgcaacgcccccgggcacggcagacgcatttccacaatctaatgcgcctatacaagacgaggagagagatattccagaacgtagttggaactcaggcaatgagtggataaccgatttcgcaggtaaaacagtctggttcgtgccgtctataaaagccggcaatgacatcgccaattgtctacgtaaaaacggtaagaaagttattcaactttcccgtaaaacgttcgataccgaataccagaaaaccaaactaaatgactgggacttcgtagtcaccaccgatataagcgagatgggagctaacttcaaagctgacagagtaatagacccccgtcgttgtctaaaaccagtaatacttactgacggcccagaaagggtcattctagctggaccgatgccagtaaccgcagcatcggctgctcagaggaggggacgagttggccggaatcctcaaaaagaaaatgatcaatacatttttactggacaaccgctcaacaacgatgaagaccacgcacattggactgaagcaaaaatgcttttagataatataaatactccagaaggcataataccagcactttttgaaccagagcgcgagaagagtgccgcaatagatggtgaatatcgacttaaaggggaatcacggaaaacgtttgtagaattaatgcgtcgaggcgatctacccgtttggctagcccacaaggttgcgagcgaaggaataaaatacactgatcgtaaatggtgttttgatggtcagcggaacaaccaaattctagaagaaaatatggatgtcgaaatttggactaaagaaggggagaagaagaaattaagacccagatggctcgacgccagaacatattccgacccactagcacttaaagagtttaaagactttgctgctggtagaaagtcaatagcgctagatttagtcacagagataggacgtgtaccaagccatctagcccatcggactagaaacgcacttgataatcttgttatgttacacactagcgaacacggagggagagcatatagacatgccgtagaagagttaccggaaacaatggaaacactcttgttgctaggcctgatgatattattaactggtggggcgatgctctttcttataagcggaaaagggataggcaagacatctataggtctaatttgtgtaatagcctcatcaggaatgctctggatggctgagatcccgttacaatggatagccagtgcaatcgtgttagaatttttcatgatggtactattaatacctgagccagaaaaacaacgaacgccccaagataaccaacttgcatatgtagtaataggaatactgacgctagcagcaataatagcagcaaatgaaatggggttgttagaaacaacgaaacgggatttgggaatgtcgaaggaaccgggagtagtgtcccctaccagttatctggacgttgacttacacccagcaagcgcgtggactctttacgctgttgccactacagtaataacccctatgctacgacatacgatcgagaactctaccgccaatgtctccttagcagcaattgctaatcaagcagttgtgttaatgggtctcgacaaaggatggcctatttctaaaatggatctaggagtgccactacttgctttaggatgctatagtcaggtgaatcctcttacactaaccgcagcagtattacttttaatcacacactatgctataataggtccgggactacaggctaaggcaactcgtgaagcacagaaaagaaccgctgcggggataatgaagaatccaacagtggatggaataatgaccatagacctggaccctgttatatacgattcaaaatttgaaaagcaactgggtcaagtaatgctgttagtgttatgtgctgtccaactcttgcttatgaggacttcttgggcattatgtgaagcacttaccttggccactggtccgattacaacgttgtgggaagggagtcccggaaagttttggaatactacaatagctgtttcaatggcgaatatctttcgtggttcttacttggcgggagccggattagcattttcgattatgaaatcagttggaacagggaaaagaggtaccggatcgcaaggtgaaactttaggagaaaaatggaagaagaaattgaaccaactatctcgtaaagaatttgatctatacaagaaatcaggaattactgaggtggaccgaaccgaagctaaagaaggacttaagagaggagagattacacaccatgctgtgtctagaggaagcgcgaaactgcaatggttcgttgaacggaacatggtaattcctgaaggaagagttatcgatctaggatgcggtagaggagggtggagttattattgcgcgggactaaagaaagttacggaagtgcgaggctacaccaaaggaggacctgggcacgaagaacctgtacctatgtctacctacggttggaacatcgttaaattgatgtcaggcaaggatgtgttctatttaccaccagaaaagtgcgacacattgctatgtgacataggagaatctagtccaagtccaactgttgaagagagccgaacaattagggttttaaaaatggtcgaaccttggctcaaaaacaaccagttctgcattaaagtattgaacccatatatgcctacggtcatagaacatttggaacgtttgcaacgaaagcacggagggatgctggtgagaaatcctctatctagaaatagcacccatgaaatgtactggatttcgaacggaacaggaaatatagtcgctagtgttaatatggtatcaagattgcttctaaatagatttacaatgactcataggaggccaaccatcgaaaaagatgttgatttgggagctggaacacgtcatgtgaatgcggagcccgaaactcccaatatggatgttattggcgaaagaatcaaaagaataaaagaggaacacaactcaacttggcattacgatgatgagaatccctataagacttgggcatatcatggctcgtatgaagtgaaagcaacgggctcggcatcaagtatgattaacggagtggtcaaactactaaccaaaccatgggacgttgttccaatggtaacacaaatggctatgacggacacaaccccattcgggcaacaacgagtatttaaagaaaaagtcgatactagaacaccgcggtcaatgccagggacacgacgggttatgggcataacagcagaatggctatggagaactcttggacgaaataagaaaccgaggttatgtaccagagaggaatttactaaaaaggttagaactaacgctgcaatgggagcagtctttactgaagaaaaccaatgggattctgcgaaagcagctgtggaagacgaagacttctggaagttggtagaccgtgaacgagaattgcataaattagggaagtgcggaagttgcgtatataacatgatgggaaaacgagagaagaaattaggggaatttgggaaagcgaaaggttcacgagcaatatggtatatgtggctcggcgcccgatatctcgagttcgaagcattaggatttctaaacgaagatcactggtttagcagagaaaacagttacagtggcgttgaaggagaaggcttgcataaattaggatacatcctcagagatataagcaaaataccaggaggcgctatgtatgcagatgataccgctggctgggatacaagaattactgaggacgatttacataatgaagagaaaatcacccagcaaatggatccagagcatcggcaattagcaaatgccatatttaagttaacatatcagaataaagttgtgaaggtccaacggcccacaccaactggaacagtcatggatattataagtagaaaagatcaacgaggatcaggacaagtaggaacttacggcctcaatacctttactaatatggaggcgcagttaatacgtcagatggagggtgaaggcgtattgtccaaagctgatttagaaaacccccacttgcctgagaagaaaataacacaatggctagaaactaagggagttgagagattaaagagaatggcaatatcgggagatgattgcgttgtgaaacctattgacgataggtttgccaatgcattactcgctttaaacgatatgggaaaagtcagaaaagacatcccgcagtggcaaccatctaagggttggcatgactggcaacaggtaccattttgcagccatcattttcatgaactaataatgaaagacggacgtaagttggtagtgccctgtaggccgcaagatgagctaataggtcgtgctagaatttctcaaggtgctgggtggagtctacgggagacagcgtgtcttggaaaagcctatgcacagatgtggtcattaatgtactttcataggcgagatttaagactagcaagcaacgcgatatgctcggctgtacccgtgcattgggtaccaacttcgagaacaacatggtcaattcatgctcatcatcaatggatgactacggaagatatgctaaccgtatggaatcgagtttggattgaagataatccgtggatggaagataagacgcctgtaacaacatgggaaaacgtgccctatcttggaaagcgggaagatcaatggtgtggatcactgataggtcttacatcacgtgcgacgtgggcacagaacattccaacagcaatacaacaagtcagaagtttgataggaaacgaagagttcttagattatatgccatcaatgaaaaggttcagaaaggaggaagagtcagagggagctatatggtaa

SEQ ID NO: 23012 - RNA, 9873 nt, synthetic construct
  misc_feature 1..9873: note = derived and/or modified CDS sequence (opt6) from DENV-3__KT726349__SS-prME
  source 1..9873: mol_type = other RNA
accagcttatgtttaatgatgatcttacccgcagctctagctttccacctaaccagtagagacggagaaccgagaatgatagttggcaaaaacgaacgtgggaaatcacttctgttcaaaaccgcaagtggaataaatatgtgcactctgatagccatggatcttggagaaatgtgtgatgatacggttacatataaatgtcctcacatcactgaagtagaacccgaagacatcgactgctggtgcaatctgacgagcacttgggtaacatatggtacatgtaatcaagcgggagaacatagacgcgataaacgcagcgtagctttagcgcctcacgtcggaatgggccttgacacaaggacccaaacatggatgagtgcagaaggagcgtggagacaggtagaaaaagtagaaacgtgggcattgcgacaccccggttttacaattttagcgcttttcttagcacactacatcggtactagcttgacacagaaagtcgtaatttttatactacttatgcttgtaacaccatccatgacaatgcgatgtgtaggcgtaggtaatcgtgattttgttgaaggtttatcaggtgcaacttgggtagacgttgtactagagcatggtggatgcgtaactacgatggccaaaaacaaacctacactcgacatcgagctacagaaaactgaagctacacaattagcaacccttcgaaaactatgtatagaaggcaaaataactaacataacaacagattccaggtgtcccacgcaaggagaagcagttttaccagaagaacaagatcaaaattatgtctgcaaacatacatacgtagatcgtggatggggcaacggctgcggtttatttggaaaagggtcacttgtaacctgcgcgaaattccaatgcttagagccgatcgaaggaaaagtagtccaatacgagaaccttaaatataccgttataataacagttcacaccggagatcagcaccaggtgggtaacgaaacacaaggtgtaactgcagagataactccgcaagcatctaccactgaagctatattgccagagtacggtactttaggattagaatgttctccacggactggattggatttcaacgaaatgatcttgttgaccatgaaaaataaagcctggatggtacatagacagtggttctttgatctacccctaccatggacaagcggtgccacaacggagacacccacttggaatcggaaagaactcttagtgactttcaaaaatgcacacgcgaagaaacaggaggtcgtcgtgttgggcagtcaagaaggagcaatgcatactgcccttacgggagctactgagatccaaaactcaggaggtacaagtatttttgcaggacatttaaaatgcagactaaagatggacaaattagagcttaaaggaatgtcatatgccatgtgtacaaatacatttgtgctgaagaaggaagtctcagaaactcagcatggaactatactgataaaagtggaatacaagggtgaagatgtaccgtgtaagatacccttttcgaccgaagatggacaaggaaaagctcataacggtcgtttaataactgcgaacccagtagtaactaagaaagaagaacctgttaatatagaagcagagccgccgtttggcgaaagcaacatagtgatcgggataggcgacaatgctttaaagataaattggtacaagaaaggatcgtcaatcgggaaaatgtttgaagctacagcaagaggggcaagacggatggcaatcttaggagacacagcatgggattttgggtcggtaggaggagtattaaattcactcggaaaaatggtccatcagatctttgggtctgcatatactgcattattttcgggtgttagctgggttatgaaaataggcattggagtgctcttaacatggatcggactaaattcgaaaaatacctcaatgagcttttcatgtatagctatcggtataataacgctttaccttggcgccgtcgtgcaagcagacatggggtgtgttataaattggaaagggaaagaattgaagtgcggtagcggtatattcgtaacgaatgaagttcatacatggacagaacaatataaatttcaagccgatagtccaaaaagattggctaccgcgatcgctggggcatgggaaaatggcgtttgcggaatacgaagtacgacacgtatggagaatttgctatggaagcaaattgccaacgaactaaattatatactttgggagaataacattaaactcacggtagtggtaggggatataataggagtcctcgaacaaggaaaaaggactctaacaccccaaccaatggaacttaagtacagttggaaaacatggggaaaagcgaagatagttacagcagaaacccagaatagtagtttcataatagatggacctaatacaccagaatgcccctcagcttcaagagcttggaatgtctgggaagttgaggactatggatttggagtatttactacgaatatatggctaaagttacgtgaagtctatacacaactgtgcgatcaccgtcttatgtcagctgctgttaaagatgaacgagcagtccatgcggatatggggtattggatagagagtcagaaaaatggatcctggaaactcgaaaaggcatcattaatcgaagtaaaaacatgcacttggccgaaatcgcataccctatggtcaaatggtgttttagaatctgatatgataataccaaaatcgttggcggggcccataagccaacacaatcatcgaccgggataccatacccaaacagctgggccatggcatctcggcaaattagagctggattttaactattgcgaaggaacaaccgtagttatcaccgagaattgcggcacaagggggcctagtctacgcactacaaccgtaagcggtaaactaatacacgaatggtgctgtagatcatgtacactaccaccattaagatacatgggcgaagatggatgttggtatggaatggaaattcgacctataagcgagaaggaagagaatatggtgaaaagtcttgtttcggcgggatcaggaaaagttgacaatttcacaatgggtgtactttgccttgcaattttatttgaagaagttatgcggggaaagttcggaaagaaacatatgatagcaggcgtatttttcacatttgtactattactttcagggcaaatcacctggcgagacatggcacataccctgataatgattggatctaacgcttctgaccgaatgggaatgggtgtaacttatctagcactgatcgcgacctttaaaatacaaccctttcttgcattaggattcttcctacggaaactaaccagccgtgaaaatctcttattgggtgttggacttgcaatggcaaccactttacaattaccagaagacatagaacaaatggcaaatgggatagcactagggttaatggctttaaaactaatcacacaattcgaaacataccaattgtggactgctcttatatccctaacatgctctaacactatttttacactaacggtagcatggagaactgcgacactaatccttgcaggagttagtttgctacccgtgtgccaatcttcctcaatgcgaaaaacagactggctacctatggcagttgccgcaatgggagttccgcccttacccctctttatcttttcactgaaagatactttgaaaaggcgaagctggcctctcaacgaaggggtaatggctgttggcctcgtatcgattctagcatcttcccttctacgcaacgacgtccctatggctggacctctagtggctggaggactcttaattgcctgttacgtcataactggtacaagtgcagatctcacagtagaaaaagcggcggatataacatgggaagaggaagcagagcaaacgggggttagtcataatctaatgataacagtggacgatgatggcaccatgagaataaaagatgacgaaacggaatccatacttactgtacttttgaaaacagccttactaatcgttagtggcatatttccttatagtattccggcgactctattagtatggcatacatggcaaaaacaaactcaaaggtctggggttctttgggatgttccgagtcccccagaaacacaaaaagctgagctagaagaaggggtatatagaattaaacaacaggggatttttggtaagacacaagtcggagtgggcgttcaaaaagaaggagtatttcatacaatgtggcacgtgaccagaggggcagtacttacacataatggcaaacggctagaacctaattgggcttcagtcaagaaagacctcatatcgtacggaggtggctggcgattatcggctcaatggcaaaaaggcgaagaagtacaagtaattgctgttgaaccgggcaaaaatcccaaaaactttcaaacgatgccggggacgtttcaaactacaacgggtgaaattggggcaattgcactagattttaaaccgggaacatctggatccccgatcataaatagggaaggtaaagttgttggtctgtatggcaatggtgtcgtgactaaaaacggaggctatgtatctggaattgcgcaaacgaatgctgagcctgatggacccactccagagctagaagaagagatgtttaagaaacgaaatctcacgattatggaccttcaccctgggagcgggaaaacaagaaagtacttaccagctatagtgcgagaagcgataaagagaagactcagaacattaatcctagcaccaacacgggtcgtggcagcagaaatggaagaggccctaaaaggattaccgataaggtatcaaaccacggctacaaagtcagaacacacaggcagagaaatagtggatttgatgtgtcacgccacatttaccatgcgactactctcacccgttagagtacccaactacaatttaatcataatggatgaagcccactttactgatccagccagtatcgcagctcgaggatatatcagcacgcgagttggtatgggagaagcagcagcaatatttatgacagcaacgcctccaggaacagccgacgcctttcctcaatcaaatgctcccatacaggatgaggaacgtgacataccagaaaggagttggaactcaggaaacgaatggataacagatttcgcaggtaaaacggtctggtttgttccttcaatcaaagcaggtaacgacattgctaactgtttgaggaaaaatggtaagaaggttatacaattaagcaggaagacattcgatacagaatatcagaaaacgaaacttaatgattgggattttgtagtcacgaccgacatttcagaaatgggagctaattttaaagctgatagagtgatagatccgaggagatgtctaaaaccagtaatacttactgatggcccagaacgcgttatattagcgggtccaatgcccgtaactgcagcttcagcggcgcaacgacgagggagagtcgggcgaaatccacaaaaagaaaatgatcaatacattttcacagggcagccactcaacaacgacgaagatcacgcgcactggacggaagcgaaaatgttactagacaatataaatacaccagagggaataataccggcgttatttgaacctgaacgagagaaaagtgcagcgatagatggtgaatacagattgaaaggcgagagtcgaaaaacttttgtcgaattgatgcgacgaggggacctgcccgtatggcttgcccacaaggtggcatcggagggtataaaatatactgatagaaaatggtgttttgatggtcagcgaaataaccaaatactcgaagagaatatggacgtagaaatatggacaaaagaaggggagaaaaagaaattgcggccgagatggctagacgcaagaacgtattcggatccattggctttaaaagaatttaaagactttgctgcaggtcgaaaaagtatagccttggacctcgtaacagaaattggacgagtaccaagtcatcttgcgcatagaacaagaaatgcccttgataacctagtaatgttacatacaagtgaacatggaggcagggcataccgccatgctgtagaggagttacctgagaccatggagacactcttacttcttggactcatgattctgttaaccggtggagctatgctgttcttgatatcagggaaaggcataggaaaaactagcataggacttatatgcgtaattgctagttcagggatgttatggatggcggaaataccccttcaatggatcgcaagcgcaattgtgctcgaatttttcatgatggtgctcctgattcctgaacccgaaaagcaaagaacccctcaagacaaccaactagcttatgttgtaataggaatactaactttagctgctataatagcagccaatgaaatgggattactagaaactacaaaacgcgatcttggtatgtcgaaggagccaggtgtagtctcacctacaagttacttagacgttgaccttcacccggcttcagcatggacattgtacgctgtcgcaactacagtaattacccctatgctaagacatacaattgaaaatagcacagctaacgtttctttggcagcaattgccaaccaggcggtagtactcatgggactagataaaggatggccgatatccaagatggatttaggagtgccattacttgcactaggctgttatagtcaagtaaaccctttaacactaacagcagcagtcttgttactgattacgcattacgccataataggtccgggcttacaagccaaagccaccagggaagctcagaaaagaacagcggctggaattatgaagaatcccacagtggatggaattatgacgattgaccttgatccagttatatatgatagcaaatttgagaaacaacttggacaagttatgctattagtattatgtgcagtccaactactactaatgcgcacatcatgggcattatgtgaagctctcacattagcgaccgggccgataacaacgctatgggaaggaagcccaggaaaattctggaatactaccattgcagtcagtatggccaacatatttcggggttcatacttggctggcgccgggttagcattctctattatgaaaagcgttgggactgggaaacgaggaacaggttcacaaggagagacccttggagaaaagtggaagaagaaactaaaccaactttctcgtaaagaatttgacttgtacaagaaatcaggtattactgaagtagaccgcacagaagcgaaggaaggattgaagcgaggtgaaataacacaccacgcagtttcgcgaggatccgctaaattacaatggttcgtagaaagaaacatggttattccagagggaagagtaatagatttaggttgtggtagaggaggatggagttattattgtgctggtctcaagaaagtaacggaggtgagaggatacactaagggagggccgggacatgaggaaccagtacccatgtcaacatacggctggaacatagtcaagttaatgtcaggtaaagatgtcttttatctaccgccagaaaaatgtgacactctcctatgtgacatcggggaatccagcccatcaccaacagtggaagaaagtaggacaataagggtattaaaaatggtcgaaccttggctgaaaaataatcaattctgtattaaagtgttaaatccctatatgccaacagtaatagagcatctggaacggttacagaggaaacatggcgggatgctagtcagaaatccactttccagaaatagtacccatgaaatgtattggatttctaatggtaccgggaacattgttgcatcagtcaacatggtaagtagactcttattgaataggttcacaatgacacataggagacccaccatagaaaaagatgtagacttaggcgccgggacccgacatgtaaatgctgagcccgaaacaccaaatatggatgttataggtgaacgaattaaacgcatcaaagaggaacataattcaacctggcattatgacgatgaaaatccctacaaaacttgggcgtatcacggctcgtatgaagtaaaagcaacagggtcagccagttcaatgataaacggagtagtgaaattgctaacaaaaccctgggatgtcgtccctatggtgacacaaatggcaatgaccgacacaacaccttttggtcaacaaagggtgttcaaagaaaaagtagatacccgtacaccccgaagcatgcccggcacgagacgagtaatgggcataactgcagaatggctctggaggacactcggcagaaataagaaaccgagactttgtacaagagaagagttcactaagaaagtgcgtacaaatgctgccatgggagctgtatttactgaagaaaaccaatgggacagcgcaaaggctgcagttgaggacgaagacttttggaagttagttgatcgagagagagaactccacaaattaggtaagtgcggatcatgcgtctacaacatgatgggaaaaagagagaagaaactgggagaatttggcaaagcaaaaggttcacgcgcaatctggtatatgtggcttggcgcgcgatatctagaatttgaagcgctaggctttctgaatgaggaccattggttttcaagggaaaactcatactctggagtagaaggtgaaggactgcacaaattagggtatatattaagagatatatcaaaaatccctggtggtgcaatgtatgcagacgatacagcagggtgggacacacgaattaccgaagacgacctacataacgaagagaaaatcacacagcaaatggacccagagcacagacagttagcaaacgcaatttttaaattaacataccaaaataaagtcgtaaaggtccaaagacctacacctacaggaaccgtcatggacattatatcaagaaaggatcaaaggggatcagggcaagttgggacatatggactaaatacgtttaccaatatggaggcccagttaatacgacagatggaaggagaaggtgtattaagcaaagctgatctggaaaaccctcatttacccgaaaagaaaattacacaatggcttgaaacaaaaggagttgagaggcttaaaaggatggctatatcgggtgacgactgcgttgttaaacctatcgatgacagattcgctaatgcattgttagcccttaatgacatggggaaggttcgtaaagacataccgcaatggcaaccgagcaaaggatggcatgactggcagcaagttccgttctgttcccaccatttccatgaactaattatgaaagacggaagaaagctagtagtaccgtgtcggccgcaagatgaactgatcggtcgagcacgaatttctcaaggagctggatggtcattgcgggagacagcgtgtctcggaaaagcatacgcgcaaatgtggagtttaatgtactttcaccgtagggatctccgattagcaagcaacgccatttgttcagctgtaccagtccattgggtaccaacaagccgcacaacctggtcaattcatgcacaccatcaatggatgaccacagaagacatgctaacagtctggaacagggtttggattgaagataatccatggatggaagataaaacaccagtaacaacctgggaaaatgtaccttacctcggaaaaagagaagaccaatggtgcggatcgctcattggtctaacaagtcgagcgacatgggctcaaaatatacctactgctattcaacaagtacgaagtttgatagggaacgaggaatttctcgactacatgccatcaatgaaacgttttaggaaagaagaagaatctgagggcgccatatggtga

SEQ ID NO: 23013 - RNA, 9873 nt, synthetic construct
  misc_feature 1..9873: note = derived and/or modified CDS sequence (opt6) from DENV-3__KT726347__SS-prME
  source 1..9873: mol_type = other RNA
acaagcctgtgtcttatgatgatattaccagcagcgcttgccttccacttaacttcacgcgacggtgaaccacgtatgatagtaggcaaaaatgaaagggggaaatcacttttgttcaaaacggcttcaggaataaatatgtgtacgttgatcgcaatggacctaggagaaatgtgtgatgacacagtcacatataaatgtcctcatatcactgaagtagaacctgaagatattgactgttggtgtaatttaacgagtacttgggtaacatatggaacatgtaatcaagcaggagaacacagaagggataaacgaagcgtagctttggccccacacgtgggtatgggattagacacacgaacccaaacctggatgtcagcagaaggagcgtggagacaagtagaaaaagtagaaacctgggctttaaggcatccgggattcacaatattggcattatttctagctcattacattggcacctcattgacacaaaaagtagtcatctttattcttttaatgctagtaacgccgagtatgactatgagatgcgtaggtgtcggaaacagagatttcgttgaaggtttgagtggtgcaacctgggtggatgtcgtattggaacacggaggatgtgtaacgaccatggctaaaaataaaccgacccttgacatcgagttacagaaaacggaagcaactcaactagcaaccttgagaaaactatgtatagaaggtaaaattactaatataacaacagacagtcggtgtcctacacaaggagaagctgtactgccagaagaacaagaccaaaactatgtctgcaaacacacttacgtggacaggggttggggtaatggttgcggattgtttggtaaagggtctctagtcacgtgcgccaaatttcaatgcttggaacctattgagggaaaagttgtgcaatatgaaaacttaaaatacactgtgataataacggtccataccggcgaccaacaccaagtaggaaatgaaacgcaaggagtaaccgcagaaataactcctcaagcaagcactacggaagcgatcttaccggagtatgggacgttgggactagaatgtagcccgagaacaggattagactttaatgagatgatacttttggcaatgaaaaacaaagcatggatggttcatcgacaatggtttttcgatcttcccttaccatggacatcaggagcgacgactgagactccgacttggaatagaaaagaattattagtaacattcaaaaatgcgcatgccaagaaacaagaagttgtcgtacttggaagccaagaaggtgctatgcacacagcgctgaccggagcgaccgaaatacaaaactcaggcggaacgagtattttcgcaggacatttaaaatgcagactcaaaatggacaaattggaattaaaagggatgtcatacgcaatgtgtacaaataccttcgtactcaagaaagaagtctcggaaacacaacacgggacgattcttataaaggtagaatataagggagaagacgtaccctgtaagatacccttctccacggaagatggtcagggtaaggcccataacggcagattgataactgcaaacccagttgtaaccaaaaaggaagaacctgtaaacatcgaagctgaacctcctttcggtgaaagcaatatagtaataggtattggagataacgccttgaaaataaattggtacaaaaagggtagcagcataggcaaaatgtttgaagccacagctcgtggcgcgagacgaatggccatccttggcgacaccgcatgggatttcggcagcgtaggcggtgtactaaattctctgggaaagatggtacatcaaatctttggaagcgcctacacagcacttttcagcggtgtatcttgggtgatgaagataggtattggagtcctcttgacgtggattggactaaactccaagaacacgagcatgagtttttcatgtatagctataggaattatcactttatatctgggagcagttgtgcaggccgacatgggatgtgtgattaattggaaaggaaaagagctaaagtgtggctccggtatcttcgttactaatgaagtacatacatggaccgaacaatataaattccaagccgacagccccaagcgactcgctacagcgatagcaggagcatgggagaatggagtctgtggaataaggtctactacgagaatggaaaatttactctggaaacagattgctaatgaacttaattatatattatgggagaacaacataaaattaacggtcgttgtgggagatataattggcgtgctcgagcaaggaaagcggacattaacaccccaaccaatggaacttaaatatagctggaaaacatggggtaaagcaaaaatagttacggcagaaactcaaaacagttcctttattatcgacgggcctaatacaccagagtgtccaagcgcctccagagcatggaatgtgtgggaggtagaagattacggatttggcgtttttacaacaaacatctggctcaagttacgagaggtatatactcaattatgtgatcacagacttatgagtgcagcagtaaaagatgagcgagcagtacacgcagatatgggttattggatagaatcacagaaaaacggaagttggaaactggagaaagcgtctctaatcgaggttaaaacttgtacttggccgaaatcacacacattatggtcaaatggggtcctagagtccgatatgataattccaaaatctttagcaggacctatttcgcaacataatcatcgccctgggtatcacacacaaacagcaggaccatggcatttaggtaagctagagttggatttcaattattgcgaaggtacgactgtagttataacagaaaactgtggtacgagggggccgagcctaagaacaactactgtatcaggaaaactgatacacgaatggtgttgtaggagttgtactctaccacccctaaggtacatgggagaagacgggtgttggtatggaatggagataaggccgataagtgagaaagaagaaaatatggtgaaaagcctagtgagtgccggatctgggaaagtggacaactttactatgggagtgctatgtctagcgatactttttgaagaagttatgagaggaaagtttggcaagaaacatatgatagcgggagtattctttacatttgtcttactattatccgggcagattacttggagggatatggcgcacacgctaataatgataggaagcaatgcaagcgacaggatgggaatgggtgtgacataccttgcgctaattgctacatttaagatacaacccttcttggcattaggtttctttttaagaaaactaacgtcgagagaaaacttattgcttggggtagggttagcaatggccacgactctgcaactaccagaggatatagaacaaatggcaaacggtatcgcattaggactaatggctttgaaacttataacacaatttgagacttaccaactctggaccgcactgatttcattgacctgtagcaataccatctttactcttacagtcgcttggcgtactgccactctaattttagctggagtctcattattgccagtatgccagtcgagtagtatgcgaaagacagactggttgccaatggcagtagccgcaatgggagtgccaccgttacctctttttatcttcagtttaaaagatacattaaagagacgaagttggccacttaacgaaggcgttatggcagttggtctagtatcaattcttgcgagttcgttacttcggaatgacgtccctatggccggaccattggttgccggaggccttttaatcgcttgttatgtgattacaggaacgtctgctgatctcacagtagaaaaggcagcagatattacatgggaagaagaagccgagcaaacaggagtgtcacataacctaatgattacagtagatgacgatgggacaatgagaattaaggatgatgagacagagaacattcttactgtattactaaaaacggcattgttaattgtatctggaatatttccatatagcataccggctacgttattagtatggcacacatggcaaaaacagacccaacggtcaggagttctctgggacgtacccagccctcctgaaacgcaaaaagctgaacttgaggaaggagtatatagaattaaacaacaaggcatcttcggtaaaacacaagttggggtaggggttcagaaagagggagtttttcacactatgtggcatgtaacaagaggtgccgtgttgacacataatggtaaacgtttggagcctaattgggcaagtgttaagaaagatttaattagctatggcggtggatggcgccttagcgcacaatggcaaaaaggggaggaagtgcaagtaatagcagtggaaccaggtaaaaacccaaagaacttccaaacaatgcccggaacgttccaaacaacaacgggagagataggcgcgatagctctggactttaaaccaggaacatccggatcccccattattaacagagagggcaaagtagtcggtctttacggaaatggtgtcgtgacgaaaaatggaggatacgtcagtgggatagcacaaaccaacgcagaaccagacggaccaactccagaactagaagaagaaatgttcaagaaacggaatttaactataatggatcttcatcctggatcgggaaaaactagaaaatacttgccggcaatagtacgagaagccattaaaagacgactaagaacactaattctagcacccacacgggttgtagcagccgaaatggaagaagccctgaagggattaccaatacgttaccaaacaaccgcaacaaagtctgagcacaccggtagggaaatagtagatttaatgtgccatgctacattcaccatgagattgttgtcgccggttagggtaccaaactacaatctaatcattatggatgaagcacactttacggacccggcatcaattgccgcacgtggctacataagtactagggtaggtatgggagaagcggccgcaatatttatgacagcgactcctcccggcacagccgacgctttcccacaatcgaacgctccaatccaagatgaagaaagagatatcccagaaaggagttggaacagtggcaacgagtggataacggatttcgcagggaaaacagtttggtttgtcccttctattaaggcaggaaacgatattgcaaattgcttaaggaaaaatggtaaaaaggtaatacaattaagtagaaaaacatttgacaccgaataccagaaaactaagctaaacgattgggactttgtggttacaacggatatatcagagatgggagctaactttaaggccgaccgagtaattgatccgagacgttgcctgaagccagtgatacttactgatggtcccgagagagtcatcctagcgggcccaatgccagtaacagcagcatcggcggcgcaacgacgaggtcgcgtaggccggaatccacagaaagaaaatgatcaatacatattcacaggtcagcccttaaataatgatgaagatcacgcacactggactgaagccaaaatgctattagacaatataaacacccccgaaggaatcattcccgcactgttcgagcccgagagagaaaagtcagcagcaatagatggggaatatcgtctgaaaggagagagccgaaagacttttgtggaacttatgagacggggtgatttaccggtttggttagcccacaaagttgctagtgagggaatcaagtatacggatcggaaatggtgcttcgatggtcaaagaaataaccaaattctggaagaaaatatggatgtagagatatggacgaaagagggagaaaagaagaaattaagaccacgatggctagacgcacgaacatactcggatcctctcgctcttaaggagttcaaagacttcgcggcaggaagaaaatcgattgctttggacctagtaacggagatcggacgagtgccctcacatctagcgcatagaacacggaacgctttagataatttggtaatgttacacacctccgagcacggcggccgagcatatagacacgcagttgaggaattgcccgaaacaatggaaacattattgctgctagggctaatgatacttctcactggtggagcgatgttatttctaatcagcggtaaaggtatcggcaagacgtctatagggctaatttgtgtgatagcatcaagtggaatgttatggatggccgagatacccttgcaatggatagcttcagccattgtattagaatttttcatgatggtgttgctcatacccgaacctgagaaacaaaggactccccaagacaatcaactagcttatgtcgtaatcggcatattaacactagcagcgattattgcagcgaatgaaatgggattattagagaccacaaaaagggatcttggaatgtccaaagaacctggcgttgtctcaccaacatcatatctagacgtagatttacatcctgcatcagcatggactttatatgccgtggcaactactgttataactccaatgttgcgacacacgattgagaactccacagcaaacgtatccctagcagcaattgctaatcaggcagtagtactgatgggcttggacaaaggttggccaatatcaaaaatggatctaggtgtcccactgttagcgctcggatgttattcacaagtaaatccccttacgctaacagcagcagtgcttttgctgataacccattacgcaataataggaccaggtctacaagctaaggcaacccgagaagcccagaaaagaaccgcagctggtattatgaaaaaccctacagttgatggtataatgaccatagacttagatccggtcatttacgatagcaaattcgagaaacaactgggtcaggtaatgttattagtactatgtgccgttcaacttttactcatgaggacatcttgggccttatgcgaagccttaactctagcaactggaccaatcacaacactttgggaaggctccccaggtaagttttggaatacaaccatcgctgtgagtatggctaatatatttagagggtcctacttggcaggggctggattggcattcagtattatgaaatcagtaggaaccggaaaaagggggacaggatcacaaggggaaacattaggagaaaagtggaagaagaaattgaatcagttatccagaaaagaatttgacttgtacaagaaatcgggtattacagaagttgatagaacagaggcaaaagaggggttgaagagaggtgaaatcactcatcatgcagtgtctagaggcagtgctaaacttcaatggttcgtcgaacgaaatatggtgataccggaaggtcgcgttattgatttaggctgtggcagaggaggatggagttactactgcgccggtctaaagaaagtcacggaagtacgtgggtacacgaaaggtggacccgggcatgaggagccagtgcccatgtcaacttatggttggaacattgtaaaactgatgagtggtaaagacgtattctatctaccaccagaaaaatgcgatacgcttctatgcgatataggtgagtcctctccgtcaccaacagtagaagagtcgagaacgattagagtgctaaaaatggtggaaccatggcttaaaaacaatcaattctgtattaaagtattaaacccttatatgcctactgttattgaacatctagaaagattacaacggaaacatgggggaatgttagtaagaaatcctttatcaagaaattcgacacacgaaatgtattggatatcaaatggaacggggaacatagttgcgagcgttaacatggtgtcgagattgcttttaaacagattcacaatgacacacagaagaccgactattgaaaaagatgttgatcttggggctggaacacgacacgtgaacgccgaaccggagacgcctaacatggatgttataggagaaagaataaaaagaatcaaagaagaacataactcaacgtggcactacgatgatgagaacccttataagacatgggcttatcatggctcatacgaagtaaaagccacaggatccgcttcctcaatgatcaacggtgtagttaagctattaacaaaaccgtgggatgtggtcccgatggtaacgcaaatggcgatgacagatacaaccccatttggtcaacaacgcgtctttaaggaaaaagttgataccaggactccacgtagcatgcccggcactagaagggtaatgggcataacagccgaatggctttggaggacgttaggccgaaacaagaaaccaaggctttgtacgcgtgaagagttcactaagaaagtcagaactaatgcagcgatgggcgcagtgtttactgaagaaaatcaatgggactccgcgaaagctgcagtcgaggacgaagatttttggaaattggttgacagagaaagagaattacacaaattaggcaagtgcggatcatgtgtttataatatgatgggaaagagagagaagaaattaggcgagttcggtaaggcaaaaggctcaagagctatctggtatatgtggctgggcgcgagatacttggagtttgaagcgttaggctttcttaacgaagaccactggttcagtcgtgaaaactcatattcgggcgtagaaggggagggtttacacaaactcgggtacatcttaagagatatcagcaaaatacctggtggggccatgtacgccgacgatactgccgggtgggatacccgtattacggaggatgatctacataatgaagagaaaataacccaacaaatggatccagaacacagacaattagcaaatgctatattcaaactaacgtatcagaacaaagtggttaaagttcaacgtccaacaccaacaggcactgtaatggatatcatatctagaaaggaccaaagaggctctgggcaagtaggaacgtacggcttaaacacttttactaatatggaagcacaactcataagacaaatggagggagaaggcgtcctatctaaagctgatttagagaacccgcatctaccagagaagaaaatcacacaatggcttgaaacaaaaggtgtggagcgactcaaacgaatggcaattagcggcgacgattgtgtcgtgaaacccatcgacgaccgcttcgcaaatgcacttctagcattaaatgatatgggaaaagttaggaaagatataccacagtggcaacctagcaaaggatggcatgattggcaacaagtacctttctgtagtcaccattttcatgaacttataatgaaagacggtcggaaattggtcgttccatgtagaccacaagacgaactcattggtagggctaggatttctcaaggggccggatggagtcttagagaaactgcttgtttaggaaaagcatatgctcaaatgtggtccttaatgtatttccataggcgcgatttgcgtttagcatcaaatgctatctgtagtgctgtaccggtacattgggtaccaactagccggacgacctggtccatccacgctcaccaccaatggatgacgacagaagacatgctaacagtttggaatcgtgtttggattgaagataatccctggatggaagataaaacccctgtcaccacttgggagaatgttccttatttaggtaaaagagaagatcagtggtgcggatctctgatcggtcttacgagcagagcaacctgggcacagaatatacctaccgcaattcagcaagtaaggagcctgataggtaatgaggagttcttagattatatgccgtcaatgaaacgattccggaaagaggaagagagcgagggtgctatttggtaa

SEQ ID NO: 23014 - RNA, 9873 nt, synthetic construct
  misc_feature 1..9873: note = derived and/or modified CDS sequence (opt6) from DENV-3__KT726352__SS-prME
  source 1..9873: mol_type = other RNA
acttctttatgcttgatgatgatactcccagcggcgttagcttttcacctaacaagtagagatggagaacctagaatgatagtcggcaaaaatgaaagaggaaaatcattattgtttaaaacggctagtggtattaatatgtgcacattaatcgcaatggatttaggtgaaatgtgtgatgacactgtcacttacaaatgtccacacatcacagaagtggaacctgaagatatcgactgttggtgtaacctaacaagtacttgggttacatatggtacatgtaaccaagcgggagaacacagacgagataaaagatccgttgcactagcaccccatgtaggaatgggactggacacaagaactcaaacatggatgtctgccgagggcgcatggcggcaagttgaaaaagtggaaacttgggcactgagacaccccggtttcactatattagctctcttcctagcgcactatataggaacaagtctaacgcaaaaagttgttatatttatattactaatgttagttacaccctcaatgacgatgaggtgtgtgggagtcggtaacagagatttcgtagaaggactgtctggcgctacatgggtcgacgtcgttttagagcacggaggctgcgtaacaacaatggccaaaaataaaccgacgttggacattgaactacagaaaactgaagcgactcagttagccacgcttcgtaaactttgtatcgaaggtaaaataacaaatatcacaactgatagtaggtgtcctacacagggtgaggccgtactcccagaagaacaagatcaaaactacgtttgcaaacatacttatgtggacagaggatggggtaacggatgtggactattcggaaaaggcagtctcgttacatgtgccaaatttcaatgtttagagccgattgaaggaaaagtagtacaatatgaaaacttgaagtatacagtaataattactgtccatactggggaccagcatcaagtaggtaacgaaacccaaggagttacagctgagatcacaccgcaagcgtccaccaccgaggcaatactacccgaatatggcacactagggctagagtgctccccacgaacaggtttagactttaatgaaatgatattactgacaatgaaaaacaaagcatggatggtacatagacaatggttctttgatttaccactaccctggacttcaggagcaacaacagaaacgccaacctggaatcgtaaagaattgttagtcactttcaagaacgcacatgctaaaaagcaagaagttgtagtactaggaagtcaagagggagctatgcatacagctttaacaggcgctacagaaatacagaatagcggaggtacatcaatattcgctggacatttgaaatgccgtttaaagatggacaaactagaactaaaaggaatgagctatgcgatgtgcacgaataccttcgttttaaagaaagaagtatcagaaacacagcacgggaccattttgattaaggtcgaatacaaaggcgaagacgtcccgtgcaaaataccgttttctaccgaagatggccaaggcaaagctcataatggaagacttattaccgctaatccagttgttaccaagaaagaggaaccagtgaatatagaagccgaaccgccttttggggaatcaaatattgtaattggtatcggtgacaacgcattgaaaataaactggtataagaaaggcagttcaattggtaaaatgttcgaagcgactgcaaggggagcaagaagaatggctatactcggtgatacagcatgggactttggatctgttggaggagtgttaaattcgttaggcaaaatggttcatcaaatatttgggtccgcatacacagcattgtttagcggtgtatcttgggtaatgaaaataggaataggagtattactaacctggataggtctgaactcgaaaaatacatcaatgtccttttcgtgcattgcaatcggaataatcacgctatacttaggagccgtcgtacaagcagacatgggatgcgtaataaactggaagggtaaagagctaaaatgtggatctggcatatttgtgactaacgaagtgcatacgtggactgaacaatataaatttcaagcggactctcctaagagactagcgacagccattgccggcgcatgggaaaacggcgtatgcggaatacggtccacaactcgtatggagaatttgctgtggaaacaaatagccaatgagttgaattacatattatgggaaaataatattaaactaacggttgtggtgggggatattattggagtcctcgagcaaggtaaaagaactcttacaccacaaccaatggaattaaaatattcttggaaaacatggggaaaagccaaaatagtaacagccgaaacgcaaaactcatcgtttataatcgatggtcctaatacacctgaatgtccttcggcttctagagcatggaatgtttgggaagttgaggattatggctttggggtatttacaacaaatatctggttaaaactgcgagaagtgtacacacaattatgtgatcacaggcttatgagtgcagcagttaaagatgagcgagctgtacatgcggacatgggatattggatagaatcgcaaaagaatggctcatggaaattggaaaaggctagcttgattgaagtcaagacatgtacatggcctaaaagtcatacactttggagcaatggcgtcttagaatctgacatgattattccaaagtcgttagcggggcccatttctcaacataaccatcgtccgggatatcatacacaaactgcgggaccatggcatttaggaaaattggaactagactttaattattgtgagggtacaaccgtggtaattacggaaaattgtggaacaagaggcccttcactacggacgactaccgtttcaggaaagctaatacacgaatggtgttgcagaagttgtactttacctccattaagatatatgggtgaagacggctgttggtacggcatggagattagacccatttcagagaaggaagaaaacatggtcaaatcacttgtgagtgcaggaagtggaaaagttgataactttaccatgggcgtgctatgcctagcaatactttttgaagaggtcatgagaggtaaatttgggaaaaagcatatgatagctggagtattctttacgttcgtgttactactatccggacaaataacgtggagagatatggcccacacattgataatgattggatcgaatgcgagtgatagaatgggtatgggagtgacttaccttgctctaatagccacctttaaaatccagccgttcttagctctaggatttttcctaaggaaattaacctcacgggaaaatttattattaggggtaggcttagcaatggcgactacgctacaattgcctgaagatatcgaacagatggcaaacggaatagcattaggtcttatggctcttaaactcatcacccaatttgagacatatcagctctggacagctctaatttcgctaacctgttcaaacacaatctttacacttacagttgcctggcgcaccgcaactttgattctggctggagtgagtctgttgccagtgtgtcaatcaagttcgatgagaaaaacagactggcttccaatggctgttgccgcgatgggcgtacccccacttccactgtttatcttctccctaaaagacactctgaaaagacgatcgtggccacttaatgagggcgtcatggccgtggggttagtgtcaatacttgcgagctccctgttaagaaatgacgttcccatggcggggcccttagtcgcaggaggtctcttgattgcttgctacgtgataaccggaacgagcgcagacttgaccgtagagaaagctgcagacataacatgggaagaggaagcagaacaaacaggtgtctcacacaatctaatgatcacggtggacgatgatggaacaatgcgcataaaagacgatgaaacagaaaatatactcacagtactattaaaaacagccctattgatagtttcaggtatatttccatactccatccccgccacgcttttagtatggcacacatggcagaaacaaacgcaaagaagtggtgtcctatgggatgtgcccagtccgccagagacgcaaaaagccgaactggaagaaggagtataccgcataaaacagcaaggaatatttggtaaaacacaagtgggagtgggagtccaaaaagaaggggtatttcacactatgtggcacgtgactaggggtgctgtgttgacgcacaacggaaaaagattagaaccaaattgggcgagtgttaaaaaggatcttatatcttacgggggtggatggcgactatccgcacagtggcaaaagggagaagaggttcaggtaattgctgttgaacctggcaaaaaccccaaaaatttccaaacgatgccaggcacgtttcaaacgactacaggagaaataggggccatcgcgctagatttcaaacccggaacttctggctcaccaataattaacagagaaggaaaggtagttggactctatggtaatggagtagtaaccaaaaacggagggtatgtcagtggaatagcccaaaccaatgcagagccggatggtcctacaccagaattagaagaggaaatgtttaagaaacgcaacctgacgatcatggatttgcacccgggctctggcaagacacgtaaatatttgcctgccatagtaagagaagccattaaacggaggctgagaacattgattctagcaccgacaagagtagtggcagcggaaatggaagaggctttgaaaggacttcctatcagataccaaacaaccgctacaaaaagtgaacacacgggcagggagatagtagacttaatgtgccatgcaacgttcactatgcgcttattatcgccagttcgggtgccaaattataatctcataattatggatgaagcacacttcaccgaccccgcatccatcgcagcaagaggatatattagtacacgagtgggaatgggggaggctgccgctatttttatgacggcgacacccccaggtacagcggacgcatttccacaaagcaatgcaccaatacaagatgaagaaagggacatcccagaacgatcttggaacagcggaaatgaatggataacagacttcgctggcaaaaccgtatggtttgtgccaagcataaaagcaggaaacgatatagcgaattgccttaggaaaaacggaaagaaagtgatccaactgtcccgaaaaacatttgacactgaatatcagaagactaagttaaatgactgggactttgtggtcacaaccgatatttcagaaatgggagctaattttaaagcagatagagttatcgatccaaggcgctgtcttaaaccagttatactaacagatggaccagagagagtaattttagctgggccaatgccagtcacagccgccagtgctgctcaacgaagaggacgtgtaggcagaaacccgcaaaaagaaaatgaccagtatatatttacgggtcaaccattaaacaatgatgaagatcatgcacattggacagaagctaaaatgctattggataacataaatacgcctgaaggaatcataccagcactttttgaacccgaaagagagaaaagcgcagcaatagatggcgaatacaggttgaaaggagagtctagaaagaccttcgtcgaattaatgcggcgaggtgatctgcctgtatggttagcacacaaagtagcgtccgaaggcatcaaatatacggatcgaaaatggtgttttgacggacagcggaataatcagatattggaagaaaacatggatgttgaaatatggactaaggaaggtgaaaagaagaaacttcgaccgaggtggttagatgcaagaacctactcagaccctctagcattaaaagaatttaaagattttgctgcgggtagaaaatccatcgctcttgatctggtaacggaaatcggacgggttcccagtcaccttgcacataggactagaaatgctctggacaacttagttatgctacatacgtcagaacacggcggaagggcgtatcgacacgcagtggaagagttacccgagacgatggagactttacttttgctaggcctaatgatattactcacgggaggagccatgctatttctcatttcgggaaaagggatcggaaagacaagtattggactgatttgcgtaattgcatcaagcgggatgttatggatggcagaaattcccctacaatggatagccagtgcgatagttctcgagttctttatgatggtcttattaattccagaacccgaaaagcagcgaacaccgcaggacaatcaacttgcatatgtagtaataggtatacttactttagcagctattatagcagcaaatgaaatgggcctgctagaaacaaccaaacgtgacctaggaatgagtaaagagccgggagtggtctcaccgacatcatatttagatgtagacctacacccagcgtccgcttggaccctatatgccgtagcaaccaccgtgataactccaatgctgcgtcatacaatcgaaaatagcacagccaacgtgagtctagccgctatagccaatcaagccgtagtgttgatggggcttgataaaggttggcctataagtaaaatggacctgggtgtccctttgctagcactaggctgttattctcaggtgaaccctctaacattaacggcagctgtacttttattaataacacattacgctataatcggaccaggactacaagctaaagcaaccagagaggctcaaaaacgaactgcagcaggaatcatgaaaaatcctacagttgatggaatcatgaccatagacttagaccctgtgatctatgacagtaagtttgagaaacaactgggacaagttatgttattagtcttgtgtgctgtgcaacttttattgatgcgtacttcgtgggcattatgcgaggccttaactcttgcgacagggcccataactacgttgtgggaaggttctccgggaaaattttggaacacaacaatagccgtaagcatggcaaatattttccgaggatcatatttagccggggctgggttagctttcagtattatgaaatcagtaggaactggcaaaagagggacaggcagtcaaggagaaaccttaggtgagaaatggaagaagaaacttaatcaactaagtaggaaagaatttgacttatacaagaaaagtggtataactgaagtagatcgtacggaagcgaaagaaggactcaaaaggggagaaataacccatcacgcagtatcaaggggttcagctaaacttcaatggttcgttgaacggaatatggttatacctgaggggagggtcatcgatttaggttgtggaagagggggatggagctattattgcgcaggactaaagaaagttactgaagttagaggatatactaaaggaggacccggacacgaggaacccgtgccaatgagtacttacggttggaacatagtcaagttaatgagtggaaaagacgtcttttaccttccccctgaaaaatgtgacaccctcttgtgcgacatcggcgaatcttcaccctcccctacagtcgaagagtcaagaactatacgagttcttaagatggttgaaccctggttgaaaaacaatcagttttgtataaaagtactcaatccctacatgcccactgttatagaacacctcgaaagactacagaggaaacacgggggcatgttggtacggaatccattatcgaggaactctacgcacgaaatgtattggatatctaacggaaccggaaatatagtggcgagtgttaacatggtaagtaggttgttactaaatcgatttactatgacacacagacgaccagcaattgaaaaggatgtggatctgggcgcgggtacacggcacgtgaatgcagaaccagagaccccaaacatggacgtgattggggaacgaataaagcgcatcaaagaagaacataatagtacatggcactatgatgatgagaacccatataaaacctgggcttaccacggctcatacgaagttaaggccacaggcagcgcttcgtcaatgatcaacggagttgtaaaacttttaactaagccttgggatgtcgtcccgatggtaacacaaatggcgatgactgatacaacaccctttgggcaacaaagagtgtttaaagaaaaagttgacactcgtacacccagatcaatgcctgggacacgacgggtaatgggcatcacagcagagtggctatggagaacactggggcgtaataaaaagcctcgattatgtaccagggaagaatttacgaagaaagtcaggacaaatgcggcaatgggagccgttttcacggaagaaaatcagtgggatagtgctaaagcagctgttgaagatgaagatttttggaaattagttgaccgagagagagaactacacaaattaggtaaatgtggatcatgtgtatataatatgatgggcaaacgggagaagaaattgggcgagttcggtaaagccaagggtagccgagccatctggtatatgtggctgggtgcaagatatttagaatttgaagcgctagggtttttaaatgaagaccattggttcagtagggaaaatagctactccggcgtcgaaggagaaggtctacataaattaggatacattttgagagatatttccaaaattccgggaggcgcaatgtatgctgatgatacagcaggctgggatacgagaattactgaagatgatctgcacaatgaggagaaaattacacaacagatggatcctgaacatagacaattagcaaacgcgatctttaaattaacataccaaaataaagtagtaaaagtgcaaagacccacaccgacaggcacagtaatggatataattagcagaaaagatcaaaggggctccggacaagtaggaacatacggactaaacacatttacaaatatggaggcacagcttatacgacaaatggaaggtgaaggagtcctatcaaaggcagatcttgaaaatccccacttgcccgaaaagaaaataacccagtggcttgagacaaaaggagttgaacgtttaaaaagaatggcgataagtggagacgactgcgttgttaaaccaatagatgatagatttgcaaatgcgctattagcgctgaacgacatgggcaaagtgagaaaagatataccccaatggcagccctcaaaaggctggcatgactggcagcaggtaccattctgtagccatcactttcacgaactcatcatgaaggatggccgtaaactcgtggtaccttgcaggccacaggatgaactgatagggcgagcacgaatatcacaaggagcagggtggtcattacgtgaaacagcctgtctgggtaaagcatacgcccaaatgtggagcttaatgtatttccaccgacgggatttaaggcttgcgtcaaatgctatatgttcagcagtaccagtgcactgggtaccaacttcacgtactacatggagcatacacgcacatcaccaatggatgacgaccgaagatatgctcacagtatggaaccgtgtctggattgaagacaatccgtggatggaggataaaaccccagtaacaacttgggaaaatgttccatacctaggaaaacgagaagatcaatggtgcggtagtttaatcggcttaacgtctcgagctacttgggcacaaaatataccaacggccatacaacaagttagatctcttattggtaatgaagaatttctagattatatgccatctatgaaacgctttaggaaagaagaagagagtgaaggagccatttggtaa

SEQ ID NO: 23015 - RNA, 9873 nt, synthetic construct
  misc_feature 1..9873: note = derived and/or modified CDS sequence (opt6) from DENV-3__KT726356__SS-prME
  source 1..9873: mol_type = other RNA
acaagtttatgtttaatgatgatcttaccagctgcattagcatttcatcttacttcgcgtgacggtgaaccgagaatgatcgtgggtaaaaacgaacgcggtaaaagccttctatttaaaactgcgagcggtatcaacatgtgtaccttaatagcgatggatctaggggaaatgtgtgatgataccgtaacctacaaatgcccacatataactgaagtggaaccagaagatatcgattgctggtgtaacttaacatctacatgggtcacttatggtacttgtaatcaagccggagaacatcgtcgagacaaacgatctgttgctcttgcgccacacgttggaatggggctagatacaagaacacaaacttggatgagcgctgaaggtgcatggcgtcaagttgaaaaagtagaaacatgggcattacgccatccaggctttacaatcctagccttatttttggcccactatatcggaacatctctgacacaaaaagtagtcatttttatactacttatgttagtgacaccatctatgacgatgaggtgcgtaggggttgggaaccgagatttcgtggaaggcctttcgggagcaacctgggttgatgtagtattagaacatggtggatgtgtcacaacaatggcgaaaaataaaccaactttagatatagaattacagaaaacggaagcaacgcaattggcgacacttaggaaattatgcatagaaggaaaaattacaaatatcaccacagacagtaggtgtccaacacaaggagaagcggtattacccgaagaacaagatcaaaattacgtctgcaaacatacatacgtagatagaggatggggcaatggttgcgggttatttggaaaaggttcgctagtaacatgcgcaaaatttcaatgccttgaacccatagaaggtaaagtagttcaatatgaaaatctgaaatataccgttataatcactgtgcacacgggcgatcaacatcaagttggcaatgaaacccagggggtaaccgccgaaattactccccaggcttcgaccacagaagctatactaccagaatacggcactttaggcctcgaatgttcaccacgaacgggtctggacttcaacgaaatgatacttcttaccatgaaaaacaaagcgtggatggttcatcgacaatggttctttgatttgcctttaccatggacaagtggtgctactaccgaaacgcctacgtggaataggaaagaattacttgtaactttcaaaaatgctcatgccaagaaacaagaagttgttgttttggggtcccaggagggagcaatgcataccgcattaaccggggctacagagattcagaactcaggcggaacaagtatatttgcaggtcatctgaaatgtcgactaaaaatggataaattagaattaaaaggcatgagttatgcaatgtgtacaaatacattcgtacttaagaaagaagttagcgaaacgcaacacggtaccatcctaattaaagtagaatacaaaggagaagatgtaccttgcaaaatacccttttctactgaagatggccaaggcaaagcacataatggcagattgattacagctaatcccgtagtcaccaagaaagaagaacccgtaaatattgaggccgagccgcctttcggagagtctaatatagtaatcggtattggggacaacgcattgaaaattaactggtacaagaaagggtctagcatagggaaaatgtttgaagctacagcccgtggtgctcgccgcatggccatattgggagacactgcttgggacttcggctctgtgggaggagttctaaattcattaggtaaaatggtgcatcaaatattcggtagtgcgtatacagcgttattctctggagtgtcatgggttatgaaaattggaataggcgtacttttaacatggataggtttaaactccaaaaataccagcatgtcatttagttgtatagctattgggataataacactatacctaggagcagtcgtacaggcagatatgggctgcgtaataaattggaaaggaaaagagcttaaatgtggctcaggaatctttgtcaccaatgaagtccatacttggactgagcaatataaattccaagctgacagtccaaagagattagcaaccgcaatcgcgggtgcttgggaaaacggggtatgtggaataagatcaactaccagaatggagaatcttctatggaaacagatagcaaacgaactaaactacatactctgggaaaacaatatcaaattaacagtagtagtcggggacattataggagtgctagaacaaggaaaacgaactttaactccccaacccatggaactgaagtacagttggaaaacatggggaaaggccaaaatcgttacagcagaaacacagaatagctcatttataatagacggcccgaacactcccgaatgcccaagtgcctcaagagcatggaatgtttgggaagttgaggattatggattcggcgtcttcacaacaaatatctggctgaaattaagagaggtttatactcagttatgtgaccataggttaatgtcagcagctgtaaaagatgaaagagctgtccacgcagatatgggttactggatagaatcacagaaaaatgggagctggaagctagagaaagcgagtttaatcgaagtaaaaacctgtacatggccaaagtcgcatacactctggtctaatggagtattagagagtgatatgataattccgaagtcactagcaggaccaattagccaacataaccacagaccgggatatcatacacaaaccgcagggccctggcatttaggaaaattagaacttgactttaattactgtgaaggtacgacggtcgttataacagaaaattgtggcactcgaggcccgagcctaagaactaccaccgtatctgggaaacttatccatgaatggtgttgccgttcatgtacattgcccccactaagatacatgggagaagatggctgttggtatggtatggaaataaggcctataagtgaaaaggaagaaaacatggtaaaatcgttagtctcagcaggttcgggaaaagtcgataattttacgatgggagtgctatgtttagcaatcctctttgaagaggttatgcgaggcaaattcggcaaaaagcatatgatagccggtgtattctttacatttgtcttattactttcagggcagattacatggcgtgatatggcacacacacttataatgattggatccaatgcgtctgacagaatgggaatgggtgtgacatacctggcgttaatcgccacattcaaaatacaaccattcttagccctaggatttttcctgaggaagctcacaagccgcgagaatctattactgggggttggactggccatggcaacgacgctacaactacctgaggacatcgaacaaatggcgaatggtatagcattaggcttgatggcgttaaaactaattacccagtttgaaacctatcagctatggacagcattgataagcctgacgtgcagcaatacaatatttacattaaccgttgcgtggagaactgcaacactcatattagctggcgtatccctacttccggtttgccaatcgagttcaatgcggaagacagattggctacccatggccgttgcggctatgggagtaccaccactacccctgttcatattttccttaaaagatacgctaaaacgacgttcatggccacttaacgaaggggtcatggctgtcgggcttgtatcaatcttggccagtagccttctgcgtaacgacgttcccatggcgggtccattattggccggagggctcttaatcgcatgttatgtaataaccggaacatcggcagatttaacagtagagaaagcagcagatataacgtgggaagaggaagcggaacaaacaggagttagccataatctaatgataacagttgatgacgatggaacgatgaggatcaaggatgatgaaaccgagaacatcctcacagtgttactcaaaaccgctcttttgatagtttcggggatctttccatatagcatacctgcaacgctattagtatggcatacatggcaaaaacagacacagagaagtggagtactttgggatgtaccgtcacccccggaaactcagaaggcagaattagaagagggagtttatcggattaaacaacaaggtatttttggcaaaacccaagtaggtgtaggagtacagaaggaaggagtatttcatacaatgtggcatgtcacacgaggagccgttctaactcataacggcaaaagactagaacctaattgggccagtgtgaagaaagatcttatctcctatggaggaggttggcgattatcggcgcaatggcaaaaaggagaagaagtacaagtaatagcggtggaaccaggaaagaacccgaagaatttccagacgatgcctggaactttccaaacaacgacgggggaaatcggagcaattgccctggactttaaaccaggtacaagtggatctcctattataaatcgggaaggaaaagttgtaggtctatacggcaacggtgtcgtaacgaaaaacggtggttatgttagcggcattgcacagaccaatgcagaacctgacggacccactccagaattagaggaagagatgtttaagaaaagaaatctaacaataatggacctacacccaggaagtggtaaaacaagaaaataccttcccgcaattgttcgagaggctatcaaacgcagattaagaactttgatattggcacccacaagagtggtagctgcagaaatggaggaagccttgaaaggattgccaatccggtatcaaacaacggctacaaaaagtgaacacactggcagagaaatagttgacctcatgtgtcatgcgacattcacaatgcgattattaagcccagtaagagttcctaattataacctaataatcatggatgaagcacattttaccgacccggcgagtattgccgcgagaggatacatttccactcgagtaggaatgggtgaggcagcagcaatttttatgactgccacacctccgggaacagcagatgcgttcccgcagagcaatgcgccgattcaagatgaagagagagatataccagaaagaagttggaactctggcaatgagtggataacggacttcgcaggaaagactgtatggttcgttcccagtataaaggcaggcaacgatatagctaattgtctaaggaaaaatggcaagaaagtgattcaattaagtcgcaagacatttgataccgaatatcagaaaactaagctgaatgactgggattttgtggtgactactgatatctcagaaatgggagcgaacttcaaagcggatcgagtaatagatccacgtagatgtttaaaaccggtgattttaacggacggtcccgaaagagtgatactcgcgggacccatgccggtaacggcggcgagtgctgcacagagaaggggacgggtcggacgtaatcctcagaaagagaacgaccagtatatattcacaggtcaaccactaaacaatgacgaggatcacgcacactggactgaagcaaaaatgctcctcgataacataaacactcccgaaggtataataccggctttattcgaacctgaacgcgagaaaagtgctgcgatagacggagaatacagactaaagggagaaagccgaaagacatttgttgaactaatgaggagaggtgatttacctgtctggttagctcacaaagtcgcgagcgaagggatcaaatataccgacagaaagtggtgttttgatggtcaacgcaataaccaaattttagaagaaaacatggatgtagaaatatggaccaaagaaggagaaaagaagaaactacgacctcgatggttagatgcaagaacttacagcgatccactcgcccttaaagagtttaaggattttgcagcgggaaggaaaagtatagcccttgatctggtaacagagataggtagagtcccatcacacctagcgcatcgaacaaggaacgccttagataacttagtaatgttacacacatcagaacatggaggaagggcatacaggcacgctgtcgaagaacttccggaaaccatggagacgctgttactattaggattgatgatactcctgacagggggagccatgttgttcttaatatctggtaaaggaataggcaaaacatcgattggattaatctgcgtaatagcttcatcaggaatgttatggatggcggaaattccattacaatggatagcatcagctatagtattggaatttttcatgatggtcctgctaatacctgaacctgagaagcagagaacgccccaggataaccaattagcctatgtagtgatcggaatcctaacattggccgcaattatagccgcgaatgaaatggggctgttagagacaacgaaaagagacctcggcatgagtaaagaaccaggcgtggtaagtccaacatcatatttagatgtcgatctacacccggcgagcgcgtggactctctacgccgtggcaacaacagtcataacacccatgctcagacatacgattgaaaattcgacagctaatgtgtcgttagccgcaattgctaatcaagcagtcgtgctcatgggattagacaaggggtggccaatttctaaaatggatttgggcgtgcccttactcgcactaggatgctactcccaagtcaatcctctcactctcactgcagcagtattgctactaataactcattatgcaatcattggaccaggattacaggcgaaagcaacgcgagaagcccagaaaaggactgcagccggtataatgaaaaacccaacagtagatgggattatgacgatcgatttagatccagtaatttatgacagcaaatttgaaaagcagcttggtcaagtcatgttgttagtattatgtgcagttcaactacttttgatgagaacgtcgtgggctttatgtgaagcattaacattagcaacgggaccgatcacaaccctatgggaaggttcgccaggaaagttttggaacactactatagcggtatccatggcgaatatatttagaggatcatacctagcaggagcaggactagccttttccataatgaaatcagtaggtacgggaaagagaggtactggctctcaaggtgagaccttaggagagaaatggaagaagaaactaaaccaactatctcgaaaggagttcgacctatacaagaaaagtggcataacagaagtcgatagaacagaagcaaaggagggtcttaaacggggtgaaataacccatcacgcagtctctagaggatctgctaagttgcagtggtttgttgaaagaaacatggtgatccctgagggacgagtgattgatcttggttgcggaagaggcggatggagttattattgtgcaggactcaagaaagtaacggaagtacgtggatacaccaagggaggcccaggacacgaggaaccagtaccgatgtctacatacggatggaatatagtcaaattaatgtctgggaaggatgtgttctaccttccacccgaaaaatgcgacacactcctgtgcgacataggagaatcatcacctagccccactgtcgaagaaagccggacaattcgtgttttgaaaatggtcgaaccgtggctcaaaaataatcagttctgtataaaagtactaaacccttacatgccaacagtcattgaacatctagaacgtctacaaagaaaacatggcggtatgctggtaagaaatccattgagtagaaactcaacacacgaaatgtactggatctcaaatggaacaggcaatatcgttgcttcagtaaatatggtgtcaaggcttttactaaatagatttacgatgacatatagaaggccaaccattgaaaaagatgttgatctaggtgcaggaacacgacatgtaaacgcagagcccgaaacacccaatatggacgttataggagaacgaattaaacggattaaagaagaacataactctacatggcattatgatgacgaaaatccatataaaacatgggcatatcatggtagttatgaggtaaaagcaacaggatctgccagtagcatgattaacggagtcgtaaaactattaactaaaccttgggacgtagtacccatggttacgcaaatggccatgacagacactaccccgttcggtcaacaacgtgtttttaaggagaaagtagatactagaacaccacgatcaatgccaggaacgcgaagagtcatgggaataaccgcagaatggttatggaggactttaggaagaaataagaaacctagattgtgtacgcgagaagagtttaccaagaaagtcagaaccaatgcagcaatgggtgctgtgtttaccgaagagaaccagtgggattcggctaaggcagcagttgaagatgaagacttctggaaacttgtcgacagagaaagagaattacacaagctgggaaaatgcggttcttgtgtatacaatatgatgggaaaaagagagaagaaacttggagagttcggaaaagcaaaaggctcaagagccatatggtatatgtggctcggggcccgatatctagagttcgaggcgttgggatttttaaatgaagatcattggtttagccgtgaaaactcttatagcggagtagagggagaaggcctacataaactgggctatatacttagagatattagtaaaataccgggtggcgctatgtatgcagatgacaccgccggctgggatacacgaataactgaagatgacttgcataatgaggagaaaatcacgcagcagatggacccagaacatagacaattagctaatgccatatttaaattaacctatcagaataaagtggtaaaagtccaacgcccaacaccaactggaacagttatggatattataagtcgtaaggatcaacgaggaagtggacaagtagggacatatggccttaataccttcaccaacatggaagcgcaacttattcgacagatggaaggtgaaggcgttttgagtaaagcagaccttgaaaatcctcatttacccgagaagaaaattacacaatggctcgagacaaaaggggtcgagcgcctaaaacgtatggctattagcggtgatgactgcgtcgttaaaccaattgacgacagatttgcaaatgcacttctagcacttaatgatatgggaaaagtcaggaaggatatcccgcaatggcaaccaagtaagggatggcacgattggcaacaagtacccttttgttctcatcatttccatgaattaatcatgaaagatgggagaaaattagtcgtcccatgtcgacctcaagatgaattaattgggcgtgccagaatatcacaaggcgctggatggtcccttcgtgagacggcgtgcttgggaaaggcttatgcccaaatgtggtctttaatgtatttccatcgacgggatttaagattagcttcaaacgcaatatgttcagcggtaccagttcactgggtccctactagccggacgacatggtcaatccatgcccatcatcaatggatgaccacagaagacatgcttactgtttggaaccgtgtctggattgaagacaatccctggatggaagacaaaacaccagtaacaacgtgggaaaatgtcccttatctgggtaaacgcgaagatcagtggtgtggaagcctaataggcctaacgagtcgcgcaacgtgggctcagaatatacctaccgcaatacaacaggtacggtccttaataggtaatgaggagttcttagactatatgccaagcatgaaaagatttagaaaggaggaagagtcagaaggtgcaatttggtag

SEQ ID NO: 23016 - RNA, 9873 nt, synthetic construct
  misc_feature 1..9873: note = derived and/or modified CDS sequence (opt6) from DENV-3__KT726342__SS-prME
  source 1..9873: mol_type = other RNA
accagcttatgcttaatgatgatactcccagcagcacttgcttttcacttaacaagtcgtgacggagaacctagaatgatcgtagggaaaaacgaacgcggcaaaagcctcctatttaaaactgcgagtggaatcaatatgtgcacgctcatagctatggatttaggagaaatgtgtgatgacacagtcacctataaatgcccacacattacggaagtggagccagaagacatcgactgttggtgcaatttaacctcaacgtgggtaacatatgggacgtgcaatcaagcgggtgaacatagaagagataaaagatccgttgcactggcaccacacgttggtatgggccttgatactagaacacaaacttggatgtcggcagagggtgcgtggaggcaagtagaaaaagtggaaacatgggcacttcggcatcctggatttacaatattggcattatttctagcacactacataggaacttcattgactcaaaaagtggttatatttatcttactaatgttagtaacaccttctatgacaatgcgctgcgtgggcgtcggtaatagagactttgtcgaaggattatccggggctacgtgggtagatgtagtcttggaacatgggggatgcgtaactacaatggccaaaaacaaacctacactagatatagagttacagaaaacggaagcaacacaattagccactctaaggaaactatgtatcgaaggtaaaatcacaaatattacgacagacagtagatgtccaacgcaaggcgaggcggttctgcctgaagaacaagatcaaaactacgtctgtaaacacacgtatgtagaccgcggctgggggaatggatgcggtttatttggaaaaggatcactggtcacctgtgctaaatttcaatgcctagaaccaatcgagggaaaagttgtacaatatgagaatctgaaatatacagtgattataactgtacatacaggagaccagcatcaagtaggtaacgaaacccaaggtgtaacggcagaaatcactccccaggcttcaacaacagaggctatcctgcccgaatatggtacgctcggcctagaatgttcgccgaggacgggacttgactttaacgaaatgatactattaacaatgaaaaataaggcttggatggtgcataggcagtggttctttgatcttcctttaccatggacaagtggagctacaacagaaacacccacctggaaccgtaaagaacttttagtaacattcaaaaatgcacatgccaagaaacaagaagtcgtcgtacttggaagtcaagaaggtgccatgcataccgcactaacaggtgcgactgaaattcaaaattcaggtggaacaagtatcttcgcaggccatttaaaatgtcgcctaaaaatggacaaattagaactaaaaggtatgtcatatgccatgtgtacaaatacatttgtattgaagaaagaagtgagcgaaacccaacacgggacaattttaattaaagtagagtacaaaggggaagacgtcccgtgtaaaatccctttttccacagaagatgggcaaggaaaagcgcataatggacgactaattacggctaacccggttgtcactaagaaagaggaaccagtaaatattgaagctgaaccaccattcggggaaagtaatatagttatagggattggagataatgcactgaaaataaattggtataagaaagggtcaagtattggcaaaatgttcgaagccaccgcaagaggggctcggagaatggctatattaggcgatacggcttgggatttcggaagcgttggcggcgtattaaattctttgggaaaaatggtacatcaaatctttggttcagcatatacagcacttttctcgggtgttagttgggttatgaaaatagggataggagttctattaacttggatcggtctcaacagtaaaaatacgtcaatgagtttttcctgtattgcaatagggataataacattgtatctaggtgcggtagttcaagctgatatgggatgtgttattaattggaaaggaaaagaactaaaatgcggttcaggaatattcgtaacaaatgaagttcatacttggactgagcaatacaaattccaagcggattcgccgaagcgtctggcgacagcaatcgccggtgcatgggaaaatggtgtttgcggaatcagatcaactaccagaatggaaaatctattatggaagcaaatcgcaaatgaattaaattacattctatgggaaaataatattaagctcactgttgtagtaggagatattataggagtactcgaacaaggtaaaagaactttaactccgcagcccatggaacttaagtattcatggaaaacttggggaaaagcgaaaatagtaaccgctgaaacacaaaattcatcatttataatcgatggaccaaacaccccggaatgcccatctgcctcgcgagcttggaacgtatgggaagtcgaggattatggattcggggtcttcacaactaatatttggctcaaactacgtgaagtctacacccagctttgcgaccacaggctcatgtctgcggctgtgaaggacgaacgcgcggtccacgctgatatggggtactggatcgaatcacagaaaaacggaagttggaaattagaaaaagcaagccttatcgaagtcaaaacttgtacctggccaaaatcgcacacattatggtcgaatggcgtcttagaaagtgatatgataatacccaaaagtctagcgggtccgatttctcaacataaccatcggcccggttatcacactcaaacagctggtccatggcatctcggtaaactagagctggattttaattattgtgaaggtactacagtggtcattacggaaaattgcggaacccgtggacccagtttaaggacaacaacagtcagtggaaaactaatacatgaatggtgctgtagatcgtgcaccctcccaccattgagatacatgggtgaggatggttgttggtatggaatggagataagaccaataagtgaaaaagaagagaatatggtaaagtccttagtgtccgctggttcaggaaaggttgataattttacaatgggagttctgtgtcttgcaatactttttgaagaggtgatgagagggaaatttggaaagaaacacatgatagctggggtcttctttacgtttgttctgctgctatcgggacagataacatggcgagacatggcacatacgctcataatgattggctcaaacgcttctgacagaatgggtatgggtgttacttacttagccctaattgcaacattcaaaattcaaccgttccttgcactcggattctttctaagaaaacttacctcgcgagaaaatctccttttaggagtaggtctagcgatggcaacaactctacaacttcctgaagacattgaacaaatggcaaacggaatcgctttaggcctaatggctttgaaattaattacacagttcgagacttatcagttatggaccgctctaataagtttaacatgctcaaatacaatctttactctcaccgtagcttggagaactgctacgctcatacttgccggggtctctttattacccgtatgtcaatcttcttccatgcgaaaaaccgactggttaccgatggctgtggctgcgatgggagtgccccctctgcccctctttatctttagtttaaaggacaccttaaagcggagatcctggccgcttaacgagggtgtgatggcagtaggattagtgtctatattggcatcttcattattacgaaatgatgtacctatggctggtcccttggtcgctggaggactgctaatagcatgctatgtaattaccggcacatccgcagatttgacagttgagaaagctgcagacattacctgggaagaagaggcagagcagacgggagtaagtcataacttaatgataaccgtagatgacgacggaactatgcgaattaaagatgatgaaactgagaacatacttacggtgctcttaaagaccgcattgttaatcgtgtcaggcatatttccctactcaattccagctacgctattagtatggcatacctggcagaaacaaacgcaaagatctggagttttatgggatgtgccttcaccaccagaaacccaaaaggcggaactggaagaaggcgtgtaccgcataaaacaacaaggtatctttggaaagacacaagtaggagttggagtgcaaaaagaaggggtgttccatacgatgtggcatgtaacgagaggagctgtattaacacataatggaaaaaggctagagccaaattgggccagtgtaaagaaagatctgattagctacggcggcgggtggcgtctatccgcccaatggcagaaaggagaagaagtgcaagtgattgctgtagaaccggggaaaaaccccaagaattttcagacaatgcccggcactttccagactacaacaggtgagataggggctattgcgctagacttcaaacccggtaccagcggttccccaattattaatagagaaggaaaggtggtcgggttgtacggaaacggcgtagtaactaaaaacggcggatatgttagcggaatagcacaaaccaatgcggaaccggatggccccacaccggagttagaggaagagatgtttaagaaacgaaacttaacaattatggacctccacccaggctctggtaaaacaagaaagtatctacccgctatcgttagagaagctataaagagacgcctgagaacattaatattagcacctactagagtagtagcagctgaaatggaagaggctttgaaaggtcttccgattcggtaccagacaacagctaccaaaagtgaacatacaggtagagaaatagtagatttgatgtgccacgctacttttactatgagacttttaagtccagtaagggtgccaaattacaatctaataattatggatgaggcacattttacggatcctgcgagcatagcagctcgaggctatatatcaaccagggttggaatgggagaagcagcggcgatttttatgacagctacaccccctggcacggcagacgcttttccacaatcaaacgctccaattcaagatgaagaacgagatataccggaaagatcctggaactcaggaaatgagtggattacagactttgcgggcaaaactgtatggttcgtcccctcaataaaggctggaaacgatatagcaaactgtcttaggaaaaatgggaagaaagtaattcagctaagtcgaaagacatttgatacggaatatcaaaagacaaaacttaatgattgggactttgtggtaacaaccgacatttccgaaatgggtgctaattttaaagcagaccgagtaatagacccgagaagatgcttgaaaccggttatactcacggacggacctgagcgagtgatcctcgcgggtcccatgcccgtaacagcagcctcagcggctcaacgtcgcggaagagtcggcaggaatccccagaaggaaaatgatcaatatatatttacaggacaacctctgaacaatgatgaagatcacgcacactggacggaagcaaaaatgcttcttgacaatataaacacaccagagggtataatccccgcattattcgaaccagaacgggaaaaatcagccgctatagacggtgaatacagactcaaaggggagtctcgtaaaacattcgttgaattaatgagaagaggtgatctcccagtttggctcgcccataaagttgccagtgagggtataaaatatacagacaggaaatggtgttttgacgggcaacgaaacaaccaaatattagaagaaaatatggacgtagaaatatggacaaaagaaggtgagaagaagaaattaagaccaagatggttagacgctaggacatactcagacccattagctctaaaagaatttaaggactttgcggcaggaagaaaaagtatagccttggatttagtgaccgaaatcggacgagtcccgtcacacctggcacataggactaggaatgccttagacaacctggtaatgttacatacaagtgagcatgggggtagagcatatagacatgctgtagaagaactcccagagactatggaaactcttttgctattgggactaatgattctacttacagggggagcgatgctctttcttatatcaggtaagggaataggtaaaacgtctataggtctcatctgtgtaatcgcttcctcaggtatgttgtggatggcagagataccgctacagtggatagcaagtgcaatagttttagagtttttcatgatggttcttctaatcccggaaccagagaagcaaagaacaccacaggataatcaattagcctatgtagtaatagggatacttacattggctgctataatagcagcaaatgagatgggcctcctcgagacaactaaaagggaccttggaatgtcgaaagaaccaggagtggtatcaccaacgagttatctagatgtcgacttacatccggcatcagcttggacgttgtacgcagtggctacaaccgtaatcacgccgatgttaaggcatacgatagaaaattccactgcaaatgtatcgttagctgcaatagccaatcaagctgtcgtactaatgggattagacaaggggtggccgatcagtaaaatggatctaggagtcccactattagcattaggatgttatagtcaagttaatccactcactctgacagcagctgtactactactaatcacgcattatgcaataataggaccaggattacaggcaaaggcaaccagagaagcgcaaaagagaaccgccgccggtataatgaaaaatccaacggttgacgggataatgacaattgaccttgaccctgttatctacgattcaaaatttgaaaaacaattaggtcaagtaatgttacttgttttatgtgcggtacaacttctattaatgcgcaccagctgggccttatgcgaggcgttaaccttggccacaggacctataacaacactatgggaaggctcacctggtaaattctggaatacgaccattgcagtttctatggccaacatctttcgcgggtcatacctagccggtgcaggcctcgctttttctataatgaaaagcgttggtacgggcaaaaggggcactggctcacaaggcgaaactctaggcgaaaagtggaagaagaaactaaatcaactatcgagaaaagaatttgatctatataagaaaagcggtataacagaagtagaccgcactgaagcgaaagaaggacttaaaaggggagaaattacgcatcatgccgtctcacgcggaagtgcaaaactgcagtggtttgttgaaagaaacatggtaataccggaagggagggtgatcgatctaggttgcggcaggggaggctggagctattactgtgcaggacttaagaaagtcacagaggttcggggctacacaaagggtggcccaggacacgaggaacccgttcctatgagtacatatggatggaacattgtgaagttaatgtcgggaaaagatgtattttatttgccgcccgaaaaatgtgatacgctattgtgtgatattggcgaatcatcaccaagtcctactgttgaagagtcgcgtacaatacgagttctgaaaatggtggaaccatggttaaagaataaccagttttgtataaaggtactaaacccatatatgccgacagtaatcgaacacttagaacgattacaacgcaaacatggaggaatgctggtgcgtaaccccttaagtcgaaattccacccatgaaatgtattggataagcaatggaacgggaaatattgtggcgtcggtaaacatggtatctagacttttattgaacaggtttactatgacccacaggcgcccaacaattgaaaaagacgtggatttgggggcaggtacgaggcacgtcaatgcagaaccagaaacaccgaatatggacgtaataggagagagaataaaaaggataaaggaagaacacaattccacatggcactacgatgacgaaaacccttataaaacttgggcgtaccatggtagttacgaagtaaaagctacaggcagtgcctcttcaatgattaatggcgtagtgaagctacttacgaaaccctgggatgtcgtgccaatggtaacgcaaatggctatgacggatactacaccatttggacaacaaagagtgttcaaagaaaaagttgatacaagaaccccaagatcgatgcctggaactagacgagttatgggtataaccgctgagtggttgtggcgaacgctgggtcgaaataagaaacctagactatgcactagagaagagttcactaagaaagtaagaaccaatgctgcaatgggcgcggtttttaccgaggaaaatcaatgggacagtgccaaagccgctgtggaagatgaggacttctggaagctagtagatagagaacgagagttacacaaactaggtaaatgtggatcttgtgtctacaatatgatgggcaagagagagaagaaactcggcgagtttggaaaagcaaaaggctcacgagctatctggtacatgtggcttggggcaaggtatcttgagttcgaagcattgggatttttgaatgaagatcattggttcagtagggaaaattcatacagcggagtagaaggagaaggcctccataaattgggatacatattgagggatatatcgaaaattccaggcggcgctatgtacgctgacgatacagcagggtgggacacacgtattacagaggatgacctacataacgaagagaaaataacacaacaaatggatccagagcaccgtcaacttgcaaacgctatatttaagctaacttaccaaaataaagtggtaaaggttcaaagacccacaccgacagggaccgtcatggacataataagcagaaaagaccaaagaggaagcgggcaagtcggaacctacggactcaatacatttaccaacatggaagcacagctgattcgacaaatggaaggggaaggagtcctttctaaggcagacctcgaaaacccacatctgccagagaaaaagattacccaatggctagagacaaaaggggtggaaaggttaaaacggatggcgattagcggtgacgactgtgtcgttaagccaatagatgacagatttgcgaacgctttactcgctttaaacgacatgggtaaagtacgaaaagacataccacagtggcaaccatctaaaggatggcatgattggcaacaagtgccgttttgttctcatcatttccacgaattaataatgaaagacggtcggaaattagtagtaccgtgtcgaccacaggacgagttaattgggagagcacggatatcgcaaggggcaggttggagcctacgcgaaactgcgtgtttaggaaaagcatatgcacaaatgtggtcactaatgtattttcatagaagagatctacggttagcatcaaacgccatatgttcggcagtacccgtacattgggtacccacgtctaggaccacttggagtatacatgcacaccatcagtggatgaccacagaagacatgttgactgtttggaatagagtttggattgaagacaatccttggatggaagataaaacaccggtgacgacatgggaaaatgtaccctacttaggaaagagagaagatcaatggtgcgggtccttaattgggttgacgagccgcgcaacatgggctcaaaacatacctacggcaatacaacaagtaaggtctttaatagggaacgaagaatttttggactacatgccttcaatgaaacgatttagaaaagaagaggaatcagagggagcaatatggtaa

SEQ ID NO: 23017 - RNA, 9873 nt, synthetic construct
  misc_feature 1..9873: note = derived and/or modified CDS sequence (opt6) from DENV-3__KT726343__SS-prME
  source 1..9873: mol_type = other RNA
acgagtttatgcctgatgatgattctgccagcagcacttgcatttcaccttacatctcgtgacggagaaccaaggatgatagtggggaaaaacgaacgtggaaaatccctactatttaaaacagcaagcggaataaatatgtgcacattaattgctatggacctaggggaaatgtgcgacgacacagtgacttataaatgtcctcacattacggaagttgaaccagaagatatagactgctggtgcaatttgacatcgacttgggtgacatatggtacttgtaatcaagcaggagaacataggcgagacaaacgctccgtcgccctggcaccacacgtcgggatgggactagatacaagaactcaaacttggatgagcgcggaaggcgcttggcgacaagtagaaaaagtagaaacctgggccctaagacatccaggatttacgatactagctttattcttagcacattacattgggacctctttaacacaaaaagtagttatttttatactactaatgttagtaacaccgtccatgaccatgcgatgtgttggggtcggaaacagagattttgttgaaggattgagtggcgcaacatgggtggatgtagtactagaacatggtggatgtgtaacgacaatggctaaaaataaaccaaccctagatatagagctacagaaaacagaagcgacacaattagcaacattacgaaaattatgtatagaggggaaaatcaccaatataaccactgatagtcgatgccccacccaaggggaagcagtattgccagaagaacaagatcaaaattatgtgtgcaaacatacttacgtggacagaggctggggtaacgggtgcggattattcggaaaaggatcgctggtaacttgcgcgaaatttcaatgtcttgaacctatagaaggtaaagtagtccaatatgaaaacttaaaatatactgtaataataaccgtccatactggcgaccaacatcaggtgggaaatgaaacacaaggcgtaacagccgaaataactcctcaagctagcactaccgaagcaattttacccgaatacgggacattaggactagaatgttctcccagaacaggtttagactttaacgagatgatacttcttacaatgaaaaataaagcatggatggtccaccgtcagtggtttttcgaccttccgcttccttggaccagcggagcaacaacagagaccccgacttggaatcgcaaagaactattggttacatttaaaaatgcccacgctaagaaacaagaagtggtcgtactaggttcgcaagagggagctatgcacactgcgctaaccggcgcgactgaaatacaaaattctggagggacatcgatttttgccggacacctaaagtgtagattgaaaatggacaaactagaattaaaaggaatgtcatatgctatgtgtacgaacactttcgtgctaaagaaagaggtctcagagactcaacacggaacaatacttatcaaagttgaatataaaggagaagacgcgccatgtaaaatcccattctcaacggaagatggacagggaaaagcccacaatggtagattgataactgctaatccagttgttaccaagaaagaagaacccgttaatatagaagctgaaccccctttcggtgaaagcaacattgtaatcggtattggcgataatgcattaaaaataaactggtacaagaaaggctcaagtataggtaaaatgttcgaagcaaccgcacgaggggcaagaagaatggccatacttggggacactgcatgggactttggctcagtcggcggcgtgttaaattccttaggcaaaatggttcatcaaatatttggatcagcctacacagcacttttcagtggagtatcttgggtcatgaagataggaattggagttcttctaacatggatcggattaaacagcaaaaatacttctatgagtttcagctgcatagcaattggaataataaccttatatctaggtgccgtcgttcaagccgacatgggttgtgtgattaactggaaaggtaaagaattgaaatgtggatccggaatatttgtaacaaacgaagttcatacatggactgagcaatacaagtttcaggctgattcacctaaaagattagccacggccatcgcaggagcctgggagaacggtgtttgcggaatacggagcacaaccagaatggagaatttattatggaaacagatcgcaaatgaactcaactacatattatgggaaaataatattaaactgacggtagtggttggtgatataataggagtgttagaacaaggaaaacgaacgctaacaccccaaccaatggaattaaaatatagctggaaaacttggggtaaagctaagattgtaactgcggaaacacaaaactcctcatttataattgatggaccgaacacacctgaatgtccctctgcgtcccgggcatggaacgtttgggaagttgaagattatggttttggggtattcactaccaatatttggttaaagctgagggaagtatatacgcaactatgcgatcatagattaatgagtgcagcagttaaggatgaaagggctgtacatgcagatatggggtattggatagagagtcagaaaaacggatcctggaagctcgaaaaagcaagcctaatagaagtgaagacttgcacatggccaaaatcacatactttgtggtctaatggagtactagaatctgatatgattatcccaaaatctctcgctggtccgatttcccaacataaccaccgaccagggtatcacactcaaactgccggaccttggcatcttggtaaattggaactcgatttcaattattgcgaaggaactacagttgttataactgagaattgcggcactcgtggcccttcactaagaacaacaacggtatcaggaaaactaatacacgaatggtgctgcaggtcatgcacactaccacccttacgatacatgggagaggacggatgctggtatggcatggagatacgaccaatttcggaaaaagaggagaatatggttaaaagtttagtctcagcaggttcgggaaaagttgacaactttacaatgggagtactctgtctagcaatactgttcgaagaagtaatgcgaggtaaatttggtaagaaacacatgatagccggggtatttttcacatttgtcctattactttcagggcaaataacctggcgggatatggcacatacactgataatgatagggtcaaacgcatcggatagaatggggatgggcgtaacctatttggctctcatagcaactttcaaaatacaaccgtttctggcactgggatttttcctacgaaaactaacgagccgagagaatctattattaggagtcggtttagccatggcaactacgttacaacttcctgaagatatagaacaaatggcaaacggcattgcgttaggtctcatggcactaaaacttatcacccaatttgagacttatcaactttggacagcattaatatctttgacttgctctaatacaattttcaccttgactgtggcatggcgcacagctactttaatacttgctggggtatccttgttaccagtttgccaatcctcgtcaatgcgaaagacggattggctgccaatggccgtagcagcaatgggcgttccaccactaccgttatttatattttcattgaaagatactctgaagagacgtagttggccactgaatgaaggtgttatggcagttggcctagtatcaatcttagcctctagcttgctaagaaatgacgtgccgatggccggtccgttagtcgccggaggactattaattgcatgctacgtaattaccggcacatcagcagatctaactgttgaaaaagcagctgacataacatgggaagaggaagcggaacaaactggagtctctcataatttgatgataactgtagacgacgatggaacaatgcgtataaaagacgacgagacggaaaatattttgactgttctattgaaaactgctttgttgatagtcagtggtattttcccgtattccatccctgcgacattattagtatggcatacttggcaaaaacagacacaaagaagtggggtactttgggacgtccctagtcctccggaaacacaaaaagcagaactagaggaaggagtgtataggattaaacaacaagggatatttggtaaaacgcaggtaggggtgggtgtacaaaaagaaggagtctttcatactatgtggcatgttacaagaggggctgtattaactcacaacgggaaaagattggaaccaaattgggcaagcgttaaaaaggatttaatatcttatgggggtgggtggagattatcagctcagtggcaaaagggagaagaagtgcaagtaatagcagtcgaaccaggcaaaaatccgaaaaattttcaaacaatgccaggaacctttcaaactaccacgggagaaattggagccatcgcacttgattttaagcctggtactagcgggtcaccgatcattaatcgggaaggaaaagtcgtgggattatatggaaatggagtagtcaccaaaaacgggggatatgtatccggaattgcgcaaacaaatgcagaacctgatggaccaacccccgaattagaagaggagatgtttaagaaacgaaacctaaccataatggatctacatccgggatcaggtaagactaggaaatatttacccgcaatagttagagaagcaataaagaggagactaagaacactaatattagctccgactcgtgtagtagcggctgagatggaggaagccctaaaaggactccctataaggtatcaaacaactgcaacaaaatcggagcacacggggcgggaaatagtagatttaatgtgccatgcgacatttacaatgcgactacttagtccggtccgagtaccaaattacaaccttatcataatggatgaagcgcacttcaccgatccggccagcatagccgcacgaggttacataagtacgcgggttggaatgggcgaagcagcagcaatatttatgacggcaacacctccaggaacagctgacgcattccctcaatcaaatgcaccaatacaagatgaagaacgagatatcccagaaagatcatggaatagtggaaatgagtggatcactgattttgctggaaaaactgtttggttcgtaccatctataaaagcaggaaacgatatagcaaactgtctacgtaaaaacggtaagaaagtcatacaactatctagaaaaactttcgacacagaataccagaaaactaaactaaacgattgggattttgttgtaacaacggatatatcagaaatgggagctaattttaaggcagatagagttatcgatcccagaagatgtctcaaacccgtaatattgaccgatggcccagaacgagttatactagctggccctatgccggttactgctgctagtgcggctcagcgtagagggagagtcggtcgtaacccacaaaaggaaaacgatcaatatatctttactgggcaaccccttaataacgatgaagatcacgcgcactggacagaagcgaaaatgttacttgacaacataaacacccctgaaggtataataccagctctttttgaacctgaaagagagaaatccgctgctatagatggagaatatagattaaaaggggaatcccgtaagacattcgttgagctcatgagacgtggtgacctaccagtctggctagcacataaagtggctagtgagggcatcaaatatactgatcgcaaatggtgctttgacgggcaaaggaacaatcaaatcttagaagaaaacatggatgttgaaatatggaccaaggaaggggagaagaagaaactccgtccaagatggttagacgccagaacttactcagacccactagctctaaaggaatttaaagattttgctgcggggcgaaaatctatagcactcgacttagtaactgaaataggacgggtgccatctcatcttgcacacagaacaagaaacgctctagacaacttagttatgttacacacctccgagcatggaggcagagcatatagacacgctgtagaggaattacctgaaacaatggagactctgctattacttggactaatgatattattaactggaggtgctatgctatttcttatatcaggaaagggcattggtaaaacaagtataggtcttatatgtgttatagcatcaagcggaatgctttggatggcagaaataccgttacaatggatagcctccgcaattgtgctagagttctttatgatggttctactaattcctgaaccggaaaaacaacgtacaccacaagacaatcaattggcgtatgtagtaattgggatattaacactcgcagcgattatagcggcaaacgaaatgggactattagaaactacaaaacgcgatttaggcatgtctaaagaaccaggagtggttagccctacaagttacctggacgttgatctgcaccccgcatcagcatggaccctctatgctgtggctactacagtaataacgccgatgttacgtcacacgattgagaactctacagctaatgtttctttagctgcaatagcaaatcaagcagtagtactaatgggcttagataagggatggcctatatccaaaatggaccttggagtgccactacttgctctaggatgttactcacaggtaaatcctctcacattgacagccgcggtacttctgctaatcacacactatgccattatcggcccggggttacaagcaaaggctactcgtgaagcgcagaaacggacagctgccggaattatgaagaatcctacagtggacggaataatgacaatagatttggaccccgttatttacgatagtaaatttgaaaaacaactaggtcaagttatgctcctagtcctatgcgcagtacaactgctattaatgagaacaagctgggctttatgcgaagcgttaacacttgccaccggcccaatcacaaccctttgggagggatcaccaggtaaattttggaatactactatagcagtatccatggctaacatatttaggggcagctatctagcaggcgcaggactagcattcagcattatgaaatcagtaggaactggtaaacgaggtacggggtcgcaaggagaaacgctaggggaaaaatggaagaagaaactcaaccaactaagcagaaaagagttcgacctttacaagaaatcaggaattacagaagttgataggacagaagcaaaagagggattaaagagaggtgaaattactcatcatgcagtgtctcgagggtcggctaagctacagtggtttgtggaaaggaacatggtgatccctgaggggcgcgtaatagacctaggttgtggaagaggcggctggagttattattgtgccggactcaagaaagttacagaggtcaggggctacacaaaaggtggtccgggtcatgaagaacctgtaccgatgtcaacgtatggatggaatatcgtaaaattaatgagcggaaaagacgtgttttaccttcccccagagaaatgcgatacattactttgcgacatcggtgaatccagtccatcacccactgtagaagaaagccgtacaatcagagttctaaaaatggtcgaaccgtggctcaaaaataatcaattctgcataaaagttttgaacccatatatgccgactgttattgaacatcttgagcgactacaaagaaaacacggagggatgttagtacgcaatcccctatcgaggaactcaacccacgaaatgtactggataagcaacggcacaggaaacatagtggccagcgtaaatatggtatcaagactactacttaaccgtttcacaatgacgcatcggcgtccgacgatcgagaaagacgtagacctcggcgcgggaacacgacatgtaaacgctgaacccgaaacccctaatatggacgtcatcggagaacgaatcaaacgaataaaagaagaacataactcaacgtggcactatgatgacgaaaatccatataaaacctgggcgtatcatggatcgtatgaggtgaaggccactggctcagcaagcagtatgattaacggggtcgtaaaacttttaacaaaaccatgggatgtcgtccctatggtaacacaaatggcgatgacggacacaacgccgttcggacaacaacgagtcttcaaagaaaaagtagatactagaactcccagatcgatgcccggcacgagaagggttatgggcattacggcagaatggctgtggagaactttaggaagaaataagaaaccccgtttatgcacacgtgaggaatttacaaagaaagtgagaaccaacgcagcaatgggcgcggtcttcactgaggaaaatcaatgggattctgcaaaagctgccgtagaagacgaagatttctggaaattggtcgacagggaaagggaattacacaagttaggaaaatgtggctcgtgcgtatataatatgatgggtaaaagagagaagaaactaggtgagtttggtaaagcaaaaggatcaagagctatatggtacatgtggttaggagctaggtaccttgagtttgaagcactcggatttctgaatgaggaccattggtttagtcgagagaacagctatagtggtgtagagggggaaggattacacaaacttggatatattctaagagacatctccaaaattcccggaggtgcaatgtatgcagacgataccgcaggctgggatactaggattacagaagacgacctccataatgaagagaaaataacacaacaaatggaccctgaacataggcagttagccaatgcgatattcaaattaacatatcagaataaagttgtaaaagtgcaaagaccaacccctactgggacagtaatggatataattagcagaaaagatcagcggggaagcggacaagttggaacctacggacttaacacatttaccaacatggaagcacaactaattaggcaaatggagggtgaaggcgtgttatctaaagcagacttagaaaatccacatctgccagagaagaaaataacacagtggttggaaactaaaggtgtagaacgtcttaaaagaatggcaatttcaggagacgattgcgtggttaagccaatagatgatcgctttgcaaatgcgttattggccttaaacgatatgggtaaagtacgcaaagatatacctcaatggcagccatcaaagggatggcatgactggcaacaagtacccttctgcagtcaccacttccatgagctaattatgaaagatggtagaaaactggtagtaccatgccgaccacaggacgaattaataggaagggcaaggatatcacaaggagcgggatggagcctacgagaaaccgcgtgcttaggaaaagcatatgcccaaatgtggtcattaatgtattttcatagacgtgatttaagattggcatcaaacgcaatttgctctgcagtacccgtacattgggtgcctacttctcgaacgacttggagtatccatgctcaccaccaatggatgactaccgaagatatgttaacagtatggaaccgagtttggatagaggacaacccatggatggaagataagacgccggtaacaacatgggaaaacgtcccctacctaggaaaaagagaggaccaatggtgtgggtccttaataggcctaacctctcgtgcaacatgggcgcaaaacatcccgacagcaatacaacaagtccgatcattaattggaaatgaagaatttctggattatatgcctagtatgaaaagattccgaaaagaagaagagagtgaaggagcgatctggtga

SEQ ID NO: 23018 - RNA, 9873 nt, synthetic construct
  misc_feature 1..9873: note = derived and/or modified CDS sequence (opt6) from DENV-3__KT726351__SS-prME
  source 1..9873: mol_type = other RNA
acgagtctatgcttaatgatgattttgcccgcagcactagcatttcatttaacttcaagagacggagaacccaggatgatcgtaggcaaaaatgaaagaggtaaatcactactttttaaaactgcctcagggatcaatatgtgcactctaatagctatggatctaggagaaatgtgcgatgacactgtcacctacaaatgtccccatatcaccgaagtcgaacctgaagacattgattgttggtgtaatttaacgtctacctgggtcacttacggcacctgtaatcaagcgggggaacatcggcgcgataaacgttctgttgctttagcacctcatgtcggcatgggtctcgatacaagaacccaaacatggatgtctgctgaaggagcctggagacaagttgaaaaagttgaaacctgggcattaagacatccaggttttactatacttgcactctttctcgcacactatataggcaccagtctaacccaaaaagttgttatatttatactattaatgttagtgacaccatctatgaccatgagatgtgttggtgtcggaaatcgcgatttcgtcgaaggtttgtcaggcgcaacatgggtagatgtagtcttagaacatggcggttgtgtaaccacaatggccaaaaataaaccgaccttggacatagaattgcagaaaactgaagctactcaattagctactttacgtaaattatgtattgaaggaaaaataacaaatatcaccacggatagtaggtgccccacccaaggcgaagcggtacttcccgaagaacaagatcaaaattacgtatgtaaacatacatatgtagatcgtggttggggaaacggctgcgggttgtttgggaaaggtagcctggttacatgcgccaaatttcaatgtttagaaccaatagaaggaaaagtcgtacaatacgaaaaccttaaatacacagtcatcattacagtacatacaggagatcaacatcaggttggtaatgaaacacagggcgttacagcagaaataacgccgcaggcttcaacaacagaagcaatactaccagaatacggtacacttggactagaatgcagtccaagaacagggcttgatttcaatgaaatgatcctactaacaatgaaaaataaagcatggatggtacacagacaatggttctttgacttaccgttaccatggacgtcaggagcgacaacagaaacacctacatggaataggaaagaattattagtcacatttaaaaatgcccacgccaagaaacaagaggttgtagtcctaggtagtcaggaaggagctatgcacacagcactaaccggtgccacggaaatacaaaattcaggaggaacttcaatatttgcagggcacttaaaatgccggctaaaaatggataaactagagttaaaaggaatgagctatgcaatgtgtacaaacaccttcgtgctcaagaaagaagtaagtgaaacacaacacggaacaatactcataaaagtagaatacaaaggtgaagatgtcccgtgtaaaatacccttcagcacagaagacggccaaggcaaagcccataatggcagattaataactgcgaaccccgtggtaactaagaaagaggagccagtcaatattgaagctgaaccaccctttggcgaaagcaacatagttataggtataggagataacgcgttaaaaattaactggtacaagaaagggtcgtctattggtaaaatgtttgaagcaacagctcgaggtgcacggagaatggcaattctaggtgatacagcctgggacttcggtagcgtaggaggagtactcaattctctgggaaaaatggtacatcaaatctttggatcagcttacactgcattattctcaggtgtaagctgggtcatgaaaataggaataggagtgttattaacgtggataggactaaattcgaaaaatacgagtatgtccttcagttgtattgcaataggtataataactttatacctaggagccgtcgtacaagcagatatgggatgtgttattaattggaaaggaaaagaattgaaatgcggcagtggtattttcgtgacaaatgaagttcacacttggaccgaacaatacaaatttcaagcagattcacctaaacgtcttgcgacggctattgctggagcatgggaaaacggggtctgcggtattagaagcactacccgaatggaaaacttactatggaaacagatcgccaacgaacttaattatattttatgggaaaacaatataaaacttacagtagtagtaggcgatataattggtgtacttgaacagggcaaaaggacactgactccccaacctatggaattaaaatactcctggaaaacgtggggaaaagccaaaattgtcacagcggagactcaaaatagtagttttataattgatggtccgaacacacccgagtgtccatcagcaagcagggcgtggaatgtatgggaagtggaggactatggattcggtgtattcacaacgaatatttggcttaaactcagagaagtgtatacccagctatgcgatcataggctcatgtctgcagccgtaaaagacgaaagggccgtgcatgccgatatgggttattggatcgagtcacagaaaaatgggtcatggaaactagaaaaagcatccttaatcgaagtcaaaacctgcacctggcctaaaagtcatacgctatggagcaatggagtactggaaagtgatatgatcataccaaaaagtctggccggacctatatcccaacacaatcaccgcccaggatatcatacacaaacagcaggaccatggcaccttgggaaattagaacttgactttaactattgcgagggtactacggtagtaattaccgagaactgtggcacacgtggaccaagtttaaggactacaactgtatcaggtaagctgatacatgaatggtgttgtcgttcttgtactttacccccactcaggtatatgggtgaagatggttgttggtacggaatggaaatcaggccaataagtgaaaaagaggaaaatatggtaaagtccctagtctcagctggtagcggaaaagtggacaattttactatgggtgttctttgtctggcaatactatttgaggaagtaatgcgtgggaagtttggaaagaagcacatgatcgcgggcgttttctttactttcgttctattactatcgggccaaataacttggagagacatggctcacacattaataatgatagggagcaatgcaagcgaccgcatgggaatgggggtaacctatcttgcactgattgcgacttttaaaatccagccatttttagccctcggattctttctcagaaaacttacatcgagagaaaaccttctcctaggagtaggtttagccatggcgacaacactgcaacttcccgaggacattgaacagatggcaaacggtatcgctttagggctgatggcactaaaattgataactcaatttgaaacgtatcaattgtggaccgcccttatcagtttaacttgtagcaacactatctttacacttactgtagcttggagaactgcaacactgatattagccggtgtttccttactcccggtctgtcaaagtagcagtatgcggaaaactgattggctgcccatggcggtagctgcaatgggggtaccacccttacctttgttcattttctcccttaaagatactctgaaaagacgctcgtggccattaaacgaaggagttatggccgttggattagtatcaattctagcaagttcattactgcgaaatgatgtaccgatggctgggccgctagtcgcaggaggactattaatagcatgctatgtaataacaggaacgtcagcagatctcaccgttgaaaaggcggcagatattacatgggaagaggaagctgagcaaacaggagtgtcgcataatttaatgatcactgtggacgacgacggaactatgaggataaaagatgacgaaacggaaaatatattaacagtcctcctaaaaactgccttattaatagtaagtggaatattcccgtatagtattcctgccactctgcttgtctggcatacatggcaaaaacaaactcaacgttcaggtgtactttgggatgtaccctctccacccgagactcagaaagctgaactggaagaaggtgtgtaccgaataaaacaacaaggaatatttggaaaaacacaagtcggagtaggagttcagaaagaaggtgttttccacaccatgtggcatgttacaagaggcgccgtcttgacacacaatggaaaaagactggaaccaaattgggccagtgtcaaaaaggatttgatttcttatggcggaggctggagattatcagcacaatggcagaaaggagaagaagtacaagtaatcgcagtagaacccggaaagaatcccaaaaacttccaaacaatgcctggtacctttcagaccacaactggggaaataggcgcaatagcgttagattttaaaccgggtacgtctggaagtccgattataaatagagaaggtaaagtggtaggattatacggcaacggtgtcgtgaccaaaaatggaggatacgtatcaggaatagcacaaacaaatgcagaaccggatggccctactcctgagctggaggaagaaatgttcaagaaaagaaatctaacaataatggatcttcacccaggttcaggaaagacaaggaagtatttacccgcaatagtaagggaagccattaaacgaagacttaggactctcatattagcccctacccgtgtagtggctgcagaaatggaagaagccctaaagggtctcccaatcagataccaaacaacagcaactaaatctgaacataccggccgagagattgttgacttaatgtgtcatgcaacgttcacgatgcggctactgagtcctgtgagagtaccaaattacaatctaataattatggatgaagcgcacttcacagatccggctagcattgcagcacgaggctatatatcaactcgcgtaggaatgggggaggcggcagcaatatttatgacagcaactcctccaggaactgctgacgccttccctcaatccaacgctccaatacaagatgaggaaagagatattcctgaaaggagctggaactccggcaacgaatggattacggattttgcaggaaaaacagtatggtttgtcccatcaattaaggctgggaacgacattgctaattgtttacgcaagaatggaaagaaagtaatacaactttccagaaaaacatttgacactgaatatcagaaaacgaaacttaacgactgggacttcgtagtgacgactgatattagtgaaatgggtgcaaactttaaagcagatagagttattgacccgagacgatgcttaaaaccagttatacttacggacggacctgagcgagtgatactcgcaggacctatgccagtcacagcagcaagtgctgcacagagaagaggaagagtagggcgcaatccacaaaaagaaaacgatcaatatatttttaccgggcaaccactcaataatgacgaagaccatgcacactggacggaggctaaaatgttattagacaacataaatacgccagaaggtataatacccgcactatttgagcctgagagagaaaaatctgctgcgatagatggcgaatatcgcttaaaaggtgaaagccgtaaaacatttgttgagttaatgcgtcgaggagatcttcctgtttggctggcacacaaggtagcttccgaaggtataaagtatacagatagaaaatggtgcttcgacggacaaagaaacaatcaaatattagaagagaatatggacgtagagatatggaccaaagagggcgagaagaagaaattgagaccacgatggctagatgcccgtacctactcagatcctctagccctaaaagaatttaaagatttcgctgccgggcgtaagtcgatagccctcgatctcgtcacagaaatagggcgagttccctctcatctagcacacagaacaaggaacgctttagacaatttggtaatgctacatacctctgaacatggcggcagagcttatcgacacgcggtggaagaattaccagaaactatggaaacattactactattaggcctaatgattctacttacagggggagcgatgcttttcttaattagtggaaaaggaattgggaaaacatcaatagggcttatttgcgtcatagccagttccggcatgttgtggatggctgaaattccgttgcaatggatcgctagtgcaatagtgttagaatttttcatgatggtattactgataccagagccggaaaagcaaaggacaccacaggataatcaattggcatatgtagtgataggaatactaactctcgctgcgataattgcagctaatgaaatgggactacttgaaaccacaaagagagacttggggatgtcaaaagaaccaggagtagtttcaccaacgtcatacctggatgtagatcttcatccagctagcgcatggacactatacgcagtggctactaccgtaataacaccgatgctgcgccacacaatagaaaattcgactgcgaatgtttcattagcagcaatagctaaccaggccgtcgttctcatgggacttgataagggttggccaatatccaaaatggatttaggagtccccctattagcccttggctgttatagccaagttaaccctctaactctaacagctgctgtattactcttaataacgcattatgcaataatcggtcctggcttacaagcaaaagcaactagggaagctcagaaacgtaccgcggcaggaataatgaagaatcctacagtagacggaattatgactattgatctagatccggtcatttacgacagcaagtttgaaaaacagcttggtcaagtgatgctacttgtgttatgtgccgttcagttattactaatgcgtacaagctgggccctttgtgaagccttgacgttagcaaccgggcctatcaccacgctctgggaaggctcaccagggaagttttggaatacaacgatagcggtcagtatggcaaatatatttaggggttcctatctggcgggagcaggcttggcgtttagtataatgaagtccgttggcacaggcaaacgggggactggatcacaaggagaaacactaggagaaaaatggaagaagaaacttaaccagctcagcaggaaagaatttgacctctacaagaaaagcggaataacagaggtagacagaacagaggcgaaagagggcttaaaacgtggtgaaatcacgcaccacgccgtctctagaggatcggcaaaactacaatggttcgtagaacgtaacatggtcatacccgaaggacgtgtcatagatcttggatgtggaagaggaggatggtcatactactgtgcaggcctcaagaaagtcacagaagtccgaggatatacgaagggtggtccaggtcatgaagaaccagttccaatgagtacatacggttggaatatagttaaattaatgagtgggaaagatgtattttatttgccaccagaaaagtgcgacactttattatgcgacataggagaatcatcgcccagcccgacagtcgaggagtcacgaaccataagggtattgaagatggtcgaaccgtggctcaaaaacaatcagttttgtataaaagttctaaacccctacatgcctactgtaatcgaacacctggaaaggctccaacgaaaacatggtgggatgctagttcggaatcctttatcgagaaattcgacacacgaaatgtactggatttcaaatggaactggcaatatcgtggcttcggtcaacatggtaagtagacttttattaaacaggtttacgatgactcatagacgacctacaattgagaaagatgtagatttaggtgcagggactagacacgttaacgcagaacctgaaacaccaaatatggacgtaatcggcgaacgcatcaagcgtatcaaagaagaacataattcaacatggcactatgacgatgaaaatccctacaaaacttgggcatatcacggatcctacgaagtaaaagcaactggatcagcctcaagtatgatcaacggcgtggtgaaactattgacaaagccttgggatgttgtacccatggtaacgcaaatggcgatgactgacacaacacctttcgggcagcaaagggtattcaaagaaaaggtagatacacgaaccccacgttcgatgccaggtacacggaaggtaatgggtataaccgctgaatggttatggcgaactctaggtcgaaataaaaagccgcggttatgtacgagggaggaatttactaagaaagttagaactaatgcggcaatgggtgctgtttttaccgaggaaaatcaatgggattcagcaaaagctgcagtcgaggatgaagatttttggaagctagttgacagagaaagagagttacataaactcggaaagtgcgggagttgcgtttacaatatgatgggaaaacgcgagaagaaattgggggagttcggtaaagcaaaaggaagtcgcgctatatggtatatgtggctcggcgcacgttatttggagttcgaggcgcttggatttttaaatgaagaccactggttctctcgtgaaaattcatactcaggcgtagaaggagagggattgcataaactgggttatattcttagggacataagtaaaatacccggcggagccatgtatgccgatgacacagcaggttgggatacaagaattactgaggatgacctacacaatgaagagaaaataacccaacagatggatccagaacatcgacaactagctaacgccatttttaaactaacatatcaaaataaagtggtcaaagtacaaaggccaaccccgaccggaacagtaatggatataataagtagaaaagatcaacgtggctcagggcaagtgggaacatacgggttgaacactttcaccaatatggaagcacagcttatccgtcaaatggaaggcgagggtgtcttatcgaaagcagacttagaaaatccgcatttgccggaaaagaaaataacccaatggctggaaacaaagggagtggaaagactaaaaagaatggcaataagtggtgatgattgtgtagttaaacctatagatgacagatttgccaatgcattgttagcacttaacgatatgggaaaagttcgaaaagatattccacagtggcaaccctctaaggggtggcacgactggcaacaagttcctttttgttcacatcactttcatgaactcataatgaaagatggacgaaagctggtagtaccatgtcgaccacaagatgaattgatcggtagggcacgaatttcacaaggtgctggatggtctttacgggaaactgcatgtttaggtaaggcttatgctcagatgtggtcactgatgtactttcataggagagacttaaggttagcaagcaatgcaatatgtagtgcagttcctgtgcattgggtgcccacaagtagaacgacttggagtatacatgcacatcaccaatggatgacaacggaagatatgctcacagtttggaatcgagtttggattgaagacaatccttggatggaagataaaacccccgtaacaacatgggaaaacgtgccatatttaggtaaaagggaggaccaatggtgtggttctctaatcggacttacatctagggctacatgggcgcaaaatataccaacggcaatacaacaggtaagatccttaattggcaacgaagaatttttagactacatgccctccatgaaacgattcaggaaagaagaagagagtgaaggagctatctggtaa

SEQ ID NO: 23019 - RNA, 9873 nt, synthetic construct
  misc_feature 1..9873: note = derived and/or modified CDS sequence (opt6) from DENV-3__KT726360__SS-prME
  source 1..9873: mol_type = other RNA
actagcttgtgtttaatgatgattctcccagcagcattggcttttcaccttacatccagagacggagaaccaagaatgatcgtcggtaaaaatgaacgaggaaaatctttattatttaaaactgctagtggaataaacatgtgtacgctcatcgctatggacttaggagaaatgtgcgatgatactgtcacatataaatgcccacacataacagaagtagaaccagaagacatagattgttggtgtaatctaacgagtacgtgggtcacttatggaacatgtaatcaggccggtgaacacaggcgtgataaacgttctgttgcattagcaccgcatgtgggaatgggcctagacacacgtacacagacatggatgtctgccgaaggcgcatggaggcaagtagaaaaagtagaaacgtgggcgttacgacatccgggattcactattctagcattgtttctcgcgcactatattggaacgtcactaacacaaaaagtagtaatatttattctacttatgctagttacgccaagtatgactatgagatgtgtcggagtcggcaatcgcgactttgttgaaggcctaagcggggccacatgggtagatgtagtactagaacatggagggtgtgtaacaaccatggcgaaaaacaaacccacattagatatagaacttcagaaaactgaggcgacacaattagcgactcttcgtaaattatgtatcgagggaaaaatcacaaacattactaccgactcaaggtgccccactcagggcgaagcagtattacccgaggaacaagatcaaaattacgtatgtaaacacacgtacgtagaccgaggatggggaaatggctgtggactattcggaaaaggcagcttagtaacatgtgctaaatttcaatgcctggaacccattgaaggaaaagtggtccaatacgaaaacctaaaatacacagtcattattacggttcacacaggagatcagcaccaagtcggaaacgagacgcaaggagtaacagctgaaattacaccacaagctagtacaaccgaagcaatattaccagagtatgggacattgggactagagtgcagtcctcgaacaggtctcgattttaacgaaatgattcttctcacaatgaaaaacaaagcctggatggttcatcgccaatggttcttcgacctgccactcccatggacgtccggagcgacaaccgaaactccaacttggaatagaaaagaacttttagtaacatttaaaaacgctcatgcaaagaaacaagaagtggtagtattaggtagtcaagagggagcaatgcatacagcgcttactggggcaacagaaatacaaaatagtgggggcacatcaatatttgctggtcatctgaaatgccgactaaaaatggacaaactggaactgaaaggaatgagttatgcaatgtgcacaaacacttttgtgcttaagaaagaggtctcagaaacccagcatggaactatcttgatcaaagtagaatacaaaggcgaagacgtgccatgtaaaatcccatttagcaccgaagatggacaaggaaaagcgcataatggcagattgattacagcaaacccagtggtaaccaagaaagaggagccagttaacatcgaagccgaaccaccgtttggcgagtcaaatatcgtcataggtataggtgataacgccttaaaaataaactggtataagaaaggatcatccatagggaaaatgtttgaggcaacagctagaggggcccgcagaatggccatcttaggagataccgcatgggacttcggttccgtcgggggagtactaaacagtctcgggaaaatggtacatcaaattttcggaagtgcatatacagctctcttcagcggtgtttcgtgggtaatgaaaataggaataggagtattgctcacttggatagggcttaattcgaaaaatacgagcatgtcgtttagttgtatcgcgatcggcattattactttatatttaggagcagtagtacaagctgatatgggttgcgtaataaactggaaaggtaaagagctaaagtgcggctcaggcatctttgtgactaacgaggtccatacctggacggaacaatacaaatttcaggccgactcacccaaaagattagcaacggcaatcgcgggtgcctgggaaaacggtgtctgcggaatcagaagtactactcgaatggaaaatctcctttggaaacaaatagcaaacgaactaaattacatactttgggagaacaacataaagctgacggtagttgtaggggatataattggagtattagaacagggaaaaaggacacttactccgcaacctatggaattaaagtatagctggaaaacctggggaaaagctaaaatcgtgaccgcagaaacgcagaatagctcattcattattgatggaccaaatacacccgaatgcccgagtgccagtagagcttggaatgtatgggaagtagaagactatgggtttggagtgttcacaacgaatatttggctaaaacttcgagaggtgtacacacaactatgtgaccatcgactgatgtccgctgccgttaaagatgaacgagcagtacacgcagatatgggatattggatagaatcccagaaaaacggaagctggaagttagaaaaagcgtccttaatagaagtaaagacatgcacgtggcccaaaagtcacaccctatggagtaatggcgtattagaaagtgatatgataatacctaagagtttagcaggtccaatcagccaacacaaccatagaccgggatatcacactcaaacggcaggaccttggcatctaggcaagctagaacttgactttaactattgtgaaggtacgacagtagttataaccgaaaattgtggcacgagaggcccaagtttacgtacgactactgtaagcggaaaacttatacatgaatggtgctgcagatcatgcacattacccccactacgatatatgggtgaggatgggtgctggtacggaatggaaataagacctatctcagagaaagaggaaaatatggttaagagtctagtatctgccgggtcgggtaaggtcgataattttacaatgggagtactctgtcttgcgattttgtttgaagaagttatgagaggaaaattcggtaagaaacacatgattgccggtgtatttttcacgtttgttcttctattgtccggccagatcacttggagagacatggcacatacattaatcatgatagggtccaatgcaagtgacagaatgggaatgggagttacctacctagctctaattgctacattcaaaatacaaccattcctagctttaggatttttcttaagaaaactaacatcccgtgagaatctcttactgggcgtgggcctagcaatggccacgacactacaactcccagaggatatcgaacaaatggcaaacgggattgcacttgggcttatggcattaaaactaatcactcagttcgaaacgtatcaactatggactgctctgatttcgctcacttgttcgaacaccatctttactctcaccgtcgcctggaggactgcaactttaatcttagctggggtgtccctactaccggtttgtcaaagttcatccatgcgaaaaacggactggttaccaatggctgtggccgcaatgggagttccacccctccccttgttcattttctctcttaaagatacactcaagaggcgatcgtggcccttgaatgaaggagtcatggcagttggcttagtatctattctagcaagctcattactccgaaatgatgtacccatggccggacccctagttgcagggggactactcatagcctgttacgtgatcacgggaacctcagcagacttaacggtggaaaaggctgctgacataacatgggaagaagaggcggaacagaccggagtaagccataatctaatgattaccgtagatgatgatggaacaatgcgtataaaagatgatgaaacggagaatatactcactgtactgttgaagacggcattactaatagtatctggaattttcccctatagtatcccagcgactctattagtatggcatacctggcagaaacaaacacagcgttccggtgtattatgggacgtaccatcaccaccagaaacacaaaaagctgagttagaggaaggagtatatagaataaagcaacaaggaatattcggaaaaacgcaagtaggagtcggagtacagaaagaaggagttttccatacaatgtggcatgtaactagaggggctgtgctaacgcataacgggaaacgactagagccaaattgggcgtccgttaagaaagatctaatatcatatggaggaggatggcgattatcagcacagtggcaaaagggagaagaagttcaggtcattgcggtggaaccagggaaaaaccctaaaaatttccagacaatgcctggaacatttcagactacaactggtgaaatcggtgcaattgcattagactttaaaccaggtacgtcagggtccccaatcataaacagggaaggaaaagtagtcgggctttatggcaatggtgtcgtgacaaagaacggtggctatgtatcgggtatcgcgcaaacaaacgcagagccggacggcccaacaccagaactcgaggaagaaatgtttaagaaacgaaatttgacgattatggatctacacccaggtagtggtaagactcgtaagtatctccctgcaatcgtgagggaagccatcaaaagaagacttagaacactaatactggcacctacaagagtcgttgcagcagaaatggaagaggccctgaaaggactcccaataagatatcagactaccgcaacaaagagcgaacataccgggagggagatagtggacctcatgtgtcacgccacatttaccatgagacttttaagtcctgttagagttcctaattataatctaattataatggacgaagcccacttcactgatcctgcatccatagcggcaaggggttatatttcaaccagagttggtatgggagaagccgcagcaatctttatgactgccacacctccaggtactgcggacgcttttccgcagagcaacgctcctatacaggatgaagaacgagatatacccgaaaggtcatggaatagtggaaatgaatggataacagatttcgccggcaaaactgtctggtttgttccttcaatcaaggcaggcaatgatatagccaattgccttcgtaaaaatgggaagaaagttattcaactgagccgaaaaacttttgatacagaatatcagaagacgaaattaaacgattgggattttgtagttacgacagatatcagtgaaatgggtgcaaatttcaaggctgacagagtaatagacccaagacgatgtttaaaaccggtcatattgacagacggaccggagcgagtaatcctagcaggaccaatgcctgtaaccgcagctagcgcagcacaacgaagaggccgtgtaggacgcaacccacaaaaggaaaatgaccaatacatcttcacaggtcaaccactaaataatgatgaagatcatgctcattggacagaggcaaaaatgttattggataatataaacactccagaaggtattatcccagcgctattcgaacccgaacgtgaaaaatcagctgcaattgatggcgaatatcgccttaaaggagaatctagaaaaacattcgtagaactgatgcggcgtggggacttaccagtatggctagcacataaagttgcttcggaaggaatcaagtacactgatcgaaaatggtgtttcgatggccaaagaaacaatcaaatcttagaagaaaacatggatgtagagatttggacaaaagagggagagaaaaagaaactgcgtcctagatggctagacgctaggacgtatagtgacccgctagccttgaaagaatttaaagatttcgcagctggtagaaaaagtattgcattagatttagtgacagaaataggaagagtaccttcacacttagcacatagaacacgtaatgcgttggataacctagtcatgctacatacctccgaacatggtggtcgcgcatatcggcatgcagttgaagaactaccggaaacaatggaaaccctattacttttggggttgatgatactattgacaggaggtgctatgttgttcctgattagtggtaaaggaatcgggaaaacctcaatcggtttaatttgtgtcatagcctctagtggaatgttatggatggcagaaatacctcttcaatggatagcatcagcaatagtcctagagttctttatgatggtattgctcattcctgagcctgaaaaacaaaggacaccccaagacaatcagctagcttatgttgttatcggcatattaactctcgcagcgataatagccgcaaacgaaatgggactgttagagactactaaaagagatctgggcatgtcaaaggatccaggcgtcgtgtcacccacgagttacttggacgtggacctgcaccctgcctctgcttggacattatacgcagtagcgaccactgttataacacccatgctcagacacacaatcgaaaattcaacggcgaacgtcagcctggcagcaatagcaaatcaagccgtagtgttaatggggttggataaaggttggcctattagtaaaatggatttaggcgtaccgctcctagccttaggatgctattcgcaagttaacccgctaactctaaccgcagctgttttgcttttaataacacactacgcaataattggaccgggtctacaagcgaaagctacaagagaagcacaaaagaggacagcggctggaattatgaaaaacccaacagtagatggaattatgacgatcgacttagatccagtaatctatgactcaaaattcgagaagcaactgggtcaagtaatgctcctagttctatgcgccgtacaattattattaatgaggaccagctgggcactatgcgaagcactaacactcgcgacaggcccaattactactttgtgggaaggatcaccgggaaagttttggaatacaacgatcgcggttagtatggcaaacatatttcggggaagttatttagcgggtgcaggattggccttcagtattatgaaaagcgtaggtactggtaaaagagggacaggaagccaaggagaaactttaggagaaaaatggaagaaaaagttgaaccaactttcccgaaaagagtttgatctatacaagaagagtggtataacggaagttgatagaacggaagcaaaagaaggtttaaaacgaggagagattactcatcatgcagtctcgagaggctcagcaaaactccaatggttcgttgagcgcaacatggtcattcctgaggggagggtgatcgacttaggatgtggccgtggtggttggtcctactattgtgcaggtctaaagaaggtcacagaagtacgtggctatacaaaaggcgggccaggacacgaggaaccggtcccgatgagcacttatgggtggaatattgttaaacttatgagtgggaaggatgtgttttatttaccaccggaaaaatgcgatacactgttatgcgacataggcgaaagcagtcctagtccaacagtagaagaaagccgaacgattagagttcttaaaatggtcgagccttggctcaagaataatcagttttgtattaaggtcctcaatccatacatgccgacagtaatagaacacctagaacgactacaacgcaaacatggaggtatgcttgtgcgaaatcctttatccagaaattccactcatgaaatgtattggatatcgaacggaaccggtaatatagttgcatctgtaaatatggttagtcgtttactcctaaatagatttacgatgactcatcggcgacctacaatcgaaaaggatgtcgatcttggcgcaggcaccagacacgttaatgccgaaccggaaacaccaaatatggatgtcataggagagagaataaaaagaatcaaagaagaacacaatagtacttggcattacgatgacgaaaatccatataaaacatgggcgtaccatggatcatacgaggtaaaagcgacaggtagtgcttcttccatgataaatggcgtggtcaaattattaacaaagccatgggatgtcgtgccaatggtaacgcaaatggcaatgacagacacaacaccttttggacagcaaagagtttttaaggaaaaagtagatactcgtactccccgatcaatgccaggcacacgcagagtaatgggaataactgcagaatggttatggagaacattaggaaggaataagaaaccccgtctatgtacgcgagaagagttcaccaagaaagtcaggacaaatgcagcaatgggtgctgtgttcacagaagagaaccagtgggattcagcgaaggccgctgtagaagatgaagatttctggaaacttgtggacagagaaagggagctacataaattaggaaaatgtggttcatgtgtatacaacatgatgggaaagcgagagaagaaattaggcgaatttgggaaagccaagggctcacgcgctatctggtatatgtggctaggtgccagatacctagaatttgaagcattggggttcctaaacgaggatcattggtttagtagagaaaattcatattcaggagttgagggagaaggtttacataaacttggttatattctccgtgacatttcgaaaatccccggtggagcaatgtacgcagatgacacagctggatgggatacccggattacagaagatgatttgcacaatgaggaaaagatcacgcaacaaatggatccagaacatagacaactggcaaatgcaatatttaaattgacttatcaaaataaggttgtgaaggtacaaagacctactccaacagggactgtgatggacataataagtagaaaagatcaaagaggatccggacaggttggtacctatggacttaatacttttacaaacatggaagcgcagttaatacgccaaatggaaggcgaaggggtcttgtctaaagcagatttggagaatcctcatctgccggagaagaaaattacgcagtggctagaaacgaaaggtgttgaaagattgaaacggatggctatcagcggggacgactgtgtagtaaagccaatagacgatagattcgcaaacgcactattagcactaaatgatatgggaaaggtaagaaaggatataccccaatggcaaccatctaagggttggcatgattggcaacaagtgccgttttgtagtcatcacttccatgagttaattatgaaggatggacgcaagctagtggtaccttgtaggccccaggacgaattaattggccgagcacggatatcacaaggtgccggctggtcgttacgtgaaacggcttgcctgggaaaagcatatgcccaaatgtggtcgttaatgtatttccatcggagagaccttagactggcatccaacgccatctgctctgccgtcccagtgcactgggtaccaacctcacgaacaacttggagtatacatgctcatcatcagtggatgacaactgaagacatgctaacagtatggaaccgcgtatggattgaagataatccgtggatggaagataaaactccagtaacaacatgggaaaatgtaccatatctaggaaaaagagaagatcaatggtgcggttctctaataggcttaacttccagagcgacgtgggctcaaaacataccaacagcaatccaacaagtccgctcattaataggcaatgaagagtttctcgactacatgccctctatgaaacgattccgaaaggaagaagaatcagaaggtgccatatggtaa

SEQ ID NO: 23020 - RNA, 9873 nt, synthetic construct
  misc_feature 1..9873: note = derived and/or modified CDS sequence (opt6) from DENV-3__KF041259__SS-prME
  source 1..9873: mol_type = other RNA
acctcactatgcttaatgatgatactgcctgcggcgctggccttccatcttacttcaagggatggtgaacccaggatgattgttgggaaaaacgaaaggggtaaatctctactatttaaaaccgcgagcggaataaacatgtgtacactaatagcaatggacctaggagaaatgtgcgatgatacagtaacctacaaatgcccccatataaacgaagtcgaacccgaagatatcgattgttggtgtaacttgacatccacatgggtaacatatggaacatgcaatcaagcaggagaacacaggagggataaaagaagcgtagcattagcaccgcatgtaggaatgggactagatacaaggacgcaaacgtggatgtccgccgaaggagcttggcgacaagtagaaaaagtggaaacctgggctttacgtcatcctggatttactatattggccctgtttctcgcacactatattggtacaagtttaactcaaaaagttgttatcttcatcctattaatgttagtaacaccttcaatgacaatgcgatgtgtaggagtaggaaatcgtgattttgttgaagggctttccggagcgacttgggttgatgttgttctcgagcatggtggctgcgtaacgacaatggccaaaaataaacctacattggacattgaactacagaaaactgaggcaacgcaattagctaccctcaggaaattatgcatagaaggtaaaattacaaatataacgacagactccaggtgcccgacacaaggagaggccgtactccccgaggaacaagatcaaaattacgtttgcaaacatacatacgtggatagaggatggggaaacggatgtggcctcttcggaaaaggctctctagttacatgtgccaaattccagtgtcttgaacccattgaaggaaaagtggtgcaatatgaaaatctaaaatacacagttataataactgtacatacaggtgaccaacatcaagttggcaatgaaactcaaggggttactgcagagataacaccgcaagctagcacaactgaagccatactacctgaatatggaacgctcggattagagtgctcaccaagaacaggtctagattttaatgaaatgattctcctaacaatgaaaaataaagcatggatggttcaccgacaatggttctttgatctccccctaccttggacaagtggcgctactacagaaactccaacgtggaatcgaaaagagcttctcgtaacatttaaaaacgctcatgctaagaaacaagaggtcgtagtcctaggatcgcaagaaggagcaatgcacacggcattaacaggcgctacagaaatacaaaatagtggcggaacatcaatatttgcagggcatttgaaatgtcgcctcaagatggacaagctagaactaaaaggaatgagttacgctatgtgcacaaacaccttcgtactcaaaaaggaggtaagtgaaacacagcatggaacaatacttattaaagtagaatacaagggggaagatgcgccatgtaagatcccattttcaaccgaggacggtcaaggcaaagcccataatgggcgcctgataactgccaatcccgtagtgacgaagaaagaggaacctgtaaatatagaagcggaaccgccattcggagaatcaaatatagtaattggtataggtgacaatgcgttgaagattaactggtacaagaaaggctctagtatcggaaagatgtttgaagccactgcaagaggagccagacgaatggcaatacttggagatacggcttgggattttggatcagtaggaggtgtactgaactcattagggaaaatggtacaccaaatatttggctcagcatatactgcgctcttttcaggtgtaagctgggtcatgaaaattggaataggcgttctcctcacgtggataggtttaaattctaaaaatacttctatgagttttagctgtatcgctataggtatcataaccctatatttaggggctgtagtgcaagcggacatgggttgcgtcattaactggaagggcaaagaattgaaatgcggtagcggcatatttgtaactaacgaagtacacacttggacggaacaatataagtttcaagcggattcccccaagagactagccaccgctatcgctggtgcgtgggaaaacggagtatgcggcataagatcaacaactaggatggaaaatttactatggaagcagatcgcaaacgaattaaattatattttatgggaaaacaacattaaacttaccgtagttgttggggatacgataggggttcttgaacaaggaaagagaacactaacaccccaaccaatggaattaaaatattcatggaagacatgggggaaagctaaaatagtaactgctgagactcaaaattcaagttttatcatagatggacctaatactccagaatgtccatctgcatcgcgagcgtggaatgtgtgggaagttgaggactatggctttggagtatttacaacaaacatatggctaaaacttcgagaagtatatactcaaatgtgcgatcatcgcctgatgagtgcagccgtgaaagatgaaagagctgtacacgctgacatgggatattggattgagagtcagaaaaatggcagctggaaactagaaaaagctagtttaattgaggtcaaaacatgtacgtggcctaaatcccatactctctggagcaatggagtacttgaaagtgacatgataattccaaaaagccttgctggtcccattagccaacacaattaccgacctggataccatacccaaacggctggaccatggcatttaggaagattagagttggattttaattattgcgaaggtaccacagtagttatcacggaaaattgcggaacgagaggcccatccctacgcactacgactgtttccggaaagctaattcatgagtggtgttgcagaagctgcacactaccaccccttagatatatgggagaagatgggtgttggtacggaatggaaattagacccatcagtgaaaaagaggaaaacatggtaaagagcttggtttctgctggctctgggaaggttgataatttcacaatgggagttctctgtcttgctatattattcgaagaggttatgcgaggtaaattcggcaagaaacatatgattgctggtgtgttctttacatttgtgttgttgctaagtggtcagataacgtggagagacatggcacatacacttataatgatcggaagtaatgcaagtgaccgcatgggaatgggggtgacctatctggctctcatcgctacatttaagatacagccatttcttgcgttaggtttctttctaaggaaattaacgtcacgagaaaatttgttactgggcgtaggcttagcaatggcaacaaccttacaacttcccgaggacattgaacagatggccaacggaatagctttaggactaatggccctcaaactaataactcaatttgaaacctaccaattatggacagcgcttatttcactaacttgttctaacactatctttacactaaccgtagcatggcgtactgctacactgattctagctggagtttcacttttacccgtatgccaatcctcttccatgagaaaaactgactggttgccgatgacagtagctgccatgggtgtaccacctctacccttatttatattctcgctaaaagatacccttaaacgacgaagctggccattaaatgagggtgtcatggccgtaggcttagtgtcgatacttgcaagtagtcttctaaggaatgatgttccaatggctggacccttggttgccgggggcctcctgatagcctgttacgtaatcacaggcacgtcagctgatcttactgtcgaaaaagcagccgatgtaacttgggaagaagaggcagagcaaacaggcgtctctcacaatctaatgataacggtcgacgatgacggaaccatgagaataaaagacgacgaaactgagaacatactaaccgtattattgaaaacagctctcttaatcgtttcaggtatttttccttattcaattcccgcaaccttactcgtctggcatacctggcaaaagcaaacacagagatcaggagtcctttgggatgttccttcaccacccgaaacacaaaaagctgaattagaagaaggtgtatatcgtattaaacaacaaggaatcctaggaaaaactcaggtaggtgtcggagtccaaaaagaaggggtattccacaccatgtggcatgttacccgaggagcggttcttactcataacgggaaaagactagagccaaactgggcatcggtgaagaaagacttgattagttatggagggggatggagattgtcggcacaatggcaaaagggtgaagaagtacaagtaattgcagttgaacccggcaaaaaccctaaaaacttccaaactatgcccggcacttttcaaacaactacaggagagatcggagcaatcgcgttagatttcaaaccgggcacttcaggatctcctattataaatagagaaggtaaagtggtgggattatatggaaatggagtggtgactaaaaatggaggatatgtgagtggcatagcccaaactaatgcagaacctgatggtcccaccccagaactggaagaagaaatgtttaagaaacgaaaccttacaataatggaccttcatccggggagcggaaaaacgaggaagtaccttccagctattgtcagagaggctattaaacggaggcttagaacacttatactcgcacccacacgagtcgtggcagcggaaatggaagaagctctaaaaggtttacctataaggtatcaaaccacagcaacaaagtcagaacacacaggaagagaaatagtagatttgatgtgtcacgcaacattcacgatgagattattatccccggtaagggtcccaaattataatttaatcataatggatgaggctcattttactgatccagcctctatagcagcgcgaggatatatttccacccgtgttggaatgggggaggcagctgcaatcttcatgactgcgacaccaccaggtacggcggatgcgtttccacaaagcaacgctcccatccaagatgaagaacgcgatatccccgaacgatcttggaactccgggaatgaatggataacggactttgcaggaaaaacagtctggttcgtaccgtcgataaaggctggaaacgatatagccaattgcctaaggaagaatggcaagaaagtaattcaactcagtagaaagacttttgacacggaatatcagaaaactaagttgaacgattgggattttgttgttaccacagatataagcgaaatgggagccaactttaaagctgaccgagtaatagatcctcgtcgatgcttgaaacccgtaatactaactgatggaccagaaagagttatcctcgcgggaccaatgcccgtaacagcagcaagtgctgcacaaagaagagggagagtaggtcgtaacccccaaaaagaaaatgaccaatatatttttacgggccaacccttaaataatgacgaagatcatgcacactggacagaagcaaaaatgctcctcgataatattaatactccagaaggtatcatcccagcgctatttgagccagagcgcgaaaaatcagcggctattgacggagaatatcgattaaaaggtgaaagtcgcaaaacattcgtagaactgatgagaagaggtgatttaccggtttggctcgcgcataaagttgcatcagaaggtataaaatatacagatagaaaatggtgctttgatggacaacgaaacaatcaaatactagaagaaaatatggatgtcgagatttggactaaagaaggggaaaaacgaaaattacgtcctaggtggttagacgctagaacttattccgacccccttgcactaaaagaatttaaggactttgcagcaggccgtaagtctatcgcattagatcttgttacagaaattggtagggtgccatcgcatctggctcatcgtactcgaaatgctctcgacaatctcgtgatgttacatacgtcagaacacggtgggagagcatacagacatgctgtagaagaattgcccgaaacaatggaaaccttgttgctcctgggcttaatgatcctattaacagggggagcaatgctctttttgataagtggaaaaggaatcggaaaaacgagtattggcttaatatgtgtgattgcgagctctggtatgctatggatggctgagatccccctgcagtggatcgcatcggcaatagtactcgaatttttcatgatggtcctattgatccccgaacctgagaaacaacgaacaccccaggacaatcaattagcgtatgtagttataggtatactaactctcgcagctataattgcagctaacgaaatgggattattagaaacaactaagcgagatctggggatgagtaaggaaccaggagtggtatctccgacttcttacttagatgttgacctacacccagcgagtgcttggactctatacgccgtagcaactacagtaattaccccaatgctgagacatactatcgaaaatagtaccgcaaatgtaagcctcgcagccattgcaaaccaagcagttgtattaatgggattggacaaaggttggccgatatccaaaatggacctcggcgtccccctattagcattgggatgttattcacaggtcaaccccctaacattaacggctgcagtgttacttctgattacccactatgcaataattggtccagggctacaagcaaaagctaccagggaagcacagaaaagaaccgcagcaggaataatgaaaaacccgacagttgacggcataataacgatagatctcgaccctgtaatctacgactcgaagttcgaaaaacaactaggacaggtcatgttacttgttttatgtgccgtacaactcctattaatgcgcacatcttgggctttgtgtgaagccttgacattagcaacgggaccaataactactttgtgggagggcagcccaggtaagttttggaatactacaatagcagtttctatggcaaatattttccgaggatcctatctagcaggagcgggtttagcatttagtatcatgaagtcggtgggcactgggaagagaggcaccggaagtcaaggagaaactttaggggaaaaatggaagaagaaattaaaccagctaagtcgcaaagagtttgacttatataagaaatcaggaattactgaagtcgacagaacagaggcaaaggaaggattaaagagaggcgaaacaacacatcatgctgtctcgcgaggtagcgcaaaattgcaatggttcgtcgaaaggaacatggttatcccagaaggcagggtcatagatttaggctgtggcagaggagggtggtcatactactgcgcagggctcaagaaagtaacagaagtaagaggatataccaaaggtggaccaggccatgaagaacctgtaccaatgtcaacatacggatggaatatagtaaaacttatgagcggtaaggatgtattttacttaccccctgaaaaatgtgatacgttactatgcgatataggggagtctagtccatcaccaacagtagaagaaagcaggacaataagggtcctgaaaatggtggagccgtggctgaaaaacaatcagttctgcataaaagtgctaaatccatatatgcctgcagtaatagagcatttagaaagactacagagaaaacatgggggaatgctggttcggaatccattgagtcgaaattcaacacacgaaatgtattggatatcaaatggcacaggcaatatcgtaagctcagttaacatggtcagccgacttctcctcaatcgttttaaaatgacgcatcggagaccaacgatagaaaaagatgtggacttaggagcagggacacgacacgtaaacgctgaacccgagacgcctaatatggatgtaattggtgaaaggattaaacggataaaagaggagcataattctacatggcattatgacgacgagaatccatataaaacttgggcctatcacggttcgtatgaagttaaggctacaggctctgcttcaagcatgatcaatggagtagttaaacttctaaccaagccatgggacgtagtaccaatggttacgcaaatggctatgactgatacaacaccatttggtcaacaaagagtatttaaagaaaaagttgatacacgtacgcccagaccaatgcccggtacacgaaaagtaatggaaatcaccgcagaatggctttggagaacacttggtcgaaacaaaaggccaaggctatgtactcgagaagagttcactaagaaagtgagaacaaatgctgctatgggagcggtatttacagaagaaaatcaatgggattcggcaaaggcggccgtagaggacgaagagttctggaagctagtagatcgagaaagagaattacacaaattaggcaaatgtggatcatgtgtctacaacatgatgggcaagcgcgagaaaaagctgggggagttcgggaaggctaaaggatcccgtgccatttggtatatgtggttaggagctcgatatctggaatttgaagcacttggcttcctaaatgaagaccattggttctcacgtgaaaatagctactctggtgttgagggagaaggactacataaacttggatatatactaagggacataagtaaaattccaggaggggcaatgtatgctgatgatacggccggctgggacacaagaattactgaagacgacttacataacgaggagaaaataacacaacaaatggatcccgagcaccgtttattagctaacgccatatttaaattgacctatcaaaataaagtagtgaaggtgcaacgcccgacccccacagggaccgtcatggacatcatatcaagaaaggatcaacggggttctggtcaggttggtacatacggactgaatactttcacaaacatggaagcgcaattggtacgtcaaatggaaggtgaaggtgtactaagtaaagcagacctcgaaaacccccacttaccagagaagaaaatcacacaatggcttgaaactaagggcgttgagcgcctaaagcgtatggcaataagcggtgacgattgtgtagtgaaacctattgatgaccgattcgccaatgcacttttggcccttaatgacatggggaaagtgagaaaagatataccccaatggcagccatcaaaaggatggcatgactggcaacaggttccattttgttcacaccatttccacgaactaataatgaaggatggtaggaaactcgtcgtaccatgccgtccacaggatgagctaatagggcgagcaagaatcagtcaaggggcagggtggagcctaagagagacagcatgcttaggcaaggcttacgcgcaaatgtggtcacttatgtattttcatagacgcgatcttagactagcaagcaatgcaatttgttccgcagtaccggttcattgggtaccaacctcacgcacaacatggtctatacatgcccatcatcaatggatgacaactgaagacatgttaactgtctggaacagggtctggattgaagataatccttggatggaagataaaactccagtgactacttgggaaaatgtaccatatctaggcaaacgagaagaccaatggtgtggaagtttaataggactcacaagtcgcgcaacatgggcccaaaatattccaacagcaatacaacaagtgcgttccctcattgggaacgaagagttccttgattatatgcctagtatgaaacgcttcagaaaagaagaggaactcgaaggggctatctggtag

SEQ ID NO: 23021 - RNA, 9873 nt, synthetic construct
  misc_feature 1..9873: note = derived and/or modified CDS sequence (opt6) from DENV-3__KF041258__SS-prME
  source 1..9873: mol_type = other RNA
acttccttgtgtttaatgatgatactcccagctgctttagcatttcatttaacgtcacgcgatggggaacccagaatgatcgttggcaaaaacgaacgcggtaagagcttattgtttaaaactgcgtctggtataaacatgtgtactttaatagcgatggacttaggcgaaatgtgcgacgatactgtaacatataaatgcccacatataacagaagtagaaccagaagacatagattgttggtgcaacttaacaagtacttgggtcacttacggaacttgtaaccaagcaggcgaacatcgacgtgacaagagaagtgttgctttagcgccacatgtaggaatgggtttggacacacgaacacaaacgtggatgagcgccgagggggcatggagacaagttgaaaaagttgaaacatgggcattacgtcatccaggattcactatattagccctattcttagctcactacattggaaccagtttaacccaaaaagtggttatatttatactactcatgctagttaccccgtcaatgactatgcggtgtgttggcgtaggtaatcgcgactttgtagaaggactaagtggcgcaacatgggtagacgtagtactggaacacggcggctgcgttacaacaatggccaaaaacaaacctacgctagatatagagctacagaaaaccgaagcaacccaactcgcaaccttacgaaaactttgtatagaaggaaaaataaccaacataacaactgacagcagatgcccaacgcaaggagaggcagtgttgccggaagaacaagaccaaaattatgtctgtaaacatacatacgttgacagaggatggggtaacggttgcggcttatttggcaaaggttctttagtaacgtgtgccaaatttcaatgtcttgaacccatagaaggcaaagttgtacaatatgaaaacctaaaatatactgtgattattacagtacacacgggggatcaacatcaagtcggaaacgaaacccaaggcgtgacggctgaaataacaccccaggcttcgactaccgaagcaattctaccggaatatgggacactaggactagagtgttcgccccgtactggccttgattttaacgaaatgatattgctaacaatgaaaaacaaagcatggatggtacacaggcaatggtttttcgatttgccgttaccatggacaagtggggcaacaactgaaactcccacatggaatcgtaaagagctgttagtaaccttcaaaaacgcgcatgccaagaaacaagaagtagttgtcttaggtagtcaagaaggagcaatgcatacagcgttgacaggtgctacggagatacaaaatagtggaggaacttctatttttgcgggacacctaaaatgcagattaaaaatggacaagctagaactaaaaggaatgtcatatgcaatgtgcactaacacattcgtactgaaaaaggaggtttcagagacacagcatggtactatcctgattaaagttgaatacaaaggcgaagatgctccctgcaaaattccgttttcaactgaagacggacaaggaaaagcacacaacggacgacttataacagcgaatcctgtagtaactaagaaagaagaaccagtcaacatagaagcagaaccacccttcggagaatcgaacatagttatcggcataggtgataacgcactaaagataaattggtataaaaagggtagctctattggaaaaatgttcgaagccacggcaagaggtgctagaagaatggcaatattaggagacactgcctgggacttcggtagtgtcggtggcgtcttaaattctctaggcaaaatggtccatcagatctttggaagtgcttatacagccttattttcgggggtaagctgggtcatgaaaattggaataggcgtactattaacttggataggccttaattcgaagaacacaagcatgtcattttcttgcattgcgatagggatcatcactttgtatctaggagcggtcgtacaagccgatatgggatgcgtgataaactggaagggaaaagagcttaaatgcggaagtggtatcttcgtcacaaatgaagtgcacacgtggaccgagcaatacaagtttcaagcagattcaccgaaacgccttgcaacagccatcgcaggagcttgggaaaacggggtatgtggaataagatctactactagaatggaaaatctcttatggaaacaaattgccaatgagttaaattacatactctgggaaaacaacattaagctcacggttgtagtcggagacacaataggcgtattagagcagggcaagagaacgttaacgccacagccaatggaactaaagtactcatggaaaacatggggcaaagcgaaaatagtcacagcggagacccaaaattctagcttcattattgatggacctaatacgccagaatgtccttcagcaagtagggcttggaatgtatgggaagtcgaagattacggatttggtgtatttacaacgaacatatggttaaaactaagggaagtttacacacagatgtgcgatcatcgattgatgagcgccgcagtcaaagacgaaagagccgtgcatgcagacatgggatattggatagaatcccaaaagaatggctcatggaaattagaaaaagcatcattaattgaagtaaaaacgtgtacctggccgaaaagccataccctatggtctaatggagtactagaatcagacatgataataccaaagagtctagcgggaccaataagtcagcataactatagacccggctatcatactcaaaccgccggtccgtggcaccttggcaaactggaactagacttcaactattgtgaaggcacaacagtggtaataacagaaaattgcggcacaaggggaccgtctttaagaactactactgttagtgggaagctaatacacgaatggtgttgtagaagctgtacgcttcccccattacgctatatgggagaagatgggtgctggtacggaatggaaattagacctataagcgaaaaagaggagaacatggtgaaatccctagtttctgccggatccggtaaagttgataatttcactatgggagtactctgtctcgcaatattatttgaagaagttatgcgaggtaaatttggtaagaaacatatgattgcgggggtattctttacctttgttttgttattgtctggacaaataacctggcgtgatatggctcatactttaataatgattggatcaaatgcgtccgatcggatggggatgggcgttacatatctggcattaatagcaacatttaaaatacagcctttccttgctctaggatttttcctaagaaaactaactagccgcgagaaccttctactgggcgtgggactggccatggcaactacgctacagctaccagaagacatagagcaaatggcgaatggcatcgctctagggctgatggcattgaagctcatgacacaatttgaaacttatcagctatggaccgcattaatatcattaacttgttccaatactatcttcacgctaacagtggcttggcgaactgccacactcattttggcaggcgtatcgttattacctgtatgccaatcctcaagtatgcgtaaaacagattggctgccaatgactgtcgctgcaatgggagtacctccacttccgttgtttatcttctccttgaaagatactcttaaacgcagatcatggcctctaaatgagggggttatggctgtgggcctcgtaagtatcttagcgagtagcttactcaggaatgacgtcccaatggcgggaccattagtagcaggcggacttttaattgcatgctatgtaatcacaggtacgagtgcagatttaacagtggaaaaagcagcagacgtaacatgggaagaagaagctgaacaaacaggagtatcgcataatttaatgataacagtcgatgacgatggcacaatgaggattaaagatgatgaaaccgagaatatattgacggttctactaaaaactgctcttttaattgtaagtggaatttttccttattcaatacccgcgacattattagtttggcacacttggcagaaacaaacgcaaagatctggcgtcttgtgggatgtaccaagtcctcctgagacacaaaaggcggaacttgaggagggagtatatcgtataaaacaacaaggaatactaggaaaaactcaggtaggagtcggcgtacagaaagaaggcgtatttcatactatgtggcatgtaactagaggagcagttctaacacacaatggaaaaagattagaacctaactgggcatctgttaagaaagatctaatctcctatggaggaggatggcgtctcagcgcgcaatggcagaagggagaagaggtccaagtaattgctgtcgaaccaggtaagaatcccaaaaatttccaaacaatgcctggtacatttcaaacaactacgggcgaaattggtgcgatagctttagattttaagcctggaacctccggttcacctataatcaatcgagagggaaaagttgttggactgtacggaaacggtgtagttacgaaaaacggcggatatgtaagtggtattgctcaaacgaatgctgagcctgatgggcccactccagagttagaagaagaaatgttcaagaaaagaaatctcacaatcatggatttgcatcctggatccggaaagaccagaaaatatctaccagctatagttcgtgaagcaataaaacgaaggctacgaacactaatattagcccccacgagagtggtagccgcagaaatggaagaggccctaaaaggacttccaataaggtatcagactacagccaccaaatccgaacacactggcagagagattgttgatttaatgtgccatgctacgttcactatgagattactttcgccagtacgcgtgcctaattacaatctaattattatggacgaggctcactttacagacccagcatcaattgctgctaggggctatatatcaacgagagtaggcatgggtgaagcagctgcaattttcatgacggctacaccgccgggtactgctgatgcttttccccaatccaatgcaccaatacaagatgaggaaagagatatcccagagcgctcttggaactcaggaaacgagtggattacagattttgcgggcaaaactgtatggttcgtgccttccattaaggccggaaatgatattgcgaactgcctaaggaaaaacggcaagaaggtaatacagctttcaagaaaaacatttgatacggaatatcagaaaaccaagttaaacgactgggactttgttgtaactacagatatcagtgaaatgggggccaatttcaaagcggatagggtaatagatccccgacggtgtctaaagcccgttatattaactgacggacctgagagggtgatattagcgggccctatgccggtaacggctgcaagtgcagcacagcgtagggggagagtcggaaggaacccgcaaaaggaaaatgaccaatacatattcaccggacaaccattgaacaatgacgaagatcacgcacattggacagaagccaaaatgttactagacaatatcaacacacctgagggaatcatacctgccttatttgagccagaacgagagaagtccgccgcgatagacggagagtatagacttaaaggcgagagccgcaaaaccttcgtagaattgatgcgcagaggtgatctaccggtttggttagcacataaggtggctagtgaaggaataaagtatactgacagaaaatggtgttttgatggacaaaggaacaaccaaatactagaagagaacatggacgtggaaatctggaccaaggaaggagagaaaaggaaacttaggccacgatggctggatgcgagaacatattctgatccgctcgcgttaaaagaatttaaagatttcgcagctggtcggaaaagtattgccttagacctagttacagaaataggccgtgtaccatcgcacttagctcataggactaggaacgcactggataatctagttatgctccacacaagtgaacatggaggccgagcgtataggcatgcagtagaagaacttccagaaactatggaaacattattactgctcggactcatgatattactaacaggaggagctatgctttttctaataagtggtaaaggaataggcaaaacaagtattggattgatatgcgttatagcaagctccggtatgctgtggatggcagaaataccactacaatggatagcgtcagcaatagtacttgagttctttatgatggtgcttctaatcccggaaccagaaaagcaacgaactccacaggacaatcaacttgcctatgttgtaataggcattctaacgttagctgcaataatagccgcaaacgaaatgggtttgcttgaaaccactaaaagagacttaggtatgtctaaagaaccaggcgtggtctcgcccacctcatatcttgacgttgatttgcaccctgcgagcgcttggacattatatgcggtcgcgacgacggtaataacccctatgctaagacacacgatcgaaaattcgaccgccaatgtgagtttagcagcaattgcaaatcaagccgtggtattgatgggtcttgacaaaggttggccgatttcaaaaatggaccttggagtacccctactggcattagggtgttatagtcaagttaacccactaacgctaacagcagcagtcttattactcataactcattatgctatcattggacccggacttcaagcaaaagctactagggaagcacagaaaagaaccgctgcgggcataatgaaaaatccaaccgtcgacggcatcataacgattgacctggacccagtcatttatgattctaagtttgaaaaacagttaggacaagtgatgctcttggtactatgcgccgttcaactcttactaatgaggacatcatgggctctatgcgaagcgctgacactagcaaccggtcctatcacaacattatgggaaggatcgccgggtaaattttggaatacgactatcgcagtgtctatggcgaatatctttagaggatcctatctcgcaggcgctggcctagcttttagcatcatgaagtcagtgggcactggaaaacggggaacagggagtcaaggagaaacattaggcgaaaaatggaagaagaaattgaatcaactctctagaaaagaatttgatctttacaagaaatcaggaatcaccgaagtggatagaactgaagcaaaagagggcttaaaaagaggagaaactacacaccacgcagtcagtcgtggatcagcaaaattacaatggtttgttgaacggaatatggttatcccagaaggtcgggtaattgacttaggatgcggaagaggtggttggtcctattattgtgctggcctgaaaaaggttactgaggttcgaggctataccaaaggagggcctggacacgaagaacccgttccgatgtcaacatatggatggaatatagtgaaactaatgtcaggaaaagacgtcttttatttacccccagaaaaatgtgacacattgttatgcgatattggagaaagctcgccgagccctacagtagaagaaagccgcacaataagggtacttaaaatggtagaaccctggctgaaaaataaccaattctgtatcaaagtactcaatccctacatgccagctgtaatagaacaccttgagcgactacagcgcaagcatggcggaatgctagtacgcaatcctttgtcccgcaactctacacacgaaatgtattggataagtaacgggaccggtaatatagttagttccgtaaatatggtaagtaggctactgttaaatcgtttcactatgacacatcgacgtccaacaatcgaaaaagatgtcgatctaggagccggtacacgccacgtgaatgcagaaccggaaacacctaatatggacgtcataggtgagaggataaaaagaattaaggaagaacacaattcaacatggcactatgatgatgaaaacccctacaaaacgtgggcttatcatggttcttatgaagtgaaagcaactgggtctgcctcctctatgattaacggggttgtgaaactcctaacaaaaccatgggatgtggtaccaatggtgactcaaatggcaatgacagataccaccccctttgggcaacagagggtatttaaggagaaagtcgatactaggacaccgcgtcctatgcctggaacaagaaaagtaatggaaatcacagcagagtggctgtggcgcactctcggtcggaataagagacctcgattatgcactcgagaagaatttacgaagaaagttagaacgaatgccgcaatgggtgctgtattcacggaagaaaaccaatgggatagtgcgaaagcagcagtcgaagacgaggaattttggaagctggtagaccgggagagagaactacataaactgggtaaatgtgggtcatgcgtctataatatgatgggtaaacgcgaaaagaaactcggtgagttcggaaaagccaaaggatcaagagccatatggtatatgtggctcggagcacgatacctagagtttgaagctctcggattcttaaacgaagaccactggttcagtcgagaaaacagttactctggcgtcgagggggagggattacataaactgggatatgtgctaagagatataagtaaaatacccgggggtgccatgtatgctgatgatacggcaggatgggatacaaggattacagaagacgacttgcacaatgaggagaaaatcacccaacagatggatccagaacataggttacttgcaaatgcaatcttcaaactaacttaccaaaataaagtggtaaaagtgcaacggccaacacccacaggaactgtcatggatatcatatcacgaaaggatcaacgtggaagtggacaagtcggtacatacggacttaatacatttactaatatggaagcgcaattagtaagacaaatggaaggcgagggagttctatcaaaagcagacttggagaacccacatttgcctgagaagaaaattacacagtggcttgagacaaaaggtgtcgaaagattgaaaagaatggccatttcaggcgacgattgtgtggtaaaaccgatcgatgatcgcttcgcgaatgccctactggctttaaacgacatgggcaaagtaagaaaagatatccctcaatggcaaccatcgaaaggctggcacgactggcaacaagtaccattttgtagccaccactttcacgaacttattatgaaagacggacgaaagttagtcgtaccctgtagaccccaagacgaactgattgggagagctcgtatatcacaaggcgccggatggagtttacgtgaaacagcatgtctgggaaaggcttatgcacaaatgtggagtttaatgtatttccatagaagagatcttagactagcctctaacgccatatgctcagcggtaccagtacattgggtaccgacgagtaggactacctggagtattcatgcacatcaccagtggatgactactgaggatatgctaacagtttggaaccgagtatggattgaagataacccttggatggaggacaaaacacccgtaacgacatgggaaaatgtgccatatttgggcaagcgagaggatcaatggtgtggaagtttgatcggattaacatctcgtgcaacttgggcgcagaacatccctactgcaatacagcaggttagatccttgattgggaatgaagaatttttagactacatgccctcgatgaagagattcagaaaagaagaagagttggaaggggcaatatggtaa

SEQ ID NO: 23022 - RNA, 9873 nt, synthetic construct
  misc_feature 1..9873: note = derived and/or modified CDS sequence (opt6) from DENV-3__KF041257__SS-prME
  source 1..9873: mol_type = other RNA
acctcattatgtctgatgatgatattaccagcggcactggcatttcacctaacttcaagagacggggaaccgcggatgatagtgggtaaaaacgaacgtggtaaatcgcttctctttaaaacggcatctgggatcaacatgtgtacgctaatagcaatggacctcggagaaatgtgtgatgacacagtaacctataaatgtccacatataactgaggtggaaccagaagatatcgactgttggtgtaacttaacaagtacatgggtaacatatggaacttgcaatcaagcaggagaacatcggcgagataaacgaagtgttgctctagccccgcatgtgggaatgggattagacacacggacacagacctggatgagtgccgaaggagcatggagacaagttgaaaaagtcgaaacatgggcgttaagacatccaggttttaccattttagccctgtttttagcccactacatcggaacttcattgacgcagaaagtagtaatatttattctgctcatgctggtaactccatctatgactatgcgttgtgtaggagtcggaaatagagacttcgttgaaggacttagcggggccacatgggtagacgtagtacttgagcatggagggtgcgtaacgacaatggctaaaaacaaaccaaccttagatatcgaattacagaaaacagaggcaacacaattagctacattgagaaaattatgtatagagggtaaaataacaaacataacgactgactctcgttgccccacacaaggggaggctgtcttacctgaggaacaggatcagaactacgtctgcaaacatacatatgtagacagaggatggggtaacggttgtggcttatttggtaaaggctctctagtaacatgtgcgaaatttcagtgtctagaaccaattgaagggaaagtggtacaatatgaaaacttaaaatataccgtaatcataacagttcataccggagatcagcatcaagttggcaatgaaacccaaggagtcacggctgaaataacgccgcaagcaagtaccacagaagcaatattaccggaatatgggacgttgggtttagaatgtagtccgcgaaccggactagacttcaatgaaatgattctattaacaatgaaaaataaggcttggatggttcatagacaatggttctttgatctaccactaccatggacgtcgggcgcgaccacggaaactccgacatggaatcgaaaagagctcctagtaacattcaaaaacgcacacgccaagaaacaagaagttgtggtgctaggatcgcaagaaggggccatgcacacagccctgacaggcgctacagaaattcaaaattcgggcggcacaagtatatttgccggacatttgaaatgtcgactaaaaatggataaactagaattaaaaggaatgagctatgcaatgtgtacgaatacctttgtcctgaagaaagaggtatctgaaacgcagcacggcacaatattaatcaaagtagagtacaaaggggaagatgctccatgtaaaatccccttcagtaccgaagatggccagggtaaagcacataatggtcgactaattactgcgaatccggttgtaactaagaaagaggagcccgtcaatatcgaagcagaaccccctttcggtgaatcgaacatcgtaataggtataggtgataatgcattaaaaatcaactggtacaagaaaggttcgagtataggaaaaatgtttgaggctacagctcggggagcaaggaggatggctatcttaggcgacacagcttgggattttggatcagtaggtggagtcttaaatagccttggaaaaatggtacatcaaatctttggtagcgcatacacggcgctcttttctggggtttcatgggttatgaaaataggaataggagtcctactaacctggataggcctaaacagcaaaaataccagcatgtcttttagttgcatcgcgataggaattattacattatatctaggagctgtggttcaagcggacatggggtgcgtaataaactggaaaggcaaagaattaaaatgtggaagtgggatattcgttactaatgaagttcacacatggactgaacaatataaattccaagcggatagtccaaaaagacttgcgacggcaatagccggtgcgtgggaaaatggagtttgcggtattagatcaactaccagaatggaaaacttattgtggaagcaaattgcaaacgaactcaattacatactgtgggaaaacaatataaaattaactgtagttgtaggagacactattggtgtattggagcaaggtaaaagaactcttacgccgcaaccaatggagctaaaatacagttggaagacatgggggaaagcaaaaatagtgacagctgaaacacaaaattcatcttttataatagatggaccaaacacacccgaatgccctagcgccagtagagcatggaatgtttgggaagtcgaggactatggatttggagttttcaccacaaatatctggttgaaacttcgcgaagtttacacacagatgtgtgatcacagactcatgtctgcggcagttaaagatgaacgagctgtacatgcggacatgggatactggattgaatcacagaaaaatggatcttggaaattggaaaaagccagcttaattgaagttaagacttgtacgtggccgaaaagtcatactttgtggtcgaatggagtacttgaaagtgatatgataataccgaagtcactagcaggaccaatctcacaacataattatcgaccaggatatcatacacaaaccgccggtccttggcacctcgggaaactggaactggattttaactactgcgaaggtaccacagtagtcataacggaaaattgcggtactcgggggccaagtttaagaaccactacagtatcaggaaagctcatacacgaatggtgttgtagaagctgtacgttaccaccgctacggtatatgggagaagacggttgttggtacggcatggagattcgacctatttcagaaaaggaagaaaatatggttaaatctttagtttcggccggctcaggcaaggtcgacaactttacaatgggtgttctttgcttagctattctattcgaggaagtaatgagaggaaagttcggcaagaaacacatgatagcaggagtattcttcacatttgtgttattattatcaggccaaattacatggcgagatatggcacacacattgattatgatcggaagtaatgcgagcgatcgaatgggaatgggcgtgacctatctagcattaatagcaacctttaaaatccaaccatttcttgcactaggattctttcttagaaaattaacttccagagaaaatctattgttgggggtcggattggctatggcgacaacacttcaacttcccgaggatatagaacagatggcaaatggaattgctctcggactaatggctcttaaattgatcacacaattcgaaacttaccaattatggacggcactgataagtcttacatgctcaaatactatatttacacttacagtagcctggagaacagccactctgatacttgcaggcgtaagtttgctcccagtatgccagtcatcttccatgcgtaaaacagactggttaccaatgactgtagcagctatgggggttccaccactaccgctatttattttcagtttaaaagacactcttaagcgacgtagctggcccttaaatgagggcgtgatggcggttggcttagtatccattttagccagtagcttactgaggaatgacgtgccaatggcaggacccctggtagcgggaggcctcctgatagcgtgttatgttatcacaggaacctcggcagacctgactgtagagaaggcagccgatgtcacttgggaagaagaggcagaacaaactggagtgtcacataatttaatgataacggtagatgatgatgggaccatgagaataaaagacgatgagacagaaaatatattaacggtcctactaaagaccgcactgttaattgtgtcgggtatatttccatattcaataccagcaaccttattagtatggcacacatggcaaaaacaaactcaaagatcaggagtattatgggacgtaccgagtccaccggaaactcaaaaggccgaattagaggagggcgtctatcgaatcaagcaacaaggaatactaggaaaaacccaagtcggagttggcgtgcaaaaggaaggagtctttcatacaatgtggcacgttacaagaggcgcggtactaacgcataacggtaaaagacttgaaccgaactgggcgtcagtaaagaaagaccttatttcgtatggaggaggatggcgtctatcagcacagtggcagaaaggggaagaagttcaagtgatcgccgttgaaccgggcaaaaatcccaaaaactttcaaacgatgcccggtacattccagactactacaggagaaattggagccatagcattagattttaagccaggaaccagtggatcaccaataataaatagggaaggcaaggtagttggattatacggaaatggagtcgttactaaaaacggaggctacgttagtggcatcgctcaaacaaatgcagaaccagacggtccgacgccggagttagaagaagagatgttcaagaaacgaaacctaactatcatggaccttcatccgggctcgggaaaaactaggaaatacctccctgcaattgtaagggaagcaattaaacgaagattacgaacactcatattagctcccactagggtagtcgcagcggaaatggaagaagcactaaaaggcttacctataagatatcaaacaacagcaacaaaatccgaacacacaggacgcgagatcgtagaccttatgtgccatgcgacttttaccatgcgattattaagccccgttcgagtaccaaattataatttgataattatggatgaagcacactttactgacccagcaagtatagcagccaggggctatataagcacacgagtaggcatgggggaagccgcagctatctttatgacagcaaccccacctggcaccgctgatgcttttccacaatctaatgcaccaattcaggacgaggaacgagatataccagaaagaagttggaactcaggaaatgaatggattacggacttcgctggtaaaactgtctggttcgttccctccattaaggctggaaatgatatagctaattgcttaaggaagaacggcaagaaagtaattcagctaagcagaaagacattcgatacagagtatcagaaaactaaactgaatgactgggacttcgtagtaacgacagatattagcgaaatgggggcaaatttcaaagcggaccgtgtaattgaccctagaaggtgtcttaaaccagttatattaacagacggacctgaaagggtaattctagcaggacctatgcctgtaacagcagcatctgcagcacaaagacgagggagagttggtagaaacccgcaaaaagaaaatgatcaatatatttttacagggcagccacttaacaacgacgaagaccatgcgcattggactgaggcgaaaatgttattagacaatataaacaccccagagggcatcatcccggcgttatttgaaccagagagggaaaagtcagcggcaattgacggcgaatatcggttaaaaggcgaatcgcggaagacctttgttgagttaatgagaagaggtgatttgcccgtatggctggcccacaaagtagcgtcagaaggaataaagtacacggacaggaaatggtgcttcgacgggcagcggaataaccaaattctcgaggaaaatatggatgttgaaatatggaccaaagagggtgagaaacgcaagctcaggcctagatggcttgacgcccgaacgtattcggatcccctcgctctaaaagaatttaaggactttgcagctggaagaaaaagtattgcattagatttagttacagaaataggaagagtaccgtctcatctagctcaccgcactaggaacgcattagataatctggtaatgctacatacttctgaacatggcggaagggcctatagacatgcagtagaggaattacccgagactatggaaactttactacttctaggactgatgatcctattaaccgggggtgcaatgttgtttctaatatcgggtaaaggaataggaaaaacgagcattgggctgatatgtgtaatagcttctagcggaatgctatggatggcagaaatcccactgcaatggattgcatctgcaattgtactcgaatttttcatgatggtgttattgatcccagaaccagaaaagcaacggactccacaagataatcaattggcatatgttgttataggcatactaaccttagcagcaataattgccgcaaacgaaatgggcctgctggaaactacaaaaagagacttaggaatgtcaaaggagcccggcgtagttagccccactagctatttagacgtggatctacatccagctagcgcctggacactatatgcagtcgctacaacagtcatcacacctatgttaagacatacgatagagaatagtacagctaatgtctctctagctgcaatagcaaaccaggcggttgtcttgatggggttagacaaaggttggccaatctcgaagatggaccttggagttcctttgttagcactaggctgctactcccaggttaatccgcttacccttacagccgctgtgctgttactgataacacattatgcaataatcgggcctggtttacaggcgaaagcaaccagggaagcccaaaaacggactgctgcaggtataatgaaaaatcccacagttgatgggatcattacgatagatttggatccagtcatttacgatagcaagtttgaaaaacaactcggtcaagtaatgctattagtgctatgcgctgtgcagctattacttatgagaacaagctgggcgctttgtgaagcgttaacattagctacaggtccaatcactaccttgtgggaaggatcaccaggaaagttctggaacacaacgatcgccgtatcgatggctaatatattccggggtagttatctagctggggctggtttagctttttccattatgaagtcagtcggtacaggcaaaagaggtacggggtcacaaggagaaactctaagagaaaagtggaagaagaagctcaaccaattatcccggaaggaatttgatttatataaaaagtctggaataacagaggttgaccggacagaagcgaaagagggtctaaaaagaggggagacaacgcatcacgcggtaagccgaggatcggctaaacttcaatggttcgtagagagaaacatggttataccagaaggaagagtgatagatttaggatgcggtagaggtggttggagctactactgtgcgggcctcaagaaagttacagaggtcagaggatatacaaaaggtggcccaggccatgaagaaccagttccaatgagcacatacgggtggaatatcgtgaaattaatgtcaggaaaagatgtattctatctacctccggagaaatgtgatactctactatgcgatataggagagtcaagtccgtcaccaacagtagaagaatcgagaactataagagtactgaaaatggtcgagccttggcttaaaaacaatcagttttgtataaaagttttgaacccgtacatgcccgcagtcatagaacacctagaacgtttgcaacgcaagcatggaggtatgctcgttagaaatccgttaagtcgaaactctacacacgaaatgtattggatttcgaatggcactgggaatattgttagttcagtaaatatggtatctcgccttttgttaaatcggttcacaatgacccaccggagaccaacaatagaaaaggatgtagatttaggagccggaacaaggcacgtaaacgctgaacctgaaaccccaaatatggatgtaattggagaacgaataaagagaatcaaagaggaacataatagtacttggcattatgatgatgaaaacccctataagacatgggcgtatcacggaagctatgaagttaaggccaccggttctgcaagttcgatgattaatggtgtggtgaaactcctaaccaaaccatgggacgtagtcccgatggttacgcaaatggctatgacggatacgactccatttggtcaacaacgagtattcaaagaaaaagttgacacgagaaccccaagaccaatgccaggtactcgtaaagttatggaaataactgccgagtggttatggagaactttaggtcgaaataagagaccccgcttgtgcactcgagaagaatttacaaagaaggttagaacaaatgccgcgatgggggccgtttttacagaggaaaatcagtgggacagtgcaaaggcagcagtagaagatgaagaattttggaaacttgttgaccgtgaacgagaattgcataaattgggaaagtgcggaagttgcgtatacaacatgatgggtaaacgtgagaagaaattaggggaatttggtaaagcgaagggttcgcgcgcaatttggtatatgtggttgggtgctaggtacctcgaatttgaagcattagggtttttgaatgaagaccactggttttctcgcgaaaactcttacagcggagtggagggagagggtttacacaaactagggtatatattaagagatatatctaaaattccagggggagctatgtatgcagatgacacagcaggttgggacacccgcataacagaggatgatctacataacgaagaaaagataactcaacaaatggatcctgagcacagattattagctaatgcgatatttaagctaacatatcagaacaaagttgttaaagtacagagacccacgcctacaggtacagtaatggatataatttcacgcaaggaccaaaggggcagtggacaagtaggaacatacggtctcaatactttcacgaatatggaagctcaattagtgagacagatggaaggagaaggagtcttatcgaaagcggatttagagaatccacatttaccggagaagaaaataactcaatggctagaaaccaagggcgttgaaaggctaaaacgaatggctatctcaggcgatgattgcgttgttaagcctattgacgatagatttgctaatgcgttgctagctttaaacgatatgggcaaggtgagaaaagatattccgcaatggcaaccaagtaaaggttggcacgattggcaacaagttccattttgctcccaccactttcacgaattaattatgaaggacggacgaaaattagtagtcccttgccgaccgcaagacgaactgataggtagagcccgtatatcgcaaggagcgggttggtcactaagagagaccgcctgcttaggaaaagcgtatgctcaaatgtggtccttaatgtatttccatcgtagagatttaaggttagcttcgaatgctatctgtagcgctgttcctgtacactgggtaccaacaagtagaacaacctggtcgatacatgcacaccatcagtggatgacaactgaagatatgttaactgtttggaatcgtgtctggattgaggataatccgtggatggaagataaaacacccgtgacgacgtgggaaaacgttccgtacttaggtaagcgagaagatcaatggtgcggttctttaatcggcctcacgtctagggcaacatgggcacagaacatacccaccgctatccaacaagtaaggtctctaataggaaacgaggagtttttagactatatgcctagcatgaaaagatttcgcaaagaggaagaattagagggagcaatatggtaa

SEQ ID NO: 23023 - RNA, 9873 nt, synthetic construct
  misc_feature 1..9873: note = derived and/or modified CDS sequence (opt6) from DENV-3__KF041255__SS-prME
  source 1..9873: mol_type = other RNA
acctcactgtgtttaatgatgatcctacccgcagctctggctttccatttaacttcaaggaatggtgaaccacgaatgatagttggcaaaaatgaaaggggaaaatcactacttttcaaaactgcgtcagggataaatatgtgtactttaatagcaatggacttgggagaaatgtgtgacgacaccgtgacttacaaatgtccacatataacggaagtggaacccgaagacattgattgctggtgcaacctcacgtccacttgggtcacatacgggacatgtaaccaagcaggagaacatagaagagataaaagatctgtagcactggcgcctcacgtgggaatgggattagacactcgaacgcaaacctggatgagcgcagaaggagcatggaggcaagtggaaaaagtcgaaacttgggcacttagacatcctgggtttacaatacttgctttatttctcgcgcattacatcggaacaagtttgacgcaaaaagtagtaatattcatacttctcatgttagtaaccccttcgatgacgatgaggtgtgtgggagttggaaacagggacttcgtagaaggattatctggagcgacttgggttgacgtagtcttagaacatggaggatgtgttaccactatggctaaaaacaaaccaacgttagatatagaactccagaaaactgaagcaacccaactagcaacactacgtaaactgtgcatagaaggaaaaataaccaacatcacgacagatagtaggtgtcccacacaaggtgaagcggtattaccggaagaacaggaccagaattatgtgtgtaaacatacgtatgtagacagaggatgggggaacggctgtgggctctttggtaaagggagcttagtgacttgtgcaaaatttcaatgcttagaaccgatagaaggtaaagttgtgcaatatgagaatttaaaatataccgtaattattacagtgcataccggagatcaacaccaagtcggaaatgaaacccaaggggttacagcagagataaccccacaagcaagcaccacggaagctatacttccggaatatggaactctcggactcgagtgcagcccaaggactggtctggacttcaatgaaatgatattattgactatgaaaaataaagcatggatggtgcatcgtcagtggttctttgatttacctttgccctggacttccggagctaccactgagacacctacatggaatagaaaagaacttttagtgacatttaaaaatgcgcatgctaaaaagcaagaagtcgtagtgctaggaagtcaggagggtgcaatgcatacagctttgaccggtgctacagagatacaaaattccgggggcactagcattttcgccgggcacttaaagtgtaggttaaaaatggataaactcgaattaaagggaatgtcttatgcaatgtgtacgaatactttcgttctaaagaaagaagtatctgagactcaacatgggacaatattaattaaggttgaatacaagggagaagatgccccttgcaaaataccattctctactgaagatggtcaaggtaaagctcataatggaagactaataacagcaaaccccgttgttactaagaaagaagaaccagtaaatatagaagctgagccgccttttggcgagtcaaacattgtaataggaattggggataacgcgctcaaaattaattggtataagaaaggaagctcaataggcaaaatgttcgaagcaaccgctagaggtgcgagaagaatggcaatactgggagacactgcttgggacttcgggtctgtcggaggagttcttaactcacttgggaagatggtacatcaaatttttggctcggcctacacggctttattctcgggtgtatcatgggtcatgaaaattggtataggggtcctattaacgtggataggactaaattctaaaaatacaagtatgtcattttcatgcatcgcaataggaataataaccttgtacttaggtgctgtcgttcaagccgatatgggatgtgtgataaattggaagggaaaggaattaaaatgtgggtccggaatatttgtgactaacgaagtccatacatggaccgaacaatataagtttcaagctgattcccctaaacgattagccaccgcaatagcaggagcgtgggaaaacggcgtttgtggtataaggagcactactagaatggaaaatctgctctggaaacaaatcgctaacgagttaaattatatattatgggaaaataacataaaacttaccgtggtcgtcggagacaccattggcgtactggaacaaggaaagagaaccctaacacctcaaccaatggagctgaagtactcgtggaaaacttggggtaaagcaaaaatcgtcactgcagagactcaaaattcaagtttcattatagatggcccgaacacaccagaatgtcccagcgcatcacgggcttggaacgtatgggaagtagaagattacggtttcggagttttcacaactaatatatggctaaagctgagagaagtttacacacaaatgtgtgatcaccgtctaatgtcagcagcagttaaagatgagagagctgtgcatgccgatatgggttactggatcgaatcacagaaaaacggatcatggaaactagagaaggccagcttgatagaggtaaaaacgtgtacttggcccaaatcacatactctctggtcgaacggcgtattagaaagcgatatgataataccaaaaagtctggcaggaccaattagtcaacataactatcgcccaggatatcatacacaaaccgctggcccatggcatttgggaaaactagaactggattttaattattgtgaaggaaccacagtggtaatcacagagaactgtggaacaagagggccctcattacgaactacaactgtatcaggtaaactaatacacgaatggtgttgccgatcctgtaccttaccgccccttagatacatgggagaagatggctgttggtacgggatggaaataagaccaattagcgagaaagaagaaaatatggtaaaaagcctcgtctcagccggcagcggaaaagtagataatttcactatgggtgtactatgcttagccattctcttcgaagaagtaatgagagggaaattcggtaagaaacacatgattgcaggcgtattcttcacatttgtcctgctactgtcaggacaaataacctggcgagacatggcccacacgttaatcatgataggaagtaatgcttcagaccgcatgggaatgggtgtgacatatttagccctaattgctaccttcaaaatacaaccatttctcgcattaggatttttccttcgaaaactcacgtcgagagagaatcttttattaggcgtcggactggccatggctacgacccttcaattaccagaggacatagaacaaatggcaaatggaatcgcgttgggactgatggccctgaaacttatcactcaatttgagacataccaactgtggaccgcattaataagccttacctgtagcaatacaatattcacgcttacagtggcctggaggactgcgactttaatattagctggagtaagccttttgcctgtttgtcagtcttcatccatgagaaaaacagactggttacccatgacagtagcagcgatgggcgtgccacccctaccacttttcatattcagtctaaaagacactttgaaacggcgaagttggccattaaatgaaggagtgatggcagtcgggctagtgtcaatattagcatcctctctcctaagaaacgacgtacctatggcaggaccgctcgtcgccggaggcctactgatagcgtgctatgtgataactggcacaagtgctgacttgactgtagaaaaggcagctgatgttacttgggaagaagaggcagagcaaactggagtttcacataacttaatgatcactgtggacgatgacggtacaatgaggataaaagatgatgagacggaaaatatattgactgtcttgttaaagacagccctactaatagttagtgggatcttcccctattcaattcccgcaacactgctcgtctggcatacatggcaaaagcaaacacagagaagtggcgtactatgggacgtcccatcaccacccgagacgcagaaagcagaactagaagaaggggtctaccgtattaagcaacaagggatattaggcaaaactcaagtcggagtaggagtacagaaagaaggtgtcttccacacaatgtggcatgttactcgaggggcagtgctcactcataacggtaagcgcttggaaccgaactgggcctccgtgaaaaaggacctcataagttacggcggcgggtggagactgtcagcacaatggcaaaaaggagaagaggtacaagtaatcgcagtagaaccaggtaagaatcccaaaaacttccagacaatgccaggaacatttcaaacaactacaggtgaaataggagcaatagcactcgatttcaaaccgggaacgagcggaagtccgattataaatcgagagggcaaagtcgtaggcctatacggaaacggtgttgttactaaaaatggaggatacgtcagcggaattgctcagacaaatgcggaaccagatggtccaactccagaattagaagaagaaatgtttaagaaaagaaaccttaccataatggatctacatccaggaagcggcaaaacgcgaaaatatctcccagcaatagtacgtgaagcaatcaaaaggcgacttcgaacgttaatacttgctccaacaagagtagtagctgctgaaatggaagaggctctaaaaggtttaccaattagatatcaaaccacagccaccaaaagtgaacatacgggcagggaaatagtagatttaatgtgtcacgcaacgtttaccatgcgtctgctttcgccagtccgagtcccaaattataacttaattatcatggacgaagctcatttcaccgacccggcgtctattgcagctcgtggatacatatcaacacgagtaggcatgggcgaagccgcagcaatatttatgaccgctacacctccggggacagctgatgcttttcctcagtcaaatgctcccatacaggatgaagaaagagatattccggaacgcagttggaactctggaaatgaatggatcactgattttgcaggaaaaacagtttggtttgtgccaagtataaaagcaggtaatgacatagctaattgcttaagaaagaacggtaagaaagttatacaattgtcgcggaagacattcgacacagaatatcaaaagacgaaacttaatgactgggactttgtagtaactaccgacatcagtgaaatgggagctaatttcaaggcagatagagtaattgatccacgaaggtgtttaaagcctgttatactaacggatggtcccgaacgcgttatattggcaggaccaatgcctgtcactgccgcgtccgccgcacaaaggcgaggaagagtcggacgtaatcctcaaaaagagaacgatcagtatattttcacgggacaaccattaaataacgacgaggatcatgcacactggacagaagctaaaatgctactagataacataaatacacccgagggcattattccagcactatttgaacctgaacgagaaaaatccgcagcgattgacggagaataccgattaaagggcgaatccagaaagacttttgtggagttaatgaggcgtggtgatctgcctgtttggttagcccacaaagttgcttccgaaggcatcaaatatactgacagaaaatggtgctttgatggacaacgcaataatcaaatattagaagaaaacatggacgtcgaaatatggaccaaggagggtgaaaagaggaagttgcgtcctagatggctagacgcgagaacttacagtgacccactggcactcaaagagtttaaggatttcgcagcaggtagaaagagcattgctctcgatttggtcacagagatcgggagagtaccctctcaccttgcacatagaacgcggaatgcactagacaacttggtaatgcttcatacttctgaacatggcggtcgagcttaccgtcatgcagtagaggaattaccagaaacaatggagacactcctattactaggtctaatgatcctgttgacaggtggagcaatgctattcctgatatcaggaaaaggcatagggaagacatcaattgggctgatatgtgtaatcgcatcgtcaggaatgttgtggatggcagagataccactacaatggattgcatcagctatagtactagagttctttatgatggtcctcctaatcccagaaccagaaaaacaaaggactcctcaagacaatcaattagcatatgtggtaatcggcatactgacacttgcagccataatagcagctaacgaaatgggtctcctcgaaaccacaaagcgagatttaggaatgtcaaaagaaccaggtgtagtatctcctacttcatatttagatgttgatctacatccagcatcagcatggactctttacgcggttgctactacagtaataacacctatgttacgacacaccatagaaaatagcactgctaacgtatcgctggcggcgattgccaaccaggcagtagtgttaatgggtctcgacaaaggctggccaataagcaaaatggatttgggagttcccttattagcccttggatgttattctcaagttaatcctttgactttgaccgccgctgtactgttattaataactcattacgcaattatcggacctggattgcaggccaaagcgacaagagaagcacaaaaacggactgcagctggtataatgaaaaacccaacagttgatggaattattacgatagatctagatccagtgatatacgactctaaattcgagaaacaattggggcaagtaatgctactggtgttatgcgctgtacagctacttttaatgaggacttcatgggctctttgtgaggcacttacattagcgacaggcccgataacaacattatgggaggggagcccggggaagttttggaacacaaccattgccgtcagcatggctaacattttccgaggatcatacctggccggtgcaggactagcctttagcatcatgaaaagcgtagggacaggtaagagaggaaccggtagccaaggagagacactcggcgaaaaatggaaaaagaagttaaaccaactctcacgaaaagaatttgatttgtacaagaaatccggaatcacagaagtagatagaacagaggcaaaagaagggctaaagagaggcgaaactacccaccacgcagtatcacgcggtagcgcaaaattacagtggtttgtcgaaagaaacatggtaatacctgaaggaagagtgattgatttaggctgcggacgaggcggttggtcttactattgtgccggcctcaagaaagtgactgaagtacgaggatacactaaaggagggccaggacatgaagaaccagtacccatgtcaacttatgggtggaatatagtgaaactaatgtccggcaaagacgtgttctatctaccgccagaaaaatgcgatacattactatgtgacattggagaaagcagtccgtctccgactgtagaggaatcaagaacgatccgtgtacttaaaatggtagaaccttggctgaaaaataaccaattctgcataaaagttctaaacccgtatatgccagctgtaattgaacatctggagagattacaacgtaaacatggaggtatgcttgtcagaaatccgctgagtagaaactcaactcatgaaatgtattggatatccaacggtaccggcaatattgtgtcaagcgtaaacatggtctcaagattattgttaaataggtttaaaatgacgcaccgtcgaccaacaatagaaaaagatgtagatttaggggcaggcactcgtcacgttaatgcagaaccagaaacaccaaatatggatgtcattggagaacgtataaagagaataaaggaggaacacaatagcacatggcactacgatgatgaaaatccatataaaacatgggcataccatggatcatacgaagtaaaggctactggctcagcttcctcaatgatcaatggggtggtaaagctactaacaaagccgtgggacgtagtaccgatggtaacgcagatggctatgacagacaccacaccgtttggccaacagagagtattcaaggagaaagtggataccagaactccaaggccaatgcccggaacccgaaaggtaatggaaatcactgcagaatggttatggcgtacactaggtcggaacaagcgtcctagattgtgtacccgtgaagagttcacgaaaaaggtcaggacaaatgcggctatgggcgcagtatttacggaagaaaatcagtgggacagcgccaaagccgcagtcgaagacgaagaattttggaaactcgtagacagagagagagaactacataaattaggaaagtgtggctcatgcgtatacaacatgatgggtaaaagagagaaaaagctaggcgaatttggtaaagcaaaaggatctcgggcgatttggtatatgtggttaggagctaggtacttagagttcgaagctctcggatttctaaacgaggaccactggtttagtcgcgaaaatagctatagcggggtggaaggtgagggtttacacaaattaggatatatacttagggatatctcaaaaattccgggtggagcaatgtacgcagacgatacagcgggatgggatacacgaataaccgaggatgatctacataatgaagagaaaataacccaacaaatggatcctgaacacagattgttggctaacgcaattttcaaattaacctatcaaaataaggtagttaaggttcaaagaccaacgcccaccggcacggtcatggatattatatcacgtaaggatcaaagaggatctggccaagtaggcacatatggattaaatacatttacaaatatggaagctcagctagttagacaaatggaaggtgaaggagtcttatctaaagcagacttagaaaacccccacttaccggagaagaaaataacccagtggcttgagactaaaggcgtagagagacttaaaaggatggctataagtggagacgactgtgttgtgaaacctatagatgatagatttgccaatgcgttactcgctttaaatgacatggggaaagtaagaaaagatataccacaatggcaaccttccaagggatggcatgattggcagcaagtacccttttgcagtcatcattttcacgaattaataatgaaggatggaaggaagttagttgtaccgtgcagaccccaagatgagttaataggacgagcgcgaataagccaaggagctggttggagtttaagggaaacagcatgcctaggaaaggcctatgcacagatgtggtcattaatgtatttccatcgccgagaccttcgactagcaagtaacgcaatctgcagtgcagtccctgtccattgggtacctacttcgcggacaacgtggtcgatacatgctcatcaccagtggatgactaccgaggatatgctaaccgtttggaaccgcgtatggatagaggataacccatggatggaggataagactcctgtaacaacatgggaaaatgttccataccttggtaaacgagaagatcaatggtgcggcagcttgattggattaacaagtagggcaacgtgggcacaaaatatacccactgctatacaacaagttagatcacttattggtaatgaagaatttctagattatatgccttccatgaaaaggtttcgcaaagaagaagaacttgagggtgccatttggtag

SEQ ID NO: 23024 - RNA, 9873 nt, synthetic construct
  misc_feature 1..9873: note = derived and/or modified CDS sequence (opt6) from DENV-3__KF041256__SS-prME
  source 1..9873: mol_type = other RNA
acgagcttatgtctcatgatgatacttccagctgcattagctttccatttaacttctcgagatggggaacccagaatgatagtaggcaaaaacgaaagaggtaaatctctactattcaaaacagcatcaggaatcaacatgtgtacactaatcgcaatggacctgggtgaaatgtgcgacgacactgtaacgtacaaatgccctcatatcacggaagtagaaccagaagatattgattgctggtgcaacctaacatcaacctgggtaacttatggaacatgcaaccaagctggtgaacatagaagagataaacgttcagtagcactagctccccacgtaggaatgggactagacacaagaacccaaacttggatgtctgcagaaggagcatggagacaagtcgaaaaagtagaaacttgggcacttaggcacccaggatttacgattttggcattattccttgctcattatataggaacatccttgactcagaaagtagttattttcattttgttgatgttagtaaccccatcaatgactatgcgctgtgtaggagtcggaaatagagacttcgtagaaggattatcaggagctacttgggttgatgtagtacttgagcatggagggtgcgtgacaacaatggctaaaaacaaaccaactcttgacatagaattacagaaaactgaagcaactcaactagcaacgttgagaaaactttgtatagagggaaaaatcaccaacatcacgacagacagcagatgccctacccaaggagaggccgtactaccagaggaacaagaccaaaactatgtatgtaaacacacatatgtagatcgaggatggggaaatggatgtggattatttgggaaaggatctctagtcacttgtgctaaatttcagtgcttggaacctatagaaggaaaagtagtacaatacgagaatttaaaatacacagtaatcattacagtacacacaggagatcagcatcaggtaggaaatgaaactcaaggtgtaaccgccgaaattacaccacaagctagtaccacagaggcaatacttccagaatacgggactctcggattagagtgtagtccaagaaccggattagacttcaatgagatgatattactaacgatgaaaaataaagcgtggatggtacaccgacaatggtttttcgacctaccactcccctggaccagtggagctacaacggagacacccacttggaaccgaaaagaactcctagtaacttttaaaaatgcgcatgcgaagaaacaagaagtagtagttttagggtcacaggaaggagcgatgcatactgcactaaccggtgccaccgaaatacaaaactctggtgggacaagtattttcgccggccaccttaaatgtcgactgaaaatggacaaactagagctaaaaggaatgagctatgcaatgtgtacaaatacttttgttctaaagaaagaagtctcagagacgcaacacggaacaatcttgatcaaagtagaatataaaggggaagatgccccttgcaaaattcccttttcaacagaagatgggcagggtaaagcgcacaatggaagactaatcaccgcgaatcccgtcgtcaccaagaaagaagaaccagttaatatagaagcagaacctccattcggagaatcgaacatagtaataggaattggcgataatgcactgaaaattaattggtataagaaaggatctagtataggtaaaatgttcgaagcaactgcacgcggggctcgcaggatggctattttgggcgatacagcctgggactttggttccgtaggaggtgttcttaacagtttagggaaaatggtacaccaaatttttggatcagcttacactgcactgttctctggggtctcatgggtaatgaaaataggtatcggcgttctactcacatggatcggtctaaattccaaaaacacctcaatgtctttttcatgtattgcaattggtataataactttataccttggtgcagttgttcaagctgacatgggctgtgttattaattggaaaggaaaagaattaaaatgcggttcgggaatttttgtgacaaatgaagtacacacctggacggaacagtataaatttcaagccgacagcccaaaacgtttagcaactgcaatagcgggagcatgggaaaatggggtatgtggcatccgaagcactacgcgaatggagaacttactatggaagcaaatcgcaaatgagctcaattacatattatgggaaaacaatatcaaactaactgtcgtagtcggcgatacaattggagttttggaacagggcaaaagaacgctaaccccacaaccgatggaactaaaatactcttggaaaacatggggcaaagcaaagatcgttacagcagaaacccaaaattcatcatttataattgatggacccaatacaccggaatgtccctccgcctctcgagcttggaatgtatgggaagtggaagactatggttttggcgtcttcactacaaacatatggctcaagctaagagaagtttatactcagatgtgtgatcaccgtttaatgtctgccgctgttaaagatgaacgggcggtacacgcggatatgggttattggattgagagtcagaaaaacggctcttggaagttagaaaaggcaagcctaatagaagtcaaaacatgcacatggccaaaatcacatacattgtggagtaatggggttctcgagtccgatatgataatccccaaaagtctagctggacctataagtcaacataactataggccaggatatcatacccaaacagccgggccatggcaccttggcaaactggagctcgattttaattactgcgaaggaactacagtagtaataacagaaaactgtggaacacgcggtccgtcactaagaaccacgactgtaagtgggaaactcatacacgaatggtgttgtagatcttgcaccctaccacctcttagatatatgggagaggatggttgttggtacggcatggaaattcgacctattagtgaaaaagaagaaaatatggtaaaaagtttagtatcggcaggcagcggcaaagttgacaatttcactatgggagtactttgccttgcaatcttgttcgaggaagtcatgagaggcaaatttggaaagaaacatatgatagccggtgtattctttactttcgtgcttctattaagtggacaaataacatggagagatatggcacatacacttataatgataggatcaaatgcgagtgaccggatgggaatgggcgtaacgtatttagcactaatagccacattcaaaattcaaccgtttttagctttgggcttctttttacgtaaattaacaagtagagaaaatttacttctaggcgttgggcttgctatggcaacaacactacaattgccagaggatattgaacaaatggccaacgggatagcacttggattaatggccctaaaactaatcacacaattcgaaacttaccagttgtggacggcccttatatcacttacatgttccaatacaatttttaccttaaccgtagcctggcgaactgcgaccttaattttggccggtgtaagtttacttccggtctgccagagttcgtccatgagaaaaacagactggcttcctatgacagtagcagcaatgggagtgccaccgctgccattattcatcttttctctaaaggatactctcaaaagaaggtcttggccattaaatgagggagtaatggctgtaggattagttagtatattagcatcgtcattattacgcaatgacgtaccaatggctggaccgttagtcgctggtggcctacttatagcctgttatgtgataacaggaacatcagctgacttaaccgttgaaaaagctgcggatgtaacttgggaagaagaagctgagcaaactggtgtttctcataatttaatgattacagtagatgatgacggcacaatgcgaatcaaagatgatgagacagaaaatattttaacagtcctattaaaaaccgccttattgattgtgagtggaattttcccatattcaataccggcaacgctattggtatggcatacttggcaaaaacagacacaacggtctggcgtcctgtgggatgtacctagcccgccagagacacaaaaagcagagttagaggaaggggtatatcgcattaaacaacaagggatattaggaaaaacacaagtaggggtaggcgtacaaaaggaaggtgtttttcatactatgtggcatgtcacgagaggagcggtccttacacacaatggcaaaagactagaaccaaactgggcttcagtaaagaaggatctcataagttatggtggcggatggaggctatcagctcagtggcaaaaaggagaagaagttcaggtgattgcagtggaacctggtaaaaacccaaagaatttccagactatgcccggcacattccagactacaactggtgaaattggggctattgcgttggattttaaaccaggtacgtctgggagtccaataataaacagagaaggcaaagttgtagggctatacggtaacggagtggttactaaaaacggtgggtacgtctccgggatcgcacagactaacgccgagcctgacgggccaacacctgagttagaagaagaaatgttcaagaaaaggaacttgacaataatggacctgcatcctggttcaggaaaaacgaggaaatacttacccgccatagtaagagaagcaataaaacggcgattgcgcaccctcatccttgccccaaccagagtggttgctgcggagatggaagaagccttgaaaggcttacccatacgttaccaaacgaccgccactaagagtgagcacaccggacgtgaaatcgtcgacctaatgtgccatgccaccctaacaatgcggttacttagccccgttcgggtgcctaactataatcttatcataatggatgaggcacattttacggaccccgcatcaatcgcagctcgaggctatataagcacccgagttggcatgggagaggccgccgctatctttatgacagcaactccgccaggtacagccgatgccttccctcaatcaaatgcgcctatacaggacgaggaacgcgatatacccgagaggagttggaatagtggtaacgaatggattacagattttgccggtaaaactgtatggttcgtgccaagtataaaagcaggaaatgatatagcaaattgcctaagaaagaatggcaagaaagtcatacaattatcccgaaaaacctttgacacagaatatcagaaaacaaaactcaacgattgggatttcgtggtaacaacagatataagtgaaatgggagcaaattttaaggcagatcgcgtaattgacccaagacgttgtttaaagccagtcatccttacagacggcccagagcgtgttattttagccggacctatgccagtaacagccgctagcgccgcacagaggaggggccgagtgggaagaaatccacaaaaagagaatgaccagtatatctttacagggcagccacttaacaatgatgaggatcatgcacattggacggaagctaagatgctattagataatataaacactcctgaaggtataattccagctttattcgaacctgaacgggaaaaatccgcagccattgacggagaatataggttaaaaggcgaatcacgcaaaacctttgtggagcttatgagaagaggagatttacctgtatggcttgcccataaggtagcaagcgaagggatcaaatataccgatcgaaaatggtgttttgacggccagcgtaataaccaaatcttggaagaaaatatggatgtagaaatatggacaaaggagggggagaaaagaaaacttcgcccgagatggcttgatgcacggacctattcagacccattggccttaaaagaatttaaagattttgcagcagggagaaaaagcattgctctagacttagtgacggagattgggagagtgccaagtcatcttgcgcataggacccgaaacgctttagataaccttgtaatgttacacacatcagaacacggaggtagggcctatcgacatgcagtagaggaacttccggagaccatggaaaccctactactattaggattgatgattcttttaactggtggggcgatgttattcttgatatcaggcaaggggattggtaaaacaagtataggattgatatgcgtcattgccagcagtggaatgctctggatggccgaaattccattacagtggattgcaagtgcaatagtactagagttcttcatgatggttttactaatccctgaaccagaaaaacaaaggacgccccaagataatcaattagcttatgtagtcatagggatacttacactggcagcaattatcgcagccaacgaaatgggtttgttagaaactacaaaaagagacctaggaatgtccaaagaaccaggagttgttagtccaacatcatacttagatgtggatcttcatccggcttcggcatggacactatacgccgtggctactactgttattacacccatgcttagacacaccatagaaaacagcaccgcaaatgtctccctggcggcaatagctaaccaagctgtagttttgatgggtctagataaaggatggcccatatcaaagatggacctaggggttccattattagcacttggatgttactctcaggtaaatccattaacactaaccgcagctgttcttttacttattacacattatgcaataatcggaccgggcttacaggcgaaagcaactcgggaagcacagaaacgaacggctgctggaatcatgaaaaatcctacagtcgatggcataattacaattgatctagatcccgtaatatatgacagcaaatttgagaagcaacttggtcaagtaatgctcctagttttatgtgctgtccaattattactaatgaggacgtcatgggctctttgcgaagccctcacattggctacagggcccatcacgacattatgggagggttctccaggcaaattttggaacacaacgattgccgtaagtatggcgaacatttttcgaggaagctatcttgcaggagcgggattagcgttttctataatgaaatcagtaggaaccgggaaaagagggacgggatcacaaggagaaacgcttggagagaaatggaagaagaaattaaatcagctgtcaagaaaagagtttgacctatataagaaatcgggcataactgaggtagaccgaacggaagcaaaggaaggactcaaaagaggagagacaactcatcacgcggtttctagaggaagtgctaaactccaatggtttgtagaaagaaacatggtaattccagagggtcgagtgatcgacctaggatgtggacgcggaggctggtcctattattgtgcaggactcaaaaaggtaacggaagtacgaggctatacaaagggaggaccaggccatgagaaacccgtgccaatgtcgacctacggatggaatatagttaaattaatgtcaggtaaggatgtgttctatctgcctccagaaaaatgtgacaccttattatgcgatataggcgaatccagtcctagcccaactgtagaggaatcacgaactatccgggtcctaaagatggtagaaccctggctaaagaacaatcaattttgtataaaagtgttgaatccttacatgcctgcggtaatagaacatttagagagacttcaacggaagcacggaggaatgctagttcgcaatccactatcaagaaatagcacacacgagatgtattggatatcgaacggaacaggaaacatagtgtcgtcagtcaatatggttagtagattgttgttaaatcgattcaaaatgacgcatcgacggcctaccattgaaaaagatgtcgacctaggtgctgggacacgacatgtaaatgctgaaccagaaactccgaatatggatgtaatcggggaacgaataaaaagaataaaggaagaacataatagtacttggcattacgatgatgaaaacccgtataaaacgtgggcttaccacggtagctacgaagtcaaagccaccggcagtgctagttcaatgataaacggagtagtaaagttactaacaaaaccttgggatgtcgttccaatggtcacacaaatggcaatgacagatactaccccattcgggcagcagagagttttcaaggaaaaggttgatacacgaacacctagacctatgcccggtacaagaaaggtaatggaaataacagcagagtggttatggagaactctaggacgcaataaaaggcccaggttgtgtacacgcgaagaatttactaaaaaggtcaggacaaacgcagctatgggcgctgtctttaccgaagaaaaccaatgggatagtgcaaaagcagctgtggaagatgaggaattttggaagctagtagaccgagaaagagaactgcacaaactaggaaaatgtggaagttgcgtgtacaatatgatgggtaagagagagaagaaacttggagaatttgggaaagctaaaggtagtcgcgcaatctggtacatgtggttaggggcaagatacttggaatttgaagctctagggtttctaaatgaagatcactggtttagtcgagaaaattcgtattccggcgtcgagggagaagggcttcataaattaggatatatcttaagagacataagcaaaattcccggaggagcaatgtatgcagatgatacggcaggctgggacactcgaataactgaagacgacctacataacgaagagaaaataacacagcagatggatcctgaacatagattgctagctaatgcaatctttaaacttacgtatcagaataaagttgtcaaggttcaaaggccaacaccgacagggactgtaatggatatcatatcccgaaaagaccagaggggctctggtcaagtaggtacgtacggcttgaatacattcacgaacatggaggcgcaattagttcgtcagatggaaggggagggagtattgtcaaaagcggatcttgaaaacccgcatttacctgagaagaaaattactcaatggttagaaacaaaaggtgtcgaaagactcaaacgcatggcgatctccggagacgattgtgtcgtcaagccgattgatgaccgatttgctaatgctttattagctttaaatgatatgggcaaagtaagaaaagatatcccacaatggcaaccatctaaaggatggcacgattggcaacaggttcctttctgttcacatcatttccacgaactgattatgaaagacgggagaaagctagtggttccatgtagaccacaggatgaacttattgggagagcaaggatctcacagggggcaggttggtccttaagagaaacagcatgtctaggcaaggcgtacgctcaaatgtggtctttaatgtactttcaccgtcgtgatttaagacttgcttctaatgctatatgtagcgcagtacctatacattgggtaccaacatcacgaacaacttggtcaattcatgcacatcatcaatggatgactacagaagacatgctaactgtctggaatagggtatggatagaagataacccctggatggaggacaaaacaccagtaactacttgggagaacgtcccctacttggggaagagagaagaccagtggtgcggaagtttaattggactaacatcaagggccacttgggctcaaaatataccaacagctatacaacaagtgaggagtttaattggtaatgaagagttcttagattatatgccatcaatgaaaagatttcgtaaagaagaagaactagaaggagcgatttggtaa

SEQ ID NO: 23025 - RNA, 9873 nt, synthetic construct
  misc_feature 1..9873: note = derived and/or modified CDS sequence (opt6) from DENV-3__KF041254__SS-prME
  source 1..9873: mol_type = other RNA
acttcattatgcttgatgatgatacttcctgcagcactagcatttcatctaacttcaagggacggtgaaccccgcatgattgtaggcaaaaatgaaaggggaaaatccttattgtttaaaacagcaagtggaatcaatatgtgtactctaatcgcaatggatctaggagaaatgtgtgacgacacagtcacttacaaatgtccacacataacagaggtggagccagaagacatagattgctggtgtaatcttacaagtacgtgggtaacatatggaacatgtaaccaagcaggggaacatagaagggacaaacgaagtgtggcactagcacctcatgtaggcatgggattagatacgcgtacacagacatggatgagtgcagagggagcgtggcggcaagtagagaaagtcgaaacttgggcgcttcggcatccaggatttacaatcttagcactatttttggcacactatattggaacatcattaacgcaaaaagtagtaatattcattctattgatgctagttacgccatcaatgacaatgcgctgtgtaggggtgggaaacagagactttgtagaagggttatccggggcaacatgggtagatgtcgtcttagaacatggagggtgcgttacaacaatggccaaaaataaacccacattagatatagagttacagaaaacagaagctactcaactagctaccttacgaaaactatgcatagaaggcaaaataactaatattaccacggacagtagatgcccaacgcaaggtgaggcagtattaccggaagaacaagaccaaaactacgtatgtaaacatacatacgttgataggggatggggaaatggttgtggactttttggcaaagggagtctagtaacatgtgcaaaatttcaatgtctagaacctattgaaggtaaagttgttcagtacgaaaacttaaaatacacagtaatcataacggtccatacaggagaccaacatcaggtaggaaatgaaacacaaggtgtcactgctgagatcactccgcaagcatcaacaactgaagctatcttaccagaatatgggaccttaggattagagtgtagtcctagaacgggattggattttaatgagatgatccttctgacaatgaaaaacaaagcatggatggtccatcgtcagtggttctttgatctacctctaccttggacatcgggtgcaacgacggaaacaccgacgtggaatagaaaagagctcctggtaaccttcaaaaatgcgcatgccaagaaacaagaagtcgtggtcctaggatctcaggagggtgcaatgcacacagctctaactggagctacggagattcaaaatagtgggggtacatcaatttttgcaggccatctcaaatgcagacttaaaatggacaaactagaattaaaaggaatgtcctacgcaatgtgcacaaacacatttgtattgaagaaagaagtttcagaaacacaacatggtacaatattaattaaagtagaatataagggagaagatgcgccgtgtaaaattcctttctctacagaagacggacaggggaaagcacataatggcagactaattaccgcaaaccccgttgtgaccaagaaagaagaaccagttaatatcgaagctgagccaccctttggtgaaagtaacatagtaatcggaataggtgacaacgccctaaaaataaactggtacaaaaagggttcgtcaataggaaagatgtttgaagcgacagcgcggggcgcaaggaggatggctatacttggagacacggcatgggactttgggagtgtgggtggagtcctaaattctcttggaaaaatggtccaccagatattcggatcagcatatacggcattattttcaggcgtcagttgggtaatgaaaatcgggataggagtattactgacttggattggattaaattccaaaaacacctcaatgtcattctcatgtatagccatagggataataacgctttatcttggcgttgtggtacaggctgacatgggctgcgtgattaactggaaaggtaaagaacttaaatgtggtagcggtattttcgtgacaaacgaagtacacacctggacagagcagtacaaatttcaagcagactcaccgaaacgactcgcaactgcaatagcaggagcatgggaaaatggtgtgtgcgggataagaagtaccacgcgaatggaaaatttattatggaaacaaatagcaaatgaattgaattacattctatgggaaaataatataaaattaactgttgtagtgggagacacgataggagttctagaacaaggaaaaagaacgttaacacctcaacccatggaactaaaatactcatggcggacttggggtaaagcaaagatagtaactgctgaaacgcaaaacagctcgttcataatcgacggcccaaatacccctgagtgcccttcggcatcccgggcctggaatgtatgggaggtggaggattatggatttggagtattcacaacgaacatatggttaaaattgagagaaatgtatacacaaatgtgtgatcatagactgatgagcgccgcagtaaaggatgaaagggcagttcatgcagacatgggctattggattgaatcacagaaaaatggttcttggaagctagaaaaagccagtctcatagaagttaagacctgtacatggcctaagtctcatacactatggtcgaatggtgttttagagtcagacatgattatacctaaatcgttagctggaccaatatctcagcacaattatagacctggttatcacacacaaacggcaggtccttggcatctaggaaaactcgaacttgactttaactactgcgaaggcactaccgttgtaataaccgagaattgcggcacgcgaggtccctcactacgcacaacaacagtttcaggaaagttaattcatgaatggtgttgtagatcatgtactttaccaccattacggtacatgggcgaagatggttgctggtatgggatggaaatacgacctatcagtgaaaaagaagaaaacatggtgaaaagtctcgttagtgcgggatctggtaaggtggataactttacaatgggagttctatgcctagctatcttattcgaagaagtgatgcgtgggaaattcggaaagaaacatatgattgctggggtattctttacgtttgtcctactcctatcgggtcagatcacgtggagggacatggcgcatacccttattatgattggttcaaatgcatcggatcggatggggatgggcgtaacttacctggcccttatagctacgtttaagatacaaccattccttgcactaggatttttcttaagaaaactcacgtccagagaaaatctgcttttaggggtgggcttagcaatggcaacgacgctccagttaccggaagatattgaacagatggcaaacggcattgcccttggcctaatggccttaaaactcatcacacaattcgaaacatatcagctctggacggctctaatttcattgacttgtagtaataccatttttacattaaccgtcgcttggagaactgcgactttgattctggccggtgtaagtttattgccagtgtgtcaaagttccagtatgcgtaagaccgactggctcccaatgacggtcgccgcgatgggagtacctcctttgcctttattcatattttcacttaaagacacactaaaaaggcgatcttggccattaaatgagggagttatggcagtgggattagttagtattcttgcgagctccctcctcagaaatgatgtaccaatggcaggaccgcttgtagccggcggtttgctaatagcctgctacgtgattacaggaacaagcgctgatttaacagtcgaaaaggcagctgacgtaacttgggaagaggaggcagagcaaactggtgtatcacacaatttgatgattactgtagatgacgatggtactatgcggattaaggatgacgaaaccgaaaacatcttaaccgttctgctgaaaaccgccttgctaatagtctcaggtatttttccatatagtataccggctacattattggtttggcatacatggcagaaacagacacaaagatcaggagtattgtgggacgttccgagtccacctgaaactcaaaaagcggaattagaagaaggagtttatcgtattaaacaacaggggatccttggaaaaacgcaagttggggttggcgtgcaaaaagagggagtatttcatacaatgtggcacgtaactaggggagctgtactaacacacaatggtaaacgtcttgaaccaaattgggcatcagttaagaaagatttaatttcttacgggggaggatggagattgtcggcacagtggcaaaaaggtgaagaagtacaagtaatagcagtagagccgggcaaaaatcctaaaaattttcagacaatgcctggaactttccaaacaaccacaggagaaatcggcgcaattgccctagattttaagcctggtacatctggaagcccaataataaaccgcgaaggtaaagtagtaggcctatatggaaacggcgtggttaccaaaaatgggggttacgtgagcggcatagctcaaacaaacgcagagccagacggcccgaccccagaattggaggaagagatgttcaagaaacgaaatcttacgatcatggacctgcaccctggttcaggcaaaacacggaaatatttacctgctattgtcagagaggcgataaagcgtaggctcagaactttaatcctagcaccgactcgtgtggtggcagcagaaatggaagaagcactcaaaggactaccaatacggtatcaaacgactgcaacaaaatccgaacatactggacgggaaatagtagatctaatgtgccacgcaactttcacaatgcgcctgttaagtcccgtccgcgtgccgaattataacttaataataatggatgaagcacactttaccgaccctgcgagcatagccgcgagaggatatatttcaacacgcgtaggaatgggggaagctgcagctattttcatgaccgcaactcctccaggaacagccgacgctttccctcaaagtaatgcaccaatccaggatgaagaacgggatatacctgaaaggtcctggaactcggggaatgaatggattacagatttcgcaggaaaaactgtatggtttgtgccctcaattaaagctggcaatgatattgcaaactgtttacgtaaaaatggtaaaaaggttatccagttaagtagaaaaacatttgacactgaatatcagaaaactaaattaaatgactgggacttcgtggtaacaacagacattagcgaaatgggtgcaaacttcaaagcggatagagtcatagaccctagaaggtgcttaaaacctgtaatactaacagatggtccggaaagggtaatacttgcgggtcctatgccagtaaccgcagcttctgctgctcagagaagaggacgtgtaggaagaaatccgcagaaagaaaatgatcaatatatcttcaccgggcagcctctaaataacgacgaagatcatgctcactggacagaagccaaaatgctcctcgacaatataaacacaccggaaggaattattccggcattattcgagccggaacgtgaaaagagcgcggcaatagacggtgaataccgactaaagggtgaatcacgcaaaacctttgttgagttaatgaggaggggagatctaccagtctggctggcacataaagttgcgtctgaaggcattaaatatacagatagaaaatggtgctttgacgggcaacgaaacaaccaaattttagaggaaaatatggacgttgaaatttggacaaaggaaggtgaaaagagaaaactacgaccgagatggttagatgcacggacgtattcagatccactcgccttaaaggagttcaaggactttgcagcaggccgtaagagcattgcacttgatcttgtgacagaaattggacgtgtcccatctcatcttgcacatagaacaaggaatgcactagataatctagtaatgctacacacttcagagcacggaggcagagcttatcgacatgcagttgaggagctaccagagacaatggagacccttcttttactaggacttatgatactactgacgggaggagctactctatttttaatatctggaaaaggaataggtaaaacttctataggattaatctgtgtaattgcttcctccggtatgttatggatggcagagattccgctgcaatggatagcatccgctatagttctagagttctttatgatggtacttttaatacctgaaccagaaaaacaaagaactcctcaagataatcaattagcatatgttgtcattggaatattaacactagcggcaataatagctgcaaatgaaatgggcctgcttgagaccacaaaacgcgacttaggtatgtccaaagagccaggcgtggtctcaccaaccagttatctggacgttgatttacacccagcttccgcttggactctctatgcagtcgcaacgacagtaattacgccaatgcttagacatacaatagaaaattcaacagcgaacgtaagtttagctgcaatagcgaatcaagcagtagtccttatgggattagacaaggggtggccaatatcaaaaatggacctaggcgtaccattattagccttaggctgctacagtcaagtaaatccacttacactcacggctgctgttttgttattgattacgcattatgccataatagggccaggtttgcaagcaaaggcaacaagagaagcgcaaaagaggacagcagcaggcatcatgaaaaaccccacagtagatgggattattacaatcgacctcgatccagtgatctacgatagcaagttcgaaaaacagttagggcaagttatgctgttagttttatgtgccgttcaacttttactaatgcgcacgtcatgggctttgtgtgaggcactaacgctcgcaacaggtcctatcaccactctttgggaggggagtccaggtaagttttggaacactaccatcgctgtatcaatggcaaatattttcagagggtcatatctggctcgcgcaggcttagcctttagcataatgaaatcagtaggcacaggaaagcgcggtacaggcagccaaggagagacactaggagaaaaatggaagaagaaattaaaccaactcagtagaaaagaatttgatctatacaagaaaagtggtataactgaggtcgataggacagaagcaaaagaaggactaaagcgaggcgaaacaactcaccatgctgtttcacgcggttctgcaaagctccaatggtttgtagagagaaatatggttattcccgaaggacgagtgatcgatttgggatgtggtagaggaggttggtcctattactgtgcaggcctgaagaaagtaacagaagttagagggtacacgaaaggcggacctggacacgaagaacctgtccctatgagtacctacggatggaatatagtgaaactaatgtcaggcaaagacgtgttttacttgccaccagagaaatgtgatacattactgtgcgatataggtgagagttctccatcaccaacagtagaagaatcccgaactatcagagtattaaaaatggtggaaccttggttgaagaacaaccagttttgtataaaagtgctaaatccatatatgcctgctgttatagaacatttggaaagacttcaaagaaagcacggcggtatgctagtaagaaatccattaagtagaaactctacgcacgagatgtactggatttcaaatggaacgggaaatatcgtaagctctgtcaacatggtttcgaagttattattgaacaggtttacaatgactcatagaaggcccactatagaaaaggatgtcgatctcggtgcaggaacccgtcacgttaatgccgagcctgaaactcccaatatggacgttatcggagaaagaataaaacgtataaaagaagaacacaatagtacgtggcattacgacgatgagaacccgtataaaacttgggcataccacggcagttacgaagtcaaggcaactggaagtgcttcaagcatgataaatggagtggtaaaattattaacgaaaccctgggacgttgttccaatggttacgcaaatggcgatgactgatacgacacctttcggtcagcaaagagtcttcaaagaaaaagttgatacaagaacgccgagacctatgccaggtacaagaaaagttatggaaataacagcagaatggttgtggagaacacttggcaggaataagcgacccagactttgcaccagagaagaatttaccaagaaagtcagaacgaatgctgcaatgggggcagtcttcactgaggaaaatcagtgggatagcgcaaaggcagcagtagaagatgaagaattttggaaattagtagacagagagagggaactacacaaactgggcaaatgcggatcatgtgtatataatatgatgggtaaaagggagaagaaactcggcgaatttggtaaagccaaaggatccagagcgatatggtatatgtggttaggtgctagatatctcgagttcgaagcactcggatttttaaatgaggatcattggtttagtagagaaaactcatattcgggggtggaaggtgagggactacataaactaggatacatcctaagagacatatctaaaatccccgggggcgcaatgtatgctgacgacaccgcaggatgggacacccgcattacggaagatgacctacataatgaagagaaaatcactcagcaaatggaccccgaacacagactcctagcgaacgcaattttcaagctaacataccagaataaagtagtaaaagtccaacgtccgacaccaacgggtacagtaatggacataattagcaggaaagaccaaagaggatcaggacaagttggaacatacgggttaaacacattcaccaacatggaagcacaacttgtacgccagatggaaggggaaggggtattaagcaaggccgatctagaaaaccctcatttaccagagaagaaaattacacaatggctagaaactaaaggtgttgaacgattaaaacgaatggccatatcaggtgacgattgcgtagtgaagccaatcgatgataggtttgccaatgcattactcgcgctgaatgatatgggaaaagtaaggaaagacataccacaatggcagccaagcaagggctggcatgattggcaacaagtgcctttttgctcgcatcacttccatgagctaattatgaaagacggtcggaaattagtagtaccttgtagaccacaagatgagttaatcggacgcgccaggatttcccaaggagcagggtggtcattacgtgagacagcttgcttaggtaaggcctacgctcagatgtggtcacttatgtatttccaccgaagagatttacgactagctagtaatgctatttgttcagcggtaccagttcactgggttcctacatctagaacaacatggagcatccatgcacaccatcaatggatgaccacagaggacatgttgactgtttggaatagagtatggattgaggataatccatggatggaagacaaaacaccagtaacaacttgggagaatgtcccctacctgggaaaaagagaagatcaatggtgcggatcacttattggcctaacaagccgtgctacttgggcacaaaatatcccaacagcgattcaacaggtgagatcgctgataggtaatgaagaatttttagactacatgcctagtatgaagcgcttcagaaaagaagaagaattggaaggtgctatatggtaa

SEQ ID NO: 23026 - RNA, 9873 nt, synthetic construct
  misc_feature 1..9873: note = derived and/or modified CDS sequence (opt6) from DENV-3__KX380841__SS-prME
  source 1..9873: mol_type = other RNA
acgtcactctgtcttatgatgatcctccctgcggcactcgctttccacctcacgtcccgtgacggtgaacctagaatgattgttggcaaaaatgaacgcgggaaaagtttactctttaaaacggcatcaggaattaacatgtgcacgttaatagcaatggacctcggagaaatgtgcgatgatacagtcacctacaaatgtcctcatatcacagaagtggaacctgaagacattgactgctggtgtaatcttactagcacatgggtcacatatggaacttgcaaccaagctggggaacatcgtagagataaacgatcggtagccttagctccgcatgtaggtatgggtttagacacgaggacacaaacttggatgtcagctgaaggagcctggagacaagtcgaaaaagttgaaacatgggcattgcggcatccgggatttactattttagcactcttcctcgcacactacataggaacgtcattaactcaaaaagtcgtaatattcattttacttatgttagtaaccccatctatgacaatgaggtgtgttggtgtaggaaacagggacttcgtagaaggtctcagtggagccacttgggttgacgtagttttggaacatggaggatgcgttacaacgatggctaaaaataaaccaacgcttgacatcgaattacagaaaaccgaagccacacaacttgctacgctacggaaactatgtattgaaggaaaaataaccaacataactacagattcacgatgcccaacacaaggagaagctgtattacctgaagaacaagatcaaaattacgtttgcaaacacacgtacgttgacagaggttggggaaatggatgcggcttattcggcaaaggatcattagttacatgtgcaaaatttcaatgtttagagcctatagaaggtaaagtcgttcagtatgaaaatctaaaatatacagtcattattactgtacacaccggtgatcagcatcaagtaggaaatgaaacacagggaataactgcagaaataacccctcaggcttcgactacggaagctattctgcctgagtatggaacactcggtctggaatgtagtccgagaacgggtctagacttcaatgaaatgatcctacttacaatgaaaaataaggcttggatggtacaccgtcagtggttctttgatctgccactaccatggacttctggcgcaacaacggaaaccccaacatggaatcggaaagaactattagtaacttttaaaaatgctcacgcgaagaaacaagaagttgtcgtattaggatcgcaagagggggcgatgcatacagctctcacgggagcgactgaaattcaaaatagtggtggaacctcaatatttgctggacaccttaaatgccgactaaaaatggataaattagaattaaaagggatgtcctatgctatgtgcacaaacacgttcgtactaaagaaagaggtgtcagaaactcaacatgggaccatactgatcaaagtcgagtacaaaggagaagacgcgccatgcaaaataccttttagtacagaggatggacaagggaaagctcacaatggaagacttataaccgcaaatcctgttgtaacgaagaaagaagaacccgtaaatatagaggccgaacccccgttcggtgaatcaaacatagttattggcattggagacaacgctctgaaaataaattggtataaaaagggatcttcaatagggaagatgtttgaagctacggcaagaggagctcgcagaatggctatattaggtgatacggcttgggatttcggtagtgtaggaggtgttctaaattcactcgggaagatggtgcatcaaatcttcggttcagcatatactgcactttttagcggagtatcatgggtcatgaaaattggaataggtgttttactaacctggataggactaaatagcaaaaatacaagcatgtccttctcatgtattgctatcggaataattactctatatttgggggcagttgttcaagcagatatgggatgcgtcataaactggaaggggaaagaactcaagtgcggatcgggaatttttgtcactaatgaggtccatacttggactgagcaatataaatttcaagcagattcacctaaacgtttagcgacggcgatcgcaggggcgtgggaaaacggagtatgcggcataagaagcacaaccagaatggagaatctgctctggaaacaaatagctaacgaattaaattacatactctgggaaaataacataaaactgaccgtagttgtaggagatactataggtgtgttagaacaaggcaaacgaactctaacaccacaaccgatggagttaaaatactcatggaagacatggggaaaagcaaagatagttacggcagagactcaaaacagctcgttcattattgatggacctaatactcctgagtgtcctagcgcctcaagagcctggaatgtttgggaagtagaagattatgggttcggagtattcacgacaaatatttggctcaaattacgagaggtctacacgcaaatgtgtgaccaccgactcatgagtgcagcagtaaaagacgaacgagcagtacacgctgatatgggatattggatagaaagtcagaaaaatggtagttggaaattagaaaaagcgagcctgattgaagttaaaacatgtacttggcctaaaagtcataccctatggagtaatggggtcctggagagtgacatgatcatacctaaatcattggctggaccaatatctcaacataactatagacccggataccatacacaaaccgcaggtccatggcacttaggtaaactggaattagactttaattattgtgaagggacaaccgtggtcataaccgagaattgtggtacgcgtggaccatccttgagaacaacaaccgtatccggaaaacttatccatgaatggtgttgtcgctcgtgcacattgccaccattgaggtatatgggcgaagacggttgttggtacggtatggaaataagaccaataagcgaaaaagaagagaacatggtaaagtccttagttagtgcaggttccggaaaagtcgataacttcacaatgggagttctttgccttgccatactgttcgaggaagtgatgagaggtaaatttggtaagaaacatatgatcgctggagtattctttacatttgtcttattactgtctggccaaattacttggagagatatggcacataccttaatcatgatcggtagcaacgcttctgatcggatgggaatgggggttacttacttggctctaattgccacttttaaaattcagccatttctcgcattgggctttttcttaagaaaactcacatcccgtgaaaacttgcttctaggagtaggcctagccatggccacgacgttgcaacttccggaggacattgagcaaatggcaaatggaattgctcttggcctgatggctctaaaattaataactcaatttgaaacttaccaattgtggacagctctgatatctctaacttgttcaaatacaatttttacattaaccgtagcttggaggacggcaacgttaatattagccggagtctctctactacctgtttgtcagtctagctcaatgagaaaaactgattggttacctatgacagtagccgcaatgggggtgccgcctcttccattattcatattttctttaaaagacacattaaaaagaagatcatggcccttaaatgaaggagtcatggcagttgggttggttagcatactggcttcatcactcttacgaaatgatgtgcccatggcgggccccctagtcgccggagggttactcatagcatgttacgtcataacgggaactagcgctgacctcacagtggagaaggcagcagacgtaacatgggaagaggaagccgaacagacgggtgtaagccataatttgatgataaccgtggatgatgacggaaccatgcgcatcaaagacgatgagacagaaaacatattaacagtgttgcttaaaacggctttgctaatagtatccggaatttttccttactcaatacccgcaactcttttagtatggcatacttggcaaaaacagacccagcgcagcggagtcctttgggacgtacctagtccaccagagactcaaaaagcggagctagaagagggcgtctacaggatcaaacaacagggaatactaggaaaaacacaagttggtgtaggtgttcaaaaagacggggtatttcacacgatgtggcacgtaacaaggggtgctgtattaacacacaatgggaaaagacttgaacctaattgggcgtcagtcaaaaaggacttgataagctatgggggagggtggagacttagtgcgcaatggcaaaagggagaggaagtacaagtcatcgcagtagaaccaggcaaaaatccgaaaaacttccaaactatgcccggtactttccaaacgacaactggtgaaataggagcaatagctctagacttcaagccaggaacttccggatcaccaataattaatagagagggaaaagtggttggtctgtacggaaacggtgtggtcactaaaaatggtggatatgtcagcggtatagcgcaaacaaacgctgaaccagatggacccacaccggaattagaagaagaaatgtttaagaaacgcaacttaactatcatggatctccatccgggatcaggcaaaacgaggaagtacttacctgcgatagtacgagaagcaattaaaagacgattacgtacattaattcttgctcccacacgagttgtggcggccgaaatggaggaggctttaaagggcttaccgataagatatcaaacaaccgccactaaatctgagcatacaggaagagagatagttgacttaatgtgtcatgcaactttcacgatgcgacttttatctcccgtaagagttccaaactataatcttattatcatggatgaagcgcactttacagaccctgcctctatagcagcaaggggatacatttcaacccgcgtaggaatgggtgaagccgcagcaatattcatgacagcaacacccccaggtaccgccgatgcattcccccaaagtaatgcacccatccaggatgaagaacgtgatataccagaacgaagttggaactcggggaacgaatggattacagatttcgctggaaaaacggtttggtttgttccaagtattaaggctggcaatgacattgcgaattgcttaagaaagaacggaaagaaagtgatacaattatctcgcaagacttttgacacagaatatcagaaaactaaattaaatgattgggattttgttgtaacgacagatatcagcgagatgggagcgaatttcaaggccgatcgagtaattgaccccaggaggtgcttaaaaccagttatcttaaccgacggaccggaacgtgtaattcttgctggcccaatgcccgttaccgcagctagcgcggcccaacgtagagggcgagtgggccgtaatcctcaaaaagaaaatgaccagtacatcttcacaggtcaacccttaaataatgatgaagatcacgcacactggaccgaagcaaaaatgttattagataatattaatactccagagggtattattcctgcattgtttgagcctgaaagagaaaagagtgcagccatcgacggtgaatacaggctcaaaggagaatcacgtaaaacattcgtagagcttatgagacgaggagacctgcccgtatggttagctcataaagtcgcatcagaaggaattaaatataccgatcgaaaatggtgttttgacggccaacgcaataatcaaattttagaagagaatatggatgtagaaatctggacaaaggaaggcgagaaaaagaaattgaggccacggtggctggatgcaagaacatattccgatcccctagccttaaaagaatttaaagactttgctgcaggcagaaaatccattgcccttgatttggttacggagataggaagagtaccttcgcatcttgcgcatagaactcggaatgcactagataacctagtcatgttacacacatcagaacacggtgggcgagcctataggcatgccgtagaagagttacctgaaacaatggaaacgctcttattactcggtctaatgatactactcacaggaggagccatgttatttttaattagtggaaaaggtatcggaaaaacgtcgataggattgatttgcgtgatagcatcttcgggtatgctgtggatggctgaaatacctcttcaatggatagcaagtgctatcgtactggagttcttcatgatggtactcctcatccccgaaccagagaagcaaaggactccccaggacaaccaactcgcctacgtagttatcggtatcctaacaatggctgcaattatcgctgccaatgaaatgggcttattagaaacaacgaagagggacctaggtatgtcaaaggaacctggagtagtttctccaacgagctacctagatgtagatttacatccagcaagtgcatggactctgtacgcggttgcaactacggttataacacctatgttacgacacactattgaaaattcaacagcaaatgttagcctcgccgctattgcaaatcaggcagtggtccttatgggcttagataaaggttggccaatctctaaaatggatctaggagtcccattacttgcattggggtgctatagtcaagtgaatcctttaacccttacagcagctgtacttctcctagtgacgcactatgcgataattggacctggactgcaggcaaaagcaactagagaagcacaaaaacgcacagcagcgggcattatgaaaaaccctacggtagacggaattataaccattgacctagatccagttatttatgactccaaatttgaaaagcaattgggtcaagtaatgctacttgtattatgtgccgttcaacttctcctaatgcgaacaagttgggctttgtgtgaagcactaactcttgctaccgggccgatcactacgctatgggagggctcgccaggcaagttttggaatactacaattgccgtatcaatggcaaacattttcagaggtagttacttagcaggcgcaggtttagcttttagcattatgaaatccgttggcacaggtaaacgtggaactgggagtcaaggggaaaccctgggagaaaagtggaagaagaaattgaatcaactatctagaaaagaatttgatctttacaagaaaagtggaataacagaggtggatagaacagaagcaaaagagggactaaaacgaggggaaactacacatcatgcagtgagtcgtggatccgctaaattacaatggtttgtagaaaggaatatggttataccggaaggtcgtgttatcgacctaggctgtggacgtggcggatggagttactattgcgcaggtcttaagaaagtgacggaggtgagaggttatactaaaggagggcctggtcatgaagaaccagttcccatgagtacgtatgggtggaatatagtcaagttaatgagtggcaaggatgttttctacttaccgccagaaaagtgcgacacattgttatgtgatataggagaaagctcacctagtcccacggtagaagagtcccgaaccatacgcgttttaaaaatggttgaaccatggttgaaaaataatcaattttgtataaaagtcctaaatccttatatgccagccgtaattgaacatctagaaagactacaaagaaaacatgggggaatgttagtaagaaaccctctgtcgagaaactcaacacatgaaatgtattggatttctaacggtacaggaaatatagtctctagcgtcaacatggtatcacgattgctactgaatagatttactatgacacacagacgacccacgatcgaaaaggatgttgacctaggcgctggtacgcgtcatgtcaatgccgaaccagaaacgccaaacatggatgttattggcgaacgtataaagcggatcaaagaagaacataatagcacatggcattacgatgacgagaatccatacaaaacatgggcatatcatggatcgtatgaagtaaaagcaaccggttctgcttcatcaatgataaacggtgtagttaaacttctaactaaaccttgggacgttgttccgatggtaacccaaatggcaatgacggataccacccctttcggacaacaacgagtatttaaggaaaaagtagatacacgaacccctaggccgatgcctgggactagaaaagtgatggagataacagctgaatggctatggagaacacttggtagaaataaaagaccacgattgtgtacgagagaggagtttactaagaaagtcagaacaaatgcagctatgggagccgtatttaccgaagaaaatcagtgggatagcgccaaagccgctgttgaagatgaggaattttggaaattagtagaccgagaacgagaactacataagttgggcaagtgcggctcatgcgtgtacaatatgatggggaaacgcgagaagaaactaggggagttcggcaaagcaaaagggtcgcgtgcaatatggtacatgtggttgggagcacggtatttagaatttgaggctttgggatttttaaatgaggatcactggttttctcgagaaaactcttactccggcgtagaaggcgaaggactacacaaattaggatatatactacgagatatttccaaaatcccagggggcgcgatgtacgcagacgacacggccggatgggatactcgaataacagaggatgacctacataacgaagagaaaataacgcaacaaatggatccagaacaccgacttttagccaacgctatatttaaacttacataccaaaataaagtggttaaagtgcaacgtccaacaccgacaggtacagtcatggatattatctctcgtaaagaccaaaggggatcaggacaagtaggcacttacggactgaatacatttacaaacatggaagcacaacttgtacgtcaaatggaaggtgaaggtgttcttagtaaaacagatcttgaaaatccacatttaccggagaagaaaatcacacagtggctcgaaactaaaggcgtcgagagactgaagcgaatggcaataagcggggacgattgtgtagtaaaacctatcgatgataggtttgctaatgctcttttagcattaaacgacatgggtaaagtaagaaaggacattcctcagtggcagccaagtaagggatggcacgactggcaacaagttccattttgctcacatcattttcacgagttaataatgaaagatggacgtaagttagtagtcccctgtagacctcaagatgaactaatcggtcgcgcaagaatatcacagggtgcaggttggagtctacgcgaaactgcatgtttaggtaaggcttacgcccagatgtggagtctaatgtactttcacaggcgtgacttaaggttagcaagtaacgcgatatgcagcgcagtaccggtccattgggtaccaaccagtagaacgacatggtcaattcacgcccatcatcaatggatgacaacagaagatatgctaacagtttggaacagagtatggattgaagacaatccttggatggaggacaaaacaccaattactacttgggaaaatgttccctatcttggtaaacgtgaagaccaatggtgcggaagtctaataggactaacaagtagagcaacatgggctcaaaatattcccacggcaatacaacaagtaaggtcactgataggcaatgaagaatttcttgattatatgccctctatgaagcgatttcgcaaagaagaagagagtgaaggagcaatatggtaa

SEQ ID NO: 23027 - RNA, 9873 nt, synthetic construct
  misc_feature 1..9873: note = derived and/or modified CDS sequence (opt6) from DENV-3__KX380842__SS-prME
  source 1..9873: mol_type = other RNA
accagtctctgcttgatgatgatattaccagcggccttggcttttcacttaacgtctagagatggggaaccgcggatgatagtaggtaaaaatgaacgaggtaaatctctattatttaaaactgccagtggaataaatatgtgtactctgattgccatggacctcggtgaaatgtgcgatgatactgtaacatataaatgccctcatataacggaagttgaacccgaagatattgattgttggtgcaatcttacaagcacttgggtaacatacgggacctgtaatcaagcaggggaacacagacgcgataaaagaagtgtagcactggctccacacgtagggatgggtttagataccagaacacaaacctggatgtcggcagaaggggcttggcggcaagtggaaaaagtagaaacatgggcacttaggcatccaggttttacaattctcgcgttatttctagcacactatattggcacatcgcttacgcaaaaagttgttatattcatcctacttatgctagtgactccaagtatgacaatgaggtgcgttggggttggaaatcgcgactttgtcgaagggttatcaggtgcaacttgggtagatgtagtattagaacacggcggctgtgtaactaccatggctaaaaacaaaccaacacttgatatagaattacagaaaaccgaagccacacaattagcgacgctgagaaaactttgtattgaaggcaaaataacaaacataacaacagactcacgttgcccgacacagggtgaagctgtattacccgaagaacaagatcagaactacgtatgtaaacatacatatgttgatagggggtggggcaatggatgtggtttatttggtaaaggtagtttagtgacgtgtgcgaaatttcagtgtttggaacctatagaaggcaaagttgtacaatatgaaaacttgaaatacacagtgattattactgtccacacgggcgaccagcaccaagtaggtaatgaaacgcaggggataacagcggaaatcacaccacaggcatctactactgaagctattttacccgaatatggtactttagggctagaatgtagtccacgcacaggtctagattttaacgaaatgattctgctgacaatgaagaacaaagcatggatggtacatagacagtggttctttgacttacctctgccatggactagcggggcaactaccgaaactcccacatggaatcgaaaagaacttttagtaacattcaaaaacgcacacgcgaagaaacaagaagtcgtcgtgctgggttcacaggaaggagccatgcacacagctttgacaggagcaactgaaatacaaaatagcggaggcacaagtatatttgcaggtcatttaaaatgtagactaaaaatggacaaactagaattgaaaggtatgagctacgctatgtgcacaaatacattcgtacttaagaaagaagtgagtgaaacgcaacatggaacaatacttatcaaggtagaatataaaggcgaagatgcaccttgcaaaattccattcagtacagaggatggacagggtaaagcacataatggtagactgataacggcgaacccagtagtaactaaaaaggaagaacccgtgaacattgaagccgaacccccttttggcgaaagcaacatcgtgattggtataggtgacaatgcattaaaaatcaactggtacaaaaagggtagttcaattggaaaaatgtttgaggcgactgcaagaggagcaagacgcatggcaattttaggggacaccgcgtgggatttcgggtcagttggaggtgttttaaattcactcggaaagatggtccatcaaatattcggatcagcgtatacagctctgtttagtggagtctcatgggtgatgaaaataggtattggcgtgttactgacatggattggactaaattccaaaaatacaagtatgtcattttcttgtatagcaatcggcataataactttatacctaggggcggttgtgcaagccgatatgggctgtgtaatcaactggaaagggaaggaactcaagtgtggttcaggaatatttgtaacgaacgaagtacacacgtggaccgaacagtataagtttcaagcagatagtcccaaacgccttgcgacagccattgtaggtgcctgggaaaatggtgtctgtgggatcagatcgacaacacgaatggagaatctactctggaaacaaatagcaaatgaactaaattatatactatgggaaaacaatataaaactaacggtagtggtgggcgatacaattggggtactagaacaaggtaaaagaactctaacaccccagcccatggaactgaaatatagttggaaaacatggggcaaagcaaaaatagtaacggcagaaacacagaatagctcttttataatcgacggaccaaacactccagaatgcccctcagcatcgcgagcatggaatgtctgggaagtagaggattatggatttggagtttttacaactaatatttggttaaaattacgggaagtatatacacagatgtgtgaccaccgcctaatgtctgcagcagtgaaagatgaaagggccgtgcacgcagatatgggatattggatagagagtcagaaaaatggctcatggaaactagaaaaagcatccttgatagaagtaaaaacctgtacgtggccaaaaagtcacacactttggtccaatggtgtactagaatctgatatgataatacctaaatctctggctggtccaatatctcaacacaactataggccaggttaccacacacaaacggcaggcccctggcatctagggaaacttgagttagactttaattattgtgaagggactacagtggtcataaccgagaactgtggtacaagagggcctagccttagaacgactacggtttctggaaagttaatacatgaatggtgttgtagaagctgcacccttccgcctcttcgttacatgggagaagacggatgttggtatggtatggaaatccgacctatctctgaaaaagaagaaaatatggtaaaaagtttggttagtgccggttcaggtaaggtagacaatttcacaatgggagttttatgtctagcaatattgtttgaagaggtgatgcgtggaaagtttggtaagaaacatatgatagctggagtattctttactttcgttctactcttatccggacaaataacctggagagacatggcacacacattgatcatgatcgggtcaaacgcaagtgatagaatgggaatgggagtcacctacttagcattgatagcgacttttaaaatacaaccatttctcgccttagggtttttcctgcgaaaattaacatcgcgtgaaaacctcttgcttggtgttggacttgcaatggcaaccacgttacaattgcccgaggatatagaacaaatggccaatggaatcgcacttggattaatggcactaaaacttataacgcaattcgaaacttaccaactatggaccgcattaataagtttaacatgctctaacacaatctttacccttaccgtagcgtggagaacggccacacttatcctcgctggagtttcgcttttgccagtatgtcagagctcctctatgagaaaaactgattggttacccatgacagtcgcagcaatgggggtgcccccattgccgctatttatattttcgttaaaagatacgctgaagagaagatcttggccccttaatgagggtgtaatggcagttggactcgtctcaatgttagcgagttctcttcttaggaacgatgttcctatggcaggacctttagtcgccggcgggttattaatagcgtgctatgtaataacaggcacgtctgctgacctcacagtagaaaaagcagcagacgtaacctgggaagaagaagcagaacaaacaggcgtatcacataatttgatgataactgttgacgatgatggaacaatgcgaattaaggacgatgaaacagaaaacatactcaccgtactccttaaaacggcattgttaatagttagtggaatttttccatattctatacccgccacgctattagtttggcatacttggcaaaaacagacacaaaggtctggcgttttatgggacgttccttccccacccgaaactcaaaaggctgaattagaggaaggcgtttatcggatcaaacaacagggcatattaggaaaaactcaagtcggcgtaggtgtccaaaaggatggagtcttccacacgatgtggcatgttacaagaggagctgtattaacacacaatgggaaaagattagagcctaactgggcctcagtaaagaaggaccttatttcatatggaggtggttggagattatcggcacagtggcaaaaaggcgaagaagtacaagtgatagcagttgagccgggtaaaaatcctaaaaattttcagactatgcctggaacctttcagacaactacaggtgaaataggcgccattgctctcgattttaagccgggcacatccggcagtccaatcataaaccgagaaggtaaagttgttggattgtatggtaacggggttgttactaaaaacggaggatacgtatctggaatagcacaaaccaatgcagaaccggatggacccacacccgaattagaagaggaaatgtttaagaaaagaaacttaacgattatggaccttcatcctggaagtggaaagacacgaaagtatttaccagcaatagtacgcgaagcaatcaaaagaagactaagaaccttgattttagctccaaccagagtggtggcggcagaaatggaagaagccttaaaggggctacctataagataccaaacaactgccacaaaaagtgaacacacaggaagagaaattgtagatttaatgtgccatgcaacatttacaatgcgtttattaagtcccgtacgagtacccaactacaatctaattataatggatgaagctcactttaccgatccagcatcaatagccgcacgcggatacatatcaactagagtcggcatgggggaagccgcagcaatattcatgacggctactccaccaggaaccgctgatgccttcccacaatctaatgcccccattcaagatgaagaacgcgacataccggaaaggagctggaatagcggaaacgaatggattaccgatttcgctggtaagactgtctggttcgtccccagtattaaagcaggcaatgatatagccaattgtctccgcaaaaatggcaagaaagttatccaactgagtaggaaaacgttcgataccgaatatcagaagacaaaactgaatgattgggactttgttgtaacaaccgacataagcgaaatgggagctaattttaaagcagatagagtaatagaccccagacgatgcctgaagccagtgattctcaccgacgggccggaaagagtaatcttagctggccctatgcctgttacagcagcatctgcagcacaaaggagagggagagtaggtagaaatccccagaaagaaaatgaccaatatatttttacggggcaacctttgaacaatgatgaagaccatgcacactggactgaagcaaaaatgttattagacaatataaatacaccagaaggaataatacccgctttgtttgagccagaacgagagaaaagcgcagcaattgacggtgaataccgactcaagggtgaatctagaaaaactttcgtcgaattgatgaggagaggcgacctaccagtatggttagcgcataaagtagcatcagaaggtatcaaatacacagacagaaaatggtgtttcgatggtcagaggaacaatcaaatcctagaagaaaatatggatgtagaaatttggaccaaggaaggtgagaagaagaaactgaggccgcgctggctagatgcaagaacctactcagatccgttagctttaaaagaatttaaggatttcgcagcgggcagaaaaagcatagcactggatctagttacagaaataggcagagtaccatctcatctggcccatcgaacacgtaacgcattggacaatctagtaatgttgcacacatcggaacacggagggcgagcatacagacacgcagtggaagaactcccagagaccatggaaacgctcctactattgggtcttatgatattgttgacaggcggcgccatgctatttctgatttcaggaaaaggaattggtaaaacatcaataggactaatttgtgtcatagcaagctccggaatgttgtggatggcagagataccattacagtggatagcatcggctattgttcttgaatttttcatgatggtactattaattccagagccagaaaaacaaagaacgccgcaggataaccagctcgcatacgttgtaataggaattttaactatggcagcaatcattgcagccaacgaaatggggttgttagagactactaaacgagatttaggtatgtcaaaggaaccgggggttgttagcccgacctcttatttagatgtagacttacatccagcgtccgcatggacgctgtatgctgttgcaacaactgtaataacacccatgttacgtcacacaattgaaaactcgactgcaaacgttagtttggcagcaattgcaaaccaagcagtggtattgatgggtttagacaaagggtggcccatatcaaaaatggacttaggtgttccactgctagcattgggatgctatagtcaggtgaacccattgaccttaacagcagcagtgttactactcgtgactcactatgcgatcataggaccggggctacaagcgaaagctacccgggaggctcaaaaacgtactgcggccggaatcatgaaaaatccaactgtcgatggtatcattaccattgatctagacccagtaatttatgatagcaagtttgaaaaacaacttggtcaggttatgttattagtattatgcgcagtacaattattgctcatgagaacaagctgggccctatgcgaagccttaaccctcgcgactggtcccattacaacactgtgggaagggtcgcctggtaaattttggaacactacgattgcagtatcaatggcaaacatattcagaggaagttacttagcgggcgccggactggcatttagtattatgaaatccgtaggtacgggtaaaagagggacaggaagtcaaggagagacgttaggagaaaaatggaagaagaaattgaatcagttgtcaagaaaagaatttgatttatataagaaaagtggaatcacggaagttgatcgaacagaagcaaaagaaggattaaaaagaggcgaaactactcaccatgcagttagtcgaggaagtgcaaaactccaatggttcgtagaaagaaacatggtgattcccgaaggccgagttatagatttaggttgcgggagaggcggctggtcgtattactgtgcaggcctaaagaaagtaacagaagttagaggttacaccaaaggaggaccaggccacgaagaacctgttccaatgtctacgtacggctggaacattgtgaagctgatgagcggaaaggacgtcttttacctaccacccgaaaaatgtgacacactactatgcgatatcggcgaatctagtccttcaccaactgtggaagaaagtcgcactataagagtgctaaaaatggtggaaccctggctgaagaataatcaattctgcataaaagtcctcaacccgtacatgcctgcagtaatagaacatctcgagagactacaaagaaagcacggaggtatgcttgtgagaaaccccttgtcgcgaaattccacacacgagatgtattggatctccaacggaactggtaacatagtctctagtgtaaatatggtcagtagattgttgttgaataggtttaccatgactcacagaaggcctacaatagaaaaggatgtggacttaggtgcaggaaccagacatgtaaatgcagaaccagagacacctaatatggacgtaataggcgaacgaattaaaaggattaaagaagaacacaattcaacgtggcactatgacgatgagaacccatacaaaacctgggcttaccacggatcatatgaggtcaaagctactggctctgcatcgtctatgattaacggtgttgtaaagctattaacgaagccttgggacgtcgtgccaatggtcacacagatggcaatgacggacacaacaccttttggccaacaacgagtttttaaagaaaaggtagataccagaacaccaaggccaatgcccggaacgagaaaagtgatggaaatcacagcagagtggttatggaggacactgggacgaaataagagaccacgcttatgcactagggaagagttcaccaaaaaggtccgcactaacgccgcaatgggcgctgtctttacagaagaaaaccagtgggatagtgccaaagctgcagtcgaagatgaagagttctggaaactcgtagatagagaaagagagttacacaaactcggtaaatgtggcagttgtgtatacaacatgatgggaaagagagagaagaaactcggggaatttgggaaggcaaaaggcagtcgtgctatatggtatatgtggctcggggctcggtatttagaatttgaggcattaggatttttaaacgaagaccactggttcagtcgagaaaactcgtattctggagtcgaaggcgaaggattacataaactaggttacatcctaagagacatcagtaagattccgggaggagcaatgtatgcagatgatactgctgggtgggatacccgaattacagaagatgacctacacaacgaagagaaaatcacccagcaaatggatcctgaacatcgactcctggcaaatgcaatctttaaattaacataccaaaataaagtcgtgaaagtacaacggccaacgccaacgggaacagtaatggatattatatcacgcaaagatcaacgtggtagcggtcaagtaggtacctatggtttaaatacatttactaatatggaagcgcagcttgtaaggcagatggaaggcgagggcgtactatcaaagacagatctagaaaaccctcatctaccagagaagaaaattacgcaatggttagaaacaaagggtgttgaacgcctaaaaagaatggccatttccggagacgactgcgttgtaaagccgatagacgatagatttgcaaacgccctgcttgctctaaacgatatgggaaaggtcaggaaagacataccccaatggcagccatctaaagggtggcacgactggcaacaagtgccattctgttcccatcactttcatgaacttataatgaaagacggccgcaagttagtcgtgccctgtcgtccgcaggatgaactaatagggagagcccgaatttctcaaggtgccggttggagtttacgcgaaacagcctgtctaggtaaagcatacgctcaaatgtggtcattgatgtattttcataggcgtgatttaagattggcatcgaatgcaatttgtagtgctataccagtacactgggttccaacatcacgtacgacatggtccatacatgctcaccaccagtggatgaccaccgaagatatgttgaccgtatggaatagagtatggatcgaagataacccgtggatggaagataaaactcccataacaacgtgggaaaatgtcccttatttgggaaaaagagaagatcaatggtgtggatctctcataggactcacgtcaagagcaacatgggctcagaacatccccacggcaatacaacaggtccgttcgctgataggaaacgaggagttcttagactatatgccgtcaatgaagcgttttcgtaaagaagaagagagtgaaggagcaatctggtga

SEQ ID NO: 23028 - RNA, 9873 nt, synthetic construct
  misc_feature 1..9873: note = derived and/or modified CDS sequence (opt6) from DENV-3__KX380839__SS-prME
  source 1..9873: mol_type = other RNA
acaagtttatgcttaatgatgatgttgcctgcaacactagcatttcatttgacatcaagagacggtgaaccaaggatgatcgtaggtaaaaacgaacgaggaaaatcgctacttttcaaaactgcaagtggtataaatatgtgtaccttaatagctatggatctcggagaaatgtgtgacgacacgataacttataaatgtccgctaatcacagaagtcgaacccgaagatatcgattgctggtgtaaccttacctcaacttgggtaacatacggtacttgtaaccaagcaggagaacaccgccgagataaacggagtgttgctctagctccccatgttggaatgggactcgatacaagggcccaaacatggatgagtgcggaaggagcatggaggcaagtagaaaaagtagaaacttgggctttccgccacccaggatttacaatattagcacttttcttagcgcactacatagggacatctctaactcaaaaagtcgttatcttcatcctattgatgcttgtcacgccttccatgacgatgaggtgcgttggtgtaggcaatagggactttgttgaagggttaagtggagcaacgtgggtagacgtcgtattagaacacggaggttgtgttacaacgatggctaaaaacaaaccaacattggacatagaattacagaaaacggaagctactcaactggcaacattacggaaattatgtatagaagggaaaattacaaacgtaacgacagactcaaggtgtccgacacaaggagaagcgaccttgcctgaagaacaagaccaaaactacgtttgtaaacacacatatgtggacagaggatggggtaatggttgtggcttatttggaaaaggatcactggtaacttgtgcaaagtttcaatgcctcgaactaactgaagggaaagttgtacaacatgagaacttaaaatatacggtaataattactgtacatacaggtgatcaacaccaggtaggaaatgaaactcaaggggtcaccgcagaaataacaccacaggcttcaactgttgaagcaatattcagatcttatgggacattaggcctagaatgttccccacggactggactagactttaatgaaatgattttgttaacgatgaaaaataaagcgtggatggtacatagacaatggttctttgacctccccttaccatggacatctggggctacaactgaaacacccacatggaacaagaaagaacttctcgttacatttaaaaatgcccacgccaagaaacaagaagtggtagtactgggatctcaagaaggagccatgcatactgctctcactggtgcaacggaaatccaaacatctggagggacgtctatttttgcaggtcacctgaaatgcagactcaaaatggacaaactagaactaaaagggatgtcgtacgcaatgtgttcaaatgcgtttgtattaaagaaagaagtgtcggaaacccaacatggtactattcttataaaagtagagtataaaggcgaagacgccccatgcaaaataccgttttcaactgaggatggacagggaaaagcccataacggcagactaataaccgccaacccagtagtcacgaagaaagaggaaccagtaaatatcgaggcagaaccgccgtttggtgagtcgaatattataattggaattggtgataaagcactaaaaataaattggtataagaaaggatcaagtattgggaaaatgttcgaagcaacggcaagaggggctcgtagaatggctattctgggtgatacagcatgggactttggttctgtaggaggcgttcttaatagcttaggaaagatggttcatcaaatatttggttctgcatacacagctctcttctcaggtgtatcctggataatgaaaataggcataggagtactactaacatggatagggctcaacagcaaaaatacctcaatgtcgtttagttgcattgtgattgggataatcacgctctacttaggggctgtcgtgcaagccgatatgggctgcgtaataaattggaaaggaaaagaactgaaatgcggtagtggtatctttgtcacaaatgaggtacatacatggactgaacaatacaagttccaagcagattccccgaaacgactcgccacagccattgccggcgcctgggaaaacggcgtatgtggaatccgcagtacgacaagaatggagaacctattatggaagcaaatagcaaatgaactgaattatatattatgggagaataacataaaactaacagtggttgttggagacataataggcatactagagcagggaaaacgtacattgaccccacaaccaatggaattaaagtactcgtggaagacatggggtaaagcaaaaatcgtcactgcagaaacacaaaactcttcatttataatagacggaccaaacacaccagaatgtcctaatgctagtcgcgcatggaacgtatgggaggtcgaggattacggcttcggagtattcacgacaaacatatggttaaaattaagagaaatgtatacacaattatgcgaccacaggttaatgtcagcagctgttaaagacgaaagagcagttcatgctgacatgggatactggatagagtcccagaaaaatggtagttggaagttggaaaaggcatcgcttatagaggtaaagacgtgtacatggcctaaatcacacacattgtggagcaacggtgtattggaatctgatatgattattcccaaatcgttggcgggacccatatcacagcataattatagacccggatatcatacacaaacagcagggccctggcacctaggaaaactagagttagattttaactactgcgaagggacaacggtagttataacagaaaattgcggcacaaggggcccaagcctaagaacaacaactgtctctgggaaattaatacatgaatggtgctgtagatcatgtaccttaccgccattaagatatatgggagaggatggatgctggtatggtatggaaattagacctataaacgaaaaggaggaaaacatggtaaagtcacttgtaagtgcggggtcggggaaagttgacaattttacaatgggtgttctatgcttggcaatactattcgaagaagtaatgaggggcaagttcggcaagaaacacatgatcgcaggagtgttatttactttcgtcttgttgttatctggacagatcacgtggcgagatatggcgaggacactaattatgataggtagcaatgcgtcggatagaatggggatgggagtcacctatttagctctcatagcaacctttaaaattcaaccattccttgcattgggatttttccttcgtaaactaacatccagagagaacttactgctaggtgtaggactagctatggcaactaccttacaactcccagaggatatagaacagatggccaacgggatagctttaggtcttatggcacttaaactaataacacaattcgaaacgtatcaactatgggcagctctagtaagtctgatgtgttcaaacaccatatttactctgactgttgcttggaggacggccacattaatcctagcagggatttcattattacccatgtgtcaatcctcaagtatgcgtaagactgactggctacccatgaccgtagcagcaatgggagttccaccgcttccgctattcatattttcccttaaggacacactcaagcgcaggtcatggcccttaaacgaaggcgtaatggcagtcggtttggtatcaattctagcatcgtcgcttctaagaaatgatgtaccaatggcaggtcctcttgtagctggcggcttgctgatcgcctgttatgttataacaggaacgtcggcggatttaactgtagaaaaagcagcagatgttacgtgggaagaagaagccgagcaaacaggcgtctcacataatctgatgataacagtggatgatgacggtacaatgagaattaaagatgatgaaacggaaaacatattaactgtcctgttgaaaaccgcattactgatagtgtccggaatatttccctatagtatacctgccacgttattggtatggcatacttggcaaaaacaaacccaacgcagcggagttctgtgggatgtgccttctccaccagaaacacaaaaggcagagctagaagaaggtgtttaccgaatcaaacaacaggggatatttggaaaaacacaagtcggcgtaggcgttcaaaaggaaggtgttttccacacaatgtggcatgttactcgaggagcagtgctcacacataatggaaaacgattagaaccaaattgggctagtgtcaagaaagatctgatttcatatggaggcggatggcgcctctcggcacaatggcagaaaggtgaagaagtacaagtcatagcagttgaacctggcaaaaaccccaaaaacttccaaacaatgccgggcatatttcaaacaactactggtgagataggtgctatagcattagattttaaacccggtacatccgggtcgcctatcataaacagagaaggaaaagtagttggtctctatggcaacggggtcgttaccaaaaatggcggatacgtaagcggaatagcacaaacaaatgctgagccggatggacctactccagaattggaggaagaaatgttcaagaaacgaaatttgacaataatggatttacatcccggttcaggtaagacaaggaaatatctgcccgcaatagtgcgtgaagcaataaaacgaagacttagaacattgattcttgcaccaacaagagtagtagctgctgaaatggaagaggcgttaaaaggattaccaataagataccagaccactgcaaccaagtccgagcacaccggaaaagaaattgtagatttaatgtgccacgctacttttactatgcgactcttaagccctgtaagagtccccaactacaatctcataatcatggatgaggcgcatttcacagatcccgcctcaatagcagcgagaggttatatctctacacgcgtaggaatgggagaagcggctgccatctttatgaccgccactcctcccggaactgccgaagcatttccccaaagtaatgccccaatacaagatgaagaacgcgacatccctgagagatcttggaactctgggaatgactggatcaccgattttgctggaaagactgtatggttcgtgccttcaataaaagcgggtaatgatattgctaactgtctaaggaaaaacggaaagaaggtaatacaattgtctaggaaaacgttcgatacagaatatcaaaagacaaaattgaacgattgggacttcgtagtaactacggatatttctgaaatgggggctaattttaaagctgatagggttatagatcctagaagatgtctaaagccagtaatactgacagatggtcctgaaagagttatacttgcgggccccatgccggtgactgtagcaagcgccgcccaaagacggggacgtgttgggcgaaatccccaaaaggaaaacgatcaatacatattcacaggacaacctctaaacaatgatgaagaccacgcccattggacggaagcaaaaatgctactagacaatattaacactccggaaggtataatacccgcactcttcgaaccagaaagagagaaaagtgcggctatagacggcgagtatagattgaagggagaaagtagaaagacatttgtagagctaatgcgtaggggagatctccctgtctggcttgctcacaaggtggcgagtgagggaataaaatatacagatagaaaatggtgtttcgacggagaacgcaataatcaaatacttgaagaaaacatggatgtggagatatggactaaagaaggagagaagaagaaacttcggccacgatggctcgacgctaggacctactcagatcccttggctttaaaagaatttaaagacttcgctgcaggaagaaaatcaatagcattagacctagtgaccgagatagggcgtgtaccacctcacctagcacaccggactaggaatgccttggataatctagtcatgttgcatacaagtgaatatgggggtcgcgcgtaccgacacgcagtagaggaacttccagaaacgatggaaactctattattactaggtttaatgatactacttacagggggagtcatgcttttcttgatcagtggcaaaggtgtcggaaaaacttccataggattaatttgtgtggtggcatcatcgggcatgttgtggatggctgatatacctctccagtggatcgcgagcgcaatagtattggagttcttcatgatggtactactgataccagagcccgaaaaacaacggaccccacaagacaaccaattagcgtatgtagtaataggcatcttaacgttagcggcaatagtggccgcaaacgaaatggggctacttgaaaccaccaaaagagatttgggaatgagcaaagaaccgggagttgtaagccccacttcatatttagacgtggaccttcatccagcctctgcatggaccttatatgcagtagctactactgtaataactccaatgcttcgacatacaatagagaacagcacggctaatgtatcgttagcggcgatcgctaatcaagctgtggtattgatgggcttagataaggggtggcctattagtaaaatggacttaggagttccgctactcgctctgggatgctactctcaagttaatcctctaactttaaccgcagcagttcttttgctagtaacacactatgccataatcgggcctggcctacaagcaaaagcgaccagagaagctcagaaaagaacagctgctgggataatgaaaaatccaactgtcgacggaatcatgactattgatcttgatccagttatttatgacagcaaattcgaaaaacagctaggtcaagtaatgctattagttttgtgtgcagtacagctactcctgatgagaacatcctgggcattttgcgaggcattaacattagcaacaggaccaattactacgttgtgggaaggatcaccaggaaaattttggaatactactatagcagtatccatggccaatatatttcgagggtcttatctggccggtgcaggcttagcgtttagtattatgaaatcagtaggaaccggtaaaaggggaaccgggtcacaaggtgaaaccttgggagaaaagtggaaaaagaaattaaaccaattatcacgaaaagaatttgacttatacaagaaatcgggtatcacagaagtagaccgtactgaagcgaaagagggactaaaacgtggagaaataacgcatcatgccgtatctcgaggaagtgcgaaactgcaatggtttgtagaacgaaatatggtcatacctgagggaagagtcatcgatttaggatgcggaagaggtggatggtcatactattgtgccggtctaaagaaggttacagaagtacgagggtatacaaagggagggccgggccatgaagaacccgttccgatgtcaacatatggttggaatatcgtaaaactaatttcgggaaaggatgtattttacctaccaccagaaaaatgtgataccttgttgtgtgatataggagaatcttcgccgagtcctactgttgaagagtccaggacaatccgtgttctcaaaatggtagaaccttggctgaaaaacaatcaattttgcattaaggtactaaacccatacatgccagctgttattgaacatttagagagattacagagaaaacatggtggtatgttagtacgtaaccccttaagcaggaacagtactcacgaaatgtattggatttcgaatggaaccggtaatattgtttccagcgtaaacatgatatctagactgttattaaatagatttactatgacctatagaagacctaccatagagaaagatgttgatttaggagcagggacaagacacgtaaatgcggagccagaaacacctaacatggacgtaataggagagagaataagaaggattaaagaagaacactcatcgacttggcattatgatgatgagaatccatacaaaacatgggcataccatggaagctatgaggtaaaagcaacaggatccgcgtcctcaatgatcaatggcgtagtcaagttactgacgaaaccttgggatgtcgtaccaacagtgactcaaatggcaatgactgataccacaccatttggccaacaacgggtctttaaagaaaaagtagatacacgtacaccaaaaccaatgccaggaaccagaaaggtaatggaaattacagccgaatggttatggagaaccctgggacgtaacaaaagacctagactatgtacaagagaggaatttacaaagaaagtaagaaccaacgctgccatgggtgcggtatttactgaagagaatcaatgggatagtgcgcgtgctgcagttgaggacgaagagttctggaaattagtagacagagagagagaattacataaactagggaaatgcggttcttgtgtatataatatgatgggtaaaagagagaagaaactcggagagttcggaaaagcaaaaggttcacgtgcaatatggtacatgtggctaggggcgagatatttggagtttgaggcactaggtttcctaaatgaggatcactggttcagtcgtgaaaacagttatagtggagttgagggggaaggactccataaactaggatatatactaagggatataagtaagataccgggaggtgctatgtatgcagacgatacggcaggatgggatactcgcataacggaagacgatctgcataacgaagagaaaataactcaacagatggatcctgaacatcgacaactagcgaacgctatatttaaactaacatatcagaacaaagtggtaaaggtacaaagaccaactccaaaagggactgttatggacataatttccaggaaggatcaaagaggcagtggccaagtggggacatatggcctcaatacatttaccaatatggaggctcaattaataaggcaaatggaaggagaaggtgtacttagtaaaacggaccttgagaaccctcatttactagagaagaaaattacacaatggttggaaacaaaaggagtagagagacttaaaagaatggcaatatcaggtgatgactgtgtagttaaacctattgacgacagatttgcgaacgctttacttgcactaaatgatatgggaaaagtcagaaaagacattccgcagtggcaaccttcgaagggatggcatgattggcagcaggttccattctgtagtcatcatttccatgagctcataatgaaagacggtagaaaattagtagtaccttgccgaccacaagatgaactaataggcagagcgcgaatatcacagggggcagggtggtcattaaaggaaacagcatgtttggggaaagcgtacgcacaaatgtgggcccttatgtactttcatagacgggatctaaggttagcatctaacgcaatttgcagtgctgtccccgtacactgggtgccaacgtcccgaaccacatggagcattcatgcacatcatcagtggatgacaactgaagacatgctaacggtatggaacagagtgtggatcgaagacaacccatggatggaagacaagacacctgtaacaacgtgggaggacgtcccgtatctgggcaaaagagaagatcagtggtgtggatctttaataggtctaacatcgcgagcgacgtgggcccagaatattctcacggcaatccaacaagttagaagccttataggaaacgaagaatttttggactacatgccatcaatgaaacgtttcagaaaggaggaggaatccgagggtgcgatctggtga

SEQ ID NO: 23029 - RNA, 9873 nt, synthetic construct
  misc_feature 1..9873: note = derived and/or modified CDS sequence (opt6) from DENV-3__KX380840__SS-prME
  source 1..9873: mol_type = other RNA
acaagtctttgcttgatgatgatgctgccggcaacactagcttttcatctgacaagcagggatggggaacccagaatgatcgttggtaaaaatgaaagagggaaatctctgttgtttaaaacagcatccgggattaatatgtgcaccctaattgcaatggaccttggtgaaatgtgtgatgacacaataacctataaatgtcccctaataacagaagtagaacctgaagacattgattgttggtgtaatctgacaagcacttgggtaacttatgggacatgcaaccaagcaggagaacatagaagagacaaaagatctgttgcactagcgccccatgtcgggatgggactagacactagagctcaaacatggatgagtgcggaaggtgcatggagacaagttgaaaaagtagaaacatgggcttttagacatcctggttttacaattctagctctctttttagcgcattacatcggaaccagcctgactcaaaaagttgtgatcttcatactactgatgctcgtaaccccaagcatgacaatgcgttgtgtgggagtgggaaatagggatttcgtggaaggtctctcaggtgctacttgggtggatgtggtgttggagcacggtggttgtgtgacgaccatggctaaaaataaacctaccttggacatagaattacagaaaacggaggcaacacaattggccacgctacgcaaattatgtatagaaggcaaaataactaatgttacaacagactcaagatgccccacacaaggtgaagcaactcttccggaggagcaagatcagaattacgtatgtaaacacacatacgtagatcgaggatggggaaacggatgcggattatttggaaaaggatcgcttgtaacatgtgcgaaattccaatgtttagaactcacagaaggaaaagtagtccaacatgagaatctcaaatataccgtaattataacagtacacacgggtgatcaacaccaagttggaaacgaaacgcaaggcgtgacagccgaaataacacctcaagcgtctacagtagaagccatattcaggtcctatggaacattgggtctcgagtgctcaccacgcacgggattagacttcaatgaaatgatacttcttaccatgaaaaacaaagcatggatggttcatcggcaatggttctttgatttaccattgccgtggacgagtggggcaacaacagagactccaacatggaacaagaaagaactcttagtgacatttaaaaatgcccatgccaagaaacaagaagtagtcgttctgggatcacaggaaggcgcaatgcacacggcgttgactggagcaacagagatccaaactagcggaggtacaagtattttcgcaggacatctaaaatgtcgactaaaaatggataaattagaattaaaaggtatgtcctatgcaatgtgcagcaatgcgtttgttcttaaaaaggaagtcagtgaaacacagcatggaactatactaataaaagtcgaatacaaaggagaagatgctccatgtaaaatcccattcagcacagaagatggccaaggcaaggcgcacaatggaagactaatcaccgccaatccagtagtcactaaaaaggaagaaccagtaaacatagaggcggaaccaccttttggagaatcaaatataataatcggcatcggagacaaggcgcttaaaattaattggtataaaaaggggtcgagcatagggaaaatgttcgaagcgaccgccagaggtgcaagaagaatggccatcctcggggataccgcgtgggattttgggtcagtagggggtgtacttaactctctaggaaaaatggttcatcagatctttggttctgcctacacggccctcttcagtggagtgagctggataatgaaaatagggatcggggtactactaacttggatagggttgaactcaaagaacacatctatgtcgttctcatgtattgtaatcggaattatcacactttatttaggcgctgttgtgcaggctgatatgggctgcgtgattaattggaaaggaaaagaactaaaatgtggctcaggcatatttgtaaccaatgaagtgcacacatggacggaacaatataaatttcaggcggatagtccaaaacgattagccacagccattgctggggcatgggaaaatggagtctgtggcatacgctccacaaccagaatggaaaatctactatggaaacaaatagcaaacgaattaaattatatactatgggaaaataatataaagctaactgtggtagtcggagacataatcggcattctggaacaagggaaacgaacactaacaccacagccaatggagctaaagtactcgtggaaaacctgggggaaagctaaaatagtcaccgcagagacacaaaatagttcatttattatagacgggccgaacactccggaatgtcctaatgcactacgtgcgtggaatgtatgggaagtagaggactatggtttcggagtgtttacaacaaatatctggttgaagctccgggaaatgtatacgcaattgtgtgatcatcgacttatgtctgcggcggttaaggacgagagagccgtacatgcggacatgggttactggattgaatcgcagaaaaatggatcatggaaattggaaaaagcatccttaatagaagtaaaaacatgtacctggccgaaaagtcatactttatggagtaatggtgtgttagaatctgacatgataataccaaaatcactagcaggcccaatatctcaacacaattacaggccaggatatcatacacaaacggcaggcccctggcatcttggaaagttagaattagattttaattattgtgaaggcacaacggtagtcataacagaaaattgtgggactagaggacccagtctaagaactacgacagtctcaggtaaactcatacatgaatggtgttgtagaagttgtactttaccaccattacgatacatgggtgaagatggttgctggtacggaatggagattaggccaattaatgaaaaagaagaaaatatggttaagtccctcgttagtgcaggttctggaaaggttgacaacttcacgatgggagtcctgtgcttagcaatacttttcgaagaagttatgcgaggcaagtttggcaagaaacatatgatagcaggagtcttatttactttcgtactactactaagcggtcaaataacttggagagatatggcccgcacactgataatgataggctcaaacgcaagtgacagaatgggtatgggagttacatacttagctttgattgctacttttaaaattcaaccatttcttgcgttaggattctttcttagaaaattgaccagtagagaaaatctactattaggagtcggccttgcaatggcaacaactcttcaattaccagaagacattgaacagatggcgaatggcatcgccttaggactaatggctttgaaacttatcactcaattcgaaacatatcaattatgggcagctctagtaagtctcatgtgctctaacactatctttactctaactgtagcctggagaacagccaccctcatcctggccggtatatcccttttacctatgtgccaatcgagcagtatgcgaaaaacagactggctgcccatgacagtagcggcaatgggtgtgcctccactcccccttttcatatttagtttaaaagacacattaaaacgcagaagttggcctctaaacgagggagtaatggctgtaggactggtaagtatcctcgctagttctttgttaaggaacgacgtaccaatggctggaccacttgtagcgggaggtttgttaatagcgtgttatgtgattacaggcacttctgcagacctgaccgtagaaaaagcggccgatgtaacctgggaggaagaggccgaacaaacaggtgtgtcgcacaatctcatgattacagtggatgatgacggaaccatgagaattaaagacgatgaaaccgagaacatattaacagtgttgctaaaaactgccctactcattgtcagtggtatattcccctatagtattcccgcaacattactggtatggcacacctggcagaaacaaactcagcgaagtggagtattgtgggatgtaccatcgcctcccgaaacacagaaagcagaactagaggagggtgtatatagaatcaaacaacaaggtatctttggaaaaactcaagtcggggtaggagtacaaaaggagggagtctttcatactatgtggcatgtaacgagaggggctgtcctgacacataatggtaaacgactagagccgaattgggctagtgtcaagaaagaccttatatcatacggaggtggatggagactatcggcccaatggcagaaaggcgaagaagtccaagtgatagccgtggagccaggaaagaatcctaaaaactttcaaaccatgcctggcatatttcagacaactacgggggagattggagccatcgctctggatttcaaacctggaacaagtggaagtcccatcattaacagagagggtaaagtggttggattatacggcaatggtgtggtaactaaaaatggagggtatgtatctgggatagcgcaaactaacgccgagccagacggacccacacccgagctagaagaagaaatgttcaaaaagcgcaatttaaccataatggatttacatccaggatcaggcaaaactagaaagtatctacctgcgatagttagagaagctattaaaaggagactaagaacactcatactggcacctactcgggtggtggccgcggaaatggaagaagcactgaagggcctcccgattcgatatcagacaacggctacaaaaagtgagcatacgggtaaagagatagtagacctaatgtgtcatgcaacatttacgatgagactactgagtcccgtgagagtccctaattacaatctaatcataatggatgaagcacattttacagatccagcatcaatcgctgcaagaggctatatttcaactagagtagggatgggcgaggcggctgcaatctttatgacagcgacacctccaggtaccgcagaagcatttccacagtctaacgcaccaattcaggacgaggagagagatataccagaacgaagttggaactctggaaacgactggattacagatttcgcgggtaaaactgtatggtttgtaccaagcataaaggctggaaatgatattgcaaattgtttgaggaagaatggcaagaaagtgatccaattaagtcgaaaaaccttcgatacagaataccaaaagacgaaattgaatgattgggattttgtcgtaactacagatatatcggagatgggtgccaactttaaagccgatagggtaatagacccccgacgatgtttaaaaccggtaatcttaaccgacgggccagagcgagttatactagccggccccatgcccgtgacggttgctagtgcggcacaacggcggggtcgcgttggacgaaacccacaaaaagaaaatgatcaatatatatttactgggcagcccttgaataacgacgaggatcatgcgcactggacagaggcaaaaatgcttcttgacaatattaatactccagagggaatcataccggcactatttgaaccagagcgggagaaatcggcagcaattgacggagaatatagactaaagggagaatcacgcaaaactttcgttgaattgatgcgaagaggagacttacctgtatggttagctcataaagtagcatccgaaggtataaagtacactgatcgtaaatggtgttttgatggcgaaagaaataaccagatcttagaagaaaacatggacgttgaaatctggactaaagaaggagagaagaagaaacttagaccaagatggctggacgctcgaacctacagtgatccgctagctttgaaagagttcaaagactttgcggcaggaagaaagagtatagcgttagatctggtcactgaaatagggcgagtaccaccacatttagcacatcgaaccaggaatgccttagataacctagttatgcttcacacctcagaatatgggggccgagcttatagacatgctgtagaagaacttcctgagactatggagacgttactactacttggccttatgattctcttgactggaggagtaatgctatttttaatatcgggaaaaggtgttggaaaaacgtccattggtctgatatgtgttgtcgcctcaagcgggatgctatggatggctgatatacctttgcaatggatcgctagtgctatcgttcttgagttctttatgatggtcttattaatacctgaaccagaaaaacagagaactccacaggacaatcaactcgcatacgtagttatagggattttaacactagcagctatagtagctgctaacgaaatgggcctactagaaacaacaaaaagagacctcggtatgtctaaggaaccaggtgttgtttcgccaacatcatatctagatgttgatctacacccagcgagtgcatggaccttgtatgctgttgctacaacagtgataactcccatgttaagacacaccattgaaaacagcacggccaacgtttctttagccgcaattgctaatcaagcagtggtactaatgggtctggataagggctggcctatatcaaaaatggatttaggtgtaccactattggcgttggggtgctactcacaagtaaatcctctaactttgacagctgccgttctgctgttagtaacacactacgctatcataggtcctggattgcaagcaaaagcgacaagagaggcacaaaaacgaacggcggctggaatcatgaagaatccgacggtcgatgggattatgaccatagacctagatccggttatatatgactcaaaattcgagaaacaactcggtcaggtaatgctattagtattatgcgcagtacaactactactgatgcgaacgtcatgggctttttgtgaggcgctcacacttgcaacagggccaatcaccacattatgggagggttcaccaggcaaattttggaacacgactatagctgttagtatggccaacatcttccgcggaagttatctagcaggagcagggctagcattcagtataatgaaatccgttggtacaggaaaaagaggaacaggatcccaaggtgaaactttaggcgaaaagtggaagaagaaactaaatcagctctccagaaaagaatttgatctatataaaaagagtggaattacagaagtagaccggacagaagctaaggaaggtctaaaaaggggagaaataacacatcatgctgtttcacggggctctgcaaaattacaatggtttgtcgaaagaaatatggtaataccagagggaagagtaattgatttgggatgcggtcgaggtggttggagttattattgcgcaggattaaagaaagtcactgaggtaaggggctacacaaagggtgggcccggacacgaagaacctgtcccgatgagcacctacgggtggaacattgttaaacttatttcagggaaagatgtattctacttaccgcctgaaaaatgtgatacattactatgtgatattggagagtcatcaccatctcccacagtagaagagtcaagaacaattagagtcttaaagatggtagaaccatggctgaaaaataaccaattctgtataaaagtactaaatccatacatgcctgcagtaatagaacacttagagcgtttgcagaggaagcatgggggaatgttggtgagaaatccattatcgagaaactccacacatgaaatgtattggatttccaacggcacaggaaacatcgttagctcggtcaatatgatttcccgtctcctactcaacagatttaccatgacctaccggagaccaacgatcgaaaaagatgtcgatctgggggcaggaacacgtcatgtcaacgcagaacctgaaactcccaatatggacgtaattggagaaagaatcagacgaataaaggaagaacattcgagtacatggcattacgatgatgagaatccctataagacatgggcatatcatggaagttatgaagtaaaagctacagggtcggcatcatcaatgataaacggagtggtcaaacttctaacaaagccatgggatgttgtaccaacagtaactcaaatggctatgacagatacaaccccattcggccaacaaagggtattcaaggaaaaagtcgatacacgaactcccaaacctatgcccggcacgagaaaggtgatggaaatcactgccgaatggttatggcgaacattaggaagaaacaaacgaccccgactgtgcaccagggaagaatttactaagaaagttagaaccaatgccgcaatgggcgctgtatttacggaagaaaatcaatgggattcggcaagagcagcggtggaagatgaagaattttggaagttagttgacagagagcgggaattacataagctaggtaaatgcggatcatgcgtctacaatatgatgggaaaaagggagaaaaagttaggtgagttcggtaaagccaaagggtccagagcaatatggtacatgtggttaggtgcacgatatctcgagtttgaagcgttaggatttcttaacgaagatcattggtttagcagagaaaattcatattctggagttgaaggagaaggtttacataaacttggctatatattaagagatatctcaaaaatccccggtggagccatgtatgcggacgacaccgctggatgggacacaaggattacagaggatgatttacataatgaagaaaagataacgcagcaaatggatccagagcaccgacaactcgccaacgcgattttcaaattaacatatcaaaacaaagttgtaaaagtgcaaagacctacgccaaagggcacggtaatggatattatttcaagaaaggatcaacgaggaagtggacaagtgggaacgtacggtcttaatacttttacaaacatggaagcacagttaataagacaaatggagggtgaaggagtcctatcaaaaacagacttagaaaatccccatctactagagaagaaaatcactcaatggttagaaacaaaaggtgttgaaaggttaaaacgtatggctatcagcggggacgactgcgtagtaaaaccaatcgacgacagattcgcaaatgccttactcgcactaaacgatatgggtaaggttaggaaagacattccgcagtggcaacctagtaagggttggcacgactggcaacaagtacccttttgtagtcatcacttccatgaactcattatgaaggacgggcgcaagttagtagtcccttgtagacctcaagacgaattaatagggagggctaggatttcacaaggagcgggatggagcctcaaagaaactgcatgcttgggaaaagcatatgcccagatgtgggctttgatgtacttccaccgaagagatcttcgcttagccagcaatgcgatatgttcagctgtcccagtacattgggtgccgacaagtagaactacatggagtatacatgcccatcatcaatggatgaccacggaagatatgttgacggtatggaacagagtatggattgaagacaatccatggatggaggataaaacacccgtaacaacctgggaagatgtaccatatttaggcaagagggaagaccagtggtgtggatccttaattggcttgacttctagagcaacatgggctcagaatatattgactgctattcaacaagtaaggtcactcataggaaacgaagaatttttagattatatgccatcaatgaaaagatttaggaaagaagaagagtctgaaggagccatctggtaa

SEQ ID NO: 23030 - RNA, 9873 nt, synthetic construct
  misc_feature 1..9873: note = derived and/or modified CDS sequence (opt6) from DENV-3__JF808121__SS-prME
  source 1..9873: mol_type = other RNA
acgtcgctgtgcctcatgatgattctgcccgcagctttagcatttcacctaacatctcgagatggggaaccaagaatgatagtcgggaaaaatgaacgcgggaaatcgctattgtttaaaacagcatccggtacaaacatgtgtaccttgattgccatggatctaggagaaatgtgtgacgatacagttacctacaaatgtccgcatattacagaagttgaaccggaagatatagactgctggtgtaatctgaccagcacttgggtcacctacggaacttgcaaccaagccggagaacggcgcagagataaacggtctgtggctctggcacctcatgtcggtatgggactcgatactcgtacacaaacgtggatgtctgccgaaggggcatggaggcaagtcgaaaaagtcgaaacatgggctttacgtcaccccggtttcaccattctagctttgtttttggcacattacattggaacatctttaacacaaaaagtagttattttcatattgttaatgctagtgacaccatccatgacgatgcgttgtgtgggagtaggcaacagggatttcgttgaaggtttaagcggagccacttgggtagacgtggttcttgaacacggtggttgcgttactacaatggccaaaaacaaacctaccctagacatagaactgcagaaaacggaagcaactcaactagcgacgctccgcaaattatgcattgaaggtaaaataactaatattacaactgatagtagatgtcccacacaaggcgaagctgtacttccagaagaacaagatcaaaactacgtctgcaaacacacttatgtggatagaggatggggtaatggctgtggtctctttggtaaaggctcattggtaacctgtgcaaaatttcagtgccttgaactaatagaaggtaaagttgtgcaatatgaaaatttgaaatacaccgtaataatcacagtgcatacaggtgaccagcaccaagtaggaaatgaaacgcagggcgtaacagctgaaatcacaccccaggcttcgacaaccgaagcaatacttcctgagtatggtacactcggactagaatgtagtccccgcactggtctggactttaacgaaatgatactcctgactatgaaaaacaaggcgtggatggtccatcgacaatggttcttcgatctaccgctgccatggacaagtggagcaaccacagagactcctacatggaaccgtaaagaactgctagtgacctttaaaaacgcacacgccaagaaacaggaggttgttgtactgggctctcaggaaggagcaatgcatacggctctaaccggtgcgacggagatacaaaatagtggaggaacgtctatattttctggacatttaaagtgtcgacttaagatggacaaattggaacttaaaggaatgtcctatgctatgtgtacaaatacatttgtcttgaaaaaggaggtcagtgaaacacagcacggcaccattcttataaaagttgaatataagggggaggatgcaccatgtaaaatacccttcagcactgaagatggacaaggaaaagcccataacggaagacttattacagcaaacccagtcgttaccaagaaagaagaacccgttaacattgaagctgaaccaccctttggcgagtcaaacattgtcatcggaaccggggataatgctttaaaaatcaattggtataagaaaggaagcagtatagggaaaatgtttgaagccactgcaagaggagcccgtcgaatggctatcctcggagatacagcctgggattttggtagtgtaggaggggttctgaatagtctcggtaaaatggtgcaccagattttcgggtcagcatataccgcgcttttcagcggagtgtcgtgggtaatgaagataggtataggagtcctcttaacctggataggcttaaatagtaaaaatactagcatgtcattctcatgcatagcaatcggaataataacactttacttaggtgcagttgtacaggcggatatgggctgcgtgataaattggaagggcaaggaactaaaatgtggttcaggcatattcgtaacgaatgaagtacacacttggactgaacaatataaatttcaagcagattctccaaaaagattagcaactgcaatcgcaggagcgtgggaaaatggagtgtgcggaatcaggtctaccacccgcatggaaaatttgctttggaaacaaatcgcaaatgaactaaactacatattatgggaaaacaatatcaaactaacagtagtagtaggcgatatcatcggtgtgctggaacaaggcaaacgaacattaacacctcaacccatggagcttaaatactcttggaaaacctggggtaaggctaagatagtaactgccgaaacacaaaacagctcatttataatagatggcccaaatacacccgaatgtccttcggctagtagagcttggaatgtatgggaagttgaggactacgggtttggtgtcttcacgacgaatatatggttaaaattacgcgaagtatacacccaactttgtgatcatcgactcatgtcagccgcggtaaaagatgaaagggctgtacatgcagatatgggatactggatagaaagccagaaaaacggcagctggaaactcgaaaaggcgtcactaattgaagttaagacatgtacatggccaaaaagtcacacactatggtcaaatggcgtcttagagagtgacatgatcatccccaagagtttggcaggcccaataagccaacacaatcacagaccgggatatcacacacaaacagctggtccttggcatctcgggaaactcgaacttgacttcaactactgtgaaggaacaacggtcgtaataactgagaactgtggtaccagaggaccctccctacggacaaccacagtaagtggtaaactgatccatgaatggtgttgtcgaagctgcacactcccaccgctaagatatatgggtgaagatggttgttggtacggcatggaaatccggcctatatcagaaaaagaagagaatatggtcaaaagtttagtatcagcagggagcggcaaggtcgacaactttacaatgggcgtactctgtctagcaattctttttgaagaggtaatgcgaggaaaattcgggaagaaacatatgattgcaggggtattctttacttttgttctgttattaagcggacaaatcacatggagggacatggcccataccctaacaatgatcgggtcgaacgcttcggataggatgggtatgggtgtaacatatctagccttaatagcaacttttaaaatacaaccatttttagctcttggattctttcttagaaagttaacatccagagaaaacttgttactaggtgtagggcttgctatggcaaccactctccaattaccagaagatattgaacaaatggctaatggcattgcactaggtttaatggctctaaagttgattacccaatttgaaacttaccaactatggattgctcttatatctttgacatgcagtaataccatgttcacactaactgtagcttggcgtacagcaactttaatccttgcaggagtctcactattacccgtatgtcaatccagtagtatgagaaagacagattggcttccaatggccgtagcggccatgggggtacctccactaccgttgtttatattttctcttaaagacacattaaagcgcaggtcttggccactcaatgaaggagtaatggcggtgggactcgtcagcatattggcaagtagtctattaagaaatgatgtaccaatggcggggccactggtagctggtggacttctcatagcatgttatgtaattactgggacaagcgcagacttaacagtagaaaaagcagcagacataacctgggaagaagaagcggagcaaacgggggtttcgcataacctaatgattacagtcgatgatgatggaacgatgagaatcaaagatgatgaaacagaaaacatattgacagtactattaaagactgcactgttaatcgtatcaggtgtttttccttattctatacccgcaactttgttagtttggcacacatggcagaaacaaacccagcggtcaggcgttctctgggacgttccaagtccgcctgagacgcagaaagcggaattagaggaaggcgtatatagaattaagcaacaaggtatttttgggaaaacccaagtaggtgtcggagttcaaaaagagggagtctttcatacaatgtggcatgttactagaggagccgtattaacatataatggaaaaaggttggaacccaattgggccagcgttaagaaagacttaatttcttacggcggagggtggcgcctctcagcacaatggcaaaagggagaggaagtccaagtgattgcagttgagcctggtaaaaatccaaagaatttccaaacaatgccaggaacattccaaaccacaaccggtgaaattggtgcaatagcattggattttaaacctggaacaagtggatcgcctataattaatagagaagggaaggtcgtcggactttatggtaatggagtagttaccaagaatggtggttatgtaagtggcatcgcacaaactaatgccgagccagatggacccacgcccgagctagaagaggagatgtttaagaaacgcaatttgacgatcatggacttgcatccgggatccgggaaaactagaaagtatctgccagctatagttagggaagctattaaaaggagactacgaacactcattcttgcacctactagggtagtagcagcagagatggaagaagccttaaaaggactgcccataagatatcaaacgactgctacaaaatctgaacatacaggtcgagaaatcgttgaccttatgtgccatgctacttttaccatgcgcttattaagcccagttcgagtacctaactataacttgattataatggatgaggcgcatttcactgacccggcctcgatagcggcgagaggttatatttctactcgagtcggcatgggagaagccgctgcaatattcatgacagccacgccacccggaacagcagatgcgtttccgcagagtaacgcacccatacaagacgaagaacgcgatataccggagcggtcgtggaactccggcaatgaatggataactgattttgctggtaaaactgtgtggtttgtgcccagtattaaagcaggcaatgatatcgcaaactgcctgcgaaagaatggcaagaaagtaatacaattatctagaaagacgtttgatacagagtaccagaaaactaaactaaacgattgggactttgtagtgacaaccgatatctctgaaatgggcgccaattttaaagcagatagagtcattgatccacgacgatgtttaaagcctgtgatattaaccgatggccctgaaagagtaatcctagctggtcccatgccggtcaccgctgcctctgcagctcaaagacgcgggagagtgggacgaaacccccaaaaagagaatgatcagtacatattcaccggtcagcccctaaacaatgatgaagatcacgctcactggacagaagcaaaaatgttattggataatataaacactcccgaggggataatacctgcactatttgagcccgaacgcgagaaaagtgcagcaatcgatggtgagtaccgtctcaagggagaatcgagaaaaacttttgtagaattgatgaggcgaggcgatcttcctgtttggctagcccataaagtagcaagtgagggtataaaatatactgatcggaaatggtgttttgatggtcagaggaataaccaaattctcgaagaaaacatggacgtcgagatctggacgaaggaaggagagaaaaagaaattaaggccaaggtggttagatgctagaacatacagtgatccgcttgccttaaaagaatttaaagatttcgcagccgggcggaaaagtatcgccttagatttagtaacggaaataggaagagtgccatcccatctagcgcatagaacaagaaatgccctggacaatcttgtcatgctacatacctctgaacatggaggccgtgcgtacagacatgcagtagaagaattgccagagacgatggagactttattactgttaggcttaatgatcttattgactggaggagccatgttatttcttataagcggcaaaggaataggtaaaaccagtataggactcatatgcgtgatagccagcagcggtatgctttggatggcagaaatacccttacagtggattgcaagtgcaatagtattagagttctttatgatggtcttacttattccagaacctgaaaaacaacgtaccccacaggataaccaactggcatacgttgtaataggaatcctcacactagcagctattatagccgccaatgaaatgggactcttagagacaactaagagagaccttggcatgtcaaaagaaccgggagtcgtgtctccaacgtcatatctggatgttgacctccaccctgcttcagcatggacattatatgcagtcgccacgacagtaattacacccatgctacgacacacaattgaaaactccacggctaacgtctctcttgctgctatagccaaccaagcagtagtgttgatgggactcgataaagggtggccgatctccaaaatggatttaggtgtccctctcttagcactgggttgttatagtcaggttaatccgttaacattgactgctgcagtgttattattaataacacattacgcaataattggccccggtttacaggctaaagcgacaagagaagcgcagaaaagaacggcggccggcataatgaaaaatccgacagtggacggtataatgacgatagatttggaccccgttatctacgactcaaaattcgaaaaacagcttggtcaagtaatgctattagttctctgtgcagtacaactcttgctgatgagaaccagttgggcactatgtgaggctttaactcttgccacaggtccgatcacaacactttgggagggctctccaggtaaattctggaatacaacaatagcagttagcatggcgaacatatttcgaggatcatatctagccggtgcagggctagctttttcaataatgaaatctgtaggcactggaaaaagaggtacaggatcacagggagaaacacttggagaaaaatggaagaagaaattgaatcagttaagcaggaaagaatttgatctatacaagaaatcgggtataaccgaagtggaccgaacagaggcgaaagaaggtttaaaaagaggagaaataacccatcatgccgtgagtagaggatcagcaaaactccaatggtttgttgaacggaatatggtaattcccgaaggaagagttattgacctaggctgcggaagaggaggttggtcatattactgtgcagggctcaagaaagtgaccgaagtaaggggatatactaaaggaggtccggggcatgaagaaccggttcctatgagtacttacggatggaatattgtaaaattaatgtcaggaaaagatgtattttatctaccgccagaaaaatgtgacactttattgtgtgatataggcgaatcatctccctcaccaacggtagaagaatccaggacaataagagtattgaaaatggtagaaccatggttgaaaaacaatcaattctgtataaaagtccttaacccttatatgccaaccgttatagaacatttggagcgattacaacgcaaacatggaggtatgttggtacgcaatcccctatctagaaattctacacatgaaatgtattggattagcaacggtacaggtaatatagtcgctagcgtgaatatggttagtagattattattaaatcgattcacaatgaagcatagaaggcccacgatagaaaaagatgttgacctaggtgcgggtactcgccacgttaatgcagaaccagagactccaaacatggatgtaataggcgaaagaataaagagaatcaaagaggagcacaatagtacctggcactatgacgacgaaaacccatacaaaacatgggcttaccacgggtcctatgaagttaaagctaccggctctgcctcaagtatgataaatggagttgtaaaattattaacaaaaccttgggacgtagtacctatggtaactcaaatggctatgacagacacaactccattcgggcaacaaagggtattcaaagagaaagtagatacacgaaccccgcgatccatgccaggaaccagaagagtaatgggtataacagctgaatggctttggaaaacattggggagaaataagaaacctcgactatgtccaagggaagaatttactaagaaagtgagaactaatgcggcaatgggagcagtcttcactgaagaaaatcaatgggattcagccaaagcagctgtggaagatgaagacttctggaaacttgtagaccgtgaaagggaattacataagttaggcaaatgtggaagttgtgtctataacatgatggggaaaagggagaagaaactgggagaatttgggaaagcaaaaggaagccgtgccatatggtacatgtggttgggagcgcgctatttggagttcgaggcactaggatttttaaacgaggatcattggtttagtcgagaaaatagctattctggagtagagggggaagggttacataaactaggttatatcctaagagatatctctaaaataccaggaggcgcaatgtatgcagacgatactgcgggatgggataccagaattacagaggatgatctacataatgaagagaaaattacacaacaaatggacccagagcacagacaattagcaaacgctatcttcaagttaacataccagaacaaggttgtcaaggtccaaagacctacaccaaccggcacagtaatggatattatatcgcgaaaagatcaaaggggcagcggacaagttggtacatatggacttaatacgtttacgaacatggaagctcaactaattagacaaatggaaggagaaggtgtgctttctaaagccgaccttgagaatccgcatttacctgagaagaaaataacgcaatggctagagactaagggagtagaacgcttgaaacgaatggccatatctggtgatgactgtgttgtgaagcccatcgacgacagatttgcaaacgcattattagctctaaacgacatgggtaaagttagaaaagatattcctcaatggcaaccttcgaagggttggcatgactggcaacaagtgccattttgttcgcatcatttccacgagttaataatgaaagatggaaggaagctagtcgttccttgccgccctcaagatgaactaatcggacgtgcccgtatatcacaaggctcaggatggagcttacgggaaactgcatgtttaggaaaagcgtatgctcagatgtggtcacttatgtactttcacagacgagatttaagattggcatcaaacgccatatgtagcgcagttcctgttcactgggtcccgacttcaagaatgacatggagtattcatgcccaccaccaatggatgacaacagaagacatgcttacagtatggaatagagtgtggatagaggacaacccttggatggaggataagacaccagtgaccacgtgggaaaatgttccatatcttgggaaaagagaagatcagtggtgcggttcactaatcggcttaacctccagggctacgtgggcacaaaatatcccgacagccatccagcaagttcgtagtttaattggaaatgaagaatttttggactatatgccttctatgaagcgctttcgaaaagaagaagaatcagagggcgcgatttggtaa

SEQ ID NO: 23031 - RNA, 9873 nt, synthetic construct
  misc_feature 1..9873: note = derived and/or modified CDS sequence (opt6) from DENV-3__JF808120__SS-prME
  source 1..9873: mol_type = other RNA
accagcttatgcctaatgatgatactccctgctgcactagcattccatttaacatcccgagatggagaacccaggatgattgttggcaaaaatgaacgcggaaaatccttgttatttaaaacagcatcaggtattaacatgtgcacccttatcgccatggatcttggagaaatgtgtgacgacactgtcacgtataaatgtccgcatataacagaagtagaaccagaagatatcgattgttggtgtaaccttacttctacctgggtcacatatggtacatgtaatcaagccggagaaagaagacgcgataaacgttccgtagctttggctccccatgtgggaatgggtttagacacaaggacacaaacctggatgtcagctgaaggtgcatggagacaagtggaaaaagtagaaacttgggcacttaggcatccaggttttacaattctggcattatttttggcacattatattgggacatcactgacacaaaaagtagtcattttcatattacttatgctcgtaacgccctccatgacaatgagatgcgtaggtgttggaaaccgcgactttgttgaaggattaagtggagcaacatgggtcgacgtagtattagaacatggtggatgcgtgaccacaatggccaaaaataaaccaaccttggacatagaactacagaaaacagaagcgacacaactggctacactcagaaaactatgcatcgaaggtaaaataacgaatattactactgactctagatgtccaactcaaggtgaagcagtactaccagaagaacaagatcaaaattacgtatgtaaacatacctatgtggacagaggttgggggaatgggtgcggactgtttggaaaaggatcactcgttacatgtgccaaattccaatgccttgaattaattgaaggtaaagtagtccagtacgaaaacttaaaatatactgtaattattaccgtacacaccggagatcaacaccaggtgggtaacgaaactcaaggggtaacagctgaaattactcctcaagcgtcgactaccgaagcaattcttcctgaatatggaacacttgggttagaatgttcacctagaacaggtttagactttaacgaaatgattttgttaacaatgaaaaacaaggcttggatggttcatcgacaatggtttttcgatttacctttgccatggacaagcggtgcaactactgaaacacccacgtggaaccgaaaagaactcctagttacattcaaaaatgcccatgcgaagaaacaggaagtagttgtcttagggagtcaagaaggtgccatgcatactgcacttacaggagctaccgaaatccaaaattcaggtggaacgagtatatttgcagggcacctcaaatgtcgtttaaaaatggacaaactagaattaaaaggtatgagctatgccatgtgtacgaatacatttgttcttaagaaagaagtcagtgaaacacaacatggaactatacttatcaaagtagaatacaaaggcgaagatgccccctgtaaaataccttttagtacagaagatggtcaaggaaaagctcataacggcagattaataactgccaatcccgtcgtaaccaagaaagaggagcctgtgaatatagaagcagagccaccgttcggtgaatccaacatcgtgatagggacaggagataacgccctaaaaataaattggtacaagaaaggatcaagcatagggaaaatgtttgaggctacggcaagaggtgctagaagaatggcaattcttggtgacactgcttgggatttcggaagtgtgggtggagtcctaaactcactcgggaaaatggtccatcaaatctttggctcagcatacactgcgttattcagcggtgtaagttgggtaatgaaaattggtataggagtcttactaacttggataggcttaaacagcaaaaatacatctatgtctttctcgtgcattgcgataggaattattacattgtatttaggagccgtagtccaagccgatatgggctgtgttattaactggaaaggtaaagagcttaaatgcggatcggggatattcgttacaaatgaagtacatacctggaccgaacaatacaaatttcaggccgattctccaaaaagacttgctacagctattgcaggggcttgggaaaatggcgtatgtggaatccgctctactactcgtatggaaaatctattatggaaacagattgcaaacgaactgaattatatcctatgggaaaacaatatcaaacttacagtagtagttggtgacataataggtgtattaaaacaaggtaagcgaacgctcacaccccaacctatggaacttaaatactcttggaagacctgggggaaggcaaaaatcgtcacagcagaaactcaaaattcatcattcataatcgatggacccaatacaccagaatgtccatccgcctcgagagcttggaacgtatgggaggtggaagattacggattcggagtttttactactaacatttggctaaagttaagagaagtatatacacaactgtgtgaccatagattaatgtcagcggcggtgaaagatgaaagagctgtacatgctgatatggggtattggatagagtcccagaaaaacggatcttggaaattagaaaaggcttctctaatagaagtaaaaacttgcacttggccgaaatcacacactctctggagtaatggcgtcttagaatctgacatgataataccaaagagcttagcgggacccatcagccagcataatcatcgaccaggctaccatacacaaacggcagggccatggcatttaggtaagttggaactggactttaactactgtgagggcacgaccgtagtaattacagagaactgcggaacacgaggtccgagcctacgcacgacaacagtcagcggaaaattaatacatgagtggtgttgcagatcatgtaccctaccacccctgcgatatatgggcgaagacgggtgttggtatggtatggaaataagaccaatatctgaaaaagaggaaaacatggtgaagtctttagtttcagcgggatcaggaaaagtggacaactttacaatgggggtattgtgcctagcgatcttgttcgaagaagtcatgagaggcaagtttggaaagaaacatatgatagccggtgttttcttcacatttgtgctgttgttgtccggacagataacatggagagatatggcacataccctaataatgattggttctaacgcgagcgatcgaatgggaatgggagtgacatacctagcgctaatcgctacatttaaaatccagccgtttctcgctcttggcttcttcctgcgtaaacttacttccagggaaaatctattattgggagtggggctagcaatggcgacgacattacaacttccagaagatatagaacaaatggcaaatggaatagctctaggactaatggccttaaaattgatcacacaatttgaaacttatcaattatggactgcgttaattagcctaacatgctcaaacactatgttcaccttaactgttgcgtggaggactgctacgttaatactagctggtgtatcactgttgcctgtatgccaaagtagttctatgagaaaaaccgactggctccctatggcggtagcagcaatgggagtacctcctttgccccttttcatattcaacctaaaagacacactgaaacgacggtcatggccattgaatgaaggggtaatggctgtaggactggtaagtatcctagcaagctcattactacgcaatgatgtccctatggcaggtccgctagtagctggtggacttttaatcgcgtgctacgtcataacaggaacgtcagcagatctaactgtagagaaagccgcggatattacatgggaggaggaagcagagcaaacaggggtatctcataatttaatgattactgtagacgacgatgggacaatgcgaattaaggatgatgaaacagaaaatattttaacagtcctattaaaaacagcccttctaatagtcagcggcgtattcccctattccatccctgctacgctccttgtttggcacacttggcaaaaacaaactcaacgatcgggcgtactttgggatgtcccatctcctcctgaaactcaaaaagccgagttagaagaaggagtttacagaattaaacagcaaggtatattgggtaaaactcaagtcggagtaggtgtccaaaaagaaggtgtatttcacacgatgtggcacgtaactcgcggcgcagtattaacttataacggtaaaagacttgaacctaactgggcgtcagtcaagaaagatctgatatcatatggagggggatggaggttgtcagcgcagtggcaaaaaggggaggaagtacaagtaatagctgtggagccgggcaaaaatccgaaaaattttcaaacaatgcctggaacgttccaaactacaacaggtgaaattggagccatagcactagactttaagcctggaacatcgggtagccctatcatcaacagggaaggcaaagttgtaggtctttacggaaacggggtagtcacaaagaatggagggtatgttagcggaatagcacaaacaaacgctgagcccgacggccctacaccagaacttgaagaagagatgttcaagaaacggaatctcacgatcatggacttacacccaggatcgggaaaaactagaaaatatcttcctgcaatagtcagagaagcaatcaagaggagattaaggacattaatcttagcacctactagggtcgtcgcagcggaaatggaagaagcgctcaaaggcctgccaataagatatcaaaccactgcgactaaatctgagcacacaggcagagaaattatcgatcttatgtgtcacgccacattcacaatgcgtcttttgagccccgtacgagtaccaaattacaacttaataattatggatgaagctcatttcacggatcctgcgagtattgccgctagaggatacatctcaacaagggtcgggatgggtgaagcagccgcaatctttatgacagctaccccacctggcactgctgatgctttccctcaatctaacgcacctatccaagatgaggagagagatataccagaaagatcttggaactcagggaatgaatggattactgacttcgcaggaaaaaccgtctggtttgtgccgtccatcaaagctggcaatgatattgctaattgtttacgaaagaatggcaagaaagtgatccaactcagtaggaaaacatttgatactgaatatcaaaagactaaactaaatgattgggacttcgtcgtcactacggacatttcagaaatgggagcaaattttaaagcagatagagtaatagaccccagacgctgtttaaagcctgttatactaacagatggacccgaaagagttatactagcaggaccgatgccggtcactgcggcaagtgcagcacagcgtagaggacgagtgggccggaatccgcaaaaagaaaatgatcaatatattttcacaggccaacccttgaataatgacgaagaccacgcccattggaccgaagcaaagatgctcttagataacataaacactcccgagggcatcattcctgctttattcgagccggaaagagaaaaatctgctgctatagacggagagtatcgtctcaaaggcgaatcaagaaaaacatttgtcgaattaatgagaagaggggacttacccgtttggctcgctcacaaagttgcgtctgagggaattaaatataccgatcgaaaatggtgtttcgatggacagcgcaataatcaaatactagaagagaacatggatgtagaaatatggaccaaggaaggagagaagaagaaactgcgaccgagatggctcgacgcccgaacttacagcgatccattggcattaaaagagttcaaagattttgctgcaggaaggaaatcaatcgcactcgatcttgtaactgagataggaagggtacctagtcatctcgcacacaggacccgaaatgctctggacaatttagtaatgttacatacctctgaacatggaggccgagcatataggcatgcggtggaagaacttccggaaactatggaaactttattgctattaggattaatgattcttttaactggaggagcaatgttatttctaatttctggaaaggggatcggtaaaacatcaataggtctaatctgtgtaatcgcgtcaagcggtatgttatggatggcggaaatacctctgcaatggatcgcatcagccatagtcttggagttctttatgatggtactactcatccccgaacctgaaaagcaaagaacaccccaggacaatcaattagcatacgtcgtcataggaatattaacactggccgctattatcgcagctaacgaaatgggattgttggaaacaactaaaagagatttgggcatgagtaaagaaccaggcgttgtgagcccaacttcatatcttgacgtcgacttacaccctgcgtctgcttggacgttatatgccgtagctactacggtaatcacgccaatgctacgtcatacaatagaaaattccaccgcgaacgtaagcctagcagctatagcaaaccaagccgtagtactcatgggtctggacaaaggatggcctataagcaaaatggacctaggagtacccctcctagcattaggatgctatagtcaagtcaatcctctgacacttaccgcagctgtattactattgattacgcattacgccatcattggcccaggtctgcaagcaaaagcaacgagggaagctcaaaaacgtactgcagctggcataatgaaaaatcctactgtcgatggcatcatgaccatagacctagatcctgttatttatgacagtaaatttgaaaaacaacttggtcaagttatgctattagtcctttgtgccgtccagctccttcttatgagaacttcgtgggcgctctgtgaagccctaacattagctactgggccaattacgacactttgggagggttcaccaggaaagttctggaatacaacgatcgcagtcagcatggctaatatctttagaggatcatatctagcgggagccggactcgcttttagtatcatgaaaagcgtggggacaggaaagcgtgggaccggatcccaaggtgaaactctaggagaaaaatggaagaagaaactaaatcagctatcaagaaaagaatttgatctatataagaaatccggaataacagaggtagaccggacagaagcaaaagaagggttaaaacgaggtgaaataacacaccacgcagttagcagaggatcagccaaactgcaatggtttgtagaacgaaatatggtcattccagagggtagggtaatcgatctagggtgcggaagaggcggatggagctattactgcgccggcttaaagaaagtgacagaagtcagaggctatactaaaggtggtcctggccacgaagaacctgttcctatgacgacatacggctggaatatcgtcaagctcatgtcgggcaaggatgtattctacctgccacctgaaaaatgtgatacattgctatgtgatataggagaatcaagcccgtccccaacagtagaagaatccaggactatacgtgttctaaaaatggtagagccatggctcaaaaataatcagttctgtatcaaagtattaaatccctatatgcctacggttatagaacatctcgaacgtttacagcgcaaacatggaggaatgcttgtaagaaacccactatccagaaacagtactcatgaaatgtattggatatcgaatgggactggaaacatagtagcctcagttaacatggtaagtcgtctacttctaaatcggtttacaatgacgcatagaagacctacaattgaaaaagatgtagatctaggagcaggcacaagacatgtaaatgcggaaccagagactcctaacatggacgttataggagaacgcattaaacgaattaaggaagaacataattcgacctggcactatgacgacgagaatccatacaaaacatgggcatatcacggatcgtatgaagtaaaagcaacaggttcagcatcatctatgataaacggagtagtcaaactattaactaaaccgtgggacgtcgtaccgatggttactcagatggctatgactgataccacaccattcggacaacagagggtctttaaagaaaaggttgatacaaggacccctcgttcaatgccagggacaagaagagttatgggcataaccgcagagtggctatggaggacgctcgggcgtaacaagaaacctagattgtgtacaagagaagaatttacaaagaaagtacgtaccaatgcagcaatgggagcagtattcaccgaagagaatcagtgggacagtgccaaagctgcagttgaagacgaagatttttggaagctagttgatcgtgaacgggaattgcataaactaggaaaatgtggctcatgtgtatataatatgatgggaaaaagggagaagaaattgggtgagttcggaaaagcaaagggaagcagagctatatggtatatgtggctcggtgcgcgctatctagaatttgaagcattgggctttctcaatgaggatcattggttcagtcgagaaaactcatattcaggggtagagggcgaaggtctccataaattgggatatattctcagagacatctctaagataccgggaggagcaatgtacgcagacgacacagccggctgggacacgcgcataactgaggacgatttacacaatgaagaaaagattactcaacaaatggaccctgaacatagacaactagctaacgccatatttaagttaacataccaaaataaagtggtaaaggtacagcgtccaacaccaacaggtacggtaatggatattattagcaggaaagatcaaagaggaagtggacaagtcggcacgtacggtctaaatactttcactaacatggaagcgcaactgataagacaaatggaaggagagggagtcctaagcaaggctgacctagaaaatcctcaccttccagagaagaaaattacacagtggcttgaaacaaaaggcgtggaacgccttaaacgtatggccattagtggggatgattgtgtggtgaaaccgattgatgatcgattcgccaatgcactcctagcacttaacgacatgggcaaagtaagaaaagatataccgcaatggcaaccaagtaaagggtggcatgattggcaacaagtgccattttgctctcaccatttccatgaattaataatgaaggacggaagaaagttagtagtaccctgtagaccgcaagatgaactcataggacgtgctcgtatttctcagggtagcggctggtcattacgagaaacagcgtgtttaggtaaggcttacgcccaaatgtggtctctcatgtacttccataggcgtgatcttcgactagcaagcaatgctatctgcagtgcggtacccgtacactgggttccaaccagtagaacaacatggtcgatacacgctcatcaccagtggatgacaacggaggatatgttaacggtctggaatcgagtgtggattgaagataacccttggatggaagacaaaacgcctgtcactacttgggaaaacgtaccataccttggcaaacgtgaggatcaatggtgtgggagtcttataggactaacaagtagagccacctgggcccaaaatatacccacggccatacaacaagtaagaagtctcatcggtaatgaggagttcctagattatatgccttctatgaagaggtttagaaaggaagaagagtcggaaggtgcaatatggtaa

SEQ ID NO: 23032 - RNA, 9873 nt, synthetic construct
  misc_feature 1..9873: note = derived and/or modified CDS sequence (opt6) from DENV-3__JF808119__SS-prME
  source 1..9873: mol_type = other RNA
acttcattgtgccttatgatgattcttccaacagcactggctttccatttaacttcacgagacggagaacctagaatgattgtgggtaaaaatgaacggggaaaatctttactttttaaaacagcaagcggaataaatatgtgcactttaatcgcaatggacttgggagaaatgtgtgacgatacagttacatacaaatgcccgcacatcactgaagtcgaaccggaagacattgactgttggtgcaatttaacgtcgacatgggttacatatggaacatgtaatcaggctggtgaacaccgacgtgataaaagaagtgtagctttagcaccccatgtgggaatggggttagatacacgtacgcagacatggatgtccgcggaaggcgcatggcgtcaggtagagaaagtagaaacttgggcgctaagacatccaggcttcacgatactcgccttatttcttgcacattacatcggaacatccctcactcaaaaagtggttattttcatactgttgatgttagtaacaccatcgatgactatgaggtgcgtaggagtaggcaacagagactttgtagaaggattgtcaggtgcgacttgggttgacgtagtcctcgaacatgggggatgtgtaacaacgatggccaaaaataaaccaactttagacatagagcttcagaaaacagaagcaacacaactagcaactttgcgaaaattatgtatagaagggaaaattactaatataaccacagactctcgctgtccaactcaaggtgaagccgttcttcccgaagaacaagatcaaaattacgtgtgcaaacacacttacgtagatagggggtggggcaacggctgtggtctgttcgggaaaggatctctagtgacatgtgctaaatttcaatgtttagaaccgatagagggtaaagtagtacagtatgaaaacctaaaatatacagtcataatcacggtacacacgggggaccaacatcaggtagggaatgaaacccaaggcgttaccgcagagattacaccccaagcatcaacaacagaagccatcttgccagaatatggtacattaggtttagaatgtagtcctcggacaggcttagactttaacgaaatgattcttttaacaatgaaaaacaaagcatggatggtgcatagacaatggttctttgatctccctctaccgtggacgtcgggcgcaacaacagaaacgcctacatggaaccggaaagaattacttgtaacattcaaaaatgcgcacgccaagaaacaagaggtagtggtactcggtagccaggaaggagcgatgcacactgcgctaactggagcaacagagatacagaactccggaggtacatcaatattcgcaggtcacctgaaatgtaggctaaaaatggataaactcgaattaaaaggaatgagctatgcaatgtgtacaaatacctttgttctcaagaaagaagtttcggaaactcaacacggtactatattaataaaagtagaatacaaaggagaagatgctccttgcaaaataccgttctcgactgaagacgggcaagggaaagcacataacggaagattaataacagcaaacccagtggtgaccaagaaagacgaaccggtaaacattgaagctgaaccaccttttggggagtctaatattgtaattggaataggagataatgcattaaagattaattggtacaagaaaggctcatccattggcaagatgtttgaagctacagccagaggagctagacgaatggctatcctcggggacacagcctgggattttggaagcgtaggcggagtcctaaattctttaggaaagatggttcaccaaattttcggttcagcgtacactgcattattttcgggagtatcttgggtaatgaaaataggtataggtgtacttcttacttggataggattaaactccaaaaacacctcaatgtcattctcatgtatcgctattggaataatcacactttatctcggagcagtagtacaagcagacatggggtgtgtcataaactggaaaggtaaagaacttaaatgcggatcaggaatttttgttacgaatgaggtacatacttggacagaacagtacaaatttcaagcagattccccaaagagattagcgactgcgattgcaggcgcttgggaaaatggagtttgtggcataaggagcacgactcgaatggaaaatctgttatggaaacaagtcgctaatgaattgaattacattctatgggaaaacaacataaaattgacagttgttgttggagacatcatcggagtgctcgaacaaggtaaaagaactttaacgccacagcccatggagctaaaatacagctggaagacatggggaaaagcaaaaattgtcacagcagaaacacaaaattcatcattcattatagatgggccgaacactccagaatgtcccagtgcaagtagggcctggaacgtatgggaagtggaggactatggattcggggtatttacaaccaacatatggcttaaactaagggaagtttatacgcaactctgtgatcacaggctaatgtccgcagctgtaaaggacgaacgcgctgtacatgccgatatgggatattggattgaatcacagaaaaacggttcatggaaactcgaaaaggcttcactcattgaagtaaaaacttgtacatggcctaaatctcatacactttggtcgaatggtgtgttagaatcagatatgataataccaaaaagtcttgctggtccaataagtcaacataatcatcggccaggttaccatactcaaaccgcaggtccatggcacttaggtaaactagagttagattttaattactgcgaaggaacaacagttgtaataaccgaaaactgcggtactcgaggtccatctctaagaacaacaacagtatcaggaaaacttatacatgaatggtgctgtagaagctgtacactgccaccgcttagatatatgggagaagacggatgttggtacggaatggagatccgtcctatttctgagaaagaggaaaatatggtcaagtctttagtctcggccggatccggaaaagtcgacaactttacaatgggagtattatgtctagctatattattcgaagaagtgatgcgagggaaatttggcaagaaacacatgatagctggcgttttcttcatgtttgtcttattattatcgggacaaataacttggcgagacatggcccacacacttatcatgattggtagtaatgcgtcggatcgtatgggaatgggagtaacatatcttgccttaatagcaacatttaaaatacagccattcttagcactgggattctttttaaggaaattaacgagccgagaaaatttgctacttggcgtaggacttgcaatggccactacactgcaacttccagaggacatagaacaaatggccaacggtatagcactaggtttgatggcattaaaacttataacacaattcgagacgtaccaactgtggacggcactaataagcctcacttgtagtaatacgatgtttaccttaacagtagcatggagaacagcaacacttattcttgcgggagtctcactactaccggtttgccagtcttcttcaatgagaaaaactgactggctaccgatggcagtagctgcaatgggtgtaccacccttacccttgttcatattctcactcaaagatactcttaagagaagaagttggccattaaatgaaggagtcatggctgtagggttggtgtcaatattagcatcatcattgctacgaaacgacgtcccgatggcaggaccgcttgtagcaggaggtcttctaattgcatgctatgtaataacaggcacctccgcagacctaactgtagaaaaggccgctgatataacatgggaagaggaggcagaacaaactggtgtatcacataatctaatgattaccgtagacgatgatgggacaatgagaattaaagacgacgaaactgaaaatatccttacggtccttcttaaaaccgcattactaatagtttccggtgtatttccttattcaatacctgcaacacttttagtgtggcacacgtggcaaaaacagactcaaagatctggagttctatgggacgttcccagtcctccggaaactcaaaaagctgaacttgaggagggagtctatagaatcaaacaacaagggatattcggaaaaacacaagtaggggtaggagtacagaaggagggggtgttccatactatgtggcatgtaacacgcggagcagttctaacatacaatggaaaacgattggaaccaaattgggcttcggtcaagaaagatcttatatcgtacggcggtggctggcgattatccgcgcagtggcaaaaaggggaagaagtccaagtaattgctgtggaaccgggtaagaatcccaaaaatttccagaccatgccagggacttttcagactactacaggggaaataggagctatagcgttagacttcaaacctggaacatctggctctcccataattaatagagagggtaaagtagtaggcctatacgggaatggagtcgtcaccaaaaatggtggttacgtctcaggtatcgcacaaacgaacgcagaacccgacgggcccactccagaattagaagaagaaatgtttaagaaaagaaatctaacaatcatggacctacaccctggttctggcaagactcgtaaatacctgccagcgatcgtaagagaagcaatcaaaagaagactaagaacattgatcttggctccaactagagtcgtcgcggcagaaatggaggaagctcttaagggactaccaataagataccaaaccaccgcaacaaaatcagaacataccggaagggagatcgtagacttgatgtgtcatgcgacattcacaatgcgcctcttgagtccggtccgagtaccaaattacaacctaataataatggatgaagcgcactttactgatccggcttccattgctgcgagaggatatatatctacaagagttgggatgggggaggcagcggctatatttatgactgctacaccaccagggactgccgacgcgttcccacaaagtaacgcacctatccaggacgaagaaagagacataccggagagaagttggaactcaggcaatgaatggataacagactttgcaggaaaaacggtatggttcgtgccttccatcaaagctggcaacgacattgccaattgcttgaggaaaaatggcaaaaaggtaatacaattatcccgtaagacatttgatactgaataccagaagaccaaattaaatgactgggactttgtagtaaccacagacataagtgaaatgggagccaattttaaagcggacagagttattgatcctcgcagatgtttaaaaccagtaattcttactgatggaccggagagagtgatactagcaggcccaatgccagtaacagccgcgagcgccgcgcaaaggcggggtcgagttgggcggaacccacagaaggagaatgatcaatatattttcacaggtcaaccgttaaacaatgacgaagaccatgcgcactggaccgaagcaaaaatgctgctagataacataaatactcccgagggcatcattccagcacttttcgaacccgaacgagagaagagtgccgcgatagatggggaatacagactaaaaggagaatctagaaagacgttcgtagagctaatgcgacgaggtgatctaccggtatggttagctcacaaagtggcatccgagggtataaagtatacagatagaaaatggtgcttcgacggtcaacgcaacaaccaaatactagaagaaaatatggatgtagaaatctggactaaagagggcgagaagaagaaacttagaccaagatggctggacgctaggacatactctgatcccctagctctaaaagagttcaaagatttcgcagctggaagaaagagtatagcgttagaccttgtcacagagattggacgagtaccgtcccatttagcgcataggacccgcaacgctttagacaaccttgtaatgttgcacacgtctgagcatggtggcagagcttacaggcatgcggtggaagaactacctgaaacaatggaaacattactcttattgggtttaatgatactcctaacgggcggggctatgttattcctcattagtgggaaaggcataggcaagacgagtatcgggcttatatgtgttatcgcctcatcaggcatgctatggatggcagagattccgttacaatggatagcttccgcaatagtactagaatttttcatgatggtactcctaataccagagccggaaaaacaacgaacgcctcaggataatcaactcgcatatgtagttataggaatcctaactctagctgcaataatagcagcgaatgagatgggcttactggaaactacaaaaagagacttaggaatgagcaaggaaccaggtgtggtaagcccgacgagttacctagacgtggatttacatccagccagtgcctggacactttacgctgtggcaaccactgtgataaccccaatgctaagacatacaatagaaaactcaactgcaaatgtctctctggccgccattgcaaatcaagcagttgtattaatgggattagacaaaggttggcctatatctaaaatggacctaggagtaccccttctagcactaggttgctatagccaagtgaatccccttacacttaccgccgcggttctattgttaataacacactacgccataattggaccaggactacaagccaaagcaacaagagaagcgcaaaaacggaccgccgctggcatcatgaaaaaccctacagtggatggtataatgacaatcgacttagaccctgtaatatacgactcaaaattcgaaaaacaacttggacaggttatgctactcgtgctttgtgccgtacaactattgttaatgaggacctcatgggcactatgtgaagctctcacgttagctactggaccaatcactaccttatgggaaggatcacccggaaagttttggaatacgacaatagcagtgagcatggccaatatattcagaggatcatatttagcaggcgcgggcttagcattttcaattatgaaaagcgtaggaacgggaaaacgtggaacaggcagccagggggaaacgttaggtgaaaaatggaagaaaaagctaaaccaactaagccgaaaagagtttgacctatataagaaatccggtattacagaagttgatagaactgaagctaaggaaggtctaaaacgaggcgaaacaacccaccatgcagtgagtcgaggtagcgcgaaattgcaatggttcgtagaacgaaatatggtaatacctgaaggaagagtaatagacctaggatgcggtcgtggtggttggtcatactattgcgctgggctcaagaaggtgaccgaggtcaggggatatactaagggtggacccggccacgaagaacccgtaccaatgtcgacctatgggtggaatattattaaactcatgtcgggaaaagatgtattttacttgcccccggagaaatgtgacaccttgttatgtgacatcggagaatcaagtccgagtcctacagtcgaagaaagtagaacaattcgggtattaaagatggtggaaccgtggcttaaaaataaccaattttgtataaagatcctaaacccctacatgcctactgtgatagaacatctagaacgtctacagcgtaagcatggtggtatgctagtaagaaatccactgtctaggaacagcactcacgaaatgtattggatatctaacggaacgggtaacattgtcgcttccgtcaatatggtatcaagattacttctaaacagatttacgatgacccatcgtagacctacaatagaaaaggatgttgatttaggcgcgggtacccgacacgttaatgcggagcccgaaacgccaaacatggacgtaataggggagagaataaaacgaataaaggaggagcacaacagtacttggcactacgatgacgagaacccatataagacatgggcttatcacggctcatatgaggtgaaagcaactggttccgcctcaagtatgatcaatggcgttgtgaaattattaaccaaaccctgggatgtggtaccaatggtaacacaaatggcaatgacagacacaacacctttcggccaacaaagagtatttaaagaaaaagtcgataccagaacgccgagatccatgcctggtactcgacgcgtcatgggcattactgcggaatggctatggcgtacgttaggacgaaataagaaacctcgtttatgcacacgagaagaatttaccaagaaagtaagaacaaatgcagccatgggagcagttttcactgaagaaaatcaatgggatagtgccaaggctgcagttgaagacgaggatttctggaaattggtggatagagaacgcgaattacataaactaggaaagtgtggttcttgcgtatataacatgatgggaaagcgtgaaaagaaattaggagagttcgggaaagcaaaaggatcccgagcaatatggtatatgtggctaggggccaggtatctcgaatttgaagcattgggattccttaacgaagatcactggttcagccgagaaaattcgtattcaggagtcgaaggtgaaggactacataagctaggatatattttaagagacatatcaaaaattcccggtggcgcaatgtacgctgacgatacagcaggatgggacacaaggataacagaggacgatctacacaacgaagagaaaataacgcagcagatggacccagaacacagacaattagcaaatgctatttttaagctcacctatcaaaataaagtagtaaaggtgcaacgtccaaccccaactggaactgtaatggacataatttctagaaaagaccaacgtgggagcggacaagtcggaacgtatggacttaacacattcacaaatatggaggcgcaattaatacgtcaaatggagggcgaaggagtactaagtaaagctgatctcgagaatccacatctaccagagaagaaaattacgcagtggcttgagacaaaaggagttgagcgtttaaaacgcatggcaatttcaggagaagattgcgtcttaaaaccaatcgatgacagattcgataacgcattgttggccctgaatgatatggggaaggtaagaaaagatatcccacagtggcaacccagcaaagggtggcatgattggcagcaggtcccattctgttcccatcatttccatgaactgattatgaaggacgggcgaaaattagtcgtaccctgtagacctcaagacgaattaataggaagggcacgtatcagccaaggagcaggatggtctctgagagagacagcatgcctaggtaaggcatatgctcaaatgtggtctctcatgtattttcatcgaagagatttgcgacttgcaagtaacgccatttgttccgctgttcccgtgcattgggtgcccacttcaagaaccacttggtccatccacgcgctgcatcaatggatgacgaccgaagacatgataacagtatggaacagagtgtggatagaagataatccatggatggaggacaagacaccagtaacaacatgggaagatgttccttatctcgggaaacgagaagaccaatggtgcggctctttgataggactaacatcacgagcaacatgggcacaaaatatcccaacagcaatacagcaggtcagaagtctaattggtaacgaggagttcttggattacatgccatctatgaagaggtttagaaaggaggaagaaagtgaaggagccatctggtag

SEQ ID NO: 23033 - RNA, 9873 nt, synthetic construct
  misc_feature 1..9873: note = derived and/or modified CDS sequence (opt6) from DENV-3__JF808118__SS-prME
  source 1..9873: mol_type = other RNA
acctcactttgcttaatgatgattctccctgcagccttggcatttcatttaacttcaagagatggtgaacctaggatgatagttgggaaaaacgaaagaggaaaatcactactttttaaaaccgccagcgggattaatatgtgtacacttatagcgatggatctcggagaaatgtgtgatgacactgttacctataaatgtccccacattacggaagttgaacccgaagacattgattgttggtgtaatttaacatcaacatgggtgacatatggaacttgtaatcaagcgggggaacggagaagagataaaaggtcagtagcattagctccgcatgtaggcatggggcttgatacccgtacccaaacatggatgtccgcagaaggggcatggcgacaagtagaaaaagtcgaaacctgggcgcttagacaccccggattcactatcctagctttgtttttagcacactacatcggtacttcacttacgcaaaaagttgtaatatttattctactgatgctcgtaacacccagtatgaccatgagatgtgtaggagtgggaaatagggacttcgttgaaggattaagcggagcgacctgggtggatgtagtgttagaacacggaggatgtgtaacaaccatggccaaaaacaaaccgactctcgacattgaattacagaaaacagaagctactcaattggcgatattacgaaaactgtgtatagaaggaaaaatcacgaatattacaacagattcaaggtgtccaactcaaggtgaagccgtacttcctgaagaacaagatcagaactatgtatgcaaacacacttacgtagacagaggttggggtaatgggtgcggtttgttcggcaaagggagcttggtcacatgtgccaaatttcaatgcttagaaccgattgaaggcaaagtagttcaatacgaaaacctaaaatatactgttattattacagtacatactggagatcagcatcaggtaggaaatgaaacacagggagtaaccgctgaaataactccacaagccagcactacagaggctatactaccagaatacggaactctaggactagagtgttcaccgagaacgggcttagatttcaatgaaatgatcctcctcactatgaaaaacaaagcctggatggtgcatagacaatggtttttcgatctcccgttaccctggacgtctggtgccacaacagaaactcccacttggaaccgaaaagagttgctggtgaccttcaaaaatgctcatgccaagaaacaagaagttgtcgttcttggttcacaggagggcgccatgcatacagcgctaacgggggcgaccgaaattcagaactctggagggacaagtatatttgccggacacctaaaatgcagattaaagatggataaactcgaattaaaaggcatgagctatgcaatgtgcacgaacacattcgtgcttaagaaagaagtatctgaaactcagcatggaacaattttaataaaagttgaatacaaaggcgaagacgcgccttgtaaaattccttttagtactgaggatggccaagggaaagctcataatggaagactcataaccgctaaccctgtagttacgaagaaagaggagccagtgaatatagaagcggaaccaccatttggcgaaagcaatatagtcataggaattggagacaatgcacttaagattaactggtataagaagggaagcagtattgggaaaatgttcgaagccacagcgagaggagctaggagaatggccattttaggcgatacagcctgggactttggttccgtaggaggtgtactaaatagtctaggtaagatggtgcaccagatattcggatccgcatatactgctctgttttctggggtatcatgggtgatgaaaataggtataggagttcttttaacttggataggtctaaacagcaaaaatacaagcatgtcattttcatgcatcgcaataggcatcatcactttatatttaggggcagtggttcaagccgatatggggtgcgtcataaattggaagggaaaagaactaaaatgcggatctggcatatttgtaacaaacgaagtacacacatggaccgaacaatacaaatttcaagcagatagtccaaaaagacttgcaactgctatcgccggagcatgggaaaatggtgtgtgcggaataaggagcactaccaggatggaaaacttactctggaagcaaatagctaatgaactaaattacatcctatgggaaaataatatcaaacttacggttgttgtaggggacataataggagttctagaacaagggaaaagaacgcttaccccacaaccgatggagctaaaatacagctggaaaacatggggaaaggctaaaatagtcacagcagagacacaaaacagttcatttatcatagacggacccaacacgccagaatgcccatctgcatctcgtgcttggaacgtatgggaggtagaagactacggtttcggagtcttcacgacaaacatatggctaaaattgagggaagtctatacccaactttgcgatcacagattaatgtcggcagctgtcaaagacgaaagagccgtgcatgcagacatgggatactggatagaatcgcagaaaaatggaagttggaaactagaaaaggcgtcgttaatcgaagttaaaacctgcacatggcctaagtcacatacactgtggtcaaatggagtcctcgaatcagacatgataattcctaaatccttggcaggacctataagtcaacataatcatagaccagggtatcatacccaaactgccggcccatggcatttaggaaaactggagctagactttaactactgtgaaggtacaacagtagtaattactgaaaattgtggtaccagaggcccttcattgaggactacaacggtgtcaggaaaactaattcacgagtggtgttgtagatcctgtacattaccacccttaagatatatgggagaggatgggtgttggtacggaatggagatacgaccaatctccgaaaaggaagaaaatatggtcaaatcgttagtgtcagcgggaagtggtaaagtagataattttaccatgggcgttctatgcctagcaattttatttgaggaggttatgagaggtaaatttggtaagaaacacatgatcgctggtgtattctttacgttcgtattgttactatccggtcaaataacatggagagatatggcacacacacttataatgataggaagtaacgcctctgaccgaatgggtatgggtgtcacttatctagccttaatagcgactttcaaaatacaaccgtttctagcacttggcttctttttaaggaaactaacaagcagagaaaatcttctactgggagtcggtctggcaatggccactacactacaattgcctgaagacatagaacaaatggcaaatggtatagctcttggtctaatggccctaaagctaattacacaatttgaaacttatcaattatggaccgccctaatctcattaacatgcagtaatacaatgttcactcttacggtagcatggaggaccgctacattaattttagctggagtatcattattaccagtttgtcagtcaagttctatgagaaagacagattggttgccaatggcagttgcagctatgggtgtgcccccattgccactattcatattttcattaaaagatacgctgaaacgtaggtcctggcctctaaacgaaggtgtgatggctgtcggattggtatcaatccttgcatcttcattactccgaaatgacgtgcctatggcaggccccttggtagctggtggcttactaatagcgtgttacgtgatcaccgggacctctgctgacctaacagtggagaaagcagcagatattacatgggaagaggaggcggaacaaacaggcgtgagtcacaatttgatgataactgtagacgacgatggaacaatgcgtataaaagatgatgaaactgaaaatatattgactgtattgcttaagacggccctcctcatcgtctcgggggtctttccatactctatcccggccacattattggtttggcatacatggcagaaacaaacgcaaagatcgggggtgctatgggacgtacctagtccacctgaaacacaaaaggcagagctcgaagaaggcgtgtacaggataaagcagcaagggatcttcggaaaaacacaagtaggtgtcggagtacaaaaagaaggggtatttcatacgatgtggcacgtgacaagaggggcagttcttacttataatggtaaaagattagaacctaattgggctagcgttaagaaagacctaataagctatggcggaggctggcgattaagtgcccaatggcagaaaggggaagaggtccaagttattgcggtcgaaccagggaaaaatccgaaaaacttccaaacaatgcctggaacctttcaaacgaccacaggcgaaataggagcgatagctctagacttcaagcctggcacttcagggagcccaataattaacagagaaggaaaggtagtcggactatatggcaacggagtagttacgaaaaacggaggatacgtaagcggtatcgctcaaaccaatgcggaacctgacggaccgactccagaacttgaggaagaaatgttcaagaaacgaaatcttacaataatggatctccacccaggctcgggtaaaacccgaaaatatttaccagctatagtacgggaggcaataaaaaggagacttagaacattaatattggcacctacaagagttgttgcagcagaaatggaagaagccttgaaaggactacctataagataccaaacaacggctacaaaatcagaacacactggtagagaaattgttgatttaatgtgccatgctacattcaccatgagactactttcaccggtaagagtaccaaactacaacctaataatcatggatgaagcacattttacggacccggcttctattgcagctcgaggatacattagtacaagagtgggtatgggggaagcagcagctatatttatgacagctactcctccaggcacggccgatgcattcccacaatcaaacgcgcctatacaagatgaagaaagagacatacctgagcgatcatggaactccggaaatgagtggattacagattttgctgggaaaacagtatggttcgtccctagtatcaaggcaggaaacgatatagcgaattgcttgaggaagaatggcaagaaagtaatccagctcagccgaaagacatttgataccgaataccagaaaactaaactaaatgattgggattttgtagttacaacagatatctctgaaatgggtgcgaactttaaggcggatcgagtaatagatccccgacgatgtctaaaaccagtgattttaacagacggcccggaacgtgtaattttggcagggccaatgcctgtcacagctgcctccgccgcgcaaagacgaggcagagttggaagaaatccacaaaaggaaaatgaccaatatatatttaccgggcaacccctcaataacgacgaggatcatgcacactggacggaagccaagatgttactggacaacataaatacacccgaaggaattatccctgcattatttgagccagagagagagaaaagtgctgcaattgacggagaatatcgtctaaaaggagagtcaagaaagacatttgtagaacttatgcgcagaggtgatctacccgtgtggttagcacataaagtggcaagcgaagggattaagtacacagatcgaaagtggtgttttgatggacaacgcaataaccaaatcttggaagagaatatggacgtagaaatttggaccaaagagggtgagaagaagaaattaaggccacgatggttagacgccagaacttattctgatcctttagcgcttaaagaatttaaagacttcgcagctggtcggaaatctatcgcattagacctagtaacagaaatcggaagagtaccaagtcatttagcccaccgtacaagaaatgcactagacaatctagtaatgttacatacttccgaacacggagggagagcataccgtcacgccgtagaggaacttcctgagacaatggaaaccctgttattattgggactgatgatattgttaacgggaggagcaatgctatttttgatttccgggaaaggaataggaaaaacttcaataggactaatttgtgtgatagctagttcaggaatgctttggatggctgaaattcccctgcaatggatagcaagtgcaattgttctagagttctttatgatggtactgctaataccagaaccggaaaagcaaaggacacctcaagataaccagttggcatacgtcgtaattggcatcttgacactggctgctataatagctgcaaatgaaatgggcctactagaaactacgaaaagagatttaggaatgtcaaaagaacctggtgtagtttcccctacgtcgtacctagacgtcgatctgcatcctgcttcagcatggactttgtacgcagtagcgacaacggttataacaccaatgttacggcacacgatagaaaactcaacagctaatgtctccttagcagcgatcgccaatcaagctgtagtattaatgggtctcgacaaaggttggccaatttctaagatggacctaggagtgccactcctagcattagggtgttatagtcaagtaaaccccttaaccctgacagctgctgtgttactattaatcacacactacgcaataattggacctggacttcaagcaaaagccacaagagaggcccagaaaagaacggcagcaggaattatgaaaaatccaactgtagacggaataatgacaattgatctagatccagtgatatacgatagcaaatttgaaaagcagctcggtcaggtaatgctgctcgtactatgcgctgtacagctactcttgatgaggacaagttgggcactatgcgaagctctaactttggcgacaggaccaatcacaacgttatgggaagggagtcccggaaagttttggaacacgacgatcgcagttagcatggctaacatattccgaggatcctatctcgctggagcaggtctcgcgttctctattatgaaatccgtaggcacaggaaaacgagggaccggaagccagggcgagaccctaggagaaaaatggaaaaagaaactcaatcagttaagtagaaaggaatttgacttgtacaagaagtcaggcatcacagaagtagatcgcaccgaagcgaaagagggcttaaaaagaggagaaacaactcaccacgcggtatcgagaggtagcgctaaactacaatggttcgtggaacgtaatatggtgataccagaaggccgagtaatcgatttgggctgcggaagaggaggctggtcgtattattgtgcaggactaaagaaagtaacagaagtaagaggttatacgaaaggagggcccggacatgaagaaccggtaccgatgagtacgtatgggtggaacattgtaaaactaatgtctggaaaggacgtattttatcttcctccagaaaaatgcgataccctcctctgtgacatcggcgaaagttcaccaagccctacggtagaggaaagtagaactataagagttttaaagatggtggagccatggttgaagaataaccagttttgcataaaagtactaaacccatatatgccaactgtgattgagcaccttgaacgcctgcagaggaagcatggaggtatgttagtgagaaatccattgtctagaaacagcacacatgaaatgtattggatatccaacggaactggaaatatagtagccagcgtaaatatggtttcaagattactactcaatcgatttacaatgacacaccgtagaccgactatcgagaaagacgttgatctgggcgcaggtaccagacacgttaacgccgagccggagactcctaatatggatgttatcggtgaaaggattaagcgtataaaagaagaacataattccacatggcactacgatgacgagaatccttataaaacttgggcataccacggatcttacgaggttaaagctacaggctctgcatcgtcgatgataaacggagttgtcaaacttctaacaaaaccatgggatgtagtacctatggttacacagatggctatgaccgacactacccctttcggacaacaaagagtatttaaagaaaaagtagacactcgaacaccaagatcaatgccaggcacacgaagagtaatggggataacggcagagtggttatggagaacgctcggacgaaacaaaaagccgcgattatgtacaagagaggaatttacaaagaaagttcgaacgaatgctgcaatgggagccgtgtttacggaagaaaaccaatgggactcagcaaaagcggcagttgaggacgaagacttctggaaattagttgacagagagagagaattacacaaattaggcaaatgcgggtcgtgtgtgtataatatgatgggaaagagggagaagaaactaggggaatttggcaaagcgaagggaagccgagccatttggtacatgtggttaggcgcaaggtacctcgagttcgaagcactgggcttcttaaacgaagatcattggttctcgagagagaactcttacagcggagtagaaggtgaaggcctgcataagctaggttacattttgcgggacataagtaagatccccggtggtgccatgtacgctgacgatacagccgggtgggatactaggattacagaagacgatctccataacgaagagaaaattacacaacaaatggatcccgagcatagacagcttgccaatgcaatctttaagttaacctatcagaataaagtggtaaaggtgcagcggccaacacctactgggactgtgatggacattatttcaaggaaagaccaacgaggtagtggtcaagtaggaacgtatggtcttaatacatttactaatatggaagcacaattgataagacaaatggaaggtgaaggagtattaagcaaagcagatcttgaaaatcctcatctacccgagaagaaaataacacaatggttagaaacaaaaggagttgagcgcttaaaacggatggcaattagcggtgatgactgcgtagtaaaaccgatagatgatagatttgccaatgcgttattagctttgaacgatatgggtaaagtgcgtaaagatatacctcagtggcagccaagcaaaggttggcacgattggcagcaggtacctttttgcagtcaccactttcacgaacttataatgaaggacggacgaaaattagtggtgccatgtagacctcaagatgaactaataggtagagcaaggatatcccaaggagccggttggtctttacgtgagaccgcttgtcttggaaaggcgtatgcgcagatgtggagtcttatgtactttcatcgccgagacttgagactagcctccaatgctatatgcagtgctgtacctgtacactgggttccaacctcgagaactacgtggagcatacatgctcatcaccaatggatgactacggaggatatgttaacagtatggaacagagtatggatcgaggacaacccttggatggaagacaaaactcctgtaaccacttgggaaaatgtaccgtatctaggaaaacgcgaagatcagtggtgcggcagcttgataggattgacttcaagggctacatgggcgcaaaatatcccaactgccatacaacaagtaagatctctaataggcaatgaggagtttttagattatatgccctcaatgaaaagattccgtaaagaagaagaaagcgaaggagccatttggtga

SEQ ID NO: 23034 - RNA, 9873 nt, synthetic construct
  misc_feature 1..9873: note = derived and/or modified CDS sequence (opt6) from DENV-3__JF808127__SS-prME
  source 1..9873: mol_type = other RNA
acatccctatgtctaatgatgattttacctgctgcactagcatttcacttaacatcgagagatggtgaaccaaggatgatagtaggtaaaaatgaaagaggaaagagcttgctgtttaaaacagcttcaggaattaatatgtgcacattgatagccatggatctgggtgaaatgtgcgatgatactgtaacgtataaatgcccacacataacagaagtagaaccagaagacatagattgttggtgtaacttaacttctacatgggtcacatacggaacatgtaaccaagcaggcgaaagacgtcgagataaaagatctgtggcgctcgcacctcacgtgggaatgggattggatactcgtacacaaacatggatgtccgcagaaggtgcttggcgacaagttgaaaaagtagaaacgtgggcattaagacacccaggatttacaatattggcactctttctcgcgcattatataggtacctctttaacacaaaaagtcgtgatatttatactgctaatgctcgttactccatctctaaccatgcgctgtgtaggggtaggaaatcgagatttcgtggaagggttgagtggagcaacctgggttgacgttgttttagaacacggaggatgcgtgaccaccatggcgaaaaataaacccacattggatatcgaactacagaaaaccgaggctacacaattagccacattgagaaaattatgtatagagggaaaaatcactaatatcacaactgactcgagatgtccaacgcaaggagaagctgttctacccgaggaacaagaccaaaattatgtctgtaaacatacgtacgtcgatagaggatggggaaacggatgtggattatttggaaaaggatcattagtgacctgcgcaaagtttcagtgtttagagccaatagaaggcaaagtagtacaatatgaaaatctgaaatatactgtaataattacagtccacaccggagaccagcaccaagtaggaaatgaaacgcaaggtgtcacggccgaaataacgccccaggcttctacaacagaggctatattaccggagtacgggactctaggtctcgaatgttcaccacgaactgggcttgattttaacgaaatgatattactgaccatgaaaaataaagcctggatggttcatagacaatggttctttgatttgcctcttccatggacttcaggcgccactacagaaacgccaacgtggaatagaaaagaactacttgtaacatttaaaaatgctcatgctaaaaagcaagaagttgtagttctaggctcacaagagggagcaatgcatacagcgttaactggagcgacagaaatacaaaattctgggggaacaagcatattcgcaggacacctcaagtgtcgtctaaaaatggacaaattggaattaaagggtatgtcatatgcaatgtgtacaaatacctttgttctcaagaaagaggtgtcagaaacacagcatggtactatactcatcaaagtggagtataagggtgaagacgctccatgtaaaattccattttccacagaggatggacaaggtaaagcacataacggacgtctcatcacagcaaaccccgtcgtaaccaagaaagaagaacctgttaatatagaggcagaaccacccttcggagaatcgaacatagtcattggaacaggggataatgcactaaaaataaattggtataagaaaggaagctcaattgggaagatgttcgaagccactgcgaggggagcacgtcgaatggctattttaggggatacagcctgggattttggtagtgtcggtggcgttttaaatagtctgggtaagatggtgcaccaaatatttggaagcgcatacacagctctgtttagcggagtatcatgggttatgaaaatcggtataggggtcttactgacatggatcgggttaaattctaaaaacacatcaatgagcttcagctgtattgcaatcggaataatcactttatacttaggtgccgtagtccaagcggacatgggatgtgtcatcaactggaaaggcaaagaactgaaatgtgggagtgggatctttgttacaaatgaagtgcacacgtggacagaacaatataaatttcaggctgactcaccaaaacgacttgctacagcaatagctggcgcttgggagaatggagtttgcggtattcgaagtactacgagaatggaaaacttactttggaaacagatcgctaatgaattgaactacattctctgggaaaacaatataaaactaactgtggtagtaggagatataattggggtgctagaacaaggtaagaggacattgaccccacaaccaatggaactcaagtactcatggaagacatggggaaaagctaagatagtaaccgccgaaacccaaaatagcagtttcattattgacggaccaaacacgccagaatgtccgtcagctagtagggcgtggaatgtatgggaagtagaagattacggattcggagttttcaccacaaatatatggctaaaacttcgtgaagtatatacacaactgtgtgaccataggttaatgtcggcagcagttaaggacgaaagagcagtacatgcagacatgggttattggattgagtcacaaaagaatggcagctggaaattggaaaaggcgtcattaattgaagtcaaaacctgcacatggccaaaaagtcacactttgtggagcaacggagtactagagtccgatatgattatacctaaatcattagcaggaccgattagccaacacaatcatcgaccgggctatcatactcaaaccgctgggccctggcatttaggtaaacttgaattagattttaattattgtgaaggaaccacggttgtcatcaccgaaaattgtggcactcggggacctagtttacggacaacgactgtaagtggcaaattaattcatgaatggtgttgtagatcgtgcaccttgccgccattgagatacatgggggaagacggctgttggtatggcatggaaattagacccatcagtgaaaaagaagagaacatggttaaatcattagtatcagcaggctcaggtaaagtagacaactttacaatgggcgtactttgtctcgcgattctctttgaagaggtaatgagaggaaaattcggcaagaaacacatgatagctggagtgttcttcacttttgtactcttactatcaggacaaatcacgtggcgagatatggcacatactttaatcatgataggtagcaatgcatcagatagaatgggtatgggagtgacatatctggcattaattgcaacgttcaagattcaacctttccttgcccttggtttctttttacgaaagctaacaagcagggagaatctattgcttggtgtaggcctagctatggcaaccacgttacaacttcctgaagatatagaacaaatggccaacggaattgcactaggactaatggctctcaaattgataactcagtttgagacttatcaattatggacggcactgatatcattgacatgctcaaacactatgtttaccctaacagtagcatggagaacagcaacgttgatacttgctggagtcagtctcttaccagtttgtcaaagtagctctatgagaaaaaccgactggctaccaatggcagttgccgcaatgggagttcccccattacctctattcatattctcattgaaggacactttaaaacgccgaagctggcccttaaacgaaggcgttatggcagttggacttgttagtatattagcaagtagcttactaagaaatgatgtccccatggcaggcccccttgttgcgggaggacttctaattgcctgttatgtcataacaggtaccagcgccgatctaactgtagagaaagcagctgatattacatgggaagaggaagcagagcagacgggcgtctcacataacctaatgatcactgtggacgatgatggaactatgaggatcaaggatgacgaaacagaaaatatattaacagtgctgttgaaaacagcactattgattgtgtctggggtattcccatatagcatccctgcaacgttattagtatggcacacttggcaaaagcaaactcagcggagtggagtgttatgggatgtcccttcaccccctgaaactcaaaaagcagagttggaagaaggagtataccgtattaagcagcaaggtatattcggtaaaactcaagtaggagtaggggttcaaaaggaaggagtatttcatactatgtggcacgttacaagaggagccgtacttacatataacggtaagagattagaacctaattgggcctctgttaagaaagacctaattagttatggtggaggttggagactcagcgctcaatggcagaaaggggaagaggtgcaggttatagctgtagaacccggtaaaaaccccaaaaatttccagactatgcctggaacctttcagacgactaccggggaaataggagcaatcgctcttgattttaagccgggaaccagcggctcccccataatcaatcgagaagggaaggtcgtaggactatacgggaatggtgtagttacgaaaaatggcggatacgtgtctggaatagcacaaacaaacgcggaacctgatggcccgaccccggaactcgaggaggagatgttcaaaaagagaaacctaacaattatggatctacatccaggaagcggtaaaactcgaaagtatttgccagctatagttcgcgaagcaatcaaacggaggctacgcaccctaatattagctccaacaagagtagtagcagccgaaatggaggaggctcttaaaggtttacctatacgttatcagacaacagccacaaagagtgaacatactggtcgcgaaattgtagatctcatgtgccacgcaaccttcactatgaggctattgagccctgtaagagttccaaactataacttaattatcatggatgaagcgcattttactgatccagcttcaatagcggctagaggttatattagcaccagagttggaatgggtgaggcagcggccatattcatgaccgcaacaccacctggtactgcagatgcgttcccccagagtaacgcaccgatacaagacgaagaacgcgacatcccagaaagatcgtggaactcggggaatgaatggattactgactttgcaggtaaaacagtatggttcgtgccaagcataaaagcagggaacgacatcgcaaactgcctaagaaagaacggtaaaaaggttatacaattatcgaggaaaacattcgatacggaataccagaaaacaaaattaaacgattgggacttcgttgtaacgactgacataagcgaaatgggtgctaactttaaagcagacagggtaatagatccgagaagatgccttaagccggtgatcctcactgacggaccagagagagttatattagctgaacctatgccggttactgcagcatctgctgcccagagaaggggaagagtcgggagaaaccctcaaaaagaaaacgatcaatacatatttacaggacaacccttgaataacgacgaagatcatgcgcactggacggaagcaaaaatgctgttagacaatatcaacacccctgagggtattatacctgcactctttgagcctgagagagagaaaagcgccgcgattgatggtgaatacagattaaaaggagaatcaagaaaaactttcgtagagctaatgaggagaggagatttacccgtatggttggcacataaggtagcatccgaaggaatcaagtatactgatagaaaatggtgctttgatggccaacggaacaaccaaatcttagaggagaatatggatgtagagatttggactaaggagggagagaaaaagaaactacgacctaggtggctagatgctcgaacatactccgaccctcttgcgctgaaagagttcaaagattttgccgcaggcagaaaaagcatagctcttgatctagtgacagaaattggtcgagttccatcgcatctagctcataggactaggaatgcgcttgacaatttagttatgctacatacgtccgaacatggcggtcgtgcttatagacacgccgtagaagagttgccggagactatggaaaccttactactgctaggattaatgatacttcttactggtggcgctatgctatttttgataagtggcaaaggtatagggaaaacaagtatcggcttaatctgcgtaattgcaagtagcggtatgctgtggatggccgaaataccattgcagtggatagcgtctgctatagttttagagtttttcatgatggtcctcctaattcctgaacctgagaaacaaaggactccccaagacaaccagctagcctacgtcgtcatagggattttaacactcgcggcaattattgcagcaaacgaaatgggtttgttagaaacaacaaaacgggacctcgggatgtcaaaagaacccggagtagtgagtccaacaagttacttagacgttgacttacatccagcttcagcatggacattatacgccgttgctacaaccgtaattaccccaatgctaagacacaccatagaaaacagtactgcaaatgtatcactagcggccattgctaatcaagcagtagtgcttatggggctagataagggctggccaattagtaaaatggacttaggtgtccctctattagcactggggtgctatagccaagtcaatcctttaactctaacggcagcagtgttattattaataacacattacgctattataggccctggcttacaggcgaaagcaaccagagaagctcagaaaagaacagcagccggaattatgaaaaacccaacagttgacggaattatgactatcgatctggatccggttatatatgattccaaatttgaaaagcagttaggtcaagtaatgctattggttttatgtgctgtccaattattattaatgcgcacgtcttgggctctatgtgaagcactaaccttagcaaccggccccattaccactctttgggaaggaagtcccgggaagttttggaatacaactatcgcggtttcgatggcaaatatattcagaggatcttacctcgccggggctggactggcgttttctataatgaagtcagttggtacgggtaaaagaggcacgggttcacaaggagaaaccttaggtgaaaaatggaagaagaaactcaatcagctaagcaggaaggaatttgatttaaataagaaaagtggaataaccgaagtggatcggacggaagctaaagagggtcttaaaagaggagaaatcacacatcacgccgtctcaagaggctcagcaaaactacaatggttcgtagaaagaaacatggttattcccgaaggccgagtcattgaccttggatgtggtcgaggcgggtggagttactattgtgcaggtctgaaaaaggttacggaagttcggggctatactaagggaggacctgggcacgaagaaccagtacctatgagtacctacggatggaacattgtgaaacttatgtcaggaaaagacgtattttatctaccgcctgaaaaatgcgacacccttttatgtgacataggtgagtcaagtccatcacccactgtagaggagagcagaacgatcagggtactcaaaatggtcgaaccatggctgaaaaataatcaattctgtataaaggttctaaacccttatatgccaacagttatagaacatctagaaagactccaacgtaaacacggtggaatgcttgtacgaaatccgttatcgaggaatagcacgcatgaaatgtactggatatcaaatggtacgggaaatatagtggcctcggttaaaatggtttcgagattacttttaaataggtttacaatgacgcacagacgacccacgatagaaaaggatgtagatttaggcgcaggaacaagacacgtaaatgcagaaccggaaacgccaaacatggacgtaataggagaaagaataaaaagaataaaagaagaacacaattctacgtggcattacgatgacgaaaatccctacaagacgtgggcatatcatggaagctacgaagttaaagcaaccgggtcagcatcgtctatgatcaatggagttgtaaaattactaaccaaaccatgggatgtggtgccaatggtgacacaaatggcaatgactgacacaactccgttcggtcaacaacgggtattcaaagaaaaggtggatacccggacaccacgctcaatgcccgggacacggagagtaatgggcataactgcagaatggttatggagaactctgggaagaaacaagaaaccgaaactttgcacaagagaggaatttactaagaaagtgagaacaaatgccgctatgggggccgtattcactgaagagaaccaatgggatagtgcaaaggctgcagttgaggacgaggatttttggaaactcgtcgaccgcgagcgagaattgcataagctgggtaaatgcggtagctgcgtatacaacatgatgggaaaaagagagaagaaactaggtgagttcggaaaagcaaaaggatcaagggcaatatggtatatgtggttaggagctaggtatctagagtttgaggctcttgggtttctaaacgaagatcattggttttcgagagaaaatagttattccggagtcgaaggtgagggccttcacaaactaggttatatcctccgagatataagtaaaatccctggtggagccatgtacgctgacgatacagcaggctgggatactcgcataacagaggatgatttacataatgaagagaaaattacacagcagatggacccagaacatagacaactggccaatgcaatttttaaattaacttatcaaaataaagtggtaaaagtgcaacgacccacgccgactggaacagtaatggatataatatcacgcaaagatcaaagagggagtggccaagtaggaacttatggcttaaacacattcacaaatatggaagctcaattaataagacaaatggagggggaaggcgttttatcgaaagcggacctagaaaaccctcatctgccagagaagaaaataacccagtggctggaaacgaaaggtgtagaaaggttaaaaagaatggcaatttcaggagacgattgtgtggtgaaaccaattgacgatagatttgcaaatgcacttctagcattaaacgatatgggaaaagtaagaaaagacataccgcaatggcagcccagtaaaggttggcacgactggcaacaagttccattctgttcacaccatttccatgaactaataatgaaagatggtcgtaagttagttgtaccttgcaggccgcaagatgagctgataggcagagcaagaatctcacagggtgcgggctggagtttgagagagaccgcatgtttgggaaaagcatatgctcagatgtggtctctgatgtattttcacaggcgtgaccttagacttgcatctaatgcaatatgtagcgcggtaccagtccattgggtacctactagcagaactacttggtctatacatgcacaccatcaatggatgacaacggaggacatgctcacagtgtggaatagagtatggatagaggataatccttggatggaagataaaacgcctgtgactacatgggagaacgtcccgtacctaggtaagagagaggatcagtggtgcggcagcttaattggactaacgtcaagagcgacatgggcgcaaaatattccgaccgcaatacaacaagtaaggagtcttatcggtaatgaagagtttcttgattacatgcccagtatgaagcgttttagaaaggaagaagaatccgaaggtgcaatctggtaa

SEQ ID NO: 23035 - RNA, 9873 nt, synthetic construct
  misc_feature 1..9873: note = derived and/or modified CDS sequence (opt6) from DENV-3__JF808124__SS-prME
  source 1..9873: mol_type = other RNA
acctccttatgcctaatgatgatattacccgcagcactggcatttcacctaacttcacgagatggagaaccgcgaatgattgtaggtaaaaatgaacgaggtaaaagtctcttatttaaaactgcgtcaggaatcaatatgtgtactttgattgccatggatttgggtgaaatgtgtgacgacactgtaacctacaaatgtccacacataactgaagttgaaccagaagacatcgattgttggtgcaatcttactagcacttgggtaacctatggaacttgcaaccaggcaggagaaagacgtcgagataaacggtcagtagcattagcaccacatgtaggtatgggactagatactaggacccagacttggatgtctgccgaaggggcttggcggcaggtcgagaaagtagaaacttgggctctacgacatcctggattcacaatattagccttattcctagctcattacatagggacaagtttaacgcaaaaagttgtgatttttatattactcatgttagtaacaccaagcatgactatgcgttgcgtgggagtaggaaacagagattttgttgagggattaagtggtgctacatgggttgatgtagtgttagagcacgggggatgcgtgacaacaatggctaaaaataaaccgaccctcgatatagaactacagaaaaccgaagccacacaattagcaacacttcgaaaattatgcatagaaggaaaaattacaaatatcacaactgacagtaggtgcccaacgcagggagaagcagtgttacctgaagaacaagatcaaaattacgtttgcaaacatacgtacgtcgatcggggatggggaaatgggtgcggattgtttggaaaaggcagcttagtaacgtgcgctaaatttcaatgcctggaaccaatagaaggtaaagtagtacagtatgaaaacctgaaatatacggtgattataacagtgcacacaggtgatcaacatcaagtaggtaatgaaacacaaggtgtcacagctgagattacaccgcaagcatccacaactgaagctatactgccggaatacggtacattcggcttagaatgtagtccacgcactggtctcgattttaatgagatgatactacttacaatgaaaaacaaagcatggatggtccatagacagtggttctttgacttgcccctaccatggacatcaggcgcaacgacagaaactccaacttggaacagaaaagaattactcgtgacctttaaaaatgcacatgctaaaaagcaagaagtagtagttttaggcagtcaagagggagctatgcatacggccctaaccggtgcgacagagattcaaaacagtggtggaacttcaatctttgccggacatctgaaatgtagactgaaaatggataaattggaacttaaagggatgtcctatgcaatgtgtacaaacactttcgtattaaagaaagaagtgagcgaaacccaacatggtactatattgattaaagtcgaatataaaggggaagacgcaccttgtaaaatccccttctcgaccgaagacgggcaaggaaaagcacacaatggacgactcataacagcgaatcccgtcgttacaaagaaagaggagctagttaacattgaagctgaacccccatttggtgaaagcaatatagtaattgggattggtgacaacgccttaaaaataaactggtataagaaaggttcgtcgatcgggaagatgtttgaagctaccgctcgtggggctagaagaatggctatattaggcgacactgcgtgggacttcgggtcggtcgggggcgttctgaactctttaggaaagatggtacatcaaattttcggtagtgcatataccgctcttttcagtggagtctcttgggttatgaaaataggtataggagtactactaacatggataggactcaattccaaaaatacaagcatgagcttttcgtgtatagcaataggtataataaccctttatttgggagctgttgtgcaagctgatatgggctgcgtgattaattggaagggcaaggaactcaagtgcggtagtggcatatttgttacaaatgaagttcatacctggactgagcaatataaattccaagcagattctccgaaaagattagcgactgcaatcgcaggagcatgggagaatggagtttgtggtattcgatcaactaccagaatggaaaacctactttggaaacaagtcgcaaatgaactaaactatatcttatgggagaacaacataaaattaaccgtggttgttggagatatcatcggagttttagaacaaggcaaaagaacacttacacctcagcctatggaacttaagtatagctggaagacatggggaaaagcgaaaatcgtgactgcagaaacacaaaacagttctttcataattgatggtcctaacacaccagaatgtccgagcgctagtagagcatggaacgtttgggaggttgaagattatgggtttggcgttttcacaacaaatatatggctgaaactacgtgaagtgtacacacaactttgtgaccacagactaatgtcggcggctgtaaaagatgagagagctgtacatgcggatatgggctattggatagaatcacagaaaaacggttcgtggaaactagaaaaggcgagcttgatagaagtaaaaacttgcacttggcctaaatcccataccttgtggagtaacggagtattagaaagtgacatgattataccaaagagcttagccgggccgatatcacaacacaaccaccgacctgggtatcacactcaaacagctggaccatggcacctcggcaaactagaactcgacttcaattattgtgaaggaacgactgtcgtaataactgaaaattgtggaactcgaggtccatccttaagaacgacaacggtgagcggtaaactcatacatgaatggtgttgcagatcctgcacccttccacctttgaggtacatgggcgaagacggttgttggtatggtatggaaattagacccatttcagaaaaagaagagaatatggttaaatccttggtatcagctggttcaggaaaagttgataacttcacgatgggggtcttgtgtttggcaatactattcgaagaagttatgcgaggcaaattcggaaagaaacatatgattgctggcgtcctctttacttgtgttcttttactgagtggacaaataacttggcgcgatatggctcatacattaataatgataggctccaacgcctctgatagaatgggaatgggggttacgtatctagctctaatagccacatttaaaatacaacctttcctcgcacttggcttcttccttcgaaaacttacatctcgggaaaatttattactaggagttggattggctatggctacgactttacaactcccagaggatattgaacaaatgggtaatggaatcgcgttagggttaatggcacttaaactaataacacaattcgagacctaccaattatggacagctttaatctccctcacatgttcaaacactatgttcactttaaccgtagcctggaggacagctactctaatcctcgccggcgtatccctactaccagtttgccaatcctcctcaatgcgaaaaacagattggttgcccatggcggtggcagctatgggtgttcctccactcccgctatttatcttttcccttaaagatactctcaaaagacgctcatggccgttaaatgagggtgtgatggcagtaggtctagttagcatcttggcttccagcctcttacgtaacgatgtcccaatggcagggccattggtcgcaggcggattgttgatagcatgttatgtcatcacaggaacatcagctgacctcacagtagagaaggcggccgatataacatgggaagaagaagctgagcaaaccggcgtaagtcacaacctgatgataacagtagatgacgacggcacaatgagaattaaggatgacgagaccgagaatattcttactgtcctattaaaaacagcactcttgatacttagtggagtattcccgtattcgatacctgccacacttctagtatggcatacctggcaaaaacaaactcagagatccggagtcctatgggatgtgccatctcctcccgaaactcaaaaggcagaactagaagaaggggtatatcgaataaaacaacagggaattttcggtaaaacccaggtaggcgttggcgtgcaaaaagaaggagtatttcacactatgtggcatgtaacaagaggcgcagtgttgacctataacggtaaaaggcttgagccaaattgggcatctgtaaagaaagatttaataagttatggtggtggatggcgtctatccgctcaatggcaaaaaggggaggaagtacaagtaatagcagttgaaccaggcaaaaatcccaaaaattttcagacgatgccgggcactttccaaactaccacgggggaaatcggagcaatagcactagatttcaaacccggtacaagtggatcccctatcataaatcgggaaggaaaggtagttggactatatggaaacggcgtcgtgactaaaaacggtgggtatgtttcaggaatagcccaaacaaacgcggagcctgatggaccaaccccagagttggaagaagaaatgttcaagaagagaaatttaaccataatggacctacaccctggcagtgggaagactagaaaatatttaccggcaatcgtccgcgaagccattaaaagaagattgagaacattgatcctggcacctacaagggtagttgctgctgaaatggaagaggcactcaaaggactcccaattagataccagacaacagctactaaaagcgagcacacaggtagagaaatagttgatctaatgtgtcatgctacttttaccatgcggttattatcgcccgtaagagtacctaattacaaccttataatcatggacgaagcacatttcactgaccccgcatcaatcggggccaggggatatataagcacgcgtgtaggaatgggtgaagcagccgcgatcttcatgacagccacccctcctggcacagcagacgctttcccacagtcaaacgcacctatccaggacgaagaaagagacattccagaaagaagctggaactctggtaacgaatggatcacggattttgccggaaaaacagtatggttcgtgccttcaataaaagcaggcaatgatatagcaaactgcctgcgtaaaaatggtaagaaagttattcaattaagtagaaagacgtttgataccgaataccaaaagaccaaacttaatgattgggattttgtcgtcaccacagacatatccgagatgggtgctaactttaaagccgatagagtgatagatccaaggcgttgtcttaaaccagtgatattaaccgacggcccagaacgtgtgatattagctggtccgatgcctgtcacagctgcatcagccgctcaaaggcgcggtcgtgtaggaaggaatcctcagaaagaaaatgaccaatatatttttaccggacagcccctgaataatgatgaagatcatgcgcattggacggaagcaaaaatgttactggataatataaatacaccagaaggaatcataccggctttgttcgaaccggagagagaaaagagtgcagccattgatggtgagtataggttgaaaggcgaatcaagaaaaactttcgtcgagttaatgcgacgaggggacttaccagtgtggttagctcataaagtggcatctgaaggcataatttacacagataggaagtggtgctttgacggtcaaagaaacaaccaaattctggaggaaaacatggatgttgaaatatggacgaaagaaggtgaaaagaagaaacttcgacccagatggcttgacgcgcgaacatatagtgacccgttagcgttaaaagaatttaaggatttcgcagcagggcgaaaatccatcgcacttgatttagttacagaaatagggagagtcccatcacatttggctcaccgtactaggaacgctctagataacctggtaatgttgcacacatcagaacatgggggtcgcgcataccgccatgctgtcgaagaattaccagaaacaatggagacactattgttactgggtctgatgatcctgctcacaggaggtgcaatgctatttttaatttcaggaaagggaataggaaaaacaagtattggactgatatgtgttatagcaagttcagggatgagttggatggcggaaatccccctgcagtggatagcatcagccatagtacttgagttcttcatgatggtgcttttaatcccagaaccagaaaaacaaagaactccacaagataatcaactagcatacgtcgtcatcggcatcctcactctagcagctataatcgcagcgaacgaaatgggtctactcgaaactactaaaagagatttaggtatgagtaaagaaccgggagtagtcagcccaacaagttatttagacgtagaccttcatccggctagcgcatggactctctatgctgtggcaacaacggtgattacaccaatgttaagacatacaatagaaaatagcaccgctaacgtcagcttagctgcaatagctaatcaagcggttgtattgatggggcttgacaaaggttggcctatatcaaaaatggacctaggagttccactattggcattaggatgctatagtcaagtaaatccattgacactaacagctgcagttctactgctaataacacattatgcaataattggtcctggactacaagccaaagctaccagagaggcccagaagcgtactgcggcaggaatcatgaagaatcctacggtcgatggcataatgacaattgatcttgatccggttatctacgatagtaaatttgaaaaacaactgggacaagtcatgttactggtactctgtgccgtacaacttctactaatgcgtacatcgtgggccctctgtgaggcattaacactagcaacaggacctataactacgttgtgggaagggtcaccgggaaaattttggaatacaacgatagcggtgtccatggccaatatctttaggggatcgtaccttgcaggagccgggctcgcttttagtattatgaaatctgtaggtacaggaaaaagaggtacaggcagccaaggggagactttaggcgaaaagtggaaaaagaaactcaaccaattatcacgcaaagagttcgatttatataagaaatctggaataactgaggtagacaggaccgaagcaaaagaaggattaaaacggggtgaaataacccatcacgctgtatctcgaggaagtgctaagttacaatggtttgtcgaaagaaacatggtgattccagaaggacgagtcatagacctgggctgcggaagagggggatggtcttattattgcgcaggactgaaaaaggtgacagaagttcgtggatatactaaaggtggaccgggacatgaagaaccagtacccatgtctacatacggttggaacattgtaaagctaatgagtggaaaggatgtcttttatttgccacccgaaaaatgtgacacattattatgcgatataggagagtcaagtccatctcccacagttgaagagtctcgtactatacgtgtcctaaaaatggtagaaccatggttaaagaataatcaattctgtattaaagtactgaacccatatatgcctactgtgattgaacacctggagagactacagaggaaacatggaggaatgctagtacgaaacccattatcacgcaactccacgcatgaaatgtactggatcagtaacggaacaggaaacatagttgcctcggtgaatatggtaagtagattgttgttaaaccgctttacaatgacccataggcgccctacaatagaaaaagacgtggacctaggtgcgggaacaagacatgtaaacgccgaaccggagaccccaaacatggacgtaatcggtgagcgcatcaaacgaataaaagaagaacataattctacatggcactacgatgacgagaatccatataaaacttgggcgtatcacggatcttacgaagttaaagctacagggtcagcaagctctatgattaatggcgtcgtaaagttactaaccaagccatgggacgtcgttcccatggtaacacaaatggcaatgacggacacaacaccattcggacaacagagggtatttaaggaaaaggtagacacacgaactccaaggagcatgcccggaactcgtagagtcatgggaataactgcagagtggctatggagaacattaggtcgcaataagaaacctagactatgcactcgagaagagttcaccaagaaggtacgtactaatgccgctatgggagcagtttttacagaggagaaccaatgggattcagctaaagcagcagtagaggacgaagatttttggaaactggttgatagagaaagagagttgcataaactgggcaagtgcgggtcatgtgtatacaatatgatggggaaacgagagaagaaactcggtgagttcggtaaagcaaagggaagtagagcaatttggtatatgtggttaggagccagatacttagagtttgaggctttgggctttttaaatgaagaccactggttctctagagaaaactcctactcaggcgtagagggagaaggattgcacaaactgggctacatactacgagatataagtaaaatacctggcggagcaatgtacgctgatgacacagccggttgggacacaagaataactgaggacgatctccataatgaggagaaaatcacccagcaaatggaccccgaacaccgtcagcttgctaacgcgattttcaaattgacctaccaaaacaaagttgttaaagtacagagaccgacacccacaggaactgtcatggatataatcagtagaaaagatcaaagaggatctgggcaagttggaacctatggactaaatacttttaccaatatggaggcacaacttatacgacaaatggagggggaaggagtcttatcaaaagccgatctagagaatccccatctgcccgagaaaaagattacccaatggcttgaaacgaaaggtgttgagcgactgaaaagaatggccataagtggtgacgattgtgtagttaaaccaatagatgacagattcgctaatgcactactcgcattaaatgatatgggaaaagttcgaaaagatataccccaatggcaaccttcgaagggttggcacgattggcaacaggtaccattctgtagtcaccatttccatgagctcatcatgaaagatggtagaaagctagtagtcccatgcagaccacaggatgaattgatcggacgcgctagaatatcacaaggagccggatggtcactacgagaaacagcctgtttgggcaaagcgtacgcacaaatgtggagtttgatgtacttccaccgaagagatttacgtcttgcttcaaatgcaatttgtagtgcagttccagttcattgggtgccgacgtcacgaaccacttggtctatacatgcacatcaccaatggatgactactgaagacatgttaacggtttggaacagagtttggattgaagataatccctggatggaggataaaacgcctgtaacaacttgggagaatgtgccttacctgggtaaaagagaagatcaatggtgtgggagtttaataggactcacatcaagagccacttgggcacaaaacatacctactgccatccaacaagttagatcattaattggaaatgaagagttcttagattatatgcccagtatgaaacgattccgtaaagaagaggaaagtgaaggagcgatatggtaa

SEQ ID NO: 23036 - RNA, 9873 nt, synthetic construct
  misc_feature 1..9873: note = derived and/or modified CDS sequence (opt6) from DENV-3__JF808126__SS-prME
  source 1..9873: mol_type = other RNA
actagcttgtgccttatgatgattctacctgcagcgctcgcatttcatttgacaagtagagatggtgaaccgcgtatgatagtagggaaaaatgaaagaggtaaatcactgttatttaaaacagcctctggaattaacatgtgcacattaatagcaatggacctcggtgaaatgtgtgacgataccgttacatataaatgtccccacatcaccgaggtggaaccagaagacatcgattgctggtgcaatttaacgagtacatgggtaacgtacggtacatgtaaccaagcaggagaacacagaagggataaaagatcggttgccctagcaccacatgtaggtatgggactagataccagaacgcaaacctggatgagcgcagaaggagcttggcgacaagtagaaaaagtagaaacgtgggcccttcggcatccaggtttcacaatactagctttattcttggctcactacatcggtacaagtcttacccaaaaagtcgtaatatttacacttctaatgcttgtaacccccagtatgacgatgagatgtgttggagtaggcaatagagactttgtggaaggtctttcaggagcaacatgggtggatgttgtcttggaacatggagggtgtgtaacaaccatggctaaaaacaaaccgaccctagacatagaattacagaaaactgaagcaactcaactagcgaccttgcgcaaactatgtatagaaggcaaaattacaaacatcacaacagatagtagatgcccaacccagggcgaagcggtactgccagaagaacaagatcaaaattacgtctgcaaacatacctatgtagaccgaggatgggggaatggatgtggtttatttggtaaagggagcttagttacctgtgcaaaatttcaatgtctagaaccgattgaaggaaaagttgtacaatatgaaaatctcaaatacaccgtgataataacagttcatactggagaccaacatcaagttggtaacgaaactcaaggggttaccgccgaaatcacccctcaagcgtctactacggaagctatactgccggaatacggaacccttggcttagaatgcagtcctcgtacgggtctagacttcaacgaaatgatcctattgacaatgaaaaataaggcttggatggtccatcgtcaatggtttttagacttaccattaccatggaccagtggtgcgacaaccgaaactccgacgtggaacagaaaagaattgttagtaacattcaaaaacgcgcacgcaaagaaacaggaggtagttgtattaggatcccaagaaggcgccatgcatactgcgctaaccggtgcaactgagattcagaatagcggtgggacatctatatttgcaggacatttgaaatgcaggttgaaaatggataaattagaattgaaaggaatgagttatgcaatgtgcaccaacaccttcgtattgaagaaagaagtaagtgagacacagcatggtacgatcttgataaaagttgaatacaaaggcgaggacgccccttgtaaaattcctttctcgacagaagacggccaaggaaaagcacataatggtcgcttaataactgcgaatcctgttgtaactaagaaagaagaaccggttaatatagaagcagagcctccgttcggagaaagtaacatagttattggaatcggagacaatgctttaaaaataaactggtacaagaaaggcagctcaatagggaaaatgtttgaagcgaccgccagaggtgcgagaagaatggccatattaggtgatacggcttgggatttcggcagcgtaggaggcgtgttaaactcactaggtaaaatggtacatcaaatatttggatcggcttataccgctttattttctggagtgtcctgggttatgaaaataggcataggagtactgttaacgtggataggtctaaactctaaaaacacctctatgtccttctcttgtatagctattggaataataacattatatctcggtgctgtagtacaagcagacatgggttgtgtgataaattggaaaggaaaagaactcaaatgcggaagcggaattttcgttaccaacgaagtacatacctggacagaacaatataaatttcaagcagattccccgaagcgactagcaaccgctatagccggtgcatgggaaaatggtgtatgtggtataaggtccactacaagaatggagaacctactatggaaacagattgcaaacgaactcaactatatattatgggagaataatattaaattaacggtcgtagtcggagatataattggagtattagaacaaggaaaacgtaccctaacacctcaaccgatggagctaaaatacagctggaagacgtgggggaagtcaaagattgtaacagctgaaactcaaaattcctcatttataattgatggaccgaatacaccggaatgcccaagtgcatctagagcctggaatgtatgggaagtagaagattacggtttcggggtatttacaacaaatatatggttaaaacttagggaggtatacacccaactctgtgatcatcgactgatgtcagcagcagtaaaggatgagcgcgctgtacacgcagacatgggatactggattgaaagtcaaaagaacgggagttggaaactggaaaaagcaagtctaatcgaagtcaaaacttgcacatggcccaaatctcatacactatggtctaatggtgtacttgagagtgatatgatcataccaaagtcactagcgggacctataagccaacataatcatagaccaggatatcatacacagacagcaggtccctggcaccttggaaaacttgagttagacttcaattattgcgaaggtacaactgtcgtaatcactgaaaattgtgggactcgaggaccggcccttagaacaactacagtttcgggtaagttaatacatgaatggtgctgtcgatcgtgcaccctaccccctctacgatacatgggtgaagacggatgttggtatggtatggagattaggcctatatcagaaaaagaagaaaacatggttaaaagtctagtatccgctggtagtggaaaagtagacaactttacaatgggagtgttatgtttagccattctgtttgaagaagtaatgagaggtaaattcggtaaaaagcatatgattgctggtgtcttcttcactttcgttttattgttatccggacagataacttggcgagatatggcccatactctaatcatgatagggtcaaatgcatccgataggatgggtatgggagtaacatacttagcactaatagcaacatttaaaatacaaccctttttggcattaggattctttttacgaaaactaacgagtcgtgaaaatctattgttaggtgtagggctggcaatggccaccacgctgcagctacccgaggacatcgaacagatggctaatggtatcgcattaggtctcatggcactaaaattaatcacacaattcgaaacttaccaattgtggacggcgttaatttcacttacgtgtagcaacactatgttcaccctaactgtagcatggcggacagcaacattaatactcgccggtgtgtcgttattacccgtctgccaaagctcatcgatgcgcaaaacagactggttgccgatggccgttgcagccatgggagtaccaccattaccgttatttattttcagcttaaaagacactctaaaacgtcgtagttgcccattaaatgaaggcgttatggccgtaggcctagtgagcattctcgcttcatcactattacgaaacgacgttccgatggcggggccattagtagcgggaggacttctgatagcttgctatgtgataacgggtacgtcagctgacttaaccgttgaaaaagcggcggacataacatgggaggaagaagctgagcaaactggagtgagccataacctaatgataaccgtagatgacgacggaacaatgcgcatcaaagatgacgagacagaaaacatacttacagttttgcttaaaacggctctattaatcgtgtccggcgtgtttccctatagtattccggctacactactcgtatggcacacatggcaaaaacaaacacagcgaagcggtgttttgtgggatgttcctagcccaccagaaacacagaaagccgaattggaagaaggtgtttataggattaagcaacaaggtatattcggaaaaacgcaagtaggcgtcggcgtccagaaggagggcgtattccacaccatgtggcatgtcactcgcggtgcagttttaacatataatggtaagaggctagagccgaattgggcgtctgtcaagaaagatctagtatcatatggaggaggatggcgattaagtgcacaatggcaaaaaggagaggaagtacaagttatagcagtagaacctggcaaaaatcctaaaaactttcaaaccatgcctggaacatttcaaacaacaaccggagaaataggagctatcgccttagatttcaaacccggtacgagtggatcgcctatcataaacagagaaggtaaagtagtaggattgtacggtaatggagtagttacgaagaatggaggatacgtgtcagggatcgcgcaaactaatgccgaaccagacggacctacacccgaactcgaagaagaaatgtttaagaaacggaatttaacaataatggatttgcatccaggtagtgggaaaacaagaaagtaccttccagctatcgtgcgagaggcaataaaaagacgattacgcactttgattcttgctccgacgcgtgtagttgccgccgaaatggaagaggcattgaaaggattacccattagatatcagacaaccgctacgaaaagtgagcacacaggcagggaaattgttgatcttatgtgtcatgcaacatttaccatgaggttactatcacccgtgcgcgttcagaactacaatttgataatcatggacgaagctcattttacagatccagcgtcaattgcagctagaggatatatttctacgagagtggggatgggggaggcggcggcaatatttatgaccgcgacaccacccggaaccgccgatgcttttccacaatccaatgcacctatacaagatgaagagagagatatcccagaacggtcatggaacagcggaaatgaatggataacagactttgccggaaaaacagtgtggtttgtcccatccataaaagcagggaatgacatcgcaaattgcttacgaaagaacggtaagaaagttatacagctgtctcgtaaaacatttgataccgaataccagaaaactaaattaaacgactgggattttgttgtgacaacagacatatcggaaatgggagccaattttaaagctgacagagttattgaccctcgtcggtgcttaaaaccagttatcctcacagatggaccagagagagtgatcttggcgggacctatgcctgtaaccgcagcatcagcagctcaaaggcggggtcgagtaggtagaaacccacaaaaagaaaatgatcagtacatttttacaggtcaaccattaaataatgacgaagaccatgcccactggaccgaagcaaagatgttactggataatataaatactcctgaaggtataatccccgctttattcgaacccgaacgggagaaatcagcagcaattgacggagaatacagactaaaaggagaatcacgtaaaacattcgtggaattgatgagaagaggagacctccctgtatggttagctcataaagttgcatcggagggtatcaagtatactgatagaagatggtgtttcgatggtcaacgaaacaatcagatattggaagagaatatggatgtagaaatatggacgaaggaaggagagaagaagaaattacggccacgttggttagatgcaagaacttactcagatcccttggccttgaaagagtttaaagactttgcagcgggacgaaaatctatagcactggacttagtgactgaaattgggagagtgcctagtcacttagctcatagaacaagaaacgcacttgataacctagtcatgcttcacacaagtgagcatggcgggagagcatatagacacgccgtggaggaactacccgaaactatggaaaccttattactgttaggtttaatgattctactaactggcggagccatgctttttctaatctccggaaaaggaataggaaaaacaagtatcggtttaatatgcgtaattgcttcttccggaatgctgtggatggcagaaataccactaccatggatagcgtcagcgattgttctggagttctttatgatggtattactcatccctgaacctgaaaaacaacgcacgccacaagacaatcagttagcatatgtagtaattgggattcttactcttgcggcaattatagcggcgaacgaaatgggcttgcttgaaaccactaaaagagatttaggtatgtctaaagaacctggagtagtgagtccaacgtcatatcttgatgtagaccttcatcctgctagtgcgtggacactttacgcagtggcaacaactgtcattacacccatgcttagacacactattgagaacagcacggcgaacgtatccttggctgcaatagcaaatcaggccgtcgtattaatgggccttgacaaaggatggccgatctcaaagatggacttgggtgtacctttactagcattaggatgctactctcaagtaaatccgttgactctaacagcagcagttttactccttatcacacattacgccataataggccctgggctacaagcaaaagccacaagagaggcccagaaaaggactgcagctgggataatgaaaaacccaacagtagacggtataatgaccatcgatctggaccccgtaatttatgacagtaaatttgagaaacaactcggacaagttatgttgctcgtgctgtgcgcagtccagctcttgttgatgaggacgagctgggcgctgtgtgaggcgcttactcttgcaactggccctataactactttatgggagggttctcccggcaaattttggaacacgactatagctgtgtctatggcaaatatctttcggggttcgtacttggctggcgccggtttggcgttcagtattatgaaatcagtaggaacaggcaaacgtggaacagggtcccagggggagacattaggggaaaagtggaaaaagaaattaaatcagttgtcacgtaaagagttcgatctatataagaaaagtggtataacagaggtagatagaacggaagcaaaagagggtttaaagagaggggaaatcacacatcatgctgtatcacgcggctcagcgaagttacagtggtttgtcgagcgaaatatggtgattccggaaggaagggtcatagaccttggctgcgggcgagggggatggtcatattactgtgccggactcaagaaagttacagaagtgagaggatatacaaaaggcggtccaggacacgaagaaccagtaccaatgagtacatatggttggaatatagtcaaactaatgagtggtaaagatgtattctatctccctccagaaaaatgtgatacattgctttgtgacattggcgaatcgtctcctagccctacagtagaagaaagtagaaccattcgagtacttaagatggtagagccatggctgaaaaataaccaattctgcattaaggtacttaacccatatatgccaactgtaattgaacacctagaacggctacaaagaaagcatggagggatgttagtgcgtaatcccctaagtagaaattcgacccacgaaatgtattggatatcaaatggaacaggaaatatagtcgcatctgtaaacatggtgtcgcgattgcttctgaatagatttacgatgacccatagaaggccaaccatagagaaggatgtcgatctgggcgccggaactcggcacgttaatgcagaacctgaaactccaaatatggatgtgatcggcgaaaggataaaaagaataaaagaagaacataattccacttggcactatgacgacgagaatccttacaaaacctgggcatatcacgggtcttacgaggttaaagcaacagggtccgcaagctcaatgataaatggggtagtgaaattactaacaaagccatgggacgtcgtccccatggtaacacagatggctatgacagacacaactccttttggtcaacaacgtgtattcaaggaaaaagtagatacaagaaccccacgctccatgcctggaaccagaagagttatgggcataacggccgaatggctatggagaacactaggccgtaataagaaacctcgtttatgtactcgtgaagaatttaccaagaaagtacgaactaatgccgcgatgggtgcagtattcacagaagagaaccagtgggatagtgctaaggctgcagtggaagatgaggatttttggaagctagtggatcgcgagagagagttacataagttaggtaaatgtggatcatgtgtatacaatatgatgggaaagagagagaagaaattgggagagttcggaaaagctaaaggatcaagagctatttggtatatgtggctcggagcacggtatctagaatttgaggccctaggtttccttaatgaagatcattggttttcacgagaaaactcctacagtggtgtagaaggagaaggattacacaaactcggatatattcttagagatatatcaaagatacccgggggtgcaatgtatgcagatgatacagctggctgggatacgcgtatcacggaagatgatttgcacaatgaagagaaaatcactcagcagatggacccagaacatagacaactggctaatgcgatattcaaactgacatatcaaaacaaagtggtcaaagttcaacgtcctacacctacaggaaccgtaatggacatcataagtcgaaaggatcaaagagggtcaggtcaagttggcacatatgggttaaatacatttacaaatatggaagcacagctcattaggcaaatggaaggagaaggtgtactaagtaaagccgatttggagaatccacatctccctgagaagaaaataacacaatggttagaaactaaaggggttgagaggctcaaacgtatggcaatatcaggcgatgactgcgtagtaaaaccaatagatgatagattcgcgaatgccctgttggctcttaacgacatgggtaaggtaagaaaagacatacctcaatggcaaccatcgaaaggatggcacgactggcaacaagttcctttctgctcacatcatttccacgaacttattatgaaagatggacgaaagctagtggtgccttgtcgaccgcaagatgagttgataggtcgagcaagaatatcgcaaggagcaggatggtcattgagggaaacggcttgtttaggtaaagcgtacgctcagatgtggagtctcatgtatttccatagaagggatttaagattagcctctaatgctatatgttcagcagttccagtccactgggtcccaacgtccaggacgacatggagcattcacgctcatcatcaatggatgacaacagaggacatgttaacagtatggaacagagtgtggatcgaagacaatccctggatggaagataagacacccgtcacaacatgggaaaacgttccgtacctaggtaaacgagaagatcaatggtgtggatcattgattggccttacgtccagagccacatgggcacaaaacataccaacagctattcaacaggttagatcccttataggaaatgaggaatttttagactatatgccaagcatgaaaaggtttcggaaggaggaggaaagtgaaggggcaatctggtga

SEQ ID NO: 23037 - RNA, 9873 nt, synthetic construct
  misc_feature 1..9873: note = derived and/or modified CDS sequence (opt6) from DENV-3__JF808125__SS-prME
  source 1..9873: mol_type = other RNA
acttctctgtgcttgatgatgatattaccggctgcactagcatttcatttaacaagtagggacggtgaaccaagaatgattgttggtgaaaacgaacgaggaaaaagtctactatttaaaacggctagtggtataaatcgtagaacgttaatagccatggacttaggagaaatgtgtgaagaaactgagacctataaatgtccacatattaccgaagtcgaacccgaagatatagactgctggtgcaatctaacaagtacttgggtaacttacggaacatgcaatcaagctggggagagaagaagagacaaacggagtgtcgccttagcgccacacgtgggtatgggtctcgatacacgtacccaaacatggatgtcggctgaaggtgcttggaggcaagtagagaaagtagaaacgtgggcactcagacacccaggatttactatacttgcgttattcttggcacactatatcggtacatctctaacacaaaaagtagtaatttttattcttttaatgttagttacacccagtatgacaatgagatgtgtaggtgttggaaacagagattttgtcgagggattatctggagcaacatgggtggatgtcgtcctagaacacggaggttgtgtcacaactatggccaaaaataaaccaacattagatattgaattacagaaaactgaagctacccagttagcgacactacgtaaattgtgcattgagggaaaaattacaaatatcacaaccgattccagatgtcctacccagggagaagcggtcctacccgaagaacaagatcaaaattatgtctgtaaacatacgtacgtcgataggggatggggaaatggatgtggtttatttggaaaaggatcgctagtaacgtgcgcgaaattccaatgtttagagccaatcgaaggaaaagtcgtccagtacgaaaacctaaaatatactgtaataataactgtacatacgggagatcaacaccaagtcggcaatgaaacgcaaggagtcactgctgaaataactcctcaggcaagtacaacagaagcgattttacccgaatacggtacactcggcctcgaatgcagccctagaactgggttagatttcaatgagatgatactcttaacaatgaaaaacaaagcatggatggtacatcgtcaatggttctttgaccttcctcttccctggacgagcggagccacggcagagaccccaacgtggaatcgaaaagaactcttagtaacattcaaaaacgctcatgctaagaaacaagaagtagtcgtcttagggagccaagaaggtgctatgcataccgccctaactggagccacagaaattcaaaacagcggaggaacatcgatctttgccggccatttgaaatgcagattgaaaatggacaaattggaacttaaaggaatgtcctatgcaatgtgtaccaatacctttgtacttaagaaagaagtaagtgaaactcaacacggcactattttaatcaaagttgagtacaaaggagaagatgctccttgtaaaattcccttttcaacagaggatggacaaggtaaagcacataatggcagactgattacggccaacccagttgtcacaaagaaagaagaaccggttaacattgaagcagaacctccatttggggagagcaatatcgtaatcggaattggtgataatgctcttaaaataaactggtataagaaaggtagctccatcggtaaaatgtttgaagcgacagcacggggtgcacggcgtatggctattctcggcgatacggcatgggacttcggaagtgtaggcggagttttaaattcactggggaaaatggtacatcaaatttttggttcagcatatacagctttattttcaggagtatcttgggttatgaaaataggaataggtgtactgctaacctggatcggtctgaactccaaaaatacctcaatgagcttctcatgcatagctataggtattatcacattatatttaggggccgttgtgcaagcagatatgggatgcgtcataaattggaaaggtaaagaattaaaatgcggtagcggcatctttgtaactaacgaggtacatacctggactgaacaatataaattccaggctgattctccaaaacgcctcgcaacagctatagccggagcgtgggaaaatggcgtttgtggaattagatcaacaactaggatggagaacctattatggaaacaaatagcaaatgaattaaattatattctgtgggaaaacaatatcaaactaactgttgtagttggagacattataggggtacttgaacaaggaaaaagaactttaacgcctcagcctatggaattaaaatatagctggaaaacgtggggaaaagctaaaattgttacagcggaaacccagaactcttccttcatcatcgatggtcccaacactcccgaatgccctagcgcatcgagagcttggaacgtatgggaagtagaagattatggtttcggagtcttcacgactaatatttggttaaagttgagggaagtctatacacagctctgcgaccaccgtctcatgtcggcagctgtaaaagatgagagagctgttcatgcagatatgggctattggatcgaatcccagaaaaatggatcttggaaactagaaaaagcctctctaatagaagtaaaaacatgtacttggccaaagagtcatactttgtggtccaatggtgtgctggaatccgacatgattatacccaagtcactagcaggcccaatatcacaacataatcaccgaccgggctatcatacgcaaaccgcgggaccatggcatcttggcaagttagaactggactttaattattgcgagggtacaacagtagtaataacagagaactgtggcactagaggacccagcctaagaaccacaaccgtaagtggaaaactcatacacgaatggtgttgcaggagttgtacactgcctccgttaaggtacatgggagaggacggatgttggtacggcatggaaataaggccgataagcgaaaaagaagaaaacatggttaaatcactcgtttccgctggatctggaaaagttgataatttcaccatgggtgttttatgcctagcgatactatttgaggaagtcatgcggggaaaatttggcaagaaacatatgatcgccggagtattctttacttttgtcctactcctttcaggccagattacttggagagacatggcacacacgcttataatgataggaagtaacgcaagcgatagaatgggcatgggagttacatatttagcattaatcgccacatttaaaatacaaccatttttagccctcggattctttctaagaaaattaacatccagagaaaacttactacttggggttggattagcgatggcaacaacacttcaactaccagaagacatagaacaaatggcgaatggtatagcattaggactaatggcacttaagctaatcacacaattcgaaacttatcaattatggacggcattaataagtctcacttgttccaatacgatgtttacgttgactgtagcttggagaacagcaacacttattctggccggtgtctcattgctgccagtttgtcaaagcagtagtatgcgaaaaacagattggctgccgatggctgtagccgcaatgggagtcccaccattaccactctttatattttccctcaaagatactttaaaacgccggtcatggcctttaaacgaaggtgtaatggcagtgggcctagtatctattctcgctagttccctactacgcaacgacgtacccatggccggaccgctagtagcaggaggactcttaatagcttgctatgttataactggcacgtccgcagacttaacagtagagaaagccgccgatattacctgggaagaggaagcagagcaaacaggtgtttcacataatctcatgataacggtggacgatgatggaactatgaggattaaagacgacgaaacagaaaatattctaacggttctgttaaaaactgcgcttttgattgtaagtggtgtattcccgtatagcattccagcgacactgttggtttggcatacttggcaaaaacaaacccaacggagtggagtactatgggatgtaccatcgccaccagaaacacaaaaagctgagcttgaagaaggtgtataccgcatcaagcagcaaggtatatttggaaaaacgcaggtaggggttggggtacaaaaagaaggagtatttcatacaatgtggcacgttacgagaggtgcagtattgacatacaatggcaaacggttggagccaaactgggcatcggtcaagaaagacctgatatcaagtggcggtggatggagactatcggcccaatggcaaaaaggggaagaagtccaagtcatagccgtggaacccggcaaaaatccgaaaaactttcagacaatgccagggacattccagaccacaactggagagataggagctatagccctagacttcaagcctggcactagcggtagtccgataataaatagggagggtaaggttgtagggctatatggtaacggagtcgttacaaagaatggtggatacgtatcaggtatagcacaaacaaacgctgaaccagatggaccaactccggagcttgaggaggaaatgtttaagaaacgtaacctcacaatcatggaccttcatccaggaagcggtaagacgagaaaatatctaccggcaattgtgagggaagcgattaagagaagactaaggacattaatcttagctccgacacgcgtagtggcagcagagatggaagaggcactgaaaggattacctatacgatatcaaaccacagccacaaaaagcgaacatacaggacgagaaatagtagatttaatgtgtcatgcaacgtttactatgcgtctactgtcaccagtacgagtaccaaattataatttaataattatggatgaggctcatttcacggatcctgcaagcatagcagctagagggtacatatcaacaagggtaggaatgggcgaagctgcagcaatatttatgacagcaacgccaccaggaacggcagatgccttccctcaatcaaacgcaccaatacaggatgaggagagagatatcccagaaagatcatggaatagtggaaatgaatggatcacggattttgcaggtaaaaccgtctggtttgtgccatcgatcaaagctggaaatgatattgcgaattgcttaaggaaaaatggtaaaaaggttatccagctgagcagaaaaactttcgatacagaataccagaaaactaaacttaatgattgggatttcgttgttactactgatatatcagaaatgggagcgaattttaaagcggacagagtaatcgatccacggagatgtttaaaaccagttattctaacggatggtcctgaaagagtaatcttagctggacccatgcctgtaacagcagcaagtgcagcccaaaggcgaggtagggttggaagaaatcctcaaaaagagaacgatcagtatatatttacaggccaacctcttaataatgatgaagatcatgcgcattggacagaggctaaaatgctcttggataatatcaatacaccggaagggatcattccagctctctttgagccagaaagagaaaaatccgcggcaatagacggggaataccgcttaaaaggtgaatcaagaaaaacattcgtagaattaatgagacgaggtgatttgcccgtatggttggctcataaagtagcttctgagggaattaaatacacggatagaaaatggtgtttcgacggacaacgtaataatcaaatcctcgaggaaaacatggacgtagagatatggacgaaagagggcgagaagaagaaattacgcccgaggtggttagacgctaggacttacagcgacccattagcactgaaagaatttaaggattttgcagccggaaggaaatccatagcactagatttagtaactgaaatcgggagagtccccagtcatttagctcatcgaacacgaaatgcgctagataatttggtaatgttacacacctctgagcatggaggacgtgcttatagacacgcagttgaggaacttccagagaccatggagacactgctacttttgagattaatgattctacttacagggggagctatgctatttttaatttcagggaaagggataggcaaaacaagtataggattaatatgcgttattgcatcaagcggaatgctttggatggccgaaataccattacaatggatagcatcggcaatagtgttagagttctttatgatggtcttattaatacctgaaccggaaaaacaaagaactccgcaagacaatcagttagcgtacgttgtaataggaattttgaccctagcagccattatagctgctaacgaaatgggacttttagaaacaacgaagcgagatttagggatgagcaaggaacctggtgtagtaagccctacatcatatttagacgtggacttacaccctgctagtgcgtggacattatatgcagtagccaccacggtcattacaccaatgctccgacacaccatagaaaacagtactgctaatgtgagtctagcagcaatcgcaaatcaagcagtggttttaatgggacttgacaagggatggcctatatcaaaaatggatttaggtgtccccttactcgcactcggttgctacagccaagttaatccactaacgttaacggcagctgtactgctactaattacacactacgcgatcatagggccaggacttcaagcaaaggcaacacgtgaagcacaaaaacgcacagctgctggtattatgaaaaacccgaccgtagatggtataatgacgatcgatttggatccagtaatatatgatagcaagtttgaaaagcaacttggacaggtgatgctattagtactatgtgccgtccaactactacttatgcgaacaagttgggcgctatgtgaagccctcaccttagcaacaggtcctataacgacattgtgggaagggagcccgggcaaattttggaacacaacaatagcagtgagtatggcaaatattttccgaggttcatacctagcgggcgcaggcttagcattctcaattatgaagtctgtcgggactggcaaacgcggaactggcagtcaaggagaaaccttgggcgagaaatggaagaagaaattaaatcaactctcaagaaaagaatttgatttatataagaaaagcgggataacagaagtagatagaactgaagctaaagaaggattgaaacggggagaaattacacaccatgcagttagtcgaggctctgcaaaactgcaatggtttgtggaacggaatatggtaatcccagaaggtagggtaattgatctaggatgtggaagagggggttggtcctactattgtgctggcctgaagaaagtcacggaggtcagaggttataccaagggagggcccggacatgaggaaccagttccgatgagcacgtacggatggaatatagtaaaacttatgagtgggaaagatgtattctacctcccacctgagaaatgcgacacactcctttgtgatattggagaaagttcccctagcccaaccgttgaagaaagccgaacgatcagggtcctgaagatggttgaaccttggctcaaaaataatcaattctgtattaaggtattgaatccatatatgcctacagttatcgaacacttggaaaggctgcaaagaaagcatggaggaatgcttgtaagaaacccattgagtagaaactcaacccatgagatgtattggataagtaacggcacaggcaacattgtagctagtgtgaatatggtatcaagacttctactaaacaggtttacaatgactcatcgccggccaaccatagaaaaggacgttgatctcggtgcaggaacgcgtcatgtcaatgctgagcctgaaactccaaatatggatgtaattggcgagaggatcaagagaataaaagaagaacacaattcgacgtggcattacgacgatgagaatccgtataaaacctgggcgtaccatggaagttacgaagtaaaggcaactggctcggcgtcgagcatgatcaatggtgttgtaaaattgttaacaaagccatgggacgtggttcccatggtcactcaaatggcgatgactgatacgaccccgtttggacaacagcgtgtcttcaaagaaaaagtagatacacgaactccgagaagtatgcccggtactaggcgagttatgggaattactgcagagtggttatggcgtactttgggacggaacaagaaaccaagattgtgcacaagagaagagtttaccaaaaaggtacggacaaacgcagccatgggtgcagtattcacagaggaaaatcaatgggattcagcgaaggcggctgttgaagatgaagatttttggaagctagtagatagagagagagagttgcacaaactaggaaaatgtggttcatgtgtctataacatgatgggcaaacgcgagaagaaactaggagaatttggaaaggcgaaaggctcaagagcaatttggtacatgtggctcggggctcggtatctagaatttgaggccttaggatttttgaatgaagaccactggttcagccgtgaaaactcatacagtggagtggaaggagaaggccttcataaattagggtacatattaagggatatatcaaagattccaggcggtgccatgtacgccgatgacacagcaggatgggacacgagaataacagaagatgatctacataatgaagaaaagataacccaacaaatggacccagaacacagacaattggcgaatgcgatatttaagctaacttaccagaacaaagtcgtaaaggtacaaagacctactccaactggtaccgttatggatataatatcacgtaaagatcagcgcggatccggccaagtaggtacatatggtctaaacacattcaccaacatggaggcacaattaataagacaaatggaaggcgaaggcgtcctatcaaaagccgacctcgaaaatccgcatttaccagagaagaaaataacacaatggttggaaacaaagggagtggaaagattaaagaggatggcaatcagcggggacgattgtgttgttaaaccaatagatgacaggtttgcaaatgcacttttagcattaaatgatatgggtaaggtacgtaaggacataccacagtggcaaccatcaaaaggctggcatgattggcaacaagtcccgttttgttcccatcattttcatgaacttataatgaaagatggaagaaagctagttgtcccctgtcgcccacaagatgaactaatcggtcgcgctcgaatatctcaaggagctggttggtctttaagagagacagcatgtctgggaaaggcttatgctcagatgtggagtctcatgtatttccatcgaagggacttacgattggcgtcgaatgcaatttgttccgctgtaccggtgcattgggtacctacgtctaggacaacttggtcaattcatgctcatcaccaatggatgaccactgaagacatgctaacagtttggaaccgtgtttggattgaagacaacccttggatggaagataagacaccagtaactacgtgggagaacgtcccatatctagggaagcgggaggatcaatggtgtgggtcattgatcggactgacttcacgcgctacctgggcgcaaaatatccccacagccatacaacaggtcaggtctctgataggaaacgaagaatttttagattacatgccaagtatgaagcgcttccgaaaagaagaagaatctgaaggagctatatggtaa

SEQ ID NO: 23038 - RNA, 9873 nt, synthetic construct
  misc_feature 1..9873: note = derived and/or modified CDS sequence (opt6) from DENV-3__JF808129__SS-prME
  source 1..9873: mol_type = other RNA
acttccctttgtctgatgatgattctaccggcggcactagctttccatttaacctcacgagatggagaaccaagaatgattgtgggtaaaaatgaaaggggaaaatcgctattatttaaaacggcttcaggaatcaacatgtgcacgctgatagcaatggacctaggtgaaatgtgtgacgacactgtgacttacaaatgcccccatataacagaagtggaacctgaagatatagattgttggtgcaatttaacgtcaacctgggtgacctacgggacttgtaatcaagcaggagaacatcggagagacaaaaggagtgtcgctttagcacctcatgtaggaatgggtttagatacaaggacccaaacatggatgtcagcggaaggagcctggcgacaagttgaaaaagtggaaacttgggcattgagacatccgggattcacgatattggcactttttctcgcacattacattggcacaagtttaacacaaaaagtagtaatatttatcttactaatgctagtaacaccgagtatgacaatgagatgcgtgggagttggcaacagagattttgttgaaggactcagtggtgcaacatgggttgacgttgtacttgaacatggtggatgtgttactacaatggccaaaaacaaacctacattggacatagagttgcagaaaacagaggcaacacaattagcaactctaagaaaactatgcattgaaggcaaaattaccaatattacaactgactcccgttgtccaacacaaggagaagcagtcctacctgaagaacaagatcagaattacgtttgtaaacacacctacgtcgatagaggatggggaaacggatgcggactttttgggaaaggtagcttagtgacctgtgcaaaattccaatgtttagaaccaatagagggaaaagtagtacaatatgaaaatctaaaatacacggtcataattacagttcataccggagaccaacatcaagtaggaaacgaaacacaaggagtgacagccgaaatcacaccccaagcaagcacgacagaagctatactacctgaatacggcactcttggattagagtgcagtccacgaacaggtttagactttaacgaaatgattctgttaacaatgaaaaataaagcatggatggtccaccgccagtggttctttgatctaccactaccatggacttcaggagctaccacagaaactccaacctggaatagaaaagaacttctagttacctttaaaaatgcacatgccaagaaacaagaagttgttgttctcggcagccaggaaggcgctatgcacaccgctctaacaggggctacggaaatccaaaactccgggggaacatctatattcgcaggacacctaaaatgccgattgaaaatggacaaactagaacttaaggggatgagctatgcgatgtgcactaatacgtttgttctcaagaaagaggtaagcgaaacgcaacacggtacaatactaatcaaagttgaatacaaaggagaagacgctccgtgtaaaataccattttcaacggaagatgggcaaggcaaagcacataatggacgactaataacagcaaaccccgtagtgactaagaaagaagaaccggtaaatattgaggcagagccaccgtttggagaaagtaatattgtcataggaattggagataatgcattgaaaattaactggtataagaaaggttcaagcatcgggaaaatgtttgaagcaacggcaagaggagctcgtcgtatggcaatacttggtgatactgcatgggattttggtagcgtgggtggtgtactaaattcattaggaaaaatggtccatcaaattttcgggtcagcttatacggcattattctctggagtgtcatgggtaatgaaaataggaattggtgtgctcctcacgtggatcggattaaattccaaaaatacatcaatgtcattttcatgcatagcaataggaataataactctatatctaggagctgtagtgcaagcagatatgggatgcgtaatcaactggaaaggtaaagaattaaaatgcgggtccggcatatttgtgaccaacgaagtacacacctggaccgagcaatacaaattccaagcagactcacctaaaagattagcaacagcaatagcgggagcctgggagaacggagtatgcggaatacgctctacaacaagaatggaaaacttattatggaaacagattgcaaatgaattaaattacatactgtgggagaacaacatcaaactcacggtggtcgttggagacattactggcgtgttagagcagggaaaaaggacccttacaccccaaccaatggaattaaagtatagctggaagacctggggaaaggctaagattgtgacagcagaaacgcaaaattcatcatttataattgatgggcccaatacccctgaatgtccctcagcatcgcgcgcctggaacgtttgggaagtagaagattacggatttggtgttttcacgacaaacatctggttaaaattacgtgaagtttatacccaactttgtgatcatcgtctaatgtctgcagccgttaaagatgaacgagcagtacatgcagatatgggttattggattgaatcccagaaaaacggatcgtggaaactggaaaaagccagtttaatcgaagttaaaacatgtacgtggcctaaatctcatacactgtggtcaaatggagtactagaatcggatatgattataccaaaatcactagcaggtccgatatcccagcataatcataggccaggataccatacgcaaactgccggaccttggcatttaggtaaactcgagttagactttaattactgtgaagggaccaccgtagttatcacagaaaattgtggtacacgtggtccatccctgcgtacaactacagtaagtggtaaattgattcatgagtggtgctgccgatcgtgtacattacctccattaaggtacatgggtgaggatggatgctggtacggtatggagataagacctataagtgaaaaagaagaaaatatggttaagagtctcgtcagcgcaggttctgggaaagtagataattgtactatgggagtactctgtcttgcaatactctttgaggacgtgatgagaggaaaatttggcaagaaacatatgattgctggagtgttcttcacttttgttttactattatcagggcaaattacgtggagagacatggcacacaccctaataatgataggcagtaatgcatcggatagaatgggaatgggagttacgtacttggctttaatagcaacttttaaaatacaaccgtttcttgccctgggctttttcttgaggaaactgacttctcgagaaaaccttttactaggggtaggtcttgctatggctacaacgctacaactacctgaagatatagagcaaatggcgaacggaatagcattaggactaatggccttaaaattaataacccaattcgaaacttaccaactttggactgcgctaatctcgttaacatgttccaacacaatgtttacacttacagtagcttggagaactgctactctaatactggcaggcgtatcactattgcctgtttgtcagagtagttcgatgcgaaaaactgattggcttccgatggcggtagcggctatgggcgttccaccactcccgttatttatattttcattaaaggatacattaaaaagacgatcgtggccgttgaacgagggtgtgatggcagtaggcttagtaagtatcttagcaagcagcctattaagaaacgatgtgcctatggcaggcccgttagttgcaggcggtttgttgattgcatgttatgtaatcactggaacgagtgcagaccttaccgtggaaaaagcagcagatataacatgggaagaagaagctgagcagacgggagtcagtcataatttaatgactaccgtcgatgatgacggaacgatgcggataaaagatgacgagacagaaaacatcttgaccgttttattaaagacggccttaacaatcgtttcgggagtatttccatactcgatcccggctaccctattagtatggcacacttggcaaaaacaaacacagagaagtggggtactatgggatgtaccctcgcccccagaaacacaaaaggcagaacaagaagaaggagtctaccgcataaaacaacaaggcatatttggaaagacccaggtaggcgtaggagtgcaaaaagagggtgtttttcataccatgtggcacgttaccaggggagcagtacttacatacaatggaaaacgattagaacctaattgggcaagcgttaaaaaggatctaatatcatatgggggtgggtggcgcttaagtgcccaatggcaaaaaggagaagaggtccaagtaatcgcagtagaaccaggcaaaaaccctaaaaactttcagaccatgcctggaacctttcaaactaccacaggtgaaatcggcgcgatagcactagatttcaaaccagggacaagtggaagcccaattatcaacagagaaggtaaagtagtgggattatacggtaatggcgtcgtaaccaaaaacggagggtacgtaagcggaatagcacaaacaaatgcggagccagacggaccgacacctgaacttgaagaagaaatgtttaaaaagagaaatctgacaatcatggatttgcacccagggagcggtaaaacaaggaaatatttacctgccatagttcgtgaagcaataaaacgacgtttaagaacactcatcttagccccaacacgagttgttgccgcagaaatggaagaggcactcaaaggattacctattcgataccaaacaactgcaacgaaaagcgaacatacagggagagaaattgttgaccttatgtgccatgcgacattcacaatgaggttgttaagcccagtacgagttccaacatacaacctaattataatggacgaagctcactttacggacccagcaagcatagcggcaaggggctatatttctacaagagttggcatgggggaagcggccgcaatatttatgactgccacaccccctggtactgctgatgcttttcctcaatcaaacgcgcccatacaagacgaagagagggatataccagagagaagctggaacagcggcaatgaatggataacggattttgcaggaaagacagtgtggtttgtaccatcaataaaggcaggaaacgatatcgccaactgtcttagaaagaatggcaagaaagtcatacaattatccagaaaaacattcgatactgaataccagaaaacgaaattaaacgattgggactttgttgtcaccacagatatatcagagatgggtgcgaacttcaaagcagaccgtgtaatcgaccccagaagatgtttaaaaccagtaatcctaactgatggtcccgaacgcgtaattctcgcaggaccgatgccggttaccgctgcctctgcggcacaacgaagaggccgtgtaggaagaaacccgcaaaaagaaaatgatcagtatatctttacaggccagccgttgaacaatgatgaagatcatgcccattggacggaagcaaaaatgttgctagacaatataaatacaccagaaggtatcattcctgctctatttgaaccggaaagagagaaaagtgctgctatagatggtgaatatcggttaaaaggggaatctagaaaaacttttgtagaactcatgagacgtggagatctgccagtttggttggcacataaggtagctagtgaagggattaagtatacagaccgaaaatggtgctttgatggacaacggaataatcaaattctagaggaaaatatggacgtagaaatctggacaaaagaaggagagaagaagaaactccgtcccagatggctagatgctcgaacttatagtgatcccttggcactaaaagagttcaaagattttgcagctggtcgcaagtcgatcgctttggacctggtaactgaaattggacgtgtcccttctcacctagctcatcgaacaagaaatgcattggacaaccttgttatgttacatacaagtgaacacggagggagagcatatagacatgcagtagaagaactacctgaaacaatggaaacactactattattaggacttatgatattgttaactggaggggcaatgctctttctgatcagcggaaaagggataggaaaaacatccataggactaatatgtgtaatcgcgagtagtgggatgctttggatggctgaaatacctttacagtggatagcttcggcaatcgtcttagaatttttcatgatggtgctccttattcctgaaccagaaaagcagagaacaccacaagacaaccagttagcatacgtcgtaataggaatactaactttagctgcgatcatcgcagcaaatgaaatgggactattggaaacaactaagagggaccttgggatgagcaaagaaccaggagttgtttcacccacttcgtatctggacgttgacctccatccagcctccgcctggacgttatatgcagttgctactacggtaatcacacccatgcttcggcacaccattgaaaatagtaccgctaacgtatctcttgcagcaatcgctaatcaagccgtagtactcatggggttggacaaaggatggcccataagtaaaatggatttaggcgtgccactactagcactgggttgttacagtcaggtgaatccacttacactcaccgcagctgttctattgcttataacacattatgccataataggccctggcctacaagccaaagcgactcgcgaggcccaaaaacgaacagctgccgggataatgaaaaatccaacggtcgatgggataatgactattgacttagatcccgtgatttatgatagtaaattcgaaaaacaactaggacaagtaatgctactggtgctgtgcgcagtgcaacttctattaatgcgtaccagttgggctttgtgcgaagctctcaccttagctactggtccaataaccacgctatgggaagggagtcccgggaagttctggaacactactatcgcagtgagtatggccaatatattcagggggagttatctcgccggtgctggactcgcatttagcataatgaagtcagttggaactggaaaaagaggcactggttcacaaggagaaacgttaggcgaaaagtggaaaaagaaattgaaccaactatctcggaaggagttcgatttatataagaagagtggaattacagaagttgacagaacagaggccaaagagggactcaaaagaggtgagataacacaccacgcagtgagcaggggtagtgctaagttgcaatggttcgtcgaacgaaatatggtcatccctgaagggcgagtcatagatttagggtgtggacgcgggggttggagttattactgcgctgggctgaagaaagtaacagaagtaaggggctatacaaaaggcggaccaggacacgaagaaccggtcccgatgtcgacgtatggctggaacattgtcaaattaatgagcgggaaagacgtgttttatctgcctcccgaaaagtgcgatacgctactttgtgatataggggaatcttctccatcgccaaccgtcgaagaatcccgaacaatcagagtactaaaaatggttgagccatggctcaaaaataaccaattctgcattaaagttttaaacccgtacatgccaacagtcatagaacacttagagagactccaacgaaaacacggaggcatgctagtaaggaatccattgtcgcgtaattccacacacgaaatgtattggatatctaacggcacaggtaacatagtggcttcggttaatatggtttctcgtttattattaaatcgttttaccatgacacataggagaccgaccatcgaaaaagatgtagacctcggagcgggaaccagacatgttaatgctgaacctgaaacacccaacatggacgtcataggagaaagaattaagagaaccaaagaggaacataatagcacttggcattatgatgatgaaaacccatacaaaacgtgggcatatcatggtagttatgaggtaaaagcaacaggaagcgctagttcaatgatcaatggagttgtgaaacttctgacaaaaccatgggatgtagtgcctatggtaactcaaatggctatgacagacaccacaccttttgggcaacaacgcgtgttcaaggaaaaagtagatacaaggacgcctaggtcaatgcctggaacccgcagagttatgggaattactgcagaatggttatggcgaacactcggcaggaataagaaaccacggctttgtacacgagaggaatttaccaagaaagtaaggactaatgcggcgatgggagctgtttttactgaagaaaatcaatgggattccgcaaaagcagcagtcgaggatgaagatttttggaaactggtggatcgagagagagaactacataaactgggtaaatgcggatcctgtgtgtacaacatgatggggaaaagagagaagaaactcggagagttcggaaaagcaaaaggaagcagagccatttggtatatgtggctcggagcacgatacctagagtttgaggcacttggatttttaaatgaggatcattggtttagcagagaaaatagctattctggagttgagggcgaagggctccacaaacttggatatatactacgtgatatatcgaaaatccctgggggcgctatgtacgcagacgatacagcaggatgggacacaaggattactgaagatgatcttcataacgaagagaagataactcaacaaatggacccagaacaccgacaactagcaaatgccatcttcaagctaacgtaccaaaataaagtggtaaaggtacaaagaccaacccccactggaacggtaatggatataatctctcggaaagatcagcgaggttctggccaggtaggaacgtatggactaaatactttcacgaacatggaagctcaattaataagacaaatggagggagaaggtgtattaagcaaagcagatttggaaaatccacatttgccggagaagaaaattacacaatggttggaaactaaaggtgtagagagactcaagagaatggctataagcggtgatgactgcgtagtgaaaccgatagatgatcgttttgcaaatgcgctgcttgcactaaatgatatgggaaaggtgagaaaggacatcccacaatggcaaccatcaaaaggttggcacgattggcaacaagtgcctttctgcagccatcattttcatgagttaattatgaaagacgggagaaaacttgtagtaccgtgtcgaccacaagatgagcttataggacgtgctagaataagtcaaggggctggctggagtctcagagaaacggcatgtcttgggaaggcttatgcccaaatgtggtcattgatgtactttcaccgtcgcgatctaagactagcctctaatgctatatgttcggcagtaccagtccattgggtccctacgtcacgaactacatggtcaatacatgcacaccaccagtggatgaccacagaagacatgttaactgtttggaatcgagtctggattgaagataacccttggatggaggataaaactccagtgaccacgtgggaaaacgtgccatatttgggtaagagggaagaccaatggtgcggtagtcttataggactaacaagtagagcaacatgggcccaaaatatacccactgcgattcaacaagtccggtcactcataggtaacgaggagtttcttgattatatgccatccatgaagcgatttagaaaggaagaagaatccgaaggagctatatggtaa

SEQ ID NO: 23039 - RNA, 9873 nt, synthetic construct
  misc_feature 1..9873: note = derived and/or modified CDS sequence (opt6) from DENV-3__JF808123__SS-prME
  source 1..9873: mol_type = other RNA
acttcactttgcctaatgatgatattgcctgccgcgctggcatttcacttgacctcgcgcgatggggaacctaggatgattgtaggtaaaaatgaaagagggaaatcactattattcaaaacggcatcaggtataaatatgtgtactctaattgcaatggatcttggggaaatgtgcgatgacactgtgacgtataaatgtcctcacataacggaagtagaacccgaagatatagattgttggtgtaacctaacgtcgacatgggttacatacggaacttgcaaccaagcaggagaacggagacgggacaaacgatccgtagcacttgcaccacatgtgggtatgggactggatactagaacacaaacatggatgagcgccgaaggagcatggagacaagtagaaaaagtagaaacatgggcattaagacacccaggattcacaatactagcattatttttagctcactatattggaacttcacttactcaaaaagttgtcatatttattcttctgatgctagtgacaccctctatgacgatgcgatgcgtaggagttggaaatagggatttcgtagaaggtctatccggagcgacgtgggtagatgtagtacttgaacatgggggttgtgtaacaacaatggctaaaaataaacctacacttgatatagaattacagaaaactgaagcaacacaccttgcaactctaagaaaattatgcatagaaggaaaaattacaaatatcacaacagactcacgatgtccaacacaaggtgaagcagtgcttccagaagaacaagaccaaaactacgtttgtaaacatacgtatgtggaccgcggttggggtaatggctgtggtctttttggaaaggggtctctagttacttgcgcaaaattccaatgcttgggaccaattgagggaaaagttgtacaatatgagaacttaaagtacacggttatcattacagtgcacacgggagaccaacaccaagtaggaaatgagacacaaggagttacagcagaaattactcctcaagcatctacaacagaggccatcttacctgaatacgggaccttaggactagaatgttcaccaagaacaggattggactttaatgaaatgatacttttaacaatgaagaacaaagcgtggatggtccacaggcaatggttcttcgatctgcctttgccatggacaagtggagctacaaccgagaccccgacatggaatcgaaaagaacttcttgtgacatttaaaaatgcacatgcgaagaaacaagaagttgtagtactgggcagtcaagagggagctatgcatacagctctaactggtgctacagagattcaaaattcgggaggaacaagtatattcgccgggcacctaaaatgccgattgaagatggacaaactcgaacttaaaggcatgtcatatgctatgtgtaccaatacttttgtgttaaagaaggaagtcagcgaaacccaacatggcaccatacttataaaagtagagtataaaggagaagatgctccctgtaaaattccgtttagtacagaagatggacaaggaaaagcacataacggaagactaataacggcaaaccctgtcgtcacaaagaaagaagaacctgtaaatattgaggcggaaccaccttttggtgaaagtaacatagtgattggaacaggagacaacgcattaaaaataaattggtataagaaaggttcatctattgggaagatgtttgaggctacagcccgtggcgcacgacgtatggctattttaggtgataccgcttgggacttcgggtcggtgggaggtgtacttaattccttggggaaaatggtccatcaaattttcggaagcgcgtacacagcattattcagtggcgtgtcatgggtaatgaagataggcataggagttttactaacttggataggcctgaactcaaagaacacatcaatgagttttagctgcattgcaatcggcataataactctatatcttggagcagtagtgcaagcggatatgggatgtgtcattaactggaaaggaaaggaacttaaatgcgggtctggaatttttgtaactaacgaagtacatacatggaccgaacaatataaattccaagcggattcacccaaaagattagcaacggctatcgcgggtgcctgggaaaacggagtatgcggcattaggtcaacaacaagaatggaaaatcttttatggaaacaaatagcaaatgaattgaactacatcctctgggaaaacaacattaaattaactgtagtggtaggtgatataatcggggttctagagcaaggaaagagaactttaactccacaaccaatggaactcaaatactcttggaaaacttggggaaaagctaaaatagttaccgctgagacacaaaacagctcatttataatagacgggcctaacacgcctgaatgtccatcagcaagccgggcatggaatgtatgggaggtagaagactacggatttggtgtatttaccaccaacatttggttaaaactccgggaagtatatacccaactttgtgatcatagacttatgagtgcagctgtcaaagatgagagagctgtccatgcggacatgggatattggatagaatcacagaaaaatggtagctggaaacttgaaaaagcatcgctaatagaagtaaaaacatgtacatggcccaaatcacataccttatggtcaaatggcgttctggaatcagacatgataattccaaagtccttagcaggcccaatatcccaacacaaccatagaccaggctaccacacacaaacagctggaccttggcacctgggaaagctagaattagattttaactattgtgaagggactactgtcgttattactgaaaattgtggcacacgggggcccagcctaagaacaacgactgtatcgggcaagttgattcacgaatggtgttgccggtcgtgtacacttccaccactgagatatatgggcgaagacggttgttggtacggtatggagataagacccataagcgagaaggaagagaacatggttaagtcccttgtatctgccggatcaggcaaggtagataacttcacgatgggagtattatgtttagcaatactttttgaagaagtaatgagaggaaagttcggtaagaaacatatgattgccggcgtatttttcactttcgtgttgttattaagtggacaaatcacatggcgagatatggcgcacacgttaataatgatcggatctaatgcaagtgacaggatgggtatgggagttacttacctggcattgatagctactttcaaaattcaacccttccttgcccttggattctttttgaggaaactaacatctcgagaaaaccttctgcttggtgtaggtttggcaatggccactaccctacaattacctgaagacatagaacagatggcaaacggtatcgcattaggcttaatggcactaaagttaataactcaattcgaaacataccaactttggaccgctttaatctcacttacgtgtagtaataccatgttcaccttaaccgtagcttggcggactgcgacattgatattagcaggagtgtctctattaccggtctgtcaatcaagttcaatgaggaaaacagattggctacctatggcagtcgctgcgatgggagtacccccgcttcctctatttatatttagtcttaaagatacactaaaaagacgatcttggcctttgaatgaaggagtaatggcggtcggcctagtgtcaattctagcaagttcgctattaagaaatgatgtacctatggcaggccccttggtcgctggcggactgttaatcgcgtgttatgtaatcactggcacaagtgcagaccttactgtagaaaaggcggcagacattacctgggaggaggaagctgaacaaacgggggtctctcataacctcatgataacggttgatgacgacggtactatgagaataaaagatgacgaaaccgagaacatacttacagttttactcaaaactgcgttactaattgtaagtggggtctttccatattccataccagcaaccctactcgtgtggcatacatggcaaaagcaaacgcagagaagcggtgtattatgggacgtcccttcaccaccagaaacccaaaaagccgagctcgaagaaggcgtgtatagaataaaacaacaggggatatttggaaaaactcaagttggagttggagttcagaaggaaggagtttttcatactatgtggcatgtcacaaggggtgctgtactcacgtataacggtaaacgacttgaaccaaattgggcgtcagtcaagaaagacttaataagttacggtggcggctggcgcttgtcagctcagtggcaaaaaggtgaagaggttcaagtaatagcagttgaacccggtaaaaacccaaagaatttccaaacaatgcctggcacctttcaaacaacaaccggagaaatcggagcaatagcgctagatttcaaaccaggtacatcagggtccccgataattaatcgagagggcaaagttgtcggtctgtatggtaatggagttgtaactaagaacgggggatacgtttcgggaattgctcaaacaaatgcagaaccggatggtccaacacctgaactagaagaagaaatgttcaagaaaagaaatctgacaattatggatctgcatcccggttcgggtaaaaccagaaaatacctacctgcaattgtacgggaagcgatcaaaagaaggctcaggacacttatcttggcgccaacccgggtggtagcagctgaaatggaggaggctttgaaaggactacccataagataccaaacaactgccaccaagtcagagcacactgggagagaaatagtagacctcatgtgccatgcaactttcacgatgagactattaagtcccgtacgtgtaccaaattacaatttaattataatggatgaagcgcattttacagatccagcaagcattgcggctcgtggttatatatctaccagagtagggatgggggaagcagccgctatattcatgacggcaacgcctcctggaacggcagatgctttcccacaatcaaacgcacctatacaggatgaagaacgagacataccagaacgaagttggaactcaggaaatgagtggattacagacttcgcaggtaagacagtgtggtttgtacctagtatcaaggccggcaatgatatagcaaattgcttaagaaagaacggcaagaaagttatacagttaagtagaaagacatttgatacggaatatcagaaaacgaaattaaatgattgggacttcgtcgtcacaaccgatataagtgaaatgggtgcaaatttcaaagctgacagggttattgatcctagaaggtgcttgaagcctgtaatacttacagatggtccggaaagagtcatattggcaggtccaatgccagttacagctgcaagtgctgcgcaaagacgtggacgagtcggtagaaatccccagaaagaaaacgaccaatacatattcacaggccaaccactgaataacgatgaggaccatgcacattggacagaagcgaaaatgctcctagataacattaatactccagaaggtatcataccagctctctttgaacctgagagagagaaaagcgctgccattgatggagaatacaggttaaaaggagaaagcagaaaaacgttcgtagagcttatgcgacgtggtgacctgccagtttggcttgcacataaggtggcatctgaaggtatcaaatacacggacagaaagtggtgctttgatggtcagcgtaataatcaaatactagaggaaaacatggatgtagaaatatggaccaaagaaggagaaaagaaaaagctaagacctcgttggcttgacgcccgcacatactccgatcctctcgccttaaaagagttcaaggattttgccgcaggaaggaaatcaatagcactcgacttggttacagaaattggtagagtcccatcccatctagctcacagaactagaaatgctctagataatctggtgatgctacacacttccgaacatggagggagagcttaccgacacgctgtagaagaattacccgaaacgatggaaactctactcctattaggacttatgatattactgaccgggggagctatgttatttttaatatctgggaagggcataggcaagacgtcaataggcttgatttgtgtaatagcaagttccggaatgctatggatggcagagattccattacaatggattgcatctgcaatagtgttggagttctttatgatggtactcttaattcctgaaccagaaaaacaacgcacacctcaagacaaccaattagcctatgtcgtcattggtatccttaccctcgccgctataatcgcagcgaatgaaatgggtctcctcgaaacaaccaagagggacttgggaatgtctaaagaaccaggagtagtttctcctacaagttatttagatgttgaccttcatcccgctagtgcctggactctatatgcggtggcaaccacagtaataacaccgatgttacgacataccatagaaaacagtacagctaatgtcagcctagcagctatcgcaaatcaagctgtagttttaatggggttagataaagggtggccgatatctaagatggacctcggcgtgcccctattagccttgggttgttattctcaagtgaatccgcttaccctaaccgctgctgttctattacttataacacattacgcgattataggaccgggcctacaagcgaaagccacccgagaggctcagaaaaggactgcagccggcataatgaaaaatcccaccgtagacgggatcatgaccatagatctcgatccggtgatctatgatagtaagtttgaaaaacaacttggacaagttatgctcctagtattgtgcgcagtacagctactgttgatgaggacttcctgggcactttgtgaggctcttacattggccacgggcccgatcacaacattatgggaaggaagtcctggaaaattctggaatactactattgcggttagtatggcaaatatatttagaggttcttatttggcaggagcaggtttggcgttctcaattatgaaaagtgttggtacgggaaaaaggggaaccggtagccaaggtgaaacgctaggggaaaagtggaaaaagaaattgaaccaattatcaagaaaagaatttgatttgtataagaaaagcggaataacagaagtggataggacagaagcaaaagaagggcttaaaagaggggaaattacgcaccacgcggtaagcagaggtagtgcgaaattgcaatggtttgttgaaagaaacatggttattccagagggtagggtaatagacctgggttgcggaagaggtggttggtcttattactgtgctggattaaagaaagtaaccgaggttcgcggctacacgaaaggtgggccaggccatgaggaacctgttcctatgtccacatatggttggaatatagttaaacttatgagcggtaaagacgtattctacttaccaccagaaaaatgtgacacattactgtgtgatattggcgaatcttcaccttctcccaccgtggaagagtctcgcacaattagagtattaaaaatggtagaaccgtggcttaaaaataaccagttctgtattaaagtacttaacccatatatgccaacggtcatcgaacatcttgaaagactacaacgaaaacacggaggaatgttggtaagaaatccattaagtagaaattcaacgcatgaaatgtattggattagtaatggtacaggaaacattgtcgccagtgtgaacatggtaagcagattattgctaaaccgttttaccatgacccatagacgtcccaccatagaaaaagatgtggatttaggagcgggaactcgccatgtcaatgcggaacctgagactccgaatatggatgttataggagaacgcataaaacgaataaaagaagaacataacagtacctggcattacgacgatgaaaatccctacaaaacatgggcgtaccatggaagctacgaggttaaagctacagggtcggcatcctcaatgattaatggagtggtgaagttattaaccaaaccttgggacgtcgtcccaatggtgacccaaatggctatgaccgacacgactccattcggccaacaacgagtctttaaagaaaaagtcgatactagaactccacgttcaatgccaggaactagaagggttatgggaattactgccgagtggctttggaggactctaggacgtaacaagaaaccgcgtctttgtactagagaagagttcacgaagaaagtacgaacaaatgctgcaatgggtgcggtctttacagaagaaaatcaatgggattcagctaaagcggccgttgaggacgaagatttttggaagctcgtagatagagaacgtgaacttcacaagttaggcaagtgcggatcatgcgtttacaatatgatgggaaaaagagagaagaaactgggtgaatttggcaaagcaaaaggaagtagagccatatggtatatgtggttaggtgctcgctacttagagttcgaagcactgggatttttgaatgaagaccattggttttcgagggaaaactcatatagtggtgtcgaaggtgagggattacacaaattaggatatattttgcgtgacataagcaagattcctggaggggccatgtacgcggacgacacagctggatgggatacgagaataaccgaagatgacctccataatgaagagaagatcacacaacaaatggacccggaacatcgacagttagcgaatgctatatttaaattaacgtaccaaaataaagttgttaaggtacaacgacctactccaactggaacggtaatggacataatttcaagaaaggaccaaagaggttcgggacaagttggaacgtatggcctaaatacctttacaaatatggaagctcaactaatacggcaaatggagggggagggggtattgtctaaggcagacttagaaaatccacatttacccgagaagaaaattacccaatggttggaaactaagggagtagagagactaaaaaggatggcaatcagtggagatgattgtgtagttaaacccatagacgatcgatttgctaacgctctattagcactcaacgatatgggcaaagttagaaaagatataccccagtggcagccaagtaaaggatggcatgactggcaacaagtccctttctgcagccatcactttcatgagttaataatgaaggatggcaggaaattagttgtaccatgcagaccccaagacgaattgatcggcagagcccgtatttcccaaggagctggatggtcattacgggaaacagcatgcttaggaaaggcatacgcgcaaatgtggagcttaatgtacttccatagaagagatttaagattagccagcaatgcaatctgctcggcggtaccagtccactgggtaccgacatctcgtacgacctggagcatacatgcccaccaccaatggatgacaacagaagacatgttgaccgtatggaatagagtgtggatcgaagataacccgtggatggaagacaaaactccagtcaccacatgggaaaacgtaccttaccttggtaagagagaggatcagtggtgtggctccttgataggtttgacgtcccgagctacgtgggcacaaaacattcctactgcaattcaacaagtgcgctcgttaattggtaatgaagagtttcttgactacatgccaagtatgaagagatttagaaaggaagaagaaagcgaaggagcaatatggtga

SEQ ID NO: 23040 - RNA, 9873 nt, synthetic construct
  misc_feature 1..9873: note = derived and/or modified CDS sequence (opt6) from DENV-3__JF808128__SS-prME
  source 1..9873: mol_type = other RNA
acgtccctctgtcttatgatgatacttccagcagctctcgcatttcatctcactagcagagacggggaaccgcgaatgatagtgggcaaaaacgaacgtggaaaatctttactgttcaaaactgcatctgggattaatatgtgtaccttaatcgcaatggaccttggagaaatgtgcgatgacactgttacctataaatgtccacacataaccgaagtagaaccggaggatatcgactgttggtgtaaccttacaagcacttgggtaacgtacggaacttgcaaccaagcaggggaacacagaagagacaaacgcagtgtagcattagcgccgcacgtagggatgggtttggacacacgaacgcaaacttggatgtctgcggagggagcttggagacaagtcgagaaagtcgaaacctgggcgctccgtcacccaggattcacgatcctagcattatttttagcgcactacataggtacttccttaactcaaaaagtagtaatatttattctactaatgttagtcacaccatcaatgaccatgcgttgcgtaggtgtcggcaatagagattttgtagaaggcctatcgggtgctacttgggttgatgtggtgctggaacatggagggtgcgtcacaaccatggctaaaaacaaaccaactttggatattgaattgcagaggactgaagcgacacaacttgcgacgctcaggaaattgtgcatcgagggaaaaataactaatataacgactgatagcagatgcccgactcaaggagaagcggttttgccagaagaacaagaccaaaattatgtttgtaaacacacctatgttgatagaggatggggtaatggatgtggattatttggcaaaggaagtcttgtaacatgtgcaaaatttcaatgtttagaacccatagagggaaaagtagtgcagtatgaaaacctcaaatataccgtaataatcacagtgcatacaggagatcaacaccaggtagggaacgaaacacaaggggtaacagccgaaataacgccgcaagcatctacgactgaagcaatcttgccggagtacggcactctaggtctcgaatgcagcccacggacaggactagatttcaatgaaatgatactccttactatgaaaaacaaagcatggatggtacataggcaatggttccttgacttgcccttaccatggacatcgggtgccactactgaaactccaacttggaacagaaaagagttacttgtaacgtttaaaaacgcccacgccaagaaacaggaagttgtggtactgggatcacaagaaggcgcaatgcataccgcgcttacgggtgccactgaaatacaaaattctgggggaactagcatcttcgcgggccacttgaaatgtcgactaaaaatggacaaactagaactcaaaggaatgagttatgcaatgtgtacaaacacatttgttttgaagaaagaagtatcagaaactcagcacgggaccatcctcataaaagtagaatataaaggagaagacgcaccatgcaaaataccttttagcacggaggatggccaaggaaaagcacacaatggacgattaattacagccaatccggtagttaccaagaaagaagaaccagtaaatatagaggctgaacctccgttcggggaatctaatatagtcattggaataggagataacgcacttaaaattaattggtataagaaaggatcttccattggcaaaatgtttgaagctacagcaaggggagcaaggagaatggcgatattgggtgacactgcttgggatttcgggagcgtgggaggcgtactcaactctttaggaaaaatggtgcatcaaatattcggctctgcctataccgcactctttagtggcgtatcatgggtcatgaaaataggtataggagttttgttaacttggatcggactaaatagcaaaaatacaagtatgagctttagctgtattgcgataggaataataactctatacttaggcgccgttgttcaagcggatatgggctgcgtaataaactggaaaggtaaagaactcaaatgtggatccggtatatttgttacaaatgaagtacacacttggacggaacaatacaaattccaagctgatagccctaaaaggttggcaaccgccatagccggggcatgggaaaatggcgtgtgcggaatccgatcaaccacccggatggaaaatttactatggaagcaaattgcaaacgaactaaattacattttgtgggaaaataatataaaattaacagtcgttgtcggcgatattataggagtcttagaacaaggcaaaagaaccttaactccgcaacctatggaactgaaatattcatggaagacttggggtaaatccaaaatagtcactgccgaaacacaaaactctagctttataatagatggacccaatacaccagaatgtccatcagcaagccgagcatggaatgtatgggaggttgaagactacggattcggggttttcacaacaaatatttggctgaaattaagggaagtatatacgcaattatgtgaccatcgactaatgtcagccgctgttaaagatgaaagggcagtacatgctgatatgggctattggatcgagtctcaaaagaatggatcatggaagttggaaaaggcctcactcatagaagtgaaaacatgtacatggccgaaatcacatactttatggtccaacggagtacttgagtcagatatgataatcccaaaaagccttgcgggaccgataagccaacataatcatagaccagggtatcacacacaaaccgcaggaccatggcatttaggaaagttagaactagattttaactactgcgaagggactactgtggtgataacagaaaattgcggtactcgtgggccggccttaagaacaacaacagtctctggaaagttaatacatgaatggtgctgtcgcagctgtacattacctcctctgagatacatgggagaagatggttgttggtatgggatggagatacgaccaatatctgaaaaagaagagaacatggtaaaatctttagtatccgcaggctcgggaaaagtggacaacttcacaatgggcgtactttgcctcgcaatcctgtttgaggaagtaatgcgaggtaaattcggtaagaaacatatgattgctggagtatttttcacattcgttttattgctaagcgggcagattacgtggcgtgacatggcacatacattgattatgataggatcgaatgctagtgacagaatgggaatgggagtcacctatctggcattgattgctaccttcaaaatacaaccatttttggctcttggattctttctaagaaaattaacttccagagaaaatttattattaggagtaggtctagccatggctactactttacaactacctgaagacatcgagcaaatggcaaatggtatcgcattgggtttaatggccttaaagttaatcacacaatttgaaacgtatcagctgtggacagcactaataagtctgacatgctcaaatacgatgttcacccttactgtcgcgtggagaacagcgacactaattctagcaggagtgagccttctgcctgtctgtcaatcatcgtcaatgagaaaaacagactggctcccaatggccgttgccgcaatgggcgttccgccattgccgctatttatattctcactaaaagatacattaaaacggcgctcgtggcctctgaatgagggtgtaatggcagtgggattagtaagcattctcgctagttcactattacggaatgatgtgccaatggctggccctttagttgctggtggtcttttaattgcttgttatgtcattactggtacttcagctgatctaacggtcgaaaaagcagcagacattacctgggaagaagaagcagaacaaacaggggtaagtcacaatctcatgattacggtagatgatgacggtaccatgcgcataaaagatgacgaaaccgaaaacattttaacagtgcttttgaaaacagctcttttaatcgtttcgggggtgtttccatatagcataccagctactttattagtgtggcatacctggcagaaacaaactcaacgaagtggtgttctttgggatgtgccgagtccgccagaaacacaaaaggcggaattagaagaaggtgtctacagaatcaagcaacagggcatatttggaaaaactcaagtcggggtaggggtacaaaaagaaggagtcttccacaccatgtggcatgtgacgcggggagccgtactaacatataacggtaagagacttgaacccaattgggcgagtgtcaagaaagacttagtatcttacggtggtgggtggcgactatctgcccagtggcaaaagggtgaggaagttcaggttatagccgtagaacccggcaaaaatcccaaaaatttccaaacaatgccaggtacctttcagacaacaaccggcgaaattggagccatagcgctggacttcaaacccggaacttctgggtcaccaattattaatcgtgaagggaaagttgttggactgtacggcaatggagttgttactaaaaacggaggatatgtaagcggtatagcacagaccaatgctgaaccagatggaccgacgccagagctagaggaagagatgtttaagaaacgcaatttaactataatggatctacatccaggttcgggcaaaacacgtaaataccttccagccatagttcgggaagcaataaaaagaaggctgagaacccttatattagcaccaacaagggtagtagcagctgaaatggaagaggctttaaagggactcccaatcagataccagacaacagcaacaaagtcagaacacaccggacgagagatcgtggatctaatgtgccacgccacgttcacaatgcggttactttcacctgtcagagtaccaaactacaatctcataattatggacgaagctcactttacagatccggccagtattgcagcaagaggctacatttctacacgggttggtatgggagaagcggcagctatctttatgactgcaacaccgccaggaacagccgatgcatttccacaaagtaatgcccctattcaagacgaggagagagatatcccagaacgaagctggaatagtgggaacgaatggataacagacttcgcgggaaaaaccgtatggttcgtgccgtcaattaaggcaggtaatgacattgctaattgtcttaggaaaaacggcaaaaaggtcattcaactttccagaaaaacatttgataccgaatatcaaaagacaaaattaaatgattgggatttcgtcgtgactacagatatatccgagatgggcgctaattttaaagccgacagagtaatagatccacgcagatgcctaaaaccagtcatattgactgatggacccgagcgggtaatattagcgggtccaatgccagttactgcggcaagtgcagcccaaagaagaggtagagtgggcagaaatccacagaaagagaacgaccaatacatttttacaggtcagcctctcaataacgacgaagaccacgcgcattggacagaagcaaaaatgttgttggacaacataaatacgccagaaggtataataccagcactttttgaacctgaacgggaaaagagcgccgcgatcgatggggaatatagactaaaaggcgaatcaagaaaaacatttgtagagttaatgagacgaggtgatcttccggtctggttagcacacaaagtcgcttccgaaggaattaaatatacagacagacgatggtgttttgacggtcagagaaataatcaaattttagaagaaaacatggatgtagaaatatggacaaaagaaggagagaagaagaaattaagaccaagatggctcgatgccagaacatattcggaccctctagccttgaaagaatttaaagacttcgccgcaggccgcaaaagcatcgcactagaccttgtgactgagatcggaagagtcccctcccatctcgcacacagaacacgaaacgcattagataatttggtaatgctgcacacatctgagcacggtggccgggcgtaccgccacgcagttgaagaacttccagaaactatggaaacattgctgcttcttggccttatgattttactaacgggaggtgcgatgttatttctgatttcgggcaaaggtattggaaaaacaagtataggattgatctgcgtcattgcatctaggagtatgtcttggatggcagaaattccacttcaatggattgcctccgcaatagtactagagttcttcatgatggtactattaataccagaacctgaaaaacaaagaactcctcaagataatcagctagcctatgtagtaatagggatcttaacactagctgccatcatagcagccaacgagatggggctactagagacaacaaaaagagatctcggcatgtcgaaagaacctggtgttgtttcacccacaagttacctagacgtagatttacacccagccagtgcgtggactctctatgcggttgcaacgacagtaattacaccaatgttaagacacacaattgaaaattcgaccgcgaacgtatcgttggccgccatagcaaatcaagcagtagtattgatggggctagataagggttggcccatctccaaaatggatttaggtgtaccgctcttggcactcggatgttattcgcaagttaatccattgaccctcacagcggcggttctgctactcattacacactacgccataataggacccggtctacaagcgaaagcaactagggaagctcagaaaagaacagctgcaggcataatgaaaaaccctacggttgatgggatcatgactatagatctagatccagttatatatgactcgaaattcgaaaaacaattgggtcaggtgatgctactcgtactatgcgctgttcaactattgctgatgaggaccagttgggcgctgtgtgaagcgttaacgttagcaactggaccaataacaaccctctgggaaggaagtccaggaaagttctggaatacaactattgcagtgagtatggcaaacatatttagaggcagctatttggccggagcaggactcgctttttcaataatgaaaagtgtaggcacaggaaaacgtggaacaggatctcaaggtgagacattaggggaaaaatggaagaagaaactaaaccagctatcgagaaaagagttcgacctgtataagaaatcagggatcacagaagtagatcgtactgaagctaaagagggattgaagagaggagagatcacccaccacgcagtgtctaggggatctgctaagttacaatggttcgtggaaagaaatatggtgataccggaaggtagagtcatcgacttaggttgtgggcggggcggatggtcatattactgcgccggtctaaagaaagtaacagaagttcggggttatacaaaaggaggccctgggcatgaagaaccggtgcctatgagtacgtatggatggaacatagttaaactcatgtcagggaaagatgtcttctatcttccaccagaaaaatgtgatacccttctttgcgatataggtgaatcgtcaccctctccaaccgttgaagaaagtaggacaattcgagtcttgaaaatggtagaaccatggctgaagaataaccagttttgcattaaagtattaaatccctacatgccaacagttatagaacatttagaaaggctacaaagaaagcacggaggaatgttggtgagaaatccattgagcagaaactcgacacatgaaatgtactggatatcaaatgggacaggtaatatagtagcatcggttaacatggtatcacgattattacttaataggttcaccatgacacatagaagaccgacaatagaaaaagatgtggaccttggagctggaactcgtcatgtcaatgcggaacctgaaacgccaaatatggatgttataggggagagaataaagcgcattaaagaagaacataactctacatggcactatgatgacgaaaatccttacaagacttgggcttatcatggctcatatgaagttaaagcgacaggaagcgcatcatccatgataaacggagtggtaaagttactgactaaaccctgggacgttgttccaatggtcactcaaatggcaatgaccgataccacgccatttggacaacaacgggtttttaaggaaaaggtggacacgcgtacgccaagatcaatgccaggtactagacgcgtaatgggtataaccgcagaatggctctggcgaacactagggagaaataagaaaccgagactgtgtacaagagaagaatttaccaagaaggtacgaacaaacgctgcaatgggagcagttttcacggaagagaaccaatgggactccgccaaagccgcagttgaagacgaagacttctggaaattggtcgatagggaacgtgaattacataaattagggaaatgtggttcatgtgtttataacatgatgggaaaacgtgagaagaaattaggagagtttggaaaagcaaaagggtcaagagcaatatggtacatgtggcttggagcgagatacttagaatttgaagcgttgggctttctaaacgaagatcactggttttcacgtgaaaattcatattcgggagtagaaggagaagggttacacaagctcggttacattttacgtgatatcagtaagattccaggaggagcgatgtatgccgacgataccgcaggatgggatacaagaattacagaagatgatttacacaacgaagagaagataacccaacaaatggatccagaacacagacaattagcaaatgccatattcaagctaacctaccaaaataaggtagttaaggtacagagacccacacctaccggtactgttatggatataatcagtagaaaagatcagaggggtagcggacaggtaggaacatatggcttaaatacatttactaatatggaagctcaactaattagacaaatggaaggtgaaggagtattatcaaaagcggatctagaaaacccacacttacccgagaagaaaatcacacagtggctcgaaacgaaaggagtagaaaggcttaaacggatggctataagtggcgacgattgtgtagtcaagccaattgacgataggtttgcaaacgccttactggctctgaatgacatgggtaaggttagaaaagatattcctcaatggcaaccgtcaaagggttggcatgattggcaacaagtaccattttgttcccaccattttcatgaactaataatgaaagatggtcgcaaattagtagttccttgcagaccacaggatgaattgattggacgagctcgaatatcacaaggcgccggatggtcgctaagagagacggcatgcttaggtaaggcttatgctcaaatgtggagcctaatgtattttcatcgccgagacttaagattagcaagcaacgcaatctgctcagctgtcccagtacattgggtacctacaagtcgaacaacatggagtatccatgcacatcatcagtggatgacaacagaggatatgttaactgtatggaacagagtttggatagaagataatccatggatggaggacaaaacccctgtgacaacttgggagaatgtaccataccttggcaaacgggaggatcagtggtgtggaagtttaataggactcacgagccgtgccacgtgggcccaaaacatacctacagccatccaacaagtacgttcgttaatcggaaatgaagagttcctagattatatgccaagtatgaagcgttttagaaaagaagaagaatcagaaggagcaatatggtga

SEQ ID NO: 23041 - RNA, 9873 nt, synthetic construct
  misc_feature 1..9873: note = derived and/or modified CDS sequence (opt6) from DENV-3__JF808122__SS-prME
  source 1..9873: mol_type = other RNA
accagtttatgtctaatgatgatacttcccgcagccttggccttccatttgacttcacgcgatggggaacctcggatgatagtaggcaaaaacgaacgaggaaaaagtttattatttaaaacagcaagtgggattataaaatgtacactcattgcaatggatctcggcgaaatgtgcgacgacactgttacctataaatgtcctcatataacagaagtagaacctgaagatatagattgctggtgcaacttgacttcgacttgggtaacatatggtacatgtaaccaagctggggaaaggaggcgagacaaacgaagtgtagcactcgctccgcatgtgggtatgggtttagacaccaggactcaaacttggatgtcagctgaaggagcatggcgacaagtggaaaaagtggagacgtgggcgctgcgccacccgggttttactatcctagcgctatttcttgcccattacattggtaccagcctcacccaaaaagtagtaatttttatattactaatgttggtaacacctagtatgacaatgcggtgtgtcggggttgggaacagagattttgttgaagggctatccggggcaacatgggtagatgtggtcttggagcatggaggatgtgtaacaacaatggccaaaaacaaaccaacattagacatagaactacagaaaactgaggctccccacttagcaactttgcgaaaactctgcatagaagggaaaattactaatataactaccgatagtcgttgtccaacacaaggggaagctgttctaccggaggaacaagaccaaaattatgtgtgtaaacatacttatgtcgacagaggatggggtaatgggtgcggactattcggtaaaggtagtctcgtaacttgcgcaaaatttcaatgtttagagccaattgagggaaaagtagtacaatacgaaaacttaaaatacactgtaataataacagtacatacaggggaccaacaccaggtcggaaacgaaacacaaggcgtaacggcagaaataacaccccaagctagtaccacagaagccatattaccagaatatggcacattaggactagaatgttcaccaagaactggattggactttaatgaaatgatattactgactatgaaaaataaagcctggatggtacatagacaatggtttttcgaccttccattaccttggacgtctggagcaacaacggaaactcccacatggaacagaaaagaactattagtcacattcaagaacgctcacgcaaagaaacaggaagtcgttgtgctaggaagtcaagaaggtgcgatgcacaccgcgcttacgggagcaactgaaatacaaaattcaggaggaacctccatatttgcaggtcacctaaaatgtagattaaaaatggacaagttggagctaaaaggcatgtcctatgcaatgtgcactaatacttttgtactcaaaaaggaagtttctgaaacacaacacggaacaatcttgatcaaagtagaatataaaggtgaagacgcaccttgcaagatcccatttagtacggaagatggacaaggtaaagctcataatggtcgtctcataaccgccaatcctgtagtcactaagaaagaagaaccagtgaatattgaggcggagcccccatttggcgaatcaaatattgtaataggtacaggcgataatgctttaaaaataaattggtacaaaaagggctcgtcaataggtaagatgtttgaggcaactgctcgtggtgcccgtagaatggcaatcctaggggataccgcttgggacttcgggtcggtaggcggcgtactaaattcacttggaaaaatggtacaccaaatttttggatcagcctacacggctcttttctcaggtgtaagctgggtcatgaaaatcggaatcggggtgttgttaacctggataggacttaatagcaaaaacacaagtatgtcttttagttgcattgcaataggtatcataaccttataccttggtgctgtagtccaggcggatatgggttgtgtaattaattggaagggaaaagaactgaaatgtgggagcggtatattcgtcacaaatgaagtccatacctggacggaacaatataagtttcaagcggatagtcctaaaaggttagcgactgcaatagccggggcatgggagaatggcgtatgtgggatacgatcaacgactcggatggaaaatctattatggaaacaaattgccaatgaattgaattatatcctgtgggagaataacataaagttgacagtcgttgtaggcgatataataggggtgctggaacaaggaaaaaggactttgactccacaacctatggaactaaaatattcttggaagacttggggcaaggccaagatagtgacggctgagacacaaaattcatcctttataatcgacggacccaacacgcccgaatgtcctagcgcatctagagcctggaatgtatgggaagttgaagattacggattcggcgtattcaccacaaatatttggcttaaattgcgagaggtatacacacaattatgcgaccacaggttaatgtctgcagctgtcaaagacgagagagcagtacatgctgatatgggttattggatagaaagtcagaaaaatggtagctggaaacttgaaaaggcgagtctcatcgaagtaaagacttgtacttggccgaaatctcatacgctttggagcaatggtgtactcgaatctgatatgattatcccgaaaagcctagctggcccaattagtcaacataaccacaggcctggctatcatacacaaacagcgggtccatggcatctaggtaagctggagttagactttaattattgcgaaggaacaacagtcgtgataacagaaaattgtggtaccagaggtccaagtttacgaaccaccacagtaagcggtaagttaatacatgaatggtgttgccgcagttgtactttaccaccattgagatacatgggggaagacggctgttggtatgggatggaaataaggcccataagtgagaaagaggagaatatggtaaagagcctggtttcagctggatccgggaaagttgacaattttacgatgggagtgttgtgtttggcgatactcttcgaagaagtaatgcgaggcaaattcggaaagaaacacatgatagccggtgtattctttacgtttgttctacttttaagtgggcaaattacgtggagagacatggcacatactctaataatgataggatctaatgcaagcgatcgcatgggcatgggagtgacctacctcgctctaatagcaactttcaagattcaaccatttttagcactgggattctttctaaggaagttaactagcagggaaaatttactactcggagttggtttagctatggcaactactttacaactaccagaagatatagaacaaatggctaacgggatcgctttaggcctaatggccctgaaattaattacccagtttgaaacataccagctttggacagctctaatatcactaacgtgctcaaatacaatgtttacactaactgttgcttggcggactgcaactctcatacttgccggtgtttcactacttcctgtttgccagtcatcatctatgcgaaaaacagattggttgcccatggccgtcgcagctatgggtgtaccacctctgccactctttatattttcgctaaaagatactttgaaacgaagatcatggccgttgaatgaaggtgtaatggcagttggcttggtaagcatcttagcatcgtcctttcttcgaaatgacgttccaatggcgggacctttagtagcgggaggtctactaatagcatgttatgttataacaggtacaagcgcagacttaacggtagagaaagccgcagacataacatgggaagaagaggcagagcagacaggcgtatcacacaatttaatgattacagtcgacgacgacggaactatgagaataaaggacgatgaaaccgaaaatatcttgactgtacttttaaaaacagcattacttatagtatctggagtatttccgtattcgatacctgcgacattgttggtatggcatacatggcaaaaacagacacaacgcagtggtgttttgtgggatgtaccaagtccccctgaaacccagaaagctgaattagaagagggagtgtatagaataaaacaacagggaatattcggaaaaacacaagtaggagtaggggtgcaaaaagagggagtatttcatactatgtggcatgtaacaagaggagcagtacttacatataatggtaaaagactcgagcctaattgggcctctgtcaagaaagatctgatcagttatggtggtggttggagattgtcagcacagtggcaaaaaggcgaggaggttcaagttatcgcggttgaaccaggtaaaaacccaaagaactttcaaacgatgccaggcaccttccagaccaccacaggtgaaatcggagcaattgcacttgatttcaagccaggaaccagcggtagtccaatcattaaccgtgaaggtaaagtagtgggcctttacgggaatggggtcgtaacaaagaatgggggatatgtatcgggaatcgcacagacaaatgcggaacctgatggaccgacacctgagctagaagaggaaatgtttaaaaagcgaaaccttacgatcatggatctacaccctggatccggaaaaactaggaaatatctacctgccatagttagggaagctataaaacgacgattacgaactcttatattagcacctacacgcgttgtggcagcagaaatggaggaggctttaaagggattacccattagatatcaaaccacagccacaaaatcagaacacacaggaagggaaattgttgacttgatgtgccatgcgacatttaccatgcgattactctccccggtaagagttccaaactacaatctgattatcatggacgaagcccactttaccgaccccgcatccatcgctgccagaggttatatttcaacacgcgtaggtatgggtgaggcggcggcgatttttatgactgccacaccaccaggaacagcagatgcttttccacaatccaatgctccaatacaggacgaagaaagagatattccagaaagatcatggaactcaggcaatgaatggattactgattttgccggaaaaacagtatggtttgtaccctcaataaaagcaggtaatgatatagcgaactgtttacggaaaaacggtaaaaaggtcattcaattatcgagaaaaacatttgataccgaatatcagaaaacgaagctaaatgattgggattttgtggttactaccgacattagcgaaatgggagcaaacttcaaggctgacagagtaatagaccctagaagatgtctgaaaccagtaatactaacggacgggccagagagggttatactagcgggcccaatgcctgtaacggcagcctcagctgcacaacgtcgaggccgagtcggtagaaatcctcaaaaagagaatgatcagtacattttcacggggcaacccctaaacaatgacgaagaccatgctcattggacagaagccaaaatgcttctcgacaatattaacaccccggagggaattatccctgctctcttcgagccagaacgtgaaaaatccgctgcgattgatggagagtaccgtttgaaaggagaaagcaggaaaacttttgtcgaattgatgagacgcggagaccttcccgtctggctagctcataaagttgcatcggaaggaataaaatacacagatcggaaatggtgttttgatggccagagaaacaatcagattctagaagaaaacatggatgtcgagatttggaccaaagaaggggaaaagaagaaactgcgtccaagatggcttgatgcaagaacatatagcgacccactagcattaaaggaatttaaagatttcgcagcgggaaggaaaagtattgcactagatctagtaaccgaaatcggtagagtacccagccacttagcacaccgtacacgtaacgctttagataatctcgtcatgttacatacatctgaacatggtggtcgtgcatatcgtcatgctgtagaagaattgcccgaaacaatggaaacattacttttattaggattaatgattttattgactgggggcgccatgttgtttttaatatcaggaaaaggtataggtaaaacatcaataggcttaatatgcgtcattgctagtagtggtatgagttggatggcagagatcccgcttcagtggatagccagcgcaattgtcttggaatttttcatgatggtattattgatccctgaaccggaaaaacaacgtacaccacaagacaatcaattggcctatgtagtaataggaatcctaactcttgcagccattatagcagctaatgaaatgggtcttctagaaacaacgaaaagagatttaggcatgagcaaagaaccaggtgtagtatcacccacaagctatttggatgtggacttacatcccgcaagcgcctggaccctctatgcagtagcaactacggtaattacgccaatgctaagacatactatagaaaactcaacggctaacgtcagtttagccgccatagcaaatcaagcggtagttttgatggggttagataaaggatggcctatctctaaaatggacctaggcgtgccattactcgcccttgggtgttactcgcaagtaaacccactgacattgacagcagcggttctgctactcattacacactatgcaattattggacccggtttgcaagctaaagcaacgagagaagctcagaaaaggacagccgcaggaataatgaaaaacccaactgtcgatggcatcatgacgatcgatttagacccagtaatttacgactcaaaatttgaaaaacagctaggacaagtaatgttacttgttctttgcgccgtccaattattgttaatgagaacaagctgggcgctatgtgaggccttaacgttagcgactggaccgattactacattatgggaaggttccccaggaaaattttggaatacaactatagctgtatccatggccaatatcttccgtggaagttatttggccggcgctggattagcctttagtataatgaagtctgttggtacgggaaaaaggggaacaggatcacagggagagactcttggagaaaaatggaaaaagaaattaaaccagttaagccgcaaggaatttgatttatacaagaaatcaggaataacagaagtggacagaaccgaagcaaaagagggccttaagagaggcgaaataactcaccatgccgtctccagaggatctgccaaactccagtggttcgtagaaagaaacatggttattccggaaggacgagtaatagatttgggttgcggtagaggcggatggtcgtactattgcgcgggcctgaagaaagtaacagaagtaaggggctacactaaaggaggtccaggccatgaggaacctgtacctatgtccacatacggttggaacatagttaaacttatgtcgggcaaagacgtgttttatctacccccagaaaaatgtgatacactgttgtgtgacattggagaatcaagtcctagcccaaccgttgaggaaagcagaacaataagagtcttgaaaatggtggagccgtggctcaagaacaatcaattctgtattaaagtattaaacccgtatatgccaacagttatcgagcacctagaaagactacaaagaaagcatggtgggatgcttgtccgaaatcccctatcgcgaaactctacacacgaaatgtattggataagtaacggcacaggaaatatagtcgcatcagtaaatatggtatctcgactcttgctcaacagattcacgatgactcataggcggccaactattgagaaggatgtagatctcggcgctggaacaagacatgtaaacgcggagccagaaactccaaacatggacgtaatcggtgagaggataaaaaggattaaggaagaacataactctacgtggcactacgatgatgaaaacccttataaaacatgggcctaccacggatcgtacgaagtcaaggcaacaggtagcgcaagttccatgattaacggagtagtaaaattgcttacaaagccatgggatgtagttccaatggtgactcaaatggcaatgaccgatactacaccatttggtcaacaacgagtcttcaaagaaaaggttgatacgcgaacaccacgtagcatgcccggaacacgccgcgttatgggaataaccgctgaatggttatggcgaacattaggcagaaataaaaagccccggctatgtacccgtgaagaatttactaagaaggtacgtacgaacgctgcgatgggagctgttttcaccgaggaaaaccaatgggactcggcaaaggcggcagtggaagatgaagatttttggaagttagttgatcgtgaacgtgaacttcataaactgggtaaatgtggctcttgcgtgtacaacatgatgggcaagagagagaagaaactcggcgaatttggaaaagcaaacgggtctagggccatttggtatatgtggttaggtgcgcgataccttgaatttgaagcgcttggatttctcaaagaataccattggtttagcagagagaacagctattcgggggttgaaggggaaggactgcataaacttggctacattttacgcgatatatctaaaattcctggtggtgccatgtacgctgatgatacagcaggttgggatacgcgaataactgaggatgatctccataacgaagagaaaattactcagcaaatggatcccgaacatcgacaactagccaatgcaattttcaaattaacatatcaaaacaaagtcgtaaaagtacaacgacctactcccacaggaactgtaatggacatcatatccaggaaagatcaaaggggttctggtcaggtcggtacctatggattaaatacattcaccaatatggaagctcaactaataaggcaaatggaaggcgagggtgtactatcaaaggcagatttggaaaatccccatttaccagagaaaaagataacacagtggctggaaactaaaggtgtcgaaagattaaaaaggatggccataagtggagacgactgcgtggttaaacccatagatgatcgatttgctaatgcgttattggcattgaatgataccggaaaagtacgtaaagatattccgcaatggcaacccagtaaaggatggcacgactggcaacaagtgccattttgttcccatcattttcatgaattaataatgaaagatggaagaaaacttgtcgtaccctgccgtccgcaggatgaattaataggaagggcacgtatttcacaaggagcaggttggtcacttagagaaaccgcttgtttaggcaaagcatatgcacaaatgtggtcgctaatgtacttccatcggagagatctaagactagcaagcaacgccatatgttcagctgtaccagtacattgggtcccaacaagccgtacaacttggtccatccacgcacatcaccaatggatgaccacggaggacatgctcacagtatggaacagggtgtggatcgaagacaatccatggatggaagataaaacgccagtaacaacttgggaaaacgttccctatctaggcaaacgcgaggatcaatggtgcgggtctcttataggactaacatcaagagcaacatgggcccaaaatattcctaccgcgattcaacaggtccgatccctcatcgggaatgaagagttccttgattatatgccgagtatgaaaaggttccgaaaagaggaagagtcagaaggagcgatttggtag

SEQ ID NO: 23042 - RNA, 9873 nt, synthetic construct
  misc_feature 1..9873: note = derived and/or modified CDS sequence (opt6) from DENV-3__GQ466079__SS-prME
  source 1..9873: mol_type = other RNA
acttccctatgccttatgatgattctgccggcagcactagcctttcatttaacaagcagggatggtgaaccaagaatgatagtgggtaaaaatgaaagaggtaaaagtttactttttaaaacagctagcgggattaatatgtgtacgctaatcgcgatggatcttggtgaaatgtgtgacgacacggtaacttataaatgcccacatatcacagaagttgaaccggaagacattgattgttggtgtaaccttacgagtacatgggtaacttatggtacgtgcaaccaagcaggagaacaccgcagggataaacgatcagtggccctggcaccacacgtaggcatgggtctagatacaagaacccaaacatggatgagtgccgaaggcgcatggcggcaggtagaaaaagtggaaacctgggccctacgacaccctggatttacaatattggcactatttctggcccactacatcggaacatcacttacacaaaaagtcgtgatatttatattactcatgcttgtaacacctagcatgaccatgagatgtgtgggtgtaggcaacagagactttgtagaaggcttgtcaggggcaacgtgggtggatgtggtgctggaacacgggggatgtgtaacgacaatggccaaaaacaaacctacattagatatagaattacagaaaacggaagcgacacagctagctactttaagaaaactctgcatcgagggcaaaataacgaacattactactgatagtcgatgccctacacaaggcgaggctgtactaccggaggagcaagaccagaattatgtttgtaaacatacgtatgtggacagaggatggggcaatggatgtggactctttggaaaaggttccctagtaacatgcgcaaaatttcaatgcttagagccaatagaaggcaaagtggtacaatatgaaaatttaaaatacacggttatcataacggttcacacgggggatcagcatcaagtaggaaacgaaacccaaggagttacagcggaaataacaccacaagcatccaccaccgaagcaatcctgcctgagtatggaacattaggcttagaatgttcaccacgtactggattagattttaatgaaatgatactactaactatgaaaaacaaagcatggatggttcatcgccaatggttctttgatttgccgttaccttggacatcaggagcaacaaccgagaccccaacatggaatagaaaagaactattggtcacatttaaaaacgcccacgccaagaaacaagaagtagtcgttctgggatcacaagaaggagcaatgcatacagcattgaccggagctactgaaatacaaaattccggtggaacatcaatatttgcaggacacctcaaatgtagattaaaaatggacaaactagaactaaaaggtatgtcatatgcaatgtgcacgaacactttcgtactcaagaaagaagtatcagaaactcaacatggaacgattttaattaaagtagagtataagggagaggacgcaccttgtaaaattccttttagcaccgaggatggacaaggcaaagcgcataatggaagactaatcacagccaatccagtcgtaactaagaaagaagaaccagttaatatagaagcagaaccacctttcggggaaagtaacatagtaattggaattggggataatgctttgaaaattaactggtataagaaaggatcatccataggcaaaatgtttgaagcaacagctcgaggtgcacgacgcatggcgattcttggcgatacagcttgggatttcggctcagtaggaggtgttctaaactcactaggtaaaatggtgcaccaaatattcggttctgcatacacagcactattctcaggcgtaagttgggttatgaaaattggcataggagtgctactaacgtggattggtctcaattctaaaaacacaagcatgagtttttcatgtatagcgataggaatcataacattatacctgggagccgtagtacaggcggacatggggtgtgtcataaattggaaagggaaagaactcaaatgtggctcaggaattttcgtaacaaatgaagttcatacgtggacagaacagtacaaatttcaagcggatagtccaaaaagattggcaacagcaatcgcaggggcatgggagaacggtgtatgcggcattcgaagcacaaccagaatggagaatctcctgtggaagcagatagcaaacgaactgaactatatactctgggagaataatataaaactaactgtagtagttggggatactataggtgtattagagcaaggaaaaagaacattaacgccacaacccatggaattgaaatactcttggaaaacttggggtaaagccaaaatagtgacagctgagacacagaatagcttctttattatagatggtccaaataccccagaatgtccctcagcaagtagagcttggaatgtatgggaagtagaagactatggatttggggtatttacaactaacatttggcttaaattaagagaagtgtatacacaattatgtgatcataggctaatgagtgcagccgtgaaagacgaaagagctgttcacgcagatatgggatactggatcgagtcgcagaaaaacggctcttggaaattagaaaaggcatccctaattgaagtcaaaacgtgcacctggcctaaatctcacactctgtggtctaacggagtacttgaatcagatatgataattccaaagtctttagcgggacccattagtcaacacaaccatcgacctggatatcatacccaaactgctggaccttggcatttagaaaatctcgaattggattttacatattgtgaaggaacaacagtcgtaattacagaaaattgtggaactagaggcccaagtctaagaaccactactgtgtctggaaaactgatacatgaatggtgttgtaggtcatgtacattacccccattacggtatatgggtgaagatggatgctggtacggaatggaaatacgacctataagtgaaaaggaggagaatatggtaaagtcacttgtttcagctgggtccggaaaagtcgataactttacaatgggaatactgtgcctagcgattttatttgaagaagtcatgagaggaaaatttggtaagaagcatatgatagcgggagtcttcttcacgtttgtactgctcttaagcggccaaattacatggagggacatggctcacactcttattatgataggaagcaatgcttcagacagaatgggtatgggagtaacatatttagctttaattgctacatttaaaattcaaccatttctcgcgctggggttctttctaagaaaactgacctcgagagaaaatcttttattaggagtcggcctcgccatggcaacaactcttcagttaccggaggatattgaacaaatggcaaatggtatagctctgggtctaatggcgctaaagttaataacacaattcgagacgtaccagctatggacagcactaattagtttaacgtgctccaatacgattttcacattaactgtggcttggcgaacagcgacacttattctagcaggagtttcgttattacctgtatgccaatcgtcgtccatgagaaaaaccgattggcttccaatgaccgtagcagcgatgggtgtaccccctctacccttgtttattttcagcctaaaagacacgctaaaaagaagaagttggccattaaatgaaggagtaatggcagtagggctagtttcgatactggcatccagcttgctaagaaacgatgttcctatggcaggccccctcgttgccggaggactcctaattgcttgctacgtgatcacaggaacctcagcagacttgacagtagaaaaagctgcagatgtgacttgggaggaagaggcagaacagacaggtgtgtcgcacaaccttatgataacggtagatgacgacgggacaatgcgaattaaagatgatgaaacggagaacatactgactgtccttcttaagactgccttacttatagtttcaggaatttttccatactcgattcctgcaactctgttagtatggcatacttggcagaagcaaactcagagaagcggggttttgtgggatgttcctagccctcctgaaacgcagaaagccgaattagaagagggcgtgtatagaattaaacagcaaggaatattgggaaaaacgcaagtgggtgtgggggtacaaaaagaaggagttttccacactatgtggcatgttacaagaggagccgtattaacgcataatggaaaacgcttagaaccaaattgggcatcagtaaagaaagatctaatctcatatggaggaggttggagacttagcgcccaatggcagaaaggtgaggaagtgcaagtaatagctgtggaacccggcaaaaaccccaaaaacttccaaaccatgcctggtaccttccagacgactacaggagaaattggagcgatagcattggatttcaaaccgggtaccagtggaagtccaataataaacagagagggtaaagtcgttggtctatatggtaacggagttgtaaccaaaaacggtggctatgtctcaggaatcgcccaaacgaatgcagagcctgatggtccaacacctgaacttgaggaagaaatgtttaaaaagcgcaatttgactataatggatttacatccaggatccggaaaaacccgtaagtatttgcctgcgatcgttcgggaagctataaaacggagattaagaacactaatacttgcacctacaagagtcgtagctgcagagatggaagaggctctaaaaggcttacctatacgataccagactacggccacaaaatcagaacacaccggaagagaaatagttgacttaatgtgtcacgcaacattcacaatgcggcttttaagcccggttagagtgcccaattataacctcataatcatggacgaagcacactttacagatcccgcaagcatcgccgcacgagggtatatttcaacacgcgtaggtatgggcgaagccgctgcaatattcatgtcagctacaccaccaggaacagcagacgcattcccacaaagtaatgctccgatacaggacgaagagagggacatacccgaaagatcatggaactcagggaatgaatggatcactgactttgcaggaaagacagtgtggttcgtcccatctatcaaagctggtaatgatattgccaactgtcttagaaagaatggcaagaaagtaattcaactctctagaaaaacattcgataccgaataccagaaaactaaattaaacgactgggatttcgttgtgactaccgatatttcagaaatgggagcaaacttcaaggcagacagagtaattgatccccgtcgttgtttaaaaccagtaattctaacagacggacctgaacgggttatcctcgcaggcccaatgcccgtaacagctgcaagcgctgcccaacgtcgcggacgagttggtcggaatccccagaaggaaaatgaccaatacatctttaccggccaacccttaaacaatgacgaagaccacgcacattggacagaagcgaagatgctcttagacaatataaatacgcccgaaggaataataccagcattgttcgagccagaaagggaaaaatcggcagctatagatggagaataccgcctcaaaggagaaagtcgcaagacatttgttgaattaatgagaagaggggatttgccagtatggttagctcataaagttgcttcggaagggataaaatataccgatcgtaaatggtgcttcgacggtcagcggaataatcaaatactcgaagaaaatatggacgtagaaatatggacaaaggagggagagaaaaagaaactaagaccaagatggctcgacgcccgtacttattcagatccactagcgcttaaagaatttaaagacttcgccgccgggagaaaatcaatagcactagatctcgtaaccgaaataggaagggtaccgtctcatctagcccatagaactcgaaatgcattagataatcttgtcatgttgcatacaagtgagcatggaggaagggcttataggcatgcagtcgaagaattgccagaaactatggaaacattactgttattaggattaatgatactgttaactggtggagctatgctattcctgatatcgggaaagggaataggtaaaactagcatcggacttatctgtgtaattgcaagcagtggaatgctgtggatggcagaaattcctttgcaatggatagcatcagcaattgtgcttgagttctttatgatggtactgctcatcccagaacccgaaaagcaacgaacgccacaagacaaccaacttgcatatgtcgtaatcggtatcctcacactcgcagcgatcatagctgcaaacgagatgggccttctcgaaactaccaaaagagatcttggaatgtcaaaggaacccggtgtagttagcccaacatcatatttagatgttgacttacaccctgccagcgcatggaccctatatgcagtagctaccactgtaattactcccatgcttagacatacaatcgagaacagtactgcaaatgtatccctggccgcgatagcgaatcaagcggtagtgctcatgggattagacaaagggtggcctataagtaagatggacctaggggttcctttactagcattaggttgttattcgcaagtgaatcctctaacccttacagccgctgtactccttcttatcacccactatgctataataggaccgggtttacaagcgaaagcaacaagagaggcccaaaaacgaacggccgcagggattatgaaaaatccaacggtcgatggaatcataaccatcgacctagatccagtaatatatgacagcaaatttgaaaaacaactaggccaagtcatgctattagtgctgtgcgccgtacagttattattgatgagaacaagttgggcattatgcgaagcgttaaccctcgcgacaggccctataacgaccttgtgggaaggatcgccaggaaaattctggaacacaacaatagccgtatccatggcaaacatttttagaggatcatatttagctggtgccggtttagcgttcagtataatgaaatccgtcggaacaggaaagcgtggcacaggatctcaaggtgagacgttgggcgagaaatggaaaaagaaacttaatcaactatctcgtaaagagttcgatctatataaaaagagtggaatcacggaagtagatcgcacagaagctaaggaaggattaaaaagaggtgaaacaacacatcatgcagtgtcccgagggtcggcgaaattacaatggttggtagaacggaacatggtaatccctgaaggtcgagtaattgatttagggtgcggacgaggaggttggagttattattgcgcaggcctcaagaaagtcacagaagtgagaggatataccaaaggaggacctggccatgaagaaccggtccctatgtcaacttacggatggaatattgtcaaactaatgagcggtaaggatgtattttacttgccacctgaaaaatgtgacaccctcctttgtgatataggagaaagcagcccatcacctaccgttgaagaaagtcgcactatccgagtcctaaaaatggttgaaccttggctcaaaaacaatcaattttgtatcaaggttttaaacccatatatgccagccgtgatcgaacatctagaacgattacaaaggaaacatggcgggatgcttgtcaggaatccccttagccgtaactcaactcacgagatgtattggattagcaatggtaccggcaatattgtcagttctgtaaatatggtgtccagactacttttgaaccgattcacaatgacccaccgaaggccaacaatcgaaaaagatgtagaccttggtgccggaacaagacatgtaaatgctgaaccggagactccaaatatggacgtaataggagaaagaataaaaagaatcaaggaagaacataattcgacttggcattacgatgacgaaaatccttacaagacttgggcttaccatggttcctatgaagtaaaagcaaccgggtcagcctcatctatgatcaatggagtcgtgaaacttttaactaagccttgggacgtcgttcccatggtgactcaaatggcaatgaccgatacaactccgttcgggcaacaaagagtctttaaggaaaaagtagacactcgaacgccacgtcctatgccaggtacccgcaaagtgatggaaattacagcagagtggctctggaggacattagggagaaacaaacgtccgagactttgcacacgagaagagttcaccaagaaagttagaactaatgcagcaatgggggccgtttttacggaggaaaaccaatgggactccgctaaggcagcagtagaggacgaggaattttggaagttggtagatagggaaagagagttacataaattaggaaagtgcggcagttgcgtgtataacatgatgggaaaaagagagaagaaactgggcgagtttggtaaagcaaaaggtagccgtgcaatatggtatatgtggctcggaagcagatatctggaatttgaggctttggggttcttaaacgaagatcattggttttctagggaaaattcctactctggtgtggaaggagaaggacttcataaactcggctatatattacgggatatttcaaagatacctggtggcgcgatgtatgcagatgacacagcaggatgggatactcgaataactgaagacgatttacataatgaggaaaagatcacacagcagatggatcccgaacatcggttattagcgaacgctatctttaagttaacttatcaaaacaaggtagtaaaagttcaaagacctaccccgacaggtaccgttatggacataatatcacgcaaagaccagagaggctctggtcaagtagggacttatggtctgaacactttcactaacatggaagcccagttagtgcgtcaaatggaaggtgaaggtgtcctttctaaagctgacttggaaaacccacatctaccagagaagaaaattacacagtggttagaaactaaaggagtagaaaggttaaaaaggatggcaattagcggtgatgactgtgtagtaaaaccaatagacgatagattcgcgaatgcacttttagccctaaatgatatgggaaaggttcggaaagacattccacaatggcaaccaagcaagggctggcacgattggcaacaagtacccttctgctcccatcattttcacgaacttataatgaaagatggcaggaagttggtcgtcccgtgtaggccacaggatgaactaatcggtagagccaggatatctcaaggggctggttggtctttacgagaaaccgcgtgcttaggcaaagcatatgcacagatgtggagtctaatgtactttcaccggagagatttacgtttggcaagtaatgccatatgctcggcagtgcccgtacactgggttccgaccagtcgtactacatggtcaatacacgcccatcatcaatggatgacaaccgaagatatgctaactgtctggaatagggtatggatcgaagacaatccgtggatggaggacaagactcctgtaactacatgggaaaacgtaccgtatctgggcaaaagggaggatcaatggtgcggcagtcttattggtctgacatcgagggcaacatgggctcaaaatatcccgactgctatacagcaagttagatctttaataggaaatgaagaatttctggactacatgccgtcgatgaaaaggtttcgtaaagaagaagagtcagaaggtgctatttggtaa

SEQ ID NO: 23043 - RNA, 9873 nt, synthetic construct
  misc_feature 1..9873: note = derived and/or modified CDS sequence (opt6) from DENV-3__FJ898462__SS-prME
  source 1..9873: mol_type = other RNA
acttcactttgtctcatgatgattctaccagctgcgctagcattccatctaacttctcgcgatggagaaccaagaatgatcgtaggcaaaaatgaaagaggaaaatccttactgttcaaaacagcatccggtattaacatgtgcacattaattgccatggacttaggggaaatgtgcgacgacaccgttacctataaatgtccgcatatcactgaagtagaaccagaagatattgattgctggtgtaacctcaccagcacatgggtgacttatggaacgtgtaatcaagctggtgaacacagacgtgataaacgatcagttgcgctagcgcctcatgttgggatgggattagacactcgaacgcaaacgtggatgagtgcggaaggagcgtggagacaagtcgaaaaagttgagacctgggccctaagacatcccggatttaccattttagcactcttcttagctcattacattggaacttctttaactcaaaaagtcgttatatttatactccttatgcttgtgacgccatcgatgactatgagatgcgttggagttggtaaccgcgatttcgtggaaggccttagtggagcaacttgggttgacgttgtcttggagcatggaggatgtgtaacgacaatggccaaaaataaacctaccttagacatagaactgcagaaaactgaagcaacacaactagccactcttcgaaaactctgtatcgaaggaaaaatcaccaatatcactacagattccagatgcccaacgcaaggtgaagcagtacttccggaagaacaagatcagaattacgtatgtaaacacacatatgtagatcgaggttggggtaacggttgtgggctattcggcaaaggttccttagtaacatgcgctaaatttcaatgcttagaaccaatcgaaggaaaagtcgttcaatatgaaaacttgaaatataccgttataataaccgtccatacgggggatcagcatcaagtaggtaatgaaacacagggagtgaccgcagaaattacgccccaagcatcaacaacagaagcaatacttcctgagtacggaacattaggattagagtgctcacctaggacaggtctcgatttcaacgaaatgatattactaaccatgaaaaacaaggcttggatggtacatagacagtggttctttgatctcccattaccgtggacaagtggtgcaacaacagaaacaccaacgtggaatcgaaaagaactcctagtaacttttaaaaatgctcacgctaagaaacaagaagtcgtagtattagggagccaagagggtgctatgcacacagcgttgacaggcgcaactgaaatacagaactccggaggtacaagtatttttgcaggacacttaaaatgtcgcctaaaaatggacaaactcgagctaaaaggaatgtcatatgcgatgtgtactaacacgttcgtgttaaagaaagaggtatctgaaacccaacatggaacaatattaattaaagtagaatataaaggagaagacgcgccttgcaaaatacctttctcaactgaagacggacaaggtaaggctcataacggccgtcttattacggctaaccctgtggtaactaagaaggaagaacccgtgaacatagaagctgaacctccttttggcgaaagtaatattgtgataggtataggggataatgcgctgaaaatcaactggtataagaaaggatcttcaataggcaaaatgtttgaagcgaccgcaagaggcgcccgaagaatggcaatattaggggatacggcttgggattttggttctgtaggaggggtgctaaatagcttgggaaaaatggtacatcaaatttttggctcggcatatacagcattatttagtggagtatcatgggtaatgaaaataggtattggagtactgcttacctggatcggcctaaactcgaaaaatacttctatgtcattcagttgtattgccataggaattataacactatacctgggtgccgtggttcaagcagacatgggatgcgtcataaattggaagggcaaagaactaaaatgtgggagcggcatctttgtcactaatgaggtacacacatggacagaacaatataagtttcaagccgattcaccaaagagattggctacggcaatagcgggcgcatgggaaaatggggtctgtgggatacgatcaacaacgcgtatggaaaatttactttggaaacaaattgcaaacgaactcaattatatcttatgggagaataatatcaaattaacagttgtagtaggtgacataatcggcgttttggaacaaggaaaaagaacgttgactcctcaacctatggaattgaaatattcatggaagacgtggggtaaagccaaaatagtaaccgcagaaacccaaaacagttcctttataatagatggaccaaacaccccagaatgcccaagtgcgagcagagcgtggaatgtatgggaggttgaagattatggcttcggagtctttacgacaaacatatggctaaaattgcgggaggtctatactcaattgtgtgatcacagattaatgtctgccgcagtgaaggatgaacgcgctgtacacgcagatatgggatattggatcgagagtcagaaaaatggatcttggaaactagaaaaagctagtttaatagaggtaaagacttgcacatggcccaaatctcatacgctttggtcaaatggtgtattggaaagtgacatgataataccaaagagcttagcgggaccgataagccaacataatcacagaccagggtatcatactcaaacggcgggaccgtggcatcttggcaaactcgaactcgacttcaattactgtgaaggtacaacagtagtgatcacagaaaactgtggaaccagagggccatcgttaagaacaacaacggttagcggaaaattaatacacgagtggtgttgccgatcgtgcacattgccaccccttagatatatgggtgaagatggatgttggtatggaatggaaatcagacctattagtgaaaaggaagagaacatggtaaaatcgcttgttagtgcaggatcaggaaaagttgacaactttacaatgggcgttttgtgtttagcaatattatttgaggaggttatgagggggaaatttgggaagaaacatatgatagcgggtgtattctttacgttcgttctgttattaagtgggcagataacatggagagacatggctcacaccctaataatgataggaagcaacgcatcggatagaatgggcatgggggtaacttatcttgcgcttattgcaactttcaaaatccaacccttccttgcactaggattctttttaagaaaattgacctcaagggaaaatttactgttaggggttggattggcaatggcaactacattacagttaccagaagatatagaacaaatggctaatgggattgctctaggtcttatggcattaaaacttataacccaatttgaaacatatcaattatggaccgccttaatcagcttaacatgcagtaatacgatgttcacattgactgttgcatggagaactgcaactctcatattagcaggagtatcgctccttccagtttgtcaaagctctagtatgagaaagacagattggttgccaatggctgtagcagctatgggcgtgccaccacttcctctcttcatattttcattaaaagatacacttaaacgacgttcttggccgctaaatgaaggagtaatggccgtaggtcttgtgtcaatattagcatcgtccttattacgaaatgatgtaccaatggccgggcccttagttgcagggggtttattaattgcctgttatgtgatcacagggactagcgccgatctaacagtagaaaaagctgcagatattacttgggaggaagaagcggaacagacgggagtatctcacaacttgatgattacggtagacgatgatggaacaatgagaataaaagatgacgaaaccgaaaatatattaaccgttttgctcaaaactgctctcttaatagtgtccggggtctttccatattcaatacccgctacgttacttgtctggcatacatggcaaaaacaaactcaaaggtcaggagtcttatgggacgtgcccagtcccccagagacacaaaaggcggaattagaagaaggagtgtacaggataaagcagcaaggaatatttggcaaaactcaagttggtgtcggagtgcaaaaggaaggcgtatttcacacgatgtggcatgtaacaagaggagccgttttaacttacaacggtaaacggctagaaccaaattgggcatctgtaaagaaagatctaattagttacggagggggatggcgattatcggctcaatggcaaagaggagaagaagttcaagtaattgcagttgaacccggtaaaaatcctaaaaactttcagacaatgcctggtacattccaaacaaccacaggagaaatcggtgctatagccctagatttcaaaccaggtacttcaggatcgccaattataaatagagaaggcaaagtcgtgggactgtatggtaatggggtagtaactaaaaacggaggttatgtatccgggatagcacaaactaatgccgaacctgatgggcccactcctgaattggaggaagagatgttcaagaaaaggaacttaacaataatggacctacacccgggctcaggaaaaaccagaaaatatttgcccgctattgttagggaagcaataaaacgcaggctaagaacactgattctagccccaaccagggtagtagccgcagaaatggaagaagctctaaagggactaccaattagatatcaaaccacggcgacgaagtctgaacacactggtcgagaaatagtggatctcatgtgccatgcaaccttcacaatgagacttctatccccggtgagagtaccaaattacaacctgataattatggatgaagcacactttactgaccctgcgtcaattgccgcacgtggttacatatccactcgagtaggtatgggagaagctgcagctatttttatgacggctacaccaccgggaactgcagacgcattcccacaatctaatgcacctattcaagatgaagaaagggacattcccgaacgtagttggaatagcggaaacgaatggatcactgacttcgccggaaaaactgtatggtttgtaccatccatcaaagcagggaatgacatagcaaattgtttaaggaaaaatggtaagaaagtcatacaactatccagaaagacttttgatacagaatatcagaaaacaaaactaaacgattgggacttcgtagttacaacagacatatcagaaatgggggcgaattttaaagcagatagagtaatagaccctcgtcgttgcctaaaacctgtgattcttacagatggtccagaaagagtaatattggcgggccctatgccggttactgctgcctcagctgcacagagaagagggagagtggggcgtaatccgcaaaaagaaaatgaccagtatatattcactggacagcctttgaataatgatgaagaccatgcacattggacagaagccaaaatgttacttgataacataaacacaccagaaggaataataccagcattgttcgagccagaaagagaaaaatcagctgcaatagacggagagtaccgtcttaagggagaatcaaggaagacctttgtcgaattaatgcgaagaggtgatctcccagtctggctagcacataaagttgcttcggaaggtattaaatatacggacagaaaatggtgttttgacggccagagaaataaccaaatacttgaggaaaatatggacgtggaaatttggacaaaagaaggcgagaagaagaaactgcgaccacgatggttagacgcaagaacctactcggatccacttgcactgaaagagttcaaagactttgcagcaggtcggaaatcaattgcactagatttggttacggagatcggtagggttcctagccacctagctcatagaaccagaaacgcgctggataacctggttatgctacacacaagcgaacatggagggcgagcgtaccgacacgcagtggaggaattaccggagacgatggagactttattactactaggtttaatgatactcctcaccggtggtgcaatgctatttctcattagcggaaaggggatcggaaaaacttcaataggattaatttgtgtcatcgcaagctcaggaatgctatggatggccgaaattccactccagtggatagcatccgcgattgtcctcgagttcttcatgatggttctactgatacctgaaccggaaaaacaacggaccccacaagacaaccaactggcttacgttgtcataggaatattaaccttagcagcaataattgcagccaatgaaatgggcttattggaaactacaaaaagagatctgggcatgtctaaagagcctggagtggtttcaccgacctcttatctagacgtagacttacatcccgcctcagcatggacattatatgctgtcgcgaccacagttattacacccatgctaaggcatactattgaaaactccacagctaacgtttctctagcggcgattgcaaatcaggcagttgtcctgatgggattagacaaaggctggcctatatctaaaatggatctaggtgtcccacttctggcattaggatgctatagccaagtcaatcctctaactcttactgctgccgtcttactgctcataacacattacgccataattggaccaggattgcaagcgaaagccaccagggaggcacagaaacggacagcggccgggataatgaaaaatcctacagtcgatggaataatgacaatagatctagatccagttatttatgactccaaattcgaaaagcaacttggccaggttatgttattggtactgtgcgcagttcaactactattaatgcgtacgtcttgggcgttgtgcgaggctttgacactcgctacagggccaataactaccctatgggaaggaagtcctggaaaattctggaatacgactatagctgtcagtatggcaaatatatttagaggctcatatttagcgggtgctggactggctttttcaataatgaaatcagtcgggaccggtaaaagaggaacgggaagtcaaggcgaaaccttaggggaaaaatggaagaagaaactcaatcaactgtctagaaaggaatttgacctatacaaaaagagtggaataacagaagtagatagaactgaggcaaaagagggtctaaaaagaggagaaactacccaccatgcagtatcgcgaggatcggcgaaacttcaatggttcgtagaacgaaatatggtaataccggaggggcgggtaattgatctaggatgtggccgaggaggatggagttattattgcgcaggacttaagaaagtaacagaagtaagagggtatactaaaggcggcccggggcatgaagaaccagtcccaatgtccacttacggttggaacatcgtgaagctgatgagtgggaaggatgtcttctatttgccaccggaaaagtgcgatactctattatgtgatataggagaatctagcccaagcccgattgtggaagaatcgcggacaattagagtgctaaaaatggtagaaccatggctcaaaaacaatcaattctgtattaaagttcttaacccttatatgcctacagttatagaacatctggaacgattgcagcggaaacatggtggaatgttagtaagaaatcctcttagtagaaattcaacacacgaaatgtattggatttcaaacggaactgggaatatagtagctagtgttaacatggtatctcgactgcttctaaaccgttttacaatgacgcatagaagaccgacaatagaaaaggatgtggacttaggcgcaggaactagacatgtcaacgctgagccagaaacaccaaatatggacgttataggtgaaagaattaaacgcattaaggaagaacataatagtacatggcattacgatgatgagaacccatataaaacttgggcatatcacggctcatacgaagtgaaagcaacaggcagtgcttcatcaatgataaatggagtagtcaaattgctgactaaaccctgggacgtcgtcccaatggtaacacagatggcaatgactgatacaacgccgtttggccaacaaagggtgtttaaagagaaggtcgatacaagaacacctcgatcaatgccagggactcggagagtgatggggatcacggctgagtggctttggcgaacattaggaaggaataaaaagccgcgattatgtaccagagaagagtttactaagaaagtcagaacgaacgctgctatgggcgccgttttcacagaagaaaatcaatgggactcagctaaagctgccgtagaggatgaagatttctggaaactcgtcgacagagaaagagaattacataaactgggtaaatgtggatcatgcgtgtataatatgatgggtaaacgggagaagaagttaggagaatttggtaaagccaaaggatcacgagcaatatggtacatgtggctaggtgcgagatatctcgagtttgaagctcttggttttctaaatgaagatcactggtttagcagagaaaatagctacagtggtgtggaaggtgaaggcttacataaattgggttatatattacgcgacatatcaaaaataccgggtggcgccatgtatgctgacgacacagcagggtgggacactcggataactgaagacgatttacataacgaagagaaaatcacccaacaaatggaccccgagcataggcaactagctaacgctatatttaaactaacttaccaaaataaagtcgtcaaggtgcaacggccgacaccaactggaacagtcatggatataataagccgcaaggaccaacgcggcagtggtcaggtcggtacgtacggtttaaacacctttacaaacatggaagcacaattgatacggcagatggaaggagaaggagttctatcaaaagccgatttggagaacccacatctgcccgagaaaaagatcacacaatggttggaaaccaaaggagttgaaaggctaaagcgtatggcgatttctggagatgactgtgtagtcaagccgatagatgaccgattcgcgaatgcgctactggccttaaacgacatgggcaaggtgaggaaagacatacctcaatggcaaccatcgaaaggttggcatgattggcaacaagtaccattttgttcacatcatttccatgagcttataatgaaagatggtagaaaattggtggtcccctgtcgacctcaagacgaattaataggacgagctcgcatttcccaaggggccggatggtcactcagagaaaccgcttgtctaggaaaagcgtatgcacaaatgtggtccttgatgtactttcaccgtagagatctcagattagcttctaacgcaatttgtagcgcagtacctgttcactgggtacccacctctagaacaacctggagcatccacgcacaccaccagtggatgacgacagaagacatgctaaccgtttggaatagggtctggattgaagacaacccgtggatggaagacaaaacccctgtgacaacttgggagaacgtgccatatttaggtaagagggaggaccaatggtgcggatctttgattggtcttacgagccgagccacgtgggctcagaatattccaacagcaattcaacaagtgcgctcacttataggtaatgaagaatttcttgattacatgccatcaatgaaacgattcagaaaagaggaggagagcgagggagcgatatggtaa

SEQ ID NO: 23044 - RNA, 9873 nt, synthetic construct
  misc_feature 1..9873: note = derived and/or modified CDS sequence (opt6) from DENV-3__KF955473__SS-prME
  source 1..9873: mol_type = other RNA
acgagtctctgcttaatgatgattctaccagcagctttggcatttcatctaacttctcgtgatggagaaccaagaatgatcgtaggtaaaaatgaacgtggaaaaagtctcttatttaaaacagcgtccggaataaacatgtgcacgctcattgctatggatctaggtgaaatgtgcgatgatacggttacatacaaatgccctcacattactgaagtagaacctgaagatattgattgctggtgcaacctaacaagcacatgggtaacatatgggacatgcaatcaagctggagaacatcgtcgggataaacgatcagtcgcactggcacctcacgtaggtatgggactagacacgagaactcagacttggatgtcagcggaaggagcgtggagacaagttgaaaaagtagaaacatgggcgttacgtcaccctggattcacgatactagcgttgtttcttgctcactacatcggaactagcttaacacaaaaagttgtaatattcattctcctaatgctggttacgccgtcgatgactatgagatgcgttggggtcggtaatcgagattttgtagaaggactatccggagcaacatgggtcgacgtggttttagaacatggaggctgtgttacaactatggccaaaaataaaccaaccttagacattgaattgcagaaaacagaagcaacgcagctcgcaatactaagaaaactatgtattgaaggaaaaataacgaatataactactgatagcagatgtcccacacaaggagaagctgtattacccgaagaacaagatcaaaattatgtttgtaaacacacttacgtggatagaggctggggtaacggatgtggcttatttggaaaaggatctcttgttacatgcgcaaaatttcaatgcttagaacctatagaaggtaaagtggttcagtacgaaaatttgaaatatacagttattattacagttcacacaggggatcagcatcaagttgggaatgaaacgcaaggtgtaaccgcagaaataacaccgcaagcatcgactacagaagcaatacttccagaatacgggacattagggttagaatgttcgccaagaacgggtctagacttcaatgaaatgatattactaacaatgaaaaataaagcatggatggtccaccgtcagtggttctttgacctacccctcccatggaccagcggtgctaccactgaaacaccgacctggaatagaaaagaattactggttacttttaaaaatgctcacgcgaagaaacaagaagtagttgtactgggaagccaagaaggtgcaatgcacaccgcgttaacaggggcaactgaaatacaaaactctggaggaacaagtatttttgcgggacatttgaaatgtcgtctcaaaatggataaacttgaactcaaaggtatgagttacgccatgtgtacaaacacttttgttctcaagaaagaggtgagcgaaacacaacatggaacaatcttaataaaagtagaatataaaggcgaggatgcaccatgtaaaataccattttcgactgaagatggtcaagggaaagcgcacaacggacgattgataacggcaaacccagtcgtaaccaagaaagaagaaccggtcaacatagaagcagaaccaccatttggggagtccaatatagtcattgggattggggataacgcactcaaaattaattggtataagaaaggaagcagtatcggaaaaatgttcgaagccacggccaggggtgcaagacgtatggcaattcttggtgacactgcgtgggattttggatctgtagggggagtcctaaattcattagggaaaatggtacatcagatattcgggtctgcatacacggcccttttctcaggagtgtcttgggtaatgaaaattggaataggtgtcttgttgacgtggataggattaaactctaaaaatacttcaatgagcttctcgtgtatagcgataggaataatcactctgtatttaggtgctgttgtccaagctgatatgggatgtgttataaattggaaaggaaaagagcttaaatgtggctccggtattttcgtaacgaacgaagtacacacctggacagaacagtacaaatttcaagcagacagtcctaaacgcttagcaaccgctattgcaggggcttgggagaatggagtttgcgggatacgaagcactacgagaatggagaacttattatggaaacaaattgcaaacgagttgaattacattctatgggaaaataatataaaattaaccgtggttgttggcgacataataggtgtcctagaacaaggtaaacgaactctgacacctcaacccatggaattgaagtacagttggaaaacatggggaaaagctaaaatagtcacggcagaaacgcaaaactcgtcgttcataattgacgggcctaatacaccagagtgcccaagtgcatcaagagcatggaacgtgtgggaagtggaggactacggtttcggtgtctttacaacaaatatatggctaaaactaagagaagtatacacgcagttatgcgaccaccgactaatgtcagcagcagtaaaagatgaacgcgccgtccacgcggacatgggctattggatagaaagccagaaaaatggaagttggaaactggaaaaagcatctttgattgaagtaaaaacatgcacctggccaaaaagccacactttatggtctaacggagttctagaaagtgacatgataataccaaaatccctagcgggaccaattagccaacataatcatcgtcccgggtaccatactcaaacagcgggaccttggcacttaggtaaattagagcttgattttaattactgtgaaggtactacagttgtaataacggaaaactgcgggacaagagggccgtcactcagaacgacaacggtttccggaaaacttatccacgaatggtgttgtcgaagctgtacattgccacccttacgttacatgggagaagacggttgctggtacggaatggaaataaggccaatttccgaaaaagaggagaacatggtaaaatctttggtatcagcaggaagtggcaaagtggataactttactatgggggttttatgtcttgccatactcttcgaagaagtaatgcgtggcaaatttgggaagaaacacatgatagcaggagtgttctttactttcgtcttgctgctgagcggacaaatcacctggagagatatggcacatacactgataatgatagggtcgaacgccagcgatagaatggggatgggagtaacatacctcgcactaatagccacgttcaaaatacaaccattcctggcgctcggattctttctccggaagttaaccagtagagaaaatctattgctgggtgtaggcctagccatggcgacgacactccaattaccagaagatatagaacaaatggctaatggcatagctttgggtctaatggctttaaagttgattacacaatttgagacttatcaattatggaccgcattaatatctttgacatgttctaacactatgttcacattaactgtagcttggagaacggcgacactgatattagccggtgtctccttactaccggtttgtcagagctcgtcaatgaggaaaacagactggcttcccatggcagtggcagctatgggggtacccccacttcccctgttcatattcagcttaaaagatacactaaaaaggcgctcatggccgctcaatgaaggagttatggcagtgggccttgtatcaatccttgcttcgtcgttacttagaaacgatgtcccgatggctggaccattggtggctggtggtctattgatagcatgctatgtaattacaggaacgtccgcagatttaaccgtcgagaaggcggcggacataacatgggaagaagaagccgaacaaacaggagttagtcataatcttatgatcaccgtagacgacgacggcacaatgagaattaaagatgatgaaacggaaaacatattaacggtgttactaaaaacagcgttgttaatcgtgagtggtgtttttccatactcaatacctgctaccctattagtgtggcatacctggcaaaaacagacacaacgcagtggtgtactatgggatgtcccaagcccacccgaaacacaaaaagccgaactcgaagaaggtgtttatcgtataaagcaacagggcatatttgggaaaactcaggttggagtaggtgtacagaaagaaggagtctttcatacgatgtggcacgtgacaagaggagcggtattaacttataacggcaaacgcttagagccaaattgggcgagcgtaaagaaagatctgatcagttacggcggcggttggagattatcagcacaatggcaaaaaggggaagaagttcaagtcattgcagtggaacctgggaaaaatcctaaaaatttccaaactatgccaggtacatttcaaactactacgggggaaataggagccattgcactcgattttaaaccaggcactagcggctcaccaataataaaccgtgaaggtaaagttgtaggcctatatggaaatggagtcgtaactaaaaacggagggtatgtatcagggatcgcccagacaaatgctgaacccgacggccctacgcccgaactcgaggaggagatgtttaagaaaaggaatttaacgatcatggacctacatccaggtagtggaaagacacgtaaataccttccagcaatagtccgagaagcaataaaaagaagacttagaactctgattttagcacctactagagtagtagccgccgaaatggaggaggcactaaagggactgccaatacgatatcaaactaccgcgactaaatcagagcacacagggagagagatagttgacttaatgtgccatgccacattcacaatgcggctattaagtccggtaagagtcccaaattacaatttaattatcatggacgaagcacatttcacagacccagccagtattgcagccagagggtatatatcaacgagggtgggcatgggagaagcagcagctatctttatgaccgctacacccccgggtacagctgatgctttcccacagtcaaacgcccccattcaagatgaagaaagagacatacctgaacgatcttggaactcaggtaatgaatggataaccgactttgcagggaaaacagtatggttcgtaccaagcataaaagctggaaatgatatagcaaactgcctaaggaagaatggcaagaaagttatacagctaagcagaaaaacattcgatacagaatatcagaaaactaaattgaacgattgggatttcgtagtcaccaccgatatcagcgaaatgggagcgaattttaaagcagatcgtgtgatagacccaaggagatgccttaaacctgtaatactcactgacgggccggagcgagttatactagctggacccatgccagtcactgcggcgagtgcggctcaacgcagaggtagagtgggaagaaatcctcaaaaagaaaacgaccaatatatttttactgggcaaccactgaacaatgatgaagatcatgctcattggactgaagctaaaatgctgctagacaatattaatactccagaaggaattatacctgcattattcgaaccagagcgagagaaaagcgccgccatagatggagaatatcgtttgaagggcgaatctagaaagacatttgtagagctaatgagaagaggagacttacccgtctggttagcgcataaagttgcttcagaggggataaagtatacagatagaaaatggtgttttgacggtcagcgtaataaccaaattcttgaggaaaacatggatgtagaaatctggacaaaagagggcgagaagaagaaattgcggcctagatggttggacgctcgaacgtattctgaccctctagcattgaaagagttcaaggattttgcggcaggacgaaaatcaatcgctcttgatttggtgacggaaattggaagagtgccttcacacttagcacatcgaaccagaaatgcattagataatctcgtaatgctgcacaccagcgaacacgggggcagagcatatcgacatgcagttgaagaattacctgagacaatggaaaccctgttgttgctcggattgatgatcctgttaacaggtggggcaatgctatttctaataagcggaaaaggaatagggaaaacaagtataggcctaatatgcgtcatagcgagcagtggaatgctatggatggctgagatacctctacaatggattgcttccgcgattgtcctagagttctttatgatggttttgctgatacctgaaccggaaaagcagagaaccccgcaagataatcaattagcgtacgttgtgataggaatattgacattagcggctataattgcagcgaatgaaatgggtttgttagaaacgactaagagagacctcggaatgtcaaaagaacctggcgtagtatctccaacaagctacttagacgtggatctgcatccggcctcggcatggacactatatgcggtagcaaccaccgtaattacacccatgctcagacatactatagaaaactccaccgctaatgtttctctagctgcaattgcaaatcaagcagtagtgttaatgggtctggacaaggggtggccgattagcaaaatggacttgggtgtacctttactggcactaggatgttatagtcaggttaaccctctaacactcaccgcggcagtacttttattaataacccactatgcaataataggacccggactacaagccaaagcaacgagagaggctcaaaaacgaacagcagcaggcattatgaaaaaccccacagtagatgggatcatgacaatagaccttgatcccgtaatatatgactcaaaattcgaaaaacaactaggccaagttatgttattggtattatgtgcagtacaattactactcatgcgaacatcatgggcattgtgcgaggctttaaccctagctacaggtcccataacaacactgtgggaaggcagtccgggaaaattttggaacacgactatagctgtgagtatggcaaacatctttagagggagttatcttgcaggcgccggcctcgcattcagcatcatgaagagtgtggggacagggaaaaggggtacaggaagtcaaggagaaactttaggcgagaaatggaagaagaaattaaaccagttaagtcgaaaagaatttgacttatacaagaaatcaggtataaccgaagttgatcgaacagaagctaaagagggtctaaagcgcggagaaaccactcatcacgcagttagtcgaggaagcgcaaagttacaatggtttgtagaaagaaatatggtaatacccgaaggacgggttatcgatcttggatgcggccgaggtggatggtcatattactgtgctgggctcaagaaagttacagaagtgagaggttataccaaaggaggtccagggcacgaagaaccagtaccaatgtcgacctatggttggaatattgtgaaacttatgagtggaaaggacgtcttttacctgccaccggaaaagtgtgataccttactgtgtgacataggtgaatcatccccaagtcccacagtagaagagtcacgtacaattagagtgctcaaaatggtggaaccttggttgaagaacaatcaattttgtatcaaagtcttgaacccctacatgccaaccgtaatagaacaccttgagaggttacagagaaaacatggtgggatgttagttaggaacccgctatcccgcaacagtacacatgaaatgtactggatatccaacggaactggcaacattgtagcatcagttaacatggtaagccgtctgttactaaacaggtttaccatgactcacagaagacccacaatcgagaaagatgttgacctaggggctggaacacgtcatgttaatgcagaaccagaaacaccgaacatggatgtaataggggagcgaattaaaagaattaaagaagaacacaattcgacttggcactatgacgatgagaatccttacaaaacctgggcctatcatggttcatatgaagtgaaagcaacaggaagcgcttcatcaatgataaacggagtcgtcaaacttctcacgaagccatgggatgttgtcccaatggtaactcagatggccatgacagataccactccatttggacaacaacgagtttttaaggagaaggtagatacacgaacaccgcgatcgatgcctggaaccagacgtgttatgggaataacggccgaatggttatggcgaactctgggcaggaataagaaacctcgactatgtacaagagaagaatttaccaagaaagtaagaaccaatgcagcaatgggtgctgttttcaccgaagagaaccaatgggactccgcaaaagccgccgtagaagacgaagatttttggaagctagtagaccgtgaaagagaattacacaaactaggaaaatgcggaagttgcgtatataatatgatggggaaaagggagaagaaactaggggaatttggaaaagcaaaaggttctagggccatatggtatatgtggctgggtgcgagatatttggagtttgaagccctaggattccttaatgaagatcattggttcagcagggaaaattcgtattctggagtagaaggagaaggtctacacaaattgggatatattttacgagacattagcaaaataccgggaggtgcaatgtatgctgacgacaccgctggatgggacacgagaattacagaagatgacttacacaatgaagagaaaataacacagcagatggaccctgaacatcgacaactcgcaaatgcgatatttaagttgacctaccaaaataaagtggttaaagtacaaaggcccacacctaccggtacagtcatggatatcatatcaaggaaggatcaacgaggttctggacaagtaggcacatacggtctaaatacattcaccaacatggaagcccaattgatccgtcaaatggaaggcgaaggagttctttccaaagccgatcttgaaaacccccatcttccggaaaagaaaattactcaatggctagaaaccaaaggagtagagcgacttaagagaatggcaatctcaggggacgattgcgtggtcaaaccaattgacgatcgatttgcaaatgccttactagcgttaaatgacatgggaaaggtgagaaaagatataccacagtggcaacctagcaaaggctggcacgattggcaacaagttccattttgtagtcatcattttcatgaactaataatgaaagatggcagaaaactcgttgttccatgtaggccgcaagacgaattaataggccgagcaagaattagtcaaggtgcaggatggagtttaagagaaacagcatgtctaggaaaagcatacgcacagatgtggagcttaatgtattttcataggcgggacctgcgtcttgcaagcaatgcaatctgctctgcagttcctgtgcactgggtaccgactagcaggacgacgtggagcatacatgcccaccaccagtggatgactacagaagatatgttaactgtatggaacagagtatggattgaggacaatccttggatggaggacaagacgccagtaactacatgggaaaacgttccatatctgggtaaacgggaggaccaatggtgcggtagcttgattgggttaacatcgcgagcaacttgggctcaaaatataccaactgcaattcaacaggttcgatcattaataggtaacgaagaatttctagattacatgccgtcaatgaaacgatttagaaaagaagaagaatcagagggtgctatttggtaa

SEQ ID NO: 23045 - RNA, 9873 nt, synthetic construct
  misc_feature 1..9873: note = derived and/or modified CDS sequence (opt6) from DENV-3__FJ850079__SS-prME
  source 1..9873: mol_type = other RNA
acttctctgtgccttatgatgatacttccagcagctttagcctttcatttaacctcacgtgatggagaacctcggatgattgtcggcaaaaatgaaaggggaaaaagtctattatttaaaacggcatcaggaattaatatgtgtaccttaattgcaatggacctaggagaaatgtgtgatgacactgtaacgtacaaatgtccacatataacagaagtagaaccggaagacatagattgttggtgtaacttaacttcaacatgggttacatatggcacttgcaatcaagctggtgaacaccgtcgcgataaaaggagtgtagcattagcgccacacgtaggaatgggactagacacacgtacccaaacttggatgagtgccgaaggagcttggcgacaagttgaaaaagtagaaacatgggcgctgaggcatccagggtttactatactggcactatttcttgcacactatattgggacaagcctaacccaaaaagtagtaatattcatcctacttatgcttgtaacacctagtatgacaatgaggtgcgtcggcgtcggcaatagggacttcgttgaaggattatcgggcgcaacttgggttgacgtcgtgttagagcatggcggttgcgtaactacaatggctaaaaataaaccaacattagacatagaattacagaaaaccgaagcgactcaattagcaacgctacgaaaactatgcattgaaggtaaaattactaatataactacagactccagatgcccaacccaaggagaagcggtgcttcctgaagaacaagatcaaaactacgtttgcaaacatacttacgtagaccggggatgggggaatggctgcggtctatttggaaaagggtccttagtaacttgtgcgaaatttcaatgtcttgagcctatagaagggaaagtagtacaatatgagaatcttaaatacaccgtgattatcacagttcacactggcgatcaacaccaggtgggcaacgagacccagggcgttactgcagaaatcactcctcaggcttctactacagaagctattttaccagaatacggtactttaggtttagaatgctccccaagaaccggcctggattttaatgagatgattttattaaccatgaaaaacaaagcatggatggttcatagacagtggtttttcgatttaccactaccgtggacaagtggagctaccacagaaacgcctacatggaacaggaaagagctcctagtaacatttaaaaatgctcacgcgaagaaacaggaggtcgttgttctaggtagccaggaaggggctatgcatactgcgcttacaggagcgacagagattcaaaacagtggaggaacaagtattttcgcgggacatttgaaatgcagattaaagatggataaacttgaattaaaaggaatgagctatgcaatgtgtactaacacattcgttctcaagaaagaagtatctgaaactcaacatggtacgattctaataaaagtggaatacaaaggagaggatgttccatgcaagatccctttcagtacagaagatggacaaggaaaagcccacaatggaaggcttatcactgcaaaccccgtcgttactaagaaagaagaaccagtaaatgtggaagcagaacctccttttggagaatcgaatatcgtaatagggattggcgataacgcactaaaaataaattggtataagaaaggttccagtataggaaaaatgtttgaggcgactgcccgcggtgcaagaagaatggcaatattaggagatactgcttgggattttggatctgttggaggggttctaaacagcctcggtaaaatggtacatcaaatatttggaagcgcgtatactgcactcttttcaggggtatcctgggttatgaaaatagggataggggtactattaacgtggattggtttaaatagcaaaaacacctcaatgtcattttcctgcattgctatcggaatcattactctataccttggagcggtcgtacaggcagacatgggatgtgtaataaattggaagggaaaggaattaaagtgtggaagcggtattttcgtaactaatgaagtgcatacatggactgaacaatataaatttcaagcagactctccaaaaagactagcaacagctattgcaggcgcttgggaaaacggcgtatgtggaatccgtagcaccactaggatggaaaacctgttgtggaaacaaattgcaaacgagttgaactatattttgtgggagaataacataaaactaacggtcgtagtgggcgatataaccggtgtgctggaacagggtaaacgaactttgaccccgcagccaatggaactaaaatactcatggaagacttggggaaaagcaaaaatagtaactgcagaaactcagaacagctcatttataattgatggcccaaatacgcccgaatgtcccagcgcctcaagggcttggaatgtatgggaagttgaggattatggctttggtgtcttcacaacaaacatctggctaaaacttagggaagtatatacccaactttgcgatcatcgactgatgagcgcagcagtgaaagacgaaagggctgttcacgccgatatggggtattggatagaaagtcagaaaaatggatcatggaaattggagaaggcatcactaatagaagttaagacatgtacttggccgaagtctcataccttatggtcaaacggagtcctggaaagcgatatgatcatcccaaagagcttagcgggtcctataagtcaacataattaccgtccaggataccatactcagactgctggaccatggcaccttggaaaactagaacttgatttcaactattgcgaaggcacaactgtggtaatcacagagaactgtggaacacgaggaccaagtttaaggacaactaccgtctcgggaaaattaattcatgaatggtgctgccgttcctgtacgctgccacctcttaggtacatgggagaagatggctgttggtacggtatggaaataaggccgatcagcgaaaaagaagagaatatggttaaaagtttggtttcagcaggctcgggagaggttgataattttacaatgggagtgttatgtttggctatactgtttgaagaagtaatgaggggtaagtttggtaagaaacatatgatagctggagtattctttacgttcgtgctcctattatcaggacaaataacgtggcgagatatggctcatacgttgattatgatcgggagtaatgcctccgacaggatggggatgggagtaacatatcttgctcttatagctacctttaagattcagccatttttggctcttggcttctttctaagaaaactcacaagtagggaaaacctgctgctcggtgtaggcttggctatggctaccactctccaactaccggaagatatcgaacaaatggcaaacggtatagcgcttggcctaatggcgttgaaattaatcacgcaatttgaaacctaccagctatggacagcattgatttcgcttacgtgcagtaacaccatatttacattaacagtagcttggagaacagcgacacttatattagccggagtatctttgttaccggtgtgccaatcatcatctatgcgtaagacagactggttaccgatgactgttgcagcaatgggtgttccaccacttcccttattcatattcagcttgaaagacactctgaagagacgaagttggccactaaatgaaggcgtaatggcagtgggattagtaagcatacttgctagtagtttattacgaaatgatgtaccaatggcagggcccctagtggcagggggactgcttatagcttgttatgtcataactgggacttctgctgacctaaccgttgaaaaggcagccgacgtcacatgggaggaagaagcggaacaaaccggagtgagtcataacctcatgattacagtagacgatgatggaacaatgagaataaaagacgatgagactgagaacatactaacagtattgttaaagacagctctactgatagtttctgggatttttccatactctataccggctacgctccttgtatggcatacttggcaaaaacagacacaaagatcaggagtgctttgggacgtcccgtccccgccggaaacccaaaaggcagaattggaagagggagtgtaccggattaaacaacaaggtatctttgggaaaacacaagtaggagttggagtacaaaaagagggagtatttcacactatgtggcatgtaacaagaggagcggtattaacttataacgggaaacgactcgaacccaattgggcgtcggtaaagaaagacctaatcagttacggaggaggatggcgattatccgcacaatggcagaaaggagaggaagtccaagtcattgccgtagaaccgggtaaaaacccgaaaaactttcaaacgatgccaggaaccttccaaaccacaacgggggaaataggggcgatagcgttagacttcaaaccaggaaccagcggaagccctatcatcaacagggagggaaaagtggttggattatacggcaatggagtagtgaccaaaaacggaggatacgtttctggtatcgcccaaacaaatgctgaaccagatggcccaacaccagagttggaagaagagatgtttaagaaacgtaacctaacaatcatggacctccacccaggcagtggaaaaacaagaaaatacttgcccgctatagtacgagaagccataaagaggagactaaggaccttaatattagcgcctacaagggtcgtagccgcggaaatggaagaggccctaaaaggcttacctattagatatcagacaacagcaactaaatccgaacatacagggcgagaaatagtagatttgatgtgtcacgcaaccttcacaatgagattattatcacctgtgcgagtaccgaactacaatctaatcatcatggatgaggcccatttcaccgaccctgcttcaatagccgcacgcggatatattagtaccagggtgggaatgggagaagccgctgctatctttatgaccgcaacaccaccaggaacggctgatgcattcccccaatcgaacgccccaatccaagacgaagaaagggatataccagaacgatcttggaactcgggtaatgaatggataactgattttgctggaaaaaccgtttggttcgttccgagtatcaaagcgggaaacgatattgcgaattgccttaggaaaaatggcaaaaaggtaatacaattatccagaaaaacttttgataccgaatatcagaaaactaaattgaatgattgggactttgtagtaacaacagatatatccgagatgggagcgaattttaaggccgatagagtaatagacccaaggagatgcttaaaaccagtaatactcacggacgggcctgagcgagtaattttagcaggccctatgccagtcactgcagcgtcagccgcacaaagacgtggacgagtaggcagaaatccgcaaaaagagaatgaccaatatatctttacaggccaacccttaaataatgatgaagatcatgcccactggacagaagccaaaatgctactagacaacataaatacaccggagggtatcataccagcgctttttgaaccagagagagagaaaagcgctgcgattgacggggaatacaggctaaaaggagaatcgagaaaaacttttgttgaacttatgcgtagaggggatttacctgtctggctcgcacacaaggttgccagtgaaggcataaaatataccgaccgaaaatggtgtttcgatgggcaacgcaacaatcaaatcctagaagaaaatatggacgtagagatttggacgaaagaaggtgaaaagaagaaacttcgtccaagatggttagacgctcgaacttactctgatccactggcactgaaagaatttaaagactttgccgctggccgtaagtcaatagcgttagacctagtcaccgaaataggacgtgtgccgactcatttggcgcatcggacaagaaacgcattagataatttagtaatgctgcatacctcagaacatggaggaaaagcgtatagacatgccgttgaagaacttccggagaccatggaaactttattactacttggattaatgattcttttaacaggtggcgcaatgctatttctaattagcgggaaaggcataggtaaaacctccataggtttaatatgtgtaatagcaagttctggcatgctctggatggcagaaattccgttacaatggatcgcgtctgccatagtcttagagttctttatgatggtattgttaatcccagaacccgaaaaacaaagaactccacaagataatcaacttgcatacgtcgtaattggtattctaaccttggcagcgataattgccgctaacgaaatgggattattggaaaccacaaaaagagatttaggcatgagcaaagagccaggggtagtatcacctacttcgtatctcgacgtcgacctgcatccggcaagcgcatggaccctctatgccgtagcgacgacagtaataacaccgatgttaagacacactatagaaaattctacagcaaacgttagtctcgcggccatagccaaccaggcagtagtattaatgggtcttgataaaggatggccaataagcaaaatggatctaggtgtaccattacttgcactaggatgctactctcaggtaaatccgctgacattaacagcagcagtactgctattaataacgcattatgcaataataggcccgggtttacaggcgaaagcgaccagagaagcacaaaagaggaccgcagcgggtatcatgaaaaatccaacggtagatggaatcatgactatagacctagacccggttatctatgactcaaaatttgaaaaacagttaggacaagtaatgctcctagttttatgcgctgtccagcttctgcttatgcgaacctcatgggcactatgcgaagcactcacactagcaacggggcccataactaccctctgggaagggtcacccggtaaattttggaatactactattgctgtcagcatggccaatatatttcgaggttcctacttagccggagcaggactggcatttagcataatgaaaagcgttggaactggaaaacgggggaccggatcacagggagagactctcggagaaaaatggaaaaagaaattaaatcaactctcccgaaaagagtttgacctttataagaaatcggggataactgaagtagatagaacagaggcaaaagaaggtttaaaaagaggcgaaataacacatcacgccgtatcaagaggaagcgcgaaattgcaatggtttgttgagcgcaatatggttataccagagggtcgagtgatagacctaggatgtggaagaggcggatggtcctattattgtgcgggtctcaagaaagttacggaagtaagaggttatacaaagggaggacccgggcatgaggagcccgtaccaatgagtacatacggatggaacattgttaaattaatgtctggaaaagatgtattctatctgcctcccgagaagtgtgatacgttactatgcgatattggagagtcgagcccatccccgacagtagaggaaagtcgaacaataagggtccttaaaatggtagaaccatggctcaaaaataatcaattttgtattaaagtattaaatccatacatgcctacagttattgaacatctagagcgtttacagcgaaaacatggcggtatgctcgtacgaaaccctttatctagaaattctactcatgaaatgtattggattagtaacggaactggaaatattgtagctagtgtaaatatggtgtcaagattattactaaaccgatttaccatgactcatagaagaccgacgatagagaaagatgttgaccttggcgccggtacacgtcacgttaacgcagaacctgagacacccaatatggatgtaataggagaaagaataaaaagaattaaagaggagcatgactcaacttggcattatgatgacgagaacccttataagacttgggcataccatggatcctacgaagtgaaagctaccggttccgcatcatcaatgatcaatggagttgttaaactgctcaccaaaccatgggatgtggttcctatggttacacagatggctatgactgacaccactccgtttggacaacaaagagtattcaaggaaaaggtcgataccagaacaccgaggtccatgccaggtactcgccgtgttatgggaatcacagccgagtggctatggcgaactcttgggaggaataagaaaccgcggctttgtacaagagaagaatttactaaaaaggttcgaactaatgctgcaatgggagcagttttcacagaagaaaatcagtgggatagtgcaaaagcagctgtcgaagatgaagatttctggaagctagtagatagagagagagaactacacaagctgggcaaatgtggatcatgtgtatacaacatgatgggtaaaagagagaagaaactaggtgaatttgggaaagctaaaggttcgagagcaatatggtatatgtggttaggcgcacgttatttagaatttgaagcattaggtttccttaatgaggatcactggtttagtagagaaaattcatactcaggagttgaaggtgaggggttacacaagctcggatatattcttcgagacattagcaaaatccccggaggagcaatgtatgccgatgataccgctggatgggacacaagaataacagaagacgacctacataatgaagagaaaattacacagcaaatggaccctgaacataggcaattagcaaacgcgatctttaaattgacataccaaaacaaggtcgtgaaggtacaaagaccaacgcccacaggcactgtaatggatataatcagccgaaaggatcaaagagggagcggacaagttggaacttatggactaaacacattcaccaacatggaagcacaactcatacgacaaatggaaggggaaggagtattatcgaaagcggatttagaaaatccacatctaccagagaagaaaatcacgcaatggctagagacaaaaggggtagagaggctcaaaaggatggcaatatcgggtgatgattgcgtagtaaagccaatagatgaccggttcgcaaatgcgttactggccctgaatgatatgggcaaagtacgtaaagatattccccaatggcaaccctccaaaggatggcatgattggcagcaagtacccttttgctcacatcacttccatgaattaattatgaaagacggacgaaaattagtagtcccatgtcgtccccaagatgaactaataggacgagcacgaatatcccaaggtgccggatggagtctccgagaaacggcctgtttagggaaggcatatgcccagatgtggtcactaatgtactttcatagaagggacttaagacttgcatccaatgccatatgctccgcagtaccagttcattgggttcccacgagtagaacaacgtggagtatacacgcacatcatcagtggatgacgacagaagatatgctaacagtctggaacagggtttggatagaagataatccttggatggaagataagactcctgtaaccacatgggaaaacgtaccgtacttaggcaagcgagaagatcaatggtgtggaagtctaataggattaacatcccgtgctacctgggcacaaaacatccctactgccattcagcaggttagaagcctaattggaaatgaagaatttttagactatatgcctagtatgaaacgctttcgaaaggaggaagagagtgaaggagcgatttggtaa

SEQ ID NO: 23046 - RNA, 9873 nt, synthetic construct
  misc_feature 1..9873: note = derived and/or modified CDS sequence (opt6) from DENV-3__FJ850080__SS-prME
  source 1..9873: mol_type = other RNA
acatctttatgcctgatgatgatcttaccagcagcgctggcgtttcatctaacgagtagggatggagagccacgcatgattgtcggtaaaaacgaaagagggaaatcccttttgtttaaaacagcaagtgggataaacatgtgtactttgatagcaatggatcttggagagatgtgcgacgatacagtgacatacaaatgcccacacatcacagaggtagagcctgaggatattgactgttggtgcaacctaacatccacttgggtaacttatggtacatgcaaccaagctggagaacatcgtagggataaaaggagcgttgctttagctccccacgtcggtatgggactagatactagaactcaaacttggatgtcagcagaaggagcatggaggcaagttgaaaaagtggaaacatgggcactaagacacccgggattcacaatcctagcactctttctggcacattacataggaacttccctgacacaaaaagttgtaatatttatattactgatgcttgtaacgcctagtatgacaatgcgctgtgtcggtgtaggtaacagggactttgtagagggactttctggggcaacgtgggtcgacgtcgtcttagaacatggaggatgtgttactaccatggccaaaaataaaccgacactcgatatagaattacagaaaactgaggcaacacaattagcaactcttaggaaactctgcattgaaggaaaaattacaaatattacaactgattcgagatgtcctacacaaggcgaggcagttctgccagaagaacaagatcaaaattacgtatgtaaacacacttacgtcgacagaggctggggtaatggttgcggactgttcggaaaaggttccttggttacttgcgcaaaatttcaatgtttagaaccaatagagggaaaagtagttcaatatgaaaacttaaaatacaccgtaataataaccgtgcataccggtgatcaacatcaggtaggaaacgaaacacaaggtgttacggcagaaattaccccacaagctagcacaactgaagccattttaccggaatatggaacactaggactagaatgttcccctcgaactggtcttgattttaacgaaatgatacttctgactatgaaaaataaggcttggatggtccacagacaatggttctttgacttaccgttaccgtggacctcaggagctactaccgaaacaccgacatggaacagaaaagaactgttagtcacgtttaaaaacgcccatgccaagaaacaagaggtagtagtattaggttcccaagagggtgcaatgcacacggccttgaccggcgccaccgaaatacaaaattcgggaggaacaagcattttcgcagggcacttgaaatgtcgtctaaagatggacaaacttgaactaaagggaatgtcatacgcaatgtgtactaacaccttcgtcctaaagaaagaagtgtccgagacgcaacatggtacaattttaattaaagtggaatataaaggagaagatgcaccgtgcaaaattccattttcaactgaagacgggcaagggaaggcgcataatggaagactaattactgctaatccagtagtaaccaagaaagacgaaccagtaaatattgaagcagaaccgccctttggcgaaagtaatatagttatcgggataggcgataacgcactaaaaattaattggtataagaaaggctcaagtataggcaagatgttcgaagctacggctagaggcgccaggcggatggcaatactaggtgacacagcatgggacttcggaagcgtcggaggtgtgctaaattctttaggcaaaatggtacatcaaatattcggaagcgcatacacggcattgttcagtggcgtcagttgggttatgaagatcgggataggagtccttcttacatggatcggcttaaactccaaaaatacgagtatgagctttagttgtatagcaataggaattataactctttacttgggcgctgtagtacaagcggatatgggctgtgtaatcaactggaaaggtaaagaactaaaatgtggtagtggcatcttcgttacgaacgaagtacatacttggacagaacagtacaagtttcaagcagattcacccaagcgtttagcaaccgccatagccggtgcatgggaaaacggagtatgtggaatcagaagtacaacacgcatggaaaacctactgtggaaacaagtagcaaacgaactaaactatatcttatgggagaacaatatcaaactcacagttgtagtaggtgatataatcggagtcttggagcaaggaaaaagaacacttacgccacaaccaatggaacttaaatactcctggaagacctggggcaaagctaagatagttacggccgaaactcaaaattcatcattcatcatcgatggacccaatacgccagaatgtccttcagcaagtcgagcctggaatgtatgggaagttgaagattacggttttggagtttttacgacaaacatatggttgaaattaagagaagtatacacacaactatgcgaccaccgactaatgtctgcagcagtaaaagacgaacgtgcagtacatgcggatatggggtactggatagagtcccagaaaaatggttcatggaaacttgaaaaggcaagcctgatcgaagttaagacgtgtacctggcccaagagccatactctctggtcgaatggtgtcttggaaagtgatatgataattccaaaaagcctcgccggtcctatatctcaacacaaccatagaccaggataccacacacagacagcgggcccttggcatttaggaaaattagaattagacttcaattattgtgaaggcacaactgttgtaataacggaaaattgtggaactaggggcccttcgttacgtactacaacagtgagcggtaagctcatacatgaatggtgttgtcggagttgtacacttcctccattgaggtacatgggagaggatggttgttggtacggcatggaaataagaccaatatccgaaaaggaagagaatatggtgaagtccctggtatctgccggaagtgggaaagtagacaacttcacaatgggcgtgctgtgtttagcaatactttttgaggaagtgatgcgtggaaaatttggcaagaaacatatgattgccggagtattcttcatgtttgtacttttactatctggtcaaataacatggagagacatggcccacacattgattatgataggctccaatgcttcggataggatgggtatgggcgtaacatatctagcactaatagcgacatttaaaatacagcccttcctagctctaggattctttcttcgtaaactcactagccgtgaaaaccttttactaggtgtcggtcttgcaatggccacaacgctccaactacccgaagatatcgaacaaatggcgaatggaatcgcgttgggtctcatggcactaaagctaattactcaattcgaaacatatcaactctggaccgcactcataagtctcacctgttcaaatacaatgttcaccctaaccgtcgcatggagaacagcgaccttaatactcgccggtgtatcactactcccggtttgtcagagttcatcaatgagaaaaaccgactggttaccaatggcagttgctgctatgggggtacctcctctgcctttattcatttttagcctaaaagacacattaaaaagaagatcgtggccactaaatgaaggtgtgatggctgttggtctagtcagtatactagcgagctccttactacgtaacgacgtcccaatggccggtcccttggtagctggaggcttgctaatagcctgttacgtgattacgggcacctccgcagatttgactgtagaaaaggcagcagatatcacatgggaagaagaagccgaacagacgggggtgagccataaccttatgattacagttgacgatgatggaactatgcgaattaaggatgatgaaactgaaaatattttgacggtcttacttaaaactgcactcttgattgtatccggggtgtttccgtatagtataccagcgacattgctggtttggcatacgtggcaaaaacaaactcagcggagcggcgtcctatgggacgtgcctagtcccccggagacacaaaaggccgaactcgaagaaggggtatatagaataaaacaacaaggaatttttggtaaaacccaagtaggcgttggtgtacagaaggaaggagtattccataccatgtggcacgtgactagaggtgcagtcctgacatataatggaaagaggttagaaccaaactgggcgagcgtaaagaaagacctcatatcttatggtggcggttggaggctcagtgctcaatggcaaaaaggggaagaagtacaagtaatagccgttgaaccaggcaaaaaccctaaaaactttcaaacaatgcccgggacatttcaaacaacgacaggtgaaatcggagcgattgctctagacttcaaacctgggacatcaggtagtcctataataaacagggagggcaaagttgtcggattatacggcaatggagttgtaaccaaaaacggaggctacgtcagcgggatcgcccaaaccaacgcagaaccggatggacctacgccagaattggaggaagaaatgtttaagaaacggaacttaactattatggacttacacccaggatcaggtaagacccgcaaatacttaccagcgatagtccgtgaggcgattaaaagacgattaagaacacttatactagcacctactagagtagtggcagctgaaatggaagaagcgctgaaaggcttgccaataagataccaaaccactgctaccaaatcagaacacacagggagagaaattgtggatttaatgtgccatgcaactttcactatgcggttactgtcaccagtccgtgtaccaaattacaacttaataataatggatgaagctcactttacggatccagctagcatagcagcaagaggttatatctctactcgagtaggaatgggtgaagcggcggctatattcatgacagctacacctcctggaacagcagacgcttttcctcagagtaacgctccaattcaggatgaagaaagggacatacctgaaagaagctggaactcaggaaatgaatggataactgatttcgcaggaaaaacagtctggttcgttcctagtataaaggctggcaatgacatagctaactgcctacgcaaaaatgggaagaaagtgattcagttatcacgcaaaacgttcgacacggagtaccagaaaacaaaactaaacgactgggattttgtagtaacaactgatataagcgaaatgggagcaaattttaaagcggatcgagtaatagatcctcgtagatgcttaaagccagtaattcttaccgatggtccagaacgagtgatactagcggggcctatgcccgtgacagctgcttcagcagcccaacgtaggggtagagtaggccgtaacccacaaaaagaaaatgatcaatacatatttacaggacaaccgctaaataacgatgaagatcacgctcactggacggaggctaagatgctgttagataatattaatactccagaaggtatcatacctgcactattcgaaccagaacgagagaaaagcgcagctatcgatggggaataccgtctaaaaggcgaatcaagaaagacttttgtcgagctgatgcgtagaggagatctcccggtatggttagcgcataaggtagcaagcgaagggattaagtacaccgaccgtaaatggtgctttgacggacaaagaaacaatcagatacttgaagagaacatggacgtggaaatttggacaaaagaaggagagaagaagaaactacgtcctcgatggctagatgcccggacatatagtgaccctttagcattaaaagagtttaaagattttgcggctggccgcaaatctatcgccctggatctcgtcactgaaatcggtcgcgtaccatcccacctagcgcatagaaccagaaacgcactggataaccttgtaatgcttcatacttcagagcacggtggtagggcgtatcgtcatgccgtagaagaattaccagaaacaatggagaccttattattactgggtttaatgatcttactcactggcggggctatgttgtttctaatatcaggcaaaggaataggtaaaacgtcaatcggactgatttgtgtcattgcgtcatctggtatgctttggatggcagaaattccacttcagtggattgcttctgcgattgtattggagttcttcatgatggtacttctaattcctgagccagaaaaacagcggacaccacaggacaaccagctagcctacgtcgtcataggcatactcacattagctgctataatcgcggcaaacgagatgggattactcgagaccacaaaaagggacctaggcatgtcaaaagaacccggtgtagtctcgcctacatcttatctggacgtggaccttcatccggcttccgcttggacattatacgcggtagcgacaacagttattacccctatgttaagacatacaatagaaaacagtactgcaaacgtaagtctcgcagctatagctaatcaagcagttgtactaatgggtttagataaaggatggcctatcagtaaaatggacctaggagttccgctactagccttaggatgttattcacaagtaaatcctcttacactaactgcagcagtattactattaattacgcactatgcaataatcgggccaggactgcaggccaaagcaaccagagaagctcaaaaacgaaccgctgcaggtataatgaaaaatccaacagttgatgggataatgaccatagatctcgatccggtgatatacgattcaaagttcgagaagcagttgggacaagtcatgctcttagtattgtgtgcagtacaacttttactaatgcgaacatcctgggcattatgtgaggctcttacactagcgactggccctataacaacactctgggaaggctccccaggtaaattctggaatacaacgatagcagttagtatggcgaatatattcagagggagttatttagctggtgcaggactagcattctcaataatgaaatccgttggaacaggaaaaaggggcactggaagtcagggtgaaaccctcggcgaaaaatggaagaagaagttgaatcaactaagcagaaaagaatttgacctatataagaaatctggaataactgaggttgaccggacagaagccaaggagggattgaaacgaggtgaaaccacccatcatgccgtgtccaggggatctgctaaactacaatggttcgtagaacgaaatatggtaatacctgaagggcgtgtaattgatctaggctgcggaagaggcgggtggtcatattattgtgctggactaaagaaagtaactgaagtccggggttatacaaaaggtggaccagggcatgaagaacccgtacctatgtctacttatggatggaatatcataaaattaatgtccgggaaagacgtgttttatctacctcctgagaaatgcgacacgctcttgtgtgacatcggcgaaagttcacccagtccaacggtagaagaatcaaggacaattcgagtattgaaaatggttgaaccatggctcaaaaacaatcagttttgtataaaaattctaaatccttacatgccaactgtaattgaacacttagaaaggttgcagagaaaacatggcggtatgttagtgagaaatccactatcacgtaactcaacccatgagatgtactggatttcaaatgggaccggcaacattgttgcatctgtgaacatggtgagtcgtttgcttctgaatagatttacaatgacgcacagaagaccgacaatcgagaaggatgtagaccttggggctggaactcgacatgtaaatgcggaacccgaaacacctaatatggatgtaataggagaaaggattaaacgaataaaagaagaacataatagcacgtggcattatgacgatgagaatccctacaaaacatgggcgtaccacggtagctacgaagtgaaggcgactggtagtgcaagctcgatgataaatggtgttgtgaaattgctcacaaaaccatgggatgtcgtgccaatggttacgcaaatggctatgacagataccacaccattcggacaacagcgcgtattcaaagagaaagtagacactagaacccctcgctcaatgcccggaacacggagggtaatgggcataactgcagaatggttatggcgaacccttggtaggaataagaaaccaagactgtgtacccgtgaagaatttaccaagaaagtaaggacaaacgcagcaatgggggcagtgtttactgaggaaaaccaatgggattcagcgaaagcagctgtggaagacgaagatttttggaaattggtagacagagagagagaactacacaaactcggtaaatgcggatcctgcgtctataacatgatgggtaagagagagaagaagctcggggagtttggaaaggctaagggtagtcgtgccatatggtatatgtggctaggggcaaggtacctagaatttgaagctctaggatttctcaatgaagatcattggtttagtagagaaaattcctattcgggagtagagggcgaaggtctccataaactagggtacatattaagggacatatcgaaaattccaggtggtgccatgtacgccgacgatactgcaggctgggatacacgaatcacggaagatgatctacacaatgaagagaaaataacacaacaaatggaccccgaacacagacaattggctaacgctattttcaagctaacctaccaaaacaaagtagtaaaagttcaaaggccaacaccgaccgggacggttatggatatcataagtagaaaagatcagagaggatctggacaagtggggacgtacggattgaatacttttacaaacatggaagcgcagttgatacggcaaatggaaggcgaaggggtgctaagcaaagccgatttagagaaccctcatttaccggagaagaaaataacacagtggttagaaacgaaaggtgtcgaaagattaaaaagaatggcaataagtggagacgattgcgttgtaaaaccaatagacgaccgtttcgcgaacgcattacttgccctcaacgacatgggaaaggtaaggaaggatatacctcagtggcaaccgagcaaaggatggcatgactggcaacaggtccccttttgctctcatcacttccatgagttaattatgaaggatggaaggaagctcgtagtcccatgtaggcctcaagacgaattaataggtagagcaaggatatcgcaaggggccggatggtcgttaagagaaacagcctgcctaggcaaagcctatgctcagatgtggagtttaatgtacttccatagaagggacctgagactggcctcaaatgcaatttgcagtgctgtaccagtccactgggtaccgaccagccgaacgacctggtccatccatgcgcaccatcaatggatgaccaccgaagatatgctaacagtctggaacagggtttggatagaagataatccttggatggaagacaaaacacctgtgactacctgggaagacgtaccttatctcggaaaacgcgaagatcaatggtgcggttccttaattggattaacgtcacgtgccacctgggcacaaaatattcctacagcgatccagcaagtaaggagcctaatcgggaacgaagaatttctagactatatgccaagtatgaaaagatttcggaaagaagaagaaagtgaaggagctatttggtaa

SEQ ID NO: 23047 - RNA, 9873 nt, synthetic construct
  misc_feature 1..9873: note = derived and/or modified CDS sequence (opt6) from DENV-3__FJ850083__SS-prME
  source 1..9873: mol_type = other RNA
accagtttatgcctcatgatgatattaccagccgcacttgcgtttcatttaacttcaagagatggagagcctagaatgatagtgggtaaaaatgaaagaggaaaatcactccttttcaaaactgcctcgggaataaatatgtgtacactaatagctatggacctaggagaaatgtgcgacgatacagttacatacaaatgcccgcacattacggaagtagaaccagaggatatcgactgttggtgtaatctgacaagtacatgggtgacttatgggacatgtaaccaagcgggagaacatagaagagacaaacgatctgtagcactggcaccgcatgtgggcatggggttagacacacgaactcaaacatggatgagcgcggaaggggcgtggagacaagttgaaaaagtagagacatgggcactccgacacccaggattcactatcttagcactattcctcgcacattacattgggacaagtctaacgcaaaaagtagtgattttcatactgcttatgctagtgaccccatcaatgacaatgaggtgtgtgggtgtcggaaaccgagatttcgttgaagggttgtcgggtgcaacatgggtagacgttgtactagagcatggtggatgtgttaccacgatggcgaaaaacaaaccaactttagatatagagctccagaaaacggaagcaacccaactcgctaccttacgaaaattatgcatagagggcaaaataaccaatattacgacagatagtaggtgtccaacacaaggagaagcagtcttaccagaggaacaagatcaaaactacgtatgtaaacatacatatgtagataggggctggggaaatgggtgtggcttattcggtaaaggaagcctagtaacatgcgcaaagtttcagtgcttagaaccgatcgaaggtaaggtcgtgcaacatgagaacctgaaatatacagtaattataacagtccatacaggcgatcaacaccaagtgggaaatgaaacacagggcgttacagctgagatcactccgcaagcaagcaccacggaagcgatcctacctgagtatgggacattaggactcgagtgtagtcctcgtactgggctggattttaatgaaatgattctactcactatgaaaaataaggcttggatggtacacagacaatggtttttcgacctgcctttaccatggacaagtggggccacaaccgaaactcctacttggaacagaaaggagctattagtgacatttaagaatgcccatgccaagaaacaagaagtagtcgtattaggatcacaagaaggcgcaatgcatacagcgttgacaggagcaacagaaatacaaaattctgggggaacaagcattttcgctggacacctaaaatgtagactaaagatggacaaactagaactgaaggggatgagttatgcaatgtgcacaaacacgttcgttctgaagagagaagtatcagaaactcaacatggaaccatattaataaaagttgaatataaaggagaagatgcaccatgcaaaataccattctctactgaagatggacaaggaaaagcgcataacggtcggttaataactgccaaccccgttgtaactaagaaagacgaacccgtaaacatagaagcggagccgccatttggtgagtccaatatcgtgataggtataggggataatgcactaaagataaactggtacaagaaaggatcgagtataggaaaaatgttcgaagcgactgcaaggggagcaagacggatggctatacttggcgacaccgcatgggatttcggatcagtgggtggagtactaaacagtttagggaaaatggtacatcagatattcggcagcgcatacacagccttattcagcggggtaagttgggttatgaaaataggaattggggtattgctgacgtggatagggttaaatagtaaaaataccagcatgtctttcagttgcatagcgattgggactataacgctatatttaggggcagtagtgcaagcagatatgggatgtgtaatcaactggaaaggaaaagaattaaaatgtggatcgggaatattcgtaacaaatgaagtacatacatggacggaacaatacaaattccaagcagattcaccaaaacgattagccactgcaatagcaggagcttgggagaatggagtctgcgggattcgaagcactacacgtatggagaacctgctgtggaaacaaattgcaaacgaattaaactacattctctgggaaaataacataaaactaacggttgtagttggcgatattataggagtactagaacagggtaaaagaacactgactccacagcccatggagcttaaatattcatggaaaacatggggaaaagcaaaaatagtaactgctgaaacacaaaacagttcatttattatcgatggccccaatacacctgaatgcccttctgcctcacgcgcctggaatgtctgggaagttgaggattacggttttggagtgttcaccacaaacatctggttgaaactacgggaagtatacacgcaactatgcgaccaccgtttaatgtcagcggcagtcaaggatgaacgagctgttcacgctgacatgggatattggattgagtcacagaaaaacggaagctggaaattagaaaaagcctccttgatagaagtgaaaacatgtacttggcccaaatcacacacactatggagcaatggtgtactagaatccgatatgatcatacccaaatctttggcaggtcctataagtcaacataaccatcggccaggatatcatactcaaacggccggtccttggcatttgggaaaacttgaattggattttaactactgtgaaggcacaacggttgtaataactgaaaattgcggaacaagaggcccctcactcagaacaaccaccgtaagcggaaaactaattcatgaatggtgttgcagatcttgtactctaccaccattgcgttacatgggagaggatggatgttggtatggaatggaaattagacccatatcagaaaaagaagaaaatatggtgaagagtctagtaagtgcaggaagcggaaaagtagataacttcaccatgggagtgttatgcttagcaatcctatttgaagaagtgatgcgaggcaaatttggtaaaaagcatatgatagcaggggtcttctttacgtttgtactattgctatcaggtcaaatcacgtggcgcgatatggctcatactttaataatgatagggagtaatgcttctgacagaatgggaatgggagtaacttacttagctctaattgcaacattcaaaatacaaccatttctagcactaggtttcttccttagaaaactaacctccagagaaaatcttctgctgggggttggactagccatggcaaccacactccaacttccagaagatatagaacaaatggcaaatggaatagctctggggcttatggcattgaaacttataacacagtttgaaacctatcaattatggaccgctctcatctcactaacatgttctaacacaatgtttacgctaacagttgcatggagaacggcaaccctcattttagccggcgtttcacttttgccagtttgccaaagtagtagtatgcgaaagaccgattggcttccaatggcagtggctgcaatgggcgtacctcctctgccattgttcatattttctttaaaagatacattaaaacgaagatcctggcctcttaacgagggtgtcatggccgtcggcttggtatctatactcgcatcttccttactacgtaacgacgttcccatggcggggcctctcgtagccggaggcttgttgatcgcttgttatgttataacaggaacatcggcggacttaacagtcgaaaaagcagctgatatcacttgggaggaagaagcagaacagactggcgtgagtcataacctcatgattactgtagacgatgatggaacaatgagaataaaagatgatgaaacagaaaacatactaacagttctgttgaaaactgctctgctaatagtatccggagtgtttccatatagcatacctgccactctcttagtgtggcatacttggcagaagcaaacacaacgatcaggggtcctatgggacgtcccaagccctcccgagacccagaaggccgaactagaagaaggtgtttaccgaataaaacaacaaggaatattcggaaaaactcaagtgggtgtcggtgtacaaaaagaaggcgtatttcacaccatgtggcacgtaactcgaggcgcagtgttgacatataacggtaagagattagaacccaattgggctagtgtcaagaaagacttgatctcgtacggagggggttggagattaagtgcacagtggcaaaagggtgaggaggttcaggtaatagcagtggaaccgggaaagaatcccaaaaattttcaaaccatgcctggcacatttcaaacaacgactggagaaataggtgcaatagcgctagatttcaagcctggcaccagtggatctccaattattaatagagagggaaaagtcgtcgggctatatggcaatggagtggtcactaagaatgggggatacgtttcaggtattgcacaaactaatgcagagccagacggtccaacaccagaattggaagaggaaatgtttaagaaaaggaatttgacaattatggatcttcatccaggatcaggtaaaacaagaaaatatttaccagcgattgtaagagaggctataaagagaagactacgcacgctaatcctagcaccaacacgagtagttgcggctgaaatggaagaagcactaaaaggactacctattcgatatcaaacaacggcaacaaaatctgagcacacagggcgtgagattgtagacttaatgtgccacgcaacgtttactatgagactactaagtcccgttcgagtcccaaactataacctgataataatggacgaagcacatttcactgatccagcatctatcgctgcaaggggctatataagtacccgtgtcggcatgggagaagcggcagccattttcatgacagctacgccaccaggcacagctgacgcgttccctcagagcaatgctccaatccaagacgaagaaagagatattccagaacgcagctggaatagcggtaatgaatggataactgactttgcaggtaagacggtatggtttgttccttcaataaaagccggaaatgacattgcaaactgcctacgtaaaaacggcaagaaagtcattcaactaagtagaaaaacatttgacactgagtaccagaaaactaaactgaatgactgggacttcgtagtcacaaccgacataagcgaaatgggagctaactttaaagctgatagagtaatagatccacgaagatgcttaaaaccagtgatcctcacagatggacccgagcgagtaattttggccggtccgatgcccgtaactgccgcctctgcagcccaaagaagaggaagagtaggaagaaatccgcaaaaagagaatgatcaatatatatttacaggtcagcccttaaataatgatgaagatcacgcgcactggacagaagcgaaaatgctactagacaacatcaatactcctgaaggtataatccctgccctttttgaacctgaacgagaaaagtcagctgctatcgacggagaatacagactgaaaggagaatcccgtaaaaccttcgtggagctaatgagacgaggggatttaccggtgtggctagcacataaagttgcatcagaagggataaagtatacagaccgaaaatggtgcttcgacggacagcgaaacaatcaaatcctagaggagaacatggatgtcgagatttggacaaaggaaggcgagaagaagaaactacgacctcggtggttggatgcacggacctatagtgacccattggcgctaaaggagtttaaagactttgcagccggccggaaatctatagctcttgaccttgtaaccgaaataggacgagtaccatcacatttagcgcatcgaaccagaaatgcattagacaacttggttatgctacacacaagcgaacatggcggacgagcatatagacatgcggtggaagaactacccgaaaccatggagacattactacttttaggcttaatgatattacttaccggtggggctatgttgttcttaatatcggggaaaggaatagggaaaacatccattggattaatttgcgtcattgctagtagtggtatgttatggatggctgaaattcccttgcaatggatagcctcagccatagttctcgaatttttcatgatggttctcttaatccccgaaccggaaaaacaacgaacaccacaagataatcaactagcttacgttgtcataggtatattaactttggcagcgataatagcggcaaacgaaatgggacttttagagactacaaaaagagatctagggatgtcaaaagaaccaggggtagtatcaccaacatcatatcttgacgtggacctacacccagcttccgcttggacactatatgctgttgcaaccacagtcataacacccatgttacgacatacaatagaaaactctactgcaaatgtaagtttagcagcgatagcaaatcaagccgtagtattgatgggtctagacaaaggatggccaatatcaaagatggacttaggcgtaccactcttagcattaggttgttactctcaagtaaaccctctcactctaacggcagccgtgcttcttcttataacacactatgcaataattgggccaggactgcaggcaaaagcaacccgggaagcgcagaaaaggacagcggcgggaataatgaaaaaccctacggtagacggcataatgaccattgaccttgaccccgtaatatatgactcaaaatttgagaagcaattgggacaagttatgctattggtgttatgtgccgtacagctactacttatgaggacaagctgggctctttgtgaagctcttacactagcaaccggacccattacaacactatgggagggtagtcctggtaaattttggaacacaacgatcgcggtcagcatggcgaatatatttaggggatcgtatttagcaggagctggtctggcattttctattatgaaatccgtagggactggcaaaagggggacaggatcccaaggcgaaaccttaggcgaaaaatggaagaagaaattaaatcaactaagccgaaaagaatttgatttatataagaaatcagggataacagaagttgacagaaccgaagcaaaagaaggtttaaaacgaggagaaaccactcatcatgcagtttcgagaggaagtgccaagttacagtggtttgttgaacgtaacatggttattcctgaaggccgagtaatagacctgggatgtggacgagggggttggtcatactattgcgcaggattaaagaaggtgactgaagtacgagggtacacaaaaggagggccaggacacgaggaaccggttccaatgagtacatatggctggaatattgtaaaacttatgtcaggcaaagatgtattttacttaccaccagaaaaatgcgacacactactgtgcgatataggtgaatctagcccgtcgcctacagtagaggaatccagaacaataagagtgttaaaaatggtcgaaccgtggctcaagaataatcaattctgcataaaaatactgaacccgtacatgccaacagtaatagaacatttagaaagacttcaacggaaacacggcggcatgctagtaagaaaccctttatcgagaaattcgacgcacgaaatgtattggatctcaaacggtaccggcaatatcgtagcatcagtcaatatggttagcaggcttcttctgaatcgtttcactatgacgcacagacggccaactatcgaaaaagacgtcgatttaggagccggaacacgtcatgtaaacgcagagcccgaaactcctaatatggacgtaataggcgaaagaattaaaagaataaaggaggagcacaattcaacatggcattatgacgatgagaatccgtataaaacatgggcatatcatggtagctatgaggtaaaggcaacgggctcagcgtcgtccatgataaacggggtagtaaaactcttaacaaagccttgggacgtggtccccatggtcacacaaatggcgatgactgatacaacacccttcggacagcaacgagtattcaaagaaaaagtggatacgcgcacgcctagaagtatgccaggtactcggcgagttatgggaattacagctgagtggttgtggagaacgctgggaagaaacaaaaagccaagactgtgtacaagagaggagttcactaagaaagtgagaactaacgcggcaatgggtgcagtatttacagaagaaaaccaatgggactcagctaaggccgcggtcgaagacgaagacttctggaaattagttgacagagaaagagagctacataaattagggaaatgcggcagttgcgtgtacaacatgatgggaaagagggaaaagaaactcggagaatttggcaaagcaaaaggatctagggccatttggtatatgtggttgggagcaagatacctagaatttgaagctctgggattcctaaatgaagaccactggttctcaagagaaaatagctattcaggtgtcgaaggagaagggctacacaaattaggatatattctacgtgacatcagcaaaattccaggaggcgcaatgtacgcagacgatacagcaggatgggacacaaggattactgaagacgacttacataatgaggagaaaattacacaacaaatggatcctgaacacagacagttagcaaatgcaatattcaaattaacgtaccaaaataaggtagtcaaagtccagcgaccaacgccaaccggaacggtgatggacattatttcaagaaaagaccaacgaggctctggccaagttggtacctatggcttaaataccttcacaaacatggaggctcaattgatacgacaaatggaaggagaaggggtactttcgaaagcagatctagaaaatccgcacttaccggaaaagaaaataacgcagtggcttgaaactaaaggcgtagaacgactaaaacggatggcgatttcgggagatgattgtgtggtaaaacctatcgatgatcgttttgccaatgcacttctggcattgaacgacatgggcaaagtccgcaaggatataccccaatggcaaccatcgaaaggatggcatgattggcaacaggtacccttttgcagtcaccactttcatgagctgataatgaaagatggtagaaagttggtcgtaccctgtagaccacaagatgagcttattgggagagcacgcatatcccagggtgcagggtggagtttgcgtgagacagcatgtttaggaaaggcctacgcacaaatgtggtctctaatgtatttccatagaagagacctaaggttggcgtcgaacgctatatgctccgcagtacctgtacattgggtcccgacatcaagaacaacgtggtctattcacgctcaccaccaatggatgacaaccgaagacatgctcacagtctggaatcgcgtgtggatagaagacaacccatggatggaagacaaaacaccagtcacaacttgggaggacgttccttatttaggaaaaagagaggatcaatggtgtggctcgctcatcggactaacaagtcgcgcgacttgggcacagaatatacccacggctattcaacaagtgcgctcactaattggcaacgaagaatttttagactacatgccatctatgaagcgtttccgaaaagaagaagaaagtgaaggggcaatttggtaa

SEQ ID NO: 23048 - RNA, 9873 nt, synthetic construct
  misc_feature 1..9873: note = derived and/or modified CDS sequence (opt6) from DENV-3__FJ850086__SS-prME
  source 1..9873: mol_type = other RNA
acatcattatgtcttatgatgatattaccggcagcattagctttccatttaacatcccgtgacggtgaaccgaggatgatagtggggaaaaacgaacgaggtaaatctttattatttaaaactgcaagcgggattaacatgtgcacattaatcgcaatggatcttggagaaatgtgtgatgatacagtgacatataaatgtccccatatcacagaagtagaacccgaagacatagattgttggtgcaacctcacatcgacttgggtgacatacggaacatgcaatcaagctggagaacacaggcgagataaacggagcgttgctcttgcaccacacgtaggtatgggcttagatactcgaacccaaacgtggatgtcagcggaaggagcatggagacaagtggaaaaagtagaaacgtgggcactccgacacccaggttttaccatactagctttatttttggcgcactatattggaacgtcattgacgcaaaaagtcgtcatatttatactacttatgctcgtaactccgagtatgaccatgcgctgcgttggggtagggaatcgtgactttgttgaaggtctttcaggcgctacatgggttgatgtagtcctcgaacatggaggatgtgttacgacaatggccaaaaataaaccaactctagatatagaactccagaaaactgaagcaacacaactagcaacgttacgcaaactctgcatcgaaggaaaaattaccaatataactactgatagcagatgtccgacacaaggagaggcggttctgcccgaagaacaagaccaaaattacgtatgcaaacatacatatgtagatagaggatggggaaacggttgtggcttattcggtaaaggaagtttggtcacgtgtgctaaattccaatgtcttgaacctattgaaggaaaagtagtacagtatgaaaatcttaaatacactgtaattatcacagttcacactggagatcaacaccaagtcggtaacgaaacgcaaggagtaactgcagagataacgcctcaagcatctacaacggaagcaatattaccagaatatggcacgctggggttggaatgctcgcctagagctggattggactttaacgaaatgattttgctaacaatgaaaaacaaagcatggatggtacaccgccaatggtttttcgatttaccattaccctggacctcaggggcaacgacggaaactcctacgtggaatcgaaaagaactacttgtaactttcaaaaatgcacatgccaagaaacaggaagtggtagtattaggatcacaggaaggtgcgatgcataccgctttaactggggccacagaaatacaaaattctggtgggacttcaatattcgcaggtcatttaaaatgtcggttgaaaatggacaaattagagctcaaaggtatgtcgtatgcaatgtgcaccaatacatttgtacttaagaaagaagtatcagagacacagcatggaacaatcttgataaaagtcgaatataaaggtgaagatgcaccatgcaaaatacccttctcgacagaagacggacaagggaaagcacataacggacgattaattacagcaaacccggtggtgaccaagaaagatgaaccggtaaacattgaagcggaaccacctttcggcgagagtaatattgtaataggaatcggggataatgctctaaaaatcaattggtacaagaaaggatcatcaataggaaaaatgtttgaagcaacggcaagaggcgctcgcagaatggctatactcggagatacggcatgggattttggcagtgtaggtggtgtacttaatagtttaggtaaaacagttcatcaaatctttggatccgcatacacagctttattttcaggcgttagctgggtgatgaaaataggcattggagtcttattaacttggataggattaaattccaaaaatacaagtatgtcgttttcttgcattgcgattggaattataactttatacctaggcgcggttgtacaagcggacatgggatgtgttatcaactggaaaggaaaggagctcaaatgtgggagcggaatttttgttactaacgaagttcacacatggacagagcaatacaaatttcaagccgatagtcccaaaagactggcgactgccatagctggtgcgtgggaaaatggtgtttgcggaataagaagtacaacaagaatggagaatcttctctggaaacaggtagcaaatgaacttaattacattctgtgggaaaataacataaaactaaccgtagtagtgggagacataataggagtactggaacagggaaaaagaacactaacccctcagcctatggaactaaagtatagttggaaaacctggggaaaggcaaaaatcgtgacggcagaaacacaaaatagtagtttcattatcgacggcccaaacacccctgagtgtccttcagcaagtcgagcttggaacgtctgggaagtagaagattatggttttggagtatttacaacaaacatatggttaaaactaagagaggtttacactcaactgtgtgatcatcgacttatgagtgccgcagtgaaagacgagagagccgtgcatgcagatatgggttactggatcgaatctcagaaaaatggtagttggaagttggagaaggcatcattaatagaggtaaaaacttgcacctggcctaagtcacatactttatggtctaatggtgtgcttgaaagcgacatgatcataccgaagtccctcgcgggtccgatttcccaacacaaccatcgacccgggtatcacacacaaacggctggaccttggcatttggggaaactggaattagatttcaactattgtgagggaactacagtggtcattactgaaaactgtggtactcgaggacccagcttgcgaacgacaacagtgagcggaaaattaattcatgaatggtgttgcagatcgtgtaccctaccaccactacgatacatgggagaagacggctgttggtatggtatggaaatccgccccatatcagaaaaagaggaaaatatggtcaaatctttggtaagcgcgggtagtggcaaggttgataacttcaccatgggagtactatgccttgctatattatttgaggaggtcatgcgaggcaaattcgggaagaaacacatgattgctggagttttcttcatgttcgtattattactaagtggtcaaataacatggagagacatggcacatacccttatcatgattggttcaaacgccagtgatcgtatgggcatgggagtcacctacttggctttaatcgcaacatttaaaattcaaccatttctagctttaggattcttcctaagaaagctaacgtctagagaaaaccttttgctaggcgttggattagcgatggctacaacacttcagttgccagaagacatcgaacaaatggctaacggtattgcattaggtctaatggcccttaaactaattactcagtttgaaacataccagctatggaccgctttaatctcactaacatgctcaaatacgatgtttacactgacggtcgcatggagaacagcaacgctaattttggccggtgtttcattactcccagtctgccaatctagtagtatgaggaaaacggactggttgcctatggcggtcgccgcaatgggggtaccacctctaccattatttatattttcactgaaagacacccttaaacgcagatcctggccattaaacgaaggagtaatggcggtagggctcgtatcaattttagcttcttcgctgctaaggaacgacgtaccaatggctggtccccttgtcgctggaggtctcttgattgcatgttatgttatcactggaacaagcgccgatctaacagttgagaaggccgcagacataacatgggaggaagaagcagaacagactggagtatcacacaacttaatgatcaccgttgacgacgatggaactatgagaattaaggacgatgaaaccgaaaacatacttacagttctactcaagactgcgttattaatcgtcagcggggtattcccttattccattcccgcaacactccttgtgtggcacacatggcagaagcagacacaaagatcaggagttctatgggacgtaccgagtccgccagagactcaaaaagcagaactcgaagaaggtgtttatagaattaaacagcaaggaatctttggtaaaacccaagtaggagtgggcgtacaaaaagagggcgtattccacacgatgtggcacgtgacaagaggtgcagtcttgacatataatggaaaacgattggaaccgaactgggcaagcgtcaagaaagatttaattagttatggagggggctggagattatccgcgcaatggcaaaaaggtgaagaggtccaggtgatagccgtagagccaggtaagaatcctaaaaattttcaaactatgccaggaacattccagactacaacaggggagatcggtgccatcgcgctggatttcaaaccaggcacgagtggttcgcctataatcaacagagaaggtaaagtggtaggactctatggaaacggagttgtaaccaaaaacgggggctatgtctcaggaatagcacaaacgaacgcagaaccggatggaccaacccctgaactagaggaagaaatgtttaagaaaagaaatcttactataatggacctacaccctggaagtggtaaaactaggaagtatttaccagcaattgtcagggaggcgattaaaaggcgattacgtaccttaatcttggcaccaacaagggtcgttgcagcagagatggaagaagccttaaaaggactaccaatcagatatcaaaccactgctactaaaagtgaacacacaggaagagaaatagttgatttgatgtgtcatgcaacgttcacaatgcgtcttttatcgcccgtaagagtaccgaattataacttgataataatggatgaagcgcattttacggatcctgccagtatagctgcgagaggatacattagcacacgtgttgggatgggcgaggcggccgcaatattcatgacggcaactccacctggtaccgctgacgcgtttccacaaagcaatgctcccatacaagacgaagaaagagacatacctgagagatcatggaactccggaaatgaatggattacagattttgctgggaaaactgtatggttcgtaccttctataaaggcagggaatgatatagcaaattgtttacgcaaaaacggcaagaaagttatacaactatctaggaagacgtttgatacggaatatcagaaaactaaactgaacgactgggactttgtcgtaaccactgatatttcagaaatgggtgcaaactttaaagcagatcgggttattgaccctagaagatgtctaaaaccagtaattcttacagacggaccggaacgagtaatactagcaggtccgatgcctgtaaccgcagcaagtgcagcacaaagacgcggcagggtgggaagaaatcctcaaaaggaaaatgatcagtacatatttacaggtcaaccgctgaacaatgacgaggaccacgcacattggactgaagccaagatgctactggacaacataaatactccagaagggataatccctgctctttttgaaccagagagggaaaaatcggcagcgattgatggcgaatatcgcttaaaaggcgagagtagaaagacatttgttgaactaatgagacgaggcgatttaccagtttggctcgcacataaggtcgcatctgaggggataaaatatacagataggaagtggtgcttcgatggacaaagaaacaatcaaattctagaagaaaatatggatgttgaaatatggaccaaggaaggcgagaagaagaaattacgcccaagatggttggatgcaagaacctactccgatcctttagcgctcaaagagtttaaagacttcgcggcgggaaggaagtcaatcgcgctggatctggtcactgagatagggagagtaccaagccatcttgcacatcggactcgcaatgccctagataacctagtaatgttacatacgtctgaacacgggggcagagcatacagacatgccgtagaagaactacctgaaacaatggaaactttattattgttaggtctgatgattttgcttacgggtggggcaatgttatttttaataagtggtaagggaatcggaaagacatcaataggtttaatttgtgttattgccagctctgggatgttgtggatggcagagattcctttacagtggatagcatcagcgatagtcttagagttctttatgatggtgcttctaatcccagagcccgaaaaacaaagaaccccacaagataatcaacttgcatacgtagttataggcatccttactctcgcagcgataattgcagccaatgagatgggactcttagaaacaacaaaaagagacctaggtatgtctaaagaacctggagtagtttccccgacatcctatctggatgtggatcttcatcccgcatcagcttggacattgtatgcagtggcgactacagtaataactccaatgttacgccatacaatagaaaatagtactgctaatgttagtctcgcagcaatagcaaatcaagctgtagttttgatggggttagacaaaggatggccaatatcgaaaatggatttaggcgtaccactattagccttaggatgttattctcaggttaacccactaacccttaccgcggccgttttactactaatcacacactatgctattattggtccggggttacaagcaaaagcgactagagaagcgcaaaaacgtactgcagcaggaattatgaaaaatccgacggtagacggcataatgacaatagatctagaccctgtaatctatgatagcaaatttgaaaagcaactaggtcaagttatgttacttgtgttatgcgcggtgcagttgttattgatgagaacaagctgggctttatgcgaagcgctaacgttagcaacgggccccatcacgacgttatgggaaggatcacctggtaaattctggaatacaactatagctgttagtatggctaatatctttagaggtagctacctagccggtgcaggcctagctttctctattatgaaaagtgtagggacaggaaaaagaggaaccggttcccaaggcgaaacgttgggagaaaaatggaagaagaaattgaatcaattatcacgtaaagaatttgatttatacaaaaagtcaggcattacagaagtcgatcgaaccgaagcgaaagaaggacttaagagaggagaaaccacacaccatgcagtgtcacgaggttctgcaaaattacaatggtttgtagagcgtaatatggttattccggagggaagagtcatcgacttaggttgtggcagaggaggttggtcgtactattgcgccggcctaaagaaagtgaccgaggtaaggggttataccaaaggaggacctggacatgaagaacctgttcctatgtccacatatgggtggaacataattaaactcatgtccgggaaggatgtattttacttaccacctgaaaaatgtgacactcttctttgtgatataggagagagctcacctagtcctaccgtcgaagaatcacgcacaatacgcgttctaaagatggtagaaccctggcttaaaaacaaccaattctgcattaaaatactaaatccttatatgccgacagtaattgaacacttagaacgattacaacgaaaacatggtggaatgttagtcagaaacccactttcgcggaactcgactcatgaaatgtactggatttcaaatggaactggaaatattgttgcctctgtaaatatggtttcacggctgttgttgaatagatttacgatgacacacagaagacctacgattgaaaaggatgtagacttaggagcgggcacccgtcacgtgaatgcagagccagaaactccaaatatggacgtaatcggagaaagaattaaaagaataaaagaggaacacaattccacatggcactacgatgacgagaacccttacaaaacctgggcttatcatggctcatatgaagtaaaggcgacaggatccgcatcatccatgattaacggcgttgtaaagttgttaactaaaccttgggatgttgttccaatggtaacacaaatggcaatgactgatactactccattcggccaacaaagagtctttaaagaaaaggtagacacacgtacaccaagatcaatgccgggaacaagacgagtaatggggataaccgccgaatggttatggcggacacttggtagaaataaaaagccacggttgtgcacgcgagaagaatttactaagaaagtcaggaccaatgctgctatgggtgctgtctttactgaagagaaccaatgggattcagcaaaagccgcagtagaagacgaggatttttggaaattagttgaccgggagcgagaactccacaaacttgggaaatgcggctcttgtgtatacaacatgatgggcaaaagagagaagaaactcggagaatttgggaaggcaaagggatctagagccatttggtatatgtggttaggagcgcggtatttagaatttgaggctttaggctttttaaatgaagaccactggttctctcgagaaaacagttacagtggggtggaaggtgaaggcctacataaactcggatacatcttaagagatatatctaaaatacccggcggtgcaatgtacgctgatgacacagcgggctgggacacccggattacagaggatgatcttcataatgaagagaaaataactcaacagatggatccagaacatagacagttagcaaatgctatatttaaattaacataccaaaataaagtggttaaagtacaacgtccaaccccaaccggcacagttatggacatcatctcaagaaaggatcaacgtggctcaggacaagtgggcacgtatggcttaaataccttcacgaacatggaggcacaattaatccggcaaatggaaggtgaaggtgttctatcgaaagcagacttagaaaacccacatctaccagagaagaaaataacgcaatggctggagacaaagggcgtagaaaggctaaagcggatggccatatctggcgacgactgcgtggttaaaccaattgacgataggtttgcgaatgcgttattagcattaaacgatatgggtaaagtacgcaaagatattccccaatggcaacctagcaagggttggcatgactggcaacaagtgcctttctgtagtcaccactttcacgaactaataatgaaagatggacgtaagttggtggttccatgtcgccctcaagacgagctcattgggagggcaagaatatcacaaggtgcaggatggtcattaagggaaaccgcttgcttagggaaggcttatgctcaaatgtggtctctcatgtacttccatcgccgagatttacgcctagcttccaatgctatttgtagcgctgtacccgtacactgggtaccaacgagtcgtacgacatggagtatacacgcacatcaccaatggatgactacagaagatatgctaacagtatggaacagagtgtggatagaggataatccgtggatggaggataagacgccagttacaacgtgggaagatgtaccatacttagggaaaagagaagatcagtggtgcggcagtttaataggtttgacatcaagagcaacatgggcacaaaatataccaacggcgattcaacaggtacgatccttaattggaaacgaagagttccttgattatatgccaagcatgaaaagattccgaaaagaagaggagtcagaaggcgccatatggtga

SEQ ID NO: 23049 - RNA, 9873 nt, synthetic construct
  misc_feature 1..9873: note = derived and/or modified CDS sequence (opt6) from DENV-3__FJ850089__SS-prME
  source 1..9873: mol_type = other RNA
acttctttatgtctaatgatgatcctccccgcggcattggcgttccacttaacttcgagagatggtgaaccacgcatgatcgtaggcaaaaatgaacgtggtaaatctctgttatttaaaaccgcatctggtatcaatatgtgtactcttatagccatggatttaggggaaatgtgtgacgatacagtaacatacaaatgtcctcatataactgaagttgaaccagaagatatagactgttggtgcaatttaacgagcacatgggtcacgtatggaacatgcaatcaagcgggagaacacaggagagacaaacgaagtgtagccttagctcctcatgttggaatgggattggatactcgaacacaaacgtggatgtctgcagaaggagcctggcgacaagtggaaaaagtagaaacatgggcacttcgccacccaggctttactatacttgcgttatttctggcacactacatcggaacaagcctgacacaaaaagttgtgatctttatactattaatgctcgtaaccccatctatgactatgagatgcgtcggggtgggaaatagagatttcgttgaaggtctatctggcgctacttgggtggatgtagtgttggaacatggaggttgtgtaacaaccatggctaaaaataaaccgactttggatatagaattacagaaaacggaagcaacacaattggcgactttaagaaaactttgcatagaaggtaaaattaccaatataacgactgactctcgctgtccaacacaaggagaagcggtgttaccggaagaacaagatcaaaattatgtatgcaaacatacatatgtagaccgaggttggggcaacggctgtggactatttgggaaaggatcgctggtcacgtgtgcaaaatttcaatgtctggaacctatagaaggaaaagtagttcaacatgaaaatttaaaatatactgttataataacagtccatactggtgatcaacaccaagtaggaaatgaaactcaaggggttactgcagaaataacaccacaagcctcgacaactgaagtcatattacccgaatatggaaccttaggactagaatgctcaccacgaacaggactagactttaatgaaatgatacttctaacaatgaaaaataaagcatggatggtccatcgtcaatggtttttcgacctgcctttgccatggaccagtggggctacaacagaaacgccaacatggaatcgaaaagaattgcttgtaacttttaaaaacgctcatgcaaagaaacaagaagtggtagttctcggtagtcaagaaggagcaatgcataccgccttgaccggagccacggaaattcaaaatagtggaggtaccagtatatttgcgggacatttaaaatgtcgattaaaaatggacaaactggaactcaaagggatgtcatacgcaatgtgtactaataccttcgtactcaagaaagaagtgtctgaaactcaacacggaaccatactaattaaagtagaatataaaggagaagacgcaccatgcaaaatccctttctcaacggaagacggtcagggtaaagcgcataatggaagattaattactgcgaaccccgtcgtgacaaagaaggatgaacctgtaaatatagaagcagaaccacccttcggagaatctaatatagtaataggaataggtgacaacgcactcaagatcaactggtataagaaaggttccagtataggcaagatgtttgaagcgacagctcgaggggcaaggagaatggcaatcctcggtgatacagcatgggacttcgggagcgtcggaggggtgctgaatagtttaggcaagatggtacatcaaatattcggatcagcctatacagccctgttttcaggtgtctcatgggtaatgaaagtgggcattggagtcctattaacatggatcggtttaaacagtaaaaatacgagtatgtcgttcagttgtatcgcaataggtataatcacactatatttaggagcggtagtacaagcagacatgggctgtgtaatcaactggaagggaaaagaactaaaatgcggttcagggatatttgttacaaacgaagttcacacatggactgaacaatataaatttcaagcggatagccctaaaaggcttgcgacagcaattgcaggagcttgggaaaacggcgtctgtggtatcaggagcacaacgagaatggaaaacctactgtggaaacaaatagcaaacgaattgaactatatattatgggaaaacaatataaagttaaccgtagtggttggggatataattggggttctcgaacagggaaagcgaactctaacaccacaaccaatggaactaaaatatagctggaaaacatggggaaaggccaaaatagtaacagcggaaactcaaaattctagtttcatcatcgacgggcctaatacaccagaatgtccttcggcaagcagagcctggaatgtctgggaagtggaggactacgggttcggggtattcaccacaaacatatggctgaaactccgtgaagtttatacgcaattatgcgatcatcgtctgatgtcagctgctgttaaagatgagagagctgtacatgcagacatgggatattggatagaaagtcagaaaaatggatcctggaaacttgaaaaagcatcactaattgaggtaaagacatgcacttggcctaaaagtcatacgctgtggagtaatggcgtacttgagagcgatatgataatacctaaaagtctcgcgggtcctatctcacaacataaccatcgacctggttaccacactcaaacagccggaccctggcatttaggaaagttggaacttgattttaattactgcgaaggtacgactgtcgtcataacagaaaattgcgggacaagaggaccatcactaagaaccactaccgtttcgggcaaacttattcacgaatggtgctgcagatcctgcacactgccacctttgagatacatgggagaagatggatgctggtacggcatggaaatacgaccaattagtgagaaagaagaaaatatggtaaaaagtctagtatctgctggatcaggtaaagtggataattttacaatgggagttctttgtttagcaatattgtttgaggaagtaatgagaggaaaatttggcaagaaacatatgatagctggagtattctttacgtttgttctgcttctctcaggccaaataacatggagggatatggcccacactctcataatgataggatccaacgccagtgacaggatgggaatgggagttacttatctagcactaatagcaacttttaaaattcaaccatttctagcgctaggattctttctaagaaagttgacgtcaagagaaaatctcctattaggggtgggtctggcaatggccacgacactacaactgcccgaagacatagaacaaatggctaacggaatagcgctaggactaatggctcttaaactaataacacaattcgagacgtaccaattatggacagcactaatttcacttacctgttccaatacaatgttcacactaacggtagcgtggagaaccgctactctaatacttgctggtgtctctcttcttcctgtctgtcaatcttcttccatgcgaaaaaccgattggctaccaatggccgttgcagcaatgggagtgccacctctcccattatttatattcagtctaaaagacactctcaaaaggagatcttggccactgaatgaaggtgttatggctgtaggattagtgagcatattagcaagttccttattgcgtaatgatgtccctatggctggacccctagtagcaggagggttgttaatagcatgttacgtgataactggaacatcagctgacctgaccgtagaaaaagcagctgacataacctgggaagaagaagcggagcaaacaggtgtttcgcacaatttaatgataaccgtagatgacgatggaaccatgcggatcaaagatgatgaaacagagaacatactgacagtcttactaaaaacagcacttcttatcgtctccggtgtatttccatactcgatcccagcgaccctcctagtgtggcatacttggcaaaaacagacacaacgatccggagtcttatgggacgtaccaagtcccccagagactcagaaggcggaactagaagagggcgtgtatcgaattaaacaacaagggatctttggaaagactcaggtaggtgttggggttcaaaaggaaggagttttccatacgatgtggcacgtcacgagaggagccgtactcacttacaacggaaaaagattagaacccaattgggccagcgtgaagaaagacttaatatcatacggtggaggctggagattgtcagcgcaatggcagaagggtgaagaagtacaaataattgcagtagagcccggtaaaaacccgaaaaatttccaaacaatgccaggaacatttcaaacaacgacgggagaaatcggtgccatagcattagacttcaaaccaggcacatctggatcaccaataatcaaccgtgaaggaaaggtagtaggtctgtacggaaatggcgttgtgactaaaaatggagggtatgtaagcggaattgctcaaaccaacgctgagccagacggaccaacacccgaattagaagaggagatgttcaaaaagcggaacttaactataatggatctacatccaggctctggaaaaacacgaaaatacttgccagccattgtccgcgaagctattaaaagacggctccgaactctaatactagcgccgacaagggtagtcgctgcagagatggaggaagccttgaaagggttgcccatacgctaccagacgacagcaactaagagcgagcacacagggagggaaatcgtagacttaatgtgtcatgcgacgttcacgatgaggcttctatcacccgtaagagttccaaattataatttaataatcatggacgaggcgcactttacagaccccgcaagcattgccgcaagaggttacatttccacgagagtagggatgggggaagcggcagctatattcatgacggccacgccacctggaactgcagatgcatttccacagtcaaacgcaccaatacaagatgaagaaagggacattcccgaacgatcgtggaactcgggcaatgaatggataactgacttcgcgggcaaaacagtctggttcgtaccaagcataaaggctggaaatgatatagctaactgccttagaaagaacggcaagaaagtaattcaattatcgagaaagacctttgacactgaataccagaaaactaaattaaacgactgggattttgtcgtcacgacagacatttcagaaatgggcgcaaatttcaaagctgacagagttattgacccccgaaggtgcctgaagcccgttattttgacagatggtccagaaagagttattctggcaggaccaatgccagtcacggcagcgagcgctgcgcagcggcgcggtagggtcggtagaaatcctcaaaaagagaacgatcaatatatttttacagggcagccactaaataacgacgaggatcacgcgcactggactgaggcaaaaatgttattagacaacataaacaccccagaaggaataattccagctctattcgaaccagagcgtgagaaaagcgcggcgatagatggagaatacagactcaaaggtgaaagccgtaagactttcgtcgaactaatgcgacgaggcgatctacccgtatggctcgcgcacaaggtcgcatcggaaggtatcaaatacaccgacagaaaatggtgcttcgacggccaacgcaacaaccaaatcctggaagaaaacatggatgtagaaatatggacaaaagaaggcgagaagaagaaattaagaccacgctggctcgatgctaggacatattcggacccactggcattaaaagaatttaaagattttgcagccggacgtaagagcatagcattagaccttgtcacagaaattggcagggtaccatctcacctagcccatcgaacaagaaatgctctcgataacctagtaatgttacatacaagtgaacacgggggtagggcctatagacacgcagttgaagaattacctgaaaccatggagaccttgctactactagggctgatgatacttttaacaggaggagcaatgctgttcctcatctcaggcaaggggataggaaaaacaagtatcgggcttatctgtgttatcgcttcatctggtatgctttggatggcagaaataccattacaatggatcgcaagcgcgattgtactagagttctttatgatggttttactcataccagaaccagaaaagcaacgaaccccgcaagacaatcaactagcatatgtcgtcataggtatactaacgctcgcagcaataatcgcagcaaacgagatgggactccttgaaactactaaaagagacttaggtatgtccaaagagccaggagttgtttcccctacgtcctatttagatgtagacctacatccagcctctgcatggacattatacgcggtggcgacaacggtcataacacctatgctccgacataccatagaaaatagtactgcaaacgttagccttgcagccatagcaaaccaggcagtagtccttatgggattagacaagggttggccaataagtaaaatggatctgggcgtacctttacttgcgttaggttgttattcgcaagttaatcctttaacgctaactgctgcagtcttactgctcataactcattatgctataataggccccggtttacaagcaaaagccacgagagaagcgcaaaagagaacagcagcagggataatgaaaaatccaacggtcgatggaatcatgacaatagaccttgatccagtcatctacgattccaaattcgagaaacaactaggacaggtaatgcttcttgtcctgtgcgcagtgcagttactcttaatgcgcacatcttgggctttatgtgaagcactaaccctagcaaccggaccgattaccacactgtgggaaggtagcccgggaaaattttggaatacaacaatagccgtatcgatggccaatatattccggggtagttatttagcgggggcaggcttagcattttcgattatgaaaagtgtaggcacaggtaaaagaggcactggaagtcaaggcgaaacactaggtgaaaaatggaagaagaaattgaaccaactctccagaaaagagttcgacttatataagaaaagcggcataacggaggtagatagaaccgaagctaaagaaggtctaaaacgaggtgagactactcatcatgctgtaagtagaggtagcgcaaaattgcaatggttcgtcgaaaggaatatggttattccagagggaagagtaattgacttaggatgtgggagaggaggctggtcatattactgcgccggcttgaagaaagttacagaagttagagggtacactaagggcggtccaggccatgaagaacctgtccctatgagcacgtacggatggaatattgtaaaattaatgtcgggcaaggacgtattctatttaccccctgaaaaatgcgacacattattatgtgatataggcgaatcatcaccatcccctaccgtcgaggaaagccggacaattcgagtcttaaaaatggtcgaaccctggctcaaaaataatcaattctgtattaagatactaaatccctatatgcccacagtcatagaacatttagaacgtttacagagaaaacacggtggtatgttagtaagaaatccccttagtcgcaattcaacccacgaaatgtattggatctcaaatggtactggtaacatagtagcgtccgtgaacatggtctcccgattactcttgaacagatttactatgacacatagacgcccgacgattgaaaaagacgtagatctaggtgccggcacgcgccacgttaatgctgaacctgaaacacccaatatggacgttatcggagagcggataaaaagaatcaaggaagaacacaacagtacatggcattacgatgatgagaatccatacaagacgtgggcctatcacggaagttatgaagttaaagccacagggagtgcgagttcaatgataaatggcgtcgtcaaattacttacaaaaccatgggatgttgtacccatggttacacagatggcgatgaccgacacaaccccctttggacaacaaagagtcttcaaggaaaaagtcgacactcgaacgccaagatcgatgccaggtacgcgccgcgtgatgggtatcaccgctgaatggctgtggcggactctcgggcgtaacaagaaaccaagactctgtaccagagaagaatttactaagaaagtaaggacaaatgctgcaatgggagcagtattcactgaagaaaatcaatgggattctgcaaaagccgcagtcgaagacgaggatttttggaaacttgtcgatagagaacgtgagcttcacaaattaggaaaatgtggtagctgtgtttataatatgatgggaaagcgggagaagaaattaggcgagttcggaaaagcaaaaggttcaagagccatttggtacatgtggctaggtgcaagatatctagaatttgaggctttaggattcttaaacgaagatcactggtttagtcgggaaaactcttattctggggtcgagggtgagggacttcacaagttaggttatatactacgtgatatatcaaaaataccaggcggagcgatgtatgcggatgatacagcagggtgggacacaagaataaccgaagatgacctacacaatgaagagaaaataacacaacagatggaccccgaacatagacaacttgccaatgccatatttaaattgacgtatcaaaataaggtagtaaaagtacaaagaccaactcctactgggacggtaatggacataatttctagaaaggatcaaagaggaagtggacaggttggaacttacgggttaaatactttcacaaacatggaagctcaattaataagacagatggaaggggaaggagttctcagtaaagctgatctagaaaatcctcatctgccggaaaagaaaatcacacaatggctggaaaccaaaggagtggaaaggctaaagaggatggccatttcgggagatgactgtgtcgttaaacctatagacgatcgattcgctaatgcgttattagccctaaatgatatgggaaaagtcagaaaagacatcccacagtggcagccttctaagggatggcacgattggcaacaggtgcctttttgttcgcaccattttcatgaattaataatgaaagacggacgcaagctcgtagttccgtgtaggccacaagacgaactcattggacgagctcgaatatcacaaggagctggatggagccttagagaaacggcttgcctaggaaaggcttatgcgcaaatgtggagtcttatgtatttccatagacgagacttaaggctagcttctaacgcaatctgcagtgccgttccagtccattgggtaccgacttcccgcacaacatggtctattcacgcacatcatcaatggatgaccacagaggatatgctaacagtctggaacagagtctggatcgaagacaatccatggatggaagacaaaacaccagtaacaacttgggaggatgtaccgtatcttggaaaacgcgaagaccagtggtgcggatctttaatagggctaaccagccgagctacatgggctcagaatataccaactgctatacaacaagttcgttcattaatcggcaatgaagaatttttagactatatgccgagcatgaaacgatttcggaaagaagaggaatctgaaggagcgatctggtaa

SEQ ID NO: 23050 - RNA, 9873 nt, synthetic construct
  misc_feature 1..9873: note = derived and/or modified CDS sequence (opt6) from DENV-3__FJ850092__SS-prME
  source 1..9873: mol_type = other RNA
acatcgctatgcttgatgatgattcttcctgcagcattagcatttcatttaacttctagggacggtgaaccacgcatgatagtaggtaaaaatgaacgaggaaaatccctattatttaaaactgcgtccgggataaacatgtgcactctcatagcaatggatctaggggaaatgtgtgatgatacggttacgtataaatgcccgcacattacagaagttgaacctgaagatatagactgctggtgtaatcttacatcaacttgggtaacatacggaacatgtaaccaagcgggtgaacacagacgtgataaaaggagtgttgctttagctcctcatgtcggtatgggactagacacacgaacacaaacttggatgtctgctgaaggcgcatggagacaagtggaaaaagtagaaacctgggcattacgccatccaggattcacaatattggcactttttcttgcgcactatataggaaccagcttaacgcaaaaagtagtgatttttatattattaatgttagtcactccaagtatgacaatgagatgtgtcggtgtaggtaatcgtgacttcgttgaaggattatcgggcgcaacatgggtcgatgtagtgttagaacatgggggttgcgtcacgacaatggccaaaaataaaccaacattggacatagaattgcagaaaacagaggcaactcaattagctacactccgcaaactgtgtatcgaaggtaaaattactaatataactacggatagccgatgtcccacccaaggagaagcagttctcccggaggaacaggatcaaaactacgtgtgtaaacatacatacgtagatagaggttggggtaacggatgtggactcttcggaaaagggtctttagttacatgtgcaaaatttcagtgtctcgaacctatagaaggaaaagtagtacaacatgagaacttaaaatatacggtaataataacagtgcatactggagatcaacatcaggtcggaaacgaaacacaaggtgtgacggcagaaattacaccgcaggcttcgaccactgaagtaatcctacctgaatacggcacactgggtcttgaatgtagcccgcggaccggactagactttaacgaaatgatattattaaccatgaaaaataaagcgtggatggtgcatcgacagtggttctttgatttacccttaccatggacaagtggcgtaacaacggaaactccaacatggaatagaaaagaactacttgtgaccttcaaaaacgcccacgccaagaaacaagaggttgtcgtactaggtagtcaagagggtgctatgcatacagcgttaactggagcgacagaaatccagaatagtggcgggacgtcgatattcgcgggtcatttaaaatgcagattaaaaatggataaattagaactaaaaggtatgagctacgcaatgtgtactaatacattcgttttgaagaaagaggtaagtgagactcaacatggaacaatcttaataaaagtagaatacaaaggagaagacgccccttgcaaaattccatttagcacggaggatggacagggaaaagctcataatggaaggctaattaccgctaacccagtagtaaccaagaaagatgagcccgttaatatagaggccgaaccgccgtttggagaatcgaacattgtaattggaataggagacaatgcgcttaaaataaactggtacaagaaaggtagtagcattggcaaaatgtttgaagcaaccgcaagaggtgcgcgcaggatggcaatcctaggagataccgcctgggattttggaagcgtaggcggtgtcctaaacagcttaggaaaaatggtacatcagattttcggatcagcctatacggctctattttcaggcgtatcatgggtaatgaaggttggaatcggtgtcctactaacatggataggactaaatagtaaaaatacatcaatgtcattttcatgtattgcaattggaatcataactctttacctaggagccgttgtacaggcagacatggggtgtgtcattaactggaaggggaaagaacttaaatgtggttcaggaatattcgtaacaaatgaggttcatacgtggacggaacaatacaaatttcaagcagatagccccaaaagattagcaacagctatagctggggcttgggaaaacggggtctgtggtattaggagtacgacgagaatggaaaacttattatggaaacagatagctaacgagctgaattatattttgtgggagaacaatataaaactaacagttgtggtgggtgatattatcggggtgctagaacaaggaaaaaggactctcacgccgcaacccatggagctaaagtacagttggaagacctggggaaaagcaaaaatagtaacagcagagacacagaacagttcattcataatagatggcccaaatactccggaatgtccgagtgcaagtcgtgcatggaatgtatgggaagtggaagactacggtttcggcgtttttaccacaaacatctggttaaaactaagagaagtgtatacgcaactatgcgaccatcgccttatgagcgcagctgttaaagacgaaagagcagtacacgcagatatgggatattggatcgaatcacagaaaaatggaagttggaaactcgaaaaagcatctttaatagaggtcaaaacctgcacatggcccaaaagtcacacattgtggtctaatggagtactagaatcggacatgattattccaaaaagcctagcaggccccataagccaacataatcaccgccccggatatcatacgcagactgctggcccatggcacttaggaaaacttgaacttgactttaattactgcgaaggaactacagtggttatcactgaaaactgcggtacaagaggtccctctcttagaacgacaacggtgtcaggcaaattaatccatgaatggtgttgcagaagttgtaccttgccacccttacggtatatgggagaggatggatgctggtatggaatggaaataagacccataagcgaaaaggaagaaaacatggtaaaatctcttgtgagtgcaggaagcggaaaagttgacaatttcacaatgggagtgttatgccttgcaatattatttgaagaagtaatgcgtggtaaattcgggaagaaacacatgatagcaggggtattctttactttcgtacttttattatcgggacaaattacatggcgagatatggcgcatacgctaattatgatcggttcgaacgcatcagatagaatggggatgggtgttacataccttgccctaatagcaacgttcaaaatacaaccctttctcgcattagggttctttttaaggaagctcacgtctcgtgagaatttactattaggagtaggcctagcaatggcaaccactcttcagttgccagaagacatagaacaaatggccaacgggatagctttagggctaatggcactgaaattaatcacgcaatttgaaacttatcaactatggactgcactaatcagtctgacctgttccaatacaatgttcacactaaccgtggcatggcgaacagcaactctaatattagcaggcgtctcgcttctgcctgtgtgtcaatccagtagtatgagaaaaacggactggttaccgatggccgtagcagccatgggagttcccccattaccgttattcatttttagccttaaagatacattgaagagaagatcctggcctttaaacgagggagtcatggctgtaggcctagtttctatactggccagttcactcttacgcaacgatgtccccatggcaggacccttagttgctggagggctcctgattgcatgctacgtgataacaggaacaagtgcggatctgatagtagaaaaagcagcggacattacttgggaagaggaggctgagcagacaggggtctcccataatctcatgataacggttgacgatgatggcacaatgcgtataaaagacgatgaaaccgaaaatatcttaactgtcttacttaaaacagcattactgatagttagtggagtattcccgtatagcatccctgccacactattagtttggcatacatggcaaaaacaaacacaaagaagcggtgttctatgggacgtgccttcaccaccagaaacacaaaaggcggaacttgaagaaggtgtatacagaattaaacagcaaggaatatttggaaaaacacaagttggggtcggtgtccaaaaagagggtgtttttcacacaatgtggcacgtaacgcgaggagctgttttaacttacaatggcaaaagacttgaaccaaattgggcatccgtcaagaaagatttgatctcatacggaggaggatggagattatcggcccagtggcaaaagggtgaagaagtacaggtgatagcagtggaacctggtaaaaatcccaaaaacttccaaacaatgccaggaactttccaaactacaactggagagataggagcaatagcactcgacttcaagcccggaacctcaggtagtccaataattaatagagaaggaaaagtagttggtttatatggaaacggcgtcgttaccaaaaacgggggatatgtatcaggaatcgcccaaacgaatgcagaacccgacggtcccacgcccgaactagaagaagaaatgtttaagaagagaaaccttaccatcatggacttacaccccggctcaggcaagacaaggaagtacttacccgcaattgttagggaagcaatcaagagaagattgagaacacttattctagcaccgactcgggtagtggctgcggaaatggaagaagcgttaaaaggtttacctataagataccagaccacagcaactaagtcagaacacaccggaagagaaatagtggacctcatgtgtcatgcaacgtttacaatgcgtcttcttagtccggtcagagtacccaattataatttaatcattatggatgaagcacacttcaccgatcctgcttcaatcgcagccagaggttatatcagcacccgagtgggcatgggagaggcggcagccatatttatgaccgcaaccccacctggcacagcggatgcatttccgcaatctaatgctccgattcaagatgaagaaagagatatacccgagcggagctggaactcaggaaatgagtggataacggatttcgcgggaaaaactgtatggttcgttccttccataaaggcaggtaatgacatagcgaactgtttaaggaaaaacggaaagaaggtaatacagttatcaaggaaaaccttcgatacagagtatcagaagacaaaacttaacgactgggatttcgtagtgactaccgacatctcagaaatgggtgcaaattttaaagcagaccgcgtgattgatccgagaagatgtctcaaacctgtaatcctgacagacggccctgaaagagtgatattagcaggaccaatgccggtaacagcagctagtgcagcgcaacgtaggggcagagtggggcggaatcctcagaaagaaaacgaccaatacatatttacgggacaaccattaaacaatgatgaggaccacgcacattggacagaagcaaaaatgctgttagacaatatcaatacacctgagggtataatacctgcgctctttgaaccagagagagaaaaatctgcagctatagatggggaatataggcttaaaggagaatcccgaaagacattcgtagaactgatgcgaagaggagacctcccagtttggttagcgcacaaagttgcgagtgaaggtataaaatacacagatcgaaaatggtgtttcgatggacagcgtaataaccaaatactagaggaaaatatggatgtagaaatatggacgaaagaaggagagaagaagaaacttagaccaagatggcttgatgctcgaacatattcggacccgctggcgttaaaagagtttaaagattttgcagctgggagaaaaagcatcgcattagatttagtcacagaaataggtagagtgccaagtcatttagcacatcgtaccagaaacgctctagacaatctagtgatgttgcatacctcagaacatggtggtagggcataccggcatgcagtagaggagttaccagaaacaatggagacgttactattattaggtttaatgatattactcacaggaggtgcaatgttgttcctgatatcggggaaaggaataggaaaaacatctatcgggttgatatgtgtcatagcatcaagtgggatgctatggatggctgagatcccgttacagtggatagcgtcagcgatcgtcttggaatttttcatgatggtcttacttataccagaaccggaaaaacaacggacaccgcaagacaatcaattggcgtatgttgtaataggaatattgacattagcagcaataattgctgctaacgaaatgggattattggagacgacaaaacgagacctaggaatgagtaaggaacctggcgtcgtatctccaaccagctaccttgatgtagaccttcaccccgcctctgcttggacactgtatgcagtagcgactacagttatcactcctatgctaagacatacgatagagaatagcactgctaacgtaagtttagcggctattgcaaatcaggcagtagtattaatgggactagacaaaggctggccaatatcaaaaatggaccttggtgtaccattactagcgttgggctgttatagtcaagtgaacccacttacactgaccgcagctgttctacttttaataactcattatgcaataataggcccaggcctacaggcaaaagctacacgagaggcacaaaagaggaccgcggcaggaataatgaaaaatccgacagtagacggcattatgacaatagatctagacccggtcatatacgactcaaaatttgaaaaacagctaggccaagttatgttgctagtactttgtgccgtacaactattgctgatgcgaacaagctgggcactgtgtgaagctctcactttggctacgggcccaataacaacattatgggaaggatcaccaggtaaattctggaatactactatcgctgtatctatggccaatattttccgcgggagttacctagccggtgctgggctagcgttctcaataatgaaatccgtgggaacaggaaaacgtggtaccggaagccaaggtgaaactttgggagaaaaatggaagaagaaactaaaccaattgagtcgtaaggagtttgatttgtacaagaaaagcggaataacggaagttgatcgtacagaggctaaagaaggattaaaaagaggggaaactactcatcatgcggtctcgcgcgggagtgctaaactccaatggtttgtcgaacgtaatatggtgattccagagggccgagttatagacctgggttgcgggaggggtggctggtcgtattactgtgcaggcctcaagaaagtcacggaggttcgaggttacacaaaaggcggtccaggtcatgaagaacctgtacccatgagtacatatggatggaatatcgtaaagctcatgtcgggaaaagatgtattttatctcccaccagagaagtgtgatacattactttgtgatatcggcgaatcgtccccaagccctaccgtagaagagagcagaacgataagagtgctcaaaatggtagagccatggcttaagaacaatcaattttgtataaagatccttaatccatatatgccgacagtaattgaacacttagaaagactgcagagaaaacacggaggtatgttggtgcgaaaccctctttctagaaattcaactcatgaaatgtactggatttctaacggaacaggtaatatcgtagcttcagtgaacatggtcagtcgactcctcttaaatcgattcaccatgactcaccgacggcctactatagaaaaagatgtagatttaggcgctggtactcgacatgttaatgcagaacccgagacacctaatatggatgttataggagaacgtataaaaagaataaaagaagaacataatagtacctggcactatgatgatgaaaacccgtacaaaacgtgggcgtaccatggatcgtatgaagtaaaggctacaggatcagcatcaagtatgatcaatggtgtagttaaacttctgacaaaaccatgggacgtggtaccaatggtaacccaaatggcgatgacggacactacaccgttcggacagcagcgagtcttcaaagagaaagttgacactcgcactcccaggtccatgccaggtacaaggcgggtcatgggtataactgctgagtggttatggagaacattaggtagaaacaagaaacccagattatgtacacgtgaagaatttacaaagaaagtgagaacaaatgcggcaatgggtgcagtgtttacagaggaaaatcaatgggattcagctaaagctgcagtcgaagacgaggatttctggaagttagtagatagagagagagaactgcataagctaggtaagtgtggttcatgtgtatataacatgatgggaaagagagagaagaaactcggtgagtttggcaaagctaaaggaagtagggccatttggtatatgtggttaggggctagatacctcgaatttgaggctttgggcttccttaacgaggatcattggttcagtagggaaaactcttattcaggcgtcgaaggagaaggacttcacaaacttgggtatattttgagagacatatcgaaaatcccgggaggagccatgtatgcagatgacaccgcaggatgggatacgagaatcacagaagatgaccttcataacgaagagaaaatcacgcagcaaatggatcctgaacatcgacaactggcaaatgcgatttttaaacttacttaccaaaataaggtggtaaaggttcagcggcctacgcctactggcaccgttatggatataatctcgcgaaaggaccaaagaggatctggccaggtagggacttacggattaaacacattcacgaatatggaggcacaactaatacggcagatggaaggagaaggcgtcctatcaaaagcagatcttgaaaaccctcatttaccagagaagaaaattacccagtggctagagactaaaggtgtcgaaaggctaaaacggatggccatatcaggcgatgattgtgttgtcaaacctattgatgacagatttgcaaacgcattgttggcattaaatgatatgggaaaagttcggaaagatattccacaatggcaaccttcaaaaggttggcatgattggcaacaagtgccattctgcagtcatcattttcatgaactaattatgaaagatggcaggaagctagttgtaccgtgccgcccacaagacgaactaattggtcgtgcaaggatttctcagggcgcaggatggagtctaagagaaacagcttgtttaggtaaagcatatgcgcaaatgtggagtctaatgtactttcaccgtcgtgacttgaggttagcatctaacgccatttgtagcgcagtacctgtacactgggttccaacatctcgaaccacgtggtctatacatgcacaccaccaatggatgacgactgaagatatgttaacagtatggaaccgggtatggatcgaagacaacccatggatggaagacaaaaccccggtcacaacctgggaagacgttccgtaccttggtaaacgcgaagaccaatggtgcggtagcttaatagggctgacaagcagggctacttgggcacaaaacattcccacggcaatacaacaggttcgatctctaatcggtaatgaagagttcctagattacatgccctccatgaaaagatttagaaaagaagaagaatcagaaggagcaatatggtag

SEQ ID NO: 23051 - RNA, 9873 nt, synthetic construct
  misc_feature 1..9873: note = derived and/or modified CDS sequence (opt6) from DENV-3__FJ850094__SS-prME
  source 1..9873: mol_type = other RNA
acctcattgtgcctgatgatgatcttgccagcagctttagcttttcacttaacctcaagagatggggaacctcgaatgattgtcggcaaaaacgaaagaggaaaatcattattatttaaaaccgcttctggaattaacatgtgtactcttatagcaatggatttaggggaaatgtgtgatgacactgttacatataaatgcccgcatatcacagaagtggaaccagaagatatagactgttggtgtaatctaacttcaacttgggtaacttacggaacttgtaatcaagcaggagaacacagaagggataaacggtcagtcgcacttgctccacacgttggaatgggattagacacaagaactcaaacctggatgtcggcagaaggggcttggaggcaagttgaaaaagtagaaacatgggcgttaagacaccctggtttcacaatcctggcattattcctggcacactatataggtactagcttgacccaaaaagtagtaatattcatattacttatgttagtgacacctagcatgacaatgaggtgtgtaggagttggaaaccgagatttcgtcgaaggacttagcggtgcaacatgggtagatgtagtactagagcacggagggtgtgtgacaactatggccaaaaacaaacctactttggacatagaactacagaaaactgaagctacacaattggccaccctgaggaaattatgtatagaaggtaaaatcacgaatattacaacagacagtcgttgtccaacccaaggggaggcagtcttaccggaggaacaagatcaaaattatgtgtgtaagcatacatatgtcgatagaggttggggaaacggttgtggattgttcggaaaagggtccctagtaacatgcgctaaatttcaatgtctggaaccaatagaggggaaagtggtacaatatgaaaacctaaaatataccgtaattataacagtccacactggagatcaacatcaagtgggaaacgaaactcaaggtgttacggctgagattacgccacaagcgtcaacaacagaagcaatcttaccggaatacggaacattggggctcgagtgtagtccaaggaccggattagattttaacgaaatgatcctacttaccatgaaaaataaggcatggatggttcatagacaatggttctttgatttgccattaccgtggacttcaggcgcgaccacgggaactcccacatggaatcgaaaagagctattagtcacatttaaaaatgcacatgctaagaaacaagaagttgtggtattgggaagtcaagaaggcgcgatgcacacagcactaactggcgctactgagatccaaaattcaggtggtacaagtatatttgcagggcatctgaagtgtcgactaaaaatggataaattggaattaaagggaatgtcttacgcgatgtgcacaaacacctttgtgctaaagaaagaggtttcagaaactcaacatgggacaattctaataaaggtcgaatacaagggagaagacgcaccttgcaagatcccgttcagtacggaagatggccaagggaaggcacataacggtagattaattacagcaaatccagttgttactaagaaagatgaacctgttaacatagaagcagaaccgccttttggtgaatcaaatatagttatcgggataggtgataatgcacttaaaataaactggtataagaaaggctcctcaataggaaagatgttcgaagcaacggccagaggagcacggagaatggctatattaggcgataccgcctgggatttcggtagtgtgggaggagtcctcaattctttaggcaaaatggttcatcagatattcggatcagcttacaccgctctctttagcggggtgagttgggttatgaaaatcggcatcggcgtactattaacatggattggattaaactcgaaaaatacaagtatgagtttctcgtgtattgctatagggataatcacactatacttaggagctgttgtacaggccgacatgggatgcgtggtaaactggaaagggaaagaattaaagtgcgggtcaggaattttcgttacaaacgaggtacacacctggacagagcaatataagtttcaagcggatagtcctaagaggttagctacagcaatagcaggagcatgggagaacggggtctgcgggattagatcaaccaccagaatggagaacttattatggaaacaaatcgcaaatgaattaaactatattttatgggaaaacaatatcaaattaacagtggtggtaggagatacaattggagttttggagcaaggaaaaagaacactgactccacaaccgatggaactaaaatattcatggaaaacatggggcaaagctaaaatagtaaccgccgaaacacagaatagttcatttattatagatggaccaaacacaccagaatgtccgagcgcaagtcgcgcgtggaatgtctgggaagttgaagattacggctttggggtcttcaccacaaatatatggttgaaactaagggaagtatatactcaattgtgtgatcacagactaatgagtgctgcagtaaaagacgaacgggcagttcatgcagatatgggatattggatagagtcgcagaaaaacggaagctggaaactagaaaaagcatcgctcatagaagtcaaaacatgtacctggccaaaatcccatactttatggtctaatggggtgctagaatccgatatgatcatcccaaaaagtttagcgggccctatttcccaacataattataggcctggttatcatacgcaaacggcaggaccatggcatttaggcaaactggaattagactttaattactgtgaaggcaccacggttgtcatcacagaaaattgtggaacaagaggacccagcttgcgaacaacaaccgtatctggtaaattaatacacgaatggtgttgtcggtcatgtacattacccccactaagatatatgggagaggacggatgctggtatgggatggaaataaggccgatctctgagaaagaagaaaacatggtaaaatcactggtttcagcgggatctggaaaggttgacaattttactatgggagttctgtgtttagccatactatttgaagaggtaatgagaggcaaatttggcaagaaacatatgatagccggcgtgttctttactttcgtactattactaagtggccaaataacttggagggacatggcacacactctgataatgataggtagtaatgcgtctgacagaatgggaatgggagtaacgtacttagcgttgattgcaacattcaaaattcagccattcctagccctagggttctttttacgtaaattgacatctcgtgaaaatctattgttaggtgtaggtctagctatggcaacaactctacaactgccagaagatattgaacaaatggctaacggaattgcattgggtcttatggcacttaaactaatcacacaattcgaaacgtaccaactatggaccgcacttatcagcttgacttgtagcaacactatgtttactttaacagtagcctggcgaaccgcaacactcattttagctggagtgtccctactaccggtttgccagagtagcagcatgcggaagacggattggttaccaatggcagtagcagccatgggtgtccctccactgccactatttatattttcacttaaagataccttcaaacggagatcctggccactaaacgaaggagtaatggcagttggtctggttagcattctcgcatcatctcttctacgtaatgatgtgccaatggctggtccattagtggctggagggttacttatagcttgctatgttataactggaacttctgcagatctaaccgtagagaaagcagcggatattacgtgggaggaggaagctgaacaaaccggtgtatcgcataacctcatgatcacagtggatgacgatggaactatgcgaattaaagatgatgaaacagaaaacattcttactgtcctgctgaagactgcacttctaattgtgtcgggtgtcttcccatacagtatacctgctactcttctagtgtggcacacatggcaaaaacagacacaacggtccggtgtactgtgggacgtgccctcaccacctgaaacgcaaaaagcagaacttgaagaaggtgtatacagaattaaacaacaaggaatatttggaaaaactcaagtaggagttggcgttcaaaaggaaggtgtcttccatacaatgtggcatgtcacacgaggagcagtcttaacctataatggcaaacgtttagagccaaattgggcttctgttaaaaaggaccttataagttacggaggaggatggagactttccgcgcaatggcagaagggggaagaagtccaagtaatcgccgtagaaccaggaaagaatcccaaaaacttccagactatgccaggcacattccagacgaccacgggagagattggggcaatagccctagattttaaacctggtacgagtggatcccctataataaaccgtgaaggaaaagtcgttggactctacggtaacggagtcgtaacgaaaaatggtggctacgttagcggaatagctcagactaatgcagaaccagacggtccaacgccagaattggaagaggaaatgtttaagaaaagaaatttgacaataatggatttgcatccaggctctggaaagactagaaaatatctacctgcaatagtgagagaggccattaaacgacggctgcgcactcttatattagcccccaccagagttgtagcggctgaaatggaagaagccctgaagggactgccaatcagatatcagaccacagcaacaaaaagtgaacataccggacgtgaaattgtggatctcatgtgtcatgctacctttaccatgagattgctcagcccagtaagagtaccgaactacaatttaattatcatggatgaagcacatttcacagacccggcatcaattgcagcacgtgggtacatcagtacacgcgtcggtatgggcgaagcagcagcaatctttatgacagcaacaccacctggaacagctgacgcattcccccaatctaacgcacccattcaggatgaggaacgtgatataccagagcgctcatggaacagcggcaacgagtggattacggattttgccggaaaaaccgtttggtttgtcccgtctataaaagcaggcaatgggatagctaattgcttaaggaagaatggaaagaaagtaattcaattaagtcgaaaaacatttgatacagagtaccagaaaacaaaacttaacgattgggattttgtagtaaccactgatatcagcgagatgggcgcaaactttaaggcagatagagtgattgatccaagaagatgcctgaagccagtaattctaacagatggaccagagagagtgatcttggctggacccatgcctgtgaccgccgcatcagcagcccaaaggagaggaagagttggcagaaaccctcagaaggagaacgaccagtatattttcactggccagccgttaaacaacgatgaagatcacgcacattggacagaagccaaaatgctcttagacaatataaacacgccagagggtataataccagcactctttgagccagaacgggaaaaatcggctgcgattgacggtgaatacagactaaagggggagtctaggaagacatttgtagagttaatgcgacggggcgaccttccagtatggctagctcataaagtggctagtgaaggaatcaagtacacagacaggaaatggtgtttcgatggtcaaagaaacaatcaaattttagaagaaaatatggatgttgaaatttggactaaagaaggagagaaaaagaaattaaggcctagatggttagacgccagaacgtatagtgatccactcgcactaaaagaatttaaagacttcgctgcaggacggaaaagcatagcactagacctagtaaccgaaattgggagggttccgtctcacttagcacaccgaacaaggaatgcgttagataacctagttatgttacatacatcagaacatggcggccgtgcttatagacacgcagtcgaggagttacctgaaacaatggagactttacttttgttaggtttaatgatattgttaaccgggggtgcaatgttattcctcataagcggaaaaggcataggtaaaacttctataggactaatttgtgtaatcgcttcaagcggcatgttatggatggccgaaataccactccagtggatagcgagcgcgattgttttagagttctttatgatggttctgctaataccggaaccagaaaaacaaagaaccccacaagataatcaactcgcatatgtcgtaattggaatccttactttagcggcaatcattgcggcgaacgaaatgggattattagaaactaccaaaagagaccttggtatgtccaaagaaccaggtgtcgtgagccccacaagttacttagatgtagacttgcacccggcaagcgcatggacactttatgcagttgcaactaccgttataacgccaatgcttcgacacacaattgaaaattcaacagcgaacgtatctcttgcagccatcgctaaccaagccgtagttctcatgggcttagataaagggtggcctattagtaaaatggatctgggggtaccactgttggcactaggctgttattcacaggtgaatccgctgacattgacggcagccgtcctattgctgataacacattatgcaattataggccctgggctacaagctaaagcaacaagagaagcgcagaaaaggaccgcggccggcatcatgaaaaaccccacagtcgatggtatcatgactatagatctagacccggttatttatgattcaaaatttgaaaaacaattaggacaggtaatgctattggtcctatgtgcagttcagcttctccttatgcgaacatcgtgggcactatgcgaagcactaactcttgcaacagggcctatcacgaccctctgggagggttctcctgggaaattttggaatacgacaattgcggtctcaatggcgaatatctttcgtggctcatacctagcaggcgctggattagctttctctattatgaagagtgttggcacaggaaaacgagggacaggatcccagggagaaacactcggagagaaatggaaaaagaaactaaaccagttaagtagaaaagaatttgacttgtacaagaaatctggaattacagaggttgatcgaactgaggcaaaagaaggtctaaaaagaggcgaaacaacacaccatgcagtatcacgggggtcagcaaaactccagtggtttgtcgaacgtaatatggtcatcccagagggaagagtcatagatctagggtgtggaagaggaggttggtcatattattgcgccggactaaagaaagtaacagaggtacggggatacacaaaaggcggtccaggtcacgaggaaccagtaccaatgtcaacctatggttggaacatagtaaaattaatgtctggaaaagacgtgttctatttgcctccagagaaatgcgatacacttctgtgtgacattggcgagagtagcccatcaccaactgttgaggaatctaggacgatccgtgtgctgaagatggtagaaccatggttgaaaaataatcaattttgcataaaaatacttaacccatatatgccaacggtaatagaacacttagaacgtttacaacgaaaacacggaggcatgctagtaagaaaccctttaagtcgtaatagtacgcatgaaatgtactggataagcaacggcactggaaatatagtggcgtccgtcaacatggtttcaaggctacttcttaacagatttaccatgactcataggcgacctacaatagaaaaggatgttgatttgggtgccgggacaaggcacgtaaacgcagaacctgaaactccgaacatggatgttatcggtgaacgtattaaacggatcaaagaagaacataatagcacatggcactacgatgatgagaacccttataaaacttgggcatatcatggatcctatgaagtaaaggcgacaggatcggcatcaagtatgataaacggtgtagtaaaactcctcacaaaaccgtgggacgtcgtaccaatggttactcagatggccatgacggacaccactccatttggacaacaaagagtatttaaagaaaaagtagacacccgaactcctcgatccatgccaggtactagaagagttatgggaattactgctgagtggctatggcgaactctaggccgtaataagaaaccaaggttgtgcacgagagaggagtttactaagaaagtaagaaccaatgcggctatgggggcagtatttacagaagaaaaccagtgggactcagctaaagctgcggttgaagacgaagatttttggaaacttgtagatagggaaagagaattacataaacttggtaaatgtggaagctgtgtttacaacatgatgggaaaacgcgagaagaaactaggcgaatttggcaaagcaaaaggatcccgtgccatttggtatatgtggttaggggcgagatacctcgagtttgaggcacttggtttcctaaacgaggaccattggtttagccgagaaaactcttacagtggagtggaaggggaaggattacataaacttgggtatatcttacgagatatatcaaaaattcctggaggcgcaatgtacgcagatgataccgcaggttgggatacccggatcacagaagacgatttacacaacgaagagaaaattactcagcagatggacccggagcaccgacaattagctaatgccattttcaagctcacatatcaaaataaggttgttaaggttcaaagacctacacccaccgggactgtgatggacattatatctcgtaaagaccagcgtggaagtgggcaagtaggaacatatggactgaatacgttcacgaatatggaagcacagttgatcaggcaaatggaaggggaaggagtgcttagcaaggctgatctagaaaatcctcatcttccagagaagaaaattacccaatggctcgagaccaagggggtggagcgacttaaaaggatggcaatcagtggtgatgattgcgtagtaaaaccaatagacgatagatttgctaacgctttactggctctaaatgatatgggaaaagtacgcaaagatattccgcaatggcaacctagcaaaggatggcatgattggcaacaggttccattctgcagtcatcattttcacgaactaataatgaaggacggaagaaaattagtcgtaccatgtagacctcaggatgagctaataggtagagcacgaatatcacaaggcgcggggtggtcgcttcgagagaccgcatgtttaggaaaggcttacgcccagatgtggtcattaatgtatttccatcgaagagacttaaggcttgcaagtaacgctatatgcagcgcagtaccggtccattgggtaccaacatcacgaacaacctggagcatacatgcgcaccatcaatggatgacgaccgaagatatgctaacagtatggaacagagtatggatagaggacaatccttggatggaggacaagactccggtaactacctgggaagacgtaccttatcttggtaagcgtgaggatcaatggtgcgggagcttaattggattgacttcgcgagcgacgtgggcacaaaatataccgaccgcaattcaacaggttcgtagcctaatcggtaatgaggaatttctagattacatgccttcaatgaaaaggtttagaaaagaagaagaaagcgaaggcgcgatatggtaa

SEQ ID NO: 23052 - RNA, 9873 nt, synthetic construct
  misc_feature 1..9873: note = derived and/or modified CDS sequence (opt6) from DENV-3__FJ898446__SS-prME
  source 1..9873: mol_type = other RNA
acgtcattatgtttaatgatgattcttccagcagcgctcgcctttcacctcacaagtcgggacggcgaaccacgaatgatagtaggcaaaaatgaacgaggaaaatcactcttatttaaaacggctagtggaatcaatatgtgtacacttatagcgatggacctcggtgaaatgtgcgacgacacggtaacttataaatgccctcacatcacagaagttgaacccgaagacatagactgttggtgtaatttaacttcaacatgggtgacgtatggaacatgtaatcaagctggggaacgacgaagagacaaacgtagtgtagcgttagctccacacgtaggtatgggcttagacacccgtacacagacgtggatgagtgcagagggggcgtggagacaagtagagaaagttgaaacatgggctttaagacacccaggatttacaattttagcattatttctcgcacactatataggtacatctttaacgcaaaaagtggtaatctttatattattaatgctcgtaacaccttctatgacaatgagatgtgtgggtgtaggtaaccgagattttgtcgagggtctttcaggagctacatgggtagatgttgttttagaacatggaggctgtgtaacaactatggcgaaaaataaacccaccttagacatagaattacagaaaactgaggctacacaattagctactctgagaaaactttgtatagaaggaaaaattaccaatattaccacggacagtcgttgtccaactcaaggagaggcagttttaccagaggaacaagaccaaaactatgtatgtaaacacacatatgttgatcggggttggggaaatggctgcgggttgtttggcaaaggaagtcttgtgacctgcgctaaattccaatgccttgagcccatcgaaggaaaagtagtacaatatgaaaatttaaaatatacagtgataataacggtacatactggtgaccaacatcaagttggaaatgagacgcaaggagttaccgctgaaataactccacaagcatcaacaacggaagcaattttacccgagtatggcacactaggattagaatgttcgcccagaacaggacttgattttaatgaaatgatattattgacaatgaaaaataaagcctggatggtacatagacaatggttctttgacctgccgctgccctggacttcaggagctacaacagaaacgcccacatggaataggaaagagctattagtcacctttaaaaatgctcacgctaagaaacaagaagtcgtggtattgggcagtcaggaaggcgcgatgcacacagcgctcacaggagcgacagaaatacagaactcgggcggaacatcaatattcgcaggtcacctaaaatgcaggctgaaaatggataagctagaactaaaaggaatgagttacgccatgtgtacaaacacgtttgtgctaaagaaagaagtaagcgagactcaacacggaactattctcataaaagtagaatataaaggagaagacgcgccttgtaaaatacctttttcgacggaggacgggcagggaaaagcccacaatggtagattgataacggcaaatccagtagttactaagaaagaggagccggtaaatatcgaagcagaaccaccatttggcgagagtaacatagtcattggtaccggtgataacgcacttaaaattaattggtataaaaagggaagtagcataggaaaaatgtttgaaacgacggctagaggtgcaagaagaatggcaatactaggagatacagcttgggactttggttcagtgggtggagtactaaatagcctagggaaaatggttcaccagatcttcgggtctgcatataccgcactattttcaggcgtgagctgggtcatgaaaataggcataggtgtcctattaacctggattgggctaaactctaaaaacacatccatgtcgtttagttgtatcgccatcggaattattactttatatttaggagccgtagtacaagcagacatgggctgtgtcataaattggaaaggtaaggaattaaaatgtggtagcggcatctttgtaacaaatgaagtgcatacgtggacggagcaatataaattccaagcggattcccctaagcgattagcaacagcgattgccggagcatgggagaatggtgtatgcgggataagaagtactacgcgtatggaaaacctattatggaagcaaatagcaaatgaattaaactatattctttgggaaaacaacataaaactaaccgttgtagtaggcgatataatcggagtattagaacaaggaaaacgcactctaacaccacaaccaatggaattaaaatactcgtggaaaacttggggaaaagcaaaaattgtcacagcagagacacaaaattcatcgtttataatcgatggtccaaacactccagaatgtcctagcgcaagccgtgcatggaatgtatgggaagtcgaagactatgggttcggtgtcttcacgacaaatatatggctgaaactacgtgaagtatatacacaactttgcgatcatcgactaatgtcagccgcagtaaaagatgaacgagctgttcacgcggatatgggttactggatagaatcccagaagaacggctcatggaagttagaaaaagcatcattaattgaggtaaagacttgtacatggccaaaatcacatactctatggtctaacggcgtattggaaagtgacatgataatcccaaaaagccttgcgggccccatatcacaacacaaccatcgcccaggttatcacacccaaacagcaggaccctggcatctgggaaagctggaattggactttaactactgcgagggaactacggtggttatcactgaaaactgtggaacacggggcccgagcttaagaactaccacagtctctggcaaacttattcacgaatggtgctgtagatcttgcacgcttcccccattaagatatatgggagaggacggttgctggtatggtatggaaatcaggccaatatccgagaaagaagaaaatatggtaaagagcttggtgagtgcagggagtgggaaagtagataactttaccatgggggtactttgcttagctattttgtttgaggaagtaatgcgtggaaaattcggaaagaaacatatgatagctggcgtgttctttacattcgttctacttttgagtgggcaaattacgtggcgggatatggctcacacactgataatgatcggaagcaatgcaagtgatcgtatgggtatgggtgtaacctatttagcactaatagctacgttcaaaatccaaccgttcttggctctggggtttttcttgagaaaacttacatcgcgagaaaatctgctcttaggtgtgggcttggccatggctacaacactccaacttcccgaagacatcgagcagatggcaaatggcatagcacttgggttaatggcactcaaacttattacacagtttgagacctatcaactatggactgcacttatctcgttaacttgcagtaatacaatgtttacattaacagtggcttggcggacggcaactctaattttagcaggggtttcattattaccagtatgccaaagttctagcatgaggaaaacagattggcttccaatggcagttgccgcaatgggcgtacctccattgcctttatttatattctcactaaaagacacgcttaaaagaagaagctggcctttgaacgagggggtcatggccgtagggttggtgtcaatactagcctcttcattgcttagaaacgatgtacctatggctggtccgttagtagcaggcggcctactaatcgcttgttatgtgataacaggcacttcagcagatttgactgtcgaaaaagcagctgatataacgtgggaagaagaagcagaacaaactggtgtatcccataatctaatgatcacagtggatgatgatgggacaatgagaatcaaagacgatgagacagaaaatatactaactgtgttacttaaaacagcattactaatcgtatctggagtattcccatattctattccagcgactttgctggtttggcacacatggcaaaaacaaactcaacggtcaggcgtactctgggacgtaccttcgcctccggaaacccaaaaagccgagctagaagaaggagtctataggattaaacaacaaggtatattcggaaagacacaagtaggcgtgggtgtccagaaagaaggagtttttcataccatgtggcatgtaaccagaggagcggtgctcacttacaatggtaaaaggttagaaccaaattgggcgtctgttaagaaagacttgattagttacgggggtggatggcgcctgagcgctcaatggcaaaagggtgaagaagtccaggtcattgctgtagagccggggaaaaatccaaagaatttccagactatgccaggcacatttcagacgaccacaggtgaaataggtgccatagctttagatttcaaaccagggacctctggctctccaataatcaatcgagaaggaaaagtagtcgggttgtatggtaacggtgtggtaaccaagaatggcgggtacgttagcggtatagcgcaaacaaatgctgagccggacggacctacccccgaactggaagaggaaatgttcaagaaacgaaatctcacaataatggaccttcatccaggatccggtaaaacccgtaaatatctacccgcaatagtaagagaagcaatcaagcgaagattaagaaccttaatattagcccccacccgagtagtggccgcagaaatggaagaggcgctgaaaggcctccccatccgctatcaaacaacggcgacaaaatcggaacacaccggccgggagatcgttgatttgatgtgccatgctacgttcacaatgcgattattatctccagtgagagtgcccaactataatttaattataatggatgaggcacatttcacagatccggccagtatagcggcgagaggctatataagcactcgagtagggatgggagaggcggcagcaatctttatgacggcgacaccgcctggtacagcggatgcatttccccagtcaaatgcaccgatacaagatgaagaaagggacataccagaaaggagctggaacagtggtaatgaatggataacggattttgcaggaaagactgtatggttcgtcccaagtataaaggccgggaatgacatagcaaattgtttgcgtaaaaacggtaaaaaggtaatccaactttccagaaaaacgtttgataccgagtatcagaaaacgaaattaaatgattgggactttgtggtaacaacagatatttcagaaatgggcgccaactttaaggctgatagagttatagatccgagaagatgcctaaagccagtaatactaacggatggacctgaacgggtaattctggcagggccgatgcccgtaacagcagcttctgctgcccagagacgtgggagagtgggccgtaaccctcaaaaagaaaatgatcagtacatttttacgggacagccattaaataacgacgaagaccacgcccactggacagaagccaagatgctgctcgataatataaacacacccgaagggataattccagccctgtttgaacccgaaagagaaaaatcggctgcaattgatggtgaatacagacttaaaggggagagtcgaaagacctttgtcgaattaatgaggcgaggagacctgcccgtgtggctggcacacaaagtagcatcagaagggataaaatacacagataggaagtggtgttttgatggacaaagaaataaccaaatccttgaagaaaacatggacgttgaaatttggacaaaagaaggcgagaagaagaaacttcggccgcgatggcttgatgcaaggacatactcagacccgcttgcactaaaagagtttaaagatttcgcagcaggtagaaaaagcattgcactggatttagtaaccgaaatcgggcgagtaccctctcacttagcccacagaacgagaaatgccttagataatctagttatgttacatacctctgaacacggcggcagagcataccgacatgcagttgaagaactcccggaaaccatggaaacactgctcctcttaggtctaatgattcttctgactggaggggctatgctttttctaattagtggaaaaggtattggcaaaaccagtataggactcatatgtgtgatagctagctcaggaatgttatggatggctgaaattcctttgcaatggatagcatcagctatagtactagaatttttcatgatggttttattaattcccgagcccgagaaacaaagaactcctcaggataaccaattggcatacgtcgtcataggaattttgaccctggcagcaatcattgcagcgaatgaaatggggttgctcgaaactactaaaagggatcttggcatgtcgaaagagcccggggtggtatctcccacaagttacttagatgtggacctccatccggcatcagcatggactttatatgctgttgccaccacagtcataactccgatgctaagacataccatcgaaaattccacagcaaacgtgtcactagctgcaatcgccaaccaagctgttgtactaatgggtctagacaaaggttggccaatttcaaagatggatctgggcgttcctttactagccctgggatgctacagccaagtgaatccattaacactaacagccgcggtacttttattgattacccattacgcaattattggaccgggcctacaagcgaaagctacaagagaagcgcagaaacgtacagccgccggaattatgaaaaatccaactgtagacggaataatgactattgatttggatccagtgatatatgatagtaaatttgaaaaacaactaggacaagttatgctattagtactatgcgccgtgcaattactactaatgcgaaccagttgggcgttatgcgaggctttaaccttagcaaccgggcctattactaccttatgggaaggatctccaggcaaattttggaatacaactatcgcagtgtcaatggctaatatcttccgaggttcatatctggcaggggccggattagcgttctctataatgaaatcagtaggtacaggcaagagagggactggaagtcaaggtgagacattgggagaaaaatggaagaagaaactaaaccaactctcacgcaaagagttcgacctttacaaaaagagtgggataacagaagtcgatcgcacagaagctaaggagggactgaaacgaggagaaattacacaccatgcagtttccagaggttccgcgaaattacagtggtttgttgaacgcaacatggttattcccgagggtcgtgtaatcgaccttgggtgtggacgtgggggctggagttattattgcgcaggactaaagaaagtcaccgaagtgcgcggttatacaaaaggaggtcctggacatgaagaaccagttccaatgtcaacgtatggatggaatatcgttaaattgatgtctgggaaggacgtattttatctgccacctgaaaaatgtgacactctattgtgtgatattggggaaagcagtccaagtccaacggttgaagaatccagaacgataagggttctgaagatggtagaaccttggctgaagaataaccagttctgtataaaggtattaaacccgtacatgcccacggttatagaacatttagaaaggctacagcgaaagcacgggggaatgctggtgagaaacccattatcaagaaattccactcatgaaatgtattggatttctaacggcacaggaaacatcgtcgccagcgtgaatatggtatctagattgctattgaacaggtttacaatgactcataggagacccacgatagaaaaagacgtagatctgggtgcaggtacaaggcacgttaacgcagaaccagaaactcccaatatggacgttatcggtgaaaggattaagagaataaaggaagaacataacagtacgtggcattatgacgacgaaaatccttataagacttgggcctaccatggatcttacgaagtcaaagcaacgggatccgcgtcatcgatgataaatggtgtcgtgaaactcctcacaaaaccttgggatgttgttccaatggtcacgcaaatggcaatgacagatacgacgccattcggacagcaaagggtgtttaaagagaaagtagatacgcgcacaccgaggagcatgccgggcactagacgagtaatgggaataaccgcagagtggctttggagaactctcggcagaaacaaaaagccgaggttgtgtaccagagaagaatttactaaaaaggtacgcactaacgcagctatgggagcggttttcacagaagaaaatcaatgggatagtgcaaaagctgccgtggaagatgaggacttttggaaattagtagaccgagagagagaactgcataagttaggaaaatgcggatcttgtgtctataatatgatgggaaaaagagagaagaaactaggagaatttgggaaagccaagggaagcagagctatctggtatatgtggttaggcgcccgatacctagaatttgaagcactaggatttttaaatgaagatcattggttcagcagggaaaactcttactcaggagttgaaggagagggacttcacaaactaggatacattttaagagacatttccaaaattcctgggggcgcaatgtatgcagacgacaccgcaggttgggatacaagaataacagaggatgacttacataatgaagaaaagattactcagcaaatggatccagaacatagacaattggcaaacgcgattttcaagttaacatatcaaaataaggtagtgaaagtacagcggcccacccctacaggcacagtaatggacatcatatctcgaaaagatcagagaggcagtggtcaggtaggaacatatggcttaaatacctttactaatatggaagcacagttgataagacaaatggagggcgaaggagtattatccaaagcagacctagagaatcctcatctacccgagaagaaaataactcaatggttagaaacaaaaggagtggaacggttaaaacgcatggcaataagcggggatgattgtgttgttaaaccgatcgatgacagattcgctaatgcattgttggcactaaatgacatgggcaaagtccgaaaagacataccacagtggcaaccaagtaaaggatggcacgattggcagcaggtccctttttgctctcatcactttcacgagctaatcatgaaagatggtcgaaagttagtagtaccgtgccgaccacaagacgaattaattgggagagcaagaatctcacaaggtgcagggtggtctctgcgagagacagcatgtttaggcaaggcatatgcacaaatgtggtcactcatgtattttcaccgccgtgacttacgactcgcaagtaatgctatatgttctgcagtcccagtacattgggttccgacaagtagaactacctggtctatccatgcccatcaccaatggatgacaaccgaagacatgttaacggtatggaacagagtgtggattgaagacaatccatggatggaagataaaactccagtaacgacatgggagaacgtcccctatttgggaaaaagagaagatcagtggtgcggctccctaatcggtttgacaagtagagcaacctgggcccaaaacattccaactgcaattcaacaagttcgatcactaatcggaaacgaagaatttttagattatatgccttcgatgaagcgttttaggaaagaggaagagtcagaaggagctatatggtaa

SEQ ID NO: 23053 - RNA, 9873 nt, synthetic construct
  misc_feature 1..9873: note = derived and/or modified CDS sequence (opt6) from DENV-3__GU131844__SS-prME
  source 1..9873: mol_type = other RNA
acgagtttgtgtcttatgatgatattaccggctgcgttggcgtttcatttaacatcaagagatggtgaacctaggatgatagttggcaaaaatgaacgcgggaaatccctactgtttaaaacagcgtcaggtattaatatgtgcactctaatagctatggacctaggagaaatgtgtgacgatacagtgacatataaatgtccacacataacagaagtggaaccagaagacatagactgttggtgcaatctaactagcacatgggtaacatatggtacctgcaatcaagccggagaaaggcggcgggataaaagatccgttgcattagctccacacgtggggatgggtttagacactagaactcaaacgtggatgtctgccgaaggagcatggcgccaagtagaaaaagtcgaaacatgggcactgcggcatccgggttttacaattctagctttgtttttagcacactatatcggaacatcattgacacaaaaagttgttattttcatattacttatgttagtcactccatcgatgacaatgagatgtgttggggttgggaatagagattttgttgagggtttatcaggggcgacatgggtggacgttgttctcgaacacggagggtgcgtaacaactatggctaaaaataaaccgacactagacatagaattacagaaaacagaggctacacaactagctacccttcgaaaactttgcattgaggggaaaataacgaatatcactacagatagtagatgtccgacacaaggtgaggcggttttgccggaagaacaagaccaaaattacgtatgtaaacacacgtacgtcgatagagggtggggaaatgggtgcggtctgtttggaaaaggcagcctcgtaacgtgcgccaaattccaatgtctggaattaattgagggcaaagtcgtacaatatgagaacttgaaatatacagttattataaccgtacatacgggcgaccaacaccaagttggaaatgaaactcaaggagtgacagcggagatcacacctcaagcgagtaccacggaagcaatactccccgagtatggaacgctcggtctcgagtgttcaccacgaactgggctagattttaatgaaatgatactgttaaccatgaaaaataaagcctggatggttcacagacaatggttctttgatttaccgctaccgtggacgtcgggcgcaacaacagaaacaccaacgtggaacaggaaagaattactggtaaccttcaaaaatgcacatgccaagaaacaagaggtagtcgtattaggctcacaagagggggctatgcacacggctctcactggagcgactgaaatacaaaacagtggtggtacatccatatttgcaggacacctcaaatgtaggctgaaaatggacaaattagagttaaaaggcatgtcatatgctatgtgtacaaatacttttgtgttgaagaaagaagtatccgagacacaacacggaacaatattgatcaaagttgagtataaaggggaagacgctccttgcaaaattccctttagtaccgaggatggtcaaggaaaagcacataatggcagactcattacagctaatcccgtggtcaccaagaaagaagaacctgtcaatattgaggcagagcctccattcggtgaaagtaatatagtaataggcacgggcgacaatgcactcaaaataaactggtacaagaaaggatcatctatagggaaaatgttcgaggcaacagcgagaggagcaagaaggatggcgatcttaggcgatacagcttgggactttggatctgtgggtggtgtgttaaatagcctgggaaaaatggtacatcagatatttggatcagcttacacagcattatttagtggagtgagttgggtgatgaaaatagggataggagtcttgttaacatggatagggcttaatagcaaaaacacatcaatgagttttagctgtattgcgattggaataatcacactgtatctgggagcagttgtccaagcagatatgggctgtgttataaattggaaaggaaaagaacttaaatgtggttcgggcatatttgtaacaaacgaagtgcatacctggacagagcaatataaatttcaagcggattcgcccaaaagactagccaccgcaatagcgggtgcatgggagaatggagtttgcggaataagatccacaacgagaatggagaacttgttatggaaacagattgcaaacgaactaaattatatactatgggaaaacaatgtaaaattaaccgttgtcgtcggcgatataattggcgttctagaacaagggaaaagaacattaacaccacaacccatggagttaaaatattcatggaaaacctggggcaaggcaaaaatcgtcaccgcggaaacgcagaatagtagttttataattgatgggccaaatacccctgaatgtccatcagcaagtcgtgcatggaacgtatgggaagtagaagattatggatttggagtctttacgacaaacatatggcttaaattgagggaagtctatacccaactatgtgatcacagactcatgtcagccgctgtaaaagatgaaagggctgtacacgcagacatgggatattggatagaatcgcaaaagaatggatcatggaaattggaaaaagcaagtctcattgaagtaaagacatgcacctggccaaaatctcacactttgtggtccaacggagttctagagtctgacatgatcatacctaaaagcctcgcgggtcctatttcacaacacaatcatagacccggctatcacacgcaaacagcgggaccatggcatttaggaaagttagaactagattttaattactgcgaaggaacaaccgtagtaataacagaaaattgtggtactagggggccatcactgaggacaactacagtttcaggaaagctaatacacgaatggtgctgcaggtcctgtaccttaccgccactccgatacatgggcgaggacggatgctggtatgggatggaaattaggccaataagtgaaaaagaagagaatatggtaaagagtctagtatcggctggaagtggaaaagtagataactttaccatgggagttctatgtttagcaattctatttgaagaggtaatgaggggaaaattcggtaagaaacatatgatagcaggagtatttttcacatttgttttattgttatcaggacagattacatggagggatatggcacatacattaattatgattggtagtaatgcaagtgaccgcatgggtatgggcgtaacatatttagctttgatagctacttttaaaattcaaccatttcttgctttaggcttctttcttaggaaattaacaagccgtgaaaacttacttttaggcgtaggtctggcaatggcaacgactcttcagttgccagaagacatcgaacaaatggcaaacggaatagcacttggactcatggcattaaaattaatcacccagttcgagacgtaccaactttggactgcgttaatctcattgacgtgttcaaacacgatgttcacgttaacagtagcatggcggaccgctacgttaattttggcaggagtgagtctactgccagtttgccaaagcagttcaatgagaaaaactgactggttaccaatggctgtggcagcaatgggggtacccccactccccctatttatttttagtcttaaggatacactaaaaagaagatcttggcccctgaacgagggggtgatggccgtcggattggtctcaatattggcctcttctctattaagaaatgacgtgccgatggcaggacctttggtagctggaggtttgctcatagcgtgctatgtcataacaggcacgtctgcggatcttacagttgaaaaggccgcagatattacatgggaagaagaagcagaacaaacaggagtttcgcataacttgatgatcacagtagatgatgacggcacaatgagaataaaagacgatgagacagagaacattctaacagttctgcttaaaaccgcactgcttatagtgtccggagttttcccatactccatcccagctacactactggtatggcacacatggcaaaaacagactcaaagatcaggggtactgtgggacgtgccgagtccgcctgaaactcaaaaggcagaactagaagagggagtatatagaattaaacaacaagggatatttggtaaaacacaagtaggtgtaggcgtccagaaggaaggagtatttcataccatgtggcacgtaactagaggagcagtattaacgtataacggtaaaagattagagccaaattgggctagcgtaaagaaagatttgattagttacggaggaggatggagattaagcgcccagtggcagaagggtgaagaggttcaagttatagcagtggaacctgggaaaaatcccaaaaactttcaaactatgccgggtacgttccaaacaacaacaggtgaaataggtgcaattgcactcgactttaaacctggaacgagtggctctccaataatcaaccgagaaggtaaggtagtaggactctatggcaatggtgtagttaccaaaaatggagggtatgtatcgggcatcgctcaaacgaacgcagaacccgatggtccaactccagaattagaggaggagatgtttaagaaaaggaatctcactataatggatttacatcctggctcaggaaaaactcgaaagtatctgccagctatagtccgagaggctatcaagcgacgtctccgaactctaatactagcaccgacgagagtagtcgcagcagagatggaggaagcgttaaaggggcttcctatacgttatcaaacgacagcaacgaaatctgaacatacaggacgggaaatagtggatctaatgtgtcatgccactttcactatgcgattattatcgcctgtaagggtacctaactacaatttaataattatggatgaagcacactttaccgatcctgcaagtattgcagcaaggggatacattagtacacgggtgggaatgggagaagcggcggcgatttttatgactgcaacacctccaggaacagcggacgcattcccccagtcgaacgcaccaatacaagatgaggaaagagatataccagaaagaagttggaactcaggaaatgaatggataacagattttgcagggaagacagtatggttcgtgccaagcattaaagccggaaatgacatagcaaattgcctaaggaaaaatggaaagaaagtcatccaattaagtagaaaaacatttgacactgaataccagaaaactaaactaaatgattgggattttgtggtgacgacggatatttcggaaatgggagctaacttcaaagctgatcgagtaatagaccctagaagatgtctgaagcccgtaatactcacagatggacccgaacgagtaatcctggctggaccaatgcctgtaacagcggctagcgctgcacaacgacgaggaagagtaggtagaaaccctcaaaaagaaaatgatcaatatattttcacagggcaacctttaaataatgatgaagatcatgctcactggaccgaagcaaagatgctactggacaatattaacacacccgagggtattatacccgcactattcgaacctgaacgagaaaaatcggctgcaatagatggagaatatagactaaaaggcgagagtaggaaaacattcgtagaattgatgcgtcgcggcgatctgcctgtttggttagctcataaagtagcctcagagggcatcaaatatactgaccgaaaatggtgctttgatggtcaacggaataatcaaatcctagaggagaatatggacgtcgaaatttggacaaaagagggagagaagaagaaactcagaccaaggtggctagacgcaaggacatattcagatccattagcattgaaggaatttaaagattttgccgccgggagaaagagtatagctctcgatcttgtaaccgaaatcggaagggtaccatcacatctcgcacacaggacaagaaatgcgctagacaacctcgtaatgctccatacgagtgaacatggcggtagagcctatcgacacgcagtagaagaactaccagaaactatggaaacattactgttgctgggactaatgatcttacttacaggtggggcaatgttgtttctcatatcaggtaaaggtatagggaaaacttctatcggactcatttgcgttatcgctagcagtggaatgctttggatggcagaaatccctttacaatggatagcaagcgcaatagtactggagttctttatgatggtattgttgatccctgaaccggaaaaacaacgaactccacaagacaaccagctcgcttacgtcgtgataggaatattaaccctagccgcaattatagccgccaatgaaatgggtctcttagagactactaaacgtgacttaggtatgtcaaaagaaccaggggtggtttctccaacatcatatttggacgtagacttgcatccagcgagtgcgtggacgttatatgcagtggcgacgacagttatcactcctatgctgaggcatactatagaaaacagtaccgcgaacgtttcattggcagcgatagctaaccaggctgttgtacttatgggacttgacaaaggatggcctatatcaaaaatggatttaggagtaccgttactagcacttggatgttactcccaggtaaaccccttaactttgacagccgctgtacttttactaataacacattatgcaataattggtcctggtctccaagctaaagcaacaagagaagcacaaaaacggacggcagccgggattatgaaaaaccctacagtagacggaataatgacaattgatttggatcccgttatttatgatagcaaattcgaaaaacaactaggtcaagtaatgctactcgtgctatgtgcagcgcaacttttactgatgcggacatcatgggctctctgtgaggcattaacactggcaacaggtcctataacaactttatgggaagggtcgcccggaaagttctggaatactactatagctgtttcaatggcaaacatatttagaggatcgtatttagcaggggctggactggcattctccataatgaagtcggtaggaacagggaaaagaggtacgggatctcaaggagaaacgctaggagagaaatggaagaagaaactaaaccaattatctagaaaagagttcgatttgtataagaaaagtggaataacagaagtggacagaacagaagcaaaggaaggactaaaaagaggggaaataacacaccatgccgtatcacgaggaagtgctaaactacagtggtttgtagagcgtaatatggtgatcccggagggaagagtcatagatctggggtgtggtcgcggtggatggtcatattactgtgctggactaaagaaagtcacagaggtcaggggctatacaaaaggaggtcctggacacgaggaaccggtaccaatgagtacctatggatggaatatagttaaactaatgtccggaaaggatgtattctatcttccacctgaaaaatgcgacactttactatgtgatataggagagtcatcacctagtccaactgttgaggaaagcagaacgatacgtgtactaaaaatggtcgaaccctggctcaaaaataaccagttttgtataaaagtcttaaatccctacatgcccaccgttattgaacatttagaaagattacaaagaaaacatggcggcatgttagtaagaaatccgttaagtagaaactcaacacacgaaatgtattggatatcgaacggaacagggaatatcgttgcctccgtgaatatggtttctcgacttttattaaatcggttcacgatgacgcacagacggcctacaatcgaaaaggacgtggatctaggtgcaggaactcggcacgtaaacgcggaacccgaaactccgaacatggatgtgataggagaaagaataaaaagaataaaagaggaacacaattcaacatggcactacgacgacgaaaatccctacaagacatgggcataccacggtagttacgaggtcaaggcaaccgggtcagccagctcaatgatcaatggtgtcgtaaaattacttactaagccctgggatgtagttccaatggtcacacaaatggctatgactgatacaacaccgttcggacagcaaagagtgtttaaagagaaagtagacacaagaacaccgcgaagtatgccagggactcgacgcgtcatggggatcacagccgaatggctttggcgtactctcggacgaaataagaaaccaagattatgtaccagagaagagtttaccaagaaagttagaacaaatgctgcaatgggtgctgtatttacggaagaaaaccaatgggattcggccaaagcagctgtagaagatgaggatttctggaaattggtagatagggaaagagaattgcataaactaggaaagtgcggctcatgtgtatataacatgatgggtaaacgagagaagaaacttggtgaatttggtaaagcaaagggcagcagagcaatctggtatatgtggctgggagcaaggtacttggaatttgaagcattaggatttttaaatgaagatcactggttttccagagaaaattcatactccggagtagaaggagaaggtcttcacaaattaggatatattctacgggacatttcaaaaattcccgggggagcaatgtacgcggacgacactgcaggttgggatacgcgcattactgaagatgaccttcataatgaggagaaaataactcaacaaatggatcccgaacaccgacaattggctaacgctatttttaagttgacctaccagaacaaggtagtcaaagtccaaaggccaactcccacagggacggtgatggacataatatccaggaaggatcaacgagggagcggacaagtaggaacgtatggcttgaacacatttaccaatatggaagcacaattaataagacaaatggagggggaaggagtattatccaaggccgatttagaaaatccccaccttcctgagaagaaaatagcgcagtggttagaaacaaaaggggtggaaaggctaaaacgaatggcaataagtggggacgactgtgtagtaaaaccaattgatgaccggttcgcgaatgcgctgctagcgctcaatgacatgggaaaagttagaaaagacatcccgcaatggcaaccaagtaaagggtggcatgattggcaacaagtaccgttctgttcccatcattttcatgaattgattatgaaagatggacgaaagctggtagtgccatgcagaccacaagatgaattaatcggtcgcgcacggatatcgcaaggcagcggctggtcactaagagagactgcatgtttaggaaaggcttacgcccagatgtggagtcttatgtatttccacagacgcgatctaagattggcgtctaatgcaatctgctcagccgtacctgtacactgggtgcctacttcacgcaccacttggtccattcacgcccaccatcaatggatgactacagaggatatgctggcggtatggaatagggtctggatagaagacaacccatggatggaagataagacgccagtaacaacttgggaaaatgttccttatttaggcaaaagggaggatcaatggtgtggttcacttatcggactaacgtcgcgtgccacgtgggcccagaatatccccacggcaatacaacaggtcagatctttaattggcaatgaagaatttctagactacatgccttcaatgaaaaggtttcgcaaagaggaggagtccgaaggagctatatggtaa

SEQ ID NO: 23054 - RNA, 9873 nt, synthetic construct
  misc_feature 1..9873: note = derived and/or modified CDS sequence (opt6) from DENV-3__GU131849__SS-prME
  source 1..9873: mol_type = other RNA
acctctctgtgtttagtgatgatattacccgcagcactcgcttttcatttgacatccagagatggtgaaccgagaatgatagttgggaaaaatgaaaggggaaaatcactactattcaaaacagcaagtggaattaatatgtgtactctcatagcaatggatctcggggaaatgtgcgatgacacagttacttacaaatgcccccacataacagaagtagaacctgaagacatagattgttggtgcaatttaacatcaacctgggtaacatatggtacatgtaaccaagcaggagaaagacggcgggataaacgctcggtagccctggcccctcatgtaggtatgggactagacacaagaacccaaacttggatgtctgctgaaggagcctggagacaggtggaaaaagttgaaacttgggcactaagacatccaggtttcacaatactagcactatttcttgcccactacatcggaacatctctaacacagaaagttgtaatttttatcctcctaatgcttgtaacaccttcgatgacaatgcgttgtgtaggagtagggaatcgagactttgtagaaggattatcaggagcaacttgggttgatgtggtgttagaacatggaggatgtgttacaaccatggctaaaaacaaaccgacacttgacatcgaacttcagaaaaccgaagcaacacaactagccaccctgaggaaactgtgcatagaaggtaaaatcactaatattacaacagacagtagatgcccaacccaaggcgaagctgtgcttccagaggaacaagaccaaaattacgtatgtaaacatacctatgtcgacagaggatggggaaatgggtgtggtttgtttggtaaaggatccttagtaacttgtgcaaaattccagtgtttggaaccaatagaaggcaaagttgttcagtacgaaaaccttaaatatacagtaataataactgtacataccggcgatcaacatcaagtagggaatgaaactcaaggagtaaccgcagaaattacaccgcaagcaagtaccatagaggcaatattacctgaatatggcaccttgggactcgagtgctctccaaggactggtctagactttaacgaaatgatactcttaacaatgaaaaataaagcgtggatggtacatcgacagtggttctttgatctaccacttccctggacaagtggagccactactgaaacaccaacgtggaacagaaaagaattattggttacattcaaaaacgcccacgccaagaaacaagaagtagtagtattgggatcgcaggagggagcaatgcatacagcactgactggtgccactgagatacaaaattccggcggaacttctatattcgcagggcacttaaaatgcagattaaaaatggacaaacttgaattaaaaggaatgtcttatgccatgtgcacaaatacgttcgtactaaagaaagaggtaagcgaaacacaacacggtacaatcttgattaaagtagaatatagaggcgaagatgccccttgtaaaataccgtttagtacagaagacggccagggaaaagcacataacggccgactcatcactgcgaatcctgtagttacgaagaaagaagaaccagtaaatatcgaagctgaacctccatttggcgaatctaacatagtaattggaataggagataacgctttgaaaataaattggtataagaaagggagctcaataggtaagatgtttgaggcaacagctagaggagctagaagaatggcaatacttggcgacacagcatgggatttcggaagcgtagggggagtcttaaactctttaggaaaaatggtccatcagattttcggaagcgcttacacagcactcttcagtggtgtttcatgggtcatgaaaataggaataggcattcttctaacatggattggacttaatagtaaaaataccagcatgagttttagttgcatagctattggaataatcacgctgtatctcggagccgttgttcaggccgatatgggttgtgtaattaattggaaaggaaaagaattaaagtgcggatctggtatttttgtaacgaatgaagtacatacctggactgaacaatataaatttcaagcagatagtcccaaaagactagcaaccgccatagccggagcttgggaaaacggggtatgtggcatcaggtcaacaaccagaatggagaacctactgtggaaacaaattgcaaacgaattaaattacatcctatgggaaaataatataaaattaacggtagtggtgggagacataataggcgtacttgagcaaggaaagcgaacacttactccgcaacctatggaactaaaatattcttggaaaacatggggtaaagcaaaaatagtcaccgcggagacacaaaattccagctttatcattgatggaccaaacacgccggagtgtccaagtgcatctagagcatggaatgtgtgggaagtagaagattacggattcggagtgtttacaacgaatatttggctaaagctcagagaagtttatacacaactatgcgaccatcggttaatgtctgcagctgtaaaagacgaaagggctgtacatgctgacatgggctattggatagagagtcagaaaaatggcagttggaagctagaaaaagcaagtttaatagaagtaaaaacgtgtacatggccaaaatcacacacattatggtcaaacggagtacttgaaagtgacatgatcatacccaaatccttagcagggccgatctcgcaacataaccatagacccggatatcatactcaaacggccggcccttggcacttagggaaactagagctggatttcaactactgcgaaggcaccaccgtcgtaatcacagagaattgtggcacaaggggaccttctttgcgaacaaccacggtatcgggtaagctaatacatgaatggtgctgcagatcgtgtacattacctccactaagatatatgggagaagacggatgctggtacggtatggagattcgccccattagcgaaaaagaggaaaatatggttaaaagtctggttagtgctggatcgggaaaagtggataacttcactatgggagtactctgcttagctatactattcgaagaagtcatgaggggcaaattcggcaagaaacatatgatagcgggagtattctttacatttgtattactgctaagtggacaaatcacttggagagatatgacgcatacgcttataatgattggctctaatgcatcagatcgcatgggtatgggtgttacctacctagcactaatcgcgacttttaaaatacaaccatttctagcactcgggtttttccttagaaaactgacgtcaagggagaacttattacttggtgtaggattagctatggctacgatgctacagctgcctgaagatatagaacagatggcgaatggaatagcactgggattaatggcactaaagttaataactcaatttgaaacgtatcaactgtggaccgcgcttattagccttacatgttctaatacaatgttcacattgactgtagcatggaggacggcaactttaatcctcgcaggagtcagtttattgccagtctgtcaaagtagtagtatgagaaagaccgattggctccctatggcggtagcggcaatgggagttccaccgctgccattattcatcttttccctaaaggacacgctgaaacgaagaagttggccactgaatgaaggcgttatggccgtgggactggtatccatactagctagtagtctactacgcaatgatgttcctatggctggacctttagttgcaggaggtttgcttattgcatgctacgtcattacgggcacgagtgcggacttgaccgtagagaaggccgccgacataacgtgggaagaagaggccgagcaaaccggcgtgtcgcataacttgatgataacagtagatgatgatggcacgatgagaataaaagatgatgaaactgaaaacattctgacagtcctgctcaaaacagcgttattaatcgtttccggtgtctttccgtactccataccggctacacttctggtttggcacacatggcagaaacaaactcaaagaagtggtgtgctatgggacgtaccttcaccacccgaaactcaaaaggcagagttagaggaaggtgtatatagaattaagcaacaaggtattttcggaaagacacaagtaggtgtgggagtacagaaggaaggagtatttcatacaatgtggcacgtaacaagaggagcagtgctaacttacaatggaaagcgcttagaacccaactgggctagtgtaaagaaagacctaattagttatggaggtgggtggcgattatcggcacaatggcaaaaaggagaagaagtccaggtaatagctgtcgaacctggtaaaaatcccaaaaacttccagaccacgccaggaactttccaaactaccacgggagagattggggccatagctcttgactttaagccggggacgagcgggtcgccaattataaacagggaagggaaagttgtcggactgtatggcaatggcgtagtcacaaagaacggcggttatgtgtcaggaatcgctcaaacaaatgccgaacctgatggcccgacaccagaacttgaagaggaaatgttcaagaaacgaaatcttactatcatggacctccacccaggatccggaaaaactcgaaaatatctaccagcaattatacgggaggcgataaagcggagattaagaacactaatactagcgccgaccagagtagtagcggctgaaatggaagaagcacttaaaggactaccaattaggtatcaaacgacagcgactaaatcggaacacaccggaagagaaatcgtggatcttatgtgccacgcaactttcaccatgagactcttatcacctgtgagagttcctaattataaccttattataatggacgaagctcacttcacggacccagcatcaatagctgccaggggctacataagcacaagagtaggaatgggagaagccgcggcaatcttcatgaccgcaactcctccagggactgcagatgcctttcctcagtctaacgcacctatacaggatgaggaacgggacatcccggaaagaagttggaactctggcaatgaatggataactgatttcgccggaaaaaccgtttggttcgtcccatcaatcaaagcaggaaacgatatagcaaattgtttaaggaaaaatggaaagaaagtcatacaactatcaaggaaaacatttgatactgaatatcagaaaaccaagttaaatgattgggattttgttgtaaccacggatatatcagaaatgggggcaaatttcaaagcagatcgagttatagacccgaggaggtgtttaaagccagttatacttacagatggccctgaacgggttatattagccgggcctatgccagtaaccgcagccagtgccgcacaacggaggggaagagttggaaggaacccacaaaaagagaacgaccagtatatctttaccggacaacctttgaataatgacgaggaccatgcccattggaccgaagcgaaaatgcttctagacaacattaacaccccggaaggaatcataccggccctattcgagccagaaagagagaaaagcgcagcaatagacggtgaataccgactgaaaggtgaaagcagaaagacttttgttgaattaatgagaaggggcgacttaccagtgtggttggctcataaagtagcatcggaagggataaaatacactgacaggaaatggtgttttgatgggcaaagaaataatcaaatcttggaagaaaatatggatgttgaaatttggactaaagaaggagaaaagaagaaattacgacccagatggctagatgctagaacatacagcgacccactcgccttgaaagaatttaaggactttgcagcaggccgtaagtcaatcgcacttgacttagtaaccgaaataggaagggtgccgtcccatctagcacatagaaccagaaacgcgttagataacttagtgatgctccacacatccgaacatggcggcagagcatatcgccacgcagtagaagagttaccggagacaatggaaacgttgctcttactcgggctaatgattcttctaacaggaggtgctatgcttttccttatctcagggaaaggaatagggaagacaagtataggcctcatatgcgtcatagcctcgagtggtatgctctggatggcagaaattccattacaatggatagccagtgcaattgtcctggagttctttatgatggtattattaattcccgaaccagaaaaacaacggacaccccaagataaccaattagcatatgttgtaatcggcatcctaacactcgctgcaataattgcggccaatgagatgggattacttgaaacaacgaaacgagacttgggaatgtccaaagagccaggtgtcgttagtcccacgagctatctggacgtcgacctacatccagcatcagcatggaccttatacgcggtggcgactacagtgatcacacccatgttgaggcatacgattgaaaattctacagccaacgtatctctagcagctatagcgaaccaagcagttgtcctgatgggtctcgataaaggatggccgatatcaaagatggacctgggtgttcctttgttagcgttaggttgttactcacaagtaaatccgctaacactaactgccgcggtcttgcttctaataactcactatgcgatcattggacctggattacaagccaaggcaactcgagaagctcaaaagaggaccgccgcgggaataatgaaaaacccgacggtagatggtataatgacaatagatctagatccagtaatctacgactctaagtttgagaaacagctgggacaagtaatgctgttagttctctgcgctgtacaattgctactaatgagaacatcctgggcattatgcgaagccttaactttggcaacaggaccgataactactctatgggaaggaagccctggcaaattttggaataccactattgcggttagcatggccaacatttttcgtggatcgtatctagccggtgcaggattagcattttcaatcatgaaaagcgtgggtaccggaaagcggggaacagggtcacaaggggagactcttggggaaaaatggaaaaagaaactaaatcaattaagcagaaaagaatttgatttatacaagaaatccggaataacagaggttgaccgtacggaggcaaaagaaggtctaaaaaggggcgaaatcactcatcatgcggtatcgcgcggttcagcaaaattacaatggttcgttgaaaggaatatggttataccagaaggtagggtaatagacttaggttgcggacgagggggttggagttattattgcgccggcctcaagaaagtcacagaggttcgtgggtatactaaaggaggacccggacatgaggaacccgtccctatgtcaacgtatggatggaatatagttaaactaatgagcggaaaggatgtcttttacttaccaccagaaaaatgcgatacgctgctttgtgacattggagaatcctctcctagtcccacggtcgaagagtcacgaacgatacgggtgttaaaaatggttgagccatggttaaagaataaccaattttgcataaaggtcctaaatccttacatgccgacagtgattgaacatttagagcggttacaacgtaaacatggagggatgttagttcgtaacccactttcacgtaattccacccatgaaatgtactggattagcaatggaacaggcaacatagtagcgagtgttaatatggtcagtaggttattattaaataggtttaccatgacacacagaagacctacaattgaaaaagacgttgacttaggggcaggtacgcgtcatgtgaatgcggaaccagaaacacctaacatggatgtgattggtgaacgaattaagcgcatcaaagaagaacataattctacgtggcactatgacgatgagaacccctacaaaacgtgggcataccatggtagctatgaagtaaaagcaacgggtagtgcatcaagcatgataaatggtgtagtcaaattactcacaaaaccttgggacgtagtgccaatggtaactcaaatggctatgacggacactactccgtttgggcaacagcgtgtttttaaagaaaaagtagacacacgcacacccagatccatgccaggtacgagacgagttatggaaataacagccgaatggctttggcgaacattaggaagaaacaagaaaccacggctatgtaccagagaggagttcacgaagaaagttcgcacaaacgcagcaatgggagccgtattcacagaggaaaaccaatgggactcagctaaagccgccgttgaagacgaagatttttggaaattagtagatagagaacgtgaattacacaaattaggaaaatgtgggtcatgtgtatataacatgatgggaaaacgtgagaagaaattaggagagttcggcaaagcgaaaggaagcagagccatttggtacatgtggcttggcgcgcgatatctagagttcgaagcattaggattccttaatgaagatcattggttctcaagagaaaactcgtacagcggagttgagggtgaaggtctacataaattaggatacattctaagggatatatcgaaaatacctgggggcgccatgtatgcggacgatactgcgggctgggatacaaggattactgaagatgacttacacaacgaggagaaaataacacaacaaatggatcctgaacaccgacaattggcaaatgcgatatttaaactaacatatcaaaataaagtggtgaaagtacaacgacctacaccaacaggaactgtcatggacattatatctagaaaagaccaaagaggcagtggacaagtcggaacctacggactaaacacatttactaacatggaagcccaactcattagacagatggaaggagaaggcgtattgagcaaggcggatctggaaaattcacacttgcctgagaagaaaatcacgcagtggctagaaacaaagggtgtcgagaggctcaaaaggatggcaataagtggggatgactgtgttgttaagcctattgacgatcgatttgcgaatgcactcttagcattaaacgatatgggtaaagttaggaaagatatcccgcagtggcagccatctaagggctggcatgactggcagcaggtccccttctgctctcatcactttcacgaactaataatgaaagatggcaggaaacttgtagttccatgccgtccacaggacgaacttataggcagagcacgaatatcgcaaggagctggatggtcgttaagagaaaccgcctgcctgggaaaggcttacgctcaaatgtggtcgttgatgtacttccatcggagagacttacgattagcctcaaatgcaatttgttcggccgtaccagtacattgggtgcccaccagtcgtacaacgtggtctatacatgcacaccaccaatggatgaccaccgaggacatgttaacggtatggaatcgtgtatggatagaagataatccctggatggaagataaaacaccagttacgacctgggaaaacgtaccctatctcggaaaacgggaagaccaatggtgtggatctttaatcggtctaacctctcgcgcgacatgggcccaaaacataccaacagccattcaacaggtacgttcgttaataggaaatgaagagttcttggattacatgcctagcatgaagcgatttcgtaaagaagaggagtcagaaggtgcaatatggtaa

SEQ ID NO: 23055 - RNA, 9873 nt, synthetic construct
  misc_feature 1..9873: note = derived and/or modified CDS sequence (opt6) from DENV-3__GQ868546__SS-prME
  source 1..9873: mol_type = other RNA
acatcattgtgtttagtaatgattctaccagcagcgctcgcttttcacttaacttcacgagatggtgaaccgagaatgattgtggggaaaaatgaacgaggtaaatcattgttatttaaaactgcaagtggaattaacatgtgcacgttaattgcaatggatctaggcgaaatgtgcgacgatacagtaacgtataaatgccctcatattactgaagttgagccagaagacatagactgctggtgcaacctaactagcacatgggtaacatatggtacctgcaatcaagcaggagaacggaggcgagataaacgatctgttgcattagcccctcacgttggaatgggcctagatacacgcacgcagacctggatgtctgccgaaggcgcatggagacaagtagaaaaagtagaaacatgggcacttaggcacccaggtttcactattttagcactgtttttagcacattacataggaactagcttgacccaaaaagttgtaatattcatactgttaatgctagtaaccccaagtatgacaatgcgatgtgtaggagtaggtaacagagatttcgtagaaggtcttagtggcgctacatgggtagatgtagttctagaacatggtgggtgtgtaactactatggctaaaaacaaaccaactttagacatcgaattacagaaaacagaagcaacacaacttgctacgctaagaaaactttgcatagagggcaaaatcacaaatattaccacagattcccgctgtcctacacaaggtgaggccgtgttaccagaagaacaagatcaaaactatgtatgtaaacatacgtacgtagatcggggatggggaaacggttgtggattatttgggaaaggtagcttggtaacctgtgcaaaatttcaatgtttagaacctatagaaggcaaagtggtacaatatgagaacctcaagtataccgttataataacagtacatactggagaccaacatcaagtaggaaatgaaactcaaggtgttactgcagaaataaccccacaagcctcgaccacggaggctatattaccagaatacggaacactaggactggaatgctcaccccgtactggacttgatttcaacgaaatgattctattgacaatgaaaaacaaggcttggatggtacacaggcaatggtttttcgacctaccactaccatggacctctggtgcgacgactgaaacaccaacgtggaacagaaaggaattgcttgtcactttcaagaatgcgcacgccaagaaacaggaagtcgtggttttaggtagccaagaaggtgctatgcacaccgctctcactggggccactgaaattcaaaattctggtggaacatcaatatttgcaggccatctgaaatgtcggctaaaaatggataaactggaattaaagggaatgagctatgctatgtgtaccaatacgttcgtactaaagaaagaggtaagcgaaacccaacacggaaccatacttataaaagtagaatatcgaggagaggatgcaccctgtaaaatcccctttagtacggaagatggtcagggaaaagcccataatggtcgcctaattactgcaaatcccgtagtcaccaagaaagaagaaccggtaaatatcgaggccgaacctccatttggggaatctaatatagtcataggaataggagataacgcactaaaaataaattggtacaaaaagggatcttcgattgggaaaatgtttgaagccacagcgcgcggtgccaggagaatggctattttaggtgacacggcatgggattttggatcggtaggtggcgtgttaaattccttaggcaaaatggttcatcaaatctttggatcagcgtacacagcgttattttctggagtatcgtgggtaatgaaaataggaataggtatcttattaacctggatcggattaaatagtaaaaatacatccatgagcttcagttgtatagccattggcatcattacattatacctcggcgcagttgtccaagcggacatgggctgtgtaatcaattggaaagggaaagaattgaaatgtggtagtggcatattcgttacaaacgaagtacacacatggactgaacagtataaattccaggctgatagccctaagagactggcaacagcgatagctggtgcatgggagaatggcgtatgcgggatacgtagtactacaaggatggaaaacctgctttggaagcagatcgctaacgaactgaattatattctgtgggaaaacaatataaaattaacggtagtggtgggcgacataattggcgtattggaacaagggaagaggaccttaacacctcaacctatggaattaaaatactcatggaaaacatggggaaaagccaagattgttacagctgaaactcaaaattcttctttcattatagacggtccgaataccccagagtgtccatcagcttcaagagcatggaacgtctgggaagtcgaagattatggtttcggagtatttacaaccaacatttggttaaaattacgtgaggtgtatacacaactctgtgaccatagattaatgagtgccgcggtaaaagatgagcgcgctgtccatgcggatatgggatactggattgaatctcagaaaaatgggtcttggaaacttgaaaaggcgagtttgatagaagttaaaacatgcacttggccaaaatcgcatacactttggagcaatggggtacttgaaagcgatatgatcatacctaaaagtctcgcgggacccattagtcaacataaccatagaccaggttatcatacacaaacagcgggaccttggcatcttggcaaactagaattagactttaactattgcgagggaacaaccgtggttataactgagaactgcggaacgaggggtccgagtttgagaacaacaactgttagcggaaagctaatacacgaatggtgttgtcgctcctgcacattgccaccactacgttatatgggggaagatggatgttggtatgggatggaaattcgcccaataagcgagaaagaagaaaacatggtaaaaagcctcgtttctgccggttccggaaaagtagataactttacaatgggtgtgctttgcttagcaattctctttgaagaagtaatgagaggcaaatttggtaaaaagcatatgatcgctggggtattctttacttttgtcctactactaagcggacagataacatggagagacatgacccatacattaataatgataggatctaatgccagcgaccgcatgggcatgggagtgacatatttagctctaatagcgacattcaaaattcagcctttcctagctctaggcttcttcttaagaaaattgacgtcacgggaaaacttactgcttggtgtaggtctagccatggcgactactttacaattgccggaagacattgaacaaatggcaaatgggattgcacttgggctaatggcattaaaacttatcacccagttcgaaacgtaccagctatggactgccttaatatcactcacatgttcaaatacaatgtttacattaactgtagcttggagaacagcaacactaatcttggcaggggtttctttattaccagtctgtcagtcctcttctatgcgcaaaactgactggctaccaatggcagtagcagcaatgggcgtaccgccactgcctctttttatattcagtttgaaagatacattaaaaaggaggtcgtggcctttgaacgagggagtaatggcagtggggctagtgtctatattggcaagtagtctcctccgaaatgacgtacccatggcggggccacttgttgccggtggtttattaattgcatgctacgttattacaggaaccagtgccgacttgactgtcgaaaaagctgctgatattacatgggaagaagaggccgagcaaactggtgtcagtcacaatctgatgataacagtcgatgatgacgggactatgaggatcaaagatgacgaaactgagaatatcttaactgttctactgaaaacagctctattaatagtttcaggagtattcccctattcaattccagcaacattattagtatggcatacgtggcaaaagcagactcaaagatctggggtactatgggacgtaccttcacctcctgagacgcaaaaggctgaattagaggaaggtgtatatcgcattaagcagcaggggatttttggaaaaacacaagttggggtaggagtgcagaaggagggagtattccacacaatgtggcatgtaacgaggggagccgtgttaacttataatggtaaaagactcgagcctaattgggccagtgttaagaaagacctaatttcgtatggaggaggatggcgattaagcgcacaatggcaaaaaggagaagaagtgcaagtaattgctgtagaacccgggaaaaaccccaaaaatttccagacaactccaggcacatttcaaacaaccaccggggaaatcggcgctatagctcttgactttaaacccgggacgtctggttcaccaataattaatcgagaaggcaaagtagttggactctatggtaatggtgtcgtaaccaaaaatggaggttacgtttctggtattgcacaaaccaatgctgaacccgacgggcctactccagaactagaagaagagatgtttaaaaagagaaaccttaccattatggatctacatccaggcagcggaaaaaccagaaaatatctgccagctatcatacgagaagcgattaaaaggagactgaggactttaatactggccccaaccagggtggttgctgcagaaatggaggaggcattaaaaggactacctattagatatcaaacgactgccacaaaaagcgaacacacaggacgggaaatagtagatctaatgtgtcatgctaccttcaccatgagactgctgagccctgtccgcgtacctaactataatttaattattatggacgaagcacacttcacggatccagcaagcatagcggcaagaggttatatcagcacgagagttggaatgggagaggcagcagccatttttatgactgcgacacctccagggactgcggacgccttcccacaaagtaacgcaccaatacaagacgaagagagggacattccagagaggagttggaatagtggaaatgaatggataacagattttgccggtaaaactgtttggtttgttccatcaattaaagctggtaatgatatagcaaattgtttaagaaagaatggtaagaaagtcatacaactgagtaggaaaacatttgacactgaatatcagaaaacgaaactaaatgactgggattttgtcgtaactacggatatttcagaaatgggtgcgaattttaaagcagatagggtaatcgacccgcgcagatgtttaaaacctgtaatattgaccgatggacctgaacgcgtaatactcgcagggcctatgccagtaactgccgcgtcagcggcacagcgacgaggtcgggttgggagaaatccgcaaaaagagaatgatcaatatatctttacgggccaacccttaaacaacgacgaagaccacgcacattggactgaggcgaaaatgctattggacaatataaatacaccggagggcatcatacctgcattatttgaacccgaacgagaaaaatcagcagctatagatggggaatatagactgaaaggagagtcacgtaaaacattcgttgaattaatgcgccgtggtgatctaccagtctggttagcccataaagtcgcatcagagggcattaaatatacagatagaaagtggtgctttgatggccaacgcaataatcagattctggaagaaaacatggatgtcgagatctggactaaagaaggagagaagaagaaacttagacctaggtggctggacgctcgcacatatagtgatcccctagcattgaaagagtttaaagacttcgcggccgggcgtaaaagtattgcactagacttagtcacagaaattggaagagtaccctcacaccttgcacaccgaactcgcaatgctttggacaatttagtgatgttgcacacctctgaacatggaggacgcgcatatcggcacgcggtcgaagaactgccagagacgatggaaacccttcttcttttaggactaatgatcttactaacaggcggcgccatgttatttttaatttcagggaaagggataggtaaaacaagtattgggttaatttgcgttattgcatcgtctggaatgttatggatggctgaaataccattacagtggatagcaagtgcaatagtactcgaatttttcatgatggtactcctcattccagaaccagaaaaacaaaggacaccccaagataaccaacttgcctacgtagtaatagggatcttaaccttagcggctattatagcagccaatgaaatgggactgctagaaacaacaaaacgggatctaggtatgagcaaagaacctggagttgtgtcgccgacctcgtacttagatgtcgacctacacccggcgagtgcttggacattatatgctgttgcgaccactgttataacaccgatgctgcggcatactatagaaaatagtaccgccaatgtaagtcttgctgctattgcaaatcaggccgtagtattaatgggtcttgataaagggtggccaatcagtaaaatggatttaggagtacctcttctcgccttgggatgctattctcaagtaaatccccttactctaactgccgcagtactcttgttaataacccactatgcaataataggaccaggactacaagcaaaggcaacgagagaagcacaaaagcgaaccgcagcaggcataatgaagaatccgacagtagatggtataatgacgatcgacttggaccctgtgatttatgattctaaattcgagaagcaattaggacaggtcatgctgctagtattatgtgcggtacagctcttacttatgagaacgtcttgggcattatgtgaagcattaaccctggcaactggcccaataacgactctgtgggaagggagtccgggaaaattctggaacacaactatcgcggtatctatggcaaacatctttcgtggttcgtatctagccggtgctgggttagccttttccataatgaaaagtgttggaaccggaaaacgcggcacggggtcgcaaggcgaaacccttggtgaaaaatggaagaagaaattaaatcaactatctcgtaaagagtttgacttatataagaaatctggaataacggaggtagatagaacagaagcaaaggaaggattgaagaggggagaaatcacccaccacgctgtatcaagaggctctgctaaactgcaatggttcgtcgaaagaaatatggtaattccagaaggacgtgtgattgatttggggtgtggccgaggtggatggtcttattactgcgcaggcttaaagaaagtaacagaagtacgagggtatactaaagggggccctggtcacgaagaacctgtacctatgagtacgtacggttggaacatagtaaaattaatgtcagggaaagatgtattttatctacccccggagaaatgcgatacattactttgcgacatcggagagtcctcaccatcacccactgtagaggaaagtagaactataagggtattaaaaatggtggagccttggctcaaaaataaccaattttgcatcaaagtgcttaacccatatatgcccacagtaatagaacacctcgaacggctacaaagaaaacatggcggtatgctggttagaaatccgctctctcgaaacagcacccacgaaatgtattggattagtaatggaacgggaaatatagttgcaagcgtcaatatggtctcacgactcttactaaatagatttactatgacacatagaagaccgaccatagagaaagacgttgatctcggtgctggcactagacatgtgaatgccgaaccagaaacgccaaacatggacgtgattggcgagcgcataaaaagaattaaagaagaacacaacagtacatggcattacgatgatgaaaatccgtataaaacatgggcatatcatggctcatacgaggtgaaagcaacaggaagtgcatcatccatgatcaatggcgttgtaaaacttttaaccaaaccatgggatgtagtccctatggtaacacaaatggcaatgacagacacaaccccattcggtcaacaaagagtattcaaggaaaaagtggacacgagaacgccccgaagtatgcctggaacccggagggtaatggagatcacagccgaatggctctggagaacattaggaaggaataagaaaccaagattatgtacaagagaagaatttaccaagaaagtacgaacaaatgctgcaatgggggctgttttcactgaagaaaatcaatgggactctgcaaaagcagccgtagaggacgaagatttttggaaactggtagatagagaaagggagttgcataagttaggtaagtgtggaagttgtgtttataatatgatgggaaaacgagaaaagaaattgggcgagttcggcaaagctaagggcagtagagccatttggtatatgtggcttggggcaaggtatttagaatttgaggccctgggatttttgaacgaagatcattggttctctcgagaaaattcatactctggcgtagagggagagggattacacaaactaggatacattttgcgtgacatttccaaaattcctggtggtgcaatgtatgcagacgatactgcaggatgggataccagaatcacggaagatgatttgcataacgaggagaaaataacccaacaaatggatcccgaacaccgacagctggccaatgctatattcaagttaacatatcaaaacaaggtcgtaaaagtccaacgaccaacccctactggtaccgtaatggacataatatcacgaaaggatcagcgcggaagtggacaagtaggtacctatggactaaatactttcacaaacatggaagcacaactgataagacagatggaaggagagggtgtactgagtaaagctgatctggaaaacccccatctgccggagaagaaaattacgcaatggctcgaaactaaaggtgttgaacggcttaaacgaatggcgatatccggagacgattgtgttgtaaagcccatagatgaccgattcgcaaatgctctattagcactaaacgacatgggcaaggtaaggaaggatattccccagtggcagccttcgaaaggatggcacgactggcaacaagtaccattctgtagtcaccattttcatgaactcatcatgaaagacggtagaaagttagtcgttccgtgccggccgcaagacgagcttatcgggagagcgcgaatatcgcagggtgcaggctggagtttgcgagagacagcgtgtctagggaaagcatatgctcaaatgtggtcactaatgtacttccacagacgagatctaagactggcatcgaatgcaatatgctcggctgtacccgtgcattgggtaccaacctcacgtacgacatggtcaatacacgcacatcatcaatggatgactacagaagatatgttaactgtatggaaccgcgtatggattgaagataatccatggatggaagacaagaccccagtcacaacttgggagaatgtcccgtatctcggtaagagagaagatcaatggtgtggaagtctcatcggactaacctcacgtgcgacttgggctcaaaatataccaactgcaatacaacaagtacgttcattaataggtaatgaagaatttttagactacatgccgtcgatgaaacggtttagaaaagaagaagaaagtgagggagcaatctggtaa

SEQ ID NO: 23056 - RNA, 9873 nt, synthetic construct
  misc_feature 1..9873: note = derived and/or modified CDS sequence (opt6) from DENV-3__GU131850__SS-prME
  source 1..9873: mol_type = other RNA
acgtcactatgtttggtcatgatactacctgcagctttggcatttcatctgacgtcccgcgacggtgaaccgagaatgatagttgggaaaaatgaaagaggtaaatccctattatttaaaaccgcttctggaattaatatgtgtactctaatagctatggatctaggagaaatgtgtgacgacaccgtcacatataaatgtccccacattaccgaagtcgaaccagaagacatagactgttggtgtaacctcacatcaacgtgggtaacttacggaacatgcaaccaagctggagaaagacgcagggataaacgatcagtagcattagcgccacacgtaggcatggggctagacacgagaacgcaaacctggatgtcagctgagggagcctggcgacaagtcgagaaagtagaaacatgggccttgcgtcaccctggctttacaatccttgccttattcttggcacattatattgggacatctctcacacagaaagtcgtgatcttcatccttttgatgctagtgacaccgtcaatgacaatgcgatgtgtgggtgttggtaatagggattttgtagaaggcttatctggtgcaacctgggtagacgtcgtattggaacatggaggttgtgtaacaacaatggccaaaaataaacccaccctagatatagaattacagaaaactgaggcaacccaactagccaccttaagaaaactttgtatagaaggaaaaatcaccaatatcacaacagattcccgttgtccaacccaaggagaagctgtcttaccggaggaacaagaccagaattacgtatgtaaacatacatatgtagacagagggtggggaaatggctgtggcctatttggcaaaggctcgctagtaacctgcgcgaaattccaatgcttagaaccaatagaaggcaaagtcgtacaatatgaaaatctaaaatatactgtaattataaccgtacatacaggggatcaacaccaagtcggaaatgaaacccagggagtaacggccgaaataacaccacaagcatcaactaccgaagcaatattaccggaatatggaaccctgggtctcgaatgtagccccaggacagggcttgattttaatgagatgatacttttaacaatgaaaaacaaagcgtggatggtgcaccgacaatggtttttcgatctccctttaccctggacctccggggcaacgacggaaacaccaacttggaaccgtaaagaactgttagtcaccttcaaaaacgcgcacgctaagaaacaggaagttgtagtgcttggaagccaggaaggtgcaatgcacactgcactgactggcgccacagaaatacagaatagtggaggcacaagcatcttcgctggtcacctaaaatgtcgattaaaaatggataaattggaactcaagggaatgtcttatgccatgtgcaccaatacatttgttttgaagaaagaggtcagtgagacacaacatggtacaatcctaataaaggtggaatatagaggagaagacgctccttgtaaaatacccttttcaaccgaggatggacaaggaaaggctcacaatggacgattgataactgcgaatcccgttgttataaagaaagaagaacctgtgaatattgaagcagaaccaccgtttggagagtcaaacattgtgataggaattggtgataatgcattaaaaataaattggtataagaaaggttctagcataggaaagatgtttgaagcaacagccaggggcgctcgccgaatggcgattttaggagacacagcttgggactttggctctgttggtggagtattaaacagcctaggaaaaatggtgcaccaaatattcggttctgcttatactgctctattttccggagtaagttgggtcatgaaaatcggaataggaatactactgacatggataggattaaatagcaaaaatacaagtatgtctttctcgtgtatcgcaataggaataattactttgtatctaggggcggtagtgcaggccgatataggatgcgtcataaactggaagggaaaggaattaaaatgtggctcaggcatctttgtaacaaatgaagtccatacttggacggaacaatataaattccaagctgattcccctaaacggctagcaacagccatagcaggagcctgggagaatggtgtatgtggaatcagatcgacaacccggatggaaaaccttctgtggaaacaaatagcgaatgagctcaactatatcttatgggaaaataacattaaattaaccgtcgttgttggggatattataggagttcttgaacagggaaaaagaacattgactcctcaacctatggagctaaaatattcatggaaaacctggggcaaagccaaaattgtaaccgccgaaacacaaaactcatcatttattatagatggacctaatactcccgaatgcccgtcagcgagcagagcatggaatgtctgggaggtagaggattacggttttggtgtctttacaacgaatatatggctaaaattacgagaagtttacacccaactttgtgaccaccgcttaatgagcgcagccgttaaagacgaacgagcagtacacgcagacatgggatattggatagaaagtcagaaaaacggtagctggaaacttgaaaaagcgtctcttatcgaggttaaaacgtgtacatggccaaaatcacatacgctctggagtaatggagtcctggagtctgatatgattatccccaaatctctcgcaggtccaatatcccaacataatcataggcccggctatcatacacaaacagctggtccgtggcacctaggcaaactagaactagatttcaactactgcgaaggcaccacagtagtaataactgaaaattgtggaactcgaggtccgtccctgcgaacaacgaccgtatccggaaaattaatacatgaatggtgctgccgttcatgcaccttgcctcccttacggtatatgggtgaagatggatgctggtatggtatggaaattaggccgataagtgaaaaggaggaaaacatggtcaaaagcctggtttccgccggctcaggaaaagttgacaacttcacaatgggagtgttatgcctagcaatacttttcgaggaagttatgcgaggaaaatttggtaagaaacatatgattgcaggggtatttttcaccttcgttctcttactatctggacaaataacctggcgagatatgactcacacacttataatgataggtagtaacgcctcagatagaatggggatgggagttacgtatctagcgctaatagcaaccttcaagatacaaccattcttagcattgggattctttttgagaaagctaacgagcagggaaaaccttttgttaggcgtaggtttagcaatggcaactaccttacaactacctgaagatatagagcaaatggctaacggaatagcattagggttaatggccctaaaactaatcacacaatttgaaacatatcagttatggaccgcgctcatctctttaacgtgttcaaatactatgtttactttaactgtcgcatggcggacagctaccctgatactagcaggggtaagcctactacctgtctgtcaatcctcctccatgcgaaaaactgactggttacctatggcagtagcagctatgggcgtgccccctctgccattattcatcttctcacttaaagataccttaaaaagacgatcgtggcctctcaatgaaggagtcatggcagtaggattagtgtccatacttgcgtcgtcactattaagaaacgatgtacccatggcgggaccattagttgcagggggattgttaatcgcgtgttacgtaataaccggcaccagtgcagatttgacagtagaaaaagcagctgatataacttgggaagaagaagccgaacagactggagtaagtcataacctaatgataactgtagatgatgatggaaccatgagaataaaggacgacgaaacggaaaatatactgacggtattattgaaaactgcccttttaatagtctcaggcgtgtttccttactctataccagcaaccttacttgtttggcacacctggcaaaaacaaacacaaagatcgggtgtgctatgggacgtaccatcccctccagaaacacaaaaagctgaattagaagaaggcgtgtatcgaattaaacaacaaggtatattcgggaaaactcaagttggagtcggggtccagaaggagggagtctttcatacaatgtggcatgtaacacgaggtgctgttttaacatataacggcaaacggctagaaccgaactgggcttcagttaagaaagatctgatatcgtatggaggtggctggcgattgagcgctcagtggcaaaagggagaggaggtacaagtcattgccgtagagcctgggaaaaatccgaagaattttcaaactatgcctggtactttccaaacaacaacaggggaaatcggtgctatcgcgctagattttaagcctggtacatccggatcgcccataattaatcgggaagggaaagtagtcggactctatggaaatggagtcgttacaaagaatggaggttacgtatcaggtattgcgcaaaccaatgcggagcctgatggcccaacacccgaactagaagaggaaatgttcaagaaacgcaacttaactattatggatcttcatccaggaagcggcaaaacaaggaaatacctccccgccataattcgcgaagccataaaaagacgacttcgaacccttattttggctcccactagagttgtggccgctgaaatggaagaagccttgaaggggctacccattagataccaaactacagcaaccaaaagtgaacatacaggcagggaaattgtggatttaatgtgtcatgcaactttcactatgaggttactaagccctgtacgagtacccaattacaacttaataatcatggatgaggcacactttactgacccagctagcatcgcagctagaggatatatttctacacgagttggtatgggtgaagcagctgccatcttcatgacggcaacacctcccggtaccgcagatgctttcccccaatccaatgcaccaattcaagatgaggaaagagatatacccgaacggtcgtggaacagtggaaatgagtggataacggatttcgtcggaaaaacggtgtggttcgtcccaagtataaaagctggaaacgacatcgcaaactgtctaaggaaaaatggtaagaaagttattcaactatcccggaaaacctttgacaccgagtatcagaagacgaaattaaatgattgggattttgttgtaaccacagatatttcagaaatgggagcaaattttaaagcggatagagtaatcgatccaaggaggtgcttaaaaccagtaatcctaacagacggcccagaacgcgttatcctagcaggacctatgccagtgactgctgcatcagcagcgcagcgacgcggaagggtcggtagaaatccccaaaaagaaaacgatcaatatattttcactggccagcctttgaataacgatgaagatcatgcccattggacggaagccaaaatgttactcgataatataaacacacccgaaggtattatccctgccttattcgaaccggaacgagagaaatccgccgcaatcgatggagagtacagactcaaaggggagtctagaaaaacctttgtggaactaatgcgtcgcggtgatctaccggtatggctcgcacataaagtcgcatcagagggtatcaaatatacagatcgaaaatggtgtttcgatggacaaaggaataatcagatcttagaagaaaacatggatgtcgaaatttggaccaaggaaggggagaagaagaaactaagaccaagatggttagacgccagaacttattcggacccactagcactaaaagagttcaaagattttgcagcaggaaggaaaagtatcgcactcgatctagtaaccgagattgggagagttccatcgcatttagcacatcgaacacgaaacgcactcgacaatttggttatgcttcacacgtcggaacatggagggagagcttatagacacgctgtagaagaactacctgaaacaatggaaactttgttattgcttggactcatgatactattgaccggaggggctatgttatttttgataagcggaaaggggatcggaaagacgtcaataggacttatctgtgtaatagcttcatccgggatgctctggatggccgaaataccactacaatggatagcgagtgctatagtcctagaatttttcatgatggtacttctaatacctgagccagagaaacaaagaactccacaagacaaccagttggcttacgtagtaataggcatattaactttggccgctataatcgctgcaaacgagatgggactacttgaaaccacaaaaagagatttaggaatgtccaaagagccaggagttgtcagcccaaactcctacttagatgtcgatcttcatccagcctcagcctggaccctttacgccgtagctaccaccgtgataacccctatgttaagacacaccatagaaaatagtacagctaatgtgtctcttgcagccatagcaaatcaagccgtagttctaatgggattagataaagggtggccaattagtaaaatggatcttggtgtccctctccttgctctcggctgttactcccaagtgaatccattaacacttaccgcagcggttttattgctaataacacactatgcaattattggccccggactacaagcaaaagcaacgagggaagcacagaaaagaacagccgccggtataatgaaaaatccaacagtagatggcattatgacaatagacctcgatccagtcatctatgacagcaaattcgagaagcaattaggccaggtaatgttactcgtattatgtgccgttcaactgctactaatgcgaacgtcctgggccctctgtgaagcgttgacccttgctacaggaccaatcactacattatgggaaggaagtcccgggaaattttggaatacaacaatagccgtgagtatggcaaacatcttccgtggatcatacctggcaggggcaggtctagcgttttcaatcatgaagtccgttggaactggaaaaagaggtactggctcccaaggggagacattaggggaaaagtggaagaagaaactaaaccaactcagtaggaaagagttcgacttatacaagaagagtggaataacagaagtagataggacagaagcgaaagaaggactgaagaaaggtgaaattacacatcacgcagtttcacgaggatcagcaaaactccaatggtttgtagaacgaaacatggttatacctgaaggaagggtcatcgatctcggatgtggaagaggaggatggagttattattgtgcaggtctcaagaaggtgacagaagtgaggggatatactaaaggagggcctggtcacgaggagccagtaccgatgagcacgtatgggtggaatatagtgaaacttatgtctggtaaagacgtattttacctaccgccagaaaaatgcgatacccttctgtgtgacataggtgaaagcagtccttccccaacagtagaagagtcgcgtacaataagggtcctaaaaatggttgaaccttggctaaagaataaccaattttgtatcaaagtattaaatccgtatatgcctacggtcatagaacatctggaaaggctacagcgtaaacacggcggaatgctcgtaagaaacccactctcaagaaattcaacacatgaaatgtattggataagcaatggaacaggcaatattgtagcttctgtgaacatggtaagtcggcttctgctaaacagattcactatgactcatagacgaccgacaattgaaaaagatgtggatctgggtgcgggcactagacacgtgaatgcagagcctgaaacgccgaacatggacgttataggggaaagaatcaaaaggataaaagaggaacataactcaacttggcattacgatgatgagaacccttataagacctgggcataccatggctcttacgaagtcaaagcgactggatcagcatcctcgatgataaatggcgtggtaaaattacttaccaaaccttgggatgtggtacccatggtcacacagatggccatgacggacacaacaccattcggccaacagagggtcttcaaagagaaggtagacacccggacacctcgaagtatgcccggaacacgtagagtaatgggtatcacggcagaatggctatggcggacactcgggcgtaacaagaaaccaagactctgtacaagggaagagtttacgaaaaaggtccgtacaaatgccgccatgggggcagttttcactgaagaaaaccaatgggactctgctaaagctgccgtagaggatgaagatttttggaaattagttgatcgagaaagagaactccataagttgggcaaatgcggtagttgcgtatataacatgatgggcaaacgcgagaagaaattaggagaatttggtaaagccaaagggtctcgagctatatggtacatgtggttaggcgctcgttatcttgagtttgaagccttagggtttctcaatgaggaccactggttttcaagggaaaactcctacagcggagtcgaaggagagggcctacacaaattaggatacatcttacgtgacatcagtaaaataccaggcggggcaatgtatgcggatgatacagcgggatgggacacgagaataacagaagacgacttacataatgaagagaaaataacgcaacagatggatcctgaacaccgccaactagcaaatgcaatttttaaattaacataccagaataaagtagtgaaagtacaacgaccaaccccaactgggaccgtcatggacattataagtaggaaagaccaaagaggtagtggacaagtaggaacgtatggacttaacacatttacgaatatggaggctcaattaataagacagatggaaggagagggagtactatcaaaagcagatctagaaaatccacatcttccggagaagaaaataacacaatggttagagacaaaaggagtagaacgtctaaagcgaatggcgattagtggagatgactgtgtagttaaacctattgacgacagatttgctaacgcattactggctctaaatgatatgggtaaagttagaaaagatatcccacaatggcagccgagcaaagggtggcatgattggcaacaagtgcccttctgttcacatcactttcacgaactaatcatgaaggacggtaggaagctcgtagtaccatgcagacctcaagacgagttgataggtcgagcacggatcagtcagggggctgggtggagtttaagagaaactgcgtgtctaggtaaagcatacgctcaaatgtggtccctcatgtattttcatagacgggatctaagactagcgtctaacgcgatctgcagcgcagtacctgtacattgggtgccaacctctcgtaccacatggtcaattcatgctcaccatcagtggatgacaacggaagatatgttaactgtatggaaccgagtatggatagaagataacccatggatggaagacaaaacaccggtgaccacttgggaaaacgtaccctatctaggaaaaagagaagatcaatggtgcggatccctaataggactaacaagtcgtgcaacctgggcccagaatataccaacggcgatacaacaagtaagatcgctcatcggcaatgaggaatttctggattatatgccaagtatgaaacgatttcgcaaagaagaggaatctgagggagcaatatggtaa

SEQ ID NO: 23057 - RNA, 9873 nt, synthetic construct
  misc_feature 1..9873: note = derived and/or modified CDS sequence (opt6) from DENV-3__GU131851__SS-prME
  source 1..9873: mol_type = other RNA
acttctttatgcttagttatgatattacctgcagctttggcgttccatctgacgagtagagacggggaacctcatatgatagttggtaaaaacgaacggggaaaaagcctattattcaaaactgcctcaggtataaatatgtgtactcttattgcgatggatttaggtgaaatgtgcgatgatactgtaacttataaatgtcctcacataactgaagttgaaccagaagacatagattgttggtgcaacttaacgtctacgtgggtgacctatggtacttgcaatcaagcgggcgaaagacgtcgagataaacgcagtgtggctttagctccacacgtagggatgggactagacacccgtactcaaacttggatgagtgcggaaggggcatggcgacaagtagaaaaagttgaaacgtgggcactacgtcatcctgggttcaccattttggctctattccttgctcattacatcggtaccagtctaacacaaaaagtagtaatatttatacttctaatgcttgtaaccccaagtatgactatgaggtgtgtaggcgtcggaaacagagacttcgtggaaggattatcgggagccacctgggtagacgttgtcttagaacacggtggttgtgttacaacaatggctaaaaataaaccgacacttgacattgaacttcagaaaactgaagccacacaactagcaaccttacgaaaactgtgcatcgagggaaaaataacgaatatcacgacagatagtcgctgccccacacaaggggaagcggtcttgcctgaagaacaagaccaaaactatgtttgcaaacatacgtacgttgatagaggctggggaaacgggtgtgggttgtttgggaaaggctcattagtgacgtgtgcaaaatttcagtgccttgaacctattgaaggtaaagtcgttcaatacgagaatttaaaatatacagtaataataacagtgcatacgggggaccagcatcaagtagggaacgagacccagggtgtaactgctgaaataacaccacaggcttcaacgacagaagcaatattgccagaatatggaactcttggattagagtgttctccaagaacgggacttgactttaacgaaatgatattattgacgatgaaaaacaaagcatggatggtgcaccggcaatggttattcgacttacctctcccttggacaagtggagccacgacagagacacctacgtggaataggaaagaactcctagttacttttaaaaacgcccatgctaagaaacaagaagtagtagttctgggtagccaggaaggagcgatgcacacagccttaacgggggccacagaaatacaaaacagtggtggaacaagtatttttgcaggacacctaaaatgtagactgaaaatggacaaactcgagttaaaaggcatgtcatatgcgatgtgtacaaatacattcgtactaaagaaagaagttagtgaaacacagcacggcacaatcttaattaaagttgaatacagaggggaagacgctccttgtaaaattccgtttagtacagaggatggtcaagggaaagcccataacgggagattaattacagctaatccagtagtcacgaaaaaggaagaacccgttaacattgaagctgagccgccatttggcgaatcaaatatagtaattggaatcggtgacaacgcattaaaaatcaactggtataagaaaggatcatcaataggaaaaatgttcgaagcaaccgccaggggagcaagaaggatggcgatactaggagatacagcctgggattttggaagtgtgggaggcgtactaaattcattagggaaaatggtacaccaaatatttggaagtgcttatacagcattgttttcaggcgtatcatgggtaatgaaaataggaataggaatattattgacatggatcggactaaattccaaaaacacgagtatgtcatttagctgtattgcgatcggaatcattacgttatatctaggagcagtagtacaagcagacatgggatgcgtgataaactggaaaggtaaagaattaaaatgtggaagtggcatctttgtaaccaatgaagttcacacgtggacggaacaatataaattccaagcagatagcccgaagcgattagcaactgcgatcgcgggtgcttgggaaaatggagtatgtgggattcgaagcaccaccagaatggaaaatctgctctggaagcaaattgcgaatgaacttaactacatactatgggaaaacaatataaaactaacagtagtagtaggagatataataggtgttcttgaacaaggaaagcgcacattaactccccaaccaatggagttaaaatacagttggaagacatggggcaaagctaaaattgtaacagcggagactcaaaactctagctttataatcgatggaccaaacacacctgagtgtccctcagcttcccgagcctggaatgtttgggaagtagaagactacggattcggggtctttacaactaatatttggttaaaattaagggaggtatatactcaattatgtgatcacagattaatgtccgcggcggtaaaagatgaaagggcagttcatgccgatatgggatactggatagagagccaaaagaacggatcttggaaactagaaaaggcatctctaatagaagttaaaacgtgcacttggccaaaaagtcataccttatggagcaatggggtgctcgaaagcgatatgataattcccaaatcattagcgggaccaatatcgcaacataatcaccgcccaggttaccatacacaaactgccggaccttggcacttgggaaaacttgaactagacttcaattactgtgagggtactacagttgtaatcacggaaaattgtggtacgagagggccgtcgctacgaacaacgacagtatcggggaaacttatacacgaatggtgttgtaggagttgtaccttgccaccactgcgatatatgggtgaagatggttgttggtacggcatggaaatacgacctatcagtgaaaaagaagaaaacatggttaaaagtttagttagtgctggctctggtaaagttgataactttactatgggggttctatgtctagcgattttgtttgaagaagtaatgaggggaaagtttgggaagaaacacatgatcgcaggcgtctttttcaccttcgttctcttgctgtcaggccagattacttggagggatatgacacatacattaataatgattgggagtaatgcaagtgaccgtatggggatgggagttacatacttagccttaatagcgacgttcaaaatacagccattcttggctttagggttctttcttagaaaattaacctcgagagaaaacttactcttaggtgtggggcttgcaatggcaacaacgcttcaattgccagaagacattgaacaaatggccaatggtattgctcttgggctaatggcattaaagctaattacacaattcgaaacataccaactatggacagccttaataagtttaacatgcagcaataccatgttcacattgaccgtcgcgtggagaacggctacattaattttagcaggagtatccctattaccggtatgtcaaagtagctcaatgcgaaaaacagattggctcccaatggccgtcgctgctatgggagttccaccgttgccattgtttatttttagcttaaaagacactctcaagagaagaagttggccgttaaatgagggtgtgatggcagtaggcctagtctcgatactggcgagcagcttattaagaaatgatgttccaatggcgggaccactggtagctggtggactgctaatagcatgttatgttatcacaggaacatctgcagacttaactgttgaaaaagccgcagatattacatgggaagaagaagcagaacaaacgggagtatcccataatctcatgataacagtcgatgatgatggaactatgagaatcaaagatgacgaaacggaaaatatccttacagtactattaaaaacagcattactcattgtatcaggagtattcccatactccattccagcaacactattggtatggcatacttggcaaaaacaaacccaaagatccggtgtgttgtgggatgtcccaagtccacccgaaactcaaaaagcagaattagaagagggggtgtataggataaaacaacaagggatttttggaaaaactcaggttggtgtcggagtacaaaaggaaggtgtctttcataccatgtggcacgtgaccagaggcgctgtgttaacatataatgggaaacgtctagagccgaattgggcatctgtcaagaaagatctaatctcatacggaggaggatggaggctaagtgcgcaatggcagaagggtgaggaagtacaagttatagcggtagaaccaggtaagaatcccaaaaatttccaaactacccccggaacttttcagacaacaacgggcgaaatcggagcgatcgcattggactttaaaccaggtacgagcggaagcccaataattaacagagaaggtaaagtagtaggattatatggcaatggcgtggtaactaagaatggtggatatgtgagcggaatagcccagactaatgcggaaccagacggccctacaccagagctagaagaagagatgtttaagaaacgaaatctaacaattatggatttgcaccccggatcgggaaaaacaaggaagtatcttccagctattattcgcgaagcgataaaacgaagattaaggaccctaatactcgctcccactagagtggttgccgccgaaatggaagaggcgctgaaaggactccccattagataccaaacgacagcaaccaagtcggaacataccggcagagaaatagtagacctgatgtgtcacgcaacattcactatgaggcttctatccccagtccgagttccaaattacaatcttatcatcatggatgaggcacacttcactgatccggcttccatagctgctagaggatatatcagcacacgtgtaggaatgggagaagcagccgccatttttatgacagctacaccaccggggaccgctgatgcattcccgcaatcaaatgcgccgatccaagacgaggaacgggatattcctgaacgatcatggaactctgggaatgagtggattacggattttgccggaaaaaccgtatggtttgtgccatcgataaaagcaggaaacgatatagctaattgccttaggaagaatgggaagaaagttattcaactcagtagaaaaacctttgacactgaatatcagaaaaccaaactaaacgattgggacttcgttgtaacaaccgatatttcagaaatgggagccaacttcaaggcagaccgcgtaatagacccaagaaggtgtctgaagccggtaatcttgactgacggaccggaacgagtaatcctcgcgggccctatgccagtaactgcggcatcagctgcacaaaggagaggtagggtaggaaggaatccacaaaaagagaatgaccaatatatattcacaggccaaccacttaataacgatgaggatcacgcccactggacggaggcgaaaatgttattagataacataaatactccagaaggaataataccagcattgtttgaaccagaaagggaaaaatcagcagcaatagacggggaatatagactcaaaggagaatcaagaaagacatttgtagaattaatgcgtcgcggtgatctccccgtctggctagcgcataaggtggcatctgagggtatcaaatacacagatagaaaatggtgtttcgacggtcaacgcaacaatcaaatattagaggaaaacatggacgttgaaatatggactaaggaaggtgagaagaagaaacttcgacctaggtggcttgatgctaggacatacagcgatccccttgcattgaaagaatttaaagatttcgcagctgggagaaaatcaatagctctcgaccttgtaacggaaataggtcgtgtgccaagccacctagcccatagaacacgaaacgcgttagacaacttagtcatgttacacacatcagaacacggaggacgagcataccgacatgcagtagaggaacttcctgaaactatggaaactttattattactaggcctaatgattttgctaactgggggagcaatgctctttctaatttcaggtaaaggaataggtaagacaagtattggactcatatgtgtaatcgcaagtagcggaatgttgtggatggcagagatccccctacaatggatagcatccgcaatcgtattggagttctttatgatggtcctattgattccggaaccagaaaaacaacgtacaccgcaagataatcagctagcctacgtcgtcataggcatcctcacacttgcggcaataatagcagcaaacgaaatgggccttctggaaacaaccaagagggatttaggcatgtcaaaagaaccaggtgtagtaagtcctacaagttacttagatgtagatctacaccctgcttctgcgtggacactatatgctgtcgcgacaaccgtaattaccccaatgcttaggcacacgattgaaaattcaacagcaaacgttagcttagccgcgattgccaatcaagctgttgtattaatggggcttgataaaggctggcccatatcgaagatggatctaggtgttcctttactagcattaggatgttacagccaagttaacccattaacattaaccgccgccgtattactactgataacacattatgccatcattggcccaggtttgcaggcaaaggcaacacgcgaggctcagaaaaggaccgcagctgggataatgaaaaatcctacagtggatggtattatgacaattgacttagacccagttatttatgactccaaatttgaaaaacaactcggacaggtaatgctcctagtattatgtgcagtgcaattgctacttatgcgtacttcatgggctttatgtgaggctttaacattggcgactgggccgatcacaaccttatgggaaggatcaccaggtaaattttggaatactactattgcagtatctatggctaacatctttcgagggtcgtatttggcaggagccggcttagcgttctcaataatgaaatcagtagggaccggaaaacgaggcacgggatcacaaggtgaaacattaggagaaaaatggaagaagaaactgaatcagctaagtagaaaagaatttgacttgtacaaaaagtcaggaataacagaggttgacagaacagaggcaaaagaaggtctgaaaagaggcgaaatcacacatcatgcagtatcacgtggaagcgcaaaactacaatggtttgtagagcgaaatatggtaatacctgagggtagagttattgatctaggttgcgggagagggggatggtcctattattgtgcaggtctaaagaaagtaacagaagtacgtggatacactaaaggagggccaggccatgaagaaccggtacccatgagcacttatggatggaacattgtgaaactcatgagtgggaaagacgtcttctacttacctccggagaagtgcgataccttactttgtgacataggtgaatcatcaccaagtcctacagtagaggaaagtagaaccatccgagtcctaaaaatggttgagccatggctcaaaaataaccagttttgtattaaagtgttaaacccatacatgccaacagttatagagcatcttgaacgattacagcgaaagcacggaggaatgttagtaagaaatccattatctcggaactcaacccatgagatgtactggattagcaacggaacaggaaatattgtcgcgtcagtaaatatggtttccaggcttctgttaaatcggtttaccatgactcatagaagaccaactatagaaaaagatgtagacttgggtgctggcacaagacatgttaatgcggaaccagaaacaccaaacatggatgtcataggagaaaggattaaacgaataaaagaagaacacaacagtacttggcactacgatgatgagaatccatataagacttgggcctaccacgggtcatatgaagtaaaagcgaccgggagcgcttccagtatgatcaacggcgttgtaaaactactaacaaaaccatgggacgttgtccccatggtaactcaaatggctatgacagatacaacgccatttggccagcaacgtgtatttaaagagaaagtcgacactagaacaccacgatcaatgccaggtacacgaagagttatggagataacggcggaatggctttggcggaccttgggaagaaataaaaagccaagactatgtaccagagaggagtttactaagaaagtacggaccaacgctgccatgggtgcagtatttactgaagaaaatcagtgggacagcgcaaaagctgcggttgaagacgaggatttttggaagttagtcgatagagaacgggaattacataaacttggaaaatgcggttcatgtgtatacaacatgatgggtaaacgtgagaagaaattaggtgaatttgggaaggccaaagggagtcgagcgatttggtatatgtggttgggagctagatatttagagttcgaggcactagggtttctgaatgaggaccactggttcagccgggaaaatagctacagtggtgtggaaggtgagggactgcacaaattaggatatatcttacgcgacatatccaagatccccggcggtgccatgtacgccgacgacaccgcaggttgggatacgcgcataaccgaagacgacctacacaacgaagagaaaataacccaacagatggatcccgaacatcgacaactagcaaacgcaatattcaaattaacgtatcaaaacaaggtagtcaaagttcaaaggccgacccctaccggaacggttatggatattatttctcgaaaagaccaaagagggagtggacaagtcggtacatacggactaaatacttttactaatatggaggcgcaactaatcaggcaaatggaaggggagggagtcctctcaaaagcggatctagaaaatccacatctgcccgagaagaaaataacgcaatggcttgaaacgaagggtgtggaacgattgaaaagaatggcaatctcaggggacgattgtgtggtcaaaccaatagacgatagattcgccaacgcactgctagcacttaacgatatgggaaaagtgaggaaggatattccgcaatggcaaccaagtaaaggctggcacgattggcagcaagtaccattttgtagtcaccacttccatgagttaattatgaaagacgggcgaaagctagtagtaccatgcagacctcaagacgagcttatcgggagagcaagaatatcacagggagctggttggtccctcagggaaactgcttgtctagggaaagcatacgcgcaaatgtggagtctaatgtatttccatagaagagatctgcgtttagcctctaacgcaatttgttctgctgtgcctgtccactgggttccaacgagtcgaaccacctggagcatacacgcacatcatcagtggatgacgacagaagacatgctaacagtatggaacagggtgtggatagaggacaatccgtggatggaggataaaacaccggtaaccacctgggagaatgttccgtatttgggcaaacgagaggatcaatggtgcggatcattgatcggcctgacttcaagagctacatgggcacaaaatatacccaccgctattcaacaggttagaagtttaataggcaatgaagaatttttggattatatgccttcgatgaaaagattcagaaaagaagaagaatcagaaggagccatatggtaa

SEQ ID NO: 23058 - RNA, 9873 nt, synthetic construct
  misc_feature 1..9873: note = derived and/or modified CDS sequence (opt6) from DENV-3__GQ868547__SS-prME
  source 1..9873: mol_type = other RNA
acgagtttgtgcttggtcatgatattgcctgcggccctggcattccacttgacctctagagatggggaacctaggatgattgtcggcaaaaatgaacgaggtaaatcactactgtttaaaacagcaagtgggatcaacatgtgtacattaatcgcaatggacctgggagaaatgtgcgatgacacagtaacatataaatgtccacatataacagaagttgaaccagaagacattgactgctggtgtaatctaacatcaacttgggtaacatacggaacatgtaaccaagctggagaacggagaagggacaaaaggtctgtagctttagcgccacatgtagggatgggactagacacaaggacacaaacatggatgagcgcggaaggagcgtggaggcaagtagaaaaagtagaaacatgggctctaaggcatccaggtttcacgatacttgcattgtttctggcgcactacataggaacaagcctaactcaaaaagttgtaatcttcatactattaatgctagtgactcctagtatgacaatgcggtgcgtaggtgtaggaaatcgtgattttgtcgaagggctaagcggagcgacttgggtagatgtagtccttgagcatggtggatgcgtgacgacaatggctaaaaacaaaccaaccctagatatcgaattgcagaaaaccgaagctacgcaactagccacgctccgcaaactttgcattgagggcaaaatcactaacattactaccgactcgcgatgtcctacccaaggcgaagccgtattaccggaagaacaagatcaaaactatgtatgcaaacatacctacgtagatcgtggctggggtaatggctgtgggttattcggtaaaggtagcctcgttacctgtgcaaaatttcaatgcttagaaccaatcgaggggaaagttgttcaatatgagaatctaaaatatacggttattatcacagtgcacacaggagatcaacatcaagtaggaaatgaaacgcaaggagttacagcagagataactccacaagcgtcaacgacagaggccatcctacccgaatatggaacgttaggccttgagtgcagcccaagaacaggtttagatttcaatgaaatgattctattaactatgaaaaataaggcttggatggtgcataggcaatggttctttgatttaccgttaccatggacatcaggagcgactactgagactccgacatggaatagaaaagaacttctagtaacattcaaaaatgcacatgcgaagaaacaagaagtagtcgtcttaggatcgcaagagggtgcaatgcatactgctttaactggagccacggaaatacaaaatagcggaggcacctcaatattcgccggccatctgaaatgtcgactaaaaatggataaattagagttaaaaggcatgagttatgctatgtgcactaatactttcgtcctcaagaaagaggtgtcagaaacgcagcacggtacgatactaataaaagtggaatatagaggtgaagatgctccttgtaaaattcccttctctacagaagatggacaggggaaagcacataacggcaggctaataacagcaaacccagtggtgaccaagaaagaagaaccagttaacattgaagccgaaccaccatttggagaaagcaacattgtcatcgggataggtgataatgctttaaagattaattggtataagaaaggttcctctattggaaaaatgtttgaagcgacggcgcgaggagccagacgaatggcgatcctaggagataccgcttgggatttcggatcagttggtggggtactcaatagcttaggtaaaatggtccatcaaatttttggatcagcatacactgccttgttttcaggtgtgagctgggtcatgaaaatcgggataggaatacttttaacatggataggtctgaactcgaaaaatacatccatgtcatttagttgtattgctataggaatcataacactatacctgggagccgtcgtccaagcggatatgggttgtgtgataaactggaaaggcaaagaattgaaatgcgggtccggaatttttgttacaaatgaggtacacacttggacggaacaatacaaatttcaggcagattctccaaaaaggttggcaacagctatcgctggagcttgggagaatggcgtatgcgggatcagatccaccacaaggatggaaaatctcctatggaaacaaatagccaatgaattaaattatatcttgtgggaaaataatataaaattaacagtagtagttggcgatataattggcgtattagaacaagggaaaagaacacttactccccaacctatggaactgaagtattcctggaaaacttggggcaaagcaaaaatggtaactgcagagacacaaaacagcagtttcattatcgacgggccaaatacgcccgaatgcccatcagcaagtagggcctggaatgtctgggaagtagaagattacggatttggtgtgttcacaacaaatatatggttgaaactcagagaagttcacacccaattatgcgaccatcgacttatgtcagcggctgttaaagatgaacgggccgttcatgcggatatggggtattggatagaaagtcagaaaaatggtagttggaaacttgaaaaagcaagtctgatcgaagtaaaaacttgtacatggccaaaatcgcatactctatggtccaacggtgttctagaatctgacatgattataccgaagagtctggcaggacccataagccaacataatcatcgaccaggttatcacacacaaacagccggaccctggcacctgggaaaattagaactggacttcaattactgtgaaggaaccacagtggtaataactgaaaactgtggtacgagaggaccatctctcaggacaacaacggtgtcagggaaacttatacatgaatggtgttgccgcagctgtaccttacctcccttgcgttatatgggtgaggacggctgctggtacggaatggaaattcgtccgatatcagaaaaagaagagaatatggtgaaatctcttgtgagcgcaggtagcgggaaagtagataactttactatgggggtattatgcctagcaattttgttcgaagaagtgatgcgaggtaaattcggtaaaaagcacatgattgccggtgtatttttcacatttgtattattactgagtggccagataacatggagggatatgacacatacactgataatgatcggatcaaatgcttccgatcggatgggaatgggagttacgtatctagctctcatcgcaacattcaaaattcaaccatttttggctttgggattctttttaagaaagttgactagccgcgaaaatttacttctgggagtcggtttggccatggcgacaactctacaattaccggaggacatagaacaaatggctaacgggattgcgcttggacttatggctcttaaattaataacacaatttgaaacctaccaattatggactgcgctgatttctcttacctgcagcaacacaatgtttacgctcactgtagcatggaggacggcaacattaattttagctggagttagcttattaccggtatgtcaaagttcttcaatgagaaaaacagactggttaccgatggcagtcgcagctatgggagtaccacccctacctttatttatattctcattaaaagatactcttaagagacggagttggcctttaaatgaaggagtaatggctgtgggtttagtaagtattttggcgagtagccttctaagaaacgacgtgccaatggcggggccgttagttgctggaggattacttatagcatgctatgtaattaccgggacatcagcggacctgaccgttgaaaaagcagcagacataacatgggaagaagaagccgagcaaacaggagtaagtcacaacttaatgataacggtcgacgatgatggcacgatgagaataaaagatgatgagaccgagaacatacttacagttttactaaagacagcgctgctaatagttagcggagtgttcccatatagtatacctgcgacattactggtatggcatacttggcaaaagcaaactcaaagaagtggagttttatgggatgttccatcgccgcccgagacacagaaggcagagttggaggaaggtgtttacagaataaaacaacaaggaatattcgggaaaacacaggtaggtgttggggtacagaaggagggggtgtttcataccatgtggcatgtaactcgcggagctgttcttacatataacggaaaacgactcgaaccgaactgggcgagcgttaagaaagatttaatatcatatggtggcgggtggaggttatcagcacaatggcaaaagggggaagaagttcaagttatagcggtagaaccaggcaaaaaccccaaaaacttccaaaccaccccgggaacctttcagactacaactggagaaattggtgcaatagccttggacttcaaaccagggacgagcggcagccctataattaatagggaaggaaaagtcgtgggattatacggtaatggagtagtgacgaagaatggaggatatgtaagtgggatagcacaaacaaatgcagaaccagatggaccaactccagaactagaagaagaaatgtttaagaaaagaaatttaactataatggaccttcacccagggagtggaaaaacacgaaaatatttacctgctataatcagagaagcaatcaagcggaggctgcgcacactgatcctcgcgccaactagagtggtagccgcggagatggaagaggctctaaagggattgcctataagataccagacaactgccactaagtcagagcacaccggtcgcgaaatcgtagatcttatgtgtcatgcaacattcaccatgagactattgagccccgtaagagtcccgaactacaatctaataattatggatgaagcacattttacggacccagcaagcatcgcagccagaggatatattagtactagggttgggatgggagaagctgctgcgatattcatgacggcgacaccacccggcacagctgatgcattcccccagtcaaatgctccaatccaagacgaagaaagggatatcccagaacggagctggaatagtggaaatgagtggatcacagattttgcaggaaaaacggtatggttcgtcccatctattaaagctggaaacgatatagcaaattgcttaagaaagaacggcaagaaagtaatccagctatcgagaaaaacatttgacacagagtatcagaaaacaaaattaaatgactgggacttcgtagttactacagatatatccgaaatgggtgcaaacttcaaagcggatagggtaattgatccaaggaggtgtctcaaacctgtcatcttgaccgatggccccgaaagagtaatcttagcaggccccatgccagtcacagctgcatccgccgcacaacggagaggaagggtaggaagaaacccccagaaagagaatgatcaatatatatttacaggtcaaccattaaacaacgacgaggaccacgcccattggaccgaagcgaagatgcttctagataatataaacaccccagagggtataattcctgcgctgtttgaacctgaacgagaaaaatctgcagcaatagacggagaatatcgattaaaaggggaatcaaggaaaacgtttgttgaattaatgaggcgcggggatctccctgtttggctagcacacaaagtagctagcgaaggtataaaatatacagacagaaaatggtgtttcgacggtcaaagaaataatcaaatactcgaagaaaatatggacgtagagatctggactaaggaaggagagaaaaagaaactgaggccaaggtggttagatgcaaggacatactctgaccccctggctctaaaggagttcaaagattttgcggccggacgaaaaagcattgcactggacctcgttacagaaattggccgcgtaccgagtcacttagcacatcgcactagaaacgctctcgacaatctcgtaatgttgcacacgtcagaacacggagggagggcatatcgccacgctgtagaagagttgcctgagaccatggaaacactactcctactggggttaatgatcctattaaccggtggtgccatgctgtttctcatatccggaaaaggaattgggaaaacatctataggattgatctgcgtaattgcatcaagtggaatgctgtggatggctgaaattccattacaatggattgcatccgcgattgtcctagaatttttcatgatggtcttattaataccagaacctgaaaagcaaagaacacctcaggataaccaattagcatatgtagtgattggaatattaaccctcgcagcaataatcgctgcgaatgaaatgggcttacttgaaactacaaagagagatctcggtatgtcaaaggaaccaggagtcgtatctcccacatcatatcttgatgttgatctacatcctgcatctgcatggactctctatgccgtggctactaccgtaataaccccgatgctaagacatacaatcgaaaactctacagcaaacgtaagtctcgcggcgatagcaaatcaggcggtcgtactaatgggcctagacaaaggctggccaattagtaagatggaccttggggttccattactcgctttaggttgctatagtcaagtaaatccgttaactctaaccgctgccgtcctcttgttaataactcactacgcgattattggcccaggattacaagcgaaggctacgagagaagcacagaaaagaaccgcagctgggattatgaaaaatccaacagttgacggaattatgactattgatctagatccggtaatatatgattcaaaatttgaaaaacaactcggacaagtgatgttgttagttttatgtgctgtgcaacttctattaatgcgcacctcatgggccctatgtgaagcgctaactctcgcgactggtccgataactacactgtgggaaggtagtcctggaaaattttggaacaccacaatagccgtatcaatggccaatatattccgggggtcatatctagccggtgcaggattagctttctcgataatgaaaagcgtaggtacagggaaacgcgggacgggatcacaaggagagacactaggcgaaaagtggaagaagaaattgaatcaattaagtaggaaggagttcgatctttacaagaaaagtgggattacggaggtagatagaactgaagcaaaagaagggctgaaaagaggggaaatcactcatcacgccgtttcaagagggagcgcaaagctacagtggtttgtcgaaaggaatatggtaatcccggaaggacgtgttatagatcttggatgtggcagaggtggatggtcctattattgtgctggcttgaaaaaggtaacagaagttaggggatacacaaaagggggtcctggtcatgaagaacctgtcccgatgtccacatatggatggaatattgttaaattaatgtcgggcaaagacgtattttacttaccacccgagaaatgtgatactcttctctgtgacattggcgagtcaagccctagtcccacagttgaggaatcacgaacgattcgagtattaaaaatggtcgaaccatggctgaaaaacaaccaattttgtataaaagtcctaaacccttacatgcccactgtaattgagcacctagaaaggttgcagagaaaacacggtggaatgctagtaaggaaccctctttcaagaaactctacgcatgaaatgtactggatctcaaatggtacaggaaacatagtggcgagtgtaaacatggtgtcacgtctgttattgaatagatttacaatgacccaccgtagacccacaattgaaaaagacgtggacttaggagccggtaccaggcatgtaaacgccgagcctgaaacgccaaatatggacgttattggcgaaagaatcaaaagaataaaagaggaacataatagtacctggcattatgatgacgaaaacccatacaagacttgggcatatcacggaagctatgaagttaaggccacaggatccgcatcctcaatgataaatggtgtggtaaaactacttacaaagccctgggacgttgtgccaatggtgactcaaatggctatgaccgacacgaccccctttggccagcaacgcgtctttaaagaaaaggtcgacacgagaacaccaagatcaatgccaggaacacgacgagtgatggaaataaccgcagaatggttatggaggacattggggcgaaataagaaaccaagactatgcacaagggaggagttcacaaagaaagtaagaacaaatgcagctatgggagcggtatttacagaggaaaatcaatgggactcagcaaaagccgcagtagaagacgaagatttttggaaacttgttgatcgagaaagagaacttcataaactagggaaatgcggaagctgtgtatataatatgatgggtaagcgagaaaagaagctcggcgaatttggcaaagccaaagggtctagggcaatatggtacatgtggttaggtgcaagatatttggagttcgaagcgcttggttttctaaatgaagatcactggttctcaagagaaaattcttatagcggtgtggaaggcgaagggcttcataaacttggttacatcttgcgcgatatttcgaaaatccccgggggtgcaatgtacgcagacgacacggcaggatgggatacaaggattactgaggatgatttacataatgaggagaaaataacacaacagatggaccccgaacacagacaacttgcaaatgctatatttaagctaacataccaaaataaggtggtcaaagttcaacggcccacaccgacgggtacagtcatggatataatctcaaggaaggaccagagaggatcgggccaagtcggaacctatggtctcaacactttcacgaatatggaagcacaattaataaggcagatggagggggagggtgttctctcaaaagcggatttagaaaatccccatttacccgagaagaaaataacacaatggctggaaacaaaaggcgtcgaacgattaaagcggatggccatatcaggtgacgactgcgttgttaaacccatcgacgataggtttgcaaatgcattattagccttaaatgatatgggtaaggtacgaaaagacatacctcagtggcaaccaagtaaaggttggcacgattggcagcaagtaccgttttgcagtcaccatttccatgaattaataatgaaagacggaagaaaacttgttgtcccatgtcgtcctcaagacgaattaattggacgcgcaagaataagtcaaggcgcaggctggagtttaagggaaacagcttgcctaggaaaggcgtatgcacagatgtggagtctaatgtattttcaccgaagagatttacggcttgctagtaatgctatttgtagtgccgtacctgtacattgggtgccaaccagtcggaccacatggtcaatacacgctcatcaccaatggatgacaactgaagatatgctgacggtttggaatagagtatggatagaagataacccgtggatggaagacaagacacctgttaccacctgggagaatgtaccatacttaggaaagcgggaagaccaatggtgtgggagtctcatcgggctaactagcagagcaacctgggcacaaaacatacctaccgcaattcaacaagtcagaagccttatcggaaacgaggaatttttagattatatgccaagcatgaagcgatttaggaaggaagaagagagcgaaggtgcaatatggtga

SEQ ID NO: 23059 - RNA, 9873 nt, synthetic construct
  misc_feature 1..9873: note = derived and/or modified CDS sequence (opt6) from DENV-3__GU131857__SS-prME
  source 1..9873: mol_type = other RNA
acatcgctatgtttggtaatgatactacccgcagctttagcattccacttaacaagtagagatggagaaccacgtatgattgtaggcaaaaacgaaagaggaaaatccttacttttcaaaacagcatcgggaataaatatgtgcactcttatcgcgatggaccttggagagatgtgcgatgatacagttacttataaatgtcctcacataacagaggttgagccggaagacattgattgttggtgcaacctaacgagtacttgggtaacttatgggacatgtaatcaagcaggggaacgcagacgtgataaacggtcggttgccctagctccccatgttggaatgggtcttgacactagaacgcagacatggatgtcagccgaaggtgcctggcggcaagtggaaaaagtagaaacgtgggccctacgtcacccaggatttacaatactagctcttttcttggctcactacataggaaccagtctaacacagaaagttgtaatatttatacttttgatgttggtcacaccgtctatgacgatgagatgcgtgggggttggaaatagagatttcgtagaaggactaagtggagctacgtgggtagatgttgtcctagaacacggcgggtgtgttacaacaatggccaaaaacaaaccaacgcttgatatagaattacagaaaactgaagctacacagcttgccacgctacgtaaactatgcatagaaggaaaaatcactaacataacaacagatagccgttgccctactcaaggagaggccgtattacctgaagaacaagatcaaaactacgtatgtaaacatacttacgtcgatcgtggctggggaaatggctgcggactgtttggcaaaggcagtctggtaacatgcgcaaaattccaatgtcttgagcccatagaagggaaagtcgttcagtatgagaatttaaaatatacagtcataattacggtacatactggagaccagcatcaagtgggaaacgaaacgcagggagtcacggcagagattacaccccaagctagtactacagaagcaattcttccagaatacggaactctaggtctagaatgttcacctagaacgggattggatttcaacgagatgatattacttacaatgaaaaacaaagcatggatggtccatcggcaatggttctttgacctaccgctgccgtggaccagcggagcaacaacggaaactcccacatggaaccgaaaagagctattagttacttttaaaaacgcacatgcgaagaaacaggaagttgtagtcttaggatcacaggagggcgctatgcatacggcactgacgggcgcaactgagatacaaaattcaggcgggacctcaatctttgccggacatttaaaatgccgactaaaaatggacaaactagaactaaaaggtatgtcgtacgcaatgtgcaccaacacgtttgtattaaagaaagaggtcagcgaaacacaacacggcaccatactaataaaagtagaatatagaggagaagatgccccttgcaaaattccctttagcaccgaagatgggcaaggaaaagcgcataacgggaggttaataacggctaacccggtcgtaaccaagaaagaggaaccagttaacatagaggcagaaccgccattcggagagagtaatattgttatcggaataggtgataatgcactcaaaatcaactggtataagaaagggtcgagcatcggaaagatgttcgaagctacagctagaggagcacgccgaatggcgatactaggcgacactgcttgggatttcgggtccgtcggtggggtattaaattcattgggaaaaatggtacatcaaattttcggatcagcttatactgccttattctcgggcgtatcatgggtgatgaagataggtatcggaattttattaacatggattggattaaattctaaaaacacctcaatgtcttttagctgtatcgctatcggtattatcactttgtacctaggtgcagtcgtgcaggctgacatggggtgtgtaatcaactggaagggcaaggaattgaaatgtgggtcagggatattcgttactaacgaagtccatacttggactgaacagtataagtttcaggccgactcaccaaaaagattagcgacggccatcgcaggcgcatgggagaacggtgtctgtggaataagatctaccactagaatggaaaatttgttatggaaacaaatagctaatgaactaaattacattctctgggaaaacaatataaaattaactgttgtagtgggtgacatcataggggtgttggagcaaggaaaaagaacattgacgcctcaacccatggaactgaaatattcatggaaaacttggggtaaggcaaagattgtgacggcagagacccagaacagttcgtttattatagatggtcctaatacacccgaatgtccctctgcgagtcgagcttggaatgtctgggaagttgaagattatggtttcggagtctttaccacaaatatttggctaaaacttagagaagtatatacacaactttgtgatcacaggcttatgagtgcagccgttaaagatgaacgagcagtacatgcagacatgggttactggatagaaagccaaaagaacggatcatggaagttagaaaaggctagtttgatcgaagtaaaaacatgcacttggccaaagagccatacactgtggagcaacggtgtattggaaagcgatatgattatccccaaaagtctagcaggtccaattagtcagcataatcataggcccggataccacacacaaacggctggcccatggcatttagggaaacttgaactagactttaactactgcgaaggaacaacagttgtcataactgaaaactgtggtactcgaggtcccagcttacgcactacaactgtatcgggaaaacttatacacgaatggtgctgtcgatcgtgtaccctgcctcccttaagatatatgggtgaggatggatgttggtatggcatggaaatcagacctatttcagaaaaagaagaaaatatggtcaagtctctcgtaagcgccggttccggtaaagtagacaatttcaccatgggagtactttgtctagcaatattgtttgaggaagtaatgcgcggaaagtttggtaagaaacacatgatagcgggagtattctttaccttcgtgctgttactatcagggcagataacatggcgcgacatgacgcacacactgataatgatagggagcaacgcttcagatcgcatgggaatgggggtaacgtatttagctttgatagcaacattcaaaatccagccgtttctagctttaggattctttctaagaaagttaactagcagagagaatcttctgctcggggtgggactggccatggctacaactttgcaactgccagaggatatcgaacaaatggccaacggcatcgcattagggctaatggcattgaagctgattacccaattcgaaacgtatcaattatggacagctttaatatcactcacgtgttcaaacactatgtttacattaacagttgcgtggcggacagcaaccttaatccttgcaggagtatcgctactgccagtttgtcagtcatcaagcatgagaaaaactgactggctcccaatggctgttgcggcaatgggggttccaccattacccctgtttatatttagtctcaaagacaccttgaaaagaaggtcctggccattgaatgaaggtgtcatggcagttggactcgtatccatactagcatccagtctcttaagaaacgacgtaccaatggcgggtccattagttgctgggggtctattaattgcatgctatgttatcacaggaacaagtgccgacttaacagtagaaaaagcggctgatataacgtgggaagaagaagccgagcaaacaggggtatctcataatttaatgataacagtcgacgatgacggaacaatgagaatcaaagacgatgaaacagagaatatactgactgtattactaaaaaccgcgttactaatagtaagtggtgtttttccctatagtattccggcaacccttctcgtctggcatacatggcagaaacagactcagagaagtggagtgttatgggatgtgccttcaccacccgaaacacaaaaagcagagttggaagaaggggtatatcggattaaacagcaaggaatatttggaaaaacacaggtaggtgtcggagtgcaaaaagaaggagtatttcatactatgtggcacgtaactaggggagccgtacttacatataatggtaaaagattagaaccgaactgggcatcagtcaagaaagacttaatatcttatgggggtggatggaggcttagcgcacaatggcaaaaaggagaagaagtccaggtaatcgcagttgaaccaggcaaaaacccgaagaattttcagactacacctgggacctttcagacaacaactggtgaaatcggagctattgcacttgattttaaaccaggaacatccgggagcccaattataaatcgtgaaggtaaagttgtaggcttgtatggcaatggtgtcgttactaaaaatggaggatatgtaagtggcatcgcacaaacgaatgcggaacccgatggaccaacaccggaactagaagaagagatgtttaaaaagagaaacctaacaataatggatttgcatccaggaagcggtaaaactcgaaaatatctgccggctataatacgggaagcaataaaacggcgattaaggactttaatactagctcctactcgtgtcgtagccgcggagatggaagaagcgttaaaaggtctaccaatcagataccagactacagcaacaaagtccgagcatacaggacgagagatagtagacctaatgtgtcatgcaactttcacaatgcgcctactgtcacccgtgagggtacccaattacaacctgataatcatggatgaggctcactttacagatccagccagcattgctgcacgtgggtacatatcaacgagagtcggaatgggtgaggcggcggcaatatttatgacggcaacacctccaggaactgcggatgcgtttcctcaatcaaacgcaccaattcaagatgaagaacgtgatatcccagaaaggtcttggaatagtggaaatgaatggatcactgattttgttggaaagacagtatggttcgttccttcaataaaagccggtaacgacatagcaaattgtctcaggaaaaatgggaagaaagtaattcagctatccagaaaaaccttcgacactgaataccaaaagactaaattgaatgattgggactttgttgtaaccaccgacattagtgaaatgggtgccaacttcaaagcagatagagtaatagatccgaggagatgtttaaaaccagtaatactaacagacggaccggaaagagtgatattggctggacctatgcccgtaacagcagcaagtgcagctcagcgtaggggtagagtgggaaggaatcctcaaaaagaaaacgaccaatatatttttacaggccaacctttaaataacgacgaggatcatgcccattggacagaagcaaaaatgttattagacaatattaatacccctgaaggcatcatacctgcactcttcgaaccagaaagagagaagagtgcagcgattgatggcgaatatagattgaaaggcgagtcacgaaaaacattcgttgaacttatgcggcgaggggatctgccagtttggctggctcacaaagtagctagtgagggaataaagtacacggatcgcaaatggtgtttcgatgggcaacgtaacaaccagattctagaagaaaatatggacgtagaaatatggacaaaagaaggagagaaaaagaaactcagaccgcggtggctagacgcgcgaacctacagcgaccctcttgcactaaaagaatttaaagattttgctgcaggtcgcaagtcgattgctctggaccttgtaactgaaataggtagagtaccttcacaccttgcccacaggaccagaaatgctttagacaacttggtgatgctacacacaagtgaacatggcggcagagcctatagacatgcagtcgaagaattgccagaaactatggaaacacttttacttctagggttgatgatattgttaactggtggagctatgttatttctcatttcaggtaagggaataggaaaaacaagcataggcctcatatgtgtcatagcgtcaagtggaatgctatggatggcggaaattccattacagtggatagctagtgcaatagtacttgagttcttcatgatggtcttattgataccagaacctgagaagcaacgaacaccccaagacaaccaacttgcttatgtagtaattggcatactcaccctggcagccatcattgcggcaaacgaaatgggcctcttagaaacgacaaaaagagatctgggaatgagtaaagagcctggggtagtctcaccaacgtcgtacttagacgtcgatttacatcccgcatctgcctggaccttatatgccgtagcaacaacagtaattacaccaatgttgcgacatacaatagaaaattctactgctaatgtctcgctggccgcgatagcaaaccaagctgtagtactaatggggttagataaaggttggccaatatccaagatggacctgggagttccactactagcacttggttgttattcacaagtaaatcctttaacactaactgctgcggttttacttctaattacacattatgccatcattggtcctggactgcaagcgaaggcaacccgggaagctcaaaagcgtaccgcagctggaataatgaaaaacccaacagtagacgggatcatgacaatagatctagacccagtaatatacgattctaaatttgaaaaacaactaggtcaggttatgttattagtattgtgcgccgttcaactacttttgatgagaaccagctgggctctttgcgaagcactaacgttggcgactggtcctattacaacactatgggagggatctccaggcaagttctggaatacaactattgcagtctcaatggctaatatttttcgtggtagttacctcgccggagcgggattagcattttcaattatgaaatcagttggaaccgggaaacgtggaacaggctcacaaggcgaaaccctaggggaaaagtggaagaagaaactgaaccaactatcgagaaaagaatttgatttatataagaaatccggtataacagaagttgacagaacagaagctaaagagggactaaaaaggggtgaaataacacatcatgccgtttcccgtggttcagctaaactacaatggtttgtggaaaggaatatggtaataccagaggggagagtaatagaccttggatgtggacgaggaggatggtcttattactgtgcggggttaaagaaagtaaccgaagttagaggttatacaaaaggcggccctggtcatgaagaacctgttccgatgagtacttacggatggaatatagtcaaattaatgtcgggaaaagacgtgttctacctccctccagagaaatgcgatactttattgtgtgacataggggaatcatcgcccagtccaactgttgaagaatcccgaactatccgtgtcctaaaaatggtagagccttggttgaaaaacaatcaattctgcatcaaggtactaaacccatatatgccaaccgtcattgaacatctagaacggttacagagaaagcatggagggatgctagttagaaaccccctcagcagaaattctactcacgaaatgtactggatatcgaatggaaccggaaacatcgtcgcaagtgtcaatatggtttcaagattactcttaaatcgatttaccatgacacacagacgtccaacaatcgagaaagacgtagacttaggcgcaggaacccgacatgttaatgcagaaccagaaacaccgaatatggacgtaattggggaaaggattaagcgaattaaggaagaacataatagcacatggcactatgatgacgaaaatccatataaaacctgggcatatcacggcagctacgaggtaaaggcaacaggtagtgcaagttcgatgataaatggtgttgtaaaactattgacgaaaccatgggatgtagttccaatggtcacgcagatggctatgactgacacaactccttttggccaacagagagtttttaaagaaaaggttgacaccaggacgccaaggtcaatgccaggaaccagaagagtaatggaaattacggctgaatggctatggcgtacacttggacggaacaagaaaccaagactttgtacaagagaagaatttacaaagaaagtacgcaccaacgcagcgatgggcgcagtattcactgaggaaaatcaatgggatagcgccaaagcagcggttgaggacgaggatttttggaagctagtagatagggaaagagaattgcacaaactcggaaaatgcggatcatgtgtctacaatatgatgggaaaaagagagaagaaattgggtgaatttgggaaagcgaaaggtagtcgcgccatttggtacatgtggctcggcgcaaggtatctggaatttgaggcattggggtttttgaatgaagaccattggttctcacgtgaaaattcttattcaggagttgagggagaaggccttcataagttaggatacattctcagggatatttcaaaaatacctggaggagcgatgtacgcagacgacaccgcaggatgggataccagaataactgaagacgatctgcataacgaggagaaaatcacacaacagatggatcccgagcatcgacaattagcgaatgcgatcttcaaactaacgtaccagaataaggtagtaaaggtgcaaaggcctacgccaactggaacagtaatggacataatatcgcgtaaggaccagaggggttcaggacaagtagggacctatggacttaacactttcacaaacatggaggcacaattaatacggcaaatggaaggtgagggcgttctgtcaaaagctgacttggaaaatccccaccttcccgaaaagaaaataacgcaatggctagaaacgaagggggttgaacggctcaaacgaatggctatcagtggtgatgactgcgtcgtcaaacctatcgacgatagattcgcgaatgcattgcttgcattaaatgatatgggtaaagtaaggaaagatatccctcaatggcaaccttccaagggatggcacgattggcaacaggttccattttgcagccaccattttcacgagctcatcatgaaagacggcagaaaacttgttgtcccgtgccgtccacaagatgaattgataggcagagctcgtattagtcagggagcaggttggtcgctcagagagactgcatgtttaggtaaagcctacgctcaaatgtggtcgctaatgtattttcaccgaagagatttgcgcttagctagcaatgcaatatgcagcgctgtacccgttcactgggtacctacgtccaggacgacatggtcaatacatgcacaccaccaatggatgactactgaagatatgctaacggtctggaatagggtttggatagaagacaacccgtggatggaagacaaaacaccagtgactacgtgggaaaatgtaccatacttaggaaaaagagaagatcaatggtgcggtagtttaattggacttacctcgcgtgccacatgggcgcagaatatacctactgcaatacagcaagtaagatcactcatcggaaatgaagaatttttagattacatgccaagcatgaaaagatttagaaaagaggaagaatcagaaggagctatatggtaa

SEQ ID NO: 23060 - RNA, 9873 nt, synthetic construct
  misc_feature 1..9873: note = derived and/or modified CDS sequence (opt6) from DENV-3__GU131858__SS-prME
  source 1..9873: mol_type = other RNA
acaagtttatgtctagtaatgatattaccagctgcactggcgtttcatctgacaagtcgagacggagaaccaagaatgatcgtcgggaaaaatgaaagaggaaaatcgctattattcaaaacagcatcaggaataaacatgtgcaccctaattgcgatggatcttggagaaatgtgcgatgacactgtaacatataaatgtccgcatatcactgaagttgaaccagaagacatagattgttggtgcaatttaaccagcacttgggtgacctacggaacatgtaatcaagcaggagaacgacgacgcgataaaagaagtgttgcattagcgccacatgtcggcatgggactagatacaagaacccaaacatggatgtctgcagaaggagcttggaggcaagtggaaaaagtagaaacatgggccttgcggcatccaggtttcacaatactcgcgttatttctcgcgcactatatcggcacttcattaactcaaaaagtagtgatattcattttactcatgcttgtcacgccatccatgactatgcgctgtgtaggagtcggtaatcgagatttcgtcgaaggcctgtcgggtgcaacatgggtcgatgtagtacttgaacatggaggatgcgtaacaaccatggccaaaaataaacctacacttgacattgaacttcagaaaacagaagcgactcaactcgctacccttcgaaaattatgtatagaaggaaaaatcacaaacattactacggactcccgatgccccactcaaggtgaagctgtgttacctgaggaacaagaccaaaattacgtatgcaaacacacatacgtcgaccgaggctggggtaacggatgtggattattcggaaaaggatctctggttacctgcgccaaattccaatgtcttgaacccatagaaggtaaagtagtgcaatatgaaaacctcaaatataccgtcatcatcacagttcatactggagatcaacaccaggtgggaaatgaaacacaaggtgttacagcagaaattacaccccaagcatcaactacggaagcaatcttgcccgagtacggaacgctgggtttagaatgcagtcccagaacaggtcttgatttcaatgaaatgattcttttgaccatgaaaaataaagcgtggatggtacatagacaatggtttttcgatctccccctcccgtggacaagcggagcaacgaccgagacacccacttggaatcgaaaagaactattagtaacatttaaaaatgcccatgcaaagaaacaagaagtagtcgttctaggaagtcaagaaggagctatgcatacagcactgacaggtgcgacagaaatacaaaatagtgggggaacaagcatttttgccggtcacctgaaatgtagactgaaaatggataaattagagttaaaaggtatgagttacgctatgtgcacgaatacgttcgttttgaagaaagaggtaagtgaaacccaacatggtactatacttataaaagtagaataccgaggggaagatgccccttgtaagattcccttttcaacagaagatggtcaaggaaaggcgcacaacggcaggctaattactgcaaatcctgttgtaattaagaaagaagaaccagttaacattgaggcagaaccaccgtttggtgaatccaatattgtaatcggcatcggggataacgcactgaaaataaactggtataagaaaggaagtagcataggaaaaatgtttgaggcgacagcacggggcgcaaggagaatggcgatactaggagacacagcgtgggactttggctctgtaggtggagtattaaactcacttggtaaaatggtacatcaaatatttgggtcagcatatactgcgctcttttccggagtatcgtgggttatgaaaatcgggataggaatattgctgacgtggataggattaaacagtaaaaatacttcgatgagcttttcttgcatcgcaattgggattataacattatatttaggggctgtagttcaagcagacataggttgtgtaattaattggaagggcaaagaacttaaatgtggatcgggaatattcgttactaacgaggtacatacatggactgaacagtataaatttcaagcggacagtccaaaaagactagcaacggcaatcgcaggagcctgggaaaatggcgtatgcgggattagaagcacaactcgcatggaaaacttattatggaaacaaatagctaatgaattgaattacattctatgggaaaacaatatcaaactgacggtggtggttggggatataataggagtgctagaacaaggtaagaggacattaaccccgcaacctatggagcttaaatattcgtggaaaacttggggtaaagccaaaatagtaacagctgagactcaaaattcaagtttcataatcgatggacctaatacaccagaatgcccatcagcatcgagagcgtggaacgtctgggaagtagaagattatggtttcggtgtctttacgacaaacatatggcttaaattgcgcgaagtgtatactcagttgtgtgaccaccgattaatgtcagcggctgttaaagatgaacgagctgttcacgcagacatgggatattggatcgaatcacagaaaaatggctcttggaaactagagaaagctagtctaatagaggtcaaaacgtgcacctggcccaaaagccacactttatggagcaatggagttttagagtcggacatgataatacccaaaagtcttgccggcccaatttcccagcataaccatcgacctggctatcacacgcaaactgcaggaccttggcacctcggcaaactagagttggattttaactactgtgagggtacaacagtagttataactgagaactgtggaacttcaggaccatcactaacaacaacaacagtaagcgggaagctaattcatgaatggtgttgtcggtcatgcaccttaccgcctctaagatatatgggagaagacggttgctggtatggcatggaaattcgtccaatttccgagaaagaagaaaacatggttaaatcgttggtatccgctggatcgggcaaagtagacaattttacaatgggcgtactatgtttagccatactatttgaagaagttatgagaggaaaatttggcaagaaacacatgatagccggcgtattctttacatttgtattgttattatctggtcaaataacgtggcgagacatgacacatacccttataatgattggatcaaacgcaagcgatcgtatgggaatgggcgttacatatttagcattaatcgctactttcaaaattcaaccatttttggcattaggctttttccttcgaaaactcacatccagagagaacttactcttgggggtaggactagcaatggctacaacactgcagttacctgaggatatagaacaaatggcgaacggcatagctctgggtttaatggccctgaaacttattacacaatttgaaacataccagctatggaccgcactgattagtctaacctgttcgaataccatgttcactttaacggtagcgtggagaaccgcgacgctaatactagcgggcgtgagcttattgccagtatgtcaatcctcaagtatgaggaaaactgactggctgccaatggcggttgccgcaatgggtgtcccacccctccccttgtttatcttctctctaaaagacacgctgaaacgtaggtcatggccactaaatgagggtgtaatggccgtaggattagtaagtatactcgcatcaagcctactaagaaacgacgtacccatggccggtccgctagtagctggtggcttattgatagcctgttacgttataactggaacaagtgcggatttgactgtagaaaaggccgctgatataacatgggaggaagaggcagaacaaaccggagtcagtcacaatctcatgattacggtagatgatgatggaactatgcggattaaagatgatgagacagaaaatatattaactgttctacttaaaacagcattattaattgtaagtggggttttcccatacagcatccctgccacattacttgtttggcacacgtggcagaagcagacacagcgcagcggtgtcctatgggatgttccctcgcccccagaaactcaaaaagcagaattggaggaaggggtttatagaataaaacaacaaggtatcttcgggaaaacacaagttggggtgggggttcaaaaagaaggagtcttccacacgatgtggcatgtaacccggggtgccgtgttaacctacaatggtaaaagattagaacccaattgggcatctgttaagaaagacctcattagttatggcggaggatggagattaagcgcgcagtggcaaaaaggcgaggaagttcaggtcatagcagtagaacctggcaaaaatccgaaaaattttcaaaccatgccaggtacgttccaaaccaccacaggagaaattggtgccatagccttagatttcaaacccggcacttccggatcacctatcattaatagggaaggaaaagtagttggattatacggaaacggtgtagtgacgaaaaacgggggctatgtatctggaattgcacaaacaaatgcggaacctgatggtccaacacctgagctagaagaagaaatgttcaagaaacgcaatctcaccataatggacttacatccaggatcaggcaaaactcgtaaatatcttcctgcgattattcgagaagctatcaaacgtaggctccgtacattaatacttgcacctacaagggttgtcgcagccgaaatggaagaggcacttaaaggattgcctatccggtatcaaaccacggcgacgaagtcagaacacacagggagagagatcgtcgacttaatgtgccacgcaaccttcacaatgaggttattatcaccggttagagttcccaattacaatttaattataatggacgaagcgcacttcacggatccggcctcaattgcggctagaggttatatttcgacaagagtgggtatgggtgaggccgcagccatttttatgacagccacacctcctgggactgcagatgctttcccacaatccaacgcaccgatacaggacgaggaaagagatataccagagagatcctggaactcaggaaatgaatggataacagatttcgttggcaagacagtttggtttgtacctagtataaaagccggcaacgatatcgcaaattgtttgaggaaaaatggcaagaaagtcattcagctaagcagaaaaaccttcgatacagaatatcagaaaacgaaacttaacgactgggatttcgtcgtcacaacagatatctctgaaatgggagcaaatttcaaagcagatagagtgatagatccacggaggtgtttgaagcctgttatacttacggatgggccagaaagagtaattttagcaggccccatgccagtcaccgccgcttccgcagcgcagagaaggggtcgcgtaggtagaaatcctcaaaaagaaaatgaccagtacattttcactggtcaaccattaaacaatgatgaagaccacgcgcactggactgaagcaaagatgctcctagataatattaatacccccgaaggtataataccagcactatttgaaccagaacgagagaagtctgccgcaatcgatggggaatacagactgaaaggggagagcagaaagactttcgttgaacttatgaggagaggagacctacctgtatggctagcgcataaagtcgcatccgaagggataaaatatacagacagaaagtggtgttttgacggccaacggaataaccaaatactagaagaaaatatggacgttgaaatatggacaaaagaaggagagaagaagaaattacgtcctcgctggttagatgcaaggacttattccgacccattagcattaaaggaatttaaagattttgcagcgggaagaaaaagtatagctttggatctagttaccgaaattggaagggtaccgtcccacctcgcccataggacgcggaatgctctggataacttagtgatgttgcacacatctgaacatgggggcagagcttataggcacgcagtagaggagttaccggaaactatggaaaccctacttttgctaggattaatgattttgctaacagggggagcaatgctatttcttataagcggaaaaggtattggtaaaacatcaatcgggcttatctgtgttattgcatcttccggaatgctttggatggcagagatacccctgcagtggatagcaagcgcaattgttctagagttctttatgatggtgcttctaataccagaaccagagaagcaacgtactccacaagataaccagctagcttatgtagtaataggaatccttactctcgcagcgattatagcagccaacgaaatgggactacttgaaaccacaaagagagacctaggtatgagtaaagaacccggcgtagtaagcccgaatagctacttggatgtcgacctccatccagcgtccgcttggactttgtacgccgtagcaacgacagtcattacaccgatgttgcgacatacgatcgaaaatagtacagcaaatgtatctttagccgccatagcaaaccaagctgtagtgttaatgggcttagataagggatggcctatatctaagatggacctaggagtacctttattagcacttggttgttatagtcaagtcaatcctcttacattgactgcagcagttttactattgattacacactacgcaatcataggcccagggctgcaagcaaaagcgacacgcgaggctcagaaacgaacagcagctggcattatgaaaaatccaactgttgatggaatcatgactatagacctggaccccgttatatacgacagtaaatttgagaaacaactaggacaagttatgcttttagttttatgtgctgtacagttacttttgatgagaacttcatgggctttatgcgaagccttgacgttggctacaggacctataacgaccctatgggagggtagccccggtaaattctggaatacaactattgctgtcagtatggcgaatatatttcgaggaagctacctagctggagcgggtttggccttttctataatgaaaagcgtgggaactggcaagcgcggaacaggcagccagggagaaacacttggggaaaaatggaagaagaaactcaatcaattatctagaaaagaatttgatctatacaaaaagtctggaataacagaagtagatagaacggaggccaaagaaggattaaaaagaggggaaattacgcaccatgcagttagtcgaggttccgcaaaattacagtggtttgtcgaaaggaatatggtcataccagaaggccgagtaatagatctaggctgtggacgaggcggttggtcatattattgtgcggggttaaagaaagttacagaggttcgaggttacacaaaaggcgggcccggacatgaagaaccggtgcctatgtctacgtatggttggaatatagtaaagctaatgtcgggcaaagatgtattctatctaccacctgaaaagtgcgacactctactatgtgatatcggtgagagttctcctagtccaacagtagaagagtctcgaacaataagagtactcaaaatggtggagccatggctcaaaaataaccagttttgtataaaagttctcaacccttatatgccgacggttatcgagcatctagagaggttacagcggaagcacggtggtatgcttgttagaaacccattgtcaagaaatagtactcatgaaatgtattggatttctaacggaaccggaaatatagtggcatctgttaatatggtatctcggttattgctgaatagatttactatgacacacagacgaccgacgatagagaaagatgtagacctcggtgccggcacgcgacatgtaaatgctgaacctgagacacccaacatggacgtaataggagaacggattaaaagaataaaagaagaacataactcaacttggcactatgacgatgaaaatccatacaagacatgggcatatcatggcagttatgaggtcaaagcaacaggatcagcgtcttcaatgataaatggcgtagtgaaattgctgacgaaaccctgggacgtagtcccaatggtaacccaaatggcgatgacagacaccacaccattcgggcaacaacgtgtttttaaggagaaagtggatacaagaacgccaagatcgatgccaggaacacgccgtgttatgggaattacagcggaatggttatggagaacgttaggacgtaataaaaagccaagactatgcacaagagaagaatttacgaagaaggtaaggacaaatgctgcgatgggggcagtgtttacggaagaaaaccagtgggacagtgcaaaggcagccgtggaggatgaggatttctggaaacttgttgatagagaaagagaactccacaagttaggtaaatgtggtagctgtgtatataatatgatgggtaaacgagagaagaaacttggagaatttggaaaagcaaagggaagcagggccatatggtacatgtggttgggagcaagatacttagaatttgaagccttaggtttcttaaatgaagatcactggttcagtagggaaaattcctattcaggagtagaaggcgaaggactgcataagctcggttacattttaagggacattagcaaaatacccggaggagccatgtatgcggatgataccgcaggctgggatacaagaataaccgaagatgacttacataacgaagagaagattacacaacagatggaccctgaacatcgacaacttgctaatgctatattcaaattaacctatcagaacaaagttgttaaagtgcaaagaccaacgcctaccggaacggtaatggacattatttcgcgaaaggaccaacggggatcagggcaagtcgggacctatgggctaaataccttcacaaatatggaagcccagttaattcgtcaaatggagggggagggggtcctgtcaaaagctgatttggaaaaccctcatttaccagagaagaaaataacacagtggcttgagacaaaaggggtagaacgtttaaaacgaatggcgatctcaggagatgactgtgtagttaaaccaatagacgatagattcgcaaatgcattactggctctcaatgacatgggtaaagtgcgaaaagacatcccgcaatggcagccatctaaagggtggcacgactggcagcaagtaccattctgtagccaccatttccatgaattaataatgaaagatggaagaaaactggttgtcccatgtcggccacaagacgaactaattggtagagcaagaatttcacagggtgcaggttggagcctaagggaaactgcatgtcttggcaaagcatatgctcaaatgtggagtttaatgtatttccaccggcgagacctaagattggcatcgaatgcgatttgttcagcagtacctgtccactgggtccctacttcgaggacgacctggagtatacatgcgcaccatcaatggatgactacggaagatatgttaactgtctggaatcgagtatggatcgaagataatccatggatggaagacaaaacaccagtaactacttgggaaaacgtaccatacttaggaaaacgagaagaccaatggtgcggaagtttaataggcctcacctcaagagctacatgggcccaaaacataccaaccgctatacaacaagttcgatcccttatagggaacgaagagttcttagactacatgccatctatgaaacgatttcgaaaggaggaggaaagtgagggtgcgatttggtaa

SEQ ID NO: 23061 - RNA, 9873 nt, synthetic construct
  misc_feature 1..9873: note = derived and/or modified CDS sequence (opt6) from DENV-3__GQ868548__SS-prME
  source 1..9873: mol_type = other RNA
acatcgctatgtttagtcatgatcctgccagcggcattggcatttcacttaacttccagagacggagaaccaagaatgatagtgggcaaaaacgaacgagggaaaagtctattgttcaaaacagcgtctgggataaacatgtgtactctaatcgctatggatttgggagaaatgtgcgatgatacggttacttataaatgcccacatataactgaagtagaaccagaagatatagattgttggtgcaatctgacgtcgacctgggttacatatggtacctgcaaccaagctggggaacggagacgagataaacgatcagtagcgctggctccacatgtcggtatgggcctagatactcgtactcaaacatggatgagtgcagaaggcgcatggaggcaggtcgagaaagttgagacatgggcgttaaggcaccctggttttacaatactagccttattcttagcccactatataggcacttcgctaacacagaaagtcgtcatctttatactactaatgctagtgaccccaagtatgactatgagatgtgtaggggtaggtaatcgcgactttgtcgaaggactaagcggggctacgtgggtagatgtagtcctagaacatggtggttgtgtgacgaccatggccaaaaataaaccaacacttgatattgaattacagaaaacagaagcaacccagttagcgactttacgaaaactatgtattgaaggaaaaatcacgaatattacaacagactctaggtgtccaacacagggagaagcagttctaccagaagaacaagatcaaaactatgtgtgcaaacatacttacgtcgatagaggctggggtaatggatgtggtctgtttggcaaaggttctttagttacatgcgcaaaattccagtgcctagaaccaattgaaggcaaagttgttcagcacgaaaatttaaaatatacagtaatcatcacagtacatacaggagatcaacatcaagttggtaacgaaacccagggagtaaccgcagaaataaccccacaagcgtccacaactgaagctatacttccagaatatggtactttaggccttgaatgctcaccacgtacaggtctagattttaacgaaatgattctactaacaatgaaaaacaaggcttggatggtacatcgacagtggttctttgacttgcctctgccatggacgagtggtgctactacagagacaccaacatggaacagaaaagaattattagtaactttcaaaaatgcacatgccaagaaacaagaagtcgtcgtattaggtagtcaagaaggtgcaatgcatactgcgctaacaggagcaacagagatacagaactctggcggaactagcatttttgcaggacacttaaaatgccgactaaaaatggacaaattagaattgaaaggcatgtcatatgcgatgtgtacgaacacatttgtgttaaagaaagaagtatctgagactcaacatgggacaatcctaattaaagtagagtatagaggcgaagacgcaccgtgtaaaataccattctctaccgaagacggacaaggtaaagcacacaatggaagactaattactgccaatccagtggtcactaagaaagaagaaccagttaatatagaagcagaacccccgtttggagaatccaatattgtgattggtataggggataacgctttaaaaataaattggtataagaaaggttctagcataggcaaaatgtttgaagcgacggcaagaggcgctcgtaggatggcaatactaggggatacagcttgggattttgggagcgttgggggagtgttaaactcacttggtaaaatggttcaccagattttcgggtcagcttatacagctttattctcaggcgtcagctgggttatgaaaattggcattggaatactcctaacatggatcgggctcaattctaaaaacacctctatgtcgttttcctgtattgctatagggatcattaccttatacttaggagcggtagtgcaggcagatatgggatgcgtcataaattggaaaggtaaagaactgaaatgtggatcaggtatcttcgtcaccaacgaagtacacacatggacggaacaatataaatttcaagcagatagtccaaaacgcctcgcaacagccatagcgggagcttgggaaaatggagtttgcggcattcgcagcacgaccaggatggaaaatttactatggaaacaaatagcaaatgaattaaactatatcctctgggagaataatataaaactaacagtagtcgtaggcgacatcattggagttctggagcaagggaaaagaacacttacaccgcaaccaatggaactaaaatacagctggaaaacttggggaaaagctaaaattgtaacggctgaaacacaaaacagttcttttatcatagacggaccaaatacaccagaatgcccttccgcatctagggcctggaatgtttgggaggttgaagattacggatttggtgtttttactacgaatatttggcttaaactgcgagaagtctatacacaattatgtgatcacagacttatgagcgctgctgtaaaagatgaaagggctgtccatgctgacatgggatactggatagagagtcagaaaaatggttcgtggaaattagaaaaagcatcactaattgaggtgaaaacttgcacatggcctaaaagccacacgttgtggagtaacggagtcctggaaagtgatatgataattcccaaatcactagcaggaccaatatcgcaacacaatcacaggccggggtatcatacacaaacggctgggccgtggcatctaggaaaacttgaattagattttaattattgtgaaggtactacagtagtcatcaccgagaactgtggaacaagaggtcccagcttaagaacaaccacagttagcggtaagctaatccatgaatggtgttgtagaagttgcactttaccccctctaaggtacatgggagaagatggatgctggtatggcatggagattagacctatttccgaaaaagaagaaaacatggttaagagcttagtgtcagccggaagcggtaaagttgacaattttacaatgggagtactatgtttagcaatccttttcgaggaagtaatgagaggcaagttcgggaagaaacacatgatagcaggcgtattctttacctttgtactgttgttaagcggtcaaataacctggcgagatatgacccacactctcataatgataggttcaaacgcatcggatcgtatgggcatgggagtaacatacttggccctaatagcaacgtttaagatacaacctttcctcgcattaggtttctttcttagaaagctaacatcaagagaaaatttacttcttggcgtaggtttggcaatggccaccacactacaattaccagaagatatagaacagatggccaacggaatagcattaggactcatggctctaaagttaatcacgcaatttgaaacgtaccagctttggacagcactaataagtttaacctgctccaataccatgtttactctgacagtagcgtggcgtacagccacccttatattagcgggagtgtctctactaccagtatgtcaaagctcatcaatgagaaaaacagattggttaccaatggctgtcgctgctatgggagtaccaccgttaccgctattcatcttttcacttaaagacacattgaaaaggcgaagttggccgctcaatgaaggcgtcatggctgtgggactggtatcaatactagctagctcactactaaggaacgatgttccaatggcaggacccctagtagcgggtggattacttatcgcatgttatgttatcaccggcacatcagctgatttgacggtagaaaaagcagctgatatcacttgggaggaggaggccgaacaaacaggagtaagtcataatttgatgattaccgtagatgacgatggtacaatgagaattaaagacgatgaaacagaaaatatacttactgttcttctaaagacagcgcttttaatagtttctggagtatttccatattctataccggcaacactattagtctggcacacgtggcagaaacaaactcaaagaagtggggtattatgggatgtaccaagcccacccgaaacacagaaagctgaattggaagaaggagtatacaggattaaacagcaaggaatatttgggaagacacaggtaggggttggggtacagaaggaaggagtcttccatacaatgtggcacgtgacacgcggggctgtccttacctataatggtaaaagactggaacctaactgggccagcgtcaagaaggatttgataagctatggaggaggctggaggttaagcgcgcaatggcaaaaaggggaagaagtgcaggttatagcagttgaaccaggtaaaaatcccaaaaatttccaaacaactccaggaacattccaaacaacgacgggagaaattggagcaatagcattagatttcaaaccaggtacgtcaggaagtccaataatcaacagagaaggcaaagtagtcgggctttacggaaatggcgtagttacaaagaatggtgggtacgtttccggtatagctcaaactaacgccgaaccagacggaccaacaccggaacttgaagaagaaatgttcaagaaaagaaatctgactatcatggacttgcatcctggcagtggtaagacaagaaaatatttacctgcaattattcgggaagccattaagcgtagactacgcacactgattttggcacccacacgcgtggtggcagcagaaatggaagaggccctcaagggattaccaatacgttaccaaacaacggcaacaaaatctgagcacactggtagggaaatagtcgatctaatgtgtcatgctacattcacaatgcgattactgtcgcctgtacgagttcccaactataacctaatcataatggatgaggcacattttacagatccggcgtcgatagcagcaagaggatatattagtacaagggtagggatgggggaggctgctgcgatatttatgactgctacgcctcccggaactgcggacgcattccctcagtccaacgctcctattcaagacgaagaaagagatatacccgagaggtcatggaactccgggaatgaatggataactgactttgtaggtaaaaccgtctggttcgtacctagtataaaggcagggaatgacatagcaaattgcctgagaaagaacggtaagaaagtaatccaacttagccgcaaaacgtttgatacagaataccagaaaacaaagttaaacgattgggattttgtagttacgacagacatctcagaaatgggagctaacttcaaggcagatcgagtcatcgatcctcgaagatgccttaaaccagtaatattgactgacggaccagagagggtaatcttagccggccccatgccagttacagccgcgtccgcagcccaaagaaggggtcgagtaggaagaaaccctcaaaaagaaaatgatcagtacattttcacggggcaaccattaaacaacgacgaagaccacgcccattggacagaagcaaagatgttactggataatatcaacacccctgagggaataataccggctctattcgaaccagaacgcgaaaaatcagctgccattgatggagaataccgactaaagggagagtcgcgcaaaacttttgtagaactgatgcgaagaggagatctacctgtatggctcgctcataaggtcgcaagtgaggggattaaatacactgaccgaaaatggtgctttgatggccaacgtaacaatcaaattctagaggaaaacatggacgttgaaatttggacaaaagagggggagaagaagaaattgcgcccacgttggctggatgcaagaacgtattctgatcccctcgcgttaaaagagtttaaagattttgcagctggcagaaaatctatagcactagacttggtaacggaaataggaagagtgccatcgcacctagcacatcgcacacgaaacgcattagacaaccttgtaatgttacatacgtctgagcacggtggcagagcctacagacatgcagtagaagaacttcccgaaaccatggaaacattattacttttggggctaatgatactactgacaggcggtgcaatgctatttctaatttcaggaaagggtataggcaaaacttctatcggattaatttgtgtaattgcgtcttctggcatgttgtggatggcagaaatccctttacaatggatagcaagcgcaatagtgctcgagttctttatgatggtcttactaattccagaacccgaaaaacaaagaaccccacaagacaaccaactagcctatgttgtgattggcattttaacccttgcagccataatagcagctaatgaaatgggcttattagaaacaacaaagcgagacttaggcatgagtaaagagccaggagtagttagtcccacttcatacctagacgttgacctacatcctgccagcgcgtggacattatacgctgtcgccacaacggtaataacgcctatgttgcgacatacaatagaaaattctacagcgaatgtcagtctagccgcaatcgccaaccaagccgtagtactgatgggattggataaaggatggcctatatctaagatggacttaggggttcccctgctggccttgggatgttacagtcaagtaaatccgttgacattaactgcagcagtactccttctaattacgcattacgctatcataggtccaggattgcaagctaaagctacgcgcgaagcacaaaagagaacagcagctggaataatgaaaaacccgacagttgatggcattatgactattgaccttgatccagtaatatatgacagtaaattcgaaaagcagttaggacaagtcatgctcctagttctgtgcgccgtacagcttttactaatgagaacctcatgggcattatgtgaggctcttactcttgccaccggaccgattactacattatgggaaggttcacccggcaagttttggaacacaactatagctgtttccatggcgaatatcttccgaggttcctatttggccggcgctggtctcgccttcagtataatgaaaagtgtcggaacgggtaaacgtggaaccggctctcagggcgaaactttaggggaaaaatggaagaagaaactcaaccagctcagtagaaaggagttcgacctgtacaagaaatcaggcattacagaagtagataggaccgaagcaaaagaaggactcaaacgaggagagataacacatcatgctgtgtcaagagggtctgcaaagctacaatggtttgtcgagagaaacatggttatccctgaaggtcgagtgatagatttaggatgcggaaggggcggatggtcgtattattgcgcaggactcaagaaagtaacggaagtcagagggtatacaaaagggggtccaggtcacgaagaacctgtgccaatgagtacatacggttggaacattgtcaagctaatgagtgggaaagatgtattttacttgccaccagagaagtgcgatactctgctttgtgacattggcgaatcatcaccatctcctactgtagaagagtcaagaactataagagttctcaaaatggtagaaccatggctcaaaaataatcaattttgcataaaagtgttaaacccctatatgcccacagttattgagcacctagaaaggcttcagagaaaacacggtggcatgctggtgagaaaccctttatccagaaattcgactcatgaaatgtattggatcagcaacggtacagggaacatagtagccagcgtgaacatggtaagcaggctacttttgaatcgatttacaatgacgcaccgacgcccaacgatagaaaaagatgtagatctaggtgctgggactcggcatgtgaatgctgagccagagacaccgaacatggatgtcattggtgaaagaattaagagaataaaggaagaacacaattccacctggcattatgatgacgaaaatccctataaaacttgggcataccatggatcgtatgaggtcaaagcaactggctctgctagctctatgataaatggagtggtcaaacttttgaccaagccttgggacgtagttcctatggttactcaaatggcgatgacagatactacaccctttggacaacagagagtattcaaagaaaaagtcgacactagaactcctaggtcaatgccaggcacaagaagagtaatggagattaccgctgaatggctctggcggactctaggacgaaataagaaaccgaggttatgtactcgcgaagaatttacgaagaaagtgcgaacaaacgctgcaatgggagccgtatttacagaagagaaccaatgggactctgcaaaggccgccgtagaggatgaagatttttggaagctagttgatagagagagggaactacataaactcggcaagtgtggatcctgtgtgtacaatatgatgggaaaacgagagaagaaattaggtgagtttggtaaagcaaaaggaagtcgggctatatggtacatgtggttaggtgcgcgctatttagaatttgaagcgctagggtttcttaatgaagatcattggttttctagagagaacagctactcaggagttgagggagaaggacttcacaaactcgggtatatattacgtgatatatctaaaataccaggtggagccatgtatgcggacgatacggcgggctgggacacaaggataactgaagacgatttacacaatgaagagaaaataacacagcaaatggatcctgagcatagacaattagcaaatgctatttttaaactcacgtatcaaaataaagttgtaaaggtccagagacccacacctaccggtacggttatggacataataagtagaaaggaccaaaggggtagcggccaagtaggaacttatgggctgaacacctttactaatatggaagcacagttaattcgtcaaatggagggagaaggagttctatcgaaagctgatctggaaaatccgcatttacctgagaagaaaatcacacaatggctcgaaaccaaaggcgttgaaagattaaaacgaatggcaattagcggcgatgattgcgtagtaaagcccattgatgaccgatttgccaatgctttactagccttaaacgacatgggaaaagttagaaaggatataccgcaatggcaacctagtaaaggttggcacgattggcaacaggtcccattctgtagtcatcactttcatgaacttataatgaaggacggtcgcaaactcgtagttccatgtaggccccaagacgaactaatcggtcgagcgaggatatcccaaggagcaggctggtctttacgggaaactgcatgtttaggcaaagcgtacgcacaaatgtggtcgcttatgtattttcataggagggacctcagattagcctcaaatgctatttgctctgcggtgcccgttcattgggtacctacttcaagaacaacatggtctattcatgcgcatcatcagtggatgacaacagaagatatgttaacggtctggaaccgtgtgtggatcgaagataatccctggatggaagataaaaccccagtgacaacttgggaaaacgttccatatttgggtaagagagaagaccaatggtgtggttccctgatcggattaacttctcgggctacatgggctcaaaacatccccactgcaatccaacaggtaagaagtcttatcgggaacgaagagttcctagactatatgcctagtatgaagcggttccgcaaagaagaagagtcagaaggcgccatttggtaa

SEQ ID NO: 23062 - RNA, 9873 nt, synthetic construct
  misc_feature 1..9873: note = derived and/or modified CDS sequence (opt6) from DENV-3__GU131861__SS-prME
  source 1..9873: mol_type = other RNA
acttcactgtgtctagtcatgattttacctgccgcattagcatttcacctaacaagtagagacggggagcctagaatgatagtcggtaaaaacgagagaggcaagtctttacttttcaagactgcatcaggaataaacatgtgtactctcattgcaatggatttaggtgaaatgtgcgatgacaccgttacgtacaaatgtcctcatatcacagaagttgaacccgaggatattgattgctggtgcaaccttacgagtacatgggtcacgtatggaacttgtaaccaagcgggggaaaggagaagagataaaagaagtgtcgcactagccccacatgtaggaatggggttagatacaagaacacaaacatggatgtcggcagaaggcgcatggagacaggtagagaaggtcgaaacctgggcacttaggcatccaggttttacaattctcgcactttttttggctcattacattgggacctcgttaacacaaaaagtagtaatatttatacttttgatgcttgtcacaccaagcatgacgatgaggtgtgtaggagttggaaacagggattttgtcgaaggattatcaggtgcaacttgggtagatgtagttctagagcatggtggatgcgtaactacaatggcaaagaacaaacccactttagatatagaactccaaaagactgaagctacacaattagctactttgcgtaaattatgtatagagggaaaaattacaaacataaccaccgactctagatgtccgactcaaggcgaagcggttctgcccgaagaacaggatcagaattacgtgtgcaaacacacatacgtggaccgcggttggggaaatggatgtggactgttcggaaaaggcagtcttgtcacatgtgctaagttccaatgtttggaaccgatagaaggaaaggtagtgcaatacgagaacctgaaatatacagttattattacggtacacacgggtgaccaacatcaagttggaaatgaaacccaaggggtaacagcagaaatcactccacaagcatctactaccgaagcaatactacctgagtatgggacgcttggtctagaatgtagtccaagaacgggactggactttaacgagatgatactccttacaatgaaaaacaaggcatggatggtgcatagacagtggtttttcgacctaccactaccatggacatccggggcaacaacagaaacgccaacatggaatcgcaaagagctccttgtaacatttaaaaatgctcatgcaaaaaaacaggaggtagtagtactcggcagccaagagggcgcaatgcataccgcactcacgggtgcaacagaaatacaaaactcaggagggacgagtattttcgcaggccatttaaagtgtagattaaaaatggacaagttggagctgaaaggcatgtcgtatgctatgtgcacaaatacatttgtattaaaaaaggaagtatcagaaactcaacacggaacaattcttatcaaagttgaatataggggtgaagacgcaccttgcaaaataccgttttctacagaagacggacaaggaaaggcacataatggaagactaatcaccgctaatcctgtagtaacaaaaaaagaagaacccgttaatatagaagctgaaccaccatttggagaatctaatatagtcattggtattggagacaacgccctaaaaataaattggtataagaaaggttccagtataggaaaaatgtttgaagccaccgcgaggggagcccggagaatggcaatccttggggacacagcttgggattttggctcagtagggggagtcctaaactcgctaggaaaaatggtccatcagatttttggaagtgcctacacagctctgtttagtggtgtgagttgggtgatgaaaataggcattggtatacttcttacctggataggtttaaattctaagaacacgtctatgagtttctcgtgtattgcaataggtattataacactatatttaggagctgtagtccaggcagatatgggctgtgtgattaattggaagggaaaagagcttaagtgcggaagcggtatatttgtaacaaatgaggtccacacttggacagagcaatataaattccaagccgactccccaaaaagactagcaactgccattgctggagcatgggaaaacggcgtttgcggcatcagatctactacgagaatggaaaatttattatggaaacaaatagcgaacgaactgaattatatcctatgggaaaataatataaaattaaccgtagtagtaggagatatcatcggtgtactagaacaaggaaaaagaactttgacaccacaaccaatggaattgaagtactcctggaagacctggggaaaagccaaaattgtaacggctgaaacacagaattcttcttttattatagatggtcctaatacaccagaatgcccttctgcatccagagcttggaatgtttgggaagttgaagattacggttttggagtattcactacaaatatatggttaaaactccgagaggtgtacacacaactatgcgaccatcgattaatgtccgcggctgttaaagatgagcgagcggttcatgccgatatgggatactggattgaatcacaaaaaaacggttcatggaaacttgaaaaagctagcttgattgaggttaaaacatgtacgtggcccaaatcccacacattatggtcaaatggagtattggaatctgatatgataataccaaaatctttagcgggcccaatatctcaacataatcaccgtcctggctaccatactcaaacagcagggccctggcatttaggcaaactggagctagactttaactattgtgaaggaactaccgtagtcataacggagaactgcggtacacgaggaccctcgcttcggactacaacggtatctggtaaacttatacacgagtggtgttgtcgatcgtgcacgctgcctcccctacgctacatgggagaggatgggtgctggtacggaatggaaatcagaccgatttcagagaaagaagaaaatatggtaaaatctcttgtctctgccggaagtggaaaagtcgataactttacaatgggggtcctatgcctagcaatactttttgaagaggtaatgaggggcaagttcggaaaaaagcatatgatcgctggggtgttctttacctttgtcctattactgagtgggcagattacatggagagatatgactcacacacttattatgattggaagtaacgcatcagacagaatgggaatgggcgttacctatttagctttaatagcaacatttaagattcaaccatttttagcattaggatttttcttacgaaaattaacaagtcgggaaaacctgcttttaggggttggattagcgatggcaacaacgctgcagctcccagaagatattgagcagatggcgaacggaatcgccttagggctaatggcccttaaattaattactcagtttgagacatatcaattatggacagccctcatatccctaacttgctccaatacaatgttcaccctgacagttgcttggaggaccgcaacacttatattagcgggagtgtcattgttaccagtctgccaaagttcgagcatgcgaaaaacggattggttacctatggcggttgcagccatgggagtaccacctctaccactctttatattctccttaaaggacactttaaagcgtagaagctggccccttaatgaaggagtaatggcggtagggcttgtcagtatattagcatcgagtttactacgtaacgatgtaccaatggccggaccattagtagcggggggcttattaatagcatgctatgtgatcacagggacatcagcggatctaaccgtcgaaaaggctgctgatataacctgggaggaggaagccgaacagacaggtgtttcccacaatcttatgattactgtagacgacgacggcacaatgcggataaaagatgacgagaccgagaatatactgaccgtattgctaaaaacagcactactaattgtatccggagtttttccctatagcatacccgctacactattggtatggcatacgtggcaaaagcaaacacaacgttctggtgttctatgggatgtcccctctccacccgaaacacagaaagctgaactagaggagggagtctaccgaataaagcaacaaggaatcttcggaaaaactcaagtaggtgtaggcgttcaaaaggaaggggtctttcataccatgtggcatgttaccagaggagctgtactcacttataatggaaagaggctcgaacctaactgggcaagcgtcaagaaggacttgataagttatgggggcggctggcgtctttccgcccagtggcaaaagggagaagaagtacaagtaatagcagtggaaccagggaaaaatcctaagaatttccagaccacaccaggaacttttcaaaccacaacaggtgaaattggcgcgattgctcttgattttaaacctggtacttcaggatcaccaataataaatcgagaaggcaaagttgtcggcttatatggtaatggagttgttaccaaaaacggaggatacgtatcaggcatagctcaaaccaacgcggaacccgacggacctacacccgaattagaagaagaaatgttcaagaaaagaaatctaactattatggatctacacccggggtcaggaaagacccggaaatacttaccggcaataataagagaagcaatcaaaaggcgattacgtacacttatcctagctccaacacgagtagtcgcagcggaaatggaagaagctctcaaaggcttaccaataagataccaaaccacggtaacaaagtcagaacataccggtcgagagatcgttgaccttatgtgtcatgcaacttttacaatgaggctgctttcacctgttagagtaccaaattataatctcattattatggacgaagcacatttcaccgatccagctagcatcgccgcaaggggatatattagcacgagagtaggaatgggtgaagcagcagccatatttatgactgcaacaccgccggggacagcggatgcatttccacaatctaatgcacccattcaagacgaagaacgagacatacctgagcgatcttggaacagtggaaatgaatggataacggatttcgcaggaaaaacagtctggtttgttcccagtattaaagcagggaacgatatagccaattgtctccgaaaaaatggtaaaaaagtaatacaattaagtagaaaaacgtttgacacagaatatcaaaaaacgaaactaaacgattgggacttcgtggtaacgacagacattagtgaaatgggtgcaaattttaaggcagatcgagttattgaccctcgtaggtgtcttaaacctgtcatattaacagacgggccagaacgtgtcatattagcgggacctatgccagtcactgctgccagcgcagcacaaaggagaggtcgagtaggtagaaatcctcaaaaagaaaatgatcaatatatttttacaggacaaccactaaacaacgacgaggatcatgcacactggacggaagcaaaaatgctgttagataatataaatacaccagaggggattataccagcattatttgaaccagaaagggagaaatctgcggcaatcgatggagaatatagattgaagggagaaagtaggaaaacatttgtagaactcatgagaagaggggacctcccggtatggctggcacacaaagttgctagtgaaggtataaaatacactgaccgaaagtggtgttttgatggtcaacgaaataatcagatattagaagaaaatatggatgtcgaaatatggacgaaggaaggcgaaaaaaaaaaattaagaccacgatggctggatgcgagaacttactcagaccctcttgcactcaaagaattcaaggacttcgctgctggtaggaaatcaattgccctcgatctcgttacagaaattggacgcgtcccctcccacctagctcacaggacgagaaacgcactagacaatttagttatgcttcatacctcagaacatggagggcgtgcctatcgacatgctgtcgaagaattacctgaaactatggaaactttattattattaggcctaatgatccttcttacgggcggtgcaatgctgtttcttatatctggtaagggaatcggcaagacctctattggtctaatttgcgtaattgcttcgagcggcatgttatggatggctgaaatcccattgcaatggattgcgtcggccgtcgtattagagttctttatgatggtgttattaatacccgaaccagaaaagcaaaggactccacaagataaccaattagcctacgtagttattgggattttaacattagctgcaataattgcagctaatgaaatgggactactagaaactaccaaacgagatctaggcatgagtaaagagcccggcgttgttagcccaacttcatatttagacgtagacttgcatccagcatcagcctggacactgtacgcggttgcaaccacagtcatcacacctatgctacgacacaccatagaaaactctacagccaacgtctccctggcagcaattgctaaccaagctgttgtacttatgggactcgataaaggatggcccatttcaaaaatggatttaggcgtgccacttctagcattgggctgttacagtcaagtaaacccactcactttgactgcagctgtcttattactaattacgcattatgctataataggaccaggtcttcaagcgaaagcaacacgcgaggcacaaaagcgtactgcggctggaatcatgaaaaatccaaccgtggatggaattatgacaatagatcttgaccctgtaatttatgattcgaaatttgaaaagcaactgggtcaggttatgcttttagtgttatgtgcagttcaactcctattaatgcgaacctcttgggcgctatgtgaagctttaacattggccacgggtcccattactactctatgggaaggtagccccggaaagttttggaacacgaccatagccgtttcaatggcaaatattttcaggggaagttacctcgccggagcaggcttggcgttctcaataatgaaaagcgttggtaccggcaaacgaggtacgggatcgcagggtgagacattgggggagaaatggaagaggaagctaaatcagctatcaagaaaagaattcgatctatataaaaaatccggaataaccgaagtagataggacagaagcgaaagaaggactaaagcgaggtgaaataacacatcatgctgtatcgcgaggatcagcgaagttacaatggtttgttgagcgaaatatggtcataccagaaggacgtgtcatcgacttaggttgtggccgaggaggatggagctattactgtgcggggttaaagaaagtgactgaggtcagaggttacacgaaaggaggcccgggacatgaagaacccgtacccatgagcacctatggctggaatattgttaaactaatgtcaggtaaggatgtcttctaccttccacctgaaaaatgcgacaccttactctgtgacattggagagtctagtccttcgccaaccgttgaagaaagtcgaacaatacgagtattaaaaatggtagaaccatggttaaaaaacaatcaattctgtataaaagtcttgaacccatatatgcccacggtaatagagcatctcgaacgtctacaacgtaagcatggaggcatgctagtacgaaatccactatctcgtaattcaacgcacgagatgtactggatatcaaacgggacaggcaacatcgttgcatcagttaatatggttagtcgtcttctccttaatcgatttaccatgacgcaccgaagaccaacaatagagaaagatgtagatctgggcgcaggaacaagacacgttaatgcagaaccagaaaccccaaatatggatgttatcggggaaagaattaaaaaaataaaagaagaacataactcaacgtggcactatgatgatgagaacccttacaagacatgggcttatcacgggagctatgaagtgaaagctactgggagcgctagctccatgattaacggggttgtaaaattgttgacaaaaccctgggatgtcgtgcctatggttactcaaatggcaatgaccgacaccaccccgtttggacaacagagggtgttcaaagaaaaagtagatacaaggactcctcgttctatgcccggtacacgtcgtgtgatggaaattactgcagaatggctctggcggacgctcggtcgtaacaaaaaaccaagattgtgtactagagaggaatttacgaaaaaagtcagaacaaacgccgctatgggagccgtcttcacagaggagaatcagtgggattcagcaaaggcggcagttgaagacgaggatttctggaagttagtagacagggagagagaactacacaaattaggaaaatgcggaagttgcgtctataatatgatgggaaagcgagagaagaaattaggtgagtttggaaaagctaagggtagtagggcaatatggtacatgtggctcggcgctagatatcttgaattcgaagctctcggctttttaaacgaagaccattggtttagcagagaaaatagctatagcggtgttgaaggggaaggacttcacaaactaggttatatactcagggatatatcgaaaataccaggaggtgcaatgtacgctgacgacacagcgggatgggatacacgaatcactgaggatgatctacacaatgaagaaaagattacgcaacaaatggaccctgagcacagacaactggccaacgctatattcaaactaacttaccaaaacaaggtggtgaaagtgcaaagaccgacacccactggcactgtaatggatataataagtcggaaagaccaacgaggttctggccaagtgggaacctacgggctgaataccttcactaatatggaagcccagttaatacgacagatggaaggtgagggggtgctgtccaaagccgacctagaaaacccgcatctacccgaaaaaaaaattacacaatggttggaaaccaaaggtgtggaacgtcttaaaagaatggctatttcaggtgatgactgcgtggtaaaacctatcgatgatagatttgcaaacgccttactagccttaaatgatatgggcaaggtcagaaaagatattccacaatggcaaccaagtaaagggtggcatgactggcaacaagtacctttctgctctcaccattttcatgaattaatcatgaaggatgggagaaaattagttgttccatgtaggcctcaggacgaattaatcggaagagcacgaataagccaaggggccgggtggtcactgagagaaaccgcatgtttgggaaaagcatacgctcaaatgtggagcttaatgtactttcatagaagggacctaaggcttgcgtctaatgcaatttgctctgcagtacccgttcattgggtaccaacatctagaactacttggtcaatacacgcacaccatcaatggatgactacagaagatatgttaacggtatggaacagagtttggatagaagataacccttggatggaggataaaacacctgtaacaacatgggaaaatgtgccctatctgggaaaaagagaggaccaatggtgcggatcgctaattggcttaactagtagagcaacttgggcacagaatatacctacagcaatacaacaagttcggagtcttattggcaatgaagaatttctagattatatgcctagtatgaaaagatttagaaaagaagaagaaagcgaaggagcaatatggtag

SEQ ID NO: 23063 - RNA, 9873 nt, synthetic construct
  misc_feature 1..9873: note = derived and/or modified CDS sequence (opt6) from DENV-3__GU131862__SS-prME
  source 1..9873: mol_type = other RNA
accagtctgtgcttggtaatgatattaccagcagctctcgcgttccatctaacatcccgggacggggaacctagaatgatagttggcaaaaatgaacggggtaaaagtcttcttttcaaaacggcatcaggaatcaacatgtgcacattaattgcaatggatctaggagaaatgtgtgatgatacagttacatataaatgccctcacatcacagaagttgaacccgaagacattgattgttggtgcaatctaacgagcacgtgggtaacatacggtacgtgcaatcaggcaggagaacgtaggagggataaaagatccgtcgcgctagcccctcacgtcggaatgggattagatactcgcacacaaacatggatgtccgcagaaggtgcgtggagacaagtggaaaaagtggaaacatgggcactcaggcatccaggttttactattcttgcattattcctagcacattatataggaacaagtctaacccaaaaagtagtaatatttatattattaatgctcgtgacaccctctatgaccatgagatgcgtaggtgtgggaaaccgtgatttcgttgaaggattgtcaggagctacatgggtagatgtcgtgttagaacacggcggctgcgtaacaacaatggccaaaaataaaccgaccctagacattgaacttcagaaaacagaagcaacacaactcgccacactgagaaaattatgcatcgaaggtaaaattaccaatattacaacagatagtcggtgtccgacccaaggagaagctgttcttcctgaagaacaagatcaaaattatgtatgtaaacatacgtatgtggatcggggatggggaaacggatgtgggttgttcggaaaaggttcattggtcacatgcgcaaaattccaatgccttgaaccaatagaagggaaagtcgtgcaatatgaaaatttaaaatacactgtaataatcaccgtacacaccggtgaccaacaccaagtaggaaatgaaactcaaggagtaacggccgaaattactccgcaagcatccacaaccgaagccattttacctgaatacggtactttaggactagaatgttcaccccggacaggtttagatttcaacgaaatgatattacttacaatgaaaaataaagcatggatggtccatagacaatggttctttgatttaccactaccatggacgtcgggagctacaacagaaactccgacatggaatagaaaagaacttttagttacttttaaaaacgcacacgccaagaaacaagaagtagtcgtcctgggatcccaagaaggcgccatgcacacagctttaaccggcgctacagaaatccaaaattcaggagggacatcaatcttcgcaggacacttaaagtgtcggctaaaaatggataaattagaattgaagggaatgtcatatgctatgtgtacaaatacattcgtattgaagaaagaagtatctgaaacccaacatggtaccattcttatcaaagtagaatatagaggagaggacgcaccatgtaaaataccattctccacagaagacggtcaaggaaaagctcacaacggtagattgatcacagctaacccagttgtcattaaaaaggaagaacccgtaaatatagaagcggaacctccattcggagaaagcaatattgtcatagggataggcgacaatgcgctgaaaataaattggtacaagaaagggtcatctatcggcaaaatgtttgaagcaactgcgcgtggagcgcggcgtatggcaatacttggcgacacggcttgggacttcggttccgtaggaggagttctaaattccttaggtaaaatggttcaccaaatatttggatcggcttatacagccctattcagtggtgtatcttgggttatgaaaattggaataggcattttgcttacttggataggtttaaatagtaaaaacacctcaatgtcattttcctgcatagccattggtattattaccttgtacttaggggcggttgttcaagcagacataggatgcgtgataaattggaaagggaaagaattaaaatgtggtagtgggatcttcgtaacaaatgaagttcacacttggacagaacaatataaattccaggccgactctcctaaaagacttgccaccgccatagcaggcgcttgggaaaatggagtgtgcggaataagaagcactacacgaatggaaaatctcttatggaaacaaatcgcgaacgaactcaactacatattatgggaaaataacataaagttgaccgtagttgtcggagacataatcggagtgctcgagcaaggcaagaggacgttaacaccgcagccaatggagctcaagtattcatggaaaacctggggaaaagcaaagatagtaacagccgaaacgcagaatagcagctttatcattgacggtcccaacacgccggaatgtccttcagcaagccgggcgtggaatgtttgggaggtggaagattacggatttggagtattcacaactaatatctggttaaaattaagagaggtttatactcaattgtgcgaccacagactcatgtcggctgcagtaaaagacgagagagcagtacatgctgatatgggctattggattgagtcgcagaaaaatggtagttggaaactggaaaaggcgtctctgatagaagtaaaaacatgtacatggcccaaatcacacaccttgtggtctaatggtgtgttggaaagtgatatgattataccgaaaagccttgcgggaccaatatctcaacacaaccatcgtcctggatatcacacacagacagcaggtccatggcacttaggcaagctggaattagatttcaattactgcgaggggacaaccgttgttataacggagaactgtgggacaaggggaccgtctctccgaactacaaccgtaagcgggaaattaatacacgaatggtgttgccgcagttgtacactaccgccattacgttacatgggtgaagatggttgttggtatggaatggagataaggcccatctctgaaaaagaagagaatatggtcaagagcttagtgtcagcaggctcggggaaagtagataatttcactatgggcgttttatgtctagcgattctatttgaggaagtaatgagaggtaaatttgggaagaaacacatgatagctggagttttctttacttttgttctactcttgagcgggcaaatcacgtggagagatatgacacataccttaatcatgatagggtcaaacgcaagcgatagaatgggaatgggggtgacatatttggcgttaatagcaacttttaaaattcaaccctttttagcattagggttcttcttacgaaaactgacctcacgcgaaaatcttttactcggcgtaggattagcaatggccacaacactacaattacctgaagatatcgaacaaatggccaatggaatcgccttaggacttatggctctcaaactaataacccagttcgaaacttaccagttgtggactgctttaatttccctaacttgcagtaacacgatgttcacattaacagtcgcttggaggacagccacacttatactagctggggtatccctactaccagtctgccaaagttcaagtatgcgaaaaacagactggttacccatggccgtagctgccatgggcgttcccccattacctttgtttatattttcactaaaagacaccttgaaaagaagatcttggccgttgaatgagggagtcatggcagtaggcttggtaagtattttagcatcctcattactacggaacgatgttccaatggcaggtcctctggtagctggtggcctgctcattgcatgttacgtgataacgggaacgagcgcagatttaacagttgaaaaagccgcagatattacctgggaagaagaagcagaacaaacgggggtgtctcataatcttatgattaccgtggacgacgatggtactatgcggatcaaagatgatgagacagagaatattctcactgtgctattgaagacagcgcttcttatagtatcaggagttttcccctactcaataccagctactctcttagtatggcatacctggcaaaaacagacccagagatctggcgttctatgggatgttccaagtcctccagaaactcaaaaagcagaactagaagagggagtttacaggattaaacaacaaggtatttttggaaagacccaagttggtgtgggagtacaaaaagaaggtgtgtttcataccatgtggcatgttacaaggggagctgtcttaacctacaatggaaaacgtttagagccaaattgggctagcgtaaagaaagatctcatatcgtatgggggcggttggagacttagtgctcaatggcaaaaaggcgaagaagtacaggtaatagctgttgagcctggaaagaatcccaagaattttcagactatgccaggcacctttcaaacgacaaccggcgaaataggagcaatagctctagatttcaaacccggaacgtctggttctcctatcatcaacagagagggaaaagtggtcggactctatggcaatggcgtagttactaaaaatggaggatacgtgtcaggaatagcccagacaaatgcagaaccagatggtcccacaccagaactcgaagaagaaatgtttaagaaacgaaatttaactataatggatctgcacccaggatcaggtaagactagaaaatatttacctgctataattagagaggccatcaagcgaagattgcgaactttaatactagcccctacaagggtggtagcagcggaaatggaagaagcactaaaaggcttaccgatacgctaccagactactgctacaaaaagcgaacacactggtcgagaaattgtcgaccttatgtgccatgcgactttcacgatgcgattattgagtccagtcagagtacccaattacaacctcatcataatggacgaggcgcactttacagacccagcaagtatagcagcccgaggatatatatccactagggtcggcatgggagaagcagctgctattttcatgacggccacacccccaggtacagctgacgccttcccgcagtcaaatgccccaatacaagatgaggagagagacataccagaacgatcctggaactcgggaaatgagtggataaccgattttgtgggtaaaaccgtgtggtttgttcccagcataaaggcaggaaacgacattgctaactgccttcgtaaaaacgggaagaaagtaatacagctatcaagaaagacgttcgatacagaatatcagaaaactaaattaaacgactgggacttcgtagtgacaacggacatatcagaaatgggggcaaattttaaggctgacagggttatagacccgaggagatgtctaaaaccggtaatattaactgatggaccggaacgtgtaatcttagcaggaccaatgccagtaactgcagctagcgcggcacaacgaagaggtcgagttggacgcaaccctcaaaaggaaaatgatcaatatattttcacaggtcaaccactaaataatgatgaagaccacgctcattggacagaagccaaaatgctgttagataacataaacacacccgaaggtataattcctgccctatttgagcctgaacgggagaagtcagccgctatcgacggggaatatagactcaaaggagaatcaagaaaaacatttgttgaactcatgagaagaggtgatctaccggtctggctagctcataaagtggcttcagaaggaatcaagtacaccgacagaaaatggtgcttcgacggtcaaagaaataaccaaatattagaagaaaatatggacgtcgaaatatggacaaaagagggtgaaaagaagaaactcagacccagatggttagacgcgcgaacgtattcagatcccttggcactaaaagagttcaaagatttcgcagcaggtagaaaatcaataactcttgatctagtaacggaaataggtagggttccttcgcacctcgcccatcgtacaagaaatgctctcgacaacctagttatgttgcatacatcagaacatggagggagggcatatcgacatgcagtagaagaactaccagagactatggaaaccctgctacttctaggactaatgattttattaaccggaggagccatgttatttttaatttcaggtaagggaataggaaagacctccattggactaatatgtgtcatagcttcgtcaggcatgctctggatggcagagattccactacaatggatagcatctgctatagtactcgagttctttatgatggtacttttgataccggagccagagaagcagagaacaccacaggataaccaacttgcgtatgttgttattgggatattaacattagcagcaattatagcagcaaacgagatgggacttttagaaacaacgaaaagagatctaggcatgagtaaggaaccaggagtagttagtcccaattcatatctggatgtagacttgcatccagctagtgcatggacactatacgcagttgccacgacagtaattacaccaatgttacgtcatactatagaaaacagcaccgcaaatgtatcattagctgctatcgcaaatcaggctgtagtactcatgggacttgataaggggtggccgatatcaaaaatggacttaggagtacccctcttagctttagggtgttattcccaggtaaatccgctcacattaaccgctgccgttttactacttataacacactacgcgataattggaccaggtttgcaggcgaaggcaactagagaagcgcagaagagaactgcagcaggcatcatgaaaaatccaacagttgacggtataatgacgatcgatctagatccggttatttatgattccaaatttgaaaaacaattggggcaagtaatgctgctggtgctatgcgcagttcagcttcttctcatgcgaacaagctgggcactgtgcgaagcactgactttagccacaggtcccataacaacactatgggagggctcccctgggaaattctggaacaccactatcgcggtatcaatggcaaacatctttagaggcagttatcttgctggtgcgggtctagcattctccatcatgaaatctgtgggaactggtaaaaggggaactggttctcaaggtgaaacgcttggagaaaaatggaagaagaaactaaaccaattaagtcgtaaagagttcgatctttataagaaaagcggcattactgaagttgaccgaacagaagctaaggagggtctaaaaaggggcgagataacgcatcatgcggtatcacggggctctgcaaagctccagtggttcgtagaacgtaacatggtaattcccgaggggcgtgttatcgatctaggttgcggaagaggagggtggagctattactgtgccggcctaaagaaagtaactgaggtaagaggatatactaaaggcggacctggccatgaagaacctgtaccaatgtcgacttatgggtggaatatcgtgaaactaatgagtggaaaagatgtgttctatctacccccagaaaaatgtgatacattactatgtgatattggagagagctctccatcccccacggttgaagagagccgcaccatacgtgtattaaagatggtcgagccatggcttaaaaataaccaattttgtataaaagttctcaacccctatatgccaacagtcatagaacacctggagaggttacaaagaaaacatggcggtatgctggtaagaaatcctcttagtagaaactctacacatgagatgtactggatatcgaatggtaccggtaacatagtggcctctgttaatatggtatcccgcttactactaaatcgttttacaatgacccatcgaaggcctaccatagaaaaagatgtcgatctaggagctggcactagacacgtaaacgccgagccagaaacgccgaacatggatgtgataggagagagaataaaacgaataaaagaagaacacaatagtacatggcattacgatgatgaaaatccatataaaacatgggcgtaccacggctcctatgaagtaaaggccactggttccgcctcttccatgatcaatggcgtagtaaagttgttgaccaaaccttgggacgttgttcctatggttacccagatggctatgaccgatacaacaccatttggacaacaaagagtgtttaaagaaaaggtggatacaagaacaccacggtccatgccgggaacacgtagagtaatgggcataactgcagagtggttatggaaaactttaggacgaaacaagaaaccacgtctttgtaccagagaagaatttaccaagaaagtgaggacaaacgccgctatgggtgccgtatttacagaagaaaatcaatgggactctgctaaggcagctgtggaagacgaagacttttggaaattagtagatcgagaacgtgaactacataaattagggaagtgcggatcatgcgtttataacatgatggggaaaagggagaagaaactaggagagttcggcaaggctaagggttcacgcgccatatggtatatgtggctaggtgctagatacctcgagttcgaggcgttggggtttcttaacgaagaccattggtttagcagggaaaattcatatagtggagtagagggagaaggcttgcataaactaggttatatactacgagacattagcaaaatacctggaggagctatgtatgctgacgacacggcaggatgggatactagaataacagaagacgatcttcataatgaagagaaaataacgcaacaaatggatccagaacataggcaattagccaatgcgattttcaaattaacataccaaaataaagtggtcaaggtacaacgccctactcccaccggtacagtaatggacattatatcgagaaaagaccaacgagggagcggacaagtaggtacttacggactaaatacttttacaaatatggaagctcaactgatcagacaaatggaaggtgaaggagtattatctaaagctgatctagagaatccgcatttgcccgagaagaaaataacgcagtggctggaaactaagggtgtagagcggttaaaaagaatggcaatatccggggacgattgtgtcgtaaaaccaatagacgacagatttgcgaacgcattgttggccctgaacgatatgggaaaagtcagaaaggatataccgcagtggcaacctagtaaaggatggcatgattggcagcaagttccattttgtagtcaccatttccatgaattaattatgaaagatggaagaaagctagttgttccatgcagaccccaagacgaattaatcggacgtgcaagaattagtcaaggggcgggctggtcattaagggaaacagcatgcctaggtaaagcctacgcacaaatgtggagcctaatgtatttccataggagagatttgaggctagcaagtaatgccatatgctcagctgtgccagtacactgggtacctaccagtagaaccacatggtcaatccatgcacatcatcaatggatgactactgaagacatgctcaccgtatggaacagagtttggatagaagataatccatggatggaagataagactcctgttacgacctgggagaatgtcccatatcttgggaaacgagaggaccaatggtgtggctccttaataggtttaacttccagagcgacttgggcacaaaatatacctactgcaattcaacaagtgcgttcacttataggaaatgaggagttcttagattatatgcctagcatgaaacgttttagaaaagaagaagaatcagaaggcgcaatatggtga

SEQ ID NO: 23064 - RNA, 9873 nt, synthetic construct
  misc_feature 1..9873: note = derived and/or modified CDS sequence (opt6) from DENV-3__GU131865__SS-prME
  source 1..9873: mol_type = other RNA
acgtccctttgtctggttatgatcctgccagctgcattagcgttccatctcacaagtcgtgatggagaacctcgcatgatagtgggcaaaaacgaaagaggaaaatcattattatttaaaactgcatcaggaatcaatatgtgtacgcttatagcgatggacctgggtgaaatgtgcgatgatacagtcacttacaaatgtccacatataacggaagttgaacccgaagacatcgattgttggtgcaacctgacaagtacgtgggtgacctacggtacatgcaatcaagcaggagaaagaagaagagataaacgttcagtagctttagccccacatgtcggcatggggcttgatacaagaacccaaacctggatgagtgcagaaggagcttggaggcaagtagaaaaagtagaaacatgggctctaaggcatccaggcttcacaatacttgcattattccttgcccactatatagggacaagtttaacacaaaaagttgttatatttatactactaatgctagttacaccatcgatgaccatgcggtgtgtgggagttggaaatcgtgactttgtagaaggacttagtggagcaacttgggtcgacgttgttttggaacacggtggatgtgtaacaaccatggccaaaaacaaaccaaccttggatatagaactgcagaaaactgaagcaacgcaactagcaacactaagaaaactctgtatagaaggtaaaatcaccaacataactactgactcacgttgcccaacgcaaggagaagcggttctaccagaagaacaagatcaaaactatgtctgtaaacatacatatgtagataggggttggggaaatggttgtggattatttggcaaagggtctttagtaacttgcgcgaaattccaatgccttgagccaatagaaggaaaagtggtccaatacgaaaacttaaaatacaccgtcataataactgtacatacgggcgaccaacaccaagtcggtaacgaaacacaaggggtcacggctgagatcacgccacaagcaagcacaacagaagcaatcctgcccgagtacgggactttagggctggaatgctcaccccgaactggtttagattttaacgaaatgatactattaacgatgaaaaataaagcatggatggttcaccgtcaatggttctttgacttgcctctcccctggacgtcgggcgcgacgacagaaacaccaacttggaatagaaaagaactattagttacatttaaaaatgcccatgctaagaaacaagaagtggttgttcttggaagtcaagaaggagcaatgcatactgcgcttacaggggcaacggaaatacaaaattctggaggtacatcaatattcgcgggacatcttaaatgcaggctcaaaatggataaactagaactaaaagggatgtcatacgcaatgtgtaccaacaccttcgtgttaaagaaagaggtctccgaaactcaacacggtaccatattaatcaaagttgagtacaggggtgaagatgcaccatgtaaaatcccgttttctacagaagatggtcaagggaaagcgcacaacggaagactgataactgcgaacccagttgttacaaagaaagaagaacctgtaaatatagaggcagagccaccctttggtgaatcaaatattgtaataggaataggagataatgctctaaaaataaactggtacaagaaaggaagtagtatcggtaaaatgtttgaggctacagccagaggagctcgacgaatggctatattaggagatactgcttgggattttgggtccgtaggcggcgtactcaatagtctagggaaaatggtgcatcaaattttcggtagcgcatacacagcattattctccggagtatcatgggtcatgaaaattggaatcggcatattacttacgtggataggccttaacagtaaaaacacaagtatgagcttctcgtgtatcgctatagggatcattactttatacctaggtgcagttgtgcaagcagatatgggttgtgtaattaattggaaaggaaaggagctcaaatgtgggagtggcatttttgtaaccaatgaagtccatacttggactgagcaatacaagttccaagcagattcaccaaaaaggttagcaaccgctatagccggtgcatgggaaaacggagtatgtggtataaggtctacaactagaatggaaaaccttctttggaagcaaatagcaaacgaattaaattacatactgtgggaaaacaatataaagttgacagtcgttgttggtgatataattggtgtattagagcagggtaaaaggaccctaacaccccagccaatggaactaaaatacagttggaaaacgtggggaaaagctaagatagttacagcagaaacacaaaatagtagcttcattattgacggcccaaacacacctgagtgccctagtgcatcaagagcttggaatgtatgggaagttgaagattacggttttggtgtcttcaccaccaatatatggttgaagttacgagaagtatacactcaactctgcgaccataggttaatgtcagcggccgttaaggatgagagggcagtacatgcagacatgggttactggattgagtctcagaaaaatggctcatggaaactagagaaggccagtcttattgaagtaaaaacatgtacatggccaaaatctcataccctatggtccaacggcgtattggaatccgatatgattatacccaagagtttagcaggcccaatatcccagcacaatcatagaccgggctatcatactcaaactgcagggccatggcatttaggaaagttagaactagattttaactattgtgaaggaactacagtcgttataacagaaaattgtggaacaagaggaccttcgttaaggaccacaactgtcagcggtaaacttatccacgaatggtgttgccgatcctgtacgctacccccgttacgatatatgggtgaagacggatgctggtatggcatggaaatccgccccatatcggagaaagaagagaatatggtaaaaagtttagtatctgccggatcaggtaaagttgataacttcaccatgggagtcttatgtttggcaattctctttgaggaggtcatgcgcggaaagtttggtaagaaacatatgatagccggcgttttcttcacatttgtcttattgttgagtggtcagattacatggcgagacatgactcacaccctcataatgatcggatcaaacgcaagcgatagaatgggaatgggagtaacatatttagcactaatagccacatttaaaatccaaccatttttagcacttggattctttctaaggaaattaacctcgagggaaaatttattattaggcgtaggattagcgatggccacgacactacagcttcctgaagatatagaacagatggctaacggtattgctctcggtttaatggctttgaaactaattactcaattcgaaacataccaattgtggaccgcactaatttctctcacatgctctaacacgatgttcacactaactgtcgcatggcgaacagctactctaatcctagcaggagttagcctgttacctgtttgtcagtctagcagcatgcgaaaaacagattggttacctatggcagttgcagctatgggggtaccgccgttacctttgttcatatttagtttaaaggataccttaaagcgacgttcatggccactcaacgaaggagtgatggcagtcgggttagtatcgatattagctagctcccttttaaggaacgatgtgcctatggcaggcccgttagtggcaggaggattacttatagcatgttatgtaattacgggcacaagtgcagatttaacagtagaaaaagcagccgacataacctgggaggaagaggcagaacaaacaggtgtatcccacaaccttatgataaccgttgacgatgacggaaccatgcgaattaaagatgatgagaccgagaatatacttacagtattgcttaagactgccctcttaatagtatcgggagtcttcccttacagcatacctgctacactattagtatggcatacgtggcaaaaacagacacaacgaagtggagtgttgtgggacgttcccagtccacctgaaacacaaaaagcagaactggaagaaggtgtttaccgaattaagcagcagggaatatttggcaaaactcaagtgggtgtgggcgttcaaaaagaaggggtgtttcatactatgtggcatgtaactcggggcgcagttttaacatataatggtaaaagactagaacctaattgggcaagtgttaagaaagacctaatatcttacggaggtggatggagactctcggcgcaatggcaaaaaggtgaagaagtacaagtaatagcagtcgaacccggtaaaaatcccaaaaattttcaaacaactccaggcaccttccagaccacgaccggagaaataggggctatagcccttgacttcaaaccaggtacaagtggatcccccataattaaccgtgaaggcaaggtagtgggtttatacggaaatggagtagtcacaaagaatgggggctatgtaagcggaatagcacaaacaaatgccgaaccggatggtccaacgccagagctggaagaagaaatgttcaagaaaaggaacttaacaataatggatctgcaccctggaagcggcaaaacaagaaaatacttgccagcaataataagggaggcgattaaacgccgattgcgtacattgatattggccccgacacgagttgtggcagcagagatggaggaggctttaaaaggactaccaatcagatatcagactactgtgacgaaatcagaacatactggaagagaaattgtagatctcatgtgtcacgcaacctttacgatgaggttgctatcccccgtcagagtcccaaactataatctcataattatggatgaagcacattttacagatcctgcttctattgcagcgaggggatatatatctactcgcgtagggatgggggaagctgcagctatattcatgactgctacacccccaggcacagcagatgcctttccccaatctaacgcaccaatacaggatgaagagagagatatcccagagcggtcctggaactccggtaatgaatggattacagattttgctggaaaaacagtatggttcgttccttctataaaagccgggaatgatatagctaactgccttcgtaaaaatggtaagaaagtcatacaactcagtagaaagacatttgacacagagtaccagaaaactaaattgaatgattgggattttgtagtcaccactgatatatctgaaatgggcgctaattttaaagccgacagagtaatagatccacgacgctgccttaaaccagtgatacttaccgacggccccgaaagagtcattcttgcaggaccgatgcctgttacagcggccagcgcggcacaaagacgtgggcgagtaggaagaaatccacagaaagaaaacgatcaatatatttttactggtcagccgttaaacaacgacgaagaccatgctcactggaccgaggcaaaaatgcttcttgataacataaacaccccagaaggcattattccggcgttattcgaaccggagcgagaaaaatcagccgctatcgatggcgagtatcgattgaaaggtgagagtagaaaaacttttgttgaactgatgagaagaggtgacttaccagtatggctggcgcacaaagtagcttcagagggaataaagtacacagacaggaaatggtgctttgacggacaacgcaataaccaaatccttgaggagaatatggatgtagaaatatggacaaaagaaggggagaagaagaaactaaggccaagatggctagacgccaggacgtattccgacccgttagctctgaaagaatttaaagatttcgcagccggcagaaaaagtatagctctagaccttgttactgagatagggcgtgtaccctcacatctagcacatagaacacgtaatgctttagataatttagtgatgttacacacaagtgaacacggcggtcgagcttatagacatgcagttgaagaattaccggagacaatggagacgttgctcttactgggtctaatgattttgcttactggtggggcgatgttatttctgattagcggaaaaggtataggtaaaacatctattgggttaatttgcgttattgccagttcaggaatgttgtggatggcagaaattccattacaatggatcgcatcagctgtagtgttggaatttttcatgatggtacttctaattcccgaacctgagaagcaaaggactccacaggataatcaactagcctatgtagtaattggcatcctaaccttagctgctataatagccgcaaatgaaatgggcttattagaaacaacaaaacgagacttaggtatgagcaaggaacctggcgttgtaagtccaacaagctacctcgatgtggacttacacccggcaagcgcatggacactatatgcagtagcaacaaccgttataacacctatgttgagacacaccattgaaaacagtacggcaaacgtcagtcttgcagcaattgcaaaccaggcagtcgttttaatgggactggataaaggctggcccatatcaaagatggatttaggtgtaccattactagcattaggatgctatagtcaagttaacccattgacactcacggcagctgtcttattgctaataacacattatgctatcattggccctggcctacaagctaaggccacaagagaagcgcaaaaacgaacggcagcaggcattatgaagaaccctacagttgacggcatcatgacaattgatttagacccagtcatatacgattctaaatttgagaaacaacttggacaggttatgcttttggtcctatgtgccgtccaactactattaatgcggacatcatgggctctttgtgaagcactcacactagcaacggggcctattaccactttgtgggaaggctctcctggcaaattttggaataccacgatagccgtatcaatggctaacatctttcgtggtagctacttggcaggagcaggtcttgcattttcaataatgaaaagtgtagggacgggtaaaagggggacgggaagccaaggggagactttaggagaaaagtggaaacgaaaattgaatcaattatcccgtaaagagttcgacctatataagaaatctggtataacagaggtggatcggacggaggcgaaagagggcctcaaaagaggcgagataacccaccacgctgtaagccgaggatctgcaaaattacagtggtttgtggagaggaatatggtgataccagagggtcgagtgattgatctaggttgtggacggggaggctggagctattactgtgctggtctaaagaaagtaacagaagtccgcggatacaccaagggcggtcctggacatgaagaacctgtcccgatgtcaacatacgggtggaacatagtgaaactaatgaccggaaaagatgtattttatttaccaccggaaaaatgtgacactttactttgcgatattggagaaagttctccaagcccaacggtagaagaatcgcgaactatacgagtacttaagatggttgaaccttggttgaaaaacaaccaattctgtattaaggtattaaacccatatatgcctaccgtaattgaacatttagaacgactgcagcgaaagcacggcggaatgttagtccgtaatcctctttcacgtaactcgacacatgaaatgtactggatcagtaatggtactggaaatatagtagcctctgtaaacatggttagtcgtttactactcaatcgctttaccatgacacatcgtcgccctacgatagaaaaggacgttgaccttggtgcaggaacccgccatgtcaatgcggaacctgaaaccccaaacatggatgtcattggagaacgaattaaacgtataaaagaagaacacaactcaacttggcattacgatgacgagaatccatacaaaacgtgggcgtatcatgggagctacgaggtaaaggcaacgggaagcgcgtctagcatgattaacggtgtcgttaaacttttgactaaaccgtgggatgtcgttccaatggtaacccaaatggctatgactgatacgacaccttttggccaacaaagagtgtttaaagaaaaagtggacacgaggacccccaggagcatgccaggtacaagaagagtaatggaaattacagctgaatggctatggcgtaccttaggtaggaataagaaaccaagactatgtacaagggaggagttcaccaagaaagttagaacaaacgccgcaatgggagcagtatttacagaagagaatcagtgggattcagcgaaagcggcagttgaagacgaggatttttggaaattagttgaccgagaacgtgagcttcataagttaggaaaatgcgggtcttgtgtttacaatatgatgggaaaaagagagaagaaactaggagaatttggtaaggctaaagggagcagagccatctggtatatgtggctgggtgctcgatacttggaatttgaggcattaggcttcctaaacgaagaccattggttcagtagagaaaactcgtactctggggtggagggggaaggacttcataaattgggatatatactaagagacatttccaaaatccctggtggtgcaatgtacgcggacgacactgcaggatgggacacgcgaattacggaagatgatctgcataatgaagagaaaataactcaacaaatggatcccgaacatcgtcagctagctaatgccatctttaaattaacgtaccaaaataaagtagtaaaagtacaacgaccaacaccaacaggaactgtgatggatattatctcaagaaaagatcagagagggtcagggcaggttgggacatatggcttaaacaccttcacgaacatggaagtccaactaatcagacagatggaaggagaaggcgttctgtcaaaagcagatctagaaaaccctcatcttccagaaaagaaaattactcagtggttggaaactaaaggtgtagagcgacttaagagaatggcaatatcaggtgatgattgtgtagtaaaacccatcgatgacaggttcgcaaatgcattactagcactaaatgatatgggtaaagtccgtaaagatataccacagtggcaaccctctaaaggttggcatgactggcaacaagtacctttttgcagtcatcatttccatgaattgatcatgaaagacggtaggaaacttgtagttccctgtagaccgcaggacgaattaataggaagggcaaggatatcacaaggtgcagggtggtcgctccgagaaactgcatgcttaggaaaggcttatgcgcagatgtggtcattaatgtattttcatcggagggatcttcgcctggcatcaaatgcaatatgcagtgcagttcccgtacattgggtgcctacatctcgcacgacatggagtatacatgcccaccaccagtggatgacaacggaggacatgctcacagtctggaatcgggtttggatagaagataatccatggatggaggacaagacccctgttactacctgggaaaacgtaccatatcttgggaaaagagaagatcaatggtgtgggtctttaataggtctaacatcccgagcaacatgggcacaaaatattccaacggctatacaacaagtacgtagtctgattggcaatgaagaatttctagactatatgccaagcatgaaaagattcagaaaagaggaagagagcgaaggagcaatatggtaa

SEQ ID NO: 23065 - RNA, 9873 nt, synthetic construct
  misc_feature 1..9873: note = derived and/or modified CDS sequence (opt6) from DENV-3__GU131866__SS-prME
  source 1..9873: mol_type = other RNA
acgtctctatgtctcatgatgatattacctgcagcactcgcgtttcacttaactagcagagatggggaaccacgtatgatagttggcaaaaatgaacgcgggaaatcattgttgttcaaaacagcgtcaggaataaatatgtgcacattgatagccatggacttaggagaaatgtgtgacgacacagtaacgtataaatgtccacacatcacagaagtagaaccggaggatattgactgttggtgtaacttgacttccacctgggttacgtatggtacatgcaatcaagctggtgaacgacgacgagatcgtcgttctgtggccctagcaccgcacgtaggaatgggtttagataccagaacacaaacatggatgtctgcagagggtgcttggaggcaagtagaaaaagtagagacatgggccctgagacatccgggtttcacaatacttgcattgttcttagcacattacataggtacatccctcacacaaaaagtggtaatctttattctccttatgctggtcacaccttctatgacgatgcgatgtgtcggtgtaggcaacagggattttgttgagggactctctggcgctacttgggtcgatgttgtgcttgaacatggtggctgtgttacaacaatggccaaaaataaaccgacgcttgacatagaactgcagaaaacagaggcaactcaattagcaacactacggaaactttgtatagagggaaaaataaccaatattaccacggactcaaggtgcccaacacaaggtgaagctgttcttccagaggagcaagatcaaaactacgtttgtaaacacacttacgttgaccgtggctggggtaatggatgtggtttgtttgggaaagggagcctcgtgacctgcgcaaaatttcaatgtctagaattaatagaaggaaaagtagttcaatatgagaacttaaaatacacagtgatcatcacagtacatacgggcgaccaacatcaagtcggtaacgaaactcaaggagttactgccgaaatcacaccccaggcttctacgacagaagccatccttccagaatacggaaccttaggattagaatgttcaccccggacaggattagacttcaacgaaatgatcctgttaactatgaaaaataaagcgtggatggtccaccgtcaatggttctttgatctaccactcccttggacaagtggcgcaacaacagaaactccgacatggaatcggaaagaattattagtaacattcaaaaatgctcatgctaagaaacaggaagtagttgtcttaggaagccaagaaggagcaatgcacacggccttaacaggcgcgaccgagatacaaaactccggaggaacttcaatatttgctggccaccttaaatgtagactgaaaatggacaaattagagttgaaaggaatgagctatgcaatgtgcactaacacattcgtacttaagaaagaggtcagtgaaacccaacatggtacaatactaataaaagtcgaatacaaaggtgaagacgcgccatgcaaaatcccttttagtaccgaagatggccaaggtaaagcccacaacggaagactaataacagctaaccctgtagtaacaaagaaagaagaaccagtgaacattgaggcagaaccaccttttggggagtccaatatagtcataggcattggtgacaatgcactaaaaataaattggtataagaaaggtagttcgataggtaagatgtttgaagcaacagcaagaggcgccaggcgtatggccattttgggtgacacggcctgggattttggatccgtcggaggagtattaaactcattaggaaaaatggtacatcaaatattcggatccgcttacacagccctattctccggagtctcatgggtaatgaagataggtatcggagttctgctgacatggattggattaaatagcaaaaatacatcgatgtcattctcctgcatagcaatagggataattacgttatacctaggagctgtggtgcaagctgatatgggatgtgtgataaattggaagggaaaagaactgaagtgtggatcgggcatcttcgtcacgaatgaagttcacgcttggactgaacaatataagttccaagcagactcaccgaaacgtttggctacagcaatagcgggcgcatgggaaaatggtgtttgtggaataagaagcacaacaagaatggaaaatctgctttggaaacagatagcgaatgaacttaactatattctatgggaaaataatataaaactaaccgtagtagtaggagatattattggcgtgttagaacaaggtaaaagaacactaactcctcaacctatggaactaaagtacagttggaaaacatgggggaaagccaaaatcgtgacagcagaaactcaaaacagcagctttattatagatggacccaatactccagaatgccctagtgctagtagggcatggaatgtctgggaagtagaagattatggtttcggagtttttactactaacatctggctaaaactgagggaggtatatacacaattatgtgaccacaggctaatgtccgcggccgtaaaggacgaacgagcagtccacgcagacatgggctactggatcgaatcacagaaaaacggatcttggaaacttgaaaaggcttcgttaatagaggtaaaaacgtgtacgtggccaaagtcgcatacactttggtcaaacggtgttctcgaaagcgatatgatcataccgaaaagccttgcggggcctatatcacaacataatcatagaccagggtatcacactcagacagcaggaccttggcacttaggaaaacttgagttggactttaactactgcgaggggacaacggtcgtaatcactgaaaattgtggcactcgcggcccaagtctaaggacaacgacagtaagtggtaaattaatccacgagtggtgctgtagaagctgcacattaccacccctacgttatatgggagaagacggatgttggtacggaatggaaattcggccgatatcagaaaaggaagagaacatggtgaaatctttagtgtctgcaggaagcggaaaggtcgataatttcaccatgggcgtcctatgtctcgctattctatttgaggaggtaatgagaggtaaattcgggaagaaacatatgattgcgggtgtattctttaccttcgtcttactgttatcaggacaaataacgtggagagatatggctcacacactgataatgataggcagtaatgcatcagatcgcatgggaatgggagtcacttatcttgcactcatagccacgttcaaaattcaaccatttctagcactaggcttctttcttagaaaactgacctcacgagaaaatcttctacttggtgtaggtctcgccatggcaacaacactacagttgcctgaggacattgagcaaatggcaaacggaattgccttaggactaatggctctaaaacttataactcaattcgaaacatatcaactttggaccgctttaattagtttaacatgcagcaatacaatgtttaccctgactgtagcgtggcgaacagccacactaattctagctggggtgtcacttttgcccgtatgtcagtcttctagtatgcggaaaacagattggttacctatggcagtagccgcaatgggtgtaccgccgttacctttattcatcttcagtttaaaagatactttgaaaaggagaagttggcctcttaatgaaggtgttatggcagtaggtttagtaagtattctggcatctagcttattgcgaaacgacgtaccaatggctggtccacttgtagctggtggcctcctgattgcatgctacgtaatcacaggtaccagtgctgaccttactgttgaaaaagctgctgatataacatgggaagaagaagcagagcaaacaggcgtttcacataacctgatgataacagtagacgatgatggaactatgagaattaaagatgatgaaacagaaaatatactcactgtacttttgaaaaccgcacttttgattgtgagtggcgtgtttccttactcaatcccagcgacattactcgtatggcatacttggcagaaacaaacacaacgatcaggagtcttatgggacgttccctcaccgccggaaacccaaaaggcagagttagaagagggggtatatcggataaagcagcagggaatttttggaaaaactcaagttggagtaggtgtccaaaaagaaggagtcttccatacgatgtggcatgttacacgcggggcagtattgacctataacgggaaacgattagaacctaactgggcctccgtcaagaaagatcttataagctacggcggtggatggcgcctatcagcacagtggcaaaaaggagaagaggtacaagtgattgcagtcgaaccaggtaaaaatcccaaaaatttccagacaatgcccggaaccttccaaacaaccacaggcgaaattggagcaatagcattggattttaaacctgggacaagtgggtcgccgattataaacagagagggcaaggtagtcggtttatacggaaacggagtggtaactaaaaacgggggttacgtttcagggatcgcgcaaacaaacgcggaaccagatggacctacaccagaactggaagaagagatgttcaagaaacgaaatctaaccatcatggacttacatccagggtccggaaaaacacgaaaatatcttccagcgatagtcagagaagccataaaaagaagattgcgcacattaatactagctccgacacgggtagtggccgcagagatggaggaagcgttaaaaggactaccaattcgttatcaaactacggcgactaaatcggaacatacaggcagagagatagtcgatctaatgtgccatgcaacttttaccatgagactactaagtccagttcgagttcccaattataacctgatcataatggacgaagcccattttacggatcccgcctcaatcgccgcgcgaggatatataagcacaagggtggggatgggtgaagcagccgctattttcatgacagccactccaccgggtacagcagatgcgttcccacaatctaacgcaccaatccaagacgaggaaagagacatccctgagcgaagttggaactcgggaaacgagtggataactgatttcgctggcaagacagtgtggttcgtaccttcgattaaagccggtaacgatattgctaactgcctgcgtaaaaacggaaagaaagtaattcaactatcgagaaaaacgtttgacacagaatatcaaaagactaagttaaacgactgggatttcgtggtaacgaccgatatctcagaaatgggtgcgaacttcaaagcggaccgagtaatagacccaagacggtgtcttaaaccagtcatattgacagacggaccagaacgagtaatattagctggccctatgccggttactgctgcgagcgcagcgcaacgtagaggacgagtaggtcggaacccacagaaggaaaacgatcagtatatctttactggacaaccactaaataatgatgaggaccacgcacattggacagaggcaaaaatgctactagataacataaatacgcctgagggaataatacccgccctttttgaaccagaaagagaaaagagcgcagcaatagatggcgagtacagactaaaaggagagtcacgtaagaccttcgtggaacttatgcggaggggagacctacccgtttggttagctcataaagtagcatcagaggggatcaaatacacggatcgtaagtggtgttttgatggacagagaaataaccaaatacttgaagaaaacatggatgtagagatctggacgaaggaaggtgagaagaagaaattaagaccgagatggctcgatgccagaacgtattctgatcctttagcattaaaggaatttaaggactttgcagcgggaagaaaaagtattgcattagacttggtaacagaaatcggacgtgttccttcacacttagcacacagaactagaaacgctctagataatctcgtcatgttacatacttcagaacacggcggtagagcatacagacacgccgttgaggaactgcccgaaactatggagactctgttacttttgggtctcatgatcctcttaactggtggagccatgctgttcttaatatcagggaaaggaataggaaaaacttccattgggttaatttgtgtcatagcatcaagcggaatgttatggatggctgaaattcctctacaatggatagcgtcagctattgtgttagaatttttcatgatggttttattaattcccgaaccagaaaagcaaagaacaccacaggataaccaattagcttatgtagtaataggaatattaacactagctgctattatagccgcaaacgagatgggactactagaaacaaccaaacgtgatctgggaatgtcaaaagaaccaggagttgtctccccaacctcttatcttgatgtagacttacatcctgcaagcgcctggaccctctatgcagtagcaacaactgtaataacaccaatgcttcggcatacaatcgaaaatagcactgccaatgtaagtcttgcagcaattgcaaatcaggcggttgtcttaatgggtttagataagggttggcctatatccaaaatggacttgggcgtgcctctattggcactaggttgttattctcaagtcaatccgttaacactaacagcagctgtattactgttaatcactcattacgcaattattggacccggcttacaggcgaaagcaacccgagaggctcaaaaacgaacagcagcaggtatcatgaaaaatccaacagtcgatggtattatgaccattgatcttgatcctgtgatatacgattcaaaatttgaaaagcagcttggccaagttatgttattagtgctttgcgctgtacaattgttactcatgcgtacttcgtgggcgttatgtgaagcacttaccttagcgacaggacctataaccacactatgggaaggaagtcctggaaaattttggaatacgacaatagctgtatcaatggcgaacatattcagaggaagctacttagccggtgcaggcttagcgttttctattatgaagagtgtcggaacaggaaaacgagggacaggatcacagggagaaactttgggcgaaaaatggaaaaagaaattgaaccaattaagtagaaaagaatttgacttgtataagaaaagtggaataacagaagtcgatcgtaccgaagctaaagaaggacttaaaagaggagaaattacacatcatgccgtatcacgagggagtgcaaaactacaatggtttgttgagcgtaatatggtgatcccagaagggcgagttattgatttgggttgcggtagaggaggttggtcatattattgcgctgggcttaagaaagtaactgaagttagaggctacactaaagggggacctggacatgaagaaccagtacccatgtccacttacgggtggaatattgtaaaacttatgtcagggaaagatgtcttttatcttcctcccgagaaatgcgacacacttctatgcgacataggagagtcgtcgccctcgccgactgtcgaagagagtcgtacaatcagagtactaaaaatggtagaaccgtggctcaagaataaccaattctgtataaaggttctaaacccctacatgcctactgttatagagcatttggaaagattacaacgaaaacatggcggaatgttggtgcgaaatcccttatcaagaaattcaacgcacgaaatgtattggatttcaaatgggacaggcaacatagtagcaagtgttaacatggtatcacgtcttcttctaaatagattcacaatgacccatcgcagacccacaatcgaaaaagacgtggatcttggagcaggcactaggcacgtgaacgccgaacccgagaccccaaacatggatgtcataggcgaaaggataaaacgaataaaggaagaacacaacagcacctggcactacgatgacgaaaatccttataaaacttgggcctatcacggatcatatgaggtaaaggcaactggctcagcaagtagtatgataaacggggtagttaaactattgacgaaaccctgggacgttgtcccgatggtgacgcagatggctatgacagacacaacaccatttggtcagcaaagggtatttaaagaaaaagtagacacgcgcactccaagatcaatgccaggaacgcgaagggttatgggtataacggcagagtggttgtggagaactcttggacgcaataagaaaccgagactttgcacacgagaagaatttaccaagaaagttaggactaacgcggccatgggcgcagtattcacagaagaaaaccagtgggactcggctaaggctgccgttgaagatgaagatttttggaagctagtagatcgggagagagaacttcacaaattgggtaaatgcggatcatgtgtctataacatgatgggcaaaagagagaagaaattaggggaatttggaaaagccaaaggaagtcgagcaatatggtatatgtggttgggagctcggtacttggagttcgaggctctaggatttctaaacgaagatcactggtttagtagggagaacagctatagtggggtcgaaggtgagggattacataaattaggatatattctaagagatatatctaagatacctggaggagcgatgtacgccgacgataccgcaggatgggatacaagaataacagaagacgacttacataatgaagaaaagattacgcagcaaatggatccagaacatagaaagctggctaatgcaatatttaaactcacttaccaaaacaaagtggtaaaggtgcagagacccacacccacggggacagtgatggatataattagtagaaaagatcagcgaggaagcggccaggtcggtacatacggacttaacacatttaccaacatggaagctcaattaattcgacaaatggaaggtgaaggtgtactctcaaaagctgacttggaaaatcctcatctgccggaaaagaaaattacacaatggttagaaactaaaggagtggaaaggttaaagcgaatggccatttctggagatgattgcgtagttaaacctatagatgatcgattcgcgaatgcactgctagccttaaatgatatgggaaaagtccgtaaagacataccccaatggcaaccaagtaaaggatggcatgactggcagcaggtcccgttttgcagtcaccactttcacgagttaattatgaaagatgggagaaaacttgtagtaccatgtagaccacaagatgagttaataggcagagcaagaatatcacaaggcgctggttggagtttgagggaaaccgcatgtctgggtaaagcatacgcacagatgtggtcattaatgtattttcatcgtcgagatttaaggctagcgagcaacgcaatttgctcagccgtacctgtccattgggtaccaacttcaagaacaacctggagtatacatgcccatcatcagtggatgacaacggaagatatgcttacagtttggaatcgggtgtggatagaagacaatccttggatggaggacaaaacgccagtaactacatgggagaacgtaccatatcttggcaaacgtgaggaccaatggtgtggttcactaatcggcttgacgagccgtgcgacatgggcacaaaacattccaacagccatacaacaagtacgaagcctaatcggtaatgaagagttcttagactacatgccttctatgaaacgtttcaggaaggaagaagaaagcgaaggtgccatttggtaa

SEQ ID NO: 23066 - RNA, 9873 nt, synthetic construct
  misc_feature 1..9873: note = derived and/or modified CDS sequence (opt6) from DENV-3__GU131868__SS-prME
  source 1..9873: mol_type = other RNA
acgccactatgtcttatgatgatattgcctgcagctttagcatttcatctaacttctcgggacggggaaccaaggatgatagttgggaaaaatgaaaggggaaaatcacttttattcaaaaccgcatctggaattaatatgtgtactttaatagctatggacctcggagaaatgtgtgacgacactgttacatataaatgcccccacataactgaagtagaacccgaagatatagattgctggtgtaatctgaccagtacttgggtcacgtatggaacgtgcaaccaagcgggggaaagaagacgggacaaacggtcagtcgcattagcaccccacgtgggaatgggtcttgacactaggactcaaacttggatgagtgcggaaggagcgtggcgtcaagtcgaaaaagttgagacctgggcactgcgtcatccagggtttactattctcgcattattcttagcacactatattggaacaagtttaactcaaaaagtcgtgatttttatactactaatgttagttactcccagtatgacaatgagatgcgtaggtgttggcaaccgcgatttcgtggaaggtctgagcggcgcgacttgggttgacgtcgtattagagcacggagggtgtgtgacaaccatggctaaaaataaaccaacattggatatagaactacagaaaaccgaagctacccaactggccacactccgtaaactttgcattgagggtaaaattacgaacattactaccgacagtcgatgtcctacccaaggagaagcagtattaccagaagaacaagatcaaaattatgtttgcaaacacacatatgtagatagaggatggggcaatggatgcgggctattcggaaaaggtagtttggtcacgtgtgctaaattccaatgtttagaattgattgaagggaaagtcgtacaatacgagaacctcaaatacactgtaatcatcaccgtacacacgggagatcaacaccaagtaggaaatgaaactcaaggagtaacggctgaaataacgccccaagcgtctaccaccgaagcaatccttccagagtatggtacattaggcctcgagtgttcacccagaacgggactagatttcaacgaaatgatacttttaacaatgaaaaataaggcttggatggtgcataggcaatggttcttcgatttgcctcttccttggacgagcggggccacaacggaaacacccacatggaaccgtaaagaacttctagtcacatttaataacgcgcatgctaagaaacaagaggtagtagtattgggcagccaagaaggtgcaatgcacacagcgcttactggagcaaccgaaattcaaaattctggaggcacaagcatcttcgctggacatttaaaatgccgattgaaaatggacaaactcgaacttaaaggaatgagctatgcaatgtgcacaaacacatttgtactcaaaaaggaggtttcagaaactcaacatggtaccattttgattaaagtagaatataaaggggaggatgcaccctgtaaaatcccattctcaaccgaagacggtcagggaaaagcccataatggtcgtttaataaccgcaaatcctgtagttactaagaaagaagaacctgttaatatagaggcggaaccaccgttcggagaatctaatattgttataggaataggggacaatgctttaaaaataaactggtataagaaaggttcgagtataggaaaaatgtttgaagctactgcaaggggcgcccgaaggatggcaatacttggtgacactgcatgggactttggatccgtgggaggcgtactcaattcattaggtaaaatggttcaccaaatatttggcagtgcatataccgccctattctccggcgtaagctgggtgatgaaaatcgggatcggagtgttattaacatggataggcctgaacagcaaaaatacttcgatgagtttttcttgcatagcgattggaataattaccctatatctaggcgccgttgttcaagccgacatgggctgcgtgataaattggaaaggaaaagagcttaaatgcggaagtggcatattcgtgacaaatgaagtacacacgtggaccgaacagtataaattccaagctgatagccccaagcgattagccacggctatcgccggtgcgtgggaaaacggtgtctgcggaataagaagcactacccggatggaaaaccttctatggaaacagatagccaacgagcttaattatatactttgggaaaacaatataaagctaacagtagttgtcggcgacattataggggtactggaacaaggaaaaagaactttaacgccacaaccaatggagttgaagtactcatggaaaacatggggcaaagcaaagatagtaaccgcagagacgcaaaactcttcttttatcattgatggaccaaatactccggagtgtcccagcgcatcgcgagcctggaacgtctgggaagtcgaagactatggctttggtgtgttcactacaaatatatggctgaagttacgagaagtgtatacgcaactatgcgatcatagactaatgagcgcagctgtaaaagatgaacgggctgtacatgccgatatgggttattggatagaatcgcagaaaaatggatcatggaagctagaaaaagcgtcccttatagaagtcaaaacttgtacctggcccaaatcacacacattatggtccaacggcgttctcgaatctgatatgattatccctaaatccctcgccggaccaatttcccagcataaccaccgaccgggatatcacacacagacagcaggtccttggcatctaggaaaacttgaactcgattttaattattgcgaagggactacagtcgtcataacggaaaactgtggaacgaggggcccatctctaaggacaacaacagttagtggaaaacttatacatgagtggtgttgtcgaagttgtacactaccaccgttaaggtatatgggagaagacggatgttggtatggaatggaaataaggcctataagcgaaaaagaagaaaatatggtaaaatcactcgtatccgcgggatctggaaaggtggacaattttacaatgggagtcctctgccttgccatcttgttcgaagaggttatgagaggaaaattcggtaagaaacatatgattgcgggagtatttttcacgtttgttcttttattatccggacagattacttggcgagacatggcgcataccctaataatgataggatcaaacgcctcagacagaatgggaatgggagtaacttacctagctcttatagcgacattcaaaattcaacctttcttagccctggggttctttctgagaaagttaaccagtagagagaatcttttactaggcgtaggattggcaatggccactactttacaattaccagaagacatagaacagatggcgaacggcattgctctcgggctgatggcattaaaattaataacacaattcgaaacttaccaactatggacggctttaatatccttaacttgcagtaacacaatgtttactttgacagtggcgtggcgcactgcgactctaatccttgctggggttagcctgttgcccgtgtgtcaatccagctcaatgcgcaagacagattggttacccatggctgtcgccgctatgggagtgccacccctaccactttttattttctcgctcaaagatacgttgaaacgaagaagctggccgcttaatgaaggcgttatggcagtcggacttgtgtcgatactagctagtagcctcttgcgaaatgatgtaccaatggcgggccccctcgtcgctggaggtctattaattgcatgttatgtcattaccggaacaagtgctgacttgactgtggaaaaggcggcagatattacgtgggaagaagaagcagaacagacgggagtaagtcataacctaatgatcacggtagatgatgatgggacaatgcggatcaaagatgacgaaacagagaatatcttaacagttttgttaaagacagcactgctaattgtgagtggggtatttccatatagtattccagccactttactcgtatggcatacgtggcaaaaacagacacagcgttctggagttctttgggatgtcccatccccgcccgaaactcaaaaagccgaacttgaagaaggggtctatagaattaaacaacagggcatcttcggtaaaacgcaagtgggagtaggagtccagaaggaaggggtatttcacacaatgtggcatgttacacgtggagcagtgctgacatataacggtaaacgtttagaaccaaactgggccagcgttaagaaagatttaatatcatacggaggtggatggagactatctgcccaatggcaaaagggggaagaggtacaagtgatagctgttgaacctggcaaaaatccaaagaatttccaaaccatgcccggaacttttcagactacaacgggagaaattggcgctatagcgttagattttaaaccaggtaccagcgggagtccaataatcaatcgggaaggcaaagtagttggtttatatggcaacggcgttgttactaaaaatggaggctacgtgtccggtatagcacaaacgaaagcggaacctgatggacctactccggaacttgaagaggaaatgtttaagaaaagaaaccttacaattatggacctacatccaggaagtggcaaaactagaaaatacttgccagcgatagtaagagaggccatcaaaaggaggttacgtactttaattttagctccgactagagttgttgctgctgaaatggaagaggctttaaaaggattacctatcagatatcaaacaacggccacaaaatctgaacataccggacgagaaatagtagacttaatgtgccacgcgacctttaccatgcgtttgctaagcccagtacgagtaccaaactacaacctaattataatggatgaagcccactttacggaccccgcatccattgctgctcgggggtatattagcaccagagtcggcatgggagaggcttcagcaatcttcatgacagctaccccaccaggaaccgctgatgcgtttccgcagagcaacgcaccaatacaggatgaagaacgcgatatacctgaaagatcatggaatagcggaaacgaatggataaccgattttgcgggcaagaccgtatggttcgtacccagtataaaagcaggtaacgacatagcgaattgtctcaggaaaaacggtaagaaggtcatacaactttcaagaaagacattcgacactgaatatcagaaaacaaagttaaacgactgggacttcgttgtaacgacagatatcagtgaaatgggtgcaaacttcaaagccgatagagtaattgaccctcgcagatgcctaaagcctgtcatactgactgatggcccagaacgggttatccttgctgggccaatgcctgtgacagctgcctcagcagcacagagaagaggaagggttggaagaaacccacaaaaagaaaacgatcagtacatatttacaggacaaccattaaataatgatgaagatcacgcgcattggacagaagccaaaatgttattggacaacataaataccccagaaggaataattcctgcacttttcgaaccagaaagagaaaaatccgcagcaatagatggtgagtacaggctcaaaggagaatcaagaaaaacattcgttgaactaatgagacgaggagatcttccagtatggttagctcataaagtagcgagtgaaggaattaaatatacagacaggaagtggtgtttcgacgggcaacgaaataaccaaatcttggaagaaaacatggatgtagaaatctggacgaaagagggagaaaagaagaaacttaggccacgatggctagacgcgcgcacctacagtgaccctttagctctaaaagaatttaaagattttgcagcaggtcgaaaatcaatagcacttgatttagttactgaaataggtagggttccaagtcatttagcgcacagaacaaggaacgctttagataatttagtaatgctgcacaccagcgaacatggtggtagagcttacagacatgccgttgaagaactaccagagactatggaaactcttctattgctagggttgatgatattgttaacgggtggcgctatgttattcttaataagtggcaagggaattggcaagaccagcattggattaatctgtgtaatagccagcagtggtatgttgtggatggcagaaatccccctacaatggattgcttccgcaatcgttttagaatttttcatgatggtactacttattccggagcccgaaaaacaaaggacacctcaagacaatcaattagcatatgtagtaatagggatacttactctcgctgcaattattgcagctaatgaaatgggattgttagaaacaactaaacgggacctcggcatgagcaaagaaccatcagtagtctcgcccacgtcatatctggatgttgacctccaccctgcatcagcttggacactgtatgcagtggcaacaactgttatcacacctatgttaagacatacaattgaaaatagcactgctaatgtatctttagcagcaattgccaatcaagctgtagtgttaatggggttagataagggatggcccatctccaaaatggacctaggggtccccttattagcactgggatgttattcacaagttaatccccttacacttaccgccgctgtatttttactaataacccactacgctatcattggccctggcttacaagcaaaagcaacaagagaggcacagaaaaggactgctgccggaataatgaaaaatccaaccgtcgatggtattatgaccatcgaccttgaccctgttatatacgatagcaaattcgagaaacaactaggtcaagtaatgttattggtactatgtgccgtccagctgttgcttatgcggacgtcttgggcattatgtgaagcacttacattagcaacgggacccataaccacactatgggaaggatcgccaggtaaattttggaataccactattgctgtatcaatggccaatatcttccgcgggagctacctcgccggtgcaggtctggccttttctattatgaaaagcgtaggaaccggaaagcgaggtactggttcacaaggagaaacgttgggagaaaaatggaaaaagaaactaaatcaattatcacgcaaagagttcgacttatacaaaaagtcagggattacagaggttgatcgaacggaagcaaaagagggcctcaaacgaggagaaatcacccatcatgcagtctctcgaggttctgcaaaactacaatggtttgtagagagaaatatggttatcccagagggaagagttatagatttaggatgcggtaggggcggatggagttattattgcgccggtctaaagaaagtgacagaagttcggggttacacaaaaggagggccaggtcacgaagaaccagttccaatgagcacatatggatggaacatagtcaaactaatgagcggtaaggatgtattttatcttcctccagagaaatgtgacacattattgtgtgatataggagaatcgtcacctagccccactgttgaggaatctcgaaccataagagtactaaagatggtagaaccatggttgaagaataaccaattttgcattaaagttttaaacccctacatgccaactgtgatcgaacatctagaaaggcttcaacggaaacatggtggtatgttagttcggaatccgttatcccgcaattccacccatgagatgtactggatcagtaacggaaccggtaatatagttgcgtccgtaaacatggtttcacgattgttacttaatagattcacaatgacacaccgaaggccaacaattgaaaaagacgtagacttaggggcaggtacgcgacacgtgaacgccgaaccagaaaccccaaacatggatgtgatcggcgaacgaataaaaagaatcaaggaagaacacaattctacgtggcactatgatgatgaaaacccatataagacatgggcctaccacggatcttatgaagttaaagccacaggttcggcctcgtcgatgataaatggggttgtcaaactactaaccaaaccctgggacgtagtgcccatggtgacccaaatggctatgactgatacgactccctttggtcaacaacgcgtatttaaagaaaaggtggacacaaggactccaaggagcatgcctgggactagacgagtcatgggtataaccgcggaatggctttggaggacattagggagaaacaagaaaccaagattatgtacgcgcgaagagtttactaagaaagtacggacaaacgctgcaatgggcgccgtttttactgaagaaaatcaatgggactctgcaaaagctgctgtggaagacgaagacttttggaaattagttgatagggaaagagagttgcacaaacttgggaaatgcggatcgtgtgtatataacatgatgggtaagagagagaagaaattgggagagttcgggaaagccaaaggtagtagagctatttggtatatgtggctcggagcccggtatcttgaatttgaagcacttggcttcctcaatgaggatcattggttttctcgagaaaattcttattcaggtgtcgaaggtgaaggactacataagttaggatatatattacgcgatatatccaaaataccgggtggagccatgtacgcagacgacacagcaggctgggatacccggatcacggaagatgatcttcataatgaagagaaaatcacacaacagatggacccagaacacagacaattagcgaacgctatttttaaattaacatatcaaaataaagtcgtaaaggtgcaacgacctacacccactggaaccgttatggatattatatcgcgtaaagatcaacggggatctgggcaagtaggaacttatggcctcaacacattcactaacatggaagcgcagttgatacgccagatggaaggggaaggcgttttaagtaaagcggatttagaaaacccacatctacccgaaaagaaaataacgcaatggctggagaccaaaggagtcgagagactaaaaagaatggcaatttccggtgatgactgtgttgttaagcccatagatgatcgattcgcaaatgcgctcttggccttgaatgatatgggcaaagtgagaaaagatataccacagtggcaaccatccaaagggtggcatgattggcaacaagttccattttgcagccaccactttcatgagttgataatgaaagacggacgtaaattagtagtaccgtgcaggccgcaggatgaacttatcggacgtgcacgaataagtcaaggagcaggatggagcttgagggaaacggcctgtttaggaaaggcttacgcgcaaatgtggtcacttatgtactttcatagaagagacttgagattagccagtaatgcgatatgctccgcggtacctgtacattgggtcccgacaagccgtacaacatggagtatacatgcacatcaccaatggatgacaacagaagatatgttaaccgtctggaatagggtttggatagaagataatccatggatggaggataaaacaccagtcacgacttgggaaaatgtgccttaccttggaaaacgtgaagaccaatggtgcggttccctaatagggttgacatcgagagccacgtgggcgcaaaacataccaacagctatacagcaagtaagaagtcttatagggaacgaagagtttttggattatatgccgtcaatgaaaagattcaggaaggaagaagaaagtgaaggagcaatatggtaa

SEQ ID NO: 23067 - RNA, 9873 nt, synthetic construct
  misc_feature 1..9873: note = derived and/or modified CDS sequence (opt6) from DENV-3__GU131869__SS-prME
  source 1..9873: mol_type = other RNA
accagcttgtgtttagtgatgatattacctgctgcattggcgtttcacttaacatcacgggatggagaacccaggatgattgtcggtaaaaatgaacggggtaaatccctactttttaaaacagcatctgggattaacatgtgtactcttatcgccatggatctaggagaaatgtgtgatgatacagtaacatataaatgtccacatatcacggaagtggaacctgaagatatagattgttggtgtaatcttacatccacatgggtaacgtatgggacttgtaatcaagccggtgaaagacgaagggacaaacgctctgtcgcgttagcaccacacgttggaatgggcctagatacaaggactcaaacatggatgtcggccgaaggagcgtggcgacaagtggaaaaagtagaaacgtgggcactcaggcatcctgggttcacaatacttgcattgttcctcgcacattatataggaacaagtttaacgcaaaaagtcgtgatatttatattactcatgcttgtcacacctagtatgacaatgagatgcgtaggggtaggtaaccgcgactttgttgaaggattaagtggggcgacttgggtagacgttgtattagaacacggaggatgcgttaccacgatggcgaaaaacaaaccaaccttagacatagaattacagaaaacggaagcgacccaattagcaacattaagaaaattatgtatagaaggtaaaataacaaacataactactgatagtagatgtccaacgcaaggagaagcagttctaccggaagaacaagatcaaaattatgtttgtaaacacacatatgttgatagaggatggggaaatgggtgtggtttattcggaaaaggaagtctcgtaacttgtgctaaatttcaatgcttagaacccattgaaggtaaagtcgtgcaatacgaaaatttaaaatacactgttattataacggtacataccggagatcaacatcaagtcggaaacgaaacacaaggtgttacagctgaaatcaccccacaagcatcaacgaccgaagctatcctacctgaatatggcacgttaggactagaatgtagcccacgtacaggtctcgattttaacgaaatgatattgctaaccatgaaaaacaaggcttggatggtacaccgacaatggtttttcgacctacctttaccatggacgtctggtgcaacgaccgaaactccaacgtggaatagaaaagaattattggtcactttcaaaaacgcgcatgcaaagaaacaagaagttgtagtgctaggctctcaagaaggtgcgatgcatacagctttgacaggtgcgacagaaattcaaaattctggagggacatcaatcttcgctggacatctaaaatgcagattaaaaatggataaactagagttaaaaggtatgagctatgcgatgtgcaccaacacttttgttctcaagaaagaagttagcgaaacccaacacggaacaatactaattaaagtggaatatcggggagaagatgcaccttgcaaaatacccttctcaactgaagatggccaagggaaagcgcacaacgggagactcattacagcaaacccagttgtcaccaagaaagaagaaccagtcaatatagaagccgaacctccgttcggtgaatccaacatagtaattgggatcggcgacaatgcactcaaaatcaactggtataagaaagggtcatccattggcaaaatgtttgaagccacagcgcgcggcgcaagaagaatggcgatattgggagatatcgcctgggattttggaagtgtaggcggtgtactaaatagtttaggaaaaatggtacatcaaatattcggttccgcttatacagctctatttagtggagttagttgggtaatgaaaataggcatagggatactattaacatggattgggctaaactctaaaaacacttcaatgtcatttagttgcatagcaatcggaataataaccttatacctaggagcggtggttcaagcagatatgggttgcgtaattaactggaaaggtaaagaattaaaatgtgggtctggaatctttgttacaaatgaggttcatacttggacagaacaatacaaattccaagccgacagtcccaaaagattagcaacagcaatcgccggggcatgggaaaacggggtatgcggaatcagatcaaccacacggatggaaaatctattatggaaacaaatagcaaacgagttgaattatattttatgggaaaacaatataaaattaacggtggtagtaggtgacataataggtgttttagaacaaggaaaacgaacactcacacctcaaccaatggaattaaaatattcttggaaaacttggggaaaagcaaaaatagtaacagcagaaacacaaaatagctcatttataattgatggtccaaacacgccagaatgtccctccgcaagtagagcttggaatgtgtgggaagtagaagactacggttttggagttttcaccaccaatatatggctaaaattgagggaggtatacactcaactatgtgaccacagactaatgtcggcggccgtaaaagatgagagagcagtccacgccgatatggggtattggattgagtcccagaaaaatggttcgtggaaacttgaaaaggcttcattaattgaagtaaagacatgcacttggcctaaaagccacacgttatggtccaatggtgtattggaatctgacatgattataccaaagtcccttgctggaccaatctcccagcataatcatcgaccgggttaccacacccaaactgcaggaccttggcatcttggaaaattagagcttgattttaattattgcgaaggtacaacggtggtaataacggaaaactgtggaaccaggggaccatccttaagaacaacaacagtatccggaaaactgatccacgaatggtgttgtcgaagttgcacacttccaccattaaggtacatgggcgaagatgggtgttggtacgggatggaaatcagaccaatatctgaaaaagaagaaaatatggtaaaaagtctagtgtctgcaggatctgggaaggtggacaattttactatgggtgtgttgtgcttggccatactattcgaagaggttatgagaggaaaatttgggaagaaacatatgatagctggggtatttttcacgttcgtgttgttactttccggacaaataacttggcgtgacatgacccatacactaataatgataggtagcaatgcttcagaccgtatgggcatgggagtaacttatctggcgctcatcgctacatttaaaatccagccattcctggcattaggctttttccttcgtaaactgacttcacgcgagaatctgcttcttggggttggactcgctatggctacgaccctacaactccccgaagacatagagcaaatggcaaatggaattgcactaggtctgatggctcttaaacttataacccagtttgagacatatcaactttggacggctttaatttcgttaacgtgcagcaatacgatgttcaccctgacagtagcatggagaaccgcgacattaattctagctggagtgtcattgctgcccgtatgccaatcatcaagcatgcgaaagacagattggttgccaatggctgtcgcggcaatgggagtgcccccactgccactttttattttctccctaaaagacaccttaaaaaggagatcatggcctcttaatgagggcgtgatggccgtcggattagtttcaatccttgcaagtagcttactcagaaatgatgtgccaatggccggtcctctcgttgccggaggacttttaatagcttgttacgtaattaccggaacatcagccgacttaacagtagaaaaagcggcggatatcacatgggaagaagaagccgagcaaacaggagtaagtcataaccttatgatcacagtcgacgatgacggcaccatgcgcatcaaagatgatgaaacagaaaatatacttactgtactacttaaaacagctctattaatcgtttccggagtattcccttattcaataccagccaccttgttagtttggcatacatggcagaagcaaacgcaacgtagtggagtattgtgggatgtaccgtctccgcccgagactcaaaaagcagaattagaagaaggagtatatcgaataaagcaacagggaatatttggaaaaacacaggttggtgtaggcgtacaaaaagaaggagtcttccatacgatgtggcatgttacaagaggcgcggttttgacctacaacggcaaacgattggaaccgaactgggcttcagtcaagaaagacctcatctcttatggaggtgggtggagactttcagcgcaatggcaaaaaggagaagaagttcaagtcattgcagttgaacctggcaaaaatccgaaaaactttcaaaccacgcccggcacatttcagactacgacaggagaaataggagcaattgcactagattttaaacctggaacatcaggttcaccaattattaatagagaagggaaggtagtaggactttacggtaatggggtagtcactaaaaatggcggatatgtatcagggatagctcaaacaaatgcggaaccggatggacctaccccagagttggaagaagaaatgtttaagaaacgaaacctaacaataatggatctacacccgggatccggaaaaactcgcaaatatctaccggcgataatacgagaagcaataaaacgaagattaaggacactaatccttgcaccaacgcgggtagtagcagccgaaatggaagaggctttaaaaggcctaccaattcgttaccaaaccactgccacgagatcagaacacacaggtcgcgaaattgtagatctaatgtgtcatgcaacctttacaatgcgtctcttaagtccagtccgagttccaaattataacttaattattatggacgaggcccactttaccgatccagcatcgattgctgctagaggttatataagtactcgagtaggaatgggcgaagccgctgcaatcttcatgacagccacccctcctggcaccgccgatgcttttccccaatccaacgcacctattcaagatgaggagagagacatccccgaacggtcgtggaatagcggaaacgaatggatcactgattttgctggaaaaaccgtctggttcgttccctcgataaaggcaggaaacgatattgctaactgtctccgtaaaaatggcaagaaagttatacaactatcacgaaagacgtttgacactgaatatcagaaaacgaagctcaacgactgggattttgttgtgacgacagacatttcagagatgggtgccaatttcaaagcagacagagttatagacccccggcgctgtctaaaaccggtaatattaaccgatggcccggaacgggtcatattagctggaccaatgccagtcacagcagcttcagcagctcagcgcagaggtagagtcggccgaaacccacagaaagaaaatgaccagtacatctttactggccaaccactgaataatgatgaagaccacgcacactggacagaagcaaaaatgttattggataacataaatacaccagagggaatcataccagctctatttgaaccggaaagagaaaagagtgcggctatagacggtgaatacaggctcaaaggagaaagcaggaaaacattcgtagaattaatgcgccgtggagacctaccagtctggctcgcccataaagtcgcttcagaaggaataaaatatactgatcgaaaatggtgtttcgatggacaaagaaacaatcaaattctagaggaaaacatggatgtggaaatttggacaaaagaaggagaaaagaagaaattgagacccaggtggcttgatgctagaacgtattccgatcccctagcgctgaaggagttcaaagacttcgcagcagggaggaaaagtattgcacttgatctcgtaacagaaattggtcgagtaccctcacatcttgcacacagaacgaggaacgcgctagacaatctcgtaatgttgcacacaagtgaacatgggggtagggcttaccgacacgctgtcgaagaattaccagaaacaatggagaccctacttttgcttggactaatgattttattgaccggtggagctatgctatttctgattagcggcaaaggaataggcaaaacatctataggacttatctgtgtcatagcaagctccgggatgttgtggatggctgagatacctttgcaatggattgcttcagcaatagtactcgaatttttcatgatggtccttcttatacctgaacctgaaaaacagcgaacacctcaagacaatcaattagcgtacgttgtaataggcattctcacgctagcggccatcatcgcagcaaatgaaatggggttgttggagactacaaaaagagacttaggaatgtccaaagaaccaggtgtcgtatcgccaacaagttatttagatgtggacctacatccagcttccgcttggaccttatatgcggtagcaacaacagtcatcacaccaatgctcaggcatacgatagaaaattcaacagcaaatgtatcattagcagcaatcgcaaaccaagccgtagtcttaatgggcttagacaaaggatggccaatatcgaaaatggacctaggggtgcctttacttgcacttggatgttacagtcaggtaaacccgttaacactgaccgcggctgtattattattaatcacacattatgcaattataggaccaggcctgcaagcgaaagcaacccgggaagcacagaaaagaacagcggcagggataatgaaaaatcccaccgtagatggtatcatgacaatagatttagaccctgttatatatgattctaaatttgaaaaacaattaggtcaagtaatgttgctggtattgtgtgccgtacaactactactcatgaggacttcatgggctctatgtgaagccttgaccttagctactggaccaataacgacgctatgggaggggtcacccggaaagttctggaacaccactatagccgttagcatggcaaacatatttagaggatcatacttagcaggagccggtctggccttttcaataatgaaatcagtaggcacagggaagcggggcactggttcacaaggggaaacgctcggagagaagtggaagaagaaacttaaccaattgtccagaaaagagttcgatctgtacaagaaatctggaataaccgaagttgatagaactgaggccaaggaggggctaaagaggggagaaataacacatcacgccgtaagcagaggtagtgccaagttacaatggtttgttgagagaaatatggtaatacccgaaggtcgtgtgatagatcttggttgtggtcgaggcggttggagctattattgtgccgggctaaagaaagtaacggaagtaaggggttacacgaaaggcgggccaggccacgaggagccagtaccaatgtctacttatggttggaatatagttaaattaatgtcagggaaggatgtattttatttgccaccggagaaatgtgacactttgctttgcgacattggcgagtcgtcaccctcacccacggtagaagaaagccgaacaatcagagtattgaaaatggtagaaccatggttgaaaaacaaccaattctgcataaaagtgttaaacccctatatgcccacagttattgaacatcttgagaggctacagagaaaacacggtggaatgttagtacgaaacccattaagtcggaactctacacatgagatgtattggataagtaacggtaccggaaacatcgtcgcaagtgtaaacatggtctcacgcttattactgaatagatttactatgacccataggaggcccaccattgaaaaagatgtagatttaggtgcgggaacaagacatgtaaacgccgaaccagaaaccccaaacatggatgtaatcggtgaaagaataaagagaattaaagaagaacataattcaacctggcattatgacgacgaaaacccatataaaacatgggcataccatggttcgtacgaagtgaaagcgacaggcagtgctagtagtatgataaatggagtagtaaaattattaacaaagccctgggatgttgtgccaatggttactcaaatggctatgaccgacacgaccccctttggccaacaacgggtttttaaggaaaaagttgacacaagaacaccccgcagtatgcccggaacgcggagggtcatggaaattactgctgaatggttatggcgaactttgggtcgcaacaagaaaccccgcttatgtactagagaagagttcaccaagaaggtacgtacaaatgcggccatgggcgcagtttttactgaggagaaccagtgggactctgcgaaggctgctgtagaagatgaagacttttggaaattagtcgatagagaaagagaattgcataaacttggaaaatgcggatcctgtgtttacaacatgatgggaaaacgggagaagaaattaggggaatttggaaaagcaaaaggcagtagagcaatatggtatatgtggttaggagctagatacctggagttcgaggctttgggatttttaaatgaagatcattggtttagtagggaaaattcatactcaggagttgaaggcgaagggctacataaattagggtatattttaagagatatatcaaagatacccggcggggctatgtatgcagacgacacagctggctgggatacacgcattactgaggatgacctccacaatgaggagaaaattacgcaacagatggatccagaacatagacagctcgcgaatgctatcttcaagttgacttatcaaaataaagttgttaaggtacaaagacctacgccgacaggaacagtcatggacattataagtcgaaaagaccaaaggggcagtggtcaggtaggaacatatggactgaacaccttcactaacatggaagcacaattaataagacagatggaaggagaaggtgtgttatctaaggctgatttagaaaatccacatctaccggaaaagaaaattacacaatggttagaaactaagggagtcgaaagattgaaaagaatggctatttcaggagatgactgcgttgtcaagccaattgatgaccgattcgcaaatgctttacttgcgttgaatgatatgggaaaagtacgcaaggatatcccccaatggcaaccctcgaaaggctggcacgattggcaacaagtacctttctgcagtcatcacttccatgaactcataatgaaagacggtcggaagttagtagtaccttgtagacctcaggatgaacttattggacgagcgaggatatcacaaggagcaggttggagcttaagggaaaccgcatgtttaggtaaggcatacgcgcagatgtggtcccttatgtattttcatcgtagagacctacgcttagcaagcaatgctatatgctcagcagttcctgtacattgggtccccacgagccgtacaacctggtcgatacatgcccaccaccaatggatgacgacagaagacatgttaacggtatggaacagagtctggattgaggataacccttggatggaggataaaacgccagtcacaacatgggaaaatgtcccttatcttggaaaacgcgaggaccaatggtgcggatcattgataggcttaacctcaagggcaacgtgggctcaaaatatacctaccgctatccaacaagtgagaagtctaattgggaatgaagaatttcttgattacatgccaagcatgaaacgctttcgtaaagaggaagaatctgagggagctatatggtga

SEQ ID NO: 23068 - RNA, 9873 nt, synthetic construct
  misc_feature 1..9873: note = derived and/or modified CDS sequence (opt6) from DENV-3__GU131870__SS-prME
  source 1..9873: mol_type = other RNA
acaagtctatgcttaatgatgattctgcctgcggcattagcgtttcatctaacatcgcgagacggcgaaccgcggatgatagtgggtaaaaacgaacgcggtaaaagcctactatttaaaactgcgtcaggaatcaatatgtgcacattaatcgctatggatctaggggaaatgtgcgacgatacagttacgtataaatgtccccatattaccgaggtagaaccagaagatatagattgctggtgtaacctaacatccacgtgggtaacgtatggaacctgtaaccaggcgggagagcgaagaagagataaaaggagtgttgcattggcaccccatgtcggcatgggattagatacacgaacccaaacatggatgagtgctgaaggagcgtggagacaagtagaaaaagtagaaacatgggccctgcgacatcccggattcacaatattggcattgtttttagcacactatataggaacaagcctaacacaaaaagttgtgattttcatattgttaatgttagtaactccgtccatgaccatgcggtgtgtcggagtagggaaccgagactttgtagaaggacttagcggcgcaacatgggtagatgttgtactagaacatggagggtgcgtaactactatggccaaaaataaaccaacattagatatagaattgcagaaaaccgaggccacacagctcgcgacattgcgaaaattgtgtatagaaggaaaaataacaaacataacgacagatagccgatgcccaactcaaggggaagcagtcctacctgaggaacaagaccaaaattacgtttgtaaacatacttacgtggacaggggctggggaaacggatgcggtctttttggtaaaggttcattagtcacatgtgctaaattccaatgcctagaaccaattgaaggcaaagtagtgcagtatgaaaatctgaaatataccgttattattactgttcacacgggagatcaacatcaagtagggaatgagacacagggtgttacagccgagattacaccccaagctagtacgacagaagcaatactcccagagtacgggacattggggctagaatgcagtccacggactgggttggactttaacgaaatgatcctactaactatgaaaaataaggcttggatggttcatcgacagtggttctttgacttgccactcccgtggaccagcggtgctactactgagacaccaacatggaacaggaaagaactcctagtaacatttaaaaacgcccacgccaagaaacaagaagtagtagttctaggctcacaggagggagctatgcacactgcactaactggagcgacagaaattcaaaactcgggaggtacaagtatcttcgcaggccacttaaaatgtcgacttaaaatggacaaactagagcttaaagggatgtcttacgctatgtgtactaacacctttgtactgaagaaagaagtgagtgaaacgcaacacggtacgatactaattaaagtagaataccgaggcgaagatgcgccatgtaaaataccttttagtacggaagacggacagggcaaggcacataatgggagattaattaccgcaaatccagtagttactaagaaagaagaaccagtgaatatagaagccgaaccgccattcggggaaagcaatatagttatcggtataggagataacgctttaaagatcaattggtataagaaaggtagctcaatcggaaaaatgttcgaagccactgctcgaggagcccgaagaatggctatattaggagacacagcgtgggatttcggatccgtcggtggtgtactaaactcattaggaaagatggttcatcaaattttcggcagtgcatatacggctctcttttcaggagtttcatgggttatgaaaataggaattggaatactattaacatggataggtttaaactcgaaaaacacgtcaatgagtttttcatgtatagcaataggtattataacattgtatctgggtgcagtagtacaagccgatatggggtgcgtaataaactggaaaggaaaagagttaaaatgtggtagcggtatttttgttacaaatgaagtccatacctggaccgaacaatataagtttcaagccgactcaccaaaacgattagctacagctattgcaggagcatgggaaaatggagtatgtggaatccgatcaacaaccaggatggagaacttattatggaagcagattgcaaacgagctgaatcatatactctgggagaataacataaaattaacagtagtagtcggtgacattataggggtactagagcaaggaaaaagaacacttacacctcaaccgatggagctcaagtattcgtggaaaacctggggaaaagcaaaaatcgtaacagcagagacgcaaaattcctctttcataatagacggtccgaatacccccgagtgcccttcagctagccgcgcctggaacgtttgggaagtagaagactacggttttggtgtttttacaaccaatatctggcttaaactaagagaagtatatactcaattatgcgatcatcgactgatgagtgctgcggttaaggacgaacgtgcagtacatgcagatatgggctactggatagaatcgcagaaaaacggtagttggaaattggaaaaagcctctttaatagaagtaaaaacatgcacttggcctaaatctcacaccttatggtcaaatggcgtattagaatcagatatgatcattccaaaatcactagcaggaccaataagtcaacacaaccatcgaccaggatatcatacacaaacggcggggccatggcatctcggaaaacttgaactagattttaattactgcgagggtactactgtcgtaataacggaaaattgtggaacaagaggaccttcactaagaacgacgactgtatctggtaaattaattcatgaatggtgctgtcgatcatgcacgcttcctcctttaagatacatgggtgaggatgggtgctggtatggaatggagattagacccataagtgaaaaggaagagaacatggtaaaaagcctagtctcagccggaagcggtaaggtcgataactttacgatgggggttttatgcttggcaatattattcgaagaagtgatgcgaggaaaatttggtaagaaacatatgatagccggtgttttctttacattcgtattacttttatccgggcagattacctggcgagatatgactcatacgcttataatgataggaagcaacgccagtgaccgaatggggatgggtgtaacctatcttgctttaatcgcaacatttaaaatacaaccgtttctagcattaggattctttctcagaaagctaacatcgcgtgagaatctcctattaggtgtgggtttggcaatggcaaccacgctacagttgccagaagacattgaacaaatggctaatggcatcgctttagggctaatggctttaaaacttataactcaatttgaaacctatcaattgtggactgcgctaatatcactgacgtgttcgaatacgatgtttacgctaacggtagcctggagaactgcaaccctcattctcgctggggtgtcattactgcccgtatgtcagagttcgtcaatgagaaaaacggattggctcccaatggcagtggcagctatgggagtcccgccattgcctttatttatattttcgctaaaagatactctaaaacgtagaagttggcccttaaacgaaggtgtcatggccgtcggactcgtgagtatattagcatcttccttactcagaaacgatgtaccaatggcaggtccgttagttgctggaggcctattgatcgcgtgctatgtaatcacagggacttctgcagatttaatagtggagaaagcagcagatattacatgggaagaagaggcagaacaaacgggtgttagccacaaccttatgataactgtagatgatgacggaactatgcgaataaaagatgacgaaacagaaaatatcttaaccgtgttattaaaaaccgctctcttgattgtgtcaggggtatttccttatagtataccagctacactattagtctggcatacctggcaaaaacagacgcaacggtcaggtgtactctgggatgtcccttctccaccagagacgcaaaaggcggaattggaagagggagtatatcggatcaaacaacaaggtatatttggaaagactcaagtaggagttggagttcaaaaagagggtgtgtttcatacaatgtggcatgtaactagaggagctgttcttacatataacgggaagaggcttgaacctaattgggcatcggtgaaaaaggacttaatctcctacggtgggggctggagactttcggcacagtggcagaaaggggaggaggtccaagtaatagcagtcgaacctggcaaaaaccctaaaaacttccaaacgatgcccggaacattccagacaacaacaggggagataggagcgattgcattagattttaaaccaggcactagcggcagcccaattattaacagagagggaaaagttgtaggcctttacggtaacggagtggtaactaaaaatgggggctacgtaagtggtattgcacaaactaatgctgaaccagacggaccaacaccggaactcgaagaagaaatgttcaagaaacgcaatctcactataatggacctgcatcccggtagtggtaaaacacgtaaataccttcctgcaattataagggaagcgatcaagcgacgactaagaacgttaatccttgccccaactagagtagttgctgccgaaatggaagaagctctaaaaggactacctattagatatcaaaccacagccacgaaaagcgaacacactggacgggaaatagtcgatttaatgtgccacgctacatttacaatgagacttttgtcccctgtaagagtgcctaactacaatctcattatcatggacgaagcacattttacagatcctgcatcgatagcggcaagaggatacatttcgacgagagtcgggatgggagaagctgccgcaatttttatgacagcaaccccacctggaaccgccgacgccttcccacaaagtaatgctcctatccaggacgaggaacgtgatataccagaaaggagctggaactcaggaaatgaatggataacggatttcgctggtaaaacagtgtggttcgttcctagtatcaaagcaggaaatgacattgctaattgtttaaggaaaaatggcaagaaagtaatacagttaagcaggaaaacttttgacacagaataccagaaaaccaagttgaatgattgggactttgtagttacaacggacatcagtgaaatgggagcaaattttaaggcagatcgagtaattgacccacggagatgtcttaaaccagttatactcactgacgggccagaaagagtaatcttagctggacctatgccagtcacagctgcaagcgccgcccaaaggagaggacgagttggtcgaaacccacaaaaagaaaatgatcaatacattttcacgggtcaacccttaaacaacgatgaagatcatgcacattggacagaggcaaagatgttactggataacataaatacacctgaaggtattatcccagcattgttcgaaccagaaagagagaaaagtgcggcaattgatggcgaatacagattaaaaggagaatcccgtaaaacatttgttgagctaatgaggaggggcgatttaccagtatggctagcgcacaaagttgctagcgaaggtatcaagtacacggacagaaaatggtgtttcgatggacaaaggaataaccaaatcctagaggaaaatatggacgtcgaaatctggaccaaagaaggtgaaaagaagaaattgagaccacgttggttagatgctagaacttacagtgatcccctagcgctgaaggaatttaaagactttgctgctggccgaaagtcaattgccttagacctggtcactgagattggaagggtaccctcacatctcgcacatcgcaccagaaatgcccttgacaatctcgtaatgttacacacgtcggaacacgggggacgagcataccgtcatgcagttgaagaattaccagagactatggaaacattactattattaggattgatgattcttctcacaggtggagcaatgctatttctgatcagtggaaagggcattggtaaaacctccatcgggttaatatgtgtgatagcttcgagcggaatgttgtggatggcagagatacccttacaatggattgcctcagcgatcgttttagaatttttcatgatggtcctattgattccggaacccgagaaacagagaacccctcaagataatcaactagcttatgtcgtaataggaattttaacattagcagcaatcatcgccgcaaatgaaatgggtctcttggaaaccaccaaacgggatttagggatgtcaaaggaaccaggagttgtcagtcctacatcataccttgatgtagatctccaccccgccagcgcgtggactttatatgctgtcgcaactacagtaataacacccatgcttcgccatactatagaaaattccactgctaatgtttcccttgcagcaatagctaaccaagctgttgtactgatgggattggacaaaggttggcctataagtaaaatggatctaggagtaccgttactagctttgggatgctatagtcaagttaatccattaactttgacagccgctgtactgttattaataacacactacgcaattatcggaccaggtttgcaagcaaaggctacgcgagaagcacaaaagagaacagcggctggtataatgaaaaacccaaccgttgatggtatcatgacaatagacctggacccagtaatttacgatagtaagttcgagaaacagttgggccaggtaatgctattggtattatgcgctgtccaactgctattgatgagaaccagttgggcgttatgtgaagcactaactcttgctacaggaccaataactacactatgggagggctctcctggaaagttctggaataccacgatcgcggtatccatggccaacattttccgtggttcctatttagcgggagccggtttagcttttagtataatgaaatcagttggcaccggcaaacgcgggaccggaagccaaggcgagactttgggagaaaaatggaaaaagaaactaaaccaattatcaaggaaagaatttgatttgtacaagaagagtggaataacagaggttgacagaacagaagccaaagaaggcttaaaacggggagagattacacaccatgcagtatccagaggatcagcaaagctacaatggtttgtcgagcgaaacatggttatacccgaaggaagagtcatagacctagggtgtgggcgcggtggctggagttattattgtgcaggactaaagaaagtaactgaggtacgcggatacacaaaaggaggtccaggccacgaagaaccagtacctatgtcaacttatgggtggaatatagtgaagttgatgtcaggcaaggatgtcttctacctacctccagaaaagtgcgatacattgttatgcgatattggtgaaagtagccctagtcccactgtcgaagagagtagaactattagggtattgaaaatggtagaaccgtggttgaaaaataatcaattctgcattaaggttttgaatccatacatgcctacagtaatagaacatctagagcgccttcaacgcaagcacggaggcatgcttgtaagaaatcctttgagtcgtaattcaacgcacgaaatgtattggataagtaatggaacaggtaatatagtcgcatcagtaaatatggtaagtcgattgttgttaaatcggttcacaatgacacaccgtcgaccgaccatagaaaaagatgtggatcttggcgcgggaacacgacacgtaaacgcagagccagaaacgccaaatatggacgtaataggcgagagaattaaaagaattaaagaagaacataattccacgtggcattatgatgatgaaaatccctataaaacgtgggcatatcatggctcgtacgaggtaaaagcaaccgggtcagcttccagtatgataaatggcgtagtaaagctgttaacaaaaccgtgggatgtagttccaatggtaacacaaatggctatgactgacaccacacctttcggccaacaacgcgtcttcaaagaaaaggtcgatacaagaacaccccgaagtatgccgggcacgagaagagtgatgggtataacagcagagtggttgtggcgaacactcggtaggaacaagaagccgcgactgtgtactagggaggaatttactaagaaagtaaggactaatgcagcaatgggagccgtattcactgaggaaaaccagtgggacagtgccaaagccgctgtggaagacgaagatttttggaaacttgtagaccgcgaacgagagctacacaaattaggtaaatgtggttcgtgtgtatataacatgatgggcaaaagagaaaagaagttgggagaatttggaaaggctaagggaagtagagcaatatggtatatgtggctgggagcaaggtatttagaatttgaagcactgggattccttaatgaggaccactggttttctagagaaaattcctatagcggagtcgaaggagagggacttcataaactaggctacatcttaagagatatatcgaagataccgggtggggctatgtacgctgatgatacggctggctgggatacgcggattaccgaagatgatctacacaatgaggaaaagataacacaacaaatggacccagaacatcgacaacttgcgaacgctatattcaaactgacataccaaaacaaagtggtaaaagttcagcggccgacacctacaggtaccgtaatggatattatatcgagaaaagaccagcgaggctctgggcaagtaggaacgtatggactaaatacattcactaacatggaagcccaactaataagacaaatggaaggtgagggtgtactttccaaagcagaccttgaaaatcctcacctaccagagaagaaaattacccagtggctggaaacaaagggggttgaaaggttaaaaaggatggcaatatcgggagatgattgcgttgtaaaacctatcgacgacaggtttgcgaacgctttggtagcattaaatgatatggggaaggtgcgaaaggacatacctcagtggcaaccaagtaagggatggcatgattggcaacaagtacccttttgttcccatcattttcatgaattaataatgaaagatgggagaaagttagtggtcccatgtagaccgcaagatgagcttataggaagggcacgtattagccagggggcaggttggtcactgcgagaaacagcatgtctcggtaaggcttacgcacaaatgtggtcattaatgtattttcacagaagagatctcagacttgccagtaatgcaatatgttctgcagtgcccgtacattgggttccaacaagcagaactacctggtcaattcatgcccaccaccaatggatgacaacggaagatatgctgacagtctggaacagggtatggattgaggacaatccttggatggaagataaaacacccgttaccacttgggaaaacgtaccgtatctcggaaagagggaagatcaatggtgcggaagccttataggcttaacaagtagagctacatgggctcaaaacatccccactgcgatacagcaagttcgttcactcattggtaatgaggagttcctggattatatgccttccatgaaaaggtttcgaaaggaagaagagtcagaaggcgcaatatggtga

SEQ ID NO: 23069 - RNA, 9873 nt, synthetic construct
  misc_feature 1..9873: note = derived and/or modified CDS sequence (opt6) from DENV-3__GU131871__SS-prME
  source 1..9873: mol_type = other RNA
accagtctatgtctggtaatgattttacctgccgcgctagcgtttcaccttacttcgagagatggagagccacgaatgatagtcggtaaaaatgaacggggaaaatcattactgtttaaaaccgcgagtggaatcaatatgtgtactctgatagccatggacctgggtgaaatgtgtgatgacacagtaacctacaaatgtccacacattaccgaggttgagccagaggacatcgactgctggtgtaatttaacgtccacatgggtcacttatggaacatgtaatcaagcaggagaaaggcggagagacaagagatcagtcgctttagccccacacgtcgggatgggattagatactcgtacacaaacatggatgtccgccgaaggtgcttggagacaagttgaaaaagttgagacctgggctttgcggcatccaggattcaccatactagcactatttctagctcactacataggtacatccttaacccaaaaagtcgtgatattcatattgttaatgctagttacaccaagtatgacaatgagatgcgtaggagtaggtaatcgagattttgttgaaggtctatccggtgccacgtgggtagatgttgtccttgaacatggtggttgcgtgactaccatggccaaaaacaaacctactctggacatagaattacagaaaactgaagccacgcaactagcaacgctaagaaaactttgtattgagggaaaaatcacgaacattacaactgactcaagatgtccgacacaaggagaagctgtacttccagaagaacaagaccagaattatgtatgcaaacatacttacgtagatagaggatggggtaacggttgtggcctttttggcaaaggtagtttagtaacgtgtgctaaattccagtgtctagaaccaatagaaggaaaagttgttcagtatgagaatctaaaatatacagttattattaccgtacacacaggtgaccagcatcaagttggtaatgaaacgcagggagtaactgccgaaataacaccacaagcatcaacgactgaagcaatattgcctgaatatggtaccctgggcttggaatgctccccacgtacgggactcgattttaacgagatgatactccttacgatgaaaaataaggcttggatggttcatcgacaatggttctttgatttaccgcttccttggactaccggcgctactacagagacacccacgtggaatagaaaagaactcctggtgacatttaaaaatgcacacgctaagaaacaggaggtagttgttttaggtagccaagagggcgcaatgcataccgcactaacaggagcaacagaaatccagaactcgggtgggacaagcatttttgcagggcaccttaaatgtaggcttaaaatggacaaacttgaacttaaaggaatgagctacgcaatgtgtaccaatacatttgttctcaagaaagaagtatctgaaacgcaacatggtacaatattgatcaaagtagaatatcgcggggaggacgcaccatgcaaaatcccattttctacggaagacggacaaggcaaagcacacaacggacgcttaataaccgctaatcccgttgttactaagaaagaagaaccagtcaatatagaggccgaaccacctttcggagaaagtaatattgtaatcgggatcggtgataacgccttaaaaattaactggtacaagaaaggatcctcgatagggaaaatgtttgaggcgacagctcgtggtgcaagaagaatggcgatattgggcgacaccgcttgggattttggaagcgttggaggagttctcaacagtttaggaaaaatggtgcatcaaatattcggttcagcatatacagcattgttctcgggcgtctcatgggtaatgaaaattggaataggaatcttactaacctggattggactaaattctaaaaacacatcaatgtccttcagttgcattgcgataggcataataactctgtatttaggagcagttgtccaagcagacatgggctgcgtaatcaattggaaaggaaaagaactaaagtgcgggtctggaattttcgtaacgaatgaagtgcatacgtggaccgaacaatataaattccaagcagatagtccaaagaggctcgctacagcaatcgctggtgcttgggagaatggagtctgtggtatacggtcaacaacacgaatggaaaacttattgtggaaacaaatcgctaatgagctaaattacatactctgggaaaacaacattaaactaacagtcgtagtcggggatataataggggtcctagaacaaggaaaaagaacgcttacaccgcagccaatggagcttaagtacagttggaaaacatgggggaaagccaagatagttacagcagaaacgcaaaatagctcatttataatcgacgggcctaatactccagaatgtccatccgcctcacgtgcatggaatgtatgggaggtagaggactatggtttcggagttttcacaacaaacatatggttgaaattacgagaagtatatacacaactctgtgatcataggctaatgtcagcagcggtaaaggatgagagggctgtacatgcagatatgggatattggatagaatcccagaaaaatggatcatggaaattagaaaaggcttctcttatagaagtgaagacttgtacatggccaaagtcccatacactatggagcaatggggtactagaatctgacatgataattccgaaaagcctagcaggacccatatcgcaacacaatcatcgcccaggataccacacccaaactgccggaccatggcaccttggcaagttggaacttgattttaattactgcgaaggtactactgttgttataactgagaattgtggaaccaggggcccatcattaagaacaaccacagttagtggaaaactcatacacgaatggtgttgtagatcatgtacacttccgcctttacgatatatgggagaagatgggtgttggtatggcatggagatacgtccaattagtgaaaaagaggaaaacatggtcaaaagcctagtttcagcaggttcaggtaaagtagacaattttacaatgggtgtactctgcttagcaatcctgtttgaagaagtgatgcgcgggaaattcgggaagaaacacatgattgctggagtgttctttacgtttgttctccttctttcaggccaaattacttggcgtgacatgacgcataccctcataatgatcggaagtaatgcctctgacagaatgggtatgggcgttacatatttagcattgatagcaacatttaaaatacaaccgtttctagcactcgggttctttctaagaaaattgacttctcgtgaaaacttgctactaggggtcggtcttgccatggctacaaccttgcaacttcctgaagatatcgagcaaatggcaaatggcatagcattaggtcttatggcactaaaattaattacgcaattcgaaacttaccagctttggacagcattaatatcgctaacatgttccaataccatgttcacactcacggtagcatggagaacggctaccctaatactcgcgggtgtaagcctattacctgtctgtcaaagcagttcaatgagaaaaactgattggctccccatggcagtagcggccatgggtgtccctcctttaccactttttatattttcccttaaagatacgttaaagagacgaagttggcctctcaatgaaggagtgatggcagtaggattagtttctatcttagcaagttccctcctaagaaacgatgtaccgatggcagggcctcttgtggctggtggtctgcttattgcatgttacgtaatcacgggtacctccgcagatctgaccgttgaaaaagcagcggatataacatgggaggaagaagcggagcagactggggtgagtcacaatctcatgataactgtcgatgatgacggaactatgagaatcaaagatgatgaaacagaaaacattttaacggttttattaaagacggcattgttgatagtatcaggagtctttccatacagtataccagcaactttgctagtatggcatacatggcaaaaacaaacacagcgatctggagttttatgggacgtaccgagccctccggaaactcaaaaagcagaattagaggaaggagtatataggataaaacaacaaggaatattcggcaaaactcaagtcggcgtaggggtccaaaaggagggagtttttcacaccatgtggcacgtaacacgtggagcggtcttaacgtataatggtaaaagattggaacccaattgggcttcagtcaagaaagacctaatctcttacggcggtggttggagacttagtgctcaatggcagaaaggcgaagaggttcaggttatagcggttgaaccagggaaaaatcccaaaaattttcaaaccactcccggaacctttcaaacgacgacgggcgagataggtgctatcgccttagacttcaaaccagggacatcggggtcacctattataaatagggagggcaaggtggttggattatatggtaacggagttgtaaccaaaaatgggggatatgtatctgggatagcgcagacaaacgccgaacccgacggacctacacccgaattagaggaggaaatgttcaagaaacgaaacttaacaataatggacttacatcccggaagtggtaaaactcgtaaatatttaccggcaataatacgagaggctattaaacgaagattaagaactttaatactagcaccaacacgagttgtcgccgcagagatggaggaggcattgaaaggccttccaataagataccaaaccacagcaactaagtcggagcatacaggacgggaaatcgttgacctgatgtgtcatgcgactttcacaatgagactattaagtccagtacgcgtaccaaattacaatcttataataatggatgaggcgcacttcaccgacccggcaagtatagcagctagaggctatatctcaacacgggtaggcatgggtgaagccgcggcaatttttatgactgctaccccacctgggacagcagatgcctttccccagagtaacgcgccgattcaggatgaagaacgggatattccggaaagatcatggaactctggaaatgaatggataacagactttgcgggaaagactgtgtggtttgtaccctctataaaggccgggaatgatatcgcaaattgtctacgaaagaatggcaagaaagttatccaactttcacgaaagacattcgatacagagtatcagaaaactaaactaaacgattgggacttcgttgtaacgactgatatttcagaaatgggggctaactttaaagctgacagagtaattgacccaagacgatgtttaaaaccagttatcctcacggatggccctgaaagggtcatattagctgggcctatgccagtaacagcagcatccgccgctcaaagaagaggcagagttggcagaaatccacaaaaagaaaatgatcagtacatatttaccggccagccgttaaataacgatgaagatcatgctcattggaccgaagctaagatgctcttagataacataaacacaccggaaggaatcattcctgcacttttcgagccagaacgggaaaaatctgccgccatagacggagaatacagattaaaaggggaaagtcgaaagaccttcgtggagctaatgcgtcgaggcgacctccctgtatggctggcacacaaggtagcgagcgaaggaatcaaatataccgatagaaaatggtgctttgatggacaaagaaataaccaaatattagaagagaatatggatgtagaaatttggaccaaagaaggcgagaagaagaaattaagaccaagatggctagatgcgcgaacatactcagatccactggctttaaaagaatttaaagactttgccgcagggcgaaagtctattgcactggatctagtaacagaaataggaagggttccgagtcatttagctcatcgtactagaaacgccttagataaccttgtgatgttacatacatccgagcatggagggagagcatatagacatgctgtcgaagaattgcccgaaacaatggaaacactactcctcctgggcttaatgatactgctaacagggggtgccatgctattcctcatatccggaaagggaattggaaaaactagcataggattaatatgcgtaatagcctctagtggcatgttatggatggccgagattccgttacaatggatagcgagtgctatagttttagaatttttcatgatggtattattgataccagaaccagaaaaacaaaggacaccacaagacaatcaattagcttatgtagtcattgggatcctaacactagcagccataattgcggcaaacgaaatggggctactcgaaacaacgaagagggacttaggaatgtccaaagaaccaggggtagttagtccaacttcatacctagacgtagatttacatccagcctcagcttggactctctacgctgttgccacaacagtcattacaccaatgcttagacatactatcgaaaacagcacagcaaatgtttcactggccgctattgcaaatcaagcagttgtgcttatgggcttggataaaggttggccaatttcgaaaatggatctaggggtgccattgcttgcattaggatgctatagccaggtaaaccctttgactttgacagccgcagtgttattactgataacacattatgctataatcggaccaggattacaggcaaaagctactcgagaagcgcaaaagagaacagcagcaggtatcatgaaaaacccaacagtcgatgggataatgaccatagacctcgatccggtaatatatgacagtaaatttgaaaagcaattaggccaggtaatgctcttagttttgtgtgccgtccaactattactgatgcgtacaagttgggcactgtgtgaagctctcactttagcgaccggacctattacaacattatgggaaggttccccaggtaaattttggaacacgacaatcgcagtttctatggccaatatattccgagggagctatctggcaggagctggacttgcttttagcataatgaagtctgtaggcacaggaaagagaggaacaggatctcagggtgaaacacttggggaaaaatggaagcgcaaactcaaccagcttagcagaaaagaatttgacctttacaagaaaagtggaataactgaagtggatcgtactgaggccaaggagggacttaagagaggagagatcacacatcacgctgtaagccgagggtccgcaaaattacaatggttcgttgaacgtaacatggttatcccagagggaagagttatcgaccttggctgtggtcgaggaggctggtcttattattgtgctggcctgaagaaagtaacggaggttcgaggatatacaaaaggtggccctggacatgaggaaccggtgcccatgtcaacctacgggtggaatatagtaaaactgatgtctggaaaagacgtattctatctgccacctgaaaaatgtgatacattgctttgtgacataggagaaagttctccatctcccaccgtcgaagagtcccgcacgatcagggttctcaaaatggtcgaaccctggttgaaaaacaaccaattttgcattaaagtattgaatccgtacatgcctactgtaatagagcacctagagcggctacaaagaaagcacggagggatgttagtgagaaatccattatctcgtaactcaactcatgaaatgtactggatttcaaatggaacaggaaacatagtagcatccgtaaacatggtatcaagattattattgaacagatttactatgactcatcgaagacccactattgaaaaagacgtagatttaggagcagggactcgccatgtgaatgctgagccagagactccaaatatggacgtaataggtgagcgaatcaaacgcattaaagaggaacacaacagcacatggcactacgacgacgaaaatccgtataaaacatgggcataccatggctcatacgaagtgaaagctacgggaagtgcgtcatcaatgataaatggagtcgtgaaactcttgacgaagccgtgggatgtggtaccaatggttacacaaatggctatgacggacacaacccctttcggacaacaaagggtattcaaagaaaaagtagacacgcggactccacgatctatgccaggtactaggagagttatggaaataacagcagaatggctctggcgcactttagggaggaataaaaagccacgattgtgtactcgggaggaatttacaaagaaagtaagaacgaacgcagcaatgggagcagtatttacagaagaaaatcaatgggatagtgcgaaggcagcggtagaggacgaggacttttggaaactggtcgacagggaaagagaactgcataagttggggaagtgcggatcttgtgtgtataacatgatgggaaaacgagaaaagaaattaggcgaatttggaaaagccaaaggatcaagagcaatttggtacatgtggcttggagcgaggtacttggagtttgaagcattaggatttttaaatgaggaccattggttcagcagagaaaatagttatagcggagtagagggagagggattacacaaattagggtatattttgagggatatttcaaagatcccaggaggtgcaatgtacgcagatgacactgctggatgggacacgcgcataaccgaagacgacttgcacaatgaagagaaaatcactcaacagatggatcctgaacacaggcaacttgcaaacgctatttttaaactaacttaccagaataaagtagtgaaagtgcaaaggcctacacctactggaactgtaatggacatcatcagccgtaaagaccaacgtggatctggacaggtcggtacgtacggattaaacactttcacaaacatggaagcacaattgatacgtcaaatggaaggagaaggtgttttatctaaagctgacctcgaaaacccacacctcccggagaagaaaattacacaatggctagaaaccaaaggtgtagaaaggctcaaacgaatggcaatatcgggcgacgactgcgtcgttaaaccaatcgacgaccgatttgccaatgcattgttggccctaaatgacatggggaaagtaagaaaagatattccgcaatggcaaccaagtaagggttggcatgactggcagcaagtgccattctgttctcatcattttcatgaattgattatgaaagatggaagaaaattagtggtaccatgcagaccccaggatgaactgataggcagagcaagaatatcgcaaggagctggttggagtttgcgtgaaacagcatgcctaggtaaagcgtacgcgcaaatgtggagtttgatgtacttccatcgaagagatctgagactcgcctccaatgctatatgctcagcagtaccagttcattgggtgccaacctctagaacgacatggtcaatacatgctcatcaccaatggatgactaccgaagatatgctaacagtgtggaatcgggtatggattgaggataacccgtggatggaagacaaaacaccagttacaacttgggagaacgtaccatatctggggaaaagggaagatcaatggtgtggcagcttaataggtttgacctcgagagcaacatgggcacagaatatacctactgcaatacaacaggtacgcagcttaatagggaatgaagagttcttagactatatgccttccatgaaacgattccgaaaagaagaagagtccgaaggagcaatatggtag

SEQ ID NO: 23070 - RNA, 9873 nt, synthetic construct
  misc_feature 1..9873: note = derived and/or modified CDS sequence (opt6) from DENV-3__GU131872__SS-prME
  source 1..9873: mol_type = other RNA
acaagtttatgcctggtcatgatattaccagctgcccttgcttttcacttaactagccgggatggagaaccaagaatgatagtggggaaaaacgaacgtggaaaatcattgctgtttaaaacggcttctggcataaatatgtgcactttgatagccatggaccttggggaaatgtgtgatgacacagttacatataaatgtccacatataacggaagtagaacctgaagacatagattgctggtgtaacttaacgtcaacgtgggtaacgtatggtacctgtaatcaggcaggagaaagaaggcgagacaaacgaagcgttgctttagcgcctcacgtaggcatggggttagatacacgaacacaaacatggatgagtgcagaaggagcatggcgacaagtagaaaaagttgaaacatgggcgttaagacaccctggatttactattctagctctatttttggcccattacattggaacgtcactaactcaaaaagttgtcatctttatcctattaatgttagtcactccaagcatgactatgagatgcgtaggagtaggtaatcgggattttgtcgaaggattatccggcgctacatgggttgacgttgtgttagaacacggtggctgtgtcacaactatggccaaaaacaaaccaacattagacatagaactgcagaaaactgaagctactcaactagcaactctgaggaaattatgtatagaaggaaaaatcactaatataacaacagactcgagatgtcccacacaaggtgaagctgttctaccggaagaacaagaccaaaattatgtttgtaaacacacatacgtggatagaggatggggtaatggttgcgggctctttggaaaagggtctttagtgacttgcgcaaaatttcaatgtctagaacctatagaagggaaagttgtacaatatgaaaatttaaaatacactgtaattattacagtgcacacaggggatcaacatcaagttgggaatgaaacgcaaggtgtgacagctgaaataacacctcaagctagcacaactgaagctatactgccagaatacggtaccttaggcttagaatgctcaccgcgtacaggcttggatttcaacgaaatgatcctgcttactatgaaaaataaagcatggatggtacaccggcaatggttctttgatcttcctctaccctggacctctggagctactacagaaacacctacctggaatagaaaagaacttctcgttacatttaaaaacgcgcacgccaagaaacaagaagtagtggtactggggtcacaagaaggggcaatgcacactgcactcacgggcgccacagaaattcaaaattcagggggaacgagcatctttgccggtcatcttaaatgcaggttgaaaatggacaaattagaattgaaaggaatgagctatgcgatgtgcactaacacatttgtacttaagaaagaagtgagcgaaactcaacatggaactatattgataaaagtagaataccgaggagaagatgctccctgcaaaataccatttagtacagaagatggccaaggaaaggcacacaatggtaggctaattaccgccaatcccgtagtaacaaagaaggaagaaccagttaacatagaagcggaaccaccttttggagaaagtaatatagtcattggtatcggggataacgcattaaaaatcaattggtataaaaagggaagttcaataggcaaaatgtttgaagcaactgctaggggagccaggcgaatggcaatcctgggtgacacagcatgggatttcggatccgtcggaggtgtacttaattctttgggaaaaatggtacatcaaatatttggatccgcttacactgctttattctctggtgttagttgggttatgaagataggcataggcattctactcacttggattggactaaactcaaagaatacgagtatgtcattttcatgcatagcgatcggaataataactttatatttgggtgcggttgtacaagctgatatgggttgcgtaatcaattggaaaggaaaggaattaaaatgcggttctggaatattcgtcacaaatgaggtgcacacatggacagaacaatataaattccaagccgactccccgaaaagactagcaacagcaatagctggagcatgggaaaatggagtatgtggcataaggagcactacaagaatggagaatcttctatggaaacagattgccaacgaattaaattacattctatgggaaaataacataaaactaacagtggtggttggggatattataggcgtacttgaacagggtaaaaggacattaactccgcaaccaatggaattaaaatatagctggaagacatggggcaaagctaaaatggtcactgcagagacacaaaattcaagttttatcatagacggtccaaatacaccggaatgtccgtctgctagtcgcgcatggaatgtttgggaggttgaagattatggtttcggcgtgtttacgacaaatatatggctcaaactacgtgaagtatatacacagctatgtgatcatcgattaatgagcgcagctgtaaaagatgagagagccgttcatgcggacatgggttattggatagaatcgcagaaaaatggaagttggaagctggaaaaagcaagccttattgaagtgaaaacttgtacgtggcccaagagtcatacattatggagcaatggtgtattagaatccgatatgataataccgaagtccttggctggaccaatctcacaacataaccatagaccaggataccatactcaaactgcaggaccatggcacttgggaaaattagagttagatttcaattactgcgaggggacaacggtagttataacggaaaactgcggaacgcgcggaccttccctaagaacaacaaccgttagcgggaagttgatacatgaatggtgctgtagaagctgcaccttacctccacttaggtacatgggtgaagacggatgttggtatggaatggaaataagacccatctcggaaaaagaagaaaatatggtaaaaagtcttgtatccgccggaagcggtaaagtcgacaactttactatgggagtactatgccttgcaattctctttgaagaggttatgcgcggaaaattcggaaagaagcacatgatagccggcgtattctttacttttgtcctgctactaagtggccagattacctggcgagatatgacccacacactgataatgataggatcgaacgctagtgatagaatgggcatgggagtaacatatctagctcttatagcaacgtttaaaatacagccctttttggcattgggatttttccttagaaaactcacgtcaagagaaaatttattactaggcgttggtttagcgatggcaacgacccttcagctaccagaggatatagagcaaatggcaaacggcatcgcattagggctaatggccttaaaactaattacccaattcgaaacgtatcaactatggacagctcttatttctttgacatgttcaaatacgatgtttacgttgactgtggcatggaggaccgcgacattaattttagccggggtttcactattaccagtgtgtcagagttcatcgatgagaaaaaccgattggctgccaatggccgttgcagcgatgggagttccgcctttaccactatttatattttccttgaaggatacattgaagcgacgaagctggccacttaatgagggagttatggcagttggcttggttagtatattggccagttccctgttaagaaatgatgtcccaatggcaggaccgttggtagcgggtgggttactaattgcttgctatgttattaccggtacctcagctgacctaactgtcgaaaaggccgcggatataacctgggaagaagaagcagagcaaacgggcgtctcccataacttaatgataacagttgatgatgacggaaccatgagaattaaggatgatgaaacagagaacattttaactgtactactaaaaaccgctctcttaattgtttccggagtcttcccatacagtattccagcaactctattagtatggcatacgtggcaaaagcagacacaaaggagtggagtgttgtgggatgtacccagtccacccgaaactcaaaaagcggaattagaggaaggagtatatagaatcaagcaacaaggaatcttcggtaagacgcaagtaggagtgggtgtacaaaaggaaggggtgtttcacacaatgtggcatgtaacacgcggagcggtactgacttacaatggtaaaagactcgagcctaactgggcatcggtaaagaaagatctcatatcctacggtgggggatggagattatctgcacaatggcaaaaaggagaggaggttcaggttattgcggtagaacccggcaaaaatccgaaaaattttcaaaccactccgggaacattccagacaacgacaggtgaaataggcgcaattgcattagattttaaaccaggcacttcaggatctcctattataaaccgcgagggcaaagtggtcggcttatatggtaacggcgtagtaactaaaaacggtgggtacgtcagtggtattgcgcaaaccaatgcagaaccagatggaccaactcctgaacttgaagaagaaatgttcaagaaacgaaacttgactataatggacctgcatcccggatcaggtaaaacgcgaaaatatcttcccgccattattagagaagccataaaacgacggttacgaactcttattttagctcctactagagtcgtggctgccgagatggaggaagcattgaaaggactccctatcaggtaccaaaccacggccacgaaatcagaacatactggccgagagatagttgatttaatgtgccacgcgacatttaccatgaggttactatcaccagtacgggtaccgaattataatcttataattatggatgaagcacactttactgatcctgcttcaatagctgccagaggatacatcagcacccgagtaggaatgggggaagcggccgcaatatttatgacggccactccacccgggactgctgacgcgtttccccaaagcaatgctcccatccaagatgaggagagggatataccggaacgatcatggaacagtggaaacgaatggatcactgatttcgcaggtaaaactgtatggttcgtaccgagcattaaagctggaaatgacatagctaactgcctgcgcaaaaatggcaaaaaggttatccagttaagtagaaaaactttcgatacagagtaccagaagacaaaactaaacgactgggacttcgtagtaacaacagacatttctgaaatgggagctaattttaaggctgacagagtaattgaccctcgaagatgcctaaagccagtcatcctaacagatggtcctgagagagtaatactcgcgggtcctatgcctgttacagcagcctcagcagcacaacgaagagggcgtgtaggaagaaatccgcaaaaagaaaacgatcagtatatattcactggtcaaccgttaaataacgatgaagaccacgctcactggaccgaagctaaaatgctactggacaacattaacacaccagaaggtatcatacctgcattattcgaaccagaaagagaaaaatccgcagcaattgatggtgaatatcgtctcaaaggagaaagtagaaaaacattcgtagaacttatgcggcgtggagatttaccggtatggctagctcacaaagtagcaagtgagggtataaaatatacagaccgaaaatggtgctttgacggacaacggaacaatcagatccttgaggagaatatggatgtagagatatggaccaaagagggggagaagaagaaattaagaccacgttggctagatgcacgtacctactccgacccgctagcccttaaagaatttaaggactttgcagcaggtaggaagagtattgctcttgatttagtaacagaaataggaagagtgcccagtcacctagcccatagaactcgaaatgcactagataacttagtaatgctacacacaagtgaacacggaggtagggcatatcgccacgctgtagaagaattaccagaaacaatggaaaccttgttactgttaggtctaatgatacttttaacagggggagctatgttgttcttaatatctgggaagggcataggcaagactagcatcggtttaatatgcgttattgcatcgagcggtatgttatggatggcagaaatacctttgcaatggatcgctagcgcaattgtattagaatttttcatgatggtactacttataccagaacccgaaaagcaacgtactcctcaggataatcaactagcctatgtagttataggaatactaacacttgcagctataatagccgcgaatgagatgggcttactggaaaccacgaaacgagacttgggaatgagtaaggaaccaggcgtagtttctcctacttcctatctcgacgtagatcttcaccccgcgtcggcttggaccttatatgcggttgcaaccacagtaattacaccgatgctacggcatacaatagaaaatagcacagcaaacgtatcacttgcagcaattgctaatcaagcggtagtgctaatgggactggataagggttggccaattagcaagatggatttgggtgttccactactggccttaggctgctacagtcaggtaaaccctttaaccttaacagccgcggtgttgctattgataacacattacgcaataataggaccaggattgcaagcaaaggcaaccagagaagcacagaaacgtacagcagcaggaattatgaaaaatccgacagtggatgggatcatgacaattgacttggatccagttatctacgatagcaaatttgagaaacaactgggacaggtgatgttgctagttctgtgcgcggtccagttactcttaatgcgaacctcatgggcactgtgcgaagcactgacactagcaacaggtcccataactacactttgggaggggtctccaggtaagttttggaatacaactatagcggtaagcatggcaaatatattcagaggaagctatcttgctggtgcaggtctagcatttagtattatgaaatctgtaggaacgggaaaaagaggaacaggttcacaaggagaaaccctcggtgaaaaatggaagaagaaactaaatcaacttagtcgaaaagagttcgatctatataagaaatcaggtataacagaagtggatcgtaccgaagcaaaagagggacttaagagaggcgagatcactcatcatgcagtatcacgcgggtcagctaaattgcaatggttcgtagaaagaaacatggtgataccagaagggagagtaatcgatcttggctgcggaagagggggttggagttattattgcgcagggttaaagaaagtcacagaggtgaggggctacactaaaggtggtccaggacatgaagaaccggtgcctatgtcaacatacggctggaacatagtaaaattgatgtcagggaaagacgtattttacttgcctcctgagaaatgtgacacattactttgtgatataggcgaaagtagtccaagtccaacagttgaagaatcgcgtaccataagagtacttaaaatggtggaaccctggcttaaaaacaaccaattttgtataaaggtacttaacccatatatgccgacagtgatagaacatttagagagacttcagcgaaaacacggtggaatgctggttagaaatccgttaagtcggaactccacacacgaaatgtactggataagcaatggtacaggaaacattgtagcaagcgttaacatggtctcaagattgttactaaatcgatttactatgactcatagaagacccacaatcgagaaagatgttgatcttggcgcaggcacaagacacgttaacgccgaaccagaaaccccaaatatggacgtgatcggcgaaagaattaaacgaatcaaagaagaacataattcgacttggcattatgacgatgaaaatccctataaaacctgggcatatcacggttcatacgaagtcaaagcaactggaagcgcctcttccatgataaacggggtagtgaagttgttgacaaaaccatgggacgtagtacctatggttacacaaatggcaatgacggatacgacgcccttcggacagcagcgggtttttaaagaaaaggttgacacgcgtacccccagatctatgccaggtactagacgtgtaatggaaataactgctgaatggctttggaggactctgggtaggaacaagaaacctagactctgcacgagagaagagttcactaagaaagtaagaacgaacgcagccatgggcgcagtttttacagaagagaaccagtgggactcagcaaaagctgcggtcgaagacgaagatttctggaaattagtagacagggagcgtgagttacataaactaggaaaatgtggatcctgcgtatataacatgatgggaaaacgtgagaagaaactgggggagttcggaaaagcaaaaggtagtagggcgatctggtatatgtggttaggagcgaggtacctcgagttcgaggctttgggattcctgaatgaagaccactggttttcgcgggaaaacagctatagcggggtcgaaggtgaggggctgcacaaattaggttacatactgagagacatatcaaaaattccaggaggagctatgtatgcagacgacactgccggctgggatactaggatcacagaagatgacttacataacgaagagaaaattacgcaacaaatggatccagagcaccgacagttggcaaatgcgatttttaagctaacttatcaaaacaaagttgtaaaagtgcagagaccaacacctacgggtacggtcatggacattataagccgaaaagatcaacgaggatcaggacaagttggaacatatggtctcaacacattcacaaatatggaagcccaactaataagacaaatggagggtgagggcgtattatccaaagcagatctagaaaatccacatctacctgagaagaaaattactcagtggttagagactaaaggtgtggaaagactaaaaaggatggcaatatcgggagacgactgcgtagtaaagccgatcgacgatagatttgcgaatgctctgttagctctaaatgacatgggaaaagtaagaaaggatataccacagtggcaaccgagcaaagggtggcatgactggcagcaggtccctttctgttcacaccacttccacgaattaattatgaaggatggacggaagttagtagtaccctgtaggccacaagatgaattgataggacgggctcgcatatcccaaggagcagggtggtctctcagagagacggcttgtcttggaaaagcatatgcgcagatgtggagtctaatgtactttcatagaagagatcttagactagccagcaacgcaatatgctcggcagttcctgtacactgggttcctacatccaggacaacatggagcatacatgctcatcatcaatggatgactactgaggacatgttaacggtatggaatagggtctggatcgaagataatccttggatggaggacaaaacaccagtaacgacatgggaaaatgtaccatacttaggaaaaagagaagatcagtggtgcggcagcttaataggtttaacaagtagagctacttgggcccaaaatataccaactgccatacaacaagttcgctcactaattggaaacgaggagttcctcgattatatgccatcgatgaaacgatttcgcaaagaagaggaatcagagggcgccatatggtaa

SEQ ID NO: 23071 - RNA, 9873 nt, synthetic construct
  misc_feature 1..9873: note = derived and/or modified CDS sequence (opt6) from DENV-3__GU131873__SS-prME
  source 1..9873: mol_type = other RNA
acgtctctctgcttaatgatgatcctcccggctgcacttgcgttccacttaacaagccgcgatggagaaccccggatgatagtaggcaaaaatgaacgtggaaaatcgcttctttttaaaacagcgtcgggaattaacatgtgcacattaatcgcaatggacttaggagaaatgtgcgacgacacggtaacatataaatgtccacatattactgaagtagaacctgaagacattgactgttggtgtaacctaacaagtacctgggtaacatatgggacatgcaatcaagcaggagaacgtagaagggacaaacgttcagttgctttggcaccacacgttggcatgggactagacactaggacacaaacatggatgtccgctgaaggcgcatggcggcaagttgaaaaagtagaaacatgggctttaagacatcctggttttacaatattagctctctttctcgcccactacatcggaacaagccttacacaaaaagtcgtgatatttatattgttaatgttggtaaccccaagtatgacaatgcgatgtgtcggggtaggcaatcgagattttgtagaaggacttagtggcgcaacttgggtagatgtcgtactcgaacatggaggctgtgtcaccactatggcgaaaaacaaacctaccttagatatagaactacagaaaacagaagcgacacaactagcaacattgcgaaaattatgtatagaaggaaaaataaccaatattacaactgattcacgatgtcctactcagggagaagcggtattacctgaagaacaagaccaaaattacgtctgtaaacatacatacgtagaccgcgggtggggcaacggctgtggactttttggcaaaggttcgctagttacatgtgcaaaatttcaatgtttggaattaatagaagggaaagttgtacaatatgaaaatcttaaatatacagtggtaatcacagtacacacaggtgatcaacatcaagtaggtaatgaaacccagggtatcacagcggaaataacaccacaggcttctactacggaagcaatcttaccagaatatggcactttaggattggaatgttctcctcgtacaggactagacttcaacgaaatgatattgttaaccatgaaaaataaagcctggatggtgcacagacaatggttctttgatttaccactaccatggacatccggtgcgacaacagaaacaccgacatggaacagaaaagaactcttggtaacatttaaaaacgcccatgctaagaaacaggaagtagtagtactaggatcacaagaaggtgcaatgcacactgcactaacaggtgcgaccgaaatacaaaactcaggaggcacttcaatattcgcaggacacctcaaatgccgattgaaaatggacaaactagaacttaaaggtatgtcttatgccatgtgtacgaatacctttgtgttgaagaaagaagtatctgaaactcaacacggaaccatccttataaaagtcgaatataaaggtgaagacgctccgtgcaaaataccattctcaacggaagacggacaaggtaaagcgcacaatggtcgcctcatcactgccaatcccgtcgtaactaagaaagaggaaccggttaatatagaagctgaaccgccgttcggcgagtctaatattgtcattgggataggagataatgccctcaaaattaattggtataagaaaggatcttcaatcggtaaaatgtttgaagcaacggcacggggagcacggaggatggcaatactaggagatactgcttgggatttcggaagcgttggcggtgtattaaattccctaggaaaaatggttcaccaaatcttcggttctgcatacacagctctatttagtggtgtctcctgggttatgaaaataggcataggagtgctactcacatggataggcctaaacagtaaaaatacatccatgtcattctcttgcattgctataggaataattacgttatatctaggtgctgttgtacaagccgatatgggttgtgtaataaactggaaaggcaaagaactcaaatgtgggagcggaatcttcgttacaaacgaagtacatacgtggacagagcaatataaatttcaagcagactcccctaaaagactagccaccgcaatagctggggcatgggaaaacggagtatgtggtattcgatccacaacaagaatggaaaacctactttggaaacaaatagcaaatgaactaaattacatactatgggaaaacaatataaaacttacagtggttgtcggagacatcatcggagtacttgaacaaggaaaacgaactttaactccccagccgatggaactaaaatatagttggaaaacctggggcaaagccaaaatagtaacagccgaaacgcagaatagctcatttataatagatggccccaatacccctgaatgtccaagtgcaagtagggcatggaatgtatgggaagttgaagactatggcttcggtgtgtttactactaatatatggcttaaattgcgggaagtatacactcaattgtgcgatcaccgtctaatgtcagcagcagtcaaagatgaacgggcagtacacgctgatatgggatattggatagaatctcagaaaaatggatcatggaaattagagaaagcctctttgatagaagtcaaaacttgtacttggcccaagtctcatacactttggtcgaacggagttttagaatccgatatgatcataccaaaatcattagcaggtcccatatctcaacacaaccataggccaggctaccatacgcaaactgcagggccatggcacttagggaaattggaactagactttaattattgcgaaggaacaacagttgtaattacagaaaactgtggaacaagaggtccaagtctaaggacaacgactgtctcaggcaaactaatacacgaatggtgttgtagatcttgtaccctcccaccactgcggtatatgggtgaagatggatgctggtacggaatggaaattcgcccaatatcggaaaaagaagaaaacatggttaaatcccttgtgtcagcaggatctggaaaggtcgacaattttacaatgggagtcctctgcctagctatcctgtttgaggaagttatgagaggtaaattcggaaagaaacatatgatagcaggagttttctttacatttgtcttactactttccgggcaaatcacatggagggatatggcacatacactaataatgataggatcgaatgcgtctgatagaatgggtatgggtgtcacatatcttgcactaatcgcaacatttaaaattcagcccttcctagcactcggattctttttgagaaaactaacaagtcgagaaaatctattactaggcgttggattggcaatggcgactacgttacaattacctgaggatatagaacagatggcgaacgggattgccttaggactcatggccctaaaattaataacccaatttgaaacatatcaactttggactgctttgatctccctaacttgttccaatacgatgtttacactgacagtagcctggagaacggcaaccttaatcctagctggtgtttctttattgccagtctgccaaagtagtagcatgcgtaaaacggattggctaccgatggcggtagcggcaatgggagtccctccccttcccctgttcatattctctttgaaagacaccctaaaaagaagatcttggccattaaatgaaggagtaatggctgtaggccttgtaagtatattagcaagttcattgctgagaaacgatgttcctatggctggacctctagtagcaggaggacttttgattgcctgttatgttataaccggaacaagcgctgatttaaccgttgagaaagcggccgatattacatgggaagaagaggccgagcagactggggttagccacaatttaatgatcacggtcgacgatgacggaacaatgaggataaaagatgatgaaaccgaaaacatattgactgtcctactaaaaactgcacttctgatcgtctctggtgtttttccatatagtataccggcaacattactcgtatggcacacgtggcagaaacagacccaacgatcaggtgtgctgtgggacgtaccgtcaccgcctgaaacccagaaagctgagcttgaagaaggagtttaccgtatcaaacaacaaggtatattcggtaaaacgcaggttggcgtcggtgtacaaaaagaaggtgtgtttcatacaatgtggcatgtcacccggggagcagtactgacatacaatggaaaacggttggaacctaactgggccagcgtcaagaaagatctaatttcgtacgggggaggatggaggttgtcagcacaatggcaaaaaggagaagaggtacaagtcatcgccgtagaaccggggaaaaatcccaaaaatttccaaactatgcctggtacgtttcaaacaacaacaggagaaataggcgcaatcgccttagacttcaaaccgggtacttctggttctcctataataaatagggaaggaaaggtagttgggctatacggaaatggcgtagtaaccaaaaatggagggtacgtcagtggaatagctcaaactaatgctgaacccgatggtcctacccctgagttggaagaagaaatgtttaagaaacgaaacttgacgataatggacttgcaccctggaagtggtaaaactcgaaagtatctaccagctatagttcgagaagcaatcaagagaagactcagaactttgatccttgctcctaccagggtagtggcggccgaaatggaagaagccttaaaaggattgccaattagatatcagacaactgctaccaagtcagaacatacgggccgagaaatagtcgacctgatgtgtcacgccacgtttactatgaggcttttaagccccgtacgggtcccaaattacaacttaataattatggatgaagcacacttcacagatccagcatccattgcagcaaggggatacataagcaccagagtaggaatgggagaagccgccgccattttcatgacagcaacacctccaggcacagctgatgctttcccccaatccaacgctccaatacaagatgaagaaagagatatacctgagcgtagctggaactcagggaacgaatggattaccgactttgcgggtaaaacagtttggtttgtgccatccattaaagcggggaatgatatagccaactgcctccgtaaaaacggaaagaaggttatacaactaagtagaaagaccttcgatacggaatatcagaaaacaaagctcaatgactgggactttgtagtgaccactgacataagtgaaatgggagctaactttaaagcggaccgggttatagatccaaggcggtgtttaaaaccggtgatattaacagatggaccagaaagagtaatattggccggcccgatgcctgtaactgcggcttcagccgcacaacgccgaggacgtgtaggccgcaatccacaaaaagagaatgaccagtacattttcactggacaacccctaaataacgatgaagatcacgcacactggaccgaagcgaaaatgctgttggataatgttaataccccagagggaatcatacctgctctatttgagcccgaaagagaaaaatcagcagccatcgacggcgaatatcgcttaaaaggagaatcacgtaaaaccttcgttgaattaatgaggcgtggagatctgccggtttggctagctcacaaggtggcgagtgaaggtataaaatacacggaccgaaagtggtgttttgacggacaaaggaacaatcagatattagaagaaaatatggatgtggaaatatggacaaaagaaggtgagaagaagaaacttcggccacggtggttagacgcaagaacctactccgaccctctagccttgaaagaatttaaagacttcgcggctggtagaaaatcgattgccctagacctggtgactgaaattggtagggttccatcgcatcttgcccaccgaacgcgtaatgctctagacaatcttgtaatgttacacacatcagaacatggaggtcgcgcatacagacatgcggtagaagagttaccagagactatggaaacacttttattactgggactcatgatccttttaaccggaggggcaatgttatttatcataagcggtaaggggatcggaaagacatcgatagggctaatttgtgttatagcaagcagtggtatgttgtggatggcagaaatacctttacagtggatcgcatcagcgatagttttagagttcttcatgatggtcctcttaataccagaaccggaaaagcaacgaacaccccaagataatcaactagcgtacgttgtaataggcatattaactttggcagcaatcatagcagctaacgaaatgggtctattagaaacaactaaacgagacctaggcatgagcaaggaaccaggtgtcgttagccctacttcatatctggatgtagacctacatcccgcctcagcatggacgctatacgccgttgctacaactgtgattacgcccatgctcagacatacaatagaaaacagcactgctaatgtaagtctagctgctatagcaaatcaagcggtggtattaatgggcctagataagggctggcccatatccaagatggatttgggtgttccattactggccttaggatgctactctcaggtcaatcccctgaccctcaccgcggccgttctactactgataacacactatgcaattataggaccaggtcttcaagctaaagcgacacgagaggctcagaaacgaacagctgcgggaattatgaaaaacccgactgtagacggaataatgacaattgatctagatccagtaatttatgactcaaaattcgaaaaacaactaggacaggtgatgctacttgttctctgtgcagtgcaactgttactaatgcgaacttcgtgggcgttatgcgaagcattaacgttagcaacgggccccatcacgaccctatgggaaggatcaccaggaaaattttggaatactaccatagcagtatcaatggcaaatatattccgaggaagttacctagcaggagcaggcttagcatttagtattatgaaatcggtagggacaggaaagcgaggaaccgggagccaaggagaaacactaggagagaagtggaagaagaaactgaaccaattatccaggaaggagttcgacctgtataagaaaagtggcataaccgaggttgatagaacggaagcaaaagagggactaaaaagaggcgagataacacatcatgcggtaagtcggggaagcgccaaactacaatggttcgtagaacgaaacatggtaatacccgagggtcgagtaatagacctgggatgcggacgaggaggctggagttattattgtgctggactaaagaaagtaacagaagtaagagggtatacgaagggaggtcctgggcacgaggaacccgtccccatgagtacatatggatggaatatcgtaaagttgatgagtggtaaagacgtcttttacttaccgccagaaaaatgcgacacactactatgcgacattggcgaaagctctccgtccccgacagtagaagagagcagaacaattcgagtcctaaaaatggtcgaaccatggttgaagaataatcaattttgcattaaagtactaaatccatatatgcctacagtaatcgaacatctcgaaagactgcaacgcaagcacgggggaatgttggttagaaaccctctatcacgcaatagtactcacgaaatgtattggataagtaacggaactggaaacatagttgcctcggtgaacatggtgtcgcgacttcttttaaataggtttacaatgacccatagaagacctaccatcgaaaaagatgttgatctcggagcaggcactaggcatgtaaatgcagagcctgagacacccaacatggatgtaattggggagaggatcaaaagaatcaaagaagaacataacagcacctggcactacgatgacgaaaacccatataaaacatgggcatatcacggtagttacgaggtaaaagcaacaggaagtgcatcatcaatgattaacggggtagtaaaattactgacaaaaccatgggacgtagttccaatggttacacagatggcgatgacagatactacgccatttggacaacaacgagtttttaaggaaaaggtcgatacaagaacaccaaggtctatgccgggtactcgtcgcgttatgggcattaccgcagaatggctctggagaactctagggcgaaataagaaaccacgactatgtacgagggaagagttcaccaagaaagtacgtacaaacgccgcaatgggtgcagtatttacagaagaaaaccagtgggattcagcaaaagcagcagtagaagacgaggatttttggaaattggtagaccgagagcgagaactacacaagctgggcaagtgtggcagctgtgtatacaatatgatgggaaaaagggagaagaaattaggggagttcgggaaagcaaaaggatcacgggcaatatggtacatgtggttaggagcgcgttacctagaatttgaagcgctaggatttctgaatgaagaccactggttcagcagagaaaatagttattctggggtagaaggcgaaggtttgcacaaactcgggtacattctaagagatatctctaagatccctggaggagcaatgtatgccgatgatacagctggttgggatactcgcatcacagaggacgatttgcacaatgaagagaagatcacacagcagatggacccggaacataggcaactagcaaatgcgatatttaagttaacttatcaaaataaagtcgttaaagttcaaagacccacaccaactggtacagtaatggatataatcagtcgaaaggatcagcgaggctcaggacaagtcggcacatacggtctaaatacattcacaaatatggaagcccagttaatacgacaaatggaaggcgaaggagtgttaagtaaggctgacttagaaaatccgcacttgcctgagaagaaaattacacaatggttagaaacaaagggagtcgagagactaaaacgaatggcaatatccggagatgactgtgtagtaaagcctatagacgacaggtttgccaacgccctccttgctctaaatgacatgggtaaagttcgaaaagatattccccaatggcagcctagtaaaggctggcacgactggcagcaggttccgttttgttcgcaccattttcatgaactaattatgaaggacggtagaaaattagtcgtaccatgtaggccgcaagacgaactgataggacgagcacgtatctctcaaggtgcaggctggtctctacgagaaacagcatgtttgggtaaagcgtatgcacagatgtggtcgctaatgtattttcatcggagagacttgcgactagcttctaacgccatatgtagtgcggtgccagtacattgggtcccaacttctagaacgacatggtcaattcacgcccaccaccaatggatgacaactgaagacatgttaacagtttggaatagggtgtggatagaagacaatccctggatggaagataagacgccagttaccacatgggagaacgtaccatatttaggaaaacgcgaagaccaatggtgcggaagtcttatagggctgacttcaagagcaacttgggcacaaaatattccgacagcgattcaacaggtcaggagtctgatcggcaacgaagagttcctagactatatgccctcaatgaaaaggttcaggaaagaagaggaatcagaaggtgccatttggtga

SEQ ID NO: 23072 - RNA, 9873 nt, synthetic construct
  misc_feature 1..9873: note = derived and/or modified CDS sequence (opt6) from DENV-3__GU131874__SS-prME
  source 1..9873: mol_type = other RNA
acatccttgtgcttaatgatgatcttgcccgctgctttggcatttcatcttacgagcagagatggtgaaccacgtatgatagtaggtaaaaacgaaaggggaaaatcattgttatttaaaactgctagcggaattaacatgtgcacattaatcgcgatggatctaggagaaatgtgcgacgatactgtcacttacaaatgtcctcatattactgaagtagaaccagaagacattgactgttggtgcaacttaacatccacttgggtcacatatggaacttgtaatcaagctggcgaaaggagaagagataaacggtcagttgctttagcgccacacgtaggaatggggttggacaccaggacacaaacttggatgagcgctgagggagcatggagacaagtagaaaaagttgaaacatgggctttacgacatccaggatttacaatattagcattgttcctagctcactacattggaacttcactaacacaaaaagttgtaatattcatcctacttatgttggttaccccatcaatgactatgcggtgcgttggagtcggaaatcgtgattttgtagaaggactaagtggggcaacatgggtagatgtagttctagaacatggcggttgcgtgacgacaatggctaaaaataaacccaccttggatatagaactacagaaaactgaagcaacacaattagctactctaagaaaactttgtatagaaggcaaaataacaaacataaccacagacagtagatgtccgacacaaggcgaagcagttttacctgaagaacaagatcaaaattatgtctgtaaacacacatacgtggacagagggtggggtaacggttgcggattatttggaaaaggtagtctggttacttgtgcaaaatttcaatgtctggaattaattgagggtaaagtagtgcaatatgaaaatttgaaatacacagtaatcataacagttcacacaggtgaccagcaccaagttggaaacgaaactcagggtgtaacagcagaaataactccacaagcaagcactacagaagctatattaccagaatacggcacactgggattggaatgctcaccaaggacgggcctggacttcaacgaaatgatactccttaccatgaaaaacaaagcatggatggtacacaggcagtggttcttcgatttaccactaccatggacatcaggtgcaacgaccgaaactcccacatggaaccgaaaagaactcttagtaacgtttaaaaacgcgcacgccaagaaacaagaagtcgtagtacttgggtcgcaagaaggtgcgatgcacactgcgttgacaggtgctaccgaaattcaaaactcaggaggaacttccatttttgcggggcacttaaaatgtcgtctgaaaatggacaaactcgagttaaaaggaatgtcatatgcaatgtgcactaatacattcgtactcaagaaagaagtatcagagacccaacatggaacaatattaataaaagttgagtataaaggagaagacgcaccatgtaaaataccattttcgaccgaagacggacaaggaaaagcccataatggtaggcttatcaccgcaaatcccgtagtgactaagaaagaggaacccgtaaacatagaagcagaacccccattcggtgaaagtaacattgtaattggaactggcgataatgcattaaaaataaattggtacaagaaaggttcgtccataggtaaaatgtttgaggcaaccgcacgaggcgctaggagaatggctatcttaggcgatactgcttgggactttgggtctgtagggggtgtattaaatagccttggaaaaatggtccatcaaatttttggctcagcgtatacggcgctatttagcggcgtaagttgggtcatgaaaataggaataggggtcctacttacatggattggattgaactcgaaaaatacatcaatgtcctttagttgtatagcaatcggaatcattactttgtatctgggagccgtagtgcaagccgacatgggttgtgtaataaattggaaaggaaaagaattaaaatgcggtagtgggattttcgtcacgaacgaagtacacacatggaccgaacaatataaattccaggcggattcaccgaaaaggcttgccaccgctattgctggagcatgggaaaacggtgtatgcggtatacgatctacgacaaggatggaaaatctactctggaaacaaatagccaatgaattaaactacattttatgggaaaataatattaaattaacagttgtagtgggggacatcattggagtcttagaacaaggtaaaagaacactcactccccaacctatggaattaaaatactcgtggaaaacatggggaaaagctaaaatagtcacagcagagacgcagaacagttcatttataatagatggtcctaatacacctgagtgtccttctaccagtcgtgcttggaatgtgtgggaggtcgaagattacggtttcggagtgttcacaaccaatatctggctaaaactaagagaagtatacacacaattgtgcgatcataggcttatgtccgcagccgtaaaagatgaacgtgctgttcatgcagatatgggctattggattgaaagtcagaaaaatggaagctggaaattagaaaaagcgagtctaatagaggttaaaacatgtacgtggcctaaatcacatacactctggtctaacggagtattagaatcagatatgattattccaaaatcactagccggtccaatttctcaacacaaccatagaccaggataccatactcagactgccggaccctggcaccttggtaaactggaattggatttcaattattgcgaaggaacaactgtagttataacggaaaactgcggaacaagaggaccctcacttcgcaccactacggtgtcaggtaagctgatccacgaatggtgctgtaggtcttgtacattacctccactgcgatatatgggggaagacggatgctggtacgggatggagataagaccaataagcgagaaagaagaaaatatggttaaaagcctagtaagcgcgggatctggcaaggttgataactttaccatgggtgtcctatgtttagccatactattcgaagaagtaatgagagggaagttcggtaaaaagcatatgatagcaggcgtattctttacctttgttcttctgttgtcaggacagataacgtggagggacatggcacacacgctaatcatgatcgggtcaaatgccagtgaccgcatggggatgggagtcacatacttggctttgatagctacgtttaagattcagccgtttttagctctaggattctttttgagaaaattaacatctcgcgaaaatttgcttttgggagttgggctcgctatggcaacaacacttcagcttcctgaagatatcgaacagatggccaatgggatagcgctcggtttaatggccttaaaactaattacgcagtttgagacatatcaactatggaccgctctcatatctttaacttgtagtaataccatgttcaccttaactgtagcttggcgtacagctacattgattttagccggtgtctccctcctacctgtatgccagtcaagcagcatgaggaaaacagactggttaccaatggcagtggcggcgatgggagtacctccactacccttgttcattttctctctcaaagatactttaaaaagacggagttggccactaaatgaaggggttatggctgtaggtctagtctcaatacttgcctcatctcttctaagaaacgatgtccccatggcaggtcctctcgtggccggtggtttattgatagcatgctatgttataactgggacttcagcggacttaacagtagaaaaagcagctgatattacctgggaagaagaagctgaacaaacaggagtaagtcataatctcatgataaccgtggacgacgacggaactatgagaataaaagatgacgaaaccgagaacattttgactgttctactaaagacagcactactgatagtgtcaggagtgtttccatactctatcccagctacattattagtttggcacacttggcaaaaacaaacccaaaggtcgggggttttatgggacgtaccctcgccacctgagacccaaaaggcggaactcgaagaaggtgtctatagaattaaacaacaaggtatttttggcaaaacacaagtgggcgttggagtccaaaaagaaggcgtcttccacacaatgtggcatgtaactcgtggagctgtattaacatacaatggtaaacgacttgaacctaactgggccagcgtcaagaaagatctgatttcatatggtggcggatggaggctttccgcgcaatggcaaaaaggagaagaagtacaagtgatagcggtagaaccagggaaaaaccctaaaaactttcagacaatgccaggaacttttcaaacaacaactggagaaattggggcaatagctttagattttaaacccgggacaagtggttcacccattataaacagagaaggtaaagtcgtcgggttatatggtaatggcgttgtaacaaagaatgggggctacgtaagcggtatagcacaaacgaatgccgagccagatgggccaacacctgaattggaggaggaaatgtttaagaaacggaacctaacaatcatggatctacacccaggaagcggaaaaacgaggaagtacctaccagcaatcgtgagagaggcaattaaacgcagactaagaaccttaatattagctcctacacgcgtagtcgctgcagaaatggaagaggctctaaaaggtctaccgatcaggtatcaaacaacggccacaaagtcagaacatacaggaagggagatagtcgatttaatgtgtcatgcaacattcacaatgcgcttactcagcccagtaagggtaccaaattacaatctcattatcatggatgaagctcattttacagatccggcaagtatcgctgccagagggtatatttcaacaagggtaggcatgggtgaggcagccgccatctttatgactgcaacaccaccggggacagcagatgcctttccgcagagcaatgctcctattcaggatgaagaacgtgatataccagagaggtcatggaatagtgggaatgagtggattactgatttcgcaggtaaaactgtctggttcgtaccaagcatcaaggcgggaaacgatatagcgaactgcttaaggaagaacggcaagaaagtgatacaactcagccgaaagacattcgatacggagtatcagaaaactaaacttaacgattgggatttcgtagttaccacggatataagtgagatgggcgccaattttaaagccgatcgcgttatagaccctagaagatgtttaaaacccgtaattttaacagatggaccagagagagtcattcttgctggccctatgccagtaaccgcggcgagtgcagcacagaggaggggtagagtaggaagaaatccccagaaagagaatgaccaatatatatttacgggtcaaccattaaacaatgatgaagatcatgcacattggacggaagcaaagatgttattagacaatatcaacaccccagaaggaataatacctgctttgttcgaacccgagagggaaaaatctgccgcaatagatggagagtaccgattaaaaggagaatcacgtaagacttttgtagaactaatgagaaggggcgatttacccgtatggctagctcataaagtcgcctcggaaggtattaaatacaccgatagaaaatggtgcttcgacggacaacgaaataatcaaatactagaagaaaacatggatgtagaaatatggaccaaagaaggagagaagaagaaacttaggccacgatggttagatgcaagaacatactcagacccattggcactaaaagaatttaaagactttgccgcaggtagaaaaagcatagctcttgacctggtaacggaaattgggagggttccttcacatctcgcccacagaacacgaaatgctctagataatttggtaatgcttcacaccagcgagcatggtggcagagcctatcgccatgctgtagaagaattaccagaaacaatggaaacactacttctcttaggactcatgatccttttaacaggaggagcaatgttattcctaataagtggaaaaggaattggaaaaacgtcaatcggtctaatatgtgtgatcgcatcgtctggtatgctttggatggccgagataccacttcagtggatagcctcagcgatagtcttggagttcttcatgatggtgcttctcatacccgaaccagaaaaacaacgaacaccacaagacaaccagctagcatacgttgttataggtatactaaccctcgcagccatcattgcagcaaatgaaatgggattgctggaaacgacaaaaagagatctaggaatgtctaaagaacctggcgttgttagtcccacgagttatttagatgtcgatttgcacccagcaagtgcgtggacactctatgctgtcgcaaccaccgtaatcacccctatgttgagacacactatcgagaatagtaccgccaatgtatcactagcggcaatagctaaccaagcggtagtcctgatggggttagacaaagggtggcctataagcaaaatggacttgggcgtgcctctactcgcgctcggctgttatagtcaagtcaatccattaacattgaccgcagctgtacttctattaataacacattacgccataatcggtccagggttgcaagcaaaagcaacaagagaagctcaaaaacggaccgcagcgggtatcatgaaaaacccaacggtagatgggataatgactatagaccttgacccggttatctacgattcaaaattcgaaaaacaactgggccaggtaatgctattagtactgtgcgcggcacagctattattaatgagaacatcctgggccttatgcgaagcattaacgcttgctacgggtccaatcaccacgttgtgggaaggaagcccagggaaattttggaatacaacgatagcagtctcaatggctaatatatttcgggggagttatttagctggtgctggattagctttcagtataatgaaatcagtgggaacaggcaagcgggggacaggcagtcaaggagaaacgttaggagaaaaatggaaaaagaaattaaatcaactatcaagaaaagagttcgacttgtataagaaatccggaattacggaagtggatcgtactgaggccaaagaagggctgaaacgaggtgaaatcacacaccacgcggtatcgagaggatcggcgaaattgcaatggtttgtagagagaaatatggttattccagagggccgagtaatagatttgggttgcggccgaggcggctggtcttactattgcgccggtctaaagaaagttaccgaggtgagaggttatacgaaaggcggacccggacatgaggaaccagtaccgatgtcaacatacggttggaatatagtaaagttaatgagcggtaaagacgtattctatcttccaccagagaagtgtgacacacttttatgcgatatcggcgagagttcgccatcaccaactgtcgaggagtcgcgaacaattagggtactaaaaatggtagagccatggttaaagaacaatcaattctgtattaaagttttaaacccttatatgcccacagtgattgagcaccttgagcggctccagcgaaagcacggtggaatgttagtaagaaacccactatcgagaaactcaacgcacgaaatgtattggataagtaatggaacagggaacatagtcgcgtcagttaacatggtttcgagactcctactgaatcgattcacgatgactcatcggagacctacaattgaaaaagacgtcgatctcggtgcgggtacaaggcatgttaatgccgaacccgagactccgaacatggatgtaatcggtgagcgaataaaaaggatcaaagaagaacataattctacctggcactacgacgacgaaaatccttacaagacctgggcatatcatggatcatacgaggttaaggctacgggtagtgcatcctcaatgattaatggagttgtgaaattattaacaaaaccatgggatgtagttccaatggtaactcaaatggccatgaccgacacaaccccttttggtcagcagcgtgtatttaaagaaaaagtagatacaagaactcctcgttcaatgccagggacgagaagagtaatgggcataaccgctgaatggctatggaggacacttggtagaaataaacggccaagattatgcacgcgagaggagtttaccaagaaagtacggacgaatgcggccatgggagccgtgtttactgaagaaaaccaatgggacagtgccaaagcagcagtagaagacgaagatttttggaagctagtagacagggaaagagagcttcataaacttgggaagtgcggatcgtgcgtgtacaacatgatgggcaaacgtgagaagaaactaggggagttcggaaaggcgaaaggaagtagagcaatttggtacatgtggctcggcgcgagatatctcgagttcgaagcgttaggctttctcaatgaagatcactggttcagtagagaaaatagctatagtggcgttgaaggagaaggattgcataaactggggtacatattaagagacatatcgaaaatcccaggtggagccatgtatgcagacgatactgccggctgggacacgaggataacagaagatgatctacataatgaagaaaagatcacccaacaaatggatcctgaacacaggcaattagctaatgccatattcaagttgacatatcaaaacaaagtcgtgaaggtgcaacgtcccacaccaacaggcacagttatggatataataagcaggaaagatcagaggggtagtggccaagtaggaacttatggattaaacacgtttactaatatggaagctcaactaattcgccaaatggagggtgagggtgtcttgagtaaagcagacttagaaaatcctcatttacccgagaagaaaattgcacaatggttagagaccaaaggagtcgaacggctaaaaaggatggccattagtggtgatgattgtgtcgttaagccaatcgacgacagatttgctaacgcgttgctggcattgaatgacatgggaaaagtccgtaaggatataccacaatggcaaccgtcaaaaggttggcacgattggcagcaggtacccttctgttcccatcacttccacgaactaataatgaaggatggcagaaaactcgtggtcccctgcaggcctcaagatgagctaataggtagagcaaggatttcgcagggctcaggttggagtctaagagagacagcatgccttggcaaggcttacgctcaaatgtggagtctcatgtatttccatagaagagatctgaggttggctagtaatgcaatatgtagtgctgttccagtccattgggtaccgaccagccgaacgacatggagcatacatgcgcaccatcaatggatgacaacagaagacatgctcgccgtttggaaccgtgtatggattgaagataacccctggatggaagacaagacaccagtaactacatgggaaaatgtaccctaccttggcaagcgagaagaccagtggtgtggatcactcatcgggttaacaagccgagcaacatgggctcaaaacattccaactgctatacaacaagtgcgatcacttattggtaacgaagaatttcttgactacatgccctcaatgaagagattcagaaaagaagaagagtcagaaggagctatatggtag

SEQ ID NO: 23073 - RNA, 9873 nt, synthetic construct
  misc_feature 1..9873: note = derived and/or modified CDS sequence (opt6) from DENV-3__GU131875__SS-prME
  source 1..9873: mol_type = other RNA
acctcgctgtgcctagttatgattctccccgctgcactggcatttcaccttacctcgcgagatggagaaccgagaatgatcgtcggcaaaaatgaaagaggtaaatccctactatttaaaacagctagtgggatcaatatgtgcacactaatagcaatggaccttggagagatgtgcgatgacactgtgacttataaatgccctcacattaccgaagttgagccggaagatatagactgctggtgtaacctcacatcaacatgggtaacatacggaacatgtaatcaagcgggggaaagacgtagagataaaagatcagttgctctagcaccacacgtgggaatggggctagatacacgcacacaaacttggatgtctgcagaaggtgcatggagacaagtcgaaaaagtagaaacttgggcacttcgacatccagggttcacaatcctagcattatttctcgcacattacattgggaccagtttaactcaaaaagtagttattttcatacttcttatgttggtaaccccaagtatgacaatgagatgcgtaggggttggtaacagggatttcgtcgaaggactcagtggggccacctgggttgatgtagtgctggagcacggtggatgtgtaacgactatggccaaaaataaaccaaccctcgatatagagctacagaaaaccgaagcaacacaattagctacacttcgaaaactgtgtatagaaggaaaaattacaaatataacaactgattcacgctgtccaacacaaggtgaagcggtattaccagaagaacaagaccaaaattacgtgtgtaaacatacgtatgttgataggggatggggaaacggatgtggactgtttggtaaaggatcgttagtaacatgcgcaaaatttcaatgccttgaaccgatagaaggaaaagttgtacaatacgagaacctaaaatataccgtcatcatcacagtccacactggcgatcaacatcaagtaggcaatgaaactcaaggcgtaactgcggaaatcactccacaagcaagtacgactgaagctatccttccggaatatgggactttaggattagagtgttcacctcgaacaggcttggatttcaatgagatgattctactaactatgaaaaataaggcttggatggttcaccgacaatggttctttgatcttccgctaccctggacaagcggcgctactactgaaacaccaacatggaataggaaagagttgttagtaacatttaaaaatgctcatgccaagaaacaagaagtggtagtactagggagccaagagggagcgatgcatactgccctaacaggagcaaccgagatacaaaactctggaggtacaagtatcttcgccggacatcttaaatgtcggctcaaaatggacaaattagagttaaaaggtatgagttacgcgatgtgtacaaataccttcgtacttaagaaagaagtatcagagacgcaacatggaacaattttaatcaaagtagaatatcggggagaggatgcgccatgtaaaataccattctctacggaagatggtcagggaaaagcccacaatggccggctcataacggcgaatccagttgttaccaagaaagaagaacccgtcaacatagaagctgaacctcctttcggtgaatccaacattgtcataggtattggagataatgcacttaaaattaattggtataagaaaggatcatcgattggaaaaatgttcgaagcgacagcgaggggagcaagacggatggctattttaggggacacagcttgggattttgggagtgtgggaggtgttctaaattcactaggaaaaatggtccatcaaatattcgggtcagcttatacagccttgttttcgggtgtcagttgggtcatgaaaattggtattggaatactacttacatggataggattaaattctaaaaatactagcatgagcttctcatgtatagcaataggcatcataaccttgtacttaggagcagtagtgcaggcagatatgggatgcgtaattaattggaagggaaaagaactgaaatgtgggagtggaatattcgttaccaacgaagtgcatacatggacagaacaatataaatttcaagcagacagcccaaaaagattagctaccgctattgctggagcttgggaaaatggcgtatgtggtattcgatctacgaccaggatggaaaacttgttatggaaacaaatagcaaacgaactcaattatattttatgggagaataatataaaactaacagtagttgttggtgatataataggagtgttagagcaaggtaaacgaacactaactccccagccgatggagctaaaatattcttggaaaacgtggggaaaagcaaaaatagtcactgccgagactcaaaattcaagttttattattgatggtccaaatactccggaatgtccctcggctagcagagcatggaacgtgtgggaagtagaggattatggattcggagtttttacaaccaacatttggctgaaactacgcgaagtttacacacaattatgtgaccataggttaatgagtgcggcagtaaaagacgaaagggcagttcatgctgacatgggctactggatagaatcacagaaaaacggctcatggaaactagaaaaggccagcctaattgaagtcaagacctgcacctggcccaagtctcacactctgtggtccaatggggttttagaaagcgatatgataatacccaagtcactcgcaggaccaataagtcaacacaatcacagacctggatatcatactcaaacagccggcccttggcacttagggaaactggaattggacttcaattactgtgaaggaacgactgtagtcataacagaaaattgtgggacaagaggaccttccttgcgcacaactacagtttcgggcaaacttattcatgaatggtgctgccgatcatgcactcttccacctcttaggtatatgggtgaagacggatgttggtacggcatggaaattcgaccgatatcagaaaaagaagaaaatatggtaaaatcgcttgtaagtgcaggtagtggcaaagtagacaattttacaatgggagtcttgtgtcttgccatcctattcgaagaggttatgcgagggaaatttggcaagaaacacatgattgcaggagtatttttcacattcgtgcttcttttgtcgggtcagataacctggcgtgatatgacacatacattaattatgataggaagcaatgcaagtgatagaatgggtatgggagtaacttatttagcattgattgctacgttcaaaattcaaccattccttgcgcttggattcttcttacggaaactaacaagtagagagaatctcctcttgggagtaggtttagccatggcaactaccttacaactccccgaggatattgagcaaatggcaaacgggatagcgctcggattaatggccttaaaattaataactcagttcgagacttaccaattatggactgcgttaatttcattaacgtgctctaacactatgtttactcttacggttgcatggaggacagctacactaatcttggcgggagtgtcattgttacccgtctgtcaaagtagctcaatgagaaaaaccgactggcttccaatggccgtagcggcaatgggggttccccctttaccgctgttcatattttccctcaaagatacattaaaaagaaggtcttggcctttaaacgaaggggtaatggcagtaggcctagtatctattctggcaagcagtctcctccggaatgatgttcctatggcaggcccacttgttgcagggggattacttatcgcatgttacgtgattactggaacgagtgcagatctcacagttgaaaaagcagctgatataacttgggaagaagaagcggaacaaacaggagtttcccacaatttaatgattaccgtcgatgatgatgggaccatgaggatcaaagacgacgaaaccgaaaatattttaacggtacttcttaaaacggccctcctaattgtgagtggtgtattcccctacagtattccagcgactctgcttgtatggcatacatggcaaaaacaaactcaacgctctggtgttttatgggatgttccatcaccacccgagactcaaaaagcagagctggaagaaggggtatatcgaataaaacaacaagggatcttcggcaaaacgcaagttggagtaggagtccagaaagagggtgttttccacacaatgtggcatgtgacaaggggtgcagtcttaacatataatggaaaaagactagagccgaactgggcatcagtaaagaaagacttaatttcatatggtggcgggtggagattaagcgctcaatggcaaaagggagaagaggtgcaagtaattgcagtagaacccggcaaaaaccctaaaaactttcaaactatgccaggaacgttccaaaccacaactggggaaataggagctatagctttagattttaaaccaggtacctctggctcgcccatcatcaatcgggagggaaaagtggtaggcttatacggtaacggtgtcgtaactaaaaacggtggatatgtaagtggtatagcacaaacaaacgctgaacctgacggacccacacctgagctagaagaagagatgtttaagaaacgtaatctaacaataatggatttacatcctggatccggtaaaactagaaagtatctcccagctataatacgggaggctattaagcgaaggctacgaactttaattctggcgccaactcgggtggttgcggcagaaatggaagaagcgttgaaaggcttaccaattaggtatcaaaccaccgcgacaaaatcagaacacacaggacgtgaaatcgtagaccttatgtgtcatgctacatttacaatgcgattgttatcaccagtacgggttcccaattataaccttataataatggacgaagctcattttacagaccccgcttcgatagccgccagaggatacataagcactcgagtcggtatgggagaagctgccgctatctttatgaccgctactcctccaggcaccgctgatgctttcccgcagagtaatgcacctatccaggacgaagagagggacataccggaacgatcgtggaatagtgggaatgaatggatcacagacttcgctggaaaaaccgtgtggttcgtaccaagtattaaagcgggaaacgacatagccaactgcctaaggaaaaatggtaagaaagtgatacagttaagtcgcaaaacgtttgatacagaatatcagaaaaccaaactcaacgactgggattttgtagttacgaccgatatcagcgaaatgggtgcaaattttaaagtcgatagagtaatcgacccacgtaggtgcctcaaacctgttattttaacggatggaccagaaagagtaattttagcaggcccgatgcctgttactgcagctagcgcggctcagaggagagggagagttggaagaaacccacaaaaagagaacgatcaatatatcttcacaggtcagccgctcaataatgatgaagatcatgctcattggacggaggcaaaaatgcttcttgataatatcaatactccagaaggcattatccctgccttatttgaaccagagcgcgaaaaatccgcggcaattgacggagaatatcgtctaaaaggagagtcaaggaaaacatttgttgaattaatgagaaggggcgatctacccgtatggctagcacacaaagtcgctagtgaaggaattaaatatacagatcgaaaatggtgcttcgacggccagagaaataaccagatactggaggaaaatatggacgttgagatatggacaaaagaaggagagaaaaagaagttaagaccccggtggctagatgcaagaacttactccgacccactagcattgaaggagtttaaggactttgcagccggcagaaaatcgatagcattggatctggtaacagaaataggacgagtccccagtcacttagcacatagaactcggaatgcccttgataacttagtcatgctacacacatctgaacatggaggaagggcttacagacatgcagttgaagagttaccggaaaccatggagactctccttttattaggacttatgatactattaacaggtggagcgatgctattccttatatccggaaaaggcatcggtaaaacttcgataggcttaatctgtgtaatagccagtagtggtatgctttggatggcagagataccgttacaatggatcgccagcgctatagtattagagttcttcatgatggtactccttataccagagccagaaaaacaacgaacaccacaagacaatcaacttgcatacgtagttataggaatacttacactagccgcaattatagccgcaaacgagatgggcttactagagacaactaaacgagacttaggtatgtcaaaagaaccaggtgtcgtatctccaactagctatctagacgtagacttgcaccctgctagtgcctggacgctctatgcagtagcgacaaccgtgattacccctatgttgaggcatactattgaaaacagtacagcaaacgtaagtttggccgccatagctaatcaagctgtcgtattaatgggtctagacaaaggttggcctatttctaaaatggatctaggggtccctttgcttgccctggggtgctattcacaagtaaatcccttaacattaaccgctgcggtgttgcttctaataacacactacgccataatcggacccggtttgcaagctaaagccactagggaagcacagaaaagaacagccgctggtataatgaaaaacccgacagtggacggtattatgactattgatttagatcccgttatatatgacagtaagttcgagaaacaattaggtcaggtaatgttattagttctatgcgctgttcaacttctactaatgcgaacttcatgggctctatgcgaggcactcactttagccactggaccaataacaacactatgggaaggatcaccaggaaagttctggaataccacaatagcagtttcaatggccaatatattccgtggaagttatttagccggagctggactcgcatttagtattatgaaatcagttgggactggcaagaggggaactgggtcacagggtgaaactttaggagaaaaatggaagaagaaacttaatcagttatcaagaaaagaatttgatctatataagaaaagtggcatcactgaggtggatagaacagaagccaaagaaggtctaaaacgtggagaaataacacatcacgcagtttccagaggaagtgctaaattgcaatggtttgtagagcgaaacatggtcataccggagggccgagtgatcgatctgggatgcggacgtggcggttggtcatattattgtgctggtctcaagaaagtgactgaagttagggggtataccaaaggaggtccaggtcacgaagaaccagtgccgatgagtacgtacggctggaatatagtaaagctgatgtcaggcaaagatgtattttatcttcccccagaaaagtgtgatacccttttatgcgatataggggaaagtagtccttcacctacggtagaagagagtaggactatacgagtactgaagatggtagagccctggttaaagaataatcaattctgtatcaaagtcttaaatccatacatgccaacagtaatcgaacacttagaaagactacaacgaaaacacggaggaatgttagtaagaaaccctcttagtagaaactcaacccatgaaatgtattggatatcaaacggtactggaaatatagttgcaagtgtgaacatggtatcccgcttactgttgaatcgctttacaatgactcacagacggcccacaatagagaaagatgtcgatctgggtgctggaacaagacatgttaacgctgagcccgaaacaccaaatatggacgtgataggcgaacgaataaaaagaataaaagaagaacataactcaacatggcattatgatgatgaaaacccatataaaacatgggcctatcatggctcttacgaagtaaaagctacaggttctgcgagttccatgataaatggagtcgtgaagctcttaacgaaaccctgggacgtcgtcccaatggtcactcagatggcaatgactgacacaacgccttttggccagcagagagtattcaaagagaaagtcgacacaagaactccaagatcaatgccaggtacccgaagagttatgggcatcaccgcagagtggttgtggaggactctaggacgaaacaagaaacctcgactctgtaccagagaagaatttacgaagaaagttcgcacaaatgccgcgatgggcgcagtattcacagaggaaaaccaatgggattctgcaaaagctgccgtggaagatgaagacttctggaaattagtagaccgagaacgtgagttgcataaactaggaaaatgtggatcttgtgtatataatatgatggggaagcgtgaaaagaaattgggtgaatttggaaaagcaaaaggcagcagagcgatatggtatatgtggttaggggcccgttaccttgaatttgaggctttgggattcctcaatgaagatcattggttctcaagagagaactcatacagcggagttgaaggagaaggtcttcataaattgggttacatcctacgagatatatccaagatccctggaggagctatgtatgcggatgatacggccggatgggatacgagaataacggaagatgatttacataatgaagagaaaataacgcaacaaatggatccggaacatagacagttagccaatgcaatatttaaacttacatatcaaaataaagttgtaaaggtacagaggccaactccgactgggactgtaatggatattattagcaggaaagaccaaagaggtagtggacaagttggcacttacggactgaatactttcaccaatatggaagctcagttaataagacagatggaaggagaaggggtgttatctaaggctgacttagagaatccacatcttcctgaaaagaaaataactcagtggctagagacgaaaggtgtagaacgactcaagagaatggcgatatccggcgatgattgcgtcgtaaaaccgattgatgatagatttgctaatgcattattagccttgaatgatatgggtaaagttaggaaagacattcctcagtggcaaccatcgaagggttggcacgactggcaacaggtaccattttgtagccatcattttcacgaactcataatgaaagacggacgcaagctagtggtcccttgcaggccacaagatgaattaataggacgtgcacgaattagccaaggagccggctggtcactgagagagaccgcatgtttaggaaaggcttacgcccaaatgtggtcgttaatgtacttccaccgtcgtgacttacggctcgcttccaatgctatttgttctgcagtcccagtgcattgggttccaacttctcgtacaacctggtcgatccatgcacatcatcagtggatgacaaccgaagacatgctcacagtgtggaacagagtgtggattgaagacaacccttggatggaagacaagacacccgtgactacatgggagaacgttccttaccttggaaagcgagaagatcaatggtgcggcagtttaattggattaacgtccagagccacctgggcgcaaaacatacctactgccattcagcaagtaagaagccttataggcaatgaggaatttttagactacatgccaagcatgaaaagatttaggaaggaagaagaatcagaaggcgcgatttggtag

SEQ ID NO: 23074 - RNA, 9873 nt, synthetic construct
  misc_feature 1..9873: note = derived and/or modified CDS sequence (opt6) from DENV-3__GU131877__SS-prME
  source 1..9873: mol_type = other RNA
acgtccttatgtttaatgatgatcttacccgcagcgttagcatttcatctcacgagccgcgatggggaaccacgaatgatagtagggaaaaatgaacgtgggaaatctctcctgtttaaaacagcttctggaataaatatgtgcacgcttattgcaatggaccttggagaaatgtgtgatgacacagtcacctataaatgtcctcacattactgaagttgaaccagaagatatagattgctggtgcaacctaacctcgacctgggtgacgtacggaacgtgtaaccaagcaggagagagaaggagggataaaagaagtgtagcattggcgccacatgtaggaatggggttagatacgaggacccaaacgtggatgtcagctgaaggagcatggcggcaagtagagaaagtggaaacatgggcacttcgacatccaggcttcacaatactggcgttgttcctagcacattacatagggacaagtctaactcaaaaagtagttatatttatactgttaatgttagtgaccccttcaatgactatgagatgtgtaggagttggaaatcgagatttcgtggagggcctaagcggggcaacatgggtcgatgtagttctagagcacggtggatgtgtcacgacgatggccaaaaataaaccaacgttagatatagaactccagaaaacagaagcaacgcaattagccacattaagaaaattatgcatagaaggaaaaataacaaatattacaacagattcgcgctgccccactcaaggagaagctgtgctaccggaagaacaagatcaaaattatgtatgcaaacacacatacgtagaccggggttggggtaatggttgtggtttatttggaaaaggatcccttgtgacgtgtgccaaattccaatgtttagagccgattgaaggaaaagtggttcaatatgaaaacttaaaatatactgttattataactgtccatacaggagatcaacatcaagtaggcaacgagactcaaggagtaacggctgaaataactccacaagcaagtacgactgaagctatactacctgaatatggaacattggggttggaatgttccccaagaacagggttggattttaacgaaatgatattattaacaatgaaaaataaagcatggatggtccatcgacagtggttctttgatctccccctaccatggacgtctggagctactacggaaactcccacatggaatcgaaaagaactattagtcacatttaaaaatgctcatgctaaaaagcaagaggtagttgtactgggctcccaggaaggagccatgcatacagcgctgacgggagctactgaaatacagaacagcggtgggacgagtatcttcgcaggtcacctcaaatgtcgccttaaaatggataagctagagctaaagggcatgtcgtatgctatgtgtactaatacttttgtattgaagaaagaagtatcagaaacgcaacacggaacaattctaattaaagttgaataccgcggtgaagatgcaccttgcaaaatccccttctctacggaggatggccagggtaaagcccacaatggaagattaattacagcgaatccggtggtaaccaagaaagaggaacctgttaacattgaggctgaaccaccctttggggaaagtaacattgtaataggaataggagacaatgctctcaaaattaactggtacaagaaaggttccagcattgggaagatgtttgaagcaacggcgaggggtgcaagacgaatggcgatattgggtgatacagcgtgggattttggcagcgtgggaggcgttttgaatagtctcggcaaaatggtgcatcagatttttggatcagcgtatacagcattattttctggagtaagttgggtaatgaaaatcggcataggagtcttattaacatggataggcctaaatagtaaaaataccagtatgagctttagttgcatcgcaatagggattataacgttatatctgggggcggtcgttcaagctgatatgggatgtgtgataaattggaaaggaaaagaattaaagtgtggatcaggtatctttgttactaatgaagtacacacatggacggagcagtacaagtttcaagcagattcaccaaaacgccttgcgacagcaatagcaggagcgtgggaaaatggagtttgtggcattcgcagtaccacacgtatggaaaatctattatggaagcaaattgctaacgaactaaattatattctatgggaaaataatataaaactaaccgtcgtagtgggagatataataggagtcctcgaacaagggaaaagaacgctaacacctcaacccatggaactaaaatactcttggaagacatggggaaaagcgaaaatagtaaccgctgaaactcaaaactcgtctttcataatcgacggaccgaatacccccgagtgtccctcagcaagccgggcatggaatgtctgggaagttgaggattatgggttcggggtattcacaactaatatatggttgaaactgcgtgaagtctatactcagttatgcgatcatcgattaatgtccgcagcagtgaaagatgaacgagcggttcatgctgacatgggatattggattgaatcccagaaaaatggctcatggaaacttgaaaaggcttcgttaatagaagtaaaaacgtgcacgtggcctaaatcccatacgctttggagtaacggagttttagaatcggatatgattattccaaagagcctggcgggaccaatatcccaacataaccataggcctgggtaccacactcaaacagccggtccatggcatcttggtaaactcgaacttgattttaattattgtgaaggtaccacggttgtgataacggagaactgcggaacaagaggcccttcactgagaacaacaaccgtctcaggaaaactaatacatgaatggtgctgtcgatcatgtacattaccaccgctccgttatatgggcgaggatggctgttggtatggaatggagatacgccctataagcgagaaagaagaaaatatggttaaaagtttagtgagcgcgggatcagggaaagtggacaattttacaatgggagtattatgtctagtcatactctttgaggaggtcatgagagggaaattcggaaagaaacatatgatcgccggtgtattcttcacctttgtgctgctcttatcaggtcagataacatggagagacatggctcatacgttgattatgataggctccaacgcaagtgatcgcatgggtatgggagtaacttatctagcattaattgctacttttaaaattcaaccttttctagcgcttggattctttcttcgtaaattgacaagtagagagaatctgctattgggcgtaggattagctatggccactacacttcaattaccggaagacatagagcagatggctaacggaatagccctcgggttaatggccctaaaactaatcactcagtttgagacttaccagctatggaccgctttgatatcattaacatgttctaataccatgttcacgttaactgtagcttggagaacagcaacattgatactagccggagtcagtttactgcctgtctgccaatcaagcagcatgcgaaaaaccgattggttacctatggccgtagccgcaatgggagttcctccattgccgctatttatatttagcctcaaagataccttaaagcgtaggtcatggcctttaaacgaaggtgttatggcggttggtctcgtttctatattggcgtcgtcattactaagaaatgatgtgcccatggctggtccattagtagctggtggtttattaatagcttgttatgtaataactggaacatctgcagatttaactgtcgaaaaagcagcagacatcacgtgggaagaggaagctgaacaaactggcgtatcacataatctaatgataacggtagatgatgacggcacaatgagaattaaagatgacgagaccgagaacattcttacagtacttctaaaaacagcgcttctcataataagtggtgtcttcccgtacagtatacctgcaactctgttagtatggcatacctggcaaaaacaaacacaaagatctggtgttctatgggacgttccctctccgcctgaaacacaaaaagccgaactcgaagaaggcgtttatagaataaagcagcaaggaatatttggtaaaacgcaagtgggagtaggggtacaaaaagaaggagtattccatacgatgtggcacgtgactagaggtgcagttcttacatataacggaaaaagacttgaacccaactgggcatcagtgaaaaaggacttaatctcgtacggaggcggctggcgtctatcagcacaatggcagaaaggtgaagaagtgcaagtgatagctgtagaacccggcaagaaccctaaaaattttcaaactatgcctggaacatttcaaacaactacaggagaaataggcgcaattgccctagactttaaaccgggcacgtctggctcaccaattataaatcgtgaaggaaaagtcgttgggctatatggaaacggggtagtgacaaagaatggcggatatgtgagtggtatagcccaaacaaatgcggagccagacggtccgacacccgaactcgaagaagaaatgtttaagaagcgaaatctgacaattatggatcttcatcctggaagcggaaaaactcgaaagtacctacccgcaattatacgagaggcaataaaaaggcgtcttcgtactttgatattggcgccaacccgagtggtagcagccgaaatggaagaggccttaaaaggcctgcccatcagatatcagaccacggcaacgaaaagcgaacacacgggacgagaaatagttgatctaatgtgccacgcaactttcacaatgcgtttactatcaccggtaagggtacctaattacaacctgattatcatggatgaagcccactttaccgatccggcgtcaatagcagctagaggatacatatccacgagggttggaatgggagaagcagctgcaatctttatgaccgcaaccccgccaggaacagccgacgccttccctcaaagtaatgcacctattcaagacgaagagagagatattccggaacgatcttggaactctggaaatgaatggataactgacttttcaggtaaaacagtttggtttgtaccgtccatcaaagccggaaacgacattgcaaattgcctaaggaaaaatggtaagaaagtaattcaattaagtaggaagacattcgatacagagtatcagaaaacgaaattaaacgactgggatttcgttgttacaacagacatatcggagatgggcgcaaatttcaaagcagacagagttatagacccacggcgatgcctaaaaccggtaattttgactgatggaccagagagagtaattttagctggtccaatgccggtcaccgcagcgtctgccgctcagaggagaggcagggtcggtaggaatccacaaaaggaaaatgatcaatacatttttaccggacaacctctaaacaatgatgaagatcacgctcattggacagaagcaaaaatgctgcttgataacataaataccccagagggtataataccagcgctctttgagcctgaaagggagaaatccgcagcaatagatggcgaataccgtttaaagggagaatctagaaagacatttgttgaactcatgcgaagaggggatctaccagtatggttagcacacaaagtagcaagtgaagggataaaatataccgaccgtaagtggtgctttgacggacaacgaaacaatcaaatcttagaagaaaatatggatgtggaaatctggacaaaagaaggcgaaaagaagaaactacgtcctagatggctagacgctaggacttatagcgatcccttagccctaaaagagtttaaagacttcgcggcgggccgtaaatcgatcgcccttgatcttgtaactgaaatcggcagagtaccgagtcacttggcgcatcgtacaagaaatgcgttagataacttagtaatgctccatacatcagaacatgggggcagagcatatcgtcatgcggtagaggaactgccagaaactatggaaactttactgttattgggtcttatgatattattaacaggaggagcaatgttattccttatctctggaaaaggcatcggtaaaacttcaatcggcctaatctgtgtaatcgcatcttcaggaatgctctggatggcggaaatccctttacagtggatagcaagtgcaatagtgctagagttcttcatgatggttcttttgataccagaaccggaaaaacagcggacaccacaagacaatcaattagcatacgttgtgataggtatacttactcttgcagcgataatagccgccaacgaaatgggactcttggaaacaacgaagagagatttaggtatgagtaaagaaccgggcgtggttagtccaacatcctatctcgacgttgatttacatccggcttcagcatggaccttatatgcagtagcaacaacagttattactccaatgcttcgtcatacaattgagaatagcacagcaaacgtttcgcttgctgcaatagcaaatcaagcagtagtacttatgggtctggataaggggtggccgataagtaaaatggatttgggtgtgccactactagcattgggatgttattcccaagtaaacccgttaacattgaccgccgcagtattactactaataacacattatgcaataattggcccagggctgcaagcgaaagcgactagagaggctcagaaaaggacggccgctggaattatgaaaaatccaaccgtagatggcatcatgaccattgatttagacccagttatatacgatagcaaatttgaaaaacagttaggtcaagtaatgcttttggtattatgcgccgtgcaacttctgttaatgcggacatcttgggcattatgtgaggctttaacattagcaactgggcccataacaaccctatgggaaggatcacccgggaaattttggaataccacaatcgcagtatctatggcaaacatctttagaggtagctatttagccggagctggtttagcattctcaataatgaaaagcgtcggaactggaaaacgtggtactggtagccaaggtgaaacgctaggagaaaaatggaagaagaaacttaatcagttgtcaagaaaagaatttgatttatacaaaaagtcggggataacggaagtcgaccgaacagaagccaaagaaggtttgaaaaggggtgaaataacgcatcacgcggtaagtcgaggatcagctaagttacagtggttcgttgagcgtaatatggtaatccctgaaggacgagttattgatttgggatgtggacgaggaggatggtcatattactgtgctggattaaagaaggtaactgaagtacgcggttacacaaaaggaggccccggccacgaagaacctgttcccatgagcacgtatggttggaacatagtcaaactaatgagtggtaaagatgtcttttatttaccaccggagaaatgtgatactctattatgcgacataggagaaagttccccttcgcctacagtagaagagtcccgaacaatacgcgtacttaaaatggtagaaccatggctaaagaacaatcaattttgcataaaagttctaaatccttacatgcctaccgtgatagaacatttagaaagattacagcgaaagcacggaggaatgttagtacgaaacccactatcacgtaacagtactcatgagatgtattggatatctaatggaacaggtaacatagtagcctctgtgaacatggtatcgaggttattgctcaatagattcacaatgacccatagaagaccaactatagaaaaagatgttgatttaggtgcaggcacacggcacgtaaatgcggaaccagaaactccaaatatggatgtaataggagaaaggattaaaaggatcaaagaagaacataattcaacatggcattatgacgatgaaaacccttacaaaacatgggcataccatggatcctatgaagtaaaggcgacgggctcggcatcatcaatgattaatggtgtcgtaaaattactaactaaaccttgggatgtagtaccaatggtcatacagatggcaatgacggacacaacacctttcgggcaacaaagggtatttaaggagaaagtcgatacccggacacctagatccatgccaggaacaagacgagtcatgggtatcactgccgaatggttatggagaaccttgggcagaaacaagaaaccgcgcctatgtaccagagaagagtttaccaagaaagtacgaacaaatgcagcaatgggcgccgtgtttactgaagagaatcagtgggattccgctaaagcagcagtagaggacgaagacttttggaagctagtagacagagaacgcgagcttcacaagctaggaaagtgcggctcttgtgtttataacatgatggggaaacgcgagaagaaactcggcgagttcgggaaagcgaaggggtcgcgagcgatatggtacatgtggctaggcgcaaggtacttggaatttgaggcactaggttttcttaacgaagatcattggtttagccgcgagaacagttacagcggggtggaaggagagggtctgcacaaattagggtatatattaagggacatcagtaaaataccgggcggagcgatgtatgcggacgatacagcaggatgggacactcgaataacagaagacgatttacacaatgaagagaaaataacccaacaaatggatcctgaacataggcaacttgcaaatgctatctttaagttgacttaccagaacaaggtcgtaaaagttcaaagacccacacctactggcacagtaatggatattatcagtagaaaagatcaacgtgggagcgggcaggtaggaacttacggactgaatacattcacgaatatggaagcacaattaataagacagatggaaggcgagggagtcctgtcaaaagccgacctagaaaaccctcatctttcagagaagaaaataacccaatggttagaaaccaaaggtgttgagaggttaaaacgcatggctataagtggggatgactgtgtagtcaaacctattgatgatagattcgctaacgcgcttttagcattaaacgacatgggaaaagtccgtaaggacattccacaatggcaaccgtcgaaagggtggcatgactggcagcaggtaccattttgttcacatcactttcatgaactgataatgaaagacggaagaaaattagtagtaccatgtagaccccaagacgagctaattggaagggctaggatctcacagggtgcaggatggtcactaagagaaacagcctgtttaggaaaagcctatgcacagatgtggagcctaatgtacttccatcgcagagatttaagattagcatccaacgcgatatgtagtgcagtcccagtccattgggttccaaccagtcgtactacgtggtcaatacacgctcatcaccaatggatgactaccgaagatatgcttactgtgtggaatcgcgtatggatcgaagataatccatggatggaagacaaaaccccagttactacgtgggaaaatgtgccctatttaggtaaaagagaagatcaatggtgcggatccctcataggattaacaagcagagctacctgggcgcagaacatacctaccgcaatacaacaggtacgaagtttaataggaaacgaagaatttctagattatatgcccagcatgaaaagattccgcaaagaagaagaatccgaaggagcgatatggtga

SEQ ID NO: 23075 - RNA, 9873 nt, synthetic construct
  misc_feature 1..9873: note = derived and/or modified CDS sequence (opt6) from DENV-3__GU131878__SS-prME
  source 1..9873: mol_type = other RNA
acatcactgtgtttaatgatgattttaccggctgcattagcgttccatttaacgtcacgggatggagaaccacgaatgattgttggtaaaaatgaacgcggtaaatcgttattattcaaaactgccagcgggataaatatgtgtacgctaatagccatggacttaggggaaatgtgtgatgatactgtcacgtacaaatgtccacatataacagaagtagaacccgaagatattgattgctggtgtaatttgacatcgacatgggtcacatatggaacttgtaatcaagcaggagaacggcggcgagataaaaggagcgttgcacttgctccacatgttggaatgggccttgatacgagaacccaaacatggatgtctgctgagggagcgtggcgccaagttgaaaaagtagaaacatgggcacttcgtcatccgggctttacgatattagcactatttttggcacattacatcggaacatcgttgacgcagaaagtcgttatctttatattgttaatgctggtcacacctagcatgactatgagatgtgtaggggtaggaaatagggactttgtcgaggggttatcaggagcaacatgggtggatgtagtattagagcatgggggttgtgtaacaaccatggcgaaaaacaaaccaacactggacatcgaactgcagaaaacagaagccacacaacttgcgactttaagaaaattatgcattgaaggaaaaattacaaacataacgactgacagtaggtgcccaacccaaggagaagcagtgctaccggaggagcaagatcagaattatgtgtgcaaacatacctatgtggatagaggatggggaaacggctgtggtttattcggaaaaggcagtttggtaacatgcgcaaaatttcaatgtctagaacttatagaggggaaagtagtgcagtatgaaaacttaaaatataccgtaataatcacagtgcacaccggtgaccaacatcaagtaggcaatgaaacccaaggtgtaacggcagaaataactcctcaggcgtcgactaccgaggcgatactgccagaatatggtacattgggactagaatgctcacccagaacgggcttggacttcaacgaaatgatcctgcttacaatgaaaaacaaagcatggatggttcacagacaatggttcttcgacctgccgctaccttggacaagtggagcaacaaccgagaccccgacttggaatcgtaaagagttactggtaaccttcaagaacgctcacgccaagaaacaagaggtcgtagttctaggaagtcaagaaggcgccatgcacacagctctaactggagccactgaaatacaaaattctgggggtacttcgatatttgcaggacatctaaaatgtcgactaaaaatggacaaactcgaacttaaaggtatgtcttatgcaatgtgtacgaataccttcgttcttaagaaagaagtaagtgagacacagcacggaacaattttgattaaagttgaatacaaaggtgaagacgcaccttgcaaaattcccttttcgacagaagatggtcagggtaaagctcataatggccgactcattacagcaaatcctgtagttaccaagaaagaagaacccgtaaatatagaggcggaaccacccttcggagagtcaaacattgtcataggtacaggggataacgcactgaaaataaattggtataagaaagggagctcaattggaaaaatgttcgaggccacggcgcgaggtgcgagacgaatggcaatactcggtgacacggcatgggattttggatccgttggaggagttctcaattcattaggaaaaatggtacatcagatcttcggctctgcttataccgcattattttcaggagtttcttgggtaatgaaaataggaataggagtactcctaacatggataggattaaattcgaagaacacctcaatgtctttctcatgtatagcaatagggattataactttatacttaggtgcagtagttcaagccgatatgggatgtgtaataaactggaaaggaaaagaactcaaatgtggaagcgggatctttgtaacaaacgaagtccacacctggacagaacagtataaatttcaagcagattcaccgaaacgacttgccactgctatagcaggagcttgggaaaatggcgtgtgcggaatccggtcaacaacgcgtatggagaatttactatggaagcagattgcaaacgagttaaactatatattatgggaaaataacattaagctaacggtagtagtaggagacattataggagttttagaacaaggtaaacgaacactgacaccccaaccgatggaattgaagtacagctggaaaacctggggtaaggcaaagatagtaacagccgaaactcagaactcgtccttcataatcgacggtccgaatactccagaatgcccttcagcgtcccgagcatggaatgtatgggaagtggaagattatggttttggggtttttacgacaaatatatggctaaaacttagagaagtttatactcagttgtgcgaccatcgattaatgtccgcagcagttaaggacgaaagagcagtacacgcagacatgggttactggatagaatcgcaaaagaatggaagttggaaacttgaaaaagcctcattaatcgaggtaaagacctgcacatggcccaagtctcatacactctggagtaatggggtactagaaagtgacatgatcatacccaaatcactagcaggcccaatatctcagcacaatcatagaccaggatatcatactcaaaccgcgggaccatggcaccttggaaagctagaattagactttaattattgtgagggtactaccgttgttatcaccgaaaattgtggaacacgaggtccgagtctaaggactacaacagtatcaggaaaattaatccatgaatggtgctgtaggtcttgcactctccctccacttaggtatatgggagaagatggttgctggtacggtatggaaatcagaccaatttcagaaaaggaagaaaatatggttaagtcgttagtaagtgccggatcgggaaaagtagataattttactatgggtgttttgtgtttggctatactattcgaggaagtaatgagagggaagttcggcaagaaacatatgatagcaggcgtattctttaccttcgtcctactcctttcaggacaaattacttggcgcgacatggctcatacactcataatgatcggatctaatgccagtgaccgaatggggatgggagtcacgtatttagcattaatagcaacttttaagattcagcctttcctagcacttggattctttctaagaaaattaacatcgagagaaaatctattattaggcgtaggcctcgctatggcaactacattacaattacccgaagacatagagcaaatggctaatggcattgcgcttgggttaatggcactgaaactaatcacgcaattcgaaacttatcagctgtggactgcgttaatcagcctcacatgttctaatacgatgtttactctcacagtggcttggaggactgcaaccttaattctggccggcgtgagtttattacctgtatgtcagtcatcatctatgcggaagactgactggttacccatggcagtagctgccatgggtgttccaccattaccgctatttatctttagtcttaaagataccctaaagcggagaagctggccattgaacgagggcgtgatggcagttggacttgtaagtatattagcgagttctcttcttagaaacgatgtgccaatggccgggcctttggttgctggtggactgttaattgcctgctacgttataacgggaacatcggccgacctcactgtagaaaaagcggcagatatcacatgggaagaggaagcagaacagacaggagtgtcgcataatctcatgataacagttgacgatgacgggaccatgcgcataaaagatgatgagacagaaaacatattgacagtcttattaaagacagcactattgatagtatctggtgtatttccatactctattcccgcgactctcctggtctggcacacttggcaaaaacaaacgcaaaggagtggtgtactttgggatgtaccaagccctccagaaacccagaaagctgagctggaagagggagtatatcgaatcaaacagcagggcatctttggaaaaactcaagttggcgtaggtgtccaaaaggaaggagtcttccacacaatgtggcacgtaactaggggcgcagtcctcacctacaatgggaagcgcttagaaccgaattgggcgtcagttaagaaagatcttattagttatggcgggggttggagattatctgcacaatggcaaaaaggggaggaagtacaagtaattgccgtcgaacctggcaaaaatcccaaaaacttccaaactatgccgggaacatttcaaacgactacaggtgaaataggagcaattgccctagattttaaaccagggacatcgggttcgccaattatcaatagggagggaaaggtcgtaggtctatatggtaacggtgtggtaactaaaaacggcggctatgtttctggaatcgcccaaacaaacgcggagcctgacggtcccactcctgagctagaagaagagatgttcaagaaacggaatttaacgataatggacctacatcctggtagtggtaaaacgagaaaataccttccagcgatagtcagggaggcaataaaacgacgattacgaaccttaattctagcgccaaccagggtagttgccgctgagatggaagaagcgctaaaaggtttacctatacgatatcaaacgactgctaccaagtcagaacatacaggaagagaaattgtagatttaatgtgccatgcaacatttacaatgagactattaagccctgttcgcgttcccaattataaccttataataatggatgaagcacatttcacagaccccgcaagtatagccgcacgcggatatatttcaactcgagtaggcatgggagaagctgcggcaatcttcatgacagctactcccccagggacggctgatgcattcccacagtcaaatgcacctatacaagatgaagaacgtgacatcccagagaggagttggaactctgggaatgaatggatcacggatttcgcgggcaaaactgtgtggttcgtaccgtcaataaaagccggcaacgacattgctaactgtttacgcaaaaacggcaagaaagtcatccagttatcaaggaaaaccttcgacacagaataccagaaaactaaactaaatgattgggatttcgtcgtgactaccgacatttcagaaatgggggcaaattttaaagcagatagagtgatagaccctagaagatgcctcaaaccggttatattgacagacggtccagaaagagtaatccttgcggggccaatgcccgttacagcagcttctgcagcacaacgaagggggcgcgttggtcggaatccgcaaaaggaaaatgatcagtacatttttactggacagccattaaacaatgacgaggaccatgctcactggacggaggctaaaatgttacttgataatataaacacaccagaaggaataattccagctcttttcgaacctgaacgtgaaaaatcggctgcgatagacggtgagtaccgccttaaaggagagtcacgaaagactttcgtggaactaatgaggagaggagacctaccagtatggttagctcataaggtagcatcagagggtataaagtacacagatcggaaatggtgttttgatggccaacgaaataatcaaatactagaagagaacatggacgtagaaatatggacaaaagaaggtgaaaagaagaaacttagaccccgctggctagatgcaagaacatattcagatcctctggccctaaaggaatttaaggattttgcagcaggacgtaagagtattgcgctggatcttgtcactgagattggcagggttccttcgcatctagcacatagaacccgaaatgccctggacaacctagtaatgctacacacatctgaacacggtggtcgtgcctatagacatgctgtagaggaactacccgaaacaatggagacattgctactactaggattaatgatattattgacgggaggagcaatgcttttcctaatatccggaaaaggtataggtaaaacctcaattggactaatttgtgtaattgcaagctcaggtatgttatggatggcggccataccgttacaatggatagccagcgctatagttttagaatttttcatgatggttttgttaataccggaacctgaaaaacaacgcaccccacaagataatcaacttgcgtatgtagtaataggcatattaacactagcagcaataattgcagcaaatgagatgggcctactagaaacaacaaagagggacctaggaatgagcaaagagccgggagtagtatcaccaacttcttatcttgacgtagatctacaccccgcatcagcttggacactctatgctgtcgcaactacagtgatcacgccaatgctacgacatactatagagaatagcactgcaaacgtatcactggctgccattgcaaaccaagctgtcgtattaatgggtttagataagggctggcccatctcgaaaatggatctaggtgtaccgttgctggctttaggatgttattcccaggttaacccattaacattaacagcagcagtattactactaattacccattacgcgataatagggcctggattacaggccaaggcaacccgtgaggcgcaaaagagaaccgcggccgggataatgaaaaatccaacagtggacggaataatgacaatagacctagatccggttatttacgactccaaattcgaaaaacaacttggacaggtgatgctcctagttctatgcgctgtacaacttttattgatgagaacatcttgggctctgtgtgaggctttaacacttgcaaccggacctattacaactctttgggaaggaagtccaggaaaattctggaatacgacaattgcagtttcaatggctaacatattcagaggtagttatttagcgggtgcagggctcgcattctcaataatgaaaagtgttggaactggcaagaggggtaccgggagccaaggcgaaactctaggcgaaaaatggaagaagaaattaaatcaactgtctcggaaggaatttgatctctataagaaatcaggaataacagaagtcgaccgcaccgaggccaaagaaggtctaaaaagaggggaaatcacacatcacgcagtatcacggggatctgctaaattacaatggtttgttgaacgcaacatggtaatcccagaagggagagttatagacttaggatgtggtcggggcggttggtcctactactgtgcaggattaaagaaagtcactgaagtaagaggctacacaaaaggagggccaggacatgaggaaccagtaccaatgagcacatatggctggaatattgttaaactaatgagtggcaaggacgtattttacctgccgcctgaaaagtgtgacacactattgtgtgatataggagaatcatcaccatcacctactgttgaagaaagccggaccatacgagtacttaagatggtcgaaccttggcttaaaaacaatcaattttgtataaaagtcctgaatccttacatgccaacggtaatcgaacatctcgaacgactacaacggaaacatggaggtatgttagtccggaacccattaagccgtaactcaacccacgaaatgtactggatttccaatggaactggcaatatcgtcgcaagtgttaatatggtgtcacgattacttctgaatcgttttacaatgactcatagaaggccgactattgaaaaggatgtcgatctgggagctggaacgagacatgttaacgcggaaccagaaacaccaaatatggatgtaataggtgagagaatcaaaaggattaaagaggaacacaattcgacatggcattatgatgatgaaaacccatataagacatgggcatatcatgggtcctacgaagtaaaagcaacgggatcagcgagttctatgatcaacggtgtagttaagttgcttaccaaaccgtgggatgttgttccaatggtaacacaaatggctatgacagatacaacaccattcggtcaacaaagggtattcaaagagaaggtagataccaggacaccgagaagcatgccgggaacgcgaagggtaatgggaataaccgctgagtggttgtggagaacacttggaagaaataagaaaccaagactgtgtaccagagaagaatttacaaagaaagtaaggacgaacgctgctatgggagcagtatttacagaggagaatcaatgggattcagcaaaagctgctgtagaggatgaagacttctggaaacttgtcgatcgggaacgagaattacataaattaggaaaatgtggtagctgcgtatataatatgatgggtaaacgtgagaagaaattaggcgaatttggaaaagccaaaggcagtagggcaatctggtacatgtggttaggcgccaggtacttagaatttgaggctctcggattcttaaatgaagaccactggttttcccgagaaaactcgtactccggtgtcgaaggcgagggtttacacaaacttggctacattcttagagacatcagtaaaatcccaggtggcgcaatgtatgcagatgacactgcgggatgggatactagaataactgaagacgatttacataatgaggaaaagatcacccaacaaatggatccagaacatagacaactcgcaaacgcaattttcaaattaacataccaaaacaaagtagtcaaagtccagaggcctacaccgacagggacggtcatggatataatatcgagaaaagatcaaagaggatcagggcaagttgggacatacggattgaatacattcacgaacatggaggcccagttaataagacagatggaaggagagggagtgttatccaaagcagacttagagaatccccatctgccggagaagaaaataacgcaatggctagaaactaaaggggtcgaaagactgaagcgaatggccatcagtggggatgactgtgttgtcaaacccattgacgatagattcgctaatgcattactggcattaaacgatatgggaaaagtaagaaaggatataccccaatggcagccctccaaagggtggcacgattggcaacaggttcctttttgctcccatcattttcatgaactaataatgaaagatgggagaaaacttgtggtaccctgtcgtccccaagatgaactgataggacgcgctcgaatctctcaaggagctggctggtccttacgcgaaaccgcctgtctagggaaagcatatgcccaaatgtggtcgctaatgtattttcacaggagagacttacgactcgcgagcaatgccatttgttccgcagtacctgttcactgggtgcccacatctcggacaacgtggtctattcacgcacaccatcagtggatgactacggaagatatgctcacagtgtggaaccgtgtctggattgaagacaacccctggatggaagataaaacgcctgtcacaacttgggaaaatgtcccatatttgggaaagcgcgaagatcaatggtgcggttcgttaatcggattaaccagtcgagccacttgggcgcaaaatattcccacagcaatacaacaagtgcgaagcctaataggcaacgaagaatttctagattatatgccaagtatgaagagattcagaaaagaagaggaatctgaaggagcgatatggtaa

SEQ ID NO: 23076 - RNA, 9873 nt, synthetic construct
  misc_feature 1..9873: note = derived and/or modified CDS sequence (opt6) from DENV-3__FJ898455__SS-prME
  source 1..9873: mol_type = other RNA
acgagcttgtgtttgatgatgatgctacccgcaacactagcatttcatctaacatcaagagacggagaaccgcgaatgatagtgggtaaaaacgaaaggggaaaatcattgttattcaaaacagctagtggaattaatatgtgcacacttatcgcaatggatctaggagaaatgtgtgatgatacagtaacgtacaaatgtcctctcattacagaagtagaacctgaagatatcgattgctggtgtaatctaacaagtacatgggttacatacggtacatgcaaccaagctggggaacatagacgagataaaaggagcgtagcattagcaccccacgtgggaatgggattagatacacgaacccaaacttggatgagcgcggaaggagcctggaggcaagtagaaaaagtcgaaacatgggctttcagacatccgggattcacaatattagcacttttcctagctcattacataggtacctcacttacacaaaaagtcgtgatattcatactgctcatgttagtaacaccgtctatgacaatgaggtgtgtaggggtcgggaatagagattttgtagaaggactctcgggagcaacatgggttgacgtagttctagaacacggaggctgtgttacaacaatggccaaaaataaaccaaccctggacattgaactacagaaaactgaagcaactcaactagctactcttagaaaactatgtattgaggggaaaataacgaatgtaacaactgattcccgatgtccaacccaaggggaggccatcttgccagaagaacaagaccaaaactatgtatgcaaacatacttatgtggatcgagggtggggtaacggctgtggtttatttggtaaaggtagcttggtcacatgtgccaaattccaatgtctggaaagtattgaaggaaaagcagttcagcatgaaaacttaaaatatacagtaataatcaccgtccataccggagatcaacaccaagtagggaatgaaacacaaggtgtaacggcagaaataaccccgcaagcgagtactgtcgaggccatcttgccagaatatggaacgttgggcctggaatgttccccgcgcacgggactcgattttaatgaaatgattttgctaactatgaaaaataaagcatggatggtacatcgccagtggttcttcgatctacccttaccgtggacgagcggagctacaactgagacacccacttggaacaagaaagagctacttgtcacttttaaaaatgctcatgctaagaaacaagaagtggtggtactagggtcgcaggaaggagctatgcatacagcgcttacaggtgcaacagaaatacagactagcgggggcacgagcatttttgccggacatttaaaatgtcgcctcaaaatggacaaactcgaactaaaaggaatgtcttatgctatgtgtctcaatgcattcgtcctaaagaaagaagtaagcgagactcagcatggaacaattctaataaaagtagagtataaaggtgaagacgcaccctgtaaaatcccctttagcactgaagatggacagggtaaagcacataacgggcgcttaataacagccaatccaatcgtaaccaagaaagaagaaccggtaaacatagaagctgaaccacccttcggtgaatcaaacatcgtcatagggataggggacaaagctctcaaaatcaactggtataagaaagggagttcaattggcaaaatgttcgaagcaaccgcacggggcgctaggaggatggccattctcggggatacagcctgggacttcggttcggtagggggagtactcaacagtttaggcaaaatggtccaccaaatatttggaagcgcttataccgcgctattttctggagtatcatggataatgaaaattgggatcggcgtactcttaacctggatcgggctaaattccaagaacacatcaatgtccttcagttgtatagttattggaataataactttgtaccttggtgctgtagtccaagcagacatgggatgcgtcatcaattggaaggggaaagaactaaagtgtggctcaggcatctttgtcacaaacgaggttcatacatggacagaacaatataagtttcaggcagattctccaaaaagattggctacagctattgctggagcctgggagaatggagtctgtggaataagatccactactagaatggaaaatctgttatggaaacaaatcgctaacgaactaaattatatattgtgggaaaataacattaaacttacaatagtcgtgggtgatgtcattggcgtacttgaacaaggaaagcgaactttaaccccacaacctatggaactaaaatactcctggaaaacatggggtaaggcaaaaatagtaacagctgaaacacaaaattcaagttttataattgatggacctaacacacccgagtgtccaagtgcgagtcgtgcgtggaatgtatgggaagttgaggattacggatttggagtttttacaacaaatatctggttaaaactaagggaaatgtatacgcaactctgcgatcacaggctaatgtctgctgcagtgaaagatgaaagagcagtacacgctgacatgggatactggatagaatctcagaagaatgggtcttggaaacttgaaaaggccagcttaatagaagttaaaacatgtacgtggccgaaatctcatactttatggagcaatggagtgctggaatcagatatgattattcccaaaagtctagctggaccaatcagtcaacataactaccgaccgggttaccatacccaaactgccggcccgtggcatctagggaagttagaactagattttaactactgtgaaggtactacagttgtaatcacggaaaattgtgggacacgaggaccttcactaagaaccacaacggtttctgggaaactaatacatgaatggtgctgcagatcatgcacattacctcccctaagatatatgggcgaagatggttgttggtatggaatggaaataagaccaatcaacgaaaaagaagaaaatatggtaaaaagtttagtttctgctggatccgggaaggccgataacttcactatgggggtactctgcttagcgattttattcgaagaagttatgcgcggcaaattcggcaagaaacacatgatcgctggcgctttatttacatttgtattactactaagcggtcaaattacgtggcgtgatatggcacacactttaatcatgattggcagcaatgcgtctgacagaatgggaatgggagtaacttatctagcgcttatagcgacatttaaaattcaaccatttctggctttagggttcttcttacgtaagctaacctcgcgcgaaaatttacttttaggtgttggattagcgatggccactacactgcagcttcccgaagatatcgaacaaatggcaaatggaatagctttaggtcttatggctttaaaattaataacacaattcgaaacataccagttatggacagcgctagttagtctaatgtgctcaaatacgatatttaccttaactgtagcatggaggaccgctacgctaatactcgcggttatcagcttgctcccagtatgccaaagttcttcaatgcgtaaaacagactggcttcctatgacagtcgccgcgatgggagttcctcccttaccactcttcatatttagccttaaggacacgctcaaacgtaggtcttggcctctaaatgaaggagttatggccgtagggctagtgtctatactagcatcgtcatttctacgaaatgatgttcctatggcggggccattggtggctggaggtctccttattgcatgttatgtaataaccgggacttctgctgatttaaccgtagagaaagcggcggatgtcacatgggaagaagaggcagaacaaacaggggtaagtcacaatctaatgattacagttgatgacgatggaaccatgcgaattaaagacgacgaaacggaaaatattctcacagttttgctgaaaacagcactattaatcgtaagtggaatattcccatattcgatcccggcaacactattagtctggcatacatggcagaaacaaactcaaaggagcggagtactctgggacgtaccgtcacctcctgaaacacaaaaagccgagttggaagagggggtgtacagaataaagcaacaaggcatctttggaaaaacacaagtaggggttggagtacataaagaaggtgtcttccatactatgtggcacgttacaagaggagcggtgcttacgcacaacggcaaacgattagaaccgaattgggcaaacgtaaagaaagatctaattagttacggtggcggttggaaactaagcgctcaatggcaaaaaggagaagaagtacaagtaatagcagtagaaccaggcaaaaatcctaaaaattttcaaacaatgccagggattttccaaactacgacaggagaaattggtgctatagccctagatttcaaacccggaacttctggttctccaattataaacagagaaggtaaagttgtaggactttacggcaatggtgtagtaactaagaacggaggttacgtatccggtattgcccaaacaaacgctgaaccggacggtcccacacctgaactcgaagaggaaatgttcaagaaacgaaatctgacaataatggatctccatccaggatccggaaaaacgagaaagtatctgccggctatcgtaagagaagcaattaagagaagactaagaactctaatattggcaccaactagagtagtcgctgcagaaatggaggaggccttaaaaggtctcccaatcaggtatcaaactactgcaactaaatcggagcacactgggagggagattgttgatcttatgtgtcatgccacatttactatgcgtctgctatcaccagtaagagtaccaaactataacctcatagtaatggatgaggcacacttcactgatcctgcaagcattgcggcaagaggatatatttcaaccagggtcggaatgggcgaggcagctgcgatctttatgacggcaacaccacctggcacggctgacgcgttccctcaaagtaacgcacctatacaggatgaagaacgagatattcctgaacgatcatggaactctggaaatgaatggataactgattttgctgggaagactgtgtggtttgttccttcgattaaagcaggaaacgacattgccaactgtctacgtaagaacggaaagaaagttatccagttgtcgcggaagacttttgatacagagtatcaaaagactaaattaaacgactgggattttgtcgtaacaacggatattagtgagatgggcgcaaacttcaaggccgacagagtaatcgaccccagacgctgtttaaagccagtgattttaactgatggacctgaacgtgtaatattagctggaccaatgccagtgactgtagctagcgcagcccaaagacgaggcagagtcggaaggaatccacaaaaagagaatgaccaatacatatttactggtcaacctctaaacaatgatgaggatcatgcccattggacagaagccaaaatgcttttagataatattaacacacctgaaggaataatacctgctttatttgaaccagagagggagaagtcggcggcaatagatggagagtaccgactaaaaggggagtctagaaagactttcgtggagctaatgagaagaggagatttgccagtatggttggcacataaggtagcttccgaaggaattaaatatacggaccgcaaatggtgttttgatggggaacgcaataatcagatattggaagaaaacatggacgtggagatttggactaaggaaggagaaaggaagaaattacgtcctaggtggttagatgcacgaacgtatagtgatcctcttgcattaaaagagtttaaagacttcgctgctggtagaaaaagcatagctctggatctcgttaccgaaattggacgagtcccctcccatctcgcacatagaacacgcaatgctttagataatttagtgatgcttcacacgagtgaacacggaggtagagcttaccgacacgctgttgaagaactacctgaaacgatggaaaccttacttcttctgggactcatgatattattaactggaggcgccatgttattcctcatctcgggcaagggtattgggaaaacgtcgattggcttgatatgtgtagtcgctagttccggtatgctttggatggctgatgttccattacaatggatagctagtgccatagtgttggaatttttcatgatggtattgcttataccagaacccgaaaagcaaagaacacctcaagataatcaactagcctatgtagttatcggaatccttacattagctgcaatagtagcagcaaacgaaatgggacttcttgaaacaacaaagcgagatctagggatgtcgaaagagcctggtgtagtttcacctacaagttacttagatgtagatcttcatccagcatccgcatggacgctgtacgcggtcgcaacaactgttataacacccatgttgcgtcatacaatagagaactcgactgcgaacgtttctcttgcagccattgcaaatcaagcagtagtattaatgggactagacaaaggatggccgattagtaaaatggatttaggtgttcctttattagcattaggttgttatagtcaagtgaatccattaacactgacagcagcagtactattattagtaacgcactacgcgattattggtccaggattgcaagcaaaggcaacgcgcgaagcacagaagagaacagcagcaggtataatgaaaaatcctacagtggacggtatcatgacgattgatttagacccagtcatctacgattcaaaattcgaaaagcaacttggacaggtaatgctactcgttttatgtgcagtacagttactcttaatgaggaccagctgggcattttgcgaagcactaactttagcaaccggacctattacaactctttgggaaggcagtcctggaaagttctggaacactacaatagcagtgagcatggctaatatattcagaggttcatatctagcgggtgcaggtttggcattttctataatgaaaagtgtgggtacgggaaagaggggtaccgggtcacaaggagagacattaggagaaaaatggaagaagaaattaaaccaattaagccgaaaagagtttgatttatacaaaaagagtggcattacggaggtagaccggacagaggcaaaagagggcttgaagaggggagaaatcacacatcatgcagtatcaagaggtagtgcaaagttacaatggttcgtagaaagaaacatggtaatccctgaaggccgagtaatcgatttaggctgtggaagaggtggctggagttactattgcgccggactcaagaaggtcacagaagttaggggttacacaaaaggaggtcctggccatgaagaaccggtccctatgtcaacttatggctggaacattgtcaaactgatgagtgggaaagacgtattctacttacctcctgagaagtgcgatacacttttgtgtgatataggggaaagttcgcccagtcccacggttgaagaaagtagaaccattcgtgttttgaaaatggtggagccatggttgaaaaataatcaattctgtataaaagtcctgaacccatatatgccaacggtcatagagcacctcgaaagacttcagagaaaacacgggggtatgctggtccgaaatccactgagccggaactcaactcatgaaatgtattggatatcaaacggtacaggaaatatagtaagttctgtaaacatggtttctaggttattattaaatcggttcaccatgacgcacagacgacctacaattgaaaaggatgtagatttaggcgcggggactaggcacgttaatgctgaacctgaaactcctaacatggacgtaattggagagagaattaggcgcataaaagaagaacactcatctacctggcattatgatgacgaaaatccatataaaacctgggcctatcatggaagttacgaagtcaaagcaacaggttccgcatccagtatgataaacggtgttgtaaaattattaacgaaaccttgggacgtggtaccgatggtaacacaaatggctatgacagatacaacgccctttgggcaacaacgcgtatttaaagaaaaggtagacacgcgaacaccacgacctatgccgggtactcgcaaggtgatggagatcactgctgaatggttatggaggacattgggaagaaataaacgaccgcgattatgtacgcgagaggagttcattaagaaggtaaggacaaacgctgctatgggagcagtattcacagaagaaaaccaatgggatagcgcacgcgctgctgtcgaagatgaagagttctggaaattggtagaccgagaaagagaattgcataaattagggaaatgtggatcgtgtgtttataatatgatggggaagagagagaagaaacttggagagttcggaaaggcgaaaggatcaagggcgatatggtacatgtggttgggtgccaggtatcttgagttcgaggcattgggattcttaaatgaagatcactggtttagtagagaaaactcttattcgggggttgaaggagaaggattgcataagttaggatatatacttagagatattagcaagattcccggtggggcaatgtatgctgatgacacggcgggatgggacacccgaatcacggaagacgaccttcataatgaagagaaaataacacagcaaatggacccagagcatcgacaattagcgaacgcaatttttaaattaacgtatcaaaataaagttgtgaaagtacaacgccctacacccaaaggtaccgttatggacattatctctagaaaagatcaaagagggagtggacaagtgggaacatatggtttaaacactttcaccaatatggaggcgcaacttataagacaaatggaaggtgagggggtcctaagcaaagccgatttagaaaacccacatctactggagaagaaagtgacccagtggttggaaactaaaggagtagaacgactaaaacggatggctatttccggggatgattgtgtggttaaaccgattgacgatcgattcgcgaacgcattattggctttaaatgacatgggcaaagtgcgcaaggacattccacagtggcaaccgagcaaggggtggcatgactggcaacaagttcctttttgttctcaccactttcacgagctcataatgaaagatggacgtaagttagtcgtcccgtgtaggccacaagacgagttaataggtcgagcgagaatctcacaaggagcaggatggagtcttcgtgagacagcatgcttagggaaagcatacgcgcaaatgtgggcactaatgtactttcaccgaagagaccttcgactagcgtcaaacgctatatgcagcgcggttccagtgcactgggttcctacctctaggacaacgtggtcaatccacgcccatcaccaatggatgactacggaagatatgcttacagtatggaacagagtctggatcgaagataatccttggatggaagacaaaactccagtaaccacctgggaggatgtaccttatcttggaaagagagaagatcaatggtgcggatcgctaattggattaacttcacgagcaacgtgggctcaaaatattctaacagccatacaacaagtccgctcactaataggtaatgaggagtttttggactatatgccaagcatgaagaggtttagaaaagaagaagagtcagaaggagccatatggtag

SEQ ID NO: 23077 - RNA, 9873 nt, synthetic construct
  misc_feature 1..9873: note = derived and/or modified CDS sequence (opt6) from DENV-3__GQ199891__SS-prME
  source 1..9873: mol_type = other RNA
acatcattatgcttaatgatgatcttaccagcagcactagcatttcacttaaccagcagggatggggaacctaggatgatcgttggcaaaaacgaaaggggaaaatctctgcttttcaaaacagctagcggtattaacatgtgcacactaatagccatggacctaggcgaaatgtgtgatgatacagtcacctataaatgtccacatatcactgaagtggaaccggaggatattgactgttggtgtaacttaacaagcacttgggtaacttatggtacttgcaatcaagcaggggaacatcggagagataagcggagtgtcgccttggctccacacgtaggtatgggcttagatacaagaacacaaacgtggatgtccgccgagggggcatggcgacaggttgaaaaggttgagacatgggcactgaggcaccccggatttacaatattagcgctattcttagctcattatattggcacatcattaactcaaaaagcagtcatcttcattttactaatgctagtcactcctagtatgaccatgagatgtgtaggagtaggaaatagggattttgttgagggactatctggggcaacttgggtggacgtggtattagaacatgggggatgtgtcacaactatggcaaagaataaacccactctagatattgaattgcagaaaaccgaagcaacacaacttgctaccctcagaaaactttgcattgaagggaagatcacaaatataacaacagattctaggtgtccaacgcagggcgaagcagtgctaccggaggagcaagaccagaattacgtctgcaaacatacatatgtagatagaggttggggaaatggttgtggtctgtttggcaaaggtagtctagtcacatgtgctaaatttcagtgtttagaaccaatagaagggaaagtagtacaatatgaaaaccttaaatacactgtaataataacagtacacacaggggaccaacatcaagtgggaaatgaaacacaaggcgttacagcagagattacgccacaagccagtacaactgaagctattttaccagaatatgggacactaggactagaatgtagtccccggaccggcttggattttaatgaaatgatattactaacaatgaaaaataaggcctggatggtacatagacaatggttctttgatctaccacttccatggacttcgggtgcaaccacagaaacaccaacctggaatcgaaaagaactcttagtaactttcaaaaatgcacatgctaagaaacaagaagtagtagtactgggttcgcaagagggtgctatgcacacggctttaacgggagcaactgaaatacaaaattcaggagggacatcaatatttgctggtcacttgaaatgtcgtctaaaaatggacaaattagaactaaaaggcatgtcatacgcgatgtgcactaatacatttgtgttgaagaaagaagtttctgaaacacagcatggaacgatactcataaaagtcgagtataaaggggaagatgtcccatgtaaaataccattctctactgaggacggccaaggcaaggcgcataacggcagacttatcaccgcgaatccagtagtaacgaagaaagaggaacctgtgaatattgaagcagaaccgccgtttggagaatctaacatcgttataggaataggagacaatgcactcaagataaactggtacaaaaaggggtcatcaatagggaagatgttcgaagcaacggccagaggggcgagaagaatggctatattgggggatacagcttgggattttgggagcgtaggtggagtactaaactctctaggaaaaatggtacatcaaattttcggcagtgcgtacaccgcattatttagcggtgtgtcctgggtaatgaaaattggtataggagttctactaacttggataggtttaaacagcaaaaatacatcaatgtctttcagttgcatcgcaattggcattattactctctatttaggagcagtcgtacaggcggacatgggatgcgtcataaactggaagggtaaggagcttaagtgtggttctggaatatttgttacaaatgaagttcacacatggactgagcaatataagtttcaagcggactcaccgaagcgtttagccaccgcaatagctggagcttgggaaaatggcgtctgtggaataaggtcaacaacaaggatggagaacttattatggaagcaaatagccaatgagttgaattatatactatgggagaacaatattaaactaacagtagtggtcggcgatataataggagtgctagagcaaggaaaacgaacattaacaccacagcccatggagttgaaatattcgtggaaaacatggggtaaggcgaaaatcgtaaccgcagaaacacaaaattcaagtttcatcatcgatggtccaaatacaccagagtgcccgtctgcttctcgagcttggaatgtatgggaagtggaggattacggctttggagttttcacaacgaacatatggctaaaactaagggaggtttatacacaactatgcgaccatagactgatgtcagctgctgtgaaagatgaacgcgctgttcatgcagatatggggtattggatagaaagccagaaaaatggcagctggaaactagaaaaagcatccctcatagaagtgaaaacatgtacatggccaaaatcccatacattatggagtaacggagtattagaatccgacatgatcataccaaagtctttggccgggccaatttctcaacataactaccgaccaggataccatacgcaaacagcaggaccatggcatctcggaaaacttgaattagacttcaattattgcgaaggaaccacggtcgttataacagagaactgtggaactagaggtccgtcacttagaactacaactgttagtggcaaattaattcatgagtggtgctgtagaagctgcacattacccccacttaggtatatgggcgaagatggatgttggtatggtatggaaatacgtccaattagtgaaaaagaagaaaacatggttaaaagtctagtttcagcaggtagcggtgaggtagataatttcaccatgggtgtcctatgcttggctattttattcgaagaagttatgaggggaaaattcggaaagaagcatatgatagcgggggtatttttcacattcgttctgttattatcaggtcagataacatggcgagatatggctcatactttaataatgattgggtctaacgcttcagaccgtatggggatgggtgtcacgtatctagctctcatagcaacgtttaaaattcaacccttcttagctcttggcttctttttaaggaaactcacaagtagggagaatctattactgggggtagggctagcaatggcaacaacgctacagctcccagaggatatagagcagatggctaatggtatcgccttagggctaatggcccttaaattaataactcaatttgaaacctatcaattatggacagcattaatttcgttaacttgttccaacactatatttacattaacagtagcttggagaacagcaacccttattctagcaggagtatctcttttaccagtttgtcaaagttcttcgatgagaaaaactgactggttacctatgacggtagcagctatgggagtaccacctttaccgttatttatattttcattaaaagacaccctaaaaaggagatcctggccgttaaacgagggggtaatggccgtggggctcgtaagtatactcgccagttcactccttcggaatgacgtcccaatggcgggtccacttgtagctggtggactactgattgcgtgctacgtgataactggaacttctgctgaccttaccgtagaaaaggctgccgatgtaacatgggaagaggaagcagaacaaacaggagtatcacataatttgatgataaccgttgatgatgacggtacaatgagaataaaagacgatgaaacagagaatattcttacggttctattgaaaacagcattattgattgtatcgggaatattcccatattcgatacccgctacattattagtgtggcacacttggcaaaaacaaactcaaagaagtggtgtgttgtgggatgtaccatccccgccagaaacacaaaaagctgagcttgaagagggtgtttatcgaataaaacaacaaggcatattcggcaaaacacaagtaggcgtaggtgtgcaaaaagagggtgtttttcatacaatgtggcatgttacacgaggggcagtattaacatataatggcaaacgtctggaaccaaactgggcaagtgtgaagaaagacctgatctcgtatggtggcggctggcgtttatctgcacaatggcaaaagggtgaggaggtacaggttatagcagtagaacctggaaagaatcccaaaaattttcaaactatgccgggaacgtttcagactaccactggggaaattggtgcgatagcgttagacttcaaaccagggacaagcggaagtcccataataaatcgagagggaaaggtggtaggactctatgggaacggagttgtcactaaaaacggcggatacgttagcggcatagctcaaacaaacgcagaacctgatggaccaacgccagagttagaagaggaaatgttcaaaaagagaaatttgaccatcatggacctgcatccgggaagcggtaagactcggaaatatctaccagcgatagtaagagaagcaataaaaaggagacttaggactttgatattagcacccactagagtggttgcagctgaaatggaagaggcgctaaaagggttgccaatccgctaccagactacggccacaaagtcagaacatacaggacgcgaaatagtagatttgatgtgtcacgctacttttaccatgaggctcctaagtccggttcgtgtaccaaattataacttgattatcatggatgaagctcacttcactgaccctgcatcgatagcagcaagagggtatatatcgacaagagtaggtatgggagaggctgcagcaatcttcatgacagcaacgccgccaggtacagcagatgcatttccgcaaagcaatgcgccaattcaagatgaagaaagagatattccagaacgaagttggaacagcggtaacgagtggattactgattttgctggtaaaactgtatggttcgtacctagcataaaagcaggaaacgatatagcgaactgcttacgaaagaatggtaagaaagttatacaattatcgagaaaaacatttgacaccgaataccagaaaactaaattaaacgattgggattttgtagttaccacagacatatcagaaatgggcgcaaactttaaagcggacagggtaatagatccaagacgttgcctcaaaccagtaatcctaacagacggacccgaacgagtcatattggctggtcctatgccagtgacagcagcatctgcagcacaacgtcgggggagagtcggaaggaatccacaaaaagagaatgaccaatacatattcactggtcaacctctaaacaatgacgaagatcatgcacactggacggaggcaaagatgttactcgacaatataaacacaccggaaggtataattccggctttatttgaaccggaaagagaaaaatctgctgctatagatggcgagtaccgcctaaagggcgagtcaaggaagactttcgtagaacttatgagaaggggagacttacccgtttggctggcccataaggtcgcttcagaaggcattaagtatacagatcggaaatggtgcttcgacggccaaagaaataaccaaatactggaagagaatatggatgtcgaaatctggacaaaggagggagagaaaaagaaattgagacctcgatggctcgacgcccgaacatatagcgatccactcgcattaaaagagttcaaagactttgcagctgggagaaagagcattgccttggacttagtcactgaaatcggaagagtgccaacccatttagctcatcgaacaagaaatgctctggataatttagtgatgcttcacacctcggaacatggcggcaaagcctacaggcacgcggtggaagaactgcccgaaactatggaaaccttgctactcctaggattgatgatattacttacaggaggggcgatgctgtttttaatatcaggaaagggtataggaaaaacctcgattggtcttatttgcgtaatagccagtagcggtatgctttggatggcggagatacctttacaatggatagcaagtgcaatagtactagaatttttcatgatggtcctactaataccagaacctgagaaacaaagaacgccacaagacaaccaattagcatacgtagtgattggcatattaacattggcagcgataatagcagccaacgaaatggggctacttgagacaacaaagcgagacctcgggatgagtaaagaacccggtgtcgtctctccaacgtcatacctggatgtggacctgcaccctgcgagtgcttggacattatatgccgtggctacaaccgtaatcacaccaatgctacgacataccattgagaactctacggccaatgtgagcctagcagctattgcaaatcaagcggttgtgttaatggggctagataaaggatggcccataagtaaaatggatctcggagtaccactgttagcactgggatgctactctcaagtaaaccccctaaccttaacggccgctgttctacttttaattacacattatgcaatcattggacccggactacaggcaaaagcaacacgagaagcccagaaaagaaccgcagccggaattatgaaaaaccctactgtggatggcataatgaccatcgatttggatcctgttatttacgactcaaaattcgaaaagcaactaggacaagttatgctcttagtcttgtgtgcagttcaactgttattaatgaggacatcctgggcactctgtgaggcgctgacactagctaccggacccataacaaccttgtgggagggcagccctggcaaattttggaatacaactattgcagtcagtatggcaaatatttttcgaggcagctacttagccggtgctggtttagcctttagtataatgaaatcggtcggaacaggaaaacgaggcactggctcgcagggcgaaacattgggagaaaaatggaagaagaaactcaaccaactgtcacgaaaagaatttgacctctacaagaaaagcggaataacagaagtggatcgaactgaagcaaaagaaggactaaaaagaggagaaataactcaccatgccgtaagccggggatcagcgaaactacaatggttcgtagaaagaaatatggtaatcccggaaggacgagttattgacctgggatgtggaagagggggatggagctattattgtgcgggactcaagaaagtgacagaggttcgaggatacactaagggaggtccaggacatgaagaacctgtaccaatgagcacatacggttggaacatagtcaaattaatgtctggtaaagacgttttctatctgccacccgaaaagtgcgatactttgctctgcgacattggtgagtctagtccctcgcccacagttgaagaatctcgcacaatacgagttctaaaaatggtagaaccgtggctaaagaataaccagttctgtattaaagttttaaatccctatatgcccacagtcattgaacatttagaacgtttacaaaggaaacatgggggcatgctagtgagaaaccctcttagcagaaacagtacacatgaaatgtattggataagtaacggaacgggaaacatagtagcaagtgtaaacatggtcagcagactgttactaaatagattcacaatgacacaccgaaggccaactatagagaaagatgtcgatttgggcgcaggtacaaggcacgtaaacgctgaaccagaaactccgaacatggacgtgataggggagaggatcaaaagaattaaagaagaacacaattccacatggcactatgacgatgaaaacccatacaaaacttgggcatatcacggttcatatgaagtaaaagcgaccggatcagcgtcttcaatgataaatggtgttgtaaaactactcacaaagccatgggacgtagtgcctatggtgacacaaatggccatgacggatactacaccatttggacaacaacgcgttttcaaagaaaaagttgatactcgaaccccaaggtctatgcctggaactcggagggtaatgggaattacggcagaatggctgtggaggacacttggtcgtaacaaaaagccacgcctttgtacgagagaagaatttacgaagaaagtaagaactaacgctgctatgggcgcggtttttacagaagaaaatcaatgggacagcgcaaaagctgccgtagaagatgaggacttttggaaattagtcgaccgagaacgagaattacataaactaggaaaatgcgggagctgtgtatataatatgatgggtaaacgggagaaaaagttaggcgaatttggtaaagctaaagggtcgcgagctatatggtatatgtggctgggcgcaaggtacctagagttcgaagcgttaggattcctcaatgaggaccattggtttagtcgtgaaaattcttactcgggagtggagggagagggactacataaattgggatatattctacgtgatatatccaagatccccggcggtgctatgtacgcagatgataccgcgggatgggatacgcgaattacagaagacgatctacataacgaagagaaaataactcaacaaatggatcctgagcacagacaattagcaaacgcaatattcaaacttacataccaaaataaagtagtaaaagttcagcgaccaacacctactggcactgtgatggatataatatcaagaaaagatcaacgtggttctggacaagtgggaacatatggattaaatacctttacaaatatggaagcacaactcattcggcaaatggaaggtgaaggagtactgagcaaggcagatctcgaaaatccacatttgcccgagaaaaagataacccaatggctggaaaccaaaggtgttgaacgactaaaacgaatggcaatatctggcgacgattgtgtggtaaaaccaatcgacgatagattcgcaaacgcactgttagcactaaacgacatggggaaagtaaggaaagacataccacaatggcaaccttcgaagggatggcatgactggcaacaggttcctttctgtagtcaccattttcacgaactgataatgaaagatggacgaaagttagtagtaccatgcagacctcaagacgaactaattggtcgggccagaataagtcaaggcgcgggttggtcccttagagaaacagcatgtctcggaaaggcatacgcgcagatgtggtcactaatgtatttccatagaagagatttacggctggcaagtaatgcaatatgctcggctgtacccgttcactgggttccaacttccagaactacctggtccatacatgctcaccatcagtggatgactactgaagatatgcttactgtatggaacagagtgtggattgaagataatccttggatggaggataaaacgcctgttacgacttgggaaaacgtcccatatctcggtaaaagagaagatcaatggtgtggttcgctcatagggctgaccagtagggccacttgggctcagaacataccaacagctatccagcaagtgcggtctctaataggaaatgaagagttcttagactacatgccgtcgatgaaaaggttcagaaaggaagaagaatcagaaggtgcaatttggtaa

SEQ ID NO: 23078 - RNA, 9873 nt, synthetic construct
  misc_feature 1..9873: note = derived and/or modified CDS sequence (opt6) from DENV-3__FJ898443__SS-prME
  source 1..9873: mol_type = other RNA
actagcttatgtttaatgatgatactaccagctgcactagcttttcacctaaccagcagagacggagaaccaaggatgatagtaggcaaaaatgaacgcgggaaaagtttattatttaaaacagcgtcggggattaatatgtgtacactaattgcaatggacctaggagaaatgtgcgatgacacagtaacatacaaatgtccccatataacagaagtggaaccagaagatatcgactgctggtgtaacctaacaagtacatgggttacctacggcacgtgcaatcaagcgggagaacacagacgtgacaaacgaagtgtagcattggcgccgcacgtcgggatggggctagacactcgcactcaaacctggatgagcgctgaaggagcttggaggcaagttgaaaaagtagaaacctgggcgttacgacatccaggattcacaatactagcattatttttggctcactatattggaacaagtctaacacaaaaagccgtaatattcatactattaatgttggtaacaccatccatgaccatgagatgtgtaggagtgggaaacagggactttgtagagggacttagcggtgcaacgtgggtagatgtagtattggaacatggaggatgcgtgaccactatggccaaaaataaaccaacactagacatagaattacagaaaaccgaagcaactcagctagctaccctgaggaaattatgcatagaggggaaaatcacaaatataacaacagattcgagatgtccaacacaaggggaagctgtattacctgaggaacaagaccaaaattatgtttgcaaacatacttacgttgatagaggatgggggaatggatgtggtttatttgggaaaggatcgttagttacatgtgcgaaattccaatgtcttgaaccgatagagggtaaagtagtacaatatgaaaaccttaaatatacagtcataattactgttcacacgggtgatcaacaccaagtaggaaatgagacacaaggagtgactgcagaaattacccctcaagcgtcaacgaccgaagcaattttacctgaatacggaactctagggctagaatgcagtcccagaactggactagattttaacgaaatgatattactaacaatgaaaaataaagcctggatggtacacagacagtggttctttgatctgccattaccttggacttcaggcgccactaccgaaacaccgacctggaacagaaaagaactattagtcactttcaaaaatgctcatgcaaagaaacaagaagttgtagtcttaggtagtcaggagggggctatgcacacagcattaactggtgcaacagaaattcaaaattcaggcggtaccagcatatttgcaggacatttaaaatgcaggctaaaaatggataaattagagttaaaaggtatgtcatatgcaatgtgtacaaatacatttgttctcaagaaagaagtatcagagacgcagcatggcaccatattaataaaagtcgaatataaaggagaggatgttccctgtaaaatcccattcagtacggaggatggccaagggaaagcacacaacggtcgattgatcactgcaaacccagtagtaacgaagaaagaagaaccggttaatatcgaagcagagccacctttcggagaaagcaatattgtaataggcacaggagataacgcactaaaaataaactggtacaagaaaggtagcagtattggtaaaatgtttgaagcaaccgcacggggcgcgcgaagaatggcaatcttaggtgatacagcatgggattttggcagcgtaggaggcgtgctaaacagtctaggtaaaatggtccatcaaatattcgggagtgcgtatactgcattattcagcggagtttcttgggtcatgaaaatcggtataggagtgctcttaacttggataggactaaattcgaagaatacctcaatgtctttcagttgtattgcgatagggataattacgttatatctgggagctgtggttcaggcagatatgggatgcgttataaactggaaaggtaaagaattaaaatgcggctcgggtatatttgtaacaaatgaagttcacacatggacagagcaatacaaatttcaagctgatagcccgaaaagacttgcaacagcgattgcgggcgcgtgggaaaatggggtctgtggcatccggagcactacccgcatggagaacttgctatggaaacaaatcgctaacgaactcaactatattctatgggagaataacataaaactaactgtggtagtgggagacattataggagtgcttgaacaagggaaaaggaccttaaccccacaaccaatggaattaaaatactcatggaaaacgtggggaaaagcaaaaattgtaacggctgaaacacaaaattcatcatttataatcgatggaccaaacacacctgaatgcccttctgccagtagagcctggaatgtctgggaggttgaagactatgggttcggagtatttacgacaaatatatggttgaaactccgtgaggtatacacacagctttgtgatcatcgtttaatgtcagccgccgtaaaggatgagagagcagttcatgcggacatgggatactggatagagagccagaaaaatggcagttggaagttagaaaaagctagtctgatcgaagtaaaaacatgcacatggcctaaaagccacacgctatggtccaatggagtccttgaaagcgacatgataattccaaagagcctcgccggaccaattagtcaacacaactatcgacctggataccacacgcaaaccgcgggtccgtggcatctcggtaagttggaactagacttcaattactgtgagggaacgacagtcgtaataacagagaattgcgggacaagaggaccatccctgagaacaacaacggtttccggcaaactcatacacgagtggtgttgccgaagctgtacactgccaccattacggtatatgggggaggacggttgttggtatggtatggaaataaggccaatctcggaaaaagaagagaatatggttaagtctctagtaagcgccgggtctggaaaggtggacaacttcaccatgggcgtattatgtctagccatattattcgaagaagtaatgaggggtaaattcggcaagaaacatatgatagccggggtatttttcactttcgtactactgttaagcgggcaaataacatggagagatatggctcatacattgataatgataggctcaaatgcgtctgacaggatgggtatgggtgtaacatatctagccttaatagcaacattcaaaattcagccattccttgccttagggttctttctaagaaaacttacaagtagagaaaatttactgctgggtgttggcctggcaatggccacaacccttcaactcccggaagatattgagcagatggctaacggaatagcattaggtctaatggcgttaaaattgattacgcaattcgaaacttaccaattatggaccgctctaatatcactaacatgttcaaatacaatatttacattaactgtagcctggaggacagcgacgttaatactggcgggcgtttctttacttccagtctgccaaagctctagcatgagaaaaacggactggctaccaatgaccgtagcagccatgggtgtacctccactccctttatttatattttcactaaaagacacactcaaaagacggtcatggccactaaacgaaggagtcatggctgttggtctagtcagtatcctcgcatccagtctcctcagaaacgatgtacctatggcgggtccactcgtagcaggaggattattgatcgcatgctatgtcatcacaggtacgagtgccgacctcacagtagaaaaagcagccgatgtcacgtgggaagaggaagctgagcaaaccggagtatcacataatctaatgataacggtagatgacgatggcacaatgcgtataaaagacgatgaaaccgaaaacattctaacagtgctactaaaaacagcgttattgatagtatcaggtatatttccttactcaataccagcaaccttattggtttggcacacctggcaaaaacaaacgcaacggtcaggcgttttatgggatgtgccctcgcccccagaaacacaaaaagcagagttagaagaaggtgtgtatcggataaaacaacagggaatatttggcaaaactcaagtaggtgtaggtgtccagaaggaaggtgtatttcacactatgtggcacgtaacaagaggtgcagttctaacctacaatggaaagaggttggaaccgaattgggcatccgtgaagaaagacttgatctcatatggcggaggatggaggttaagtgctcaatggcagaaaggggaagaagtgcaagtgatcgcggtggaaccaggtaaaaatcctaaaaatttccagaccatgcccgggactttccaaacgaccaccggggaaattggagctatcgccctagacttcaaaccgggcacatctggcagccctataatcaacagagaaggcaaagtggtgggcctgtacggaaatggagtagtgacgaaaaatggaggatatgtttcgggaatagcgcagactaatgcagaacccgatggacccactcctgagcttgaggaagaaatgtttaagaagcgaaatctgactatcatggatctccatcctggatctggcaaaactagaaaatatttgccggcgatcgttagggaagccataaaaaggagactaagaacgttgattcttgccccaactagggtcgtcgcagccgaaatggaggaagcattaaaaggtctaccgatcaggtaccaaactaccgcaaccaaatcagaacacaccggccgagagatagtagatctaatgtgtcacgcaacatttactatgcgtttattaagtcctgttcgggttccaaactataatttgataatcatggatgaggctcatttcactgacccggcatccattgcagcgcgaggatacatttcaacgagggtgggtatgggcgaagccgcagcaatattcatgacagctacgccaccaggaacggctgatgcattcccccagtctaacgcacctatacaagacgaagaaagagatataccagaacgctcctggaactcgggtaatgaatggattacagattttgcgggtaaaacagtatggttcgtcccgtcaattaaagcgggcaatgacattgccaactgcttgagaaagaacggtaagaaagtaattcaacttagtaggaaaacatttgatacagagtatcaaaagacaaagttaaacgattgggactttgtagtcaccacagatataagcgaaatgggtgcaaacttcaaagctgatcgggttattgacccgaggcgatgcctaaaacctgttatactaaccgacggaccggagcgagtaatattggcgggcccaatgccggtaactgcagcctcagcagctcagcgaagagggagagttggaagaaatccccaaaaagagaatgatcaatacatcttcacgggacaaccattaaataacgacgaagaccatgctcattggacagaagcaaaaatgcttcttgacaatataaacacgcctgaaggcataatccctgctttatttgaacctgaaagagagaaatctgctgcaatcgatggagaatataggctgaaaggtgaatcaaggaaaacgtttgtagagttaatgagaagaggagatttacctgtgtggttagcacataaagtagctagtgagggaataaaatacacagacagaaaatggtgttttgacggtcaaagaaacaaccaaatattagaagaaaatatggatgtagaaatttggacgaaggaaggagagaagaagaaattacgacctagatggttagatgctagaacttattccgatcctcttgcattaaaagaatttaaggatttcgcagctggtaggaaatcaatagcattagatctagttactgagattggaagggtgccgacacatctagcgcatagaactcgaaacgctctagacaacttggttatgttgcatacttcggagcacggaggaaaagcatacagacacgccgtggaagaactgccggaaacgatggagacattactgctactgggattgatgattttattaacagggggagcaatgctctttttaatatcaggcaaagggattggaaagacctcaatcggacttatatgtgtaatagcatcgtctggtatgctatggatggcggaaattcccctgcaatggattgcgtccgcaatagtcttagagttctttatgatggtccttctcattccagaaccagaaaaacaaaggaccccacaggataatcagttagcatacgtcgtaatcgggatactaacgctggcagccattatcgcagcaaacgagatggggctattagaaaccactaagcgagatttagggatgagcaaagagccaggggttgtatcaccaaccagttatctagacgtagatctccatcctgcatctgcatggaccctatacgcagtagcaacaacagtaataaccccgatgctacgacatacaatcgaaaacagcacggcaaatgtgagcctagctgcaattgcaaatcaggcagtagttctcatgggtctagacaaggggtggcccatctcaaaaatggacctcggtgtgccattattagcactcggctgttattcacaagtaaaccctttgaccctaactgcagctgtattactattgattacacattatgctattatcggacccggattgcaagctaaagcaacgagggaggctcagaaaagaaccgctgcgggcattatgaaaaatccaacagtagacggtatcatgaccattgatctagatcccgtaatttacgatagcaagtttgaaaaacaactaggacaagtaatgttactcgttctgtgtgcagtacagctcctccttatgaggacatcatgggcattatgtgaggcgctaacacttgccactgggccaataactacactctgggaaggctcacctggtaagttttggaacacaaccatcgcagtgtccatggctaatatatttagaggaagctacctagcgggagcagggcttgcattttcgattatgaagtcagttggcacaggaaagcgaggtactggtagtcagggcgaaacacttggcgagaaatggaaaatgaaattaaatcaattaagtagaaaagaatttgacctatacaagaaatcaggcataaccgaggtcgaccgcactgaagccaaagaaggacttaaaagaggagaaataactcatcatgccgtaagtcgaggatctgctaaactccaatggtttgtcgaacgaaatatggtaattcccgaaggaagggtgatagatctagggtgtggtagaggtgggtggagttactattgtgctgggctgaagaaggttacagaagtaaggggctatactaagggagggccaggacatgaggaaccggtcccgatgtctacctatggttggaatattgttaaattaatgtcaggcaaggatgtcttttatttacctcctgaaaaatgcgatacattattgtgtgacattggtgaaagttcaccatctccaacagtagaggaaagccgcactatcagagtgctaaaaatggtagaaccttggcttaaaaacaatcaattctgtattaaagtccttaacccgtacatgccaactgttatagaacatctagaaagattacagcgaaaacatgggggcatgttggtgcgaaatcccttatcgagaaactcaactcatgaaatgtactggatttcaaatggcacaggcaacatagtagcttcagtaaacatggtatcacgtttgttactaaatcgtttcacaatgacacaccgaagacccacaatagaaaaggatgttgatctaggagctggaacgcgtcatgtcaacgcggagcccgaaacaccgaatatggatgtgataggagagcgcattaaaaggattaaagaagaacataattcaacatggcattatgacgacgaaaacccgtacaaaacctgggcatatcacgggtcgtacgaagttaaagccacaggatcagcgagttccatgataaacggggtagtcaaactattaactaagccgtgggatgtagtaccaatggttacacaaatggcgatgacagatactactccatttggacagcaacgcgtattcaaagaaaaagtcgatacaaggacgccaaggagtatgcccggaactcgtagggtcatgggaattactgccgaatggttatggagaaccttaggccgtaataagaaaccaaggttatgtacccgcgaagaatttactaagaaagttcggactaacgcagcaatgggagccgtatttaccgaagaaaatcaatgggatagtgccaaggccgcagtcgaagacgaagatttttggaagctagtagacagagaacgtgaattacacaaattaggaaaatgcggtagctgtgtttataatatgatgggtaaacgggagaagaaattaggagaatttgggaaagcaaaaggctcgcgcgctatatggtatatgtggcttggcgcaagatacctcgagttcgaagctcttggatttttaaatgaagatcattggtttagtagagaaaactcatatagcggagttgaaggagagggcctacacaaattaggatacatattaagagacatatcaaaaatacccgggggagcaatgtacgcagacgataccgcgggatgggatacgcgtataactgaggatgacttacataacgaagagaagataacccaacagatggatccagaacatcgtcaactggcaaacgcaatattcaagttaacgtatcagaacaaggtggttaaagttcaacggccgactcccactggtaccgttatggatataataagtcgaaaagaccaaagaggaagtggccaagttggtacctatggtttaaatacttttacgaatatggaagctcaattgataaggcagatggaaggggagggagtactcagtaaagcagatttagagaatccacatctaccagaaaagaaaataacccaatggctggaaaccaagggcgttgaaaggcttaaacgcatggctataagtggcgatgattgcgtcgtcaaaccaattgacgatagattcgcaaatgcattattagcacttaacgacatggggaaagtgagaaaagacattcctcagtggcaaccatccaaaggttggcatgactggcaacaagttccattttgttcacaccattttcatgaactaattatgaaggatggtcggaaacttgttgtcccttgtagaccacaagatgagttgatcggcagagcaaggattagccaaggggcaggctggtcattaagagagactgcatgtttaggtaaggcttatgcacaaatgtggagtctcatgtatttccatagaagagatctcagacttgcttcaaatgcaatctgctcagcagtacctgtacactgggttcctacatctcgaactacatggtctatacacgcgcaccatcaatggatgacaaccgaggacatgcttacggtatggaaccgtgtatggatcgaagacaacccgtggatggaagataaaactcctgtgacaacatgggaaaacgtaccctacctgggaaaacgagaggaccagtggtgtggatcgcttattggcctaacatcaagggcaacttgggcccaaaatatccccacggcaatacagcaagtgagatctttaattggaaacgaagagttcttagattatatgcctagtatgaagagatttaggaaagaggaagaactagaaggtgcaatctggtaa

SEQ ID NO: 23079 - RNA, 9873 nt, synthetic construct
  misc_feature 1..9873: note = derived and/or modified CDS sequence (opt6) from DENV-3__FJ898444__SS-prME
  source 1..9873: mol_type = other RNA
acctcattgtgtttaatgatgatcctacccgcagcactagcttttcaccttacaagccgagatggagaaccaaggatgattgtaggtaaaaacgaaaggggaaagagcttattatttaaaaccgcgtccggtattaacatgtgcacattaattgcaatggatcttggtgaaatgtgcgacgatactgtaacctacaaatgtccacacataacggaagttgagccagaagatatagattgctggtgcaacttaacatcaacttgggtcacgtatggaacatgtaatcaagctggagaacataggcgagataaaagatccgtagcacttgcaccgcatgttggaatgggattagacacgaggacccaaacatggatgtccgcagaaggcgcgtggagacaagtcgaaaaagtcgaaacatgggctttgcgacaccccggtttcacgattttagctctgtttttggctcattatataggaacaagtttaacacaaaaagtagtaatattcatcctattaatgctagtgacaccatccatgaccatgaggtgtgtaggggtaggtaacagagactttgtggaggggctaagtggggcaacttgggttgacgtagtgctagaacatggcgggtgtgtcacaacaatggctaaaaacaaacccacactagatatagaactacagaaaactgaagcaactcaactagcaacactcagaaaattgtgcattgaaggcaaaattacgaatataaccactgatagtagatgtcccacacaaggggaggcagttctccctgaagaacaagatcaaaactatgtatgtaaacacacgtatgttgaccgggggtggggaaatggatgtggattattcggcaaaggctctctagtaacttgcgcaaaatttcaatgcttagaaccaatagaggggaaagttgtacaatatgaaaacctaaaatataccgtaataataacggtccatacaggagaccaacatcaagtaggcaacgaaacgcaaggagtaacggctgaaattacaccccaagcatctacaaccgaagctatcctacccgaatatggtacactaggattagaatgctctccgcgaacagggttagactttaacgagatgatcctactaacaatgaaaaataaagcatggatggtacatagacaatggttctttgacttgccattaccatggacatctggtgcgacaaccgaaacacccacatggaataggaaagaattacttgtaacatttaaaaacgctcacgctaagaaacaagaggtggtagtgctaggttcccaagagggagctatgcacacagcactcactggagcaacggagatacaaaactcaggcggaacatcaatattcgcaggccatttgaaatgccgccttaaaatggataaacttgaactaaaaggtatgagctatgcgatgtgcaccaacacattcgtactcaagaaagaagtatccgagacacaacatggtacaatacttattaaagttgaatataaaggcgaagatgccccatgtaaaattccgttcagcacggaggatgaacaaggcaaagcacataatggaaggttgatcactgctaacccagttgtaactaagaaagaagaaccggtaaacatagaggcagagccgccctttggtgaaagcaatatagtaattggtataggagataacgctttgaaaataaactggtataagaaaggatcatcaatcggaaaaatgtttgaggctacagctcgaggtgctagacgaatggcaatattgggggacacagcctgggattttggtagcgtgggaggggtattaaattccttaggtaaaatggtccatcagatattcggctccgcatataccgcactgttttcgggtgtaagctgggtaatgaaaataggaatcggagttttattaacatggattggattaaacagtaaaaatacaagtatgagcttctcatgtattgcgatagggataattacgttgtatttaggcgcggtagtacaagcagatatgggttgtgtcgttaactggaaaggaaaagaactaaaatgtggttcaggtatattcgtcacgaatgaggttcatacatggactgaacagtacaaatttcaagcagactctcctaaaagattggcaactgcgattgcgggtgcctgggaaaatggagtatgcggtataagatctacgaccagaatggaaaaccttctgtggaaacagatagctaacgaattgaattacatactatgggaaaataatataaaactaaccgttgtagtaggtgatataataggtgtactcgaacaaggaaaaagaaccctaacaccgcaacctatggaactaaaatatagctggaaaacttggggcaaagctaaaatcgttactgcagaaacgcaaaactcgagttttatcattgacggcccaaatacgccagaatgtccaagtgctagccgagcttggaacgtttgggaagtggaggattatggttttggtgtatttacgacaaacatctggctaaaactgagagaagtctatacacaattatgtgatcaccgacttatgtctgctgcagtgaaagatgaaagagcagttcacgcggatatgggatattggatagagtctcagaaaaatggtagttggaaattagaaaaagcctcattgattgaagtgaaaacatgtacctggccaaaatcccatacactatggtcaaatggcgtgttagaatcggatatgattatacccaaatcattggcgggtcctatatcgcaacataactatcggccggggtaccatacacaaaccgcaggcccatggcatctcgggaaattagaattggatttcaactattgtgaagggactactgtggtaataacagagaactgtggtaccagaggaccgagcttgcgtacaactactgtctcaggtaaattaattcacgaatggtgctgtcgctcttgtacactacctcctttaaggtatatgggtgaagacgggtgctggtacggcatggaaatacgccccataagtgaaaaagaagaaaatatggtaaaatctctggtctcagctggtagtggagaagtggataactttacgatgggagtactatgtttagcaatactgtttgaagaggtaatgagaggcaaattcggcaagaaacacatgattgccggtgtattctttactttcgtgctattattgtcagggcaaattacgtggcgggacatggcacacacattaataatgataggaagcaacgcatcagatagaatgggcatgggagtaacgtatctcgcattaatagcaacgtttaaaattcaaccctttctagcgctaggattcttcctaagaaaactaacaagtcgggaaaacctacttctgggagtaggactggccatggcaactacgctacaactcccggaagacatagagcagatggcaaatggaatcgcgctggggcttatggcactaaaacttattacgcagttcgaaacttatcaactctggaccgcgttgatatcattaacgtgtagcaatacaatattcactctcactgtcgcctggagaactgcaactctaatattagccggtgtttcattgctccctgtatgtcaatcaagtagcatgcgcaagactgattggctaccaatgaccgtagcggcaatgggagtgccaccattaccgctctttatattttccttaaaagatacactcaaaagacgcagttggcccttgaacgaaggagtaatggccgtcggcttagtatcgatcctggcttcttcgctactcagaaatgatgttccaatggcgggcccgctcgtggctggaggtttattaattgcctgctatgttataacgggtacaagtgcagatttgaccgtagagaaagctgcagatgtaacttgggaagaagaagctgaacaaaccggggttagccacaatctaatgattacagtagatgatgatggaacaatgagaattaaggatgatgagaccgaaaacattttaactgtccttttaaaaacagcactattaatagtgtcgggtatttttccgtatagcatccccgcaacgttgttagtatggcacacctggcaaaagcaaacccaaaggagtggagtgttatgggatgtcccaagcccacctgaaacgcaaaaagcagaactcgaagaaggtgtttatcgaataaaacagcagggaatctttggaaaaacacaagttggagtaggggtccaaaaagaaggggtcttccatactatgtggcatgtaacgcgaggagcagtactgacctataacggcaagcgattggagcctaattgggcaagtgttaagaaagaccttatttcatacgggggaggttggaggctaagcgcacagtggcaaaagggggaagaagtgcaagtaatagctgtagaaccaggcaaaaatcccaaaaacttccagacaatgccaggcacatttcaaaccaccacaggggaaataggtgcaatagctctagatttcaaacctgggacttcaggctcaccgataatcaacagggaaggtaaggttgtcggtctatacggaaacggagttgtgactaaaaacgggggatacgtctcgggaatagctcaaacaaacgccgaaccagatggtccgacacctgagctagaggaagaaatgtttaagaagaggaacctcaccattatggatttgcaccctgggagtggcaagactagaaaataccttccagcaatagttagggaagcaattaaaagaagactcagaactttaatccttgcacccacacgggttgtggcggcagaaatggaagaagctcttaagggtttacctatacggtatcaaactacagcaacaaaatctgagcacactgggcgcgagattgtcgacctaatgtgtcatgctacctttactatgaggctattaagtccagttagagtcccaaactataatctcattattatggatgaagcacattttacagaccccgccagcattgccgcaagaggctatatctcaaccagagtagggatgggagaggctgcggcaatttttatgacggcgacacccccaggaacagctgatgcatttccacaaagcaacgccccaatacaagatgaagaacgagatatcccggaaagatcctggaatagtggtaatgaatggatcacagactttgcaggaaaaacagtatggtttgtaccatcgataaaagccgggaatgatatagccaattgcttacgtaaaaacggcaaaaaggttatacaactgtccagaaagacttttgatacagagtatcaaaagactaagttaaatgattgggactttgtagtcacaactgatatcagtgaaatgggtgcaaattttaaagcggaccgtgttattgatccccgtagatgtctaaaaccagtcatactaacagatggccctgaaagggttatattagcagggcctatgccagttacagccgcgtccgccgcacagaggagaggcagagttggaagaaacccgcaaaaagaaaatgaccaatatattttcacgggtcagcctttaaataatgacgaagaccatgcacattggacggaagccaagatgctgttggacaacataaacactcctgagggaataattccggctctatttgaaccagaaagggagaaaagcgcagctattgacggagagtacaggctaaaaggagaatcccgcaaaacatttgttgagctgatgcgtagaggggatttacctgtatggctggcatacaaagtagcatctgagggaataaagtatacagacagaaaatggtgtttcgacgggcaacgaaacaatcagatcttagaggagaatatggacgtggaaatttggaccaaggaaggtgagaagaagaaattacgcccaagatggctcgacgccagaacctattctgacccattagcactcaaagagtttaaagattttgctgctggcagaaaatccatagccttggatctagttactgaaataggcagagtacccacgcacttagcccaccgaacgcgaaacgctttagataatttagttatgttgcatacaagtgaacatggtggcaaagcataccgccacgcagtagaagaattgcccgaaacgatggaaacgttgctacttttgggtctaatgatcctactaactggaggagctatgttatttctcatatctgggaaaggaattgggaaaacctctattggcttaatatgtgttatcgcgagtagcggaatgctatggatggctgagatacctctacaatggattgcgagtgcaatagttcttgaatttttcatgatggtactattaatcccagaaccagaaaaacaaagaacaccacaagataaccagcttgcctatgtcgtaattggaatcttgacgctagcagcgataatagctgcaaacgaaatgggcctattagaaaccaccaaacgggatttaggaatgtccagagaacccggcgtcgtatctccaacatcgtaccttgacgtcgatcttcaccctgcatcagcgtggactttgtatgctgtcgctacaacagtgataactccaatgctacggcatacaattgaaaacagtacagccaacgtctccttggctgctattgcgaaccaagcggttgtattgatgggacttgacaagggatggccaatatcgaaaatggatctaggcgtaccccttttagctctaggttgttatagtcaagttaatccactaacattaaccgcagctgtacttcttctcataacccactatgctatcattggcccaggccttcaagcaaaggcgacacgtgaagcacagaaaagaactgctgcaggtataatgaagaatccaactgtcgatggaattatgacaattgatttagaccctgtaatatacgactcaaagtttgagaaacaattaggccaggttatgttacttgtattatgcgcagtacagttgttactgatgcgcacgtcgtgggcactatgcgaggcactaacgctcgcgaccggaccaattacaacgttatgggaaggatcacctggtaaattttggaacacaacaattgctgtttcaatggcaaacatttttagggggtcatatttagccggtgcaggattagcgtttagtataatgaaatcagttggcacaggaaaaagaggcacgggaagtcagggagaaacacttggggaaaagtggaagaagaaactaaaccagctatctcgaaaggaatttgatttatataagaagtcaggtattacagaagtagaccgtaccgaagcaaaagaaggattgaagaaaggtgaaatcactcaccacgcagtaagtcgtggctcagcaaaactccaatggtttgtagagagaaacatggtaataccggagggacgagtcattgatttaggttgcggccgaggaggctggtcgtattattgtgcaggtttgaagaaagtgacagaagtccgaggttacactaaaggaggaccaggacacgaggaaccagtaccgatgtctacgtatggttggaacatagtaaagttgatgtccggtaaagatgtgttttatcttccgcccgaaaaatgtgataccttgttatgtgatattggagaatccagtccctcaccgacagttgaagaaagcaggacgattcgtgtcctaaaaatggtcgagccatggctcaaaaacaaccaattttgtattaaagttctaaatccttacatgcccacagtgatagaacacttagaacgattacaaaggaagcatggaggcatgcttgtaagaaatccactgagccgaaactcaacccatgaaatgtactggatttctaatgggacaggaaatatagtagcgagtgtaaacatggtatcgcggctacttttgaatagatttactatgactcataggagacccactatagaaaaagatgtcgacctcggagcaggaactaggcacgtaaacgcagagcctgaaacacccaacatggatgtgatcggggaaaggataaagaggataaaagaggaacacaactcaacgtggcattacgacgatgaaaatccatataagacttgggcatatcatggttcgtatgaggtaaaagctaccgggtcggcgtcaagtatgataaatggagtcgtgaaattattaaccaaaccttgggacgtagttccgatggttactcaaatggcaatgaccgatacaacaccgtttggacaacaaagagtatttaaggaaaaagtagatacacggactccaaggccaatgccaggcactcgcagggtaatgggaataaccgcagaatggctatggagaacattaggtcgaaataaaaagccaagactttgcacaagagaagaatttaccaagaaggtcaggaccaatgcagccatgggggcggttttcactgaagaaaatcaatgggactccgcaaaggcggctgttgaagatgaggatttttggaaactggtagatagagagagagaattacataaacttggtaagtgtggttcatgcgtctacaatatgatgggaaaacgtgagaagaaattaggagaatttggaaaagcaaaaggatcacgtgctatttggtacatgtggctgggggcacgatatttagagtttgaggccctaggatttctaaatgaggatcattggttcagtagggaaaactcttattcaggggttgaaggagaaggcctgcacaaattaggctatatattaagagacataagtaaaataccgggtggtgcgatgtatgcagatgacactgcaggttgggatacccggataacagaagacgaccttcataatgaggagaaaattactcaacaaatggatccagaacatcgccaattagccaacgcaatatttaaattgacataccaaaataaagtggttaaagtccaaagacccacacccacgggcacagttatggatatcatatcccggaaggaccaaagagggtctggacaagtgggaacttacggattaaacacattcacaaatatggaggcacagttaatacgacaaatggaaggtgagggcgtactaagcaaagctgacctagaaaatccacacttacccgagaagaaaataacccaatggttagaaactaaaggagtggaaaggcttaaaagaatggctatttctggtgatgactgtgtagttaaacccatagacgataggtttgcaaatgcactattggctctaaatgatatgggaaaggttcggaaagatattccacaatggcaaccgtccaaaggttggcacgactggcagcaggtacctttttgttctcatcattttcacgaactcataatgaaagacggaagaaagctagtagttccttgtcgaccgcaggatgaattaatagggagagctagaatatcacagggcgcaggatggagcctgagagaaactgcatgtttaggtaaagcctacgcccagatgtggtcccttatgtacttccacagacgtgatttaagattagcaagtaacgcaatatgttctgcagtaccagtacattgggtccccacatccagaacgacctggtctatacatgcacaccaccagtggatgaccacagaggatatgttaacagtatggaatagagtatggatcgaggataatccctggatggaagataagacacctgtaacgacttgggagaacgtgccatacctcggaaaacgtgaagatcaatggtgtggttcacttattggactgaccagtagagcaacttgggcacagaatatacctactgccatacagcaagtccggtctttaatcggaaatgaagagttcttagattacatgccttcaatgaaaagatttaggaaagaggaagaatcagagggagcgatttggtag

SEQ ID NO: 23080 - RNA, 9873 nt, synthetic construct
  misc_feature 1..9873: note = derived and/or modified CDS sequence (opt6) from DENV-3__FJ898445__SS-prME
  source 1..9873: mol_type = other RNA
acgagtctatgtttaatgatgatcctaccagcagcattagcctttcatctcacttccagggatggtgagcctagaatgatagtaggtaaaaacgaacgaggaaaatcgttactatttaaaactgcttcaggaataaacatgtgtacactaattgcaatggacctaggggaaatgtgtgatgatacagtcacgtataaatgcccacatatcactgaagttgaacctgaagatatagactgttggtgcaatttaacaagcacgtgggttacgtacggaacatgcaaccaagcaggcgaacatcggcgtgataaaagatcagtcgcactggcgccgcacgtaggaatgggtttagatactaggacacaaacatggatgtccgccgaaggggcatggagacaagtagaaaaagtagaaacatgggccctaagacatccaggatttactattcttgcactatttttagcgcattatatcgggacctcacttactcaaaaagcggtaatcttcacactactaatgttagtaaccccttcaatgactatgaggtgtgtgggggtaggaaacagagatttcgtcgaaggactatcaggagctacatgggtagatgtcgtactcgaacacggcggttgtgtaactacgatggcgaaaaataaacctacgctggacatcgagttacagaaaacagaggctacacaattagctacacttaggaaattgtgcatcgaaggtaaaattactaatataacaaccgactccagatgtccgacacaaggagaggcggtattacccgaggaacaagatcaaaactacgtttgtaaacacacttacgtcgatcgaggttggggaaatggatgtggcctgtttggaaaaggaagcctcgtaacgtgcgcaaaatttcaatgcctcgaaccaattgaaggtaaagtagtacagtatgaaaatttgaaatatacggtaattatcaccgtgcacacaggtgatcagcaccaagtgggaaatgaaacgcagggagttaccgctgaaattacgccacaagctagtacaacagaagcaattctccctgaatatggtacgctgggcttagaatgctcacctaggactggtctagatttcaatgagatgatactccttaccatgaaaaacaaagcctggatggtacatagacaatggttctttgatttgccgctaccatggacaagcggagctactaccgaaacaccaacctggaatcgaaaagagttattggtaacatttaaaaatgctcatgcgaagaaacaagaagtcgtagttttaggatcacaggagggtgcgatgcacactgctctgaccggagcaactgaaattcaaaacagtgggggaacatcaatattcgcaggccaccttaaatgccgccttaaaatggataaactcgaattaaaaggcatgtcatacgcaatgtgcactaacacttttgttttgaagaaagaagtatctgaaacacaacatgggacaatacttattaaagtagagtacaaaggagaagacgtaccctgcaaaatcccatttagcacagaagatggacaagggaaagcacacaatggacgactaataactgcaaaccctgtcgttacaaaacgagaagaacccgttaacattgaggctgagcccccgttcggagaatcaaatatagttatcggaattggagataatgcgttaaaaatcaattggtataagaaaggctcaagtataggaaaaatgttcgaagcgacagccaggggtgcacgtcgaatggcaatactaggtgacacggcatgggactttggcagcgtaggaggagtgctcaattcgttgggaaaaatggtgcaccaaatattcggcagcgcttataccgccctcttctctggagtgagttgggtcatgaaaataggtataggggttcttttaacatggatagggctaaactccaaaaatacatcaatgtcatttagctgtatagcaatcggtatcataaccctgtacttaggtgctgtagtacaggctgatatgggatgtgttataaattggaaaggtaaagaactaaaatgcgggtcaggtatatttgtcacaaatgaggtccacacgtggaccgagcaatacaaattccaagctgatagcccaaaaagattggctaccgctatagcaggagcttgggaaaatggagtttgcgggattcgtagtaccactcggatggaaaacttgctgtggaaacaaatagccaacgagctcaattacatactatgggaaaataacatcaaattaacagtcgtggtaggagacattataggagtactcgaacaaggaaaaaggactttaacaccacaacctatggaattaaaatactcttggaaaacatggggaaaagccaagattgtaacagcagaaacacaaaattctagtttcataatagacggtcctaacaccccagagtgtcccagcgcctcgcgcgcttggaatgtgtgggaggtagaagattatgggttcggagtttttacgactaatatatggcttaaattacgggaggtatacactcaactatgtgatcacaggttaatgagcgcagcggtaaaagatgaaagagcagtacatgcggacatgggatattggatggaatcacagaaaaatggctcttggaaacttgaaaaagcctcactaatagaggtaaaaacatgtacatggccgaaaagtcatactttatggtcaaatggagtattagaatctgatatgatcataccaaaaagtttggccggaccgatcagtcaacataattataggccgggatatcatacgcagactgcaggaccatggcatctaggaaaactggaactggattttaattattgtgaaggaaccacagttgtaataactgaaaactgcggcactagaggaccgtcattaagaaccaccacggtttcaggaaaactaatacacgaatggtgctgtagaagttgcactcttccgcctctacgatatatgggagaagatggctgttggtatgggatggaaatccgtcctattagcgaaaaagaagaaaatatggtaaagagcttagtatcagcgggctccggcgaagtcgataattttactatgggcgtactctgtttagccatactctttgaagaggtcatgagggggaaatttgggaagaagcatatgatagccggagtctttttcacttttgtattgctattaagcggccagataacgtggcgtgatatggcacacacactcataatgatagggagtaacgctagcgacagaatgggcatgggagtaacttatctggcgctaatcgccacatttaaaattcaaccatttctcgcgttagggttctttcttagaaaattgacatctagagaaaacttactattaggagttggactagcaatggccacgactctacaattaccggaagatatagagcagatggcgaatggtatagctctcgggttaatggccttaaaattaatcacacaattcgagacctatcaactatggacagcgcttatctcacttacatgctctaacacaatctttacactgactgtagcttggagaacagcaactttaatcctagcgggtgtctccttattaccggtgtgccaaagttcaagcatgagaaaaaccgactggttgcctatgactgtggcggcaatgggcgtaccacctctaccacttttcatctttagtctaaaagatacattaaaacgtagatcttggccattaaacgagggtgttatggccgttgggctagtatcaatacttgctagtagccttctaagaaatgatgtaccgatggccggacccttagtagcaggcggcctattaatagcctgttatgtaataacaggaacgagtgcagatttaaccgttgaaaaagcagcagacgtaacatgggaagaggaggcagaacaaactggagtttcacataatctcatgataacagtagatgatgatggaacaatgcgtattaaagatgatgaaaccgagaatattttaacagtgctcctaaaaaccgccctccttattgtatcaggcatctttccttactcaataccggcaactctacttgtttggcatacatggcaaaaacaaacacaacgatcgggagtcctgtgggatgtaccaagtcctccggaaacccaaaaagccgaattggaagaaggagtttaccgtattaagcaacaaggaatatttggtaaaactcaagtgggagtaggtgtacagaaagaaggcgttttccatacaatgtggcatgttactaggggagctgtgctgacatataatggcaaacgactggaaccaaattgggctagcgttaagaaagatttaattagctatggtgggggatggagactctcggcgcagtggcaaaaaggcgaagaagtacaggttatagcagttgaaccaggcaaaaatcccaaaaattttcagacaatgccaggtacatttcaaactaccactggcgaaattggagcaatcgcattagattttaaaccagggacaagcgggagtcccataataaatagggaagggaaagtcgtaggactttacggtaacggcgttgtcaccaaaaacggtggatatgtatctggtatagcgcagacaaatgcagaacccgacggtccaacgccagaactagaagaagaaatgtttaagaaaagaaacctcaccataatggatttgcatcctggatctggaaagacccgaaaatatttgcctgccatagtgcgagaggcgatcaaaagaaggctgagaactttgattttagctccaacaagagtagttgctgctgaaatggaggaagcattgaaaggactacctatacgatatcagacaaccgccacaaagagcgaacatactggacgtgaaattgtagatctaatgtgccacgctacatttactatgcgattattgtcacctgtacgagtacctaattataacctaataattatggatgaagcacatttcaccgatcccgcaagtattgccgcgaggggatacatctccacacgcgtcggcatgggagaagcagctgccatcttcatgacggcaacaccacccggtactgcggacgcgtttccacaatctaatgcgcccatacaggatgaagaaagagatatacccgaaagatcttggaactctgggaatgagtggataacagacttcgctggcaaaacagtctggtttgtcccatcgataaaagccggaaacgacatagctaattgtctgaggaaaaatggtaagaaagttatacagttaagtagaaaaacgtttgatacggaatatcagaaaacaaaacttaatgattgggattttgttgtcactactgatattagtgagatgggtgccaacttcaaagctgaccgtgttattgacccacgcagatgtctaaagcctgttatattaactgatggccctgaacgagttattctagcaggaccgatgcctgtcacggcggcatcagctgctcaacgccgtggtagggtcggaaggaacccacaaaaagaaaacgatcaatacatctttaccggccaacccctcaataatgacgaagatcacgcacattggaccgaagccaaaatgctactagacaatataaacacgcctgaaggaattattcctgctctgttcgaaccagagagagaaaaatcggcagccattgacggagagtatcggttgaaaggtgaaagcagaaagacctttgtagaactcatgcgacgaggtgatttgccagtgtggttggcatataaagtagcctcagagggtataaaatatactgataggaaatggtgttttgatggacaacgaaacaaccaaatactagaagagaatatggatgtcgaaatatggactaaagaaggcgagaagaagaaactacgtcctcgctggcttgatgcccggacatatagtgatccattggcgttgaaagaatttaaagacttcgcggcaggtcgtaaatccatagccctggatttagtgacggagatagggagagttccaacccacttagctcaccgtactagaaatgcactagataacctagtaatgcttcacacaagtgaacatggaggaaaggcatacagacacgctgtagaggaattgccagaaacaatggaaactttacttttactagggcttatgatcttactcacgggaggggcaatgctgttcctaatttcgggaaaaggtattggaaaaacatccattggtttaatatgcgtcatagcttctagcggcatgctatggatggcggagattccactgcaatggatagcatctgccatagtcctagagttctttatgatggttctattgatacccgaaccagaaaaacaacgtacacctcaagataaccagctggcctatgtagtaatagggatattaactctcgcggctattattgctgcgaacgagatgggtatgctagagaccactaaacgtgatttgggtatgtcgaaagagccaggggttgcgagtccgacatcctatctcgatgtcgacctacaccctgcatcggcttggaccttatatgccgtggcaaccacggtcataaccccaatgttgaggcataccatagagaacagcaccgccaacgtaagcctcgctgctatagcaaatcaagctgtagtcctcatgggactagataaaggatggcccatatcaaagatggacttgggggtacctttattggctctcggatgttattcccaagtgaacccattaacgctgactgcagccgttttactcttaataactcactacgcaataataggacctggcttacaagcaaaggctactagagaagcgcagaaaagaacggctgccgggattatgaaaaacccaactgtggatggaatcatgacaatagaccttgaccctgttatatatgactctaaattcgaaaaacaattagggcaagtaatgctattagtcttatgcgcagttcaactactattgatgcgaacatcatgggcgttgtgtgaagccctaactctcgctaccggtccaataacgaccctatgggaaggtagtccagggaaattctggaatacaacgatagctgtttcaatggcgaacatattcagaggcagttatcttgcaggcgcaggactcgcatttagtattatgaaaagtgttggcactggtaagagaggaacaggctcacaaggtgaaacacttggtgaaaaatggaagaagaaactgaatcaactaagtcgaaaggagttcgatttatacaagaaatctggcataactgaggtagatagaacggaagctaaagaaggattaaaacggggagaaatcacacaccatgcggtctcaaggggctccgctaaactacagtggtttgtcgagagaaatatggtaatacccgagggaagagtcatagacttagggtgcggccgaggaggatggtcctactactgcgccgggttaaagaaagtgactgaggttagaggttatacgaaagggggaccaggacatgaggagccggttcccatgtctacgtacggttggaacatagtaaaattaatgtcgggcaaagatgtattttatctgccgccggaaaaatgtgacactctactctgcgacattggcgaaagcagcccgtctcctacagttgaagaatctcgtaccatcagagtactaaaaatggtcgaaccctggctcaaaaacaatcagttttgtataaaagtgttaaatccctatatgccaacagtaatcgaacatttagagaggttacaacgcaagcacggaggaatgctcgtacggaatccactctccagaaactctacgcatgagatgtactggataagtaatggcacaggtaacatagtcgcttcggtgaatatggtatctaggttattactaaacaggtttacaatgacacatagaaggcctacaatcgaaaaggacgtagatctcggggcgggtacaagacatgtaaacgcagaacccgagaccccaaacatggatgttattggggaacgaataaagcgcattaaagaagaacacaatagtacatggcattatgatgatgaaaatccatataaaacatgggcatatcatggaagttatgaggtgaaggcaacaggaagcgcatcttccatgataaatggcgtggtcaagttgttgaccaaaccatgggatgtcgtacccatggttatacagatggcgatgaccgacacaacgccatttggacaacaacgagttttcaaagaaaaggtagatacccgcactccaagatctatgcccggaactagaagagtaatgggcataaccgccgaatggctatggagaacgctaggtcggaataaaaagcccagactatgcacccgtgaagaatttaccaggaaggttcggaccaatgccgcaatgggtgctgttttcactgaagaaaatcaatgggatagcgcaaaagctgcggtggaagatgaagatttttggaagctagtggacagagaaagagaacttcacaaactgggaaaatgtggttcgtgtgtatataatatgatgggcaagcgtgagaagaaattgggggaatttggaaaagctaaagggtcaagagccatatggtacatgtggctaggtgcacggtaccttgagtttgaagctcttggattcctcaatgaagatcactggttcagtagagaaaatagttattcaggcgtggaaggagagggtctgcataaacttgggtacatattgcgtgatatttcaaagataccaggaggtgctatgtatgcagatgacacagcaggttgggatacacgtataacagaagatgatctacacaatgaagaaaagataacccagcaaatggaccccgaacatcgtcaattagcaaatgccatttttaaattaacttaccagaacaaagtagtcaaggtccagagaccaacacccacaggtacggtaatggatataatctcacggaaggaccaaaggggatcgggacaagtaggtacgtacgggctaaatacctttactaatatggaagcacagttgatcagacagatggaaggagagggagtattatccaaagcagacctagagaatccccacttaccggagaagaaaataacacaatggctagagacaaaaggagtcgaaagacttaaacgcatggccataagcggagatgactgtgttgtaaaacccattgatgaccgattcgcgaacgcactattagcgctaaatgatatgggaaaagtaagaaaagacatccctcagtggcaaccgtcaaaaggttggcatgactggcagcaggtcccattctgcagtcaccactttcatgaattgatcatgaaggacggaagaaaacttgtggttccgtgtagaccacaggacgaattaatagggagggcaaggatttcccaaggagccggatggtcactacgagaaactgcatgtctcggaaaagcatacgcccaaatgtggtcattgatgtacttccatagaagagatctacgtttagcctcaaatgcaatatgctccgccgttccagttcactgggtgccaacgagcagaaccacatggagcatccatgctcatcaccaatggatgacaacggaagatatgctaactgtatggaatcgtgtctggattgaagataatccttggatggaggataagacgccggttacaacctgggaaaacgtaccctatttaggaaagagggaagatcaatggtgcggcagtctaatcgggttgacctcgagggcgacctgggcgcaaaatatcccaacggctatacagcaggttagatcgttgatcggtaacgaagaatttctagactatatgcctagcatgaaaagattcagaaaagaagaagagagtgaaggtgctatatggtaa

SEQ ID NO: 23081 - RNA, 9873 nt, synthetic construct
  misc_feature 1..9873: note = derived and/or modified CDS sequence (opt6) from DENV-3__GQ868571__SS-prME
  source 1..9873: mol_type = other RNA
acgtccctttgtctgatgatgatcttaccagccgctcttgcatttcacttaacgtcaagggatggtgaaccgaggatgattgtaggcaaaaatgaacgcggtaaatctttgctgtttaaaactgcgagtggtataaacatgtgcaccctaattgcaatggacctaggggaaatgtgtgatgatacagttacatataaatgccctcatataacggaagtggaaccagaagacatagactgctggtgtaatcttacctcaacctgggtcacttacggtacttgcaatcaagcaggagaacatagaagggacaaacgtagcgtggcactagcccctcatgtagggatgggactggatacgagaacacaaacatggatgagcgctgaaggagcgtggagacaagtcgaaaaagttgaaacatgggcattacgacacccaggattcactatactagcattattcctcgcccattatatcggtacctctctaacgcaaaaagctgtaattttcatattgttaatgttagtaacaccgagcatgaccatgcgttgtgtaggagtcggaaaccgtgactttgttgaagggttatccggggcaacttgggtcgatgtagtccttgaacacggaggatgcgtgacaaccatggcgaaaaacaaaccaacacttgacatcgaattacagaaaactgaagcaacacaactagccacactacgtaaattatgcatagaaggtaaaataacaaatattaccacggacagtagatgtcccacacaaggtgaagcagtcctcccagaagaacaagaccaaaattacgtttgtaaacacacatatgttgacagaggctggggcaacggatgcggattgttcggcaaaggttcattggtaacatgtgccaaattccaatgtctagaaccaatagaaggtaaagtagtacaatatgaaaacttgaaatatacggtgatcatcacggttcataccggcgaccaacatcaagtcggaaatgagacccaaggcgtaactgcagaaataaccccgcaggcttcaaccacagaagccatacttccagagtatggcacgctaggacttgaatgtagtccccggactggcttagatttcaacgaaatgattttacttacaatgaaaaataaagcctggatggtacatagacaatggttctttgatttaccgttaccctggacgagcggagcaactacggaaacaccgacatggaacagaaaagaacttttagtaacatttaaaaatgcccacgcaaagaaacaagaggttgttgtattaggcagtcaggaaggagcaatgcataccgctttaaccggcgcaacggaaatccaaaattccggtggtacatcaatctttgctggacacttaaaatgtagactaaaaatggataaactagaactcaaaggcatgtcgtatgccatgtgtacgaataccttcgtgttgaagaaagaagtctcggaaacacagcacggaacaattctcattaaagtagagtataaaggtgaagatgtgccctgtaaaataccgtttagtacggaggatggacaagggaaagcacacaacggaagactaattactgcaaaccctgtagtaactaagaaagaagaacccgtcaacatagaagctgaaccaccattcggagaatccaatattgtaataggcattggtgataacgcattgaaaattaactggtataagaaaggaagttcaattggaaaaatgttcgaagcgaccgcacgtggggcacgaagaatggcaatattaggtgatactgcttgggatttcggaagcgttggtggtgttctaaatagtcttggaaaaatggtacaccaaatttttggaagtgcttacacagcgctattttcgggagtcagctgggtcatgaaaatcggcatcggtgtactgcttacctggataggacttaatagcaaaaatactagcatgtcgttctcttgtatagcaattggtataattactttgtacctaggtgcagttgtccaagctgatatgggttgcgttatcaattggaaaggcaaagaacttaaatgcggctcaggcattttcgttacgaatgaagtacacacatggactgagcaatataaatttcaggctgactccccgaaaaggcttgcaaccgcaatagcaggagcatgggaaaatggtgtatgcggaatacgttccactacgaggatggagaatttattgtggaaacagatagcaaatgaactaaactacatactttgggaaaataacataaaacttacggtcgttgttggtgacattataggcgtactagagcaagggaaacgtacacttactccccaaccaatggagttaaaatactcatggaagacttggggcaaagctaaaatagttactgcggaaacccaaaactcctcattcattattgacggtccaaatacacctgaatgcccaagtgcttcccgagcttggaacgtatgggaagttgaggattacggctttggagtatttacaacaaacatatggttgaagctgagagaagtttacacacagctgtgcgaccatcgattaatgtctgccgcagttaaagacgagcgtgccgtccatgcagacatgggttattggattgagagtcaaaagaacggctcatggaagttggaaaaagcgagcttgatagaggtaaaaacatgcacctggccaaaaagtcacacgttatggagtaatggagtgttggagtcggacatgataataccaaagtcattagcaggaccaatctcccagcacaactatagacctgggtaccacacgcaaacagccggtccatggcacctgggtaaactagaactcgacttcaactattgtgagggtacaactgtagtaatcactgaaaattgtggaacaagaggaccttccttacgtacaacgactgtatcaggtaaacttattcatgaatggtgctgtaggagttgtacattaccaccattaagatacatgggtgaagacggatgctggtatggtatggaaataagaccaataagcgaaaaggaagagaatatggtaaaatcactcgtatctgccggaagtggtgaggtggataatttcaccatgggcgtcctttgtctggcaatattgttcgaggaagtgatgagaggaaagttcggtaaaaagcatatgatagcgggggtatttttcactttcgtactactactttccggacaaataacgtggagagatatggcacatacactcataatgattggctcaaatgcgtccgatagaatgggcatgggcgtaacgtacctggcactaatcgcaacttttaaaattcaacctttcttagctttaggatttttcctacgtaaactgacttcacgagaaaatttactcctcggtgtaggtttagctatggcgaccaccttacaactaccagaagatatagagcagatggcaaacggaattgcattaggcctcatggcattaaaactgataacacaatttgaaacttaccagttatggacggcattaatttcactaacttgtagtaatactatattcacattaactgttgcatggagaacggcgacattaatactagccggggtgtctctcttacccgtatgtcaaagcagttccatgcgtaaaacagattggctaccaatgaccgttgcagcaatgggtgtgcctcccttaccactcttcatcttttcccttaaggacaccttaaaacgcagaagttggcctcttaatgaaggcgtcatggcggtcggtctggtcagtattctagcgagcagcttattaaggaatgatgtaccgatggcaggtcccctagttgcgggaggactcctaattgcatgttacgtgattacgggaacgagtgccgacttaacagttgaaaaagccgcagatgtaacatgggaagaagaggcagaacaaactggagtcagccacaatttaatgataactgtcgatgatgatggcacaatgagaattaaagatgatgagactgagaatatattgacggtcttgctaaaaacagcacttctaatagttagtggcatatttccttattcaattccagcaacgttattggtttggcatacttggcaaaagcagacccaaagaagtggagtcttatgggacgttcctagtcctcccgaaacccaaaaggcagaattggaggaaggagtgtaccgtataaaacaacagggcatattcggtaagacacaagtgggagtaggagtacaaaaagagggagtattccacacgatgtggcatgtaacaagaggagctgtactaacatataatggcaaacgtctggaaccaaactgggcctccgtgaaaaaggacttaatatcatacggaggaggttggcgactttccgcacagtggcaaaaaggagaagaagtgcaagtcatagcagtagaaccaggcaaaaatccgaaaaatttccaaaccatgcctgggacatttcaaaccactactggggaaattggagcaatagcattagatttcaaacctggtacaagtggaagtccaattataaatcgtgaagggaaagtagttgggttatatggcaacggcgtggtaactaagaatggaggttatgtatcaggaatagctcaaacaaatgctgaaccggacggaccgacaccagagttagaagaagagatgttcaagaaacgaaatctaacaataatggatttacacccagggagcggaaaaacaaggaaatatctaccagcgatcgttagggaagcaatcaaacggcgtctccgaacactcatactagcccccactagggtcgtagccgctgaaatggaagaagccttgaaaggattaccaattagatatcagacaactgcaacaaaatcggagcacactggaagagaaatagtagatctaatgtgccatgcaacattcaccatgaggctgctatctccagttagagtgccaaattacaacctaataatcatggatgaggctcactttactgatcccgccagtattgccgcaagaggatatatatccacccgcgttggaatgggtgaagcagcagcgatcttcatgactgctacaccaccgggaaccgcagacgcttttcctcagagcaacgcgccgattcaagatgaggaaagagacattccggagcgctcctggaactctggcaacgaatggattacagacttcgctggaaaaacagtgtggtttgtaccctcgattaaagcaggaaacgatattgcaaactgcttacgtaaaaatggcaagaaagtgattcaactcagtagaaaaacatttgatacagaataccagaaaactaagttaaacgactgggattttgtagtaacaacagacatttcagaaatgggcgcaaactttaaagcggatagagtgatagacccaagaagatgtttgaaacctgtgatacttacggacgggcctgaaagggtcatactggctggtccaatgcctgttaccgcagcttcagcagctcagcgtagaggccgcgtaggaagaaacccccaaaaagaaaacgatcaatatatcttcacaggacaacctcttaacaatgacgaagaccatgcgcattggacagaagcgaaaatgttattagacaacattaatacaccagagggcataataccagcgttatttgaacctgagagggaaaaatccgctgcaatagatggagaatacaggttgaaaggtgagagtaggaaaacatttgtcgaactaatgcgaagaggagatttgccagtttggttggcccacaaagtagcttcagaaggtattaaatacactgaccgaaaatggtgttttgatgggcaacgaaacaaccagatcctagaagaaaatatggatgttgaaatctggacaaaggaaggtgagaagaagaaattacgaccaagatggttggacgcgcggacatatagcgatcccctagcccttaaagaatttaaagactttgcggctggacgcaaatccatagccttagacctagttacagaaataggtcgggtaccgacccacctagctcacagaactaggaatgcattggataacttagtcatgcttcatacatctgaacacggaggaaaagcgtatcgtcacgcggtagaagaattacccgaaactatggagaccttactattgctaggactgatgatactactaacaggcggtgccatgctttttcttatatctggcaaaggaatcggaaaaacgagtattggattgatttgtgtaatagcatccagtgggatgctgtggatggccgagatacccttacaatggatagcctccgctatcgtactggagttctttatgatggtattacttataccagaaccagaaaagcaacgaaccccacaggataaccaattagcatatgtcgtaatcggtatactaaccttggccgctatcatagcagcaaatgaaatgggcatgctagaaacaaccaagagagacctggggatgtccaaggagccgggcgtcgttagtcctaccagttatcttgatgtcgatctgcaccccgccagcgcgtggacactctacgcagtagcgaccacagtaataactccaatgcttagacacacaatcgaaaacagtacagcgaatgtatctttggccgccatagctaaccaagctgttgttttaatgggacttgataaaggctggcccataagtaaaatggacctaggtgtgcctctactcgctttaggatgttatagccaggttaacccattaaccctcacggctgcagtgcttttactaatcactcattatgcaatcatagggcccgggttacaagctaaagccactcgagaggcacagaaaagaactgctgcaggaataatgaaaaacccaactgtagatggaataatgacaatcgatttggaccctgtaatttacgacagcaaatttgagaaacagctaggacaagtaatgctactcgtgttatgcgccgtccaactactcttaatgcgcacatcatgggccttgtgcgaggctttgacgctagcgacaggaccaataactactttgtgggaagggagtccaggcaaattttggaacacaacaatagccgtcagcatggccaacatctttagaggatcatatttagccggcgcgggcctagccttttcaatcatgaaatcagtgggtaccggtaaacgcggcaccgggtcgcaaggtgaaacacttggggaaaaatggaagaagaaactaaatcaattgtcgcgcaaagaatttgatctctacaagaaatccgggattactgaggtcgatagaacagaagcaaaggaaggcctcaaacggggcgagataactcaccatgccgtatcaagagggtctgcaaaattacagtggttcgttgaacgaaacatggtaattcccgaaggacgggtaatagatctgggatgtggaagaggaggctggagttactattgcgctggactgaagaaagtcaccgaagtgcgtggatacactaagggtggcccaggacatgaagaacccgtacctatgtctacttacggttggaacattgtaaaactaatgtctggaaaggatgtattttatttaccgccggaaaagtgtgataccctactgtgtgatattggcgaaagtagcccatcgcctaccgtcgaagaaagtcgaacaatacgcgtactgaaaatggtcgaaccatggctaaagaacaaccaattctgtataaaggttttaaatccttatatgccaactgttattgagcatttagaaaggttacaaagaaaacacgggggtatgctggtacgaaatccgttatcaagaaattcgacgcatgagatgtactggattagcaatggcactggtaacattgtagccagtgtaaatatggtttcacgcctattattgaacagatttacaatgacacataggagacctacaattgaaaaagacgtggatttaggagccggtactcgacatgtaaatgccgagccagagacaccgaacatggatgttataggtgaaagaattaaaagaattaaagaggagcataactctacttggcactatgatgatgagaacccatacaagacatgggcttatcacgggtcttatgaagttaaggctactgggtccgcctcctcaatgataaatggagtagtaaaattgttgacaaagccatgggacgtagtacctatggtaacacaaatggctatgacagataccacgccctttggccaacaaagggttttcaaagaaaaggtggataccagaacaccgaggtcaatgccgggaacgagaagagtaatgggaatcacagcggaatggttatggcgtacactcggacggaataagaaaccccgtctttgcacgagagaagagttcacaaagaaggtgagaacaaatgcagctatgggtgccgtattcactgaagaaaatcaatgggactcagcaaaagcagcggttgaggatgaagatttctggaagctcgttgaccgtgagagagaattgcataaactcgggaaatgtggatcctgtgtatacaacatgatgggcaaacgagagaagaaactaggcgaatttggaaaagccaagggatctagagccatatggtacatgtggctaggagcaagatatttagaatttgaggccctaggattcttaaacgaggaccattggttctcgagagaaaattcgtacagtggagtcgagggagaaggcctacataagttagggtatatattacgcgacatatcaaagatcccaggaggcgctatgtacgccgatgacacagctggctgggatacaaggattacggaggacgacctacataacgaggagaaaattacccaacaaatggaccctgaacataggcaattggctaacgcaatattcaaacttacataccaaaacaaagttgtgaaagtacaacgtccaactcctactggaacggtaatggacataatttcaagaaaagatcagcgaggatctggacaagtcggtacatatggtttgaacacatttactaacatggaagcacagcttatcagacaaatggagggtgagggagtactaagcaaagcagatttagaaaacccacacttaccagagaagaaaataacacaatggctagaaacgaagggagtggaaagactaaaacggatggcaatttcaggtgatgattgtgtagtaaagcccatagacgatcggttcgcaaacgccttattagcattaaacgatatgggtaaagtccgtaaagacataccccaatggcaaccgtctaagggctggcatgactggcaacaagtgcccttctgttcccaccatttccatgaactgataatgaaagatgggagaaagttagtagtaccctgcagaccgcaagacgaattgattggtagagcccgaatatcacaaggcgcaggttggtcattaagagaaacagcatgcttgggaaaagcgtacgcgcaaatgtggagcttaatgtacttccatcgtcgtgatttacgcctagcatcaaatgcgatatgtagcgccgtacctgtacattgggtacccacatcaagaactacatggtctatacacgcacatcatcagtggatgacaacagaagatatgcttacagtatggaatcgagtttggatagaagacaacccatggatggaagacaaaactccagttactacgtgggaaaatgttccatatctaggaaagcgagaagaccagtggtgtggcagcttaatagggctcacaagcagagccacctgggcacaaaacatacctacagcaatacagcaagtaagatctttaatcggcaacgaagagttcctagattatatgccatctatgaaaaggtttcgaaaggaagaagaatcagaaggagcaatttggtag

SEQ ID NO: 23082 - RNA, 9873 nt, synthetic construct
  misc_feature 1..9873: note = derived and/or modified CDS sequence (opt6) from DENV-3__GU131951__SS-prME
  source 1..9873: mol_type = other RNA
acttctctatgcctgatgatgatactaccagctgcactggcgtttcacttaacttcaagagacggagaaccaaggatgatcgtcggtaaaaacgaaagaggaaaatcgctactatttaaaacagcaagtggtataaatatgtgtacacttatagcaatggatctgggtgaaatgtgtgatgatacagtcacgtacaaatgtccacacattacggaagttgaacccgaagatattgactgctggtgtaatttgacatcaacatgggtaacgtacggcacttgtaaccaagctggggaacacagaagagataaaaggtcggttgcactagcacctcacgtgggtatgggtctagatacacgaacgcaaacatggatgagtgcagaaggggcctggagacaagtagagaaagttgaaacgtgggctttgcgacacccaggtttcacaattttagcattgttcttagcgcactatattggtacaagtttaacccaaaaggtagtgatttttatactattaatgcttgtgactccctcaatgaccatgcgttgtgtcggagtaggaaatagagactttgtcgaaggtctttccggtgccacttgggtagatgtggtcctagaacacggcggttgcgtaactacaatgtctaaaaacaaaccgacccttgatattgaattacagaaaacggaagccacccaattggctactcttcgaaaattatgtattgaaggaaaaataaccaacataacaacggattctagatgtcccacccagggcgaagctgtgttacccgaagaacaagaccagaactacgtttgcaaacacacatacgtagatagggggtggggtaatggatgtggactatttggcaaaggtagcttggttacgtgtgcaaaattccaatgtctagaaccaattgaaggcaaagttgtacaatacgaaaatcttaagtatacagtcataataaccgtacatacaggcgaccaacatcaagtagggaacgaaactcaaggagtaaccgctgaaataacaccgcaggcttccactaccgaagcaattcttcccgaatatggaaccctgggtcttgaatgtagtccccgcaccggattagattttaatgaaatgattttacttactatgaaaaacaaagcatggatggttcatcgtcaatggttctttgatttacccttaccatggacctcaggggcgactactgagacacccacctggaataggaaggaattgttagtaactttcaaaaatgcgcatgccaaaaagcaagaagtagtcgtattaggtagtcaggaaggagcgatgcataccgcattaacaggagctacagaaattcaaaattccgggggcacctcaatttttgcgggacatcttaagtgcagattaaaaatggacaaattagagttgaaagggatgtcatatgccatgtgcacgaacacattcgtactcaagaaagaagtaagcgaaacacaacacgggactattttaatcaaggtcgaatacaaaggtgaagacgtgccatgcaagattccgttctctactgaagacggtcaagggaaagcacataacggccgattgatcactgctaatccagtcgttacaaagaaggaagaaccggtaaatatagaagctgaaccaccatttggtgaaagcaacatagtaataggaatcggcgataatgccttaaaaataaactggtacaagaaaggttcttcaataggaaaaatgtttgaagcgacagctcgaggtgcacgaaggatggccatattaggagacacagcatgggactttgggagcgtcggcggagtactaaatagcctcggcaaaatggtgcaccaaatctttggttcagcctatactgctctattttcaggagtttcttgggtaatgaaaatcggtataggagttctgcttacatggattggactaaacagcaagaacacgtcaatgagcttcagctgtatagcgataggaataataaccctatatcttggcgcggtagtacaggcggatatgggctgcgtgataaattggaaaggtaaggaacttaagtgcggaagtggtatatttgtcacaaacgaagtgcatacatggactgagcaatataaatttcaggccgattccccaaagcgacttgccacagcaattgcaggggcatgggaaaatggcgtctgcggtataagaagcacaactcgaatggaaaatctactatggaagcaaatagcaaatgaattaaattatatattatgggaaaataacataaaattaactgtagtcgtgggagatatcattggtgtgttagaacaaggtaaaagaaccttgactcctcaaccaatggaacttaaatacagctggaaaacgtggggaaaagcgaaaatagtcactgcagaaacacaaaattcatctttcattatagatggtccgaacacaccggaatgtccgtctgcatctagggcatggaacgtatgggaagttgaagactatggttttggagtgtttaccactaatatatggttgaaacttagagaggtgtatactcaattatgcgatcatagattaatgagtgcagcagtaaaagacgagagggctgtgcacgcagatatgggttattggatcgaatctcaaaagaatggatcatggaagttagaaaaagcgtccctaatcgaagtaaaaacatgcacttggcctaaatcacacacgctttggtcaaatggggttcttgaaagcgatatgatcataccgaaaagcctagcaggacccatatcacaacacaattatcgccctgggtatcatacccaaacggcggggccctggcatcttggcaaattagaactggactttaattattgcgagggcactacagtagtcatcactgaaaattgtggcacacgaggtccttcacttcgaacaacaacggttagtggaaaactaatacatgaatggtgctgcagatcgtgtacactgccaccattaagatatatgggggaagacggatgttggtatggtatggaaataagacctatatcagaaaaagaggaaaatatggtgaaaagccttgtatcggctggatctggtgaagtcgataatttcactatgggtgtgttatgtctggcaatattatttgaagaggtaatgcgagggaaatttggtaagaaacatatgatagcgggcgtattcttcacatttgttctcttattatccggccaaataacatggagagatatggcacatactcttatcatgatcggaagtaatgcaagtgatcggatgggaatgggcgtaacatatctggccctaatagcaacctttaaaattcaaccattcctagcgctcggtttctttctacgtaaattaacgtcgagagaaaacttactccttggagtcgggctagctatggcaacgacccttcaactaccggaagatatagaacagatggccaatggaattgctttaggcttgatggccctgaaactgataactcaatttgagacataccaattatggactgccctaatatctctcacatgctctaatactatattcaccctcacggtagcatggcgcacggccactttaatattggctggggtctctttattacccgtctgccaaagttcatccatgcggaaaactgattggctaccaatgactgtagcggctatgggcgtccctccactacctttatttatatttagtctaaaagataccttaaagagacgatcgtggcctttaaacgaaggtgtaatggcagtcggtcttgtcagtattttagctagcagtttactaagaaatgatgttcctatggcaggacctctagtagcaggaggtctgcttattgcctgctatgtgataaccggtacgtcagctgaccttacagtcgaaaaggcggcagatgttacttgggaagaagaagcagagcaaacgggagttagccataatttaatgattaccgtggatgacgacgggacgatgcggattaaggatgatgaaacagaaaacatactaactgtgttgctaaagacagccctactaatagtatctgggattttcccatattctatcccagcaactctattagtatggcatacgtggcagaaacaaacccaacgatcaggagtattgtgggatgttcccagtccaccagaagcacagaaagcagagctggaagaaggtgtttataggataaaacagcaaggaatttttgggaaaacacaagttggtgttggagtacaaaaagaaggagtttttcataccatgtggcatgtgacgagaggcgccgtgctaacgtataacggaaaacggttagaaccaaattgggccagtgttaaaaaggatttaatatcatacggaggcgggtggaggttaagtgcgcaatggcaaaagggggaggaagtacaagtaatagcggtagaaccaggaaagaaccccaaaaattttcaaacgatgccagggacgtttcaaacaaccactggtgaaataggggcaatagcgctcgatttcaagccaggaacatctgggagcccaataataaaccgagaaggaaaagttgtgggtctctacggaaatggtgtagtaactaaaaatggaggttacgtctcaggcattgcacaaacaaacgcggaacctgatggccctaccccggagctagaagaagaaatgtttaagaaaagaaatctaacgatcatggacctccatccaggttctggcaagacgagaaagtatttgcctgccatcgtccgagaagctattaaaagacgcttgcgtactttaatccttgcgccgacacgggtcgtagctgcagagatggaagaagcccttaaaggattaccaataaggtatcaaacaactgccacaaaatccgaacatacaggaagggaaatagtagatctgatgtgccacgcaacattcacgatgagactattgagcccagtgcgagttccgaactacaacctaataatcatggacgaagcacactttaccgaccccgcttctatagcagcccgtggttatatttcgactagagtgggtatgggtgaagcagcagcaatctttatgactgccactcctcccggaacagcagacgcatttccacaaagcaatgcaccaatacaagatgaagaacgtgacatcccggaaagatcatggaatagtggaaacgaatggattaccgatttcgctggaaaaacagtttggtttgttccttcaataaaagcagggaacgacatcgccaactgtctaaggaaaaatgggaagaaggtaatacaattatctaggaaaacttttgacactgaatatcaaaagacgaaacttaatgattgggattttgtagtaactacagacatatcagaaatgggggctaactttaaggcagaccgtgttatagacccgagacggtgtctgaagccagtcatactgactgatggaccggaaagagtcatcctcgctggaccaatgcctgtaacagcagctagcgcagcacaaagacgaggtagagtaggtagaaatccgcaaaaagaaaacgatcaatatatattcactggacaacccttgaacaatgatgaagatcatgcacattggacagaagctaaaatgctactagacaacattaatacaccagaaggtataataccagccttatttgaaccagaaagggaaaaatctgcggcaatagatggtgaatataggttaaaaggcgaatcccgaaaaacgtttgttgaattgatgagacggggtgatctaccagtctggttagcccataaggtcgcatctgaagggataaagtataccgacaggaaatggtgcttcgatggtcagagaaataatcaaatactggaggaaaatatggacgtagaaatatggactaaagaaggtgaaaagaagaaattaagacccagatggttagatgcccgtacgtattcggatcccttagccctaaaagagttcaaagattttgccgcaggaagaaaaagtattgcactagatctagtgactgaaattggaagggtgccttcccacctagctcacaggacgaggaatgctctggataatcttgtaatgctacatacttcggaacacggaggcaaggcataccgacacgcagtagaggaattacctgaaaccatggaaacattacttctattgggcctaatgatactgctgaccggcggggccatgctctttttgatatccggaaaagggataggtaaaacctccattggcctaatttgtgtgatagccagttctggcatgttatggatggctgaaattcctttacaatggatagcatccgcgatcgttttagagttctttatgatggtactattgataccggaacccgaaaaacaacgaacgcctcaagacaatcaattagcttacgttgtaatcggaatcctcaccctcgctgcgattatagcagcaaacgaaatgggcttattagagacaaccaaaagagacttgggaatgtctaaggaaccgggtgtcgtttcccccacttcatatcttgatgttgatttacatccagcgtcagcttggacactatacgcagtagctaccacagtgataactccaatgttgcgtcatacaatagaaaattccactgcaaatgtatcattagccgctatcgcaaatcaagcagtggttctaatggggcttgataaaggatggcccattagcaagatggacctaggagtaccgcttcttgcattagggtgctattcacaagtcaatccactaacgttgacagctgctgttctgctgttaattactcattacgcaatcataggaccagggttacaagcgaaagctaccagggaagctcaaaagcgcacggccgcgggcatcatgaaaaacccgacggtggatgggattatgacaatagatctagatccagtgatatatgactctaagtttgaaaaacaacttggacaagtgatgctcttagtattgtgtgcggtacaactacttcttatgagaacaagttgggcattatgtgaggctctgacgttagcgacagggcctattacaacgttatgggagggaagtcctggaaaattttggaataccactatcgcagtttctatggctaacatttttcgagggtcatacttagccggtgcaggattggcgttttccataatgaaatcagtcggaactggcaaacgtggaaccggatctcaaggagagacacttggagaaaagtggaaaaagaaactcaatcagctttctcgtaaagagttcgacctctataagaaatcaggcataaccgaggttgatcgaacagaggcaaaagaagggttaaaaagaggagaaataacacaccatgccgtatctcgaggtagtgctaaattacaatggtttgtagagagaaacatggtaactccagaaggcagggtcatcgatctaggctgcggaagaggcggatggagctattattgcgcaggattgaagaaagtaactgaagtgagagggtatacaaaaggcggacctggccacgaagaaccagtaccaatgtctacttacggatggaatatcgtaaagttaatgtcgggtaaggatgtgttctacttaccacctgagaaatgcgacaccttactgtgtgatataggtgaatcatcaccttccccaatagtagaagaatcacgcacaatccgagtacttaaaatggtagaaccttggttaaagaataaccaattttgtataaaggtacttaacccttacatgcctactgtgatcgaacatctggaaaggctacaacgcaaacatggaggtatgctcgtcagaaatccactcagccgaaattcaacccatgaaatgtattggatctctaacggaacgggtaatatagtagcaagtgtcaacatggtatctcgcctactattgaacagatttacaatgacgcatcgacgtccaacgatcgaaaaagatgtagacttaggggcaggcacaagacatgtcaatgctgagccagaaactcctaatatggatgtaataggcgaacgcattaaaagaataaaagaagaacataatagtacttggcactacgacgacgagaacccatataagacctgggcgtatcatggcagttacgaagtaaaagcaaccggtagcgcttcttcaatgataaatggtgttgttaaactcttaactaaaccatgggatgttgtgccaatggtaacccaaatggctatgaccgatactacgccctttggacaacagcgtgtattcaaggaaaaggtagacactcgtactccacggtctatgccgggaactagaagagtaatggggataactgcagaatggctatggaggaccctaggtcgaaataagaagcctagactgtgtaccagggaagagttcactaagaaagtgaggaccaatgcagccatgggagcagtctttacagaggaaaatcaatgggactcagcaaaagcagccgtggaagatgaagacttttggaaattagtagaccgagaacgagaattacacaaactcggaaaatgtggatcatgcgtgtacaatatgatgggaaaaagagagaagaaactcggagagtttggaaaagctaaaggttctcgagcaatttggtatatgtggctaggagcgaggtacctcgagttcgaagcattaggatttttaaatgaagatcactggttttcaagagaaaattcctactcaggcgtggaaggagaggggctacataaacttggatatatcttaagagatatttcgaaaatcccaggcggtgcaatgtatgctgacgacacagccggttgggacacaagaataactgaggacgatctgcacaacgaagagaaaataacacagcaaatggaccctgaacaccgacagttagcaaacgctatattcaaacttacctaccaaaacaaagtagtcaaagtgcagcgacctacgcctactgggactgttatggatataatctcgcgcaaggaccaaagaggatcaggtcaggtagggacgtatggtctaaacacttttaccaatatggaagctcagttaataagacaaatggaaggagagggcgtgctttctaaggcagatctagagaatccacaccttcctgagaagaaaatcactcaatggttagagacgaaaggagtggaacggttgaaaagaatggcaatttcaggagatgactgtgtagtaaaaccaatagatgatagatttgccaatgccttgctagctctcaatgacatgggtaaagtgaggaaggatattccacaatggcagccaagcaaaggctggcacgattggcaacaagtaccattctgtagccatcactttcacgaactaattatgaaagacgggagaaaattagtcgttccttgtcgaccgcaagatgagctaatcggtagagcccgtattagtcaaggggcaggatggtcacttcgagagaccgcgtgtctaggtaaagcgtacgcacaaatgtggtccctcatgtatttccatcgacgagatttacggctagcaagcaatgcaatttgttccgctgttccagttcattgggtaccaacaagtcgcaccacatggtcgatacatgctcatcatcaatggatgaccaccgaagacatgctcacagtctggaacagagtgtggatcgaagataacccatggatggaggacaagacacctgtaacgacgtgggaaaacgtgccatacttagggaagagggaagatcaatggtgtggatcactaataggacttactagccgagcgacttgggcacaaaacatccctacagcgatccaacaagttagaagtttaattggtaatgaagaatttctcgattatatgccgtccatgaagaggtttagaaaagaagaagaatcagaaggagcaatttggtag

SEQ ID NO: 23083 - RNA, 9873 nt, synthetic construct
  misc_feature 1..9873: note = derived and/or modified CDS sequence (opt6) from DENV-3__GQ868572__SS-prME
  source 1..9873: mol_type = other RNA
acttctctctgtctgatgatgatactgccagctgcactggcttttcacttgacgagtcgggatggagaaccgaggatgatagtagggaaaaatgaacggggaaaatcattactctttaaaacagcaagcggtattaatatgtgtacattaattgcaatggatttaggagaaatgtgcgacgacacggtaacttacaaatgtccgcatataaccgaagtagaaccagaagacatagattgttggtgcaatcttacatccacatgggttacctacggcacctgtaaccaagctggcgaacatcgtagggataaaagatcggtagcactggccccacatgtaggaatgggcttagacacacgaacacaaacatggatgagtgcagaaggtgcatggagacaagtggaaaaagtagaaacgtgggcactcagacatcccgggtttactattctggccttatttctagcacattatataggcaccagcctaacgcaaaaagcagtaatatttatattacttatgctagttacgccaagcatgacaatgaggtgcgtcggagtgggtaatagagatttcgttgaaggcttaagcggtgcaacttgggtcgacgtagtactagaacatggaggctgcgtgacaacaatggccaaaaacaaaccaactctggacatcgaactacagaaaacggaagctacccaactagctactttacgcaaattgtgtatagaaggaaaaatcaccaatattactactgactcccgatgcccaacccaaggagaagccgtcctcccagaagaacaagaccaaaattatgtatgtaaacacacatatgtggataggggttggggcaatggatgtggtctatttggcaaaggatccttagtcacatgcgccaaattccaatgcttagaaccaatagaaggcaaagtagtccaatatgagaatctaaaatacacggttataataacagtacacacaggagaccaacatcaagtaggaaatgagacacaaggtgtaacagcagaaataacgccccaagcatcaactactgaagccatcctacctgagtacggaaccctcggattggagtgcagtccacgaaccgggctagatttcaatgaaatgatactactaaccatgaaaaataaagcatggatggtacaccgtcaatggttctttgatttaccactgccttggacgagtggagccaccaccgagactccgacatggaataggaaagaactactggtaacattcaaaaatgcccacgccaaaaagcaagaagtagtagtgttaggatctcaagaaggagccatgcacacagctctaactggggctactgaaatccaaaacagcggcgggacaagtatttttgccggacacctaaaatgtcgtctcaaaatggacaagctcgagttaaaagggatgtcctatgcaatgtgtacaaacactttcgttctaaagaaagaagtttcggaaactcaacatggaacaattttaattaaagtagaatataaaggcgaagatgtcccttgtaaaatacccttttccacggaagacggacaaggaaaagtacacaatggacgtctaattacagcaaaccctgtggtaaccaagaaagaagaacccgttaacatagaggcagaaccgccatttggtgagagcaatattgtcatcggaattggagataacgcccttaaaataaactggtacaaaaagggatcctcaatcggaaaaatgttcgaagcaacagcgcgaggagctcgaagaatggccatcttaggggacactgcatgggactttggttcagtaggtggtgtcctaaattcattaggtaagatggtacatcaaatttttggctctgcttacacagccctattttctggagtcagttgggtaatgaaaataggtataggtgttttattgacctggattggacttaacagcaaaaacacttcgatgtcatttagttgcatagcaataggtatcataacactatacctaggcgcagtagtgcaggctgacatgggatgtgtgataaattggaaaggtaaagagctcaaatgcggaagtggtatcttcgtcacaaatgaagtgcacacatggacagagcaatacaaattccaagcagatagtccgaaaaggttagctacggcgattgcgggtgcatgggaaaatggtgtttgcggtataagatccacaacacgcatggagaatctcttgtggaagcaaatcgcaaatgagctgaattacattttgtgggaaaataatattaagttaaccgtagtggtaggcgatatcataggagtactcgaacaaggtaaacgtaccttaacaccacaaccaatggaactaaaatactcatggaaaacatggggtaaagctaagatagtgacagctgaaacacaaaatagttcgtttattatagacggacccaatacccctgaatgcccttcagcatccagagcttggaacgtatgggaagtagaagactacgggtttggagtatttactacgaatatctggctgaaattacgggaagtatacacacaactatgtgaccatcgcttaatgagcgcagcagttaaggatgaaagagcggtacacgctgacatgggttattggatagaaagtcagaaaaatggatcttggaaactagaaaaggcttcactaattgaggttaaaacttgcacgtggcctaagtctcataccctttggagcaacggggtactcgaaagtgatatgatcatcccaaaatccctggctggacctattagccaacacaattaccgcccaggctaccacacacaaactgctggaccgtggcatttaggaaagttagaattagacttcaactactgtgaaggcactacggtcgttatcacagaaaactgtggcaccaggggacctagtttacggactacaaccgtatcaggcaaacttatccatgagtggtgttgtcgaagctgtactttaccgcctttaagatacatgggggaggatggatgttggtacggaatggagattagaccaatatccgaaaaagaggaaaatatggtcaaaagtcttgtatccgctggtagcggcgaagtagataacttcacaatgggggtcttatgtctagccatactgtttgaagaagtcatgagaggaaaattcgggaaaaagcatatgatagccggggtattctttacattcgtattacttttatccggccaaatcacttggcgcgacatggcacatactttgataatgataggttcaaacgcaagtgatagaatgggaatgggcgtaacatatttagctttaatcgcaacctttaaaattcaaccttttctcgcacttgggtttttcctcagaaaactaacctcaagagaaaacttattgctaggagtaggtttagcaatggcaaccacacttcaactgcccgaagacatcgaacaaatggcaaatgggatagctcttggattgatggcattaaaactaataacacaattcgagacataccagttatggacggcgcttattagtcttacttgtagtaatactatatttacgttaacagttgcctggagaacggccaccttgatattagcaggcgtgtctctgcttcccgtttgccagagctctagcatgcggaaaacggattggctacccatgacagttgctgctatgggagtaccgccactccctctgttcatatttagtttgaaggatacattaaaacgacgatcttggcccctgaatgagggtgtcatggccgtagggctagtatcaattctcgctagttcattgctccgaaatgatgtaccaatggccggccctctcgtcgcaggaggccttctaatagcgtgctatgtaataactggcacttcagccgatcttacagtagaaaaggcagcagatgttacttgggaagaagaagcagagcaaactggggtatctcataatttgatgataactgtcgatgacgacgggactatgcggattaaagatgatgaaactgagaacattttgacagtattactaaaaacggcgttgctcatcgtgagtggtatcttcccatacagcataccagctacattactggtttggcacacatggcaaaaacaaactcaacgtagcggagtcttatgggatgtaccgtcgccacctgaaacacagaaggccgaattagaagaaggggtatatagaatcaaacagcagggcatttttggaaaaacacaggtgggtgttggggtgcaaaaagaaggggtttttcacactatgtggcacgttaccagaggggccgttttgacatataatggcaaaaggttagaaccgaattgggcctctgtcaagaaagatcttatttcgtatggaggcggttggaggttatcagcccagtggcagaaaggagaggaagttcaagtgatagctgtagagccagggaaaaatcccaaaaattttcagacaatgccaggaaccttccagacaacaactggtgagattggggcaatagcattagactttaaaccaggaacaagcggatcaccaataatcaatcgtgaagggaaagtcgtaggcctctatgggaacggcgtggtaacgaaaaatggcggctatgtaagcggaattgcgcaaacgaatgctgagccagatgggcctaccccggaactagaagaggaaatgtttaagaaaagaaatctcacaataatggatcttcatcccggatcaggaaaaacaagaaaatatctcccggctatcgtacgtgaagctataaaaagaagattaagaactcttattcttgccccaacacgcgtagtcgcagctgaaatggaagaggcactgaaaggactaccaatccgctaccaaaccactgcaacaaaaagcgaacatacgggaagggagattgttgatttaatgtgtcacgcaacctttacaatgcggctgctgtctccggttagagttcctaattataatcttataattatggatgaagcacactttacagatccagcaagtattgctgctcgcggctacataagcaccagggtcggaatgggggaagctgcagcaatcttcatgaccgcaactccacctggaacggccgatgcatttcctcaatctaatgcccctattcaggatgaagaacgagatataccagaaagatcatggaatagtggcaatgagtggataaccgatttcgcagggaaaactgtttggtttgtaccaagtataaaagcaggtaacgacatcgcgaactgtctcagaaagaatggaaagaaagtgattcaacttagtagaaagacattcgatacagaatatcagaaaactaagttaaatgactgggactttgtggtaacgacggacataagcgaaatgggagcgaattttaaagcggatcgagtaatcgatccacgaagatgtctgaaacctgtcatactaaccgacggtcccgaacgagtaatccttgcgggacccatgccagtaacagcagcaagcgcggcgcaaagacgtggcagagtcgggcgtaatcctcagaaagaaaacgatcaatatatttttaccggacagccacttaacaatgacgaggaccatgcccattggacagaagctaaaatgctattagataacatcaacactccagaaggtatcattccggccctatttgaacccgagagagaaaagagtgcagctatagatggggagtaccgtcttaaaggagaaagcagaaaaacctttgttgaattaatgcgtagaggcgacctccccgtatggctagcacataaagttgccagcgaaggtataaaatatacggaccgtaaatggtgtttcgatggccaaagaaataaccaaattttggaagaaaacatggatgtagaaatctggacgaaagaaggtgagaagaagaaactgcgtccaagatggttagacgcaagaacgtacagcgacccccttgcattaaaggaatttaaagatttcgcagcgggccgcaagtcaattgcattagatttagtaaccgaaattggaagggtccccacacacctagcacaccggacacggaatgctctagataacttagttatgttgcatacctcagaacacggaggcaaggcttatagacacgcagtcgaggagctaccagagacaatggagacacttcttctattggggctaatgatattgttaacgggtggagccatgttattcttaatatcgggcaaaggaatagggaaaacgtcaatcggcttaatatgtgttatagcaagctctggaatgctatggatggccgaaataccactacaatggatagcatcggcaattgtccttgaatttttcatgatggtgctcctcatacctgaaccggaaaagcaacgtacaccacaagataaccaactggcttatgtcgtgattggaatactcacgctcgcagctataatagcggcaaatgaaatgggattacttgaaactacaaaaagagacttgggaatgagtaaagagcctggtgtggtctctcctacatcatacctggatgttgatctacacccggcatcagcctggacactgtacgccgttgctactacagtaattacaccgatgcttagacatacgatagaaaacagtaccgcgaacgtttctctggccgcaatagcgaatcaagctgtagtattgatgggccttgataaaggatggccgataagcaaaatggacctcggagtacccctattagcattaggatgctatagccaggttaaccctttaacacttacagctgctgttctacttctaataactcattacgcaattatagggccaggtttgcaagcaaaagctacaagagaagcacagaaaaggactgctgcagggattatgaaaaatccaaccgtagacggtattatgactatagatttggatcctgtaatatatgactccaaattcgaaaaacagctgggtcaggtaatgctacttgtactttgtgcagtacaactactcttaatgcgtacgtcgtgggcactttgcgaagctcttacacttgctacaggcccaataactacgctttgggaagggtcacccggaaagttttggaacactaccattgccgtgtcaatggctaacatctttagaggcagttatttagcaggggcaggtctagctttctctataatgaaatcagttggaacagggaagagaggtaccggaagtcaaggagaaacgctaggagaaaaatggaagaagaaacttaatcaactctcacgtaaagagttcgatttgtataagaaatcaggaattactgaagtggaccgaacggaagccaaagaaggtctaaaaagaggcgaaataacacatcatgcagtcagtaggggttccgctaaacttcaatggtttgtagagagaaatatggtgatacccgagggaagagtcatagatttgggatgtggcagaggtggctggtcctactattgtgccggtctaaagaaagttacagaggttagaggatacacgaaaggtggacctggacatgaagaacctgtacctatgagtacgtatggatggaacatagtgaaactaatgtcaggcaaggacgtgttctatctaccaccagaaaagtgcgatacactattgtgtgacattggagagagttccccaagcccaactgtagaagaatcgcgtacaatcagagtcctcaaaatggtagaaccttggttaaagaacaatcaattttgtatcaaagtgctaaatccctatatgccgacggtgatagaacacctagagagattacaaaggaaacatggaggtatgctcgttcgcaacccactgtcaagaaactccacacacgaaatgtattggatatccaacggcacaggaaatatagttgcatcggtaaatatggtatcaaggctgttacttaaccgcttcacaatgactcatagacgaccgactatcgagaaagatgtcgatctcggagcaggaactcgacatgttaatgcagaaccagaaactccaaatatggacgtgataggggagcgtataaaacggataaaggaagaacataactcgacttggcactacgatgatgaaaatccatataaaacttgggcataccatggatcatacgaagtgaaggcaacggggagcgcaagttcaatgatcaacggagttgtaaagctcctcactaaaccttgggacgttgttccaatggtaacacaaatggccatgacggatactaccccatttggtcaacagagagtctttaaagaaaaagtagatactagaacaccaagatcaatgcccggaacgagaagagtaatgggaataactgcagaatggttatggcgtaccctaggtagaaataagaaaccaagattgtgtacacgagaagagttcacaaagaaagtaagaacgaatgctgcaatgggggctgtttttaccgaggaaaatcagtgggattcagccaaagcagcagtagaagatgaagatttctggaagttagtggacagagaacgggaacttcataaactcggtaaatgcggctcatgcgtttataatatgatgggaaaaagagagaagaaacttggcgagtttgggaaggcaaaaggatcacgcgctatatggtacatgtggttaggagcgagatatcttgagttcgaagcactaggcttcctcaatgaagaccattggttcagcagggaaaattcttatagtggagtcgagggcgaaggtttacacaaactgggttacatattaagggatatatcaaaaatcccagggggtgcaatgtacgctgatgatacggctggatgggatacccggattactgaagacgatcttcacaatgaagagaaaataacccaacaaatggacccagaacacagacaactcgctaatgcaatctttaaattgacatatcaaaacaaagtggtcaaagtgcaacgcccaacacctacagggactgtaatggacataatttctagaaaagaccagagaggatcgggtcaagtaggaacatatggcttgaacacattcacaaatatggaagctcagctaataagacagatggagggtgaaggtgtactgagcaaagcagatctagaaaatcctcatctacctgagaagaaaattactcagtggcttgaaactaaaggagttgaaagattaaaacgaatggccataagcggcgacgattgcgttgtgaaacctatagatgatagattcgctaatgctctactagccctcaatgacatgggcaaagtaagaaaggatatcccacaatggcaaccatcgaaaggctggcacgactggcagcaagttccattttgcagtcaccattttcatgagttgataatgaaggatggacgtaaattagttgtcccatgtaggcctcaagatgaactaatcgggcgagctcgtatttcacaaggagctggatggtcgctgagagaaaccgcttgcttaggaaaagcatacgcccagatgtggtcgctcatgtattttcacagacgagatcttcgattggctagtaacgcaatttgttcagcggtgccagtgcactgggtgccaacatcaagaactacttggtcaattcatgctcatcaccaatggatgacaactgaagacatgctcactgtttggaatcgtgtttggatcgaagacaacccatggatggaggataaaacccctgttactacgtgggagaatgtcccatatctaggtaaaagagaagatcaatggtgcggttcactcataggactaacgtctcgtgcaacctgggcacagaatattcccactgcaatacaacaggtcagaagcctaattggaaatgaggagtttttagattacatgccctcgatgaaaagatttcgtaaagaagaagaaagcgaaggtgctatttggtaa

SEQ ID NO: 23084 - RNA, 9873 nt, synthetic construct
  misc_feature 1..9873: note = derived and/or modified CDS sequence (opt6) from DENV-3__GQ868573__SS-prME
  source 1..9873: mol_type = other RNA
acatcattctgcctaatgatgatcttaccggctgctctcgcgtttcacctaacaagtagagatggagaaccaaggatgattgttgggaaaaacgaaagaggaaaatccctactgttcaaaacggcatcgggaattaatatgtgcactctaattgcgatggatctcggagaaatgtgtgacgacacggttacatataaatgtccacatattactgaagttgaaccagaagatatagattgttggtgtaatctaaccagtacttgggtaacatatggaacatgcaatcaagcaggagaacatagaagggataaacgatcagttgcgctggcaccacatgtcgggatgggcttagacaccagaacacaaacatggatgtcagcagagggcgcatggcgacaagtagaaaaagtcgaaacgtgggcgctacgacatcccggatttactatactagctctattcttagcacattatataggaacgagcctgactcaaaaagcggtaatattcatattactaatgcttgttacaccgtcaatgacaatgagatgtgtaggagtagggaaccgagactttgtagaaggtttaagtggagcaacttgggttgatgtagtactagaacacggcggatgcgttactaccatggccaaaaataaaccaacactagatattgaactacagaaaactgaggcaactcaacttgcaacactgcgtaaactttgcatcgaaggaaaaattactaacataactacggacagccgatgcccaacacagggcgaagcagtgttgcctgaagaacaagatcagaactatgtttgtaaacacacatacgtcgatagaggatggggtaacggctgtggcttattcggaaaagggtcattagttacctgtgcaaagttccaatgcttggagccaatcgagggaaaagtagtacaatatgaaaatctaaagtatacagtaattataacagttcatactggtgatcagcaccaagtcgggaatgaaacacaaggcgtaaccgcagaaataactccacaagcatccaccactgaggctattcttccagaatatggtaccttaggactcgaatgttcaccacgtactggtttagatttcaatgaaatgattctattaactatgaagaataaagcgtggatggtccatagacagtggttctttgatttaccattaccgtggacatcaggggcaaccactgaaacccccacttggaaccgaaaagagttattagtgacgttcaagaatgctcatgccaagaaacaagaagttgtagtattgggatcacaagaaggcgctatgcatactgccttaacgggcgcgacggaaatccagaatagtgggggaacatccatttttgccggccatcttaaatgtagattgaaaatggataaactagaattaaaagggatgtcgtatgcaatgtgtacaaatacgtttgtattaaagaaggaagtatctgaaacacaacatggaacaattctaattaaagtagagtataaaggcgaagatgtaccttgtaagataccattctctaccgaagacggtcagggaaaagcacataacggtcgcctcattacagctaatcccgtagtaacaaagaaagaggaacctgttaacattgaggctgaacctccgtttggagaaagtaatatagtaattggtattggtgataacgcattaaaaataaattggtacaagaaaggctcaagtattggtaagatgttcgaggcaactgcaaggggtgctaggagaatggcaatcttaggagatactgcgtgggatttcggaagcgtgggcggggttttaaactctctaggaaaaatggtacaccaaattttcggaagcgcctatacagctttattttcgggggtatcatgggtgatgaagattggaatcggtgtcctgctaacctggataggcctcaacagtaaaaatacttcaatgtcattttcctgtatcgcaattggaatcattactctttatttaggcgcggtagttcaagctgatatgggctgtgtaatcaactggaaagggaaagaactaaaatgcgggtcaggaattttcgttacaaatgaagtgcatacatggaccgagcaatacaaatttcaagctgactccccaaaaaggttagctaccgctattgccggcgcttgggagaacggtgtttgtggaataagaagtacaacgagaatggaaaatttgctttggaagcagatcgccaatgaattgaactacatcctatgggaaaacaacataaaacttacagtggttgtcggcgacataattggagtattagagcaaggtaaaagaactctaacgcctcaacccatggaattaaaatacagctggaaaacctggggaaaagcaaaaatcgtgacagctgaaactcaaaacagctcatttataattgatggtcccaatacacccgagtgtccatccgcgtcgcgagcttggaatgtatgggaagtagaagactatggattcggagtgttcactactaatatctggctaaaacttcgtgaagtatacacgcaactgtgtgatcatagattaatgtccgccgctgttaaagacgaacgagccgtacatgcagacatgggctactggattgaaagtcagaaaaacgggtcatggaaactggagaaggcatctttaatagaagtaaaaacctgtacctggccaaaaagccatacactttggtcaaatggtgttctagagtccgacatgattattccaaaatcattagcaggacccatttcccaacataattacagacctggttatcatacacaaacggccggaccatggcacctaggaaaattggaactggatttcaattactgtgaaggaacgacagtcgtaataaccgaaaattgtggaaccagggggccaagtttacgaactactacagtctcaggtaaacttattcacgaatggtgctgtagatcatgtactctcccgccactccgatatatgggcgaagacggttgctggtatggcatggagataagacctattagcgagaaagaagaaaatatggtaaagagcttagtatcggcgggaagtggggaagtagataacttcactatgggagtattatgtttagcgatacttttcgaggaagtaatgcgaggcaaatttggtaagaaacatatgattgctggagtattcttcactttcgtcttattgttaagcggacagatcacatggcgagacatggcgcacacattaatcatgataggaagtaacgcatcagataggatggggatgggagtaacatatttagcactcatcgcaacattcaaaattcaaccatttctcgctcttggattctttttaagaaagttaacaagtcgtgaaaatttacttttaggtgtagggcttgcgatggcaacgaccctgcaacttccagaagatatcgaacaaatggcaaacggcattgcgcttggcctcatggctttaaagctgatcacacaattcgaaacataccaattatggactgcccttatttcgctaacgtgctccaacactatatttaccctaaccgtagcttggcgaactgcaacattaatcttggccggcgtctcgctattacctgtctgtcaatcctcgtccatgcgaaagaccgattggttaccaatgacagtcgcagcgatgggactacccccattaccattgttcatattctctttaaaagatactctaaaacggaggtcttggccgctaaacgaaggcgttatggcggttggtctcgtaagcatacttgcaagcagtttgctacgtaacgatgtgcctatggcaggtccattagtagctggaggcctattgattgcatgttatgtgataacggggacgagtgctgatttgacagttgaaaaagcagcggatgtaacgtgggaggaagaagcggaacaaactggagtaagtcataatctgatgattactgtagatgatgatggaactatgagaattaaagatgacgaaacagaaaatatactcacagtactgttaaaaaccgcgcttttaatcgtatctggaatttttccttattcaattcctgcaactttactggtatggcacacttggcagaaacaaactcaacggagtggtgtgctatgggatgtaccttcaccgcccgaaacacagaaagctgaattagaagaaggtgtatataggatcaaacagcaaggaatttttggtaaaacgcaagtcggagtcggagtacagaaggaaggagtatttcacacaatgtggcatgtaacacggggagcggttctcacatataatggtaaacgactcgagcctaactgggccagcgttaagaaagacttaataagctatggaggtggatggagacttagcgcccaatggcagaaaggagaagaagtgcaagtaatagctgttgagcctggcaaaaatcccaaaaacttccagaccatgccaggaacattccaaactacaaccggcgagattggagccatcgcacttgatttcaaaccaggcacatcaggatcaccgataataaaccgagaaggaaaagttgttggattatacggtaacggagtagtgacgaaaaacggtggttacgtatcaggtatagcccagactaacgctgaaccagatggcccgaccccagagctagaagaagagatgtttaagaaacggaatctaacaattatggacctccacccgggtagcggcaaaaccagaaagtatctacccgctatcgttagagaagcaataaaaagacggctccgaactttaatattagcaccgacaagggtcgtcgcagcagagatggaagaggctttaaaagggttgccgataaggtatcaaacaactgcaaccaagtccgagcacaccggacgcgagatagtagatttaatgtgtcatgcaacattcacaatgagactactatctccagttagagtacctaattacaatctgattataatggatgaagctcattttacagatccagccagtattgccgccagaggttacataagcacgcgtgtaggtatgggggaagcagcagctatattcatgaccgcaacgcccccaggaactgctgatgccttcccccaatctaatgctccaattcaagatgaagaaagagatattccagaaaggagttggaactcaggtaacgaatggataacagacttcgccgggaaaacagtatggtttgtcccatctataaaagcgggtaatgatatagcaaactgtctacgtaagaatggcaagaaagtcatacaactgtccagaaaaacatttgataccgaatatcagaaaactaaactcaatgactgggacttcgtggttacaacggacatcagtgaaatgggagcaaactttaaggctgatcgcgtaatcgaccctaggcgatgtttgaaaccagtaatactgactgatggacctgaaagagttatactcgctggacccatgcccgttaccgccgcctctgcggcacaaagacggggcagagtaggacgcaacccccaaaaagaaaatgaccaatacattttcactggacaaccattaaacaatgatgaagatcatgcccattggactgaggcgaagatgctactagacaatatcaatacgccagaaggcattatccctgctctatttgaaccggagcgagaaaagagtgcggctatagatggggaatatcgcttaaaaggggaatcgaggaagacatttgtagaactgatgagacggggagatctaccggtatggctcgcacataaagtggcatcagagggaatcaaatatacggatagaaaatggtgtttcgacggacaacgcaacaaccagattctagaggagaatatggacgtagaaatttggactaaagaaggagagaagaagaaacttagaccacgttggctagatgccagaacctactccgacccactcgcattaaaagagtttaaggactttgcagcaggtcgcaaatcaatagcccttgacttagttactgaaatcggaagggttccaactcatttagcacatagaacacgaaatgctttggacaacttagtgatgcttcatacgtcagagcatggaggaaaagcatatcgacatgctgtggaagaactacctgaaaccatggagacattattattactaggcttaatgatactcctcaccggaggggccatgcttttccttatttccgggaaaggaattggaaagacaagtataggtttaatatgtgtcatagcttcaagtgggatgttgtggatggccgagattccgttacagtggatagcatcagcaatagtacttgaatttttcatgatggtcctgctgattcctgaaccagaaaagcaaaggactccacaagataatcaattagcatacgtcgtaataggtattctcacgctggcggccattatagctgcaaatgagatgggacttctcgaaacaacaaaacgcgacttaggtatgtccaaagaaccaggagtagtatcacccacatcgtatcttgatgtagatttacatcccgcaagtgcatggacattgtatgcagtcgccacaacagtcataacacccatgttaagacatacaatagaaaatagtacagcaaatgtttctctagccgcgattgccaatcaagctgtagtgctaatgggattggataaaggttggcctatatctaaaatggatctaggtgtacctctactagccttagggtgttattcccaggttaatccgttaacactcacagcggcagtactacttctaatcacacactacgcgataataggacccggcttacaagcaaaagcaacgagagaagcacaaaagcgtacggcagctggaattatgaaaaatcctactgtagatgggattatgaccatagatttagatccagtaatttatgattcaaaattcgaaaaacaactaggacaagtgatgttgttggtgctctgcgctgtgcagctacttttaatgaggacttcatgggctctatgtgaagcattaacattagctacgggcccaataacgactttatgggaaggaagcccaggcaaattctggaatacaaccatagcagtttccatggctaacatcttccgtgggtcttatttggctggagcaggactagcatttagtatcatgaaatcagtaggcactggcaagagaggaactggttctcaaggggaaaccctaggggaaaagtggaagaagaaactaaatcaattaagtcgaaaagagttcgatttgtataaaaagagcggcattactgaagtcgacagaacagaagctaaagaaggtctaaaaagaggggagataacccaccacgcagtatcaagaggttcagccaaactacaatggtttgtagagcggaacatggtaatcccagaagggagagttatagatctgggatgcggtagagggggatggagctactactgtgctggtctcaagaaagtaactgaggttcgaggatatacaaaagggggtccaggacatgaagaacctgttcctatgagcacttatgggtggaacatcgttaaactgatgtctggtaaagatgtgttttaccttcctccagagaagtgcgatacacttctttgcgatataggagaatcctctccgtcacctacggtggaagaaagcagaactattagagttctgaaaatggtagaaccatggcttaaaaacaatcagttctgcataaaagttctgaatccctacatgccaacagtaattgagcacttagagagattgcagagaaaacatggtggaatgcttgtacgtaacccattaagtagaaatagtactcatgaaatgtattggatatcaaacggcacaggaaacatagtagcatccgtcaatatggtctctagattactattgaatcgattcacaatgacacataggagaccgactatagaaaaggacgtcgatctaggcgccggtacaagacatgttaacgctgagccagaaacgcccaacatggacgtgattggggaacggataaaacgcataaaagaagaacataattcaacatggcattacgatgacgagaacccttataaaacttgggcatatcacggcagttatgaagtcaaggccacaggcagtgctagtagtatgataaatggggtagtcaaattgctaactaaaccgtgggacgtcgttcccatggtgacacaaatggcaatgactgatactaccccattcggacaacaacgagtctttaaggagaaagtagatacacgcacaccaaggtcaatgccagggacgagaagagtaatgggtattacagcagaatggctgtggcgaacgttaggacgcaataagaaaccacgtttatgcacaagagaagaatttactaaaaaggtaagaaccaatgcagcaatgggtgctgttttcactgaagagaaccagtgggactcagctaaagcagccgttgaagatgaagacttctggaaattagtggatcgtgaaagagaactccataaattaggaaaatgtggtagttgtgtgtacaatatgatgggcaaaagggaaaagaagttaggcgaatttggaaaagcaaaaggaagcagggcaatatggtatatgtggttaggagcccgatacttggaatttgaggccttaggattcttaaatgaagaccactggttttctagagaaaatagctattcaggtgtagaaggcgagggattacacaaactcggctatattttaagggacatttctaaaatcccgggtggcgcaatgtacgcagacgataccgccgggtgggacaccaggattacagaagatgacttacacaatgaggagaagataacacaacaaatggatccagaacatcgccagctagctaacgccattttcaaattgacataccagaacaaggtcgttaaagtccaaaggccaactcctacgggtactgtgatggatataataagtagaaaagatcaaagaggttccggccaggtaggaacctatggtttgaatacctttactaacatggaagcacaactcattcgacagatggaaggggaaggggtattatcaaaggcagatctagaaaacccacatcttcccgagaaaaagataactcagtggttagaaacgaagggggtggaacgcctaaaacgtatggctataagcggagacgattgtgtggtgaaaccaatagatgacagatttgccaatgccttactggctctaaacgatatgggaaaagtccgaaaagatattccgcaatggcaaccctccaaagggtggcatgactggcaacaagttcctttctgctcacatcattttcacgagctaataatgaaggatgggcgcaaattagtagttccatgcagaccccaagatgaacttatagggcgcgcaaggatttcacaaggcgccggatggtcattgagagaaacggcttgccttggtaaagcatatgctcaaatgtggagccttatgtatttccaccgaagagatttaagattagcttccaatgcgatctgttcagctgtgcctgtacattgggttcccacgagtaggaccacttggtcaatacatgcacaccatcagtggatgacaaccgaagacatgctcacggtctggaatcgcgtatggattgaagataatccctggatggaggacaaaactccggtgactacttgggaaaatgtaccatacctgggcaagcgagaagaccaatggtgcggatcgcttattggcctgacttcaagagcaacctgggcacagaatattccaactgccattcaacaagtacgatcactgataggaaacgaagaatttttagattacatgcccagcatgaaaagatttcgtaaagaagaagaatcagaaggagcaatttggtga

SEQ ID NO: 23085 - RNA, 9873 nt, synthetic construct
  misc_feature 1..9873: note = derived and/or modified CDS sequence (opt6) from DENV-3__GQ868574__SS-prME
  source 1..9873: mol_type = other RNA
acttcgttgtgcttgatgatgattctaccagctgctcttgcatttcacctcacctcgcgagatggtgaacctcgcatgattgttggtaaaaacgaacgaggaaaaagtttactttttaaaacggcatccggaataaacatgtgtacacttatagcaatggatttgggagaaatgtgtgacgacaccgtaacatataaatgcccacatataacagaagtagaaccagaagatatagactgctggtgtaacctaacaagtacatgggttacttacggaacctgtaatcaagcgggagaacatagaagggataaacgtagtgtagcactagcaccgcatgttggtatgggactagatacgagaacacaaacatggatgtcagcagaaggggcatggcgtcaagtagaaaaagtggagacttgggcactcagacatcctggattcactattctagctttatttcttgcacattatatcggaacatcactaactcaaaaagcagtaatttttatactcctaatgttagtcacaccaagcatgaccatgagatgtgttggtgtaggaaatcgtgattttgtcgagggactatcaggggccacctgggtggacgttgtcctagaacacggtggatgcgttactacaatggctaaaaacaaaccaaccttagatatagaattgcagaaaacagaagctactcaattagctactttacgcaaattatgcatagaggggaaaataacaaatattacaactgacagtagatgtccgacgcaaggagaggcagttctaccagaagaacaagatcagaattacgtgtgcaaacatacctatgtagacagaggttggggaaacggatgcgggctattcggcaaaggcagtctcgtcacttgtgcaaaattccaatgtctcgagcccattgaaggtaaagtagtgcaatacgagaatctaaaatatacagtcattataacagtgcataccggagatcaacatcaagtaggtaacgaaacacaaggagtaacagctgaaataacgcctcaagcaagcacaacggaagcaatcttgcccgaatacggaactttgggtttagaatgttcgcccagaacaggactagattttaacgaaatgatcctattaaccatgaaaaataaagcgtggatggttcatagacaatggttcttcgacctaccgctaccctggacatcaggcgcaaccacagaaacacctacatggaatcgaaaagaactactggtcacatttaaaaatgcacacgccaaaaagcaagaagtagtagtactagggagtcaggaaggggccatgcacacagcattaacaggagccactgagatacaaaattcagggggaaccagcatttttgcaggccatctcaaatgccgactaaagatggataaattagaattaaaaggcatgagctatgccatgtgcactaatacgttcgtgctcaagaaggaagtctcagaaacacaacacgggacaatactcataaaggtagaatataagggtgaggacgtgccatgtaaaataccattttccaccgaggatggacaaggtaaggcccacaacgggaggttaataacggcaaatccagtagtgaccaagaaagaggagcctgtgaatatcgaagctgaaccaccatttggcgaatcaaacatagtaatcggaataggggacaacgctctgaaaatcaactggtataagaaagggtcaagtatagggaaaatgtttgaagcaactgccaggggtgcccgtagaatggcaatattaggggacacagcctgggacttcggttcagtgggaggcgtcttaaattcattaggtaaaatggtacatcaaatatttggctcagcttacacagcgctattctcaggggtgtcatgggtcatgaagataggtataggggtgctgttgacatggataggcctcaatagtaaaaatacatccatgtcattttcatgtattgcaatcggaataatcacgttatatttaggtgctgtcgttcaagcagatatgggatgcgtaatcaattggaaagggaaagaattaaaatgcggatcaggtattttcgtgaccaatgaagtgcatacttggacagaacagtacaaatttcaagcagattctcctaaaagactggcaacagctatagccggtgcatgggaaaacggagtctgcggcatcaggtcgacaactcgtatggagaacctcctgtggaaacaaattgcaaatgaattaaactatattttatgggaaaacaatattaaactaacggtagtcgtcggggatataataggcgttttagaacaaggcaaaaggactctaacgcctcagcctatggagttaaaatactcatggaagacttggggtaaagctaaaattgttactgctgaaacccaaaactcgagtttcatcatagacgggccaaacactcctgagtgcccctccgcatctcgcgcatggaatgtgtgggaggtagaagactacggctttggtgtgtttactactaacatctggttaaaactccgggaagtatatacacaactgtgcgatcatagactgatgagtgccgcagtcaaggatgagagagccgttcatgctgacatggggtattggatagaaagccagaaaaatggttcatggaaacttgaaaaagcatctttgatagaagtcaagacgtgtacctggcctaaatcccacactctatggagcaacggggttcttgaatctgatatgataattccaaaatctttagcgggtcccattagccagcataactataggccgggatatcacacacaaacagccggcccatggcacctcggaaagttagaactcgacttttcctactgtgaaggaactactgttgttataacggaaaattgcgggaccagggggccttccttacgaacaacaactgtaagcggaaagttgatacacgaatggtgttgtagatcttgcacactaccacccttacgatacatgggtgaagatggttgttggtacggaatggaaataagaccaatatctgaaaaagaagaaaatatggttaaatcccttgtttcagccgggagtggagaagtagataatttcactatgggagtattgtgcttagccatactttttgaggaagtcatgagggggaaatttggcaagaaacacatgatagcgggagtattctttacctttgttttattgctctcaggccagataacatggagagatatggctcatacactaattatgattggaagtaacgctagcgatagaatgggaatgggtgttacatatttggcgttaattgccacattcaaaattcagccttttcttgcattaggctttttcttgcgcaaattgacgtctagagaaaatttactattaggcgttggactagcgatggcgacaacactgcaattgcccgaggacatcgagcaaatggcaaacggaattgctctaggccttatggccttgaagttgatcacccaattcgaaacgtatcagttatggactgcattgattagtttaacctgcagtaacaccatttttaccttaacagtggcatggcgtactgccacattgatactcgccggtgtaagcctattaccggtctgtcagtcatcatcaatgcgtaagactgattggcttcctatgactgttgctgctatgggagtacccccacttccgctgttcatttttagtctaaaagacacattgaaacgtagatcttggcctctaaatgaaggcgtaatggcagtaggattagtatctatattggcttcttcgttactaaggaatgacgttccaatggcagggcccctagtagcaggcggacttctaatcgcctgttacgtcatcacgggaaccagcgcggatttaaccgtagaaaaagcagcagacgtaacctgggaagaagaagctgaacaaacaggagttagtcacaatttgatgattaccgtagatgatgatgggactatgagaataaaggacgacgaaactgaaaacatactgacagtactattaaaaacagctcttttgattgtttcagggatattcccctacagcataccagcaacactactggtgtggcatacgtggcaaaaacaaactcaaagatccggggtattgtgggacgtgccttctcccccggaaacacaaaaagctgaactagaagaaggcgtgtacagaattaaacaacaaggtattttcggtaaaacgcaagttggagtcggagtacaaaaagaaggcgttttccacacaatgtggcacgtgactagaggcgctgtactaacatataacggaaaaaggttggaaccaaattgggcatcagtcaagaaagacttgatttcttatgggggtggatggcgactgtcggctcagtggcaaaaaggggaggaggtgcaagttattgcagtagaaccgggtaaaaatccgaaaaatttccaaacaatgccagggactttccaaacgaccacaggtgaaataggtgccatcgcactggattttaagccgggaacatctggttcaccgataatcaatcgagaaggaaaagtagtaggcttatacggaaacggagtggttaccaaaaatggagggtacgtatctgggattgcgcagacgaacgctgaaccagatgggcctacccctgaattagaagaagagatgttcaagaaacggaacttaacaatcatggatctgcatccaggcagtggtaagactagaaaatatttgccagcaatagtcagagaagcaattaaaagaagattacggactttaatactcgcaccaacacgtgttgtagctgcagaaatggaggaggctttgaaaggtttgccaataagatatcaaacaacggcgaccaaatccgaacacacaggtagagaaattgtagatttaatgtgtcatgcaacatttacgatgagactactttcaccggtaagagtacctaactataatctaattattatggatgaagcacattttaccgatcccgcaagcatcgcagcacgaggctacatatccacaagagtgggaatgggagaagcagcagcgattttcatgactgcaacacccccaggaacagctgatgctttccctcaatctaatgcaccgattcaagacgaggagagggatattcctgaaagaagctggaacagtgggaacgagtggatcaccgatttcgcggggaaaacggtatggttcgtgccctcaattaaagcaggtaacgatatagctaactgtctcaggaaaaatggcaagaaagtaattcaattatcgcgtaaaacattcgacactgaatatcaaaagactaaacttaatgattgggattttgtcgttacaacggacatatccgaaatgggcgctaattttaaagctgacagagtgattgatccaagacgatgccttaaaccagtgattctcactgatggcccggaaagggtgatcttggccgggccaatgcctgtgacagctgcatccgctgcgcaacgacggggtcgcgtgggtaggaatcctcaaaaagagaatgatcaatacatttttaccggtcaaccattaaataatgacgaagatcatgcgcattggacagaagccaaaatgttactcgataacattaacacaccagaaggtataattcctgccctcttcgaacccgaacgggagaaatccgccgcaatagatggcgaatatcgactaaaaggtgaatccagaaaaactttcgtcgaactaatgagaagaggggatcttcctgtttggttggctcataaagtagcatcagagggtataaaatatacagatcgaaagtggtgcttcgatggacagaggaacaatcaaatcttagaagaaaacatggacgtggaaatatggacgaaggaaggtgagaagaagaaactaaggccccggtggcttgatgcacgtacctacagtgatccactagctttgaaagaatttaaagacttcgcagctggccgaaaatctattgcattagatctagtaactgagatcggacgagtgcctacacatttagcacatcgcacacgaaacgcattagataatttggtcatgctacacacctcagaacacggaggtaaagcatataggcatgcagtagaagaactcccagaaacgatggaaaccctgctactcctcggccttatgatattattaacaggtggggccatgctctttttaatatctggtaagggcattgggaaaacttcaatagggttaatatgtgtaatagcaagctcgggtatgctatggatggcagaaattcccttacaatggatagccagtgctatagttctggagttctttatgatggtgttacttataccagaaccggaaaaacaaagaacaccacaggataaccaactcgcatacgtagtaataggtatactaaccttagctgctataatagcagcaaacgaaatgggtatgttagaaactacgaagcgcgatttaggcatgtcgaaggaacccggagtagcatcaccgacatcatacctcgatgtggacctacatcccgctagcgcctggacactctatgctgtcgccactacagtgatcactccaatgcttcgccatactatcgaaaattccactgctaacgtctctctagcagcgatcgctaatcaagcggtcgtattaatgggattagacaaggggtggcctatatctaagatggatctgggagtacccttactggcgctaggatgttatagccaggtaaaccctctaaccctaacggctgctgtattattacttataacccattacgctatcattggacctggtcttcaggcaaaagcaaccagagaagctcagaaacgaaccgcagccggaatcatgaaaaacccaactgtagatggaattatgaccatagatttagatccagtaatctacgacagcaaatttgaaaaacaattaggtcaagtaatgcttctagttctatgtgcagtacaattactattaatgcgaacatcttgggcgctatgcgaagcattaacactcgctacaggaccgataacaaccctatgggagggatcccctggcaaattttggaacacaacgatagcagtttcgatggcaaatattttcagaggtagttatttggcaggggccggcctcgccttcagtattatgaaaagcgtgggtacgggaaaacgaggaactgggtcacaaggagaaactttaggagagaaatggaagaagaaattaaatcagctatcacgcaaggagtttgacctgtataagaaaagtggaattactgaagtcgaccgaacggaggcaaaagagggccttaaaagaggggaaattacccaccacgccgtaagtaggggtagcgctaaacttcaatggtttgtagaaaggaatatggtgatcccggagggacgtgtaatagatctgggatgtggacgaggaggatggtcctactattgcgcggggctaaagaaagtcactgaagtaaggggatatacaaaaggaggcccaggacacgaagaaccagttccaatgtcaacttacgggtggaacatagtcaaactaatgtcaggcaaagatgtattttatctaccaccagagaagtgcgatacacttttatgcgatattggagaatcaagtccaagcccgactgtagaggaatcaagaacgatccgggtattgaagatggtagaaccgtggctcaaaaacaatcaattttgtatcaaagtcttaaatccatacatgcccacagttatagaacatttagaacggctacaacgaaaacacggcggtatgttagtacgaaaccctttgtcgagaaactctacacacgaaatgtactggatctccaatggtactggaaacattgttgcaagtgttaatatggtcagtcgactgttacttaatcgatttacgatgactcatagaaggccaaccatagaaaaagacgtagacctaggagctgggacaagacacgtcaatgcagaaccagaaaccccaaatatggacgtcatcggagaacgaattaaaagaataaaagaagaacacaactctacttggcattatgatgatgagaatccatataagacatgggcgtaccatggatcgtatgaggtaaaggccacagggagtgccagctctatgataaacggagtggtcaaattattgactaagccttgggacgttgtaccgatggttactcagatggcaatgacagatacaacacccttcggacaacagcgcgtgtttaaagagaaagttgatactagaacacctagaagtatgccaggtacacggagagtaatgggaataacagcagaatggctctggagaactctagggcgaaacaagaaacctcgtctgtgtactagagaagagtttacaaagaaggtaagaaccaacgcagcaatgggtgcagtatttacagaagaaaatcaatgggattctgctaaagcagcagtagaagacgaagatttctggaagctagtagatagagaacgggagttacacaagttaggtaaatgtggttcttgtgtgtacaatatgatgggaaaaagggagaagaagttaggtgagtttggaaaagctaagggaagccgtgcaatatggtatatgtggttaggcgcacgatacctagagttcgaagcattaggatttttaaatgaagaccactggttttcacgtgaaaattcttatagcggggtcgaaggagaggggttacacaagctaggttacatactgcgagatatttccaagatcccgggcggtgcaatgtacgcagatgacacagccggctgggacacacgcataaccgaagatgatctccataacgaagagaaaattacccaacagatggaccctgaacacaggcagcttgcgaatgcaatatttaaactaacataccagaataaagtagttaaagtgcaacgaccaacacctacaggtacggtcatggacattataagtcgtaaggatcaacgtggcagcggccaagtaggaacttatggtttaaacacttttaccaatatggaagctcagttgataaggcaaatggaaggagaaggtgtgctaagcaaggcggacttagaaaatccccatttaccagagaagaaaatcacacaatggttagaaacgaaaggcgtagaaagattaaaacgtatggcaataagtggagacgactgtgtagtaaaacctatcgacgaccgcttcgctaatgcattgttagcattaaacgatatgggaaaagtgaggaaagacataccccaatggcaaccttcaaaaggatggcacgattggcaacaagtccctttttgctcacatcattttcatgagttaataatgaaagatggaagaaagctagtagtaccctgtcgcccgcaagacgagttaatcgggagagcgcgtatctcacaaggcgctggctggtccctaagagaaacagcatgcttgggtaaagcatacgcccaaatgtggtcattgatgtacttccacaggagggatctacgactagcctcgaatgctatttgtagtgctgttccggtccattgggtccctacgtcccgtactacttggtccatacatgcgcatcatcaatggatgacaactgaagatatgttaaccgtttggaatagagtttggatcgaagacaacccctggatggaagataaaacaccagtcactacatgggaaaatgtaccctatctaggaaaaagagaagatcaatggtgtggtagtttaattggtctgacaagtcgagctacgtgggctcaaaacatcccaactgctattcaacaagttaggagtcttatcggtaatgaagaatttctggattatatgccctcaatgaaacgttttcgcaaggaagaggaaagtgaaggagccatttggtaa

SEQ ID NO: 23086 - RNA, 9873 nt, synthetic construct
  misc_feature 1..9873: note = derived and/or modified CDS sequence (opt6) from DENV-3__GQ868575__SS-prME
  source 1..9873: mol_type = other RNA
acctcgctatgtctaatgatgatactacccgcagctttagcatttcatttaacctcgagagatggagagccgagaatgattgtgggtaaaaatgaacgagggaaatcgcttctatttaaaacggcatcagggataaatatgtgcacattgatagcaatggacctaggagaaatgtgtgatgacactgtcacatacaaatgtccgcacataacagaagtggaaccagaagacatagactgctggtgtaacctcactagcacctgggttacttatggcacatgtaatcaagcgggtgaacaccggagagataaaaggagcgttgcattagcgccccacgttggaatgggtttggatacaaggactcaaacgtggatgagtgctgaaggtgcctggcgtcaagttgaaaaagtagaaacatgggcactcagacaccccggcttcacgatacttgcattattcctggcccattacataggtacatcattaacccaaaaagccgtcatatttatactattgatgcttgtaacacccagtatgactatgagatgcgttggggttggaaatagagatttcgtagaaggcctatcaggggccacgtgggttgacgttgtactagagcacggtggttgcgtcacaactatggctaaaaataaacctaccttagacatagaattacagaaaacagaagcgacacaattggcaacattgcgtaaactctgtatagagggaaaaataacaaatataactacggatagtaggtgtcctacccaaggcgaagcagtcctacctgaggaacaagatcaaaattatgtatgtaagcatacatacgtagatagaggatggggtaacggatgtggattgtttgggaaaggtagtcttgttacctgtgctaagtttcaatgtctggagccaatagaaggaaaagtagtacaatacgaaaatttaaaatatactgtaataataacagttcatacaggtgatcaacatcaagttgggaatgagacccaaggagtgacggctgaaatcactcctcaagcaagtaccactgaagcaatattacctgaatatgggacccttggattagaatgttcccccagaacaggtcttgacttcaacgagatgatattacttactatgaaaaacaaggcctggatggtacatagacaatggttcttcgatctacccttaccctggacgtccggagcaactactgagacccccacatggaatagaaaagaactattagtcacgttcaaaaacgcacatgccaagaaacaagaagtggttgtactaggtagtcaggagggtgcaatgcacactgccctaacaggagcgactgaaatacaaaattccgggggaacatctatttttgcgggacatttaaagtgcaggctcaaaatggacaaacttgaattaaaaggaatgtcttacgccatgtgtactaatacctttgtactcaagaaagaggtatcggaaacacaacatggcactattctgataaaagtagagtacaaaggtgaagacgtaccgtgtaaaataccattttccaccgaagatggtcaaggtaaagcccataatggaaggttgataacggctaaccccgtcgtgacaaagaaggaagaacctgtaaatatcgaagcggagccaccatttggagaatctaacatagtaatcggtattggagataatgcattgaagattaattggtacaagaaaggctcgtcaataggcaaaatgtttgaagcgacggctaggggcgcacgaagaatggcaatactgggtgacacggcgtgggatttcggttcagtaggaggtgtcctcaattcactcggaaaaatggttcatcaaatatttgggtctgcatatacagcgttattttctggagtctcctgggtcatgaaaataggtattggtgtgctattaacttggatcggattgaacagcaaaaacacgtctatgtcattcagctgcatagcaattggaatcattaccttatatttaggtgcagtagtacaagccgatatgggatgcgtcattaattggaaaggtaaggaattaaaatgtggatctgggatttttgttaccaatgaggtacatacttggacggagcagtataaatttcaagcagattcccccaagagactagccacagctatagcaggggcctgggagaacggagtttgcggaattaggtcaacaacaaggatggagaacctcctctggaaacaaatagcaaatgaactcaattatattctgtgggagaacaatattaaacttactgttgtagtaggtgacataataggggtattggaacaaggcaaacgaacgttaacacctcaaccgatggagctaaaatacagctggaaaacctggggaaaagcgaaaattgtcacagcagaaacccagaacttttcttttataatcgatggacctaataccccagagtgcccatcggcttcaagggcatggaatgtttgggaagtagaagattatggctttggggtatttacaacaaacatttggctgaaattgagggaagtatatacgcaactttgtgatcatagacttatgtctgcagctgtaaaagatgagcgagcagtacatgcagatatgggatattggatagaatcacaaaagaatgggagttggaaacttgaaaaagccagtttaattgaggttaaaacctgcacatggcctaagagtcacaccctatggtcgaatggtgtgctcgaatcggacatgataataccgaagtcattggcaggtccaattagtcaacataactaccgacctggttaccacacccaaacagcaggaccatggcatttgggtaaattagaattagatttcaattattgtgaagggacgacagtggttattacagaaaattgcggcacacgcggcccgagtttacgtactaccactgtatcaggaaaacttatacatgaatggtgctgtagaagttgtaccttacctcctcttcgatatatgggagaggacgggtgctggtatggcatggaaatacgaccaattagtgaaaaggaagaaaatatggttaaatctttagtcagcgcaggaagcggcgaagtggataacttcacaatgggcgtcttgtgtcttgcaatactgtttgaagaagttatgagaggaaaattcggcaaaaagcacatgatagcgggagtattctttaccttcgtactattactcagcggtcaaattacctggagggacatggctcatacattgattatgattggcagcaatgcgtctgataagatggggatgggagtcacctatttagcattaatagcaacttttaaaattcagccatttcttgcattgggattctttctacgaaaattgacaagcagagaaaatttattattaggtgtaggtttagctatggctacaactttacagttaccggaagatattgaacaaatggcaaatggtatagcgttaggacttatggccttgaaactaatcacacaatttgaaacctatcagttgtggactgcacttatatcgttaacatgttcaaacactatttttacgctaacagtagcatggagaacagcaactctaattctcgctggggtctcactgttacccgtatgccaaagcagttccatgcgaaaaaccgattggctaccaatgacagtagccgcaatgggcgtaccacccctgcctttatttatcttcggtttaaaggatacattaaaacgtagatcttggcccttaaacgaaggagtcatggcagtaggtttagtatctattctcgcatcgagtttgctaagaaacgatgtcccaatggcaggaccacttgtagcaggaggtctcttaattgcgtgttatgtcattactggaacttcggcagatttaaccgtcgaaaaagcggccgacgtgacatgggaggaagaagcagagcaaacaggcgtatcccataaccttatgataactgttgatgacgatgggacaatgcgaattaaggacgacgaaactgaaaatatcttaacagtcctattaaaaacagcattattaatagtctcaggaatttttccgtatagtattccagcaactttattagtgtggcatacatggcaaaaacaaactcagcgttcgggggttctttgggacgttccatcgccgcccgaaacgcaaaaagcagaattagaggaaggagtttaccggataaagcaacaggggatatttgggaagacgcaagtaggagttggcgttcagaaagaaggagtatttcataccatgtggcatgtcacgagaggagcagtactaacttataatggaaagcggttagaaccaaattgggcgtcagtaaagaaagatctgatatcatacgggggaggttggagactctcagcgcaatggcagaaaggagaagaagttcaagtaatcgccgttgaaccgggcaaaaatcccaaaaattttcaaactatgcccggaaccttccagacgacaacaggagaaattggagcaatcgcgctagacttcaagcccggaacctcagggagtcccattataaatcgagagggtaaagtagtaggattatatggtaacggggtagtaacaaagaatggaggctacgtctcaggaatagcacaaaccaacgctgaaccggacggtccgacacccgaactagaggaagaaatgttcaagaaaagaaatttaactataatggatctgcaccccggttcggggaagacaagaaaatacttaccggcaatcgttagggaagctatcaagagaagattaagaactctcatactcgcaccaacacgagtcgtcgcggccgaaatggaagaggctctaaagggactacctataagatatcagacaacagccacaaaatctgaacacaccggaagagaaatcgttgatttgatgtgtcatgcgacctttacaatgcgactgttatcccctgttcgtgtgcccaactataatttgataatcatggacgaagcacacttcacggatcctgcctcaattgctgcgagaggctatatatcaactagagtcggaatgggtgaagcagcagctatatttatgaccgcgactccacctggaacagcagatgctttcccgcaatcaaacgctccgattcaggacgaggagagggatattcctgaacgatcatggaactcaggaaacgaatggattacagatttcgctgggaaaactgtctggtttgtgcccagcattaaggcaggaaacgacatcgctaattgcttgcgaaagaatggaaagaaagtaattcaattgagtagaaaaacgtttgatactgaatatcagaaaaccaaattaaacgattgggattttgtagtcacaacagatattagtgaaatgggagctaattttaaggcagatcgtgttatagatccaagacgttgtcttaaaccagtaatattaacagatggacccgaacgtgttattttagcaggtcctatgcccgtaacagcagcttcagcagcccaaagacgtggcagggtagggcgaaaccctcagaaagaaaacgatcagtacatatttacaggacaacccttaaacaatgatgaagatcatgcacactggaccgaagctaaaatgttgttggacaatatcaatacaccagaaggaattataccagcattatttgaaccagaaagggaaaaatctgccgctatagatggagaatatcgactaaaaggagaatcacgaaaaaccttcgttgaactaatgaggcgaggagacctaccagtatggttagctcataaagtcgctagcgagggaataaaatatacagatcgaaaatggtgctttgatggtcagcgaaataaccaaattttagaggaaaatatggatgtagaaatctggacaaaggaaggagagaagaagaaacttcgtccaaggtggttagacgcaagaacttactcggatccgctagctcttaaagaatttaaggactttgctgctggtcggaaatccatagctctcgacttagttactgaaatcggaagagtccctactcatctcgctcatcgtactagaaatgctctcgataatctagttatgcttcacacgtccgaacatggaggtaaagcctatcgccacgctgttgaagaactaccggaaacaatggaaacactcctactcttgggactcatgatacttctcacagggggtgcaatgctgttccttataagcgggaagggcataggaaaaacatcaataggcctaatatgtgttattgcaagtagcgggatgttatggatggcagaaataccactacagtggatagcatccgctatagtacttgagttctttatgatggttcttctgattcctgaaccggagaaacaacgaacgcctcaagataaccagcttgcctatgtagttatcggcatacttactttggccgcaataattgctgcgaatgaaatgggactgttagaaaccactaaacgagaccttggaatgtcaagagagcctggagtagtaagcccaaccagctatttagacgttgatttacatcctgcttctgcctggacattgtacgcagtagcgacaactgtaattacacccatgttaagacatacgatagaaaattccactgcaaacgtatcattagccgctatagccaaccaagccgtagtattaatggggttggataaaggctggcctatcagcaaaatggacttaggagtcccacttctagctttaggctgctattcccaagtcaatccactcactctaactgcagctgtcctgttgctcataactcattatgcaataataggaccaggattacaagctaaggcaacccgcgaagctcagaaaagaactgctgcaggcataatgaaaaatccaacagttgacggcatcatgactatagatctagaccctgttatctatgactcaaaatttgaaaaacagctaggacaagtgatgctattggtcctttgtgctgtacaactgcttctgatgagaacaagctgggcattatgcgaggctctgaccttagctacgggaccgattacgacactgtgggaaggttccccaggtaaattttggaatacaactattgcggtatcaatggcaaacatctttagaggaagttatttagctggagccggattagctttttcaataatgaaatccgttggaaccggcaaacgtggcaccggctcacaaggcgagacgcttggtgaaaaatggaaaaagaaattaaatcaactgtcaaggaaagaatttgatttatataagaagtctggtataactgaagtcgatcggactgaagctaaagaaggcctaaaaaggggagaaataactcaccatgctgtctcaagaggatcagcaaaactacagtggttcgttgaaaggaacatggtgatcccggaaggtagggtaattgatctaggatgtggacgaggaggttggtcctattactgcgctggactcaagaaagtcacagaagttcgagggtatacgaaaggtgggccaggtcatgaagaaccagtgccgatgagcacttatggttggaatatagtcaaactaatgtcaggtaaagatgttttctatttaccgcccgaaaaatgtgatacgctcttatgcgacattggcgagagttcgccatcacctacagtggaagaaagtcggacaataagagttcttaagatggtcgaaccatggttgaaaaataatcaattttgcatcaaagtactaaacccctatatgcccacggtaattgaacacttagaacgattgcaacggaaacacggagggatgctcgtaagaaatccgctcagccgcaactcaacgcatgagatgtattggatttcaaacggaaccggaaatatagtggcatcagtaaacatggttagtagactactcttaaatagattcacgatgacacacaggcgaccgacaatagaaaaagatgtggatctaggggcaggtacacgtcatgtaaacgcggaaccagaaatacctaacatggacgtaatcggcgaacgaataaaacgcatcaaggaggaacacaacagcacctggcactacgatgacgaaaatccctataaaacatgggcatatcatggatcgtatgaggttaaagcaacgggatcagcttcctccatgattaatggagtagtaaaattactaactaagccttgggatgttgttccaatggtcacgcaaatggcgatgacggacactacgccattcggtcagcaacgcgtctttaaagaaaaagtcgataccagaacccctcgatcgatgccagggacgagaagagttatgggaataacggcagaatggttatggcgaactctaggtcgaaataaaaagccaagactttgcacgcgcgaagagtttaccaagaaagttcgaacaaatgcagcgatgggagctgtgttcaccgaggaaaaccaatgggattccgcgaaagcggcggtcgaagatgaagacttttggaaattagttgatagagaacgcgagttgcataaacttggtaaatgtggatcttgcgtctacaacatgatgggtaagagggaaaagaaacttggggaatttgggaaagcaaagggatcaagagccatttggtacatgtggcttggagcccgttacttggaatttgaagctctagggttcctcaatgaggatcactggttttcacgtgaaaatagctactcgggtgtggagggagaaggacttcataaattaggatacattttaagggatatatcgaaaatacctgggggagcaatgtacgcggacgacacagcaggatgggatacgagaataacagaagacgacctacataatgaggagaaaattacccaacagatggacccggaacaccgccaacttgcgaacgcaatattcaaactaacttaccaaaataaagtagttaaggtgcaacgaccaactcctaccggaaccgtaatggatatcatatctcgaaaagatcagcgtgggtcaggacaagtagggacatatggattaaatacttttacaaacatggaagctcaacttattcgacagatggagggagagggagtactgtctaaggcagatctagaaaatccccacctaccagagaaaaagataactcaatggttagaaacaaaaggcgtagaacgactcaagagaatggcaatttcgggtgacgattgtgttgttaaaccaatcgatgacaggttcgcgaatgccttacttgcattaaacgacatgggaaaagtaagaaaagatattccccaatggcaaccaagtaaaggatggcacgattggcagcaagtccctttctgttcacatcattttcacgaactaataatgaaggacggacgtaagctagttgttccttgcagaccccaggacgaactaatcggcagagcgaggatatctcaaggcgcgggttggagtcttagagagaccgcatgtctcggaaaagcgtatgcacagatgtggtcgctaatgtactttcatagacgtgacctacggctagcaagtaatgctatctgtagcgccgttccagtacattgggttccaacgagtaggacgacatggtcaatacacgcacatcaccagtggatgacgacggaagacatgttgacagtttggaacagagtttggatagaagacaatccatggatggaagataagacacccgtaaccacatgggagaacgtgccctatctaggtaaaagagaggatcagtggtgtggctccctcataggattaacttcgagagcaacatgggcacaaaatattcccactgcgatacagcaagtacgtagtttaattggaaacgaagaatttctggactatatgccgtcaatgaaacgattcagaaaagaggaagaatcagaaggagccatatggtag

SEQ ID NO: 23087 - RNA, 9873 nt, synthetic construct
  misc_feature 1..9873: note = derived and/or modified CDS sequence (opt6) from DENV-3__GU131953__SS-prME
  source 1..9873: mol_type = other RNA
acgtcgttatgtctgatgatgatattacctgcagctttggcatttcaccttacaagtcgtgatggggaaccacgaatgatagtgggcaaaaatgaacggggtaaaagtttattatttaaaacggctagtggcataaatatgtgcacattgatagccatggacctcggggagatgtgcgacgatactgtgacctacaaatgtcctcatataacggaagttgaaccagaagatatcgattgctggtgtaatttgaccagcacctgggtaacctacggaacttgtaatcaagctggagaacatagacgcgacaaacggtcagttgcgctagcaccccatgtagggatgggactagacactcgaacacaaacgtggatgagtgcagaaggagcatggcgccaagtggaaaaagttgaaacttgggcgcttcggcaccccggttttaccattcttgcattgtttttggcacattacatcggaacaagtctgacacaaaaagcagttatatttatattacttatgcttgtgacaccctcaatgacgatgaggtgtgttggagtcggtaatcgggatttcgtagaaggactttccggagccacatgggtagacgtggtccttgaacatggaggctgcgtaacaactatggccaaaaataaaccgacacttgatatagaactgcagaaaactgaagcgacccaattggcaaccctacgcaaattgtgcatagaaggtaaaattactaacataacaacagatagtagatgtcccacacaaggagaagccgtcttacctgaagaacaagaccaaaattacgtatgtaaacacacctacgttgaccgaggctggggtaacggatgcgggttatttggcaaagggtcacttgtcacttgtgccaaatttcaatgtttggaaccaatagaaggcaaagtagtgcaatacgagaatctaaaatatacagtgattattaccgtacacacaggtgatcaacatcaagtaggcaacgagacacaaggcgtaactgcggagatcacaccacaggcatcaactacagaggcgattttacctgaatacggaacgttagggttagaatgttctccaagaaccggcttagattttaatgagatgattctattaacaatgaaaaacaaagcgtggatggtccacagacaatggtttttcgatctaccacttccatggacatccggagctacgacagaaacccccacctggaatagaaaagagttactggtaacatttaaaaacgcacatgctaaaaagcaagaggttgtggtgttaggttctcaggagggagcaatgcacaccgcattaaccggagctacggaaattcaaaactccggaggaacttctatctttgcaggccatctgaaatgcagattgaaaatggacaaattagaattgaaaggtatgtcttatgcaatgtgtacgaatacatttgttctcaagaaagaagtaagtgaaacacagcatggaactatattaattaaagtagaatataaaggcgaggacgtgccatgtaagatccctttctcgacagaagacggtcagggtaaggcacataacggaaggcttattaccgctaatccggttgtaacgaagaaagaagaacctgtaaatatcgaagccgaaccaccgtttggagagagtaacatagtgataggtataggcgataacgcactaaagataaactggtataaaaagggttcgagtattgggaaaatgttcgaagcaaccgccagaggggccaggagaatggcgattctaggagatacagcttgggacttcggatccgtgggaggagtactcaactcactaggaaaaatggtccatcaaatattcggaagtgcttacacagctctatttagtggggtcagctgggtaatgaagatcggaataggcgtattactaacatggattggtttaaacagtaagaatacttcaatgagttttagttgcatcgcaatcggtataatcacgctttacctcggagctgtggtgcaagcggacatgggatgtgtcataaactggaagggtaaggagttgaagtgtggcagcggtatttttgttactaatgaagtccatacatggacagaacaatataaattccaagcggactcacccaaaagacttgcaaccgctattgctggcgcttgggagaacggagtatgcggtattcgatctacaactcggatggagaatctactgtggaaacaaatagctaatgagcttaactacatattgtgggaaaataatataaaattaacagtcgttgttggagatatcattggagtccttgaacaaggcaaacgcacattaacaccacagcccatggagctgaagtattcatggaaaacatggggaaaagcaaaaatcgtaacggcagaaacacagaacagttcattcataatagatggacccaacacacctgaatgcccttctgcaagtagggcctggaatgtgtgggaggtcgaagactacggatttggagttttcaccacgaatatatggttaaaactaagggaagtttatactcaattatgtgaccaccgcctcatgagtgcggcggtaaaagatgagcgagcagtacatgccgatatgggatactggattgagagtcagaaaaatggttcttggaaattagagaaagcgtctttgatcgaagtaaaaacatgtacttggccgaaaagccacacactatggtcgaatgcagtcctggaatccgacatgataattccaaaatctttagcaggtccgatatcccaacataactatagaccaggatatcatacacagacagcaggtccatggcacttgggtaaattggaattagacttcaattactgtgagggcactaccgttgtaataacagaaaactgtggaacaagaggaccgtcattaagaactacaacagtctcaggaaaattaattcatgaatggtgctgccgaagctgcacacttccacctcttagatatatgggggaagatgggtgctggtatggaatggaaatacgcccgatatctgaaaaagaagaaaatatggttaagtcattagtcagcgcaggaagtggagaagttgataattttactatgggggtgctgtgcttagcaattctttttgaggaagtgatgcgaggaaaattcggcaagaaacatatgatagctggagtattctttaccttcgtcctcctacttagtgggcaaatcacatggagagacatggctcatacactaataatgatcggatcaaacgcttcagatagaatgggtatgggtgtaacatatctcgcgttgattgcgacatttaagattcagccatttttagccttaggattctttctacgtaaattaacaagtagggaaaatttacttctgggagtggggttggcaatggcaactacactgcagttacccgaagatatagagcaaatggcaaacggaattgctctcggtcttatggcactcaaacttataacccaatttgaaacgtaccagttatggacagctctgataagtctgacctgttcaaataccatttttactttaaccgttgcctggcgtacagctacgctcatcttagcaggggtgagcttattgcctgtatgccaaagtagttcaatgagaaagactgattggctaccaatgacagtggcagcgatgggagtccctcctctaccgttgtttatcttctcattgaaagatactttgaaaagaaggagttggcctcttaatgaaggcgttatggcagtaggtttagtaagtatactcgcgagttctctcttaagaaacgacgtaccaatggctgggcctctagtagctggaggattattaattgcatgttacgtaataacaggaacatccgcagatttaacagtcgaaaaggcagccgacgttacatgggaagaagaggcggagcaaacgggagtaagtcataacttaatgatcactgttgatgatgacggaaccatgagaataaaagacgatgagacggaaaatattttaacagtactcctaaagactgctctactcatagtgtctggaattttcccatatagtataccggctacactgttagtctggcacacctggcaaaaacaaactcagcgatcaggagtcttgtgggacgtgccgtcacctccggaaacacaaaaagcggaactggaagaaggagtctacagaataaaacaacaaggaattttcggcaaaacacaggtcggtgtaggtgtacaaaaagagggagtttttcacacaatgtggcatgtcacgcgcggagcagtgttgacctataatggtaaaagactagaacctaattgggcaagtgtaaagaaagaccttatatcatatggcggagggtggagactgtccgctcaatggcaaaaaggagaggaggtccaggtaattgctgtggaaccgggaaagaatccgaaaaattttcaaactatgccaggaacgtttcaaacaacaacaggcgaaataggagctatcgcgttagattttaaacccgggacatcagggtccccgataattaaccgagaaggcaaggtagtagggttatatgggaacggagttgtcacaaagaacgggggatacgttagtggtatcgcacagactaacgcggaacctgatggtccaacgccagaattagaagaagagatgtttaagaaacgcaatctaacaataatggatctacatcctggcagcggtaaaactagaaaatatctaccggccatagttagggaagctatcaaacgaaggttgagaacgctcatattggctccaacaagagtggtagctgctgaaatggaagaggctttaaagggattacccattcgatatcagaccaccgcaaccaaatcagaacataccggtagggaaatagtagatcttatgtgtcacgcaacctttactatgcgattgctatcaccagtgagagtgccaaattataatctaatcataatggacgaagcacattttaccgatcccgctagtattgctgctagaggatatatatcaacgagagtcggaatgggtgaagcggctgcaatttttatgaccgcaacaccaccgggcaccgctgatgcattcccacaatccaacgcaccaatccaagatgaagaaagagatatacccgagaggtcttggaactctggtaacgagtggataaccgacttcgccgggaaaactgtttggttcgttccttccatcaaagcaggaaacgatatagccaattgtctacgaaagaacggcaagaaagtcatacagttaagcagaaaaacttttgatacagaataccagaaaactaaactaaacgattgggatttcgtggttactacggacatatctgaaatgggcgcgaactttaaagcagacagagtcattgatcctagaagatgcctcaagcccgtaatactgacggatggtcctgaaagagtgatattagccggtccaatgcccgtaacagcagccagcgcagcgcaacgacgggggagggtaggacggaaccctcaaaaagaaaatgatcaatacatatttactggtcagccactgaacaatgatgaagaccatgcccattggacagaagcaaaaatgctattagacaatatcaacactccagaaggtataataccagctctttttgagccagagagagagaagtcagccgccatagatggtgaataccgcctcaaaggagaatctcgaaagacatttgtcgagttgatgagacgaggtgatctacccgtatggcttgcccacaaggtggcgagtgaagggattaaatacacagataggaaatggtgctttgatggccaaaggaataaccagatcttggaagaaaatatggacgtggagatatggacgaaggagggtgagaaaaagaaacttcggcctagatggttagatgcaagaacttattcagatcctcttgcattaaaagaatttaaagatttcgctgcaggtaggaaatcaatagcccttgaccttgttactgagattggacgagtgccaacacacctggcacatagaactagaaatgctttagataacttagtaatgttacatacgagcgagcatggagggaaagcatacagacatgccgtagaggaactcccagaaacaatggagacattattattattagggctaatgatactcctaacaggtggagctatgctctttttaatttcgggaaaaggtataggaaaaacaagtatcggactaatttgcgtaatagccagttctgggatgttatggatggccgaaatacccctacaatggattgctagcgcaatagtcctagagtttttcatgatggtcctcttaatacccgaacctgaaaagcaacgaactccacaggacaatcaactcgcatatgttgttatcgggatactcacccttgcagcaataatcgcagctaacgagatgggtttactcgagacaaccaaaagagatttgggtatgtccaaggagccaggtgtcgtatcaccaacaagctacctcgacgtagatttacatcccgctagtgcgtggacactctatgcagtagcgacaacagtaattacaccaatgttaaggcacaccatagaaaactccacagcaaatgtttcgttagcagctattgcgaatcaagcagtagtactaatgggcctagacaaaggttggcctatctcaaaaatggacttgggagtaccattattagcattgggttgctacagccaagtaaaccctttaactttaactgccgcagttctcctattaattacacattatgcaataataggtccgggtttgcaagctaaagcaactcgagaggcacaaaaacgtactgctgcaggaataatgaaaaaccccaccgttgacgggatcatgaccatagacctagacccggtaatctatgattctaagttcgaaaaacaactcgggcaagtcatgctattggtattatgcgctgttcagctgctactgatgagaacgtcctgggcactttgtgaagccttaactttagcgacaggaccgattacaactttgtgggagggaagcccaggtaagttttggaacacaacgatcgctgtgtcaatggctaacatattcagaggtagctatttggctggtgcaggactggcgttcagcataatgaaatcagttggaactggtaaaagaggaacaggttctcaaggagagaccttgggggagaaatggaaaaagaaattgaatcaattgagtcggaaagaatttgacctatataaaaagtcaggaataacagaggttgatcgtaccgaagcaaaagaaggtctgaaacgaggggaaataacacaccatgcggtttcaaggggtagcgcaaaactgcagtggtttgtcgagagaaacatggtaataccggaaggccgtgtcatagatttgggttgcggaagagggggatggtcctattattgcgcaggcctgaagaaagtaactgaggttagagggtacaccaaaggcgggccaggtcacgaagaaccggttccaatgtcaacatatggttggaatattgtgaaattgatgtcaggaaaggatgtcttctaccttccccctgaaaaatgtgataccttactatgtgatataggagaaagtagtccaagtccgaccgtagaggaaagccgaacaattagagttcttaagatggtggaaccctggttgaaaaataatcaattttgtataaaagtgctaaatccgtacatgcccactgtaatcgaacatctagaacgactacaaagaaaacacggcggcatgttagtacggaatcccctatccagaaatagtactcacgaaatgtattggatttcaaacggaactggaaacatcgtggctagtgtaaatatggtatcccgactacttctaaaccgctttacaatgactcatagaagaccaactatagaaaaagacgtagacttaggtgcaggaacacggcatgtgaatgcagaacccgaaacaccgaatatggatgttataggagagcgcataaaacgaattaaagaggaacataacagcacgtggcattacgatgatgaaaatccgtataagacatgggcatatcacggctcatatgaagtgaaggccacaggatcagcgagttccatgataaatggcgtcgtcaaactactcactaaaccttgggatgtagttccaatggtcactcagatggccatgacagatacgacacccttcggacagcagcgggttttcaaagaaaaagttgacactagaactcctcgaagcatgccaggaacacgtagagtgatggaaattacagcggagtggttatggagaactctaggaagaaataagaaacctagactatgtacacgtgaagaatttactaagaaagttaggacaaacgctgcaatgggagctgtattcacagaagaaaatcaatgggattccgctaaggcggccgtcgaagatgaggacttttggaaacttgtcgaccgtgagcgcgaattacacaaactcggcaagtgtggttcttgtgtatataatatgatgggaaaaagagagaagaaactaggtgaatttggtaaagctaaaggtagcagagcaatttggtatatgtggcttggggcaagatacctggaatttgaagccctcggctttctcaatgaggaccactggtttagtcgtgaaaactcatacagtggagtagaaggggaagggttacacaagttaggctacatcctaagagacatatcaaaaataccaggaggtgcgatgtatgcagatgatacggccggttgggatacacgtataactgaagatgacttacacaacgaagagaaaattacacaacaaatggatccagaacatcgtttattagctaatgcgatatttaagctaacttatcagaacaaagtagtaaaagtccaacgacctaccccgactggtacggttatggatataatatcgcgaaaagatcaaagaggcagtggtcaagttggtacatatggactaaacactttcacaaacatggaggcgcagttaattaggcaaatggaaggagaaggagtactgtcaaaagcagatttagaaaatccacatctatctgagaagaaagttacacaatggttggagacaaaaggtgttgaaaggctaaaaagaatggcaatttctggggacgactgcgttgtaaaaccaatcgatgatcgctttgcaaacgccctactagctctaaatgacatgggtaaagttagaaaagatatacctcaatggcaacctagtaaagggtggcacgactggcagcaagttccgttctgcagccatcattttcacgaactcattatgaaagacggacgaaaattggtcgttccgtgcaggccccaagatgaattgataggcagggcccgcatttcccagggtgcaggatggtccttaagggaaacagcttgcctgggaaaggcttacgcacaaatgtggtcattaatgtacttccaccgaagggatcttagattggctagcaacgccatctgctcggccgttccggtacattgggtacccacatcaagaactacatggtccatccatgcacatcatcagtggatgactacagaagatatgctaacagtatggaacagagtatggatcgaggacaatccctggatggaagataaaacacccgtaacaacatgggaaaatgttccttatttaggcaaacgcgaggaccaatggtgcggaagtttaatcggcctaacatcacgggcgacatgggcccaaaacatcccaactgcaatccagcaggtaagaagtttgatcggcaatgaggagttcttagactacatgccatcaatgaaaagatttagaaaggaggaagaaagtgagggagcaatatggtaa

SEQ ID NO: 23088 - RNA, 9873 nt, synthetic construct
  misc_feature 1..9873: note = derived and/or modified CDS sequence (opt6) from DENV-3__GQ868577__SS-prME
  source 1..9873: mol_type = other RNA
accagtttatgcttgatgatgattcttcctgcggctttagcatttcacttaacatctcgggacggagaaccgcgtatgatagttggcaaaaatgaaaggggaaaaagtttactattcaaaacggctagtggaataaatatgtgcactttgattgccatggacttaggagaaatgtgtgacgatacggtaacatataaatgcccacatatcacagaagtagaaccggaagatattgactgctggtgtaatctaacgagcacatgggttacctacggaacatgcaaccaggcaggagaacacaggagggataaaagatcagtagcacttgcgccccatgtaggaatggggcttgacacacgtacccaaacttggatgagtgcagaaggagcttggagacaagtcgaaaaagtagaaacatgggcactaagacacccaggatttactatcctagcattattccttgcacactacattggcacatcgttaacccaaaaagttgtaatttttatccttttgatgctagtgactccctcaatgacaatgcgttgcgttggtgtaggcaatagggattttgttgaaggtttatcgggagcaacatgggtcgacgtagtattagaacatgggggttgtgtgaccactatggcgaaaaacaaacctacactggacatagaacttcaaaagaccgaagcaactcaattagcaacattgagaaaactgtgtattgaaggcaaaataacaaacataacaacagacagcagatgcccaacacaaggggaagccgttctgcctgaagaacaagatcaaaattatgtttgtaaacatacatatgtcgatagaggctggggcaacggttgcggcctatttggaaaagggagtttagtaacttgtgcaaaatttcaatgtctagaaccaatcgaaggtaaagtcgtccaatatgaaaatttgaaatatactgtcataataaccgtgcatacgggagatcaacaccaagtcgggaatgaaactcaaggagttacagcagaaattacacctcaggcttcaaccacagaagctatattaccggaatatggaaccctaggactggaatgtagtccgaggaccggactagactttaatgaaatgatattattaacgatgaaaaataaagcgtggatggtacatagacaatggtttttcgatttacccctcccttggaccagtggagcaacaaccgaaactccaacgtggaaccgaaaagaactattagtaactttcaaaaatgcacacgccaagaaacaagaagtggtcgtattaggatcccaagaaggggccatgcacacagcactaactggagctaccgaaatccaaaattcaggagggacatcgatcttcgctggtcacttgaaatgtagactaaaaatggacaaactagaacttaaaggaatgagttatgcgatgtgcaccaacacctttgtattaaagaaagaagtatctgaaacacagcatggaactattctcatcaaggttgaatataaaggtgaagatgtgccatgcaaaatacctttttctacagaggacggacagggcaaggcccataacggaagattaataacagcaaatcctgtcgtaaccaagaaagaggaacccgtaaacattgaagcagaacctccttttggggagtctaatatagtaatcggaataggggacaacgctcttaaaatcaactggtataagaaaggaagttctataggaaaaatgttcgaagcaacggctcgaggcgcaagaagaatggcaatactcggagatacggcgtgggacttcggaagcgtaggtggtgttctaaattcattaggaaagatggtccatcaaatctttgggtcagcatacactgcactgttctcaggagtgagctgggtaatgaagataggcatcggagtgctcttaacgtggataggtctcaattctaaaaatacctcaatgtcctttagttgcatagcaataggtattatcactctatatctaggtgcagtcgtacaagcagatatgggttgtgttataaattggaaaggcaaagaactgaaatgcgggtcgggtattttcgtcacgaatgaggtccatacatggaccgaacaatacaagtttcaggcagacagcccaaagagactagccactgcaatagcgggtgcatgggagaatggcgtatgtggaatacgcagcacaactaggatggaaaacttattatggaagcaaatagctaacgagttaaattacattttatgggaaaataacattaaattaacagttgtcgtgggcgacattataggcgtgcttgagcaagggaaaagaacactgacaccgcaaccaatggaacttaaatactcgtggaaaacctgggggaaggcgaagatagttactgccgaaactcagaactcgtcgttcataatcgacggtcctaatacgccagaatgtccctctgccagtcgtgcctggaacgtttgggaagtggaagattatggcttcggagttttcactaccaatatatggcttaaattaagagaagtgtatactcaattatgcgaccaccggttaatgagtgcagccgttaaggatgaaagagcagtgcacgcagacatgggttattggatagaatctcagaagaacggatcatggaaactagaaaaggcttccctaatagaagtcaaaacctgtacgtggcctaaatcacacactttatggtctaacggagtattagaatctgacatgataatcccaaaatcattagcaggaccaatttcccaacacaattatagacccggttaccatacgcaaacagctggaccatggcaccttgggaaattagagttggattttaactattgcgagggtactacagttgtaataacagaaaactgtggaacgagaggccctagcctaaggacaacaacggtcagtggcaaactcatacatgaatggtgttgcagatcatgtacacttccgccccttcgttacatgggagaagacggttgctggtatggaatggaaattagacctatatctgaaaaggaagagaatatggtgaaaagcctagtttccgcaggatccggggaagtagataatttcacaatgggcgtattatgtttagctattttgtttgaagaggtaatgagaggaaagtttggcaagaaacatatgatagccggggtattctttacatttgttctacttctttctggacaaattacttggagggacatggcacatacgctaattatgatagggtccaacgcctcggatcgcatgggaatgggagttacttatctcgcgttgatagcaacatttaaaatccagccatttttagccctcggattctttctgagaaaattgacgtcgagagaaaatttattattaggtgtgggccttgcaatggctacaacactacaactccccgaagatattgaacaaatggccaatggcatcgcactcgggttaatggcactaaaactcattacgcaattcgaaacctatcagctatggaccgcactaatttcactaacatgtagtaatacaatattcactttgactgttgcgtggagaacagcaacacttatcctagccggtgtgtcactactccctgtttgtcagtcatcaagcatgcgaaaaacagactggttgcctatgactgtagcggccatgggtgtgccaccactcccgttgttcatattttcattaaaagacaccctgaaaagacggtcatggcctctgaatgaaggtgtaatggccgttggtttagtaagtattttagcttcgtcattattaaggaacgatgtcccgatggcaggtcctctagtcgcaggcgggctactcatcgcatgttatgtaatcacaggaactagcgctgatctaacagtagaaaaagcagctgatgttacctgggaagaagaagcggaacaaacaggggtatcccataatctaatgattacagttgacgatgatggtaccatgaggattaaagacgacgaaacagaaaatatcctgaccgtactacttaagacagccttattaatcgtaagcggaatttttccatactctataccagctaccttacttgtttggcatacgtggcagaaacaaactcaacgcagtggtgttctatgggatgtgccaagtccaccagaaacacaaaaagccgaactagaggaaggagtttatagaataaagcaacaaggaatattcgggaagacacaagtcggcgtaggagttcaaaaagaaggcgtattccatacgatgtggcatgttacacgaggagctgttctaacttataatggcaaacgattagaacctaactgggcttctgttaagaaagatttgatcagctatggaggcggttggcgcctatccgcgcaatggcagaaaggagaggaggtacaagttattgccgtagaaccggggaaaaaccctaaaaattttcaaacaatgccaggcacattccagacaactacgggagaaataggagctattgctctcgactttaaaccaggaacatcgggaagtccgataattaacagagagggtaagattgttggattatatggaaatggggtcgtcacgaaaaacggtggttacgtttcgggtattgcacagaccaacgctgaaccagacggaccaacacctgagctagaggaagagatgtttaagaaaaggaatttaactatcatggatttacatccgggatcaggcaagacgagaaagtatctacctgcaatagttcgcgaggcaataaaacgtcgcctacgcactttaatactggctcctaccagagttgtcgcggctgagatggaagaagcactgaaaggattacccattagatatcaaacaacagcaactaaatccgaacacaccggtagagaaatagtggacttaatgtgccatgccacgttcactatgagattactcagtccagttagggtgccaaattataaccttataattatggacgaagcacattttacggatccagccagcattgcagcaagaggttatatctcgactagggtcggtatgggagaagcggcagctatatttatgactgcaacaccaccaggaacggcggacgcattccctcaaagcaatgctcccatacaggatgaagaacgtgatatacctgaaagaagttggaactctgggaacgaatggatcactgacttcgctggcaaaacggtttggttcgtaccgtcgattaaagccggtaatgatatcgctaattgtctacgtaaaaatggtaagaaagtaatacaactctctagaaaaacgttcgacaccgaatatcagaaaacgaagctaaacgactgggatttcgtggtaactacagatatatctgaaatgggagccaatttcaaggcagatcgtgtaatagatccaagaagatgtttgaaaccagtaattttaaccgacgggccggaaagagttatcttggcaggtccgatgccagtaacagctgcctccgcagcacaacgaagaggtcgagttggacgcaacccgcaaaaagaaaacgaccaatacattttcactggtcaaccactaaataacgacgaggatcatgctcattggaccgaagcgaaaatgttacttgataatataaatacgccagaaggaataattcccgcgttgttcgaacctgaacgcgagaaaagtgccgccattgatggagagtacagattaaaaggagaaagccgaaaaacgttcgtggaactaatgcggagaggggatttaccagtgtggctcgcttacaaagtagcctctgaagggatcaagtacactgatagaaaatggtgttttgatggacaacgcaacaatcaaattctggaagaaaatatggacgtagaaatatggacgaaggaaggtgagaagaaaaagctgagaccaagatggctagacgcgaggacctatagcgaccccttagctttaaaagagttcaaagatttcgcagccggtcgaaaatcaatcgcattggatttagtgacagaaataggaagagttccaactcacttagcccatcggacgcgaaacgctctagacaatctggtaatgttgcacacatcagagcacggaggaaaggcctaccgacacgctgttgaagaattacctgaaacaatggaaacattacttctactgggcttgatgattttattaacaggtggcgctatgttatttctaatttccggaaagggtatcggcaaaacatccataggattaatttgcgtcatagcaagttcggggatgctatggatggctgaaattccactacaatggatagccagtgcaattgtattagagttcttcatgatggttttattaatacccgaacctgaaaaacagcgcacaccgcaggataaccagttggcgtacgtcgtaataggcattctaacattagcagcaattattgcagcgaatgaaatgggacttctcgaaactaccaaaagagacttaggtatgagtaaggaacccggggtagtatcaccaacaagttatcttgacgtagaccttcacccggcaagtgcgtggacgttgtatgcagtagcaactacagtaatcacaccaatgctaaggcatactattgaaaattcaaccgctaacgtttccctagctgccatcgcaaatcaagcagttgtattgatgggactagacaaaggctggccgattagtaaaatggatctaggagtgccccttttagctctaggttgctattctcaagtaaatccactgaccttaactgcagctgtgcttctccttataacccattatgcgatcataggacctggtctacaagcaaaagcaacaagagaagcacaaaaacgtacagctgctgggataatgaagaaccctactgtcgacggaattatgacaattgacctagacccagtaatatatgactcaaagtttgaaaaacagcttgggcaagtgatgctgttagtactatgcgcggttcaattgctactgatgcgcacctcatgggcattatgtgaagccctcactcttgcgaccggaccaataacgactttatgggaaggatcacctggaaaattttggaacactacaattgcagttagtatggccaatatctttagaggctcctatttagctggtgcaggattagcattcagcataatgaaaagcgttgggacaggaaaacgaggaactggcagtcaaggagaaaccttgggagagaaatggaagaagaaactaaatcagttatcgcgaaaagaatttgatctttacaaaaagagtggaattacagaggtcgatcggactgaggctaaagaagggcttaaacgaggtgagattactcaccacgcagtctcacggggatcagctaaactacaatggttcgtcgaaagaaacatggtaataccagaaggcagagtaatcgatttaggatgcggacggggtggttggtcatattactgcgctggactaaagaaagtaacagaagtcaggggatacacaaaaggcggtcctggtcatgaagaacctgtacccatgtccacctacggatggaacatagtaaaattgatgagcgggaaagacgtattttacctaccgccagaaaaatgtgataccctactatgtgatattggagaatcaagcccaagtcccactgttgaagaatcgcgcacaataagagtactcaaaatggtagaaccttggcttaaaaataatcagttctgcataaaagtattgaatccctacatgcctacggtaattgaacatttagaacgattacaacgaaaacatggtgggatgttggtaagaaacccactatctagaaactccactcatgagatgtattggatctcgaacggtacgggcaacatagtagccagtgtgaatatggtttctcgattacttctcaacaggtttacgatgacacatcgtagaccaactattgagaaggacgttgatttgggtgcgggcactcgacatgtaaatgcagagccagagacgcccaacatggatgtcatcggagaaaggataaagagaataaaggaagaacataattctacatggcattacgatgatgagaatccatataaaacctgggcataccacggatcgtatgaagtcaaagcaacggggtcagccagcagcatgatcaacggtgtagtaaaactattaacaaagccctgggacgttgtcccaatggttacacaaatggcaatgacagacactactcctttcggtcaacaacgcgttttcaaagaaaaggtcgatacgcggactccacgaagtatgccaggaacgaggcgagtaatggggattaccgctgaatggctttggagaacattaggacgcaataaaaagccccgtctatgtacaagagaagagttcacgaagaaagttaggacaaacgcagcaatgggtgccgtgttcactgaagaaaaccaatgggactcagccaaagcagcggtcgaagatgaagatttttggaaacttgttgatagggaacgcgaattacataaacttggtaaatgtggatcgtgcgtttacaacatgatgggaaaacgtgagaagaaactaggcgagttcggaaaggctaaagggtccagagccatttggtatatgtggttaggggcacgataccttgaatttgaagcactaggatttttaaatgaggaccactggttctccagagagaatagctatagtggagttgaaggcgaagggctacacaagttggggtatatacttcgcgatataagcaaaataccaggtggagcgatgtatgctgatgatacagctggctgggacacgagaataacagaggatgacttacacaacgaagagaaaattacacaacaaatggaccccgaacataggcagttagcgaatgcgatatttaaactcacctaccagaacaaagtagtcaaagtacagcgacctacacccaccggaacggtcatggatataatatcacgtaaagatcaaaggggatctgggcaggttggaacttacggattaaacacatttacgaacatggaggcacagctcatacgtcaaatggagggggaaggtgttttaagcaaagctgacctggaaaatccacacttgccagagaagaaaatagcacagtggctagaaaccaaaggcgtagaaagacttaagagaatggcgatatcaggcgatgactgtgtagtgaaacccatcgatgatagatttgctaatgcactactggcacttaacgatatgggtaaggtccggaaggacatacctcaatggcaaccttccaaaggctggcatgactggcaacaagttcccttttgtagtcatcattttcatgagttgataatgaaagatggccgtaaattagtcgtaccatgtcgtccacaggatgagcttataggtagagcaagaatttcacaaggtgcaggctggtcattaagagaaacagcatgtctgggcaaagcatacgcccaaatgtggtccttaatgtactttcacaggagagacctgcgacttgcctctaacgcaatttgttctgccgttcccgtacattgggtgcccacatccaggactacttggtcaatacatgcacatcatcaatggatgactacggaagacatgcttaccgtatggaatagagtatggatagaggataatccatggatggaaaataaaacaccggttacaacttgggaaaacgtgccatatctgggcaaacgagaagaccagtggtgtggatccttgattggacttacatctcgtgctacctgggcacaaaacattcccacagcaatacaacaagttagaagtctaataggaaacgaagaatttctcgactacatgccgtcaatgaaacgttttcgcaaggaagaagagtccgaaggagcaatctggtaa

SEQ ID NO: 23089 - RNA, 9873 nt, synthetic construct
  misc_feature 1..9873: note = derived and/or modified CDS sequence (opt6) from DENV-3__GU131954__SS-prME
  source 1..9873: mol_type = other RNA
acaagtttatgtttaatgatgatccttcctgcagcattggcttttcacctcacttccagagacggagaaccacggatgatagttggcaaaaatgaaagaggtaaatcattgttatttaaaacagcatccggaataaatatgtgtaccttgatagctatggatctcggagaaatgtgtgacgatacggtgacatacaaatgcccgcatataacagaagtagaaccagaagatatagattgctggtgcaacctaacgtctacgtgggtgacttacgggacttgtaatcaagctggagaacataggagagataaaaggagtgtagcattagcaccgcatgtcggaatgggtctagatacccgcacacaaacatggatgagcgcggaaggggcttggcgacaggtcgaaaaagtagaaacgtgggcactaagacatcccggatttacaattctcgctctttttcttgcacactatatcggaacttcactaacccagaaagtggtcatattcattctactaatgttagtcactccgtcgatgacaatgagatgcgtaggagtgggaaaccgagattttgttgaaggtcttagcggggcaacctgggtagacgtagtcttagaacacggtggatgtgttaccactatggccaaaaacaaacctacactggatatagaattacagaaaactgaagctacacaattggccaccctacggaaattgtgcattgaaggaaaaattacaaatataactacagacagtaggtgcccaacacaaggtgaagcagttttacctgaagaacaagaccaaaactacgtctgtaagcatacgtatgtcgatcgcggatggggaaatggatgcggattatttgggaaagggagcttagtaacatgtgcaaaattccaatgtctcgaaccaattgaaggtaaagtagttcagtatgaaaatttaaaatacaccgtaataataaccgttcatacgggagaccaacatcaagtaggaaatgaaacacagggagtaacagctgaaattacgccacaagcaagtaccactgaagctatcttacctgaatatggaacactaggattagaatgctcccctagaactggattagatttcaatgaaatgatattattaactatgaagaacaaggcctggatggtccacagacaatggttctttgatctcccccttccatggaccagtggagccacaacagaaacacctacctggaatagaaaagaacttcttgttacatttaaaaacgcacacgccaagaaacaggaagtagtagtcttaggaagccaagagggagcaatgcacactgcattgacaggagcaacagagattcaaaatagcggaggaacctcaatttttgctggacatttaaaatgcaggcttaaaatggacaaattagaactaaaaggaatgagttatgccatgtgcacgaacacattcgtactaaagaaagaggtgtcagaaacacaacatgggacgatattaattaaagtggaatacaaaggcgaagacgtgccctgtaaaatcccatttagcacggaggacgggcaaggaaaagcacataatggccgccttattactgccaacccggtggtaacaaagaaagaagaacctgttaacattgaagcggagccacccttcggtgaatctaatatcgtaataggaatcggtgacaatgcactaaaaataaattggtacaaaaagggatcatcaattggcaaaatgtttgaagccacagctcgcggggcccgaagaatggcgattctaggagatacagcatgggattttggcagtgtcggaggggttctaaattcacttggtaaaatggtacaccaaatattcggctctgcatatacagccctattctcaggcgtgagttgggtgatgaaaataggaataggagttcttctaacgtggattggactaaatagtaaaaacaccagtatgtcctttagttgcattgcaattggtatcataaccttatacttgggggccgtggtgcaagcagatatgggttgtgtaataaattggaaagggaaagaactaaagtgtggatctggaatttttgttacgaacgaagtacatacatggacagaacaatacaaatttcaagcagactcacccaaacgattggcgacagcgatagcaggcgcctgggagaatggtgtgtgcggcatacgatcaactaccagaatggaaaatctattatggaaacaaattgcaaatgagcttaactacatactatgggaaaacaacattaagttaacagttgttgttggggatataataggtgtgttagagcaaggaaaacgtactcttactcctcaaccaatggaattaaaatattcttggaaaacgtggggaaaagcgaaaatcgtaacagcagaaactcaaaattcgtctttcataattgatggacctaacacacctgaatgcccctctgcatcccgtgcttggaacgtctgggaagttgaagattatggtttcggggtgtttaccacgaatatatggttaaagttaagggaagtctatactcaactatgtgatcatcgcctgatgtcagcagcagtaaaggatgagagggctgtacatgccgacatgggctactggatcgaatctcagaaaaacggatcgtggaaattagaaaaagcatctctgatagaagtgaaaacttgcacatggcccaagagccatactctatggtccaatggtgtcttagagtcagatatgatcatacctaaaagtttagctggtccaatttcacaacacaactaccgacccggttaccatacacaaacagctggaccctggcacctaggcaaattagagctcgactttaattattgtgagggcacaacagtagtaataacagaaaactgcggcacaagaggaccatcactaagaacaacaaccgtatctggtaaattaattcacgagtggtgctgtaggtcctgtacactaccacctttgagatatatgggagaagatggatgctggtacgggatggaaataagacctatctcagaaaaggaagaaaacatggtaaagtcacttgtaagtgcaggatcgggtgaagttgataattttacaatgggggtcctgtgccttgctatactatttgaagaagtaatgagaggcaagttcggaaagaagcatatgattgccggtgtgttctttaccttcgtacttctcctcagtggacaaataacctggagagatatggcacataccttgatcatgatcggatcgaatgcctccgatagaatgggtatgggggtaacgtatctcgcccttatagccacattcaaaatccagccctttctagcactaggatttttcttgcgaaagctcacctcaagggaaaatttacttctgggggtaggactagcaatggctacgacattacaattacctgaggacattgaacaaatggctaatgggattgcactgggactaatggccttaaagctaattacgcaatttgaaacgtatcaactttggacagcgttaatcagtctcacatgtagtaatacaatatttaccttaacagtagcatggaggaccgcaaccctcatacttgcgggtgtttcgctcttaccagtctgtcaaagctcaagtatgagaaaaacagactggttacctatgacagtagcagcaatgggagtacctcccctaccactatttatatttagcctaaaagatacgttgaaacgaaggtcatggccacttaatgaaggagtaatggcagtaggacttgttagcattctagcttcctcgttattgcgaaatgacgtgcctatggccgggcctctagtcgcaggcggcttactcatcgcatgttatgtcataacaggaacaagtgcggatttaaccgttgagaaagctgctgacgttacctgggaagaagaagccgaacaaacaggagttagtcacaatcttatgatcacggtagatgatgacgggaccatgcggattaaagatgatgaaactgaaaatatactaactgttttactaaagacggcattgcttattgtttccggcatattcccctattccattccagcgactctcttagtctggcatacgtggcaaaaacagacccaacgaagtggagtattatgggatgtaccatctcctccagaaacccagaaagcggagttggaggaaggtgtctatcgcataaagcaacaaggaatatttggtaaaacccaagtaggagtgggagtacagaaagaaggcgtcttccacacaatgtggcacgtcactcgcggagcagtattgacgtataatggcaaacgtttggagccaaattgggcttccgtcaagaaagatctaatatcatacggcggcggttggcgattaagcgcacaatggcagaaaggtgaagaagtacaagttatagcagtagaacccggtaaaaaccctaaaaatttccaaaccatgccagggacatttcagacgaccacaggagaaatcggagccattgctcttgacttcaaacctggcacaagcggatctccaattattaatcgtgagggtaaggttgtcggtctatacggtaatggagtagttaccaaaaacggtgggtatgtaagtgggattgcgcaaacaaatgcagaacctgatggacctaccccagaactagaggaagaaatgttcaagaaacgcaatctaacgataatggatttacacccaggctcaggaaaaactcgaaagtacttaccagctatcgtcagagaagcaataaagaggagacttagaactttaatactcgccccaactcgcgtagtcgctgccgaaatggaagaggctttaaaagggcttccaatacgatatcaaactacagctactaaatccgaacacactgggagggaaattgtagatttgatgtgtcacgcaacattcaccatgaggcttctctccccagttagggttcctaattacaaccttattattatggatgaagcacactttactgatccagcaagtattgctgctagagggtatataagtaccagagttggaatgggagaagctgcagcaatctttatgacggcgactccaccaggaacagccgatgctttcccgcagtcaaatgctccgatccaagatgaagaaagggacattcccgaacgaagttggaactccggaaatgagtggataactgactttgcaggtaagacagtatggttcgttccttcaataaaagcgggaaatgatattgccaactgtcttcgaaagaacggcaagaaagtaattcaattatcacgtaaaacattcgacacggaataccaaaagacgaaactaaatgactgggatttcgtagttacgacagacatcagtgagatgggtgcaaatttcaaagcagaccgcgtaatagatccccgccgttgcctaaagccagtgatcttaactgacggaccagagcgagtcatcctagcaggacctatgccagtaactgcagcaagtgcggcacaacgacggggcagggtaggcagaaatcctcagaaagaaaacgaccagtatatatttacgggccaaccactaaataatgacgaagatcatgcacattggacggaagcaaaaatgctgctagataatatcaatactcctgaaggcattataccagctttgttcgaaccagaaagggagaagtcggcggcaatagacggagaataccgcttgaaaggagagagtagaaaaaccttcgttgaactaatgaggagaggggatctgccagtatggttagcatataaagtggcaagtgagggaataaaatacacagatcggaaatggtgcttcgacggtcaaagaaataatcaaatactagaggaaaacatggatgttgagatttggaccaaagaaggcgagaagaagaaattaaggccaagatggttagatgcaaggacatatagcgacccgttagccctaaaggagtttaaagatttcgcagcaggcagaaaaagtattgcgctagatttagtcaccgaaatcggtagagttccaacccacctagctcatcgaactaggaatgcattagataatctagtaatgctacatacgtccgagcatggcggcaaagcatacagacacgcagtggaagaattgccagaaacaatggaaactttactactattaggtttaatgatattactaacgggcggagtaatgttatttctaatatctggtaaaggtatcggtaaaacaagtataggattaatctgtgtcatcgctagtagcggaatgttatggatggctgaaattcctctacaatggatagcgtctgcaattgtattagagttctttatgatggttttattgatacctgaaccagaaaaacaaagaacaccacaagacaaccagttggcctatgtggttatcgggattcttacgctcgccgcaataatagccgcaaacgagatgggacttctggaaacaaccaaaagagatttgggcatgacaaaagagcctggcgcggtatccccaacgtcttatctcgacgtggatcttcatcctgctagtgcatggacgctttatgccgtagctacaacagtgataacacctatgttgcgtcatactatcgaaaattccacagctaatgtctctttggcagcgattgctaaccaagcagtagtactcatgggtctagacaaaggatggccaataagcaaaatggatctcggagtcccactattagcgctgggatgttactcacaagtcaatccgctaaccctaaccgcagctgttctgctactgattacacattatgcaataatcgggcctggactgcaagccaaagcaacgagagaggctcagaaaaggacagcggcaggtataatgaaaaatccgaccgtagatggtattatgacgatagatttagacccagtaatatacgatagtaaatttgagaaacagttaggtcaagtaatgttattagtactatgtgcggtacaactcctattaatgagaacaagttgggcactgtgtgaggctttgacattagcgacaggaccgataactactctatgggaaggaagtccagggaagttctggaatacaaccatcgccgtctccatggcgaacattttcagaggatcatatctagccggtgcgggccttgcttttagcataatgaaaagtgtcggaacaggcaaacggggtaccggatctcaaggtgagacattaggtgaaaaatggaaaaagaaacttaatcaactctccaggaaggagtttgatctctacaaaaagtcaggtataaccgaggttgataggacagaggctaaagaaggcctaaaacgtggggagattacacaccatgcggttagccgaggatcagcgaagttgcaatggtttgtagagaggaacatggtgattccggagggtcgcgtcattgacttaggatgtgggcgtggaggatggtcatattattgtgccgggttgaagaaagtaacggaggtccgtggttataccaaaggagggccaggacacgaggagccggtacctatgtcaacatacggatggaatatagttaagctaatgagtggaaaagatgtattttaccttccacccgaaaaatgtgataccttactgtgcgacataggagagtcgtccccatcgcctaccgtcgaagagtcaaggacaatccgggtcctaaaaatggttgaaccatggttgaaaaacaaccaattctgtatcaaagttctaaacccctacatgcccaccgtcatagagcacttagaaagacttcagaggaagcacggaggaatgctggtcaggaatccattatcccgaaatagtactcatgaaatgtactggatctcaaacggcaccggtaacatagtggcaagtgtaaacatggtatcacggctcctattgaataggtttacaatgacccataggcgaccaactatagaaaaggacgttgatctaggcgcgggcactagacatgtcaacgcagaaccagaaacccctaatatggacgtaattggagagagaatcaaaagaataaaagaggaacataactcaacatggcattacgacgatgagaacccatacaaaacatgggcataccacgggtcgtacgaagtaaaagcaacagggagtgcaagcagcatgatcaatggagttgttaagttgttaacaaaaccatgggatgtagtaccaatggttacgcaaatggcaatgaccgataccacccctttcggccaacaaagagtatttaaggagaaagtagatacccgaaccccgcgaagtatgccagggactaggcgcgttatggggattacagccgaatggctatggaggactttagggagaaacaagaaacccaggctctgtacacgtgaagagtttactaagaaagtacgaacaaacgctgcaatgggggcggtatttacagaggaaaaccagtgggactctgcaaaagcggccgtcgaagatgaggacttctggaagctagtggatcgcgaaagagaactacacaaacttggaaaatgcggaagttgcgtgtataatatgatggggaaacgagagaagaaattgggagaatttggaaaagcgaaaggcagccgcgcaatatggtacatgtggttaggcgctagatatctagagttcgaggcactaggttttctcaatgaagaccactggttctcgagggaaaattcctattccggtgtggaaggggagggtttacacaaattaggttatattctaagagatatctctaagataccagggggagctatgtacgccgacgacaccgccggatgggatacaagaataacggaggacgatctacacaatgaggagaaaataacacaacaaatggatcctgaacatagacagttagcaaatgctatcttcaaattaacatatcaaaataaagttgtgaaagttcaaagaccgacacctacaggaacagtaatggatatcataagtcgcaaagatcaacggggaagtgggcaagttggtacatacggactaaacacttttacaaatatggaggcacaactgatcagacaaatggagggcgaaggagttctatcaaaagcagacctagaaaatccacatttgcctgaaaagaaagtaacccagtggctggaaacaaaaggagtcgaacgtctgaagagaatggctatttccggtgatgattgtgtagtgaaaccaatagacgaccgattcgcaaatgcgctgttggctctcaacgacatgggcaaagttcggaaagatattccacagtggcaaccatctaaggggtggcacgactggcagcaagttccattctgctcacaccactttcacgaactgattatgaaagacggtcggaaacttgtggtaccttgccgtcctcaagatgaactaataggcagagctagaatcagccaaggagctggatggtccctaagagagacggcttgtttaggtaaagcgtatgcgcaaatgtggtcattaatgtattttcatcgtcgagatcttagactggcatcaaatgcaatatgcagtgcagttcccgttcattgggttccaacatctaggacaacatggagcattcacgcccatcaccaatggatgactactgaagacatgttaacggtctggaaccgcgtgtggatcgaagataacccatggatggaagacaaaaccccggtcaccacctgggaaaatgtaccatacctaggaaagcgtgaagatcaatggtgtggcagcttaataggattaacttctcgtgcgacatgggcacaaaatataccaacggcaatacaacaggttagaagtcttataggcaacgaagagtttcttgattacatgccgtctatgaagcgatttcgaaaggaagaggaatctgaaggagctatctggtaa

SEQ ID NO: 23090 - RNA, 9873 nt, synthetic construct
  misc_feature 1..9873: note = derived and/or modified CDS sequence (opt6) from DENV-3__GQ868578__SS-prME
  source 1..9873: mol_type = other RNA
acaagcctatgtctaatgatgatactgccagcagcattagcgtttcatttgacttcacgggatggggaaccacgtatgattgtaggtaaaaatgaacgaggaaaaagtctcctattcaaaacagcgtcgggaattaacatgtgcacacttatagctatggatcttggtgaaatgtgtgatgatacagtgacatataaatgcccgcacatcacagaagtagaacctgaagatatagattgttggtgcaatcttacctcgacgtgggtaacttacggaacatgtaatcaagcgggggaacatagaagagacaaaagaagcgtagcattagcaccacatgtaggaatgggacttgacaccagaacacaaacttggatgtcagcagaaggtgcttggcgccaagtagaaaaagtcgaaacatgggcgttaagacatccgggatttacaatactggcactatttctagctcattatattggaacttcactgacacaaaaagtagttatttttattttattaatgctagtaacacctagtatgactatgagatgtgttggtgtaggaaacagagattttgtagaaggtttaagtggagcaacttgggtcgacgtagtattagaacatggagggtgtgttacaactatggccaaaaacaaacctacactagatattgaattacagaaaaccgaagctactcaactagctaccctaagaaaactgtgcatagaaggaaaaataacgaacataactactgattcacgttgtcctacacaaggtgaagctgttcttccagaagaacaagaccaaaactacgtgtgcaaacatacgtacgtcgacagaggctggggtaatggatgcggattgtttggaaaaggctctcttgttacatgcgctaaatttcaatgcctagaaagcatcgagggaaaagtggtccaatatgaaaacctaaaatataccgtaattataacggttcacacaggagatcagcatcaagttggtaacgaaacacaaggtgttacagctgaaataacaccgcaggcatctacgacagaagcaatacttccagaatatggaacattaggattggagtgtagccctagaactggtttagatttcaatgagatgatattactgactatgaaaaataaagcatggatggtccatcggcaatggttcttcgaccttccactcccatggacatctggagcgacaacagaaacacctacttggaatcggaaagaattgctcgtcactttcaaaaacgcccacgccaagaaacaagaagtagtcgtactcggatcacaagaaggtgcgatgcatacagccctcacaggggcaacagaaattcagaactcaggtggcacaagcatatttgccggacacctaaaatgcaggttgaaaatggacaaattagaacttaaaggaatgtcctacgctatgtgtaccaatacctttgtgttaaagaaagaggttagtgagacacaacatggcacaatactgattaaagtcgagtataaaggagaagatgttccatgtaaaataccattcagcacagaagacggacaaggtaaagcacacaatggacgattaataactgctaacccagtcgtcaccaagaaagaagaaccagtaaacatagaagcggagcccccgtttggagaaagtaacattgtaatcggaattggggataatgcacttaagatcaactggtataagaaaggcagctcgattggtaaaatgtttgaagcgacagcacgaggtgcacgtagaatggctatactaggtgatacagcctgggacttcggatcggtgggaggagtattaaactccctaggaaaaatggtacatcaaatctttggatccgcctacacagcattgttttcaggggtaagttgggtaatgaaaataggaataggagtattacttacatggataggcctaaatagtaagaatacgagtatgtctttcagttgcatcgcaataggaattattacattatatctgggtgctgtagtgcaagcagacatggggtgtgttataaattggaaaggaaaagagttaaagtgtggatcaggaatatttgtgaccaatgaagtgcatacatggaccgaacagtataaattccaggccgattcaccaaaacgtctagccactgcaatcgccggtgcttgggaaaacggagtttgcggcatcagatcgacgactcgtatggagaacctattatggaaacaaatcgctaatgaacttaattacattctttgggaaaacaatatcaaattgacagtagtagtaggcgacatcattggcgttttggaacaaggtaaaagaactcttactcctcaacccatggagctcaagtactcatggaagacttggggtaaagccaaaatagtaactgcagaaactcaaaatagctcctttattatcgacggaccaaacacgcctgaatgcccctctgcttcccgagcttggaatgtatgggaagtcgaggattacgggtttggagttttcacaacgaacatatggctcaaattacgagaagtatatacgcaattatgtgatcatagactaatgagcgcagcagttaaagatgaaagggctgtacatgcagacatgggctattggatcgaaagtcagaaaaatggatcatggaaacttgaaaaggcatctttaatagaggttaagacttgtaaatggcccaaatcacatacattatggagtaacggtgttctggaaagcgatatgataatccctaaatccttagctggcccaatcagtcaacacaattataggccaggttaccatactcaaactgctggaccttggcatcttgggaagctagaactagatttcaattattgtgaagggactactgttgttattaccgagaactgtgggacaaggggtccatctctaagaaccacaacggtgagtggtaaacttatccacgaatggtgttgcagaagttgcactttaccaccattacgctacatgggagaagatggatgttggtatggcatggaaatcaggccaacctcagaaaaggaagaaaatatggttaaaagtcttgttagtgcaggaagtggcgaggtagacaatttcaccatgggtgttctttgcctagcgattcttttcgaagaagtaatgcgtggaaaatttggcaagaaacacatgatagcgggcgtgctgtttacctttgtgttgcttctaagtgggcaaatcacatggagagatatggcacacactttaataatgataggatccaatgcgagtgacagaatgggtatgggagtcacctatctggcccttatagcaacctttaaaatacagccattcttagctctaggattcttccttcgtaagctaaccagtcgtgaaaatctacttctcggggttggcctggcaatggccacaacactccagttgcctgaagatatagaacaaatggcaaatgggattgctcttggattaatggcattgaaactaatcacacaatttgaaacttatcagctatggacggcattaatttccttaacatgcagcaacactatcttcacactcacagtcgcatggagaaccgcaactctaattctagcaggggtgtcgcttttaccggtatgtcagtcatcaagcatgagaaaaactgactggttgccgatgacagtagcagcaatgggtgttccaccattgccactctttatctttagtttaaaagacacattaaagagacgttcttggcctttaaatgaaggagtcatggcagttggtctagtgagcatactagccagctctctgctacgaaatgacgtgcctatggcgggtcccctagttgctggcggactacttatcgcgtgttacgttattaccggtacctccgccgacctgactgttgagaaagctgctgacgtcacgtgggaagaagaagctgaacaaacaggtgtttctcacaacttaatgattacggtcgatgacgacgggacaatgcgtatcaaagacgacgaaacggaaaacatcctgacagtcctattaaaaactgctcttttaatagtaagtggaatctttccatattctatcccagcgacgcttcttgtttggcatacatggcagaaacagactcaaagatcaggagtgctatgggatgtaccatcacccccagaaacgcaaaaagcagaactagaagaaggtgtttaccgtattaagcaacaaggaatctttggtaaaacccaagtaggggttggtgtacaaaaagagggcgtatttcatacaatgtggcacgttacaagaggagcagtactaacgtacaatggaaaaagacttgaaccaaattgggcaagtgtcaagaaagacttgatttcatatggaggagggtggagactcagtgcacaatggcaaaaaggtgaagaagtgcaagtaatcgcagtagaaccaggcaaaaaccccaaaaatttccagacgatgccaggcacatttcagactacaactggcgagataggcgcaatagcgctagactttaaaccaggaacttcgggttcaccgataatcaaccgagaagggaaaatagtgggtctatacggtaacggcgtagtaaccaaaaatggcggctatgtctccggcatagcgcagactaacgcagagccggatggaccaacaccagaattagaagaagaaatgtttaagaaaagaaacttaacaataatggacctgcatccaggttcagggaaaacacgcaaatacttaccagctatagtgagagaagcgataaaaagacgtctgagaactctaattttggcgccgactcgagtagtagcagctgagatggaagaggctttaaaaggtctgccaataagataccagactaccgcaacaaaatccgaacacacaggtagagaaatagttgacttgatgtgtcatgctactttcaccatgcgcctactctctccggtacgagtaccaaattacaacttgattatcatggatgaagcccacttcaccgacccagccagtatcgcagcaagggggtatattagtacacgcgtaggcatgggagaagctgcagctatatttatgacagcaacaccaccggggacagccgatgcctttccccaatctaatgcacccatacaagacgaagaaagggatattccagagcgttcatggaatagcggcaacgaatggataactgattttgccggaaaaaccgtctggtttgtaccatcaataaaggccggcaatgatattgccaattgtctaaggaaaaacggtaagaaggttattcaactctcaagaaaaacatttgatacagaatatcagaaaacaaagttgaacgattgggattttgtagtcacaaccgacataagcgaaatgggagcgaatttcaaggcagacagagtaatagatccgcgacgttgcttgaaacctgttattttgaccgatgggcccgagagagtaatacttgcaggacctatgccagtaacagcagcaagcgcggcccagaggaggggaagagttggcagaaacccacagaaagaaaatgatcagtatatattcaccggacaacctttaaacaacgacgaagaccacgcccattggaccgaggccaaaatgctcctagacaatattaacactcccgaaggcatcataccagcactctttgaaccagaaagggagaagtccgcagcaattgatggtgaatacagattgaagggagaatctagaaaaacgttcgttgagttaatgcggcgaggagacctaccagtatggctagcatataaggtcgctagtgaaggaatcaaatacacggacagaaaatggtgcttcgatggacaaaggaataaccagatactggaagaaaatatggatgtggagatatggacaaaagagggggagaagaagaaattacggccgcgatggctagacgctcggacgtactccgacccacttgctctcaaagaatttaaggactttgcggctgggcggaaatcaatagcattagatttagttacagaaattgggagagtccccacccacctagcacaccgaactagaaatgcacttgataatttggtgatgttgcacacgtcagagcacggtggcaaagcatatagacacgcggtagaagaactacctgagacaatggaaactctattactattaggtttaatgattttgttaacagggggagcaatgctctttttaatttctgggaagggcatcggaaagacttcaattggactaatctgtgtaatagcatcatcaggaatgttatggatggcagagattccgttacagtggattgctagtgcaatcgtattagagttctttatgatggtacttctgataccagaacctgaaaaacagcgaactccacaggacaaccaattagcatatgtcgtaataggaatattaaccttagccgcaataattgctgcaaacgagatgggtctattagagaccacaaaaagagacttaggcatgtcaaaagaaccgggagtagtatcacctacatcgtatctagatgtggacctacatcctgccagtgcgtggaccttatatgccgtagctacgactgttataacaccgatgttacgtcatactatagaaaatagtacagcaaatgtcagcttagccgctattgcgaatcaggcagtagtattgatgggtttagataagggttggccaatttcaaaaatggatctcggagtaccattgttagcattagggtgttattcacaagtaaatccattaaccttaacagccgctgtcttactcttaataacacattatgccatcataggtccaggtctacaagcaaaagctaccagagaagctcagaaaagaacagcagctggaattatgaaaaatccaacagtagatggaataatgactatcgacctcgacccggtcatatatgacagtaaattcgaaaaacagctcggtcaagtgatgttattggttttgtgcgctgtacaacttttgctaatgagaacgtcatgggcattatgtgaggcgctcacactagccaccggacctatcacaacgctgtgggaaggaagcccaggaaaattctggaacacgaccatagctgtaagcatggcaaacatattcagaggatcatacttggctggcgccgggctagccttttcaattatgaaaagcgtggggaccggtaaacgtggtaccggttctcaaggcgagactctaggggaaaagtggaagaagaaattaaatcagttatctagaaaagaatttgacctttacaagaaatccggtataaccgaagttgacagaacggaggcaaaagaaggactcaaaagaggtgaaataactcaccacgcagtttcaagaggaagtgcaaaactacagtggtttgttgaacgtaacatggtgatccctgaaggcagggtaatagatttaggatgtgggcgaggaggatggtcgtactactgtgcaggccttaaaaaggtgacagaagtccgtggatacactaaaggaggaccgggacacgaggaaccggttccgatgagcacatatggatggaacatcgtcaaactaatgagtggaaaagacgtattttacctcccgcctgagaaatgtgacacgcttctgtgcgacataggcgaaagcagcccatcacctactgttgaagaatcgcgtactataagagtgctcaaaatggttgaaccttggctgaaaaataatcagttctgtattaaagttctaaatccctatatgccaacggtaatagaacacctcgaacgacttcaaagaaaacacggtggaatgcttgtcagaaatccactctcacgaaattcaacacatgagatgtactggataagtaacggcactggaaatatcgttgcgtcagttaatatggtgtcaagactccttctaaaccgttttactatgacgcatcgaagaccgacaatagagaaagatgtagatctgggtgctggaactagacatgtaaatgctgagccagaaacacctaatatggacgttataggtgaaagaatcaagcgtataaaagaggagcataactctacctggcattatgatgatgaaaacccttataaaacatgggcctaccatggatcgtacgaagtaaaggcaactggaagcgccagtagcatgattaatggagttgtgaagttactcacaaaaccatgggatgtggtccccatggttacgcaaatggcaatgaccgacacaacaccatttggccaacaacgagtatttaaagaaaaagttgataccaggacacctagaagtatgccaggcacgcgccgagtaatggggatcaccgccgaatggttatggagaacattgggcaggaacaagaaaccgagactatgtacccgagaggagttcactaagaaagtcaggactaacgcagcaatgggcgcggtatttacagaggaaaatcaatgggattccgcaaaagcggcagtggaagacgaagacttctggaaattagttgacagggagcgagaactccataaactcgggaagtgcggctcctgcgtatataacatgatgggaaaaagagagaagaaactaggggaatttggaaaagccaaaggatcaagagccatttggtatatgtggttaggtgccagatatctagagttcgaggctttaggatttcttaacgaagatcactggttcagcagagaaaatagttacagtggagtagaaggagaggggctacataaattgggatatatactaagagatattagcaaaatcccaggaggagcaatgtacgcagatgatactgcaggttgggacacacgaataacagaagacgacctgcacaatgaagagaaaataacacaacaaatggaccccgagcatcgacaactggcaaacgccatattcaaacttacttatcaaaacaaagtagtcaaagtacaacgtccaactccaactggcacagttatggatattatatcgagaaaggatcaaagaggaagcggccaagtaggcacatatggactcaatacatttaccaacatggaagcacagttaataagacagatggaaggagagggagtactgagcaaagcggatctagaaaatccacatttgccagagaagaagatcgcgcaatggcttgaaactaaaggggtagagaggcttaaaagaatggctatttccggagatgactgcgtagtgaagccaatcgatgatagattcgcgaatgccttacttgcattaaacgacatgggcaaagtaaggaaagacattccccaatggcagcccagcaaaggttggcacgattggcaacaggtaccattttgctcacatcatttccacgaattaataatgaaagatggtaggaaattagttgttccttgcagaccgcaggatgaactaattggcagagcaagaatcagtcagggtgctggttggtcactacgggaaacagcatgtctaggtaaggcttatgcacaaatgtggtcgctaatgtacttccatcgaagagacctacgcttagcttcaaacgctatatgttccgcagtacccgtccattgggtaccaacgagtagaacgacgtggtcaattcacgctcatcatcaatggatgacaacggaagatatgttgactgtctggaatagagtatggatcgaggacaatccgtggatggaagataagacacctgtgacaacctgggaaaatgtgccttacttgggtaaacgtgaggatcagtggtgcggtagcctcatcggattaacatcaagagccacctgggcccaaaatattcccacagcaattcaacaagttcgttctctcatgggtaacgaagagttccttgactatatgccttcaatgaaaagattccgaaaggaagaagaatctgaaggagcaatatggtaa

SEQ ID NO: 23091 - RNA, 9873 nt, synthetic construct
  misc_feature 1..9873: note = derived and/or modified CDS sequence (opt6) from DENV-3__FJ898457__SS-prME
  source 1..9873: mol_type = other RNA
acttcgctatgtttaatgatgattttgccagctgctttagcgtttcatcttacgtccagagatggagaaccgagaatgatagttggtaaaaatgaacgcggaaaatcccttctgtttaaaactgcaagtggcattaacatgtgcaccctaattgctatggacctaggcgaaatgtgtgatgatacagtaacatataaatgtccacatatcactgaagtagaacctgaagacatagattgttggtgtaacttaacatctacgtgggtcacgtatgggacatgtaaccaagccggtgaacatcgaagagataaaagaagtgtcgcattagcgccacacgtaggaatggggttagatacgcggacacaaacctggatgtcagctgaaggagcttggcgacaggtcgaaaaagtggaaacttgggctttaagacatccaggattcacaatacttgcgttgttcttagcgcattatattggcactagcttgacacaaaaagtggttatatttatactgttaatgctagtaacaccgagcatgacgatgagatgtgttggagtcgggaatcgagatttcgtagaaggactatctggggcaacttgggtagatgtagttttagaacacggaggatgtgttacaaccatggcgaaaaacaaaccaacactcgacatagagcttcagaaaactgaagctacgcaactcgctacactcagaaaattatgtatcgaagggaaaataacgaatataactactgactcaaggtgtcccacacaaggagaggcagtgctgcctgaggaacaagatcaaaactatgtatgtaaacatacctacgtcgatcgaggctggggtaatgggtgtggtttattcggaaaaggttcattagtaacgtgtgcaaaatttcaatgtttagaaccaatcgaaggcaaagtagtacaacatgaaaacctgaaatatactgttataataacggtacatacaggggatcaacatcaagttggaaacgaaacgcaaggagttacagcagagataacaccccaggcttcaacaacagaggcaatacttcctgaatatggcaccttaggacttgaatgttcgccaaggacaggacttgatttcaacgagatgatccttcttaccatgaaaaataaggcttggatggtacatagacaatggttcttcgatcttcctctaccgtggacttcaggagcaacaactgaaactccgacctggaacagaaaagaattactggttacattcaaaaacgcacatgcgaagaaacaggaggtagtagtattaggttctcaagagggcgccatgcatacagcactaacaggtgctacggaaatccagaatagtggcggtacatcgattttcgctggtcatctaaaatgtcgattaaaaatggataagttggagctaaaaggtatgagttatgctatgtgcacaaataccttcgttctgaagaaagaagtttcggaaacacaacatggaactatactaataaaggtggagtataagggcgaagacgcgccatgtaaaataccattttcaacagaggacggtcaaggaaaagcacacaatggtagattaataacagctaatcccgtcgtaaccaagaaagaagaacctgtaaacattgaagctgaacctcctttcggagaatcaaatatagtaattggtataggtgataatgctctaaaaataaactggtataaaaagggatcatcaattggaaaaatgttcgaagctactgcaagaggagcacgcagaatggcgatactcggagataccgcctgggattttggaagcgttgggggtgttttgaactccttaggtaaaatggttcaccaaatttttgggtccgcatataccgcattattttcaggggtctcatggataatgaagataggcataggtgtattgctgacgtggataggtttaaattctaaaaatacctcgatgtctttctcttgcatagctatcggaattatcacactatatttaggagccgtagtgcaagcggatatgggatgcgtaattaactggaaaggaaaagaattgaaatgcggatctgggatatttgtaactaatgaagtacatacatggaccgaacaatataaattccaagcggactccccaaagagattagctacagcaattgcgggggcttgggaaaatggggtatgtgggataaggagtaccactaggatggagaacttactttggaaacagatagcaaatgaacttaattatatactatgggagaacaatattaaactcacagttgtagttggggatataataggggtgttagaacagggaaaacgtacattaactccccagccgatggaactaaaatatagttggaaaacctggggaaaggcgaagatcgttacagccgaaacacaaaattcctcattcatcattgatggacccaacactcctgaatgtccgtccgcatcaagagcgtggaacgtttgggaggtggaagactatggatttggcgtattcacgactaatatttggttaaagctccgagaggtttacacacaactctgtgaccatagattaatgtccgccgccgtgaaagacgaacgagccgtacacgcagacatgggttattggatagaatcccaaaagaatgggagctggaaactggaaaaagcctcactaattgaggtaaaaacgtgcacatggcccaaatcacacaccctgtggagcaatggggtattagaaagcgatatgattataccaaaaagtttggcaggaccaatatcacaacacaatcatcgaccaggttaccatacacagaccgcaggtccgtggcatcttggtaaacttgaattagatttcaattattgcgagggtacaacagtagttattaccgaaaactgcgggacgaggggcccctctttacgtacaacaactgtctctggcaaattgatacatgaatggtgttgcagatcttgcacactaccaccactcagatacatgggcgaagacggatgctggtatggaatggaaattcgtcccatttctgaaaaagaagaaaacatggtgaaaagtctcgtatcggctggaagcggaaaagtggataacttcacaatgggggtcctgtgtttagcaatattatttgaagaagtaatgcgagggaagttcggaaagaaacatatgatagctggtgtatttttcacttttgtattgctattaagtgggcaaataacatggcgtgacatggcccatactctgataatgattggatccaatgcctcagatagaatgggaatgggagtaacctatctggctcttattgcgacgtttaaaattcaacctttcttagcactgggattctttttgagaaaactcacgagccgcgaaaatttacttttaggcgtagggctggcaatggcaacgacactacaacttccggaggatatagaacaaatggcaaatggtatcgcacttggattaatggcactgaaattaataacacaattcgagacataccaactttggaccgctttaatatccctaacttgttcaaatactatctttacacttaccgtcgcgtggagaactgccacactgatcctagcaggcgtctccttacttcccgtatgccaatcatcttcgatgcgtaaaacagactggctaccaatggctgtagcagcaatgggagttccaccgttacctttatttatctttagcctaaaagacactttaaaaagaaggtcatggcccctgaacgaaggggtgatggccgtaggtttggtatcaattttagcatcgtctttgttacgaaacgatgtgccgatggctgggcctctagtagccggaggattgctaattgcatgttatgtgatcacgggaacatctgcagacttgacggtagaaaaggccgcggatatcacatgggaagaagaagctgaacaaacaggagttagtcataatctaatgattacagtagatgacgacggaacaatgagaatcaaggatgacgaaacagaaaacatactcaccgtgttgttaaaaactgcattactaatagtgagtggaatatttccatattctataccagccaccctgctggtttggcatacgtggcagaagcagactcaaagatcaggagtcttatgggatgtgccaagccctcctgaaactcaaaaggcagaattagaagaaggcgtctaccggataaagcaacagggcatattcggaaaaacccaggtaggagttggtgtccaaaaagaaggcgtttttcatacaatgtggcatgtaacaagaggggcagtactgacatacaatggaaaacgattggaaccaaactgggcgtcagtaaagaaagacctcatatcctatggagggggatggcggctatctgcacaatggcagaaaggagaagaagttcaagtcatagccgtcgagccaggcaaaaatcccaaaaattttcaaaccatgccaggcacatttcaaacaactactggggaaatcggagccatagctttagatttcaaaccaggaacctccggttcgccaataattaatcgagaaggtaaagttgtgggattatatggaaacggtgtagtcaccaagaacggaggttacgtcagcggaattgcacaaaccaatgcggagcctgacgggccgacgcccgaattagaggaggaaatgtttaaaaagagaaatcttacaattatggatcttcatcctggttcaggcaaaacaagaaagtacttaccggcaatcgtgagagaagcaattaaaagacggttaagaacattaatcttagcacctactagagtggtagcggcagaaatggaagaggctttaaaaggattaccgatacgataccaaacgacggcaacaaagagcgaacatactggtagagagatagtcgatcttatgtgtcatgcaacatttacaatgcgtctgctaagcccagtaagagtgcctaattataacttgattataatggacgaggctcattttactgatccggcttcgattgctgcacgcggttatatctcgacacgcgtaggaatgggagaagcggcagcaatatttatgaccgctacaccgcctggaaccgcagatgcctttccacaatccaatgcacctatccaagatgaagaaagagacattcccgaacgaagttggaactcaggtaacgagtggattactgatttcgctggaaaaaccgtgtggtttgttccatcaataaaagctggaaacgacatcgccaattgtctaaggaaaaatggcaagaaagtgatacaactaagtaggaagacattcgacacagagtatcaaaagaccaaattaaatgactgggactttgtagtcaccaccgatatatccgaaatgggggccaacttcaaagccgacagggtaatcgatccaagaagatgcctcaaaccggtaatcctgacagacggtccggaaagggtaatattagctgggcctatgcctgtaactgcagcaagcgccgctcaaaggcgaggaagagtagggcgtaatccacaaaaagaaaatgatcaatacatttttactggacaacccctaaataatgatgaagaccacgcgcactggacagaagccaaaatgttacttgacaacataaatacgccagagggtatcataccagcactgtttgaaccggaaagggaaaaatcagcagcaattgacggagaatacagactgaaaggtgaatccagaaagacatttgtagaattaatgcgcaggggcgatcttcctgtttggttagcacataaagtagcgtctgaaggcataaaatataccgaccgaaaatggtgtttcgatggtcagagaaataaccaaattttagaagagaacatggatgtcgaaatatggacaaaagaaggggagaagaagaaacttagaccgcgctggctagacgctagaacgtatagtgacccgctggccctcaaagaatttaaagattttgcagcaggtagaaaatcgattgcgttagacctcgtaacagaaatcggtagagtaccttcccatctagctcatcggacaagaaacgctctcgacaatttagtaatgttacacacatccgaacacggaggacgtgcatatcgtcacgctgttgaagaacttcccgaaactatggaaactttactcttattagggcttatgatattgcttaccggtggagcaatgttatttcttatcagtgggaaagggataggaaaaacaagcatcggcttaatatgtgtcatagcgtcatctggcatgttatggatggccgagataccgttacaatggatagcctcggcaatagttcttgaatttttcatgatggtgcttttgataccagaaccagagaaacaaagaacccctcaagataaccagcttgcatatgtggtaatcggaatactaactctcgccgcaattatcgcagctaatgaaatgggtctgctagaaacaactaaacgtgaccttgggatgtcaaaagaacccggagttgtgtcaccaacatcctatttggacgtggatctgcaccccgcatcggcctggactctatacgcagtcgccactacagtaatcacacccatgttaaggcacacgatagagaatagcactgcgaatgttagcttagcggcaatagcaaatcaggcagttgtattaatgggattagacaagggatggcctatcagtaaaatggacttgggtgtccctttgttagcattaggttgctattctcaagtaaacccattaaccttaacagctgcagtattgttactaataacccattatgctatcattggaccgggtttacaagcaaaagcaacacgagaagcacaaaaacgtacagctgccggaataatgaaaaatcccacagtagatgggattatgaccatcgatctcgatcccgtaatttatgattcaaaattcgaaaaacagctaggtcaagtaatgctcctagtactatgcgcagttcaactattactcatgagaactagctgggccctatgcgaagcattgacactagcaacaggacctataacgacactctgggaaggaagccctggtaaattctggaatacaactatagctgtgtcgatggctaacatctttcggggatcttatctagctggagcgggcctagcgttcagcatcatgaaaacagtgggcacgggtaagagaggcactggaagtcagggagaaaccctcggggagaaatggaagaagaaactcaatcaattgagcagaaaagaatttgatctatacaaaaagtctggaataactgaggtcgatagaacagaggcaaaagagggtctgaaacgtggagaaataacacatcacgctgtttcccgtggttctgccaagttacaatggtttgtagaacgtaatatggttatacctgaaggtcgagttatagatctaggttgtggacgaggaggttggtcatattactgcgccgggctcaagaaagtaaccgaagtaagaggctataccaaaggtggacctggacacgaggagccggtgccaatgtctacatacggatggaatattgtaaaacttatgtcaggaaaagacgtgttctaccttcccccggaaaaatgtgatacattattatgcgacattggagaaagctcgccaagccctacagtcgaagaatcgagaacgataagagtcttgaaaatggtagaaccatggttaaagaataaccagttttgtataaaggtactgaacccttatatgcctacagtgatagagcatttggagagattacaaagaaagcacggaggaatgctagttagaaatccattaagccggaactcgacccatgaaatgtactggatatcaaatggaacagggaatattgtagccagtgtaaatatggtatctagactattacttaaccggttcaccatgacgcaccgtcgaccaaccatagaaaaagacgtagatttgggtgcaggtactagacatgtcaacgcagagccagaaacaccaaatatggatgtaataggagaaagaataaaacgaattaaagaggaacataattcaacttggcactatgatgatgaaaatccatataaaacttgggcctaccatggcagttatgaagtaaaggcaactggatctgcctcaagcatgataaatggagtagtaaaactattgacaaaaccatgggatgtcgtacctatggtgacccaaatggccatgaccgatacaacgccttttggacaacaaagagtgtttaaagaaaaagtagacacgagaactccaagatcaatgcctggaactcgaagggttatgggtataaccgccgagtggctatggcgaacactcgggcgaaataagaaaccaaggttatgcactcgggaagagttcaccaaaaaggtaaggacaaatgcagcgatgggagccgtattcactgaagaaaaccagtgggattctgctaaagcggctgtagaagacgaagacttttggaaacttgtagatagggaacgtgaactacacaagctaggtaaatgtggatcttgcgtatataacatgatggggaaacgggagaagaaactaggagagttcgggaaagccaaggggagcagggcaatttggtacatgtggttgggagcccgctacctcgaatttgaagccttaggattcttgaacgaagaccattggttctctagagagaactcctatagcggtgtagaaggagagggcctccataagttgggctatatattaagggacatctctaaaatacctggaggagcaatgtacgcagatgacacagcaggatgggacacaagaataacggaagacgatttacacaacgaagaaaagattacccaacaaatggatccggaacaccgccaattagcgaatgctatattcaaattaacctatcaaaataaggtggtgaaggtacaacgtcccactccaacaggcacggtcatggacataatatccagaaaagaccaaagaggtagtggacaagtaggcacctatggtctaaacacgtttacaaacatggaagcacaactcatccggcaaatggaaggagaaggcgtcttatcaaaggctgacctagagaatccacatcttcccgagaagaaaatcactcaatggctcgaaacgaaaggagtagaacgccttaaaagaatggcaatatctggagatgattgcgtcgtaaagcctattgatgatagattcgctaatgcgcttctagcacttaatgatatggggaaggtacgcaaagatataccccaatggcaacctagcaaaggttggcacgattggcagcaagtaccattttgcagccatcacttccacgaattaataatgaaagatggacggaaattagtagtaccatgtcgaccacaagatgaattaataggaagggcaagaatttcacagggagcggggtggtcactgagagaaacggcatgcctaggcaaggcatatgcccaaatgtggtcattaatgtactttcatagaagagacttacgattagcgagcaacgccatatgtagtgcagtacctgtacattgggttcctacaagtagaacaacatggtctatacatgctcaccaccagtggatgactactgaggatatgcttactgtttggaacagggtttggatagaagacaacccctggatggaagacaaaacaccagtaacgacgtgggaaaacgttccatacctaggtaaaagggaagatcaatggtgtggttcattgatcggtctgacatccagagcgacttgggctcagaatatacctacggccatacaacaagtaagatccttaattggaaatgaagagttcctcgactatatgccatctatgaagcggtttcgaaaagaagaggaatccgagggtgcaatatggtaa

SEQ ID NO: 23092 - RNA, 9873 nt, synthetic construct
  misc_feature 1..9873: note = derived and/or modified CDS sequence (opt6) from DENV-3__KF955505__SS-prME
  source 1..9873: mol_type = other RNA
actagcctctgcttaatgatgatattacctgctgcactcgcgtttcatttaacttcacgaaatggagaaccacgaatgatagtagggaaaaatgagagaggaaaatcactgttatttaaaacagcatcaggtataaacatgtgcacgctaatagcaatggatctaggagaaatgtgcgacgataccgttacttacaaatgcccccatatcacagaagtggaacctgaagatatcgattgttggtgtaacctgacatcaacctgggtaacttatggtacctgtaatcaagcaggagaacataggagagataaacgaagtgtagcgttagcacctcacgttggtatgggactggataccagaacgcaaacatggatgagcgcagaaggggcgtggagacaagttgaaaaagtagaaacctgggctctaagacatccaggctttactattctggctttatttttggcccactatataggaacgtcattgactcaaaaagtggtcatctttatactcctaatgttggttacaccttcgatgacgatgcgttgtgtcggagttggcaatcgagactttgtcgaaggcttgtccggtgcaacctgggtagacgttgtattggagcacgggggatgtgttacgactatggccaaaaacaaaccaacgttagacatcgaactccagaaaactgaggccactcaattagcaacactacgaaaattatgtatagaagggaaaataacgaatattaccacagatagccggtgccctacacaaggcgaggccgtattacccgaagaacaagatcaaaactatgtgtgcaaacatacatatgtagatcggggttggggcaacggctgtggactgttcggtaaaggatcccttgttacctgcgcaaaattccaatgcctagaaccgatcgaaggtaaagttgtccaatacgagaatttgaaatatactgttatcattactgtacacacgggagatcaacaccaagttggtaacgaaacgcaaggtgtcacggcggaaattacaccacaggcttctacaacagaggcgatcttaccagaatacggaacgctaggactagaatgctctccacgtacgggtcttgattttaacgaaatgatactactaactatgaaaaataaagcatggatggtacataggcaatggttctttgatttaccattaccctggacatcaggggccacaacagaaacacccacctggaatcgaaaagagttgttagtcacatttaaaaatgcgcacgctaagaaacaagaggtggtggtgttgggttcacaagaaggggctatgcacaccgccttaacgggtgcgactgagatccaaaactcagggggaacatcaatttttgcgggtcacctcaaatgcagactcaaaatggataaattagaactcaaagggatgagttatgcaatgtgtacgaacacgttcgtgctaaagaaagaagtgtcagagactcaacatggaactattctaataaaagtcgagtataaaggggaagatgcaccctgtaaaataccctttagtactgaagacggccaaggaaaagcccacaacggaaggttaattacagccaatcccgtggtaacgaagaaagaagaaccggtgaacatagaagctgaacccccatttggtgaaagcaatatagtgataggcatcggagataatgcattaaaaattaactggtataagaaaggatcgtctataggtaaaatgtttgaagccaccgcccgaggagcaagaagaatggctatacttggagatactgcatgggattttggatcagtcggaggtgttctaaacagcctcggcaaaatggtgcaccaaatatttggttcggcgtacacagcactattctcaggcgtttcctgggtaatgaaaattggtattggagtgctattaacctggattggtttaaatagcaaaaatacgtcgatgagtttcagttgtattgcaattgggataataacattatacctaggggctgtggttcaagcagacatgggatgcgtaataaattggaaaggaaaagagttaaaatgtggatctggaatatttgtaactaatgaagttcacacttggacagaacaatataaatttcaagcagattcaccaaaaagacttgccaccgccatcgcaggagcatgggaaaacggagtatgcggaattagaagtacaactagaatggaaaatcttttgtggaaacagattgcaaacgagctcaattatattttatgggagaacaatattaaactaactgttgtagtaggtgacattataggcgtattagaacaaggtaaacggacattaacacctcaaccaatggaacttaaatattcgtggaaaacatggggcaaagcaaaaatagttaccgcagaaacacaaaacagctcctttataatagatggtccgaatacgcctgaatgcccgagtgcctcaagggcatggaacgtatgggaggtagaagattacggatttggtgtatttacaacaaatatatggttaaaactaagggaagtatatacacagctttgtgaccaccgacttatgtccgcagccgttaaagatgaacgagcagttcacgccgacatgggttactggatagaaagccagaaaaacggcagctggaaattagaaaaagcatcgctgatagaagttaaaacgtgcacatggccaaaaagtcatactttatggagtaatggagtattagaaagtgacatgataataccaaaaagcctcgcaggaccaatcagccaacataaccaccgccctggttaccacactcaaacagcaggaccctggcacttaggtaaattggaactagactttaactattgtgaaggcacgacagtcgtgattacagaaaactgtggcacaagaggaccttctttaagaacaacgacagtgagtggaaaattgatacatgaatggtgttgcaggtcgtgcaccctcccaccacttcgctacatgggtgaagatggctgctggtatggtatggaaataagaccaatcagtgaaaaagaagagaatatggtaaaatcacttgtctcagctggctcaggcaaagtggacaactttactatgggtgttctctgtctagcaatcctatttgaagaggtaatgagaggaaaatttgggaagaaacacatgattgccggtgtctttttcacatttgttttgctattaagcgggcaaataacatggcgtgatatggcccatacactcattatgattggatcaaacgcatccgatagaatgggtatgggcgtgacctacttagctttgatagccacgtttaaaattcaacctttcttagctctgggattctttctaagaaaattgacttcgcgagaaaacctactcttaggcgtgggtctagcgatggccactacactgcaacttcccgaagacatagaacaaatggcaaacggtatcgcattaggattgatggcactaaaattaataacacaattcgaaacatatcagctttggacagcactaataagcctaacatgtagtaatacaatgttcacacttactgtagcgtggcgaaccgctacattaatactagccggtgtgtcacttttacctgtctgccaaagttcatcaatgcgaaaaacggattggctgccgatggccgtcgcggctatgggggtgccgcctctcccgttgtttatattctcacttaaggacactctaaagcgacgatcatggccgttaaacgagggcgttatggccgttggattagtcagtattttagctagcagcctacttcgaaacgacgtcccaatggcggggcccctagttgctggaggcctcttaatcgcgtgttacgtaatcactggaacaagtgcggacctcaccgtggagaaagccgcagatattacctgggaagaggaagcagaacagacaggagtatctcacaacctaatgattacggttgacgacgacggtaccatgcgaattaaagatgacgaaacagaaaatatcttgaccgttctgttgaagactgctttgctgattgttagcggcgtcttcccatattcaattccagctacgctattggtatggcatacatggcaaaaacaaacacagcgcagtggagttttatgggacgtcccatcacctccagaaacgcaaaaggctgaacttgaggaaggcgtgtacaggatcaagcaacaaggtatatttggaaaaactcaagttggtgtaggtgtgcaaaaagaaggcgtcttccatacgatgtggcatgtaactcgaggggctgtacttacatataatggaaagcgactagagccaaactgggcgagcgtcaagaaagatctaataagctatggaggaggttggaggctatcagcacaatggcagaaaggcgaagaagttcaagtgatagcagtagaaccaggcaaaaaccctaagaatttccagactatgcccgggacatttcaaacaacaactggagaaataggtgctatcgcccttgactttaaacctggaacgagcggctcaccaatcataaatagagaaggcaaagtcgtcgggctatacggtaatggtgtagtaactaagaatgggggatatgtgagtggaatagcccaaacgaacgctgaaccagacggtccgacacctgaacttgaagaagagatgtttaagaaacgaaatcttactataatggatctacaccccgggagtggcaaaactaggaaatacctccccgcgattgttagagaagctattaaaagacgcctaagaacacttattctcgccccgactagggtggttgcagccgaaatggaggaggcattaaaaggattaccaataagataccaaactacagcaactaaaagcgaacacaccggacgagagatagtggatctcatgtgtcatgccacatttacaatgcgactattgtcaccggtaagagttcctaattataatttaatcatcatggacgaagctcactttacagatcccgcgagcattgcagctagaggatacatttcaactagggtaggaatgggtgaagcagcagcgatctttatgacggctacaccgccaggcacagcagacgcgttcccgcaaagcaacgctccgattcaagatgaagaaagggacattccggaaaggagttggaatagtggaaatgaatggataacggactttgcaggcaagactgtgtggtttgtgccgagcataaaggcaggcaatgacatagctaactgtttgcggaagaacggtaagaaagtaatccaattatcacgaaaaacctttgatacggagtatcagaaaactaagctcaatgactgggacttcgtagtaaccacagatatatcagaaatgggagctaattttaaagctgaccgtgtaatagatccgagacgctgcttaaaaccggttatattaaccgatggaccagagcgggtcatcctagctggtccaatgcctgtaactgctgcttcagccgcacaaaggagaggaagggtaggacgcaatccgcaaaaagagaacgaccaatacatatttaccggacaaccactcaacaatgatgaagatcatgcacattggaccgaagcaaaaatgttattagacaatatcaacacaccagaagggataatcccagcactatttgaacctgaaagagagaaaagtgcggccatagacggagaatacagactaaagggggaatcgcgaaagacatttgtagaactaatgcgaagaggagacttaccagtttggcttgcacacaaggttgcttcagaaggaataaagtatacggataggaaatggtgttttgatggccaaagaaacaatcaaattttagaagaaaacatggatgtggaaatctggactaaggaaggcgagaagaagaaactacgaccacgatggctggatgcccgtacatattcagatccgctagcgttgaaagaatttaaagatttcgctgcaggtagaaaatcgatagcgcttgacctggtgactgagataggacgcgttccatcacaccttgcacatagaactcggaatgcactagataatctcgtaatgttacatacaagtgaacacggaggacgcgcctaccgacacgcagtcgaagagttaccagagaccatggagactttactgctactaggattaatgatattactaacaggaggagcaatgctatttttaatatctgggaaaggaataggaaagacaagtataggtctaatttgtgtaatagctagttccggcatgctttggatggcagagataccgttacaatggattgcgagtgcaatcgtgctagaatttttcatgatggtcctgttaataccggaaccagaaaagcaacgaacgcctcaagataatcaactggcatacgttgttataggtatacttactcttgctgcaattatcgcagcaaacgaaatgggacttttagaaaccactaaaagagatttggggatgagtaaagaacctggagttgtaagcccaactagctacttagatgttgatttgcacccagcgtcagcctggacattatacgctgtagctacaacggtgattacaccaatgttaagacacacaatcgaaaactctacggcgaacgtatccttggctgcaattgctaatcaggccgtcgtactcatgggactcgacaagggatggccaatctcaaaaatggatttaggtgtaccacttttagctctgggttgctactcacaagtgaatccgctaacattaacagccgcagttttattactaattacccattacgctatcattggaccaggattgcaagctaaggctaccagagaggcccagaaaagaactgcagcaggaataatgaaaaatccaaccgtagatggcattatgacgatagacttagatccggtaatatatgatagtaaatttgaaaaacaattaggacaagttatgttattggttttgtgtgccgtacagctcttacttatgcgaacaagttgggccctttgtgaagccttaactctggccacaggaccaataacgactctatgggagggaagtccaggaaaattttggaacacgacaatagcggtttccatggccaatatatttcgtggaagttatttggctggagcaggcttagcatttagcataatgaaatctgtgggaacaggaaaacgcggaacaggttcacaaggagagactttaggagaaaaatggaagaagaaattgaaccagttaagtcgtaaagagttcgacctctacaagaaaagtggaataactgaggtagatagaactgaggcaaaagaaggattaaaacgtggtgaaaccacacatcatgctgtgtcgagaggatctgcaaaactacaatggttcgtggaaaggaacatggtaatacctgaagggcgagtcattgatcttggctgtggaaggggtggttggtcatactactgtgctggtctaaagaaagtaacagaagttaggggctacaccaaaggtggcccaggccatgaagaaccagtaccaatgtccacctatggttggaacatagtcaaactaatgtctggcaaggatgttttctatctccctccagaaaaatgtgatacgctattatgcgatatcggcgaatcctctccgagtccaacagttgaagaatcaaggactataagggttttgaagatggtagaaccgtggctgaaaaataatcaattctgtattaaggttctaaatccttatatgcccactgtcatagaacatctagaacgactacagaggaaacatggaggtatgctggttagaaaccctctatcaagaaattcaactcacgaaatgtactggatatctaacggaacgggcaatattgtagcatcggtgaatatggtcagtcgtcttttgttgaatagatttaccatgactcacagacgtccaacgatcgagaaagatgtggatctcggggcaggcacacgtcatgtcaatgcagaacccgaaacacccaatatggacgtcatcggagaaagaataaaacgcataaaagaggaacataacagcacctggcactacgatgatgaaaatccttataaaacgtgggcctaccacggctcttatgaagtaaaagcaaccggtagcgcatcaagtatgataaatggagtagtgaaattgttgactaagccatgggatgttgttccgatggttactcagatggcaatgacagataccacgccttttggacaacaacgtgtatttaaagagaaagtcgatacgcgtacacctcgctccatgccgggaactagacgagttatgggcataaccgcggagtggctgtggagaaccttgggacgaaacaagaaaccccgcttatgccctcgagaagagttcactaagaaagtgcgcacaaatgctgccatgggtgcagtgttcaccgaggaaaaccagtgggactcagccaaggcggcagtagaggacgaagatttttggaaacttgtagacagagaaagagaacttcacaaactaggaaaatgtggaagctgtgtatataatatgatgggaaagagagagaagaaattaggagaatttggtaaagcaaagggaagtagagcaatatggtacatgtggttgggggcccggtacctagagtttgaggctttaggcttcttaaatgaagatcattggtttagtagagaaaattcctatagtggggtagaaggtgaagggctacccaaacttggatacattttacgcgatataagtaaaatcccaggaggtgcaatgtacgcggacgacacggctggatgggacactaggattacagaggacgatctacacaatgaagagaagataccgcaccaaatggaccccgaacactcgcgtttagctaatgcaatatttaaattaacttatcaaaataaagtggtcaaggtacagagaccaacaccgactggcactgtgatggatattatatcaagaaaagcacaaagggggagcggacaagtaggaacatacggccttaacacctttacaaatatggaggcacaacttataagacaaatggagggagaaggagttttatcaaaggcggacttagagaatccacatttacctgagaagaaaataacacaatggttagaaaccaaaggagttgaaagactgaagagaatggctattaccggtgatgattgtgtggtgaagccaattgatgaccggttcgcgaatgctctgctggcactgaatgatatgggaaaagtgagaaaagatataccccagtggcagccatctaaaggatggcatgactggcaacaagtgccgttctgctcgcaccatttccacgaactaataatgaaggatggacgaaaacttgtggtcccctgtcgcccacaagacgaattaataggcagagctcgaattagtcaaggcgcaggttggagcttaagagagacagcttgtttaggaaaggcttacgcacaaatgtggtcgcttatgtattttcaccggagagacttaagattagcatccaacgcaatatgttcagctgttccagtacattgggttcctacatcgcggactacgtggtccatacacgctcatcaccagtggatgacaactgaagatatgctgaccgtttggaatagagtctggatagaagataatccgtggatggaagataaaacaccagtaacgacctgggaaaacgtaccttatctagggaaacgtgaagaccaatggtgtggatccctaataggattgacgtcaagagcgacatgggcacaaaatatacctacggccatccaacaagtaagatctctaataggtaatgaggaatttcttgattacatgccatcaatgaaacgtttcaggaaagaagaggaatcggaaggagcgatttggtga

SEQ ID NO: 23093 - RNA, 9873 nt, synthetic construct
  misc_feature 1..9873: note = derived and/or modified CDS sequence (opt6) from DENV-3__FJ898464__SS-prME
  source 1..9873: mol_type = other RNA
acttccctatgcttgatgatgatattaccagctgccctcgcgtttcacctaacaagtagggacggggaacccaggatgatcgtagggaaaaatgaacgaggaaaatcactactctttaaaacagcatccggaataaacatgtgcacattaatagctatggatcttggagaaatgtgcgatgatacagtaacttataaatgtcctcacataaccgaagtagagccagaagatatagactgttggtgtaatttgacctctacatgggttacatatggaacatgtaatcaagcaggagaacatagacgagataaaagatccgttgctctagccccacacgttggaatgggcttagatactcgaacacaaacctggatgtctgcagaaggtgcttggagacaagtagagaaagtagaaacatgggccctaagacatccaggattcactatattggcactcttcttagctcactatatcggaacttctttaactcaaaaagttgtcatatttattttactgatgttagtcacaccctcgatgactatgagatgtgtcggtgtcggtaatagggattttgtcgaaggcctatcaggggccacatgggtagatgtagtcttagaacatggaggatgtgttacaacaatggccaaaaacaaacccacgctagacatagaattacagaaaactgaagcaactcaactagcaacattaaggaaattgtgtatagaaggtaaaatcactaatataactacagactctagatgtcctactcaaggcgaagctgttttacccgaggaacaagaccaaaactatgtctgcaaacacacatatgtggaccgaggttgggggaacggttgtggactcttcgggaaggggagcttggtaacttgtgcaaaatttcaatgtctagaaccaatcgagggaaaagtagttcaatatgaaaatttaaaatacaccgtaattattactgtgcacacaggggatcaacaccaggtaggaaacgaaactcaaggtgtaaccgcagaaatcacgccacaagcatcaaccacagaagctatacttcccgaatacgggacactgggtttagagtgttcgccaagaactgggttagattttaacgaaatgattctacttacaatgaaaaacaaagcatggatggtacataggcaatggttcttcgatctacctctaccatggacttcaggggctactacagaaacacctacttggaatagaaaagaattattagtgacattcaaaaacgcgcatgcgaagaaacaagaagtagttgtactaggtagtcaagaaggggcaatgcacaccgcattaaccggagcaactgaaatacaaaatagtggcggaacaagtatattcgctggacatttaaagtgtaggttgaaaatggacaaactggaactaaaaggtatgtcgtacgcaatgtgtacgaatactttcgttttgaagaaagaagtcagtgagacacagcacggaacaattctgataaaagtagaatacaaaggggaagatgctccatgtaaaatacctttttcaacagaagacggtcaaggtaaagcacataacgggagacttataactgcgaatccagtggtaacaaagaaagaggaaccagtaaatatagaggctgagcctccgttcggagaatcaaatattgtgatcggtatcggagataatgcattaaagataaattggtataagaaaggctcatctattggaaagatgttcgaggcaacagcaagaggtgcgagaagaatggccatattaggagacaccgcatgggattttggcagtgttggaggagtactgaactccttgggtaaaatggttcaccaaattttcggatcagcttatacagcattatttagtggagtctcttgggtaatgaaaattggtataggagtactcttaacgtggattggactaaattcgaagaatacaagcatgtcctttagctgtatcgccataggaataataacactgtatctaggcgcagtagtccaggctgacatgggttgcgtcatcaactggaaaggaaaagaactaaaatgcggcagcggaatttttgtaaccaacgaagttcacacttggactgaacaatacaaatttcaagccgacagtcccaaaagactggcgactgccattgcgggagcctgggaaaacggagtttgtggcattagaagcactacgagaatggaaaatctactttggaaacaaattgcaaatgagctcaactatatattatgggaaaacaatattaaactaaccgttgtagtaggcgatataataggagtgctcgaacaaggaaaaaggactcttactccacagccaatggaactgaaatattcatggaaaacatggggaaaagctaaaatcgtaacagctgaaactcaaaactcaagtttcataatcgatggaccgaatacacccgagtgcccgagcgcctcaagggcgtggaatgtctgggaagtcgaggactatggatttggcgtatttaccacgaatatttggctaaagttacgggaggtgtatacgcagctatgtgaccaccgcttaatgtcggcagctgtcaaagatgaaagagctgttcatgcggatatgggatactggatagaatctcagaaaaacggaagctggaaactagaaaaggcttcattgatagaagttaaaacatgtacttggccgaaatcacatacattatggtctaacggagtcttggaaagcgatatgatcatacctaagtcattagcaggacccatatcacaacacaaccatcggccaggataccacacccaaaccgcaggaccatggcatttaggaaaacttgaattagattttaactattgcgaagggacgacggtggtaatcaccgagaactgcggtacccgtggtccgagtctgcgtacgaccacagtctccggtaagctcatacacgagtggtgctgccggagttgtaccctaccaccgctaagatatatgggcgaagacggttgctggtacgggatggagataagaccaataagcgagaaagaagagaacatggttaaaagtctcgttagtgccggatccggtaaggtcgataactttactatgggcgtactatgcttagctattctatttgaagaagtgatgcgcggaaaatttggcaagaaacatatgatagcaggcgtatttttcacatttgtattattgctaagtgggcagataacatggagagatatggctcatacattaataatgatcggtagtaatgcaagcgaccggatgggaatgggcgtcacatatttagcgctgattgctacgtttaaaattcagccgtttttagctttgggattctttctacgtaaattaaccagccgtgaaaatctgttgttgggcgttggacttgccatggcgacaacattacaattgccagaggatatcgaacagatggcaaatggtatagctctcgggctaatggccctcaaacttataacccaatttgagacataccaactttggacagcattaattagtctaacttgttcaaatactatgtttactcttacagtggcttggagaactgcgacacttatactcgccggcgtcagtctgttacctgtttgccagagttctagtatgcgtaaaactgattggctcccgatggcagtcgctgcgatgggcgtaccgcctctaccactttttatttttagtttaaaagatacgctgaaaagaagatcttggcccttaaacgaaggtgtaatggcagtgggtctagtctctatactagcatcatcattacttcgaaatgatgtgccgatggctggaccattagtcgctggtggtttactaatagcatgctatgtaataacaggaacttcagcagacttgacagtagaaaaagctgcagatataacatgggaagaagaggccgaacaaactggtgtgagccataatctgatgataacagttgatgacgatgggacaatgaggataaaagacgacgaaacggagaatatattaactgtattactaaaaacggcgttgctaatagtttctggtgtatttccctattcaatcccggcaaccttgcttgtttggcacacatggcagaaacagacccaaagaagtggggtcttatgggatgtgccgagtcccccagaaacccagaaagcagaactagaggagggagtttaccgaataaaacagcagggaatatttggaaaaactcaagtaggagtaggagttcaaaaagagggagtatttcataccatgtggcatgtgacacgaggtgctgttttaacgtataatggtaaaaggctggaacccaactgggcatcagtcaagaaagacctaatttcatatggagggggctggagactgtcagcacaatggcaaaaaggagaggaagtacaagtgatagctgtagagcctggtaaaaatcctaaaaattttcaaactatgccaggaacatttcaaaccacaacaggggaaattggtgcgatagctctagattttaaacctgggacaagtggatcaccgattataaatcgtgaaggcaaagtggtaggtctttatggaaatggagtagttaccaaaaatggtggctatgtttcggggatcgcccagaccaacgcagagcctgatggacctacaccagaactcgaagaagaaatgtttaagaaaagaaacctaaccatcatggatctacaccccggatcaggtaaaacccgaaaatacctcccagcaatcgttagagaagcaattaaacgacgattaagaacattaatattagcaccgacacgcgtggtagcagcagaaatggaagaagctctaaagggactgccaattagatatcaaacaacagctacaaagagtgaacacacggggcgtgagattgtagaccttatgtgtcatgcaacattcactatgcgattattaagtccagtgcgtgttccgaactataatttaataatcatggatgaagctcatttcacagatccagcctctatagcagccaggggctatattagtacccgagtcggaatgggagaagcggccgctatattcatgaccgctaccccaccaggtacagcggacgcattccctcaatccaacgcccccatacaagacgaagaacgtgatatacctgaacgaagttggaactcaggaaatgaatggataacagattttgctgggaagaccgtatggttcgtaccaagcatcaaagcaggaaatgacatagccaactgtctgaggaagaacggtaagaaagtaatacaattaagcagaaaaacatttgataccgagtaccagaaaacaaagttaaatgattgggattttgtggttacaacggatataagtgaaatgggagcgaattttaaagccgatagagtaattgaccctaggaggtgccttaagcctgttattcttacagacggaccggagagggttatacttgcaggccccatgccagttacagcggcaagcgctgcacaaagaagaggtcgtgtaggtcgtaatccccaaaaagaaaacgatcagtatatctttacaggtcaacccttgaacaacgacgaggatcatgctcattggacggaggctaagatgttacttgacaatatcaacactcccgaaggaattataccggcactgttcgaaccagaaagagagaaatcggcagcgatagatggcgaatacagattaaaaggtgaaagccggaaaacatttgtagaactcatgcgtagaggagacttgcccgtttggctagcacataaagtggcgagcgaaggaataaaatataccgatcgtaaatggtgtttcgacggacaacgaaataaccaaatccttgaggaaaacatggacgtcgagatatggactaaagagggagagaagaagaaacttaggccaagatggttagatgcaaggacatattcagaccccttagcactgaaggaatttaaggattttgcagcaggtagaaaaagcattgctctggatttagtcacagagatagggcgtgttcctagccacctggcacaccgtacaagaaacgctctggataatttagttatgttacacacctcagaacatggtgggagagcctatagacatgcagtcgaagagttacccgagacaatggaaacgcttttgttactaggcctgatgatactgttaacaggaggtgccatgttatttctcatcagtggcaaaggcataggaaaaacaagtattggtcttatctgtgttatagccagttcaggtatgttatggatggcggagatacctttacagtggatagcgagcgcaatagtgctagagttctttatgatggtactgttaattcccgaacctgaaaaacagcgcacaccgcaagataatcaacttgcatatgtcgtcataggcatattaacattagcggctattatagccgccaatgaaatgggtctcttagaaacaacaaagcgtgatttaggaatgtctaaagaaccaggtgttgtttccccgacttcgtatctcgacgtagatcttcacccagccagtgcatggaccctctacgctgttgctacaacagtaattactccaatgctacgtcatacgattgaaaattctacggcaaacgtatcacttgcagcgattgcaaatcaagctgtcgttctaatgggattagataaaggttggccaatatcgaaaatggacttaggtgtaccattgcttgcgttggggtgttactcgcaagtaaatcctctgacgttaactgctgcggttctactcctcattacccattacgctatcataggtcctggactccaagccaaggcaacaagagaagcccaaaagcgtactgcagctggaatcatgaaaaaccccactgtggatggaataatgacaatcgatctggatccggtaatttacgactcaaaatttgaaaaacaattaggacaagtcatgttgttggtactatgtgccgtgcaactattgttgatgcggacgagctgggctctatgtgaggctttgaccctcgcgacaggaccaataactactctctgggaagggagtcctggaaaattttggaatacaacgatagcagtctcaatggccaatatatttcgcggcagttatctagcgggtgcaggtttggcgttctccattatgaaatctgtggggacaggcaaaagaggaaccggatcccagggtgaaaccttaggtgagaaatggaagaagaaattaaatcaattaagcaggaaagagtttgatctttacaagaaaagcgggattacagaagttgaccgaacagaagcgaaagaaggactaaagcgcggcgaaacaacccatcatgccgtgagcagaggtagcgccaaactgcagtggttcgtagagagaaatatggtgatacctgaaggacgcgtaatagatcttggctgcggaagagggggatggtcttactattgtgctggacttaagaaagttacagaagtccgggggtatacaaagggaggccctggtcatgaagaacctgttccaatgtctacctatggatggaacatagtcaaattgatgagtggtaaagatgtattttatctaccaccagagaaatgcgatactttactgtgtgacataggagaaagctctccaagtccgacggtagaagaatccagaacgataagagtattgaaaatggtcgaaccatggctcaaaaataatcaattttgtataaaagttttgaacccgtatatgccgacagttatagagcatcttgagcgtctccagcgaaaacacggtggcatgttagtaaggaatcctctaagcaggaacagcactcacgaaatgtactggatttcaaatggcactggtaatatagtagcatctgtaaatatggtaagtaggttgttgttaaaccggtttacaatgactcatagaaggccgacaatcgaaaaagatgtagatttgggagcaggaacacgtcatgttaatgctgaacccgaaacgcctaatatggatgtcatcggcgaacggataaaaagaataaaggaagaacataatagtacatggcattatgacgatgagaacccatacaaaacgtgggcttaccacgggtcatatgaagttaaagcgacaggcagcgccagctctatgattaacggtgtagtgaagttattgactaagccatgggatgtcgtaccaatggtgacacaaatggcgatgactgatacaacaccgtttgggcaacaaagagtatttaaagaaaaagtcgacactcgaacgccacgatcaatgccgggtacgcgacgtgtcatgggcataacagcagaatggctttggcgaacactaggacgcaataaaaagccaagactgtgtaccagagaagaatttactaagaaagtaagaacaaatgcagctatgggagcggtgttcactgaggagaaccagtgggattcggcaaaagcagcagtggaggatgaagacttctggaaattagtagatcgtgagagggagttgcacaaacttggaaaatgcggttcctgtgtatacaacatgatgggaaagagagagaagaaactcggagagttcggtaaggcaaaagggtcacgtgctatctggtatatgtggcttggagcccgatatcttgaatttgaagctctaggtttcttaaacgaggatcattggtttagcagagaaaattcatatagtggtgtagagggagagggcctccataaattaggctacattttaagggatatcagtaaaataccgggaggtgctatgtatgctgatgataccgcaggctgggatactagaataacagaagatgacttacacaatgaagagaaaattacccagcaaatggacccagaacatcgacaattagcaaatgccatatttaagctgacgtatcaaaacaaagtagtaaaagtacagagacctacccccacaggtacagtaatggatataatttcaaggaaagatcagagggggagtggacaagtagggacatacgggttaaatacgttcaccaatatggaagcacaattgattagacagatggaaggtgagggggttttatcaaaagctgaccttgaaaatcctcaccttcccgagaagaaaataactcaatggttagaaaccaaaggtgttgaaaggctgaaaaggatggcgataagtggagatgattgcgtcgttaaaccaatcgatgatagatttgcgaacgctctcctcgcactcaatgatatggggaaggtcagaaaagacataccacaatggcaaccaagtaaggggtggcatgattggcaacaagtgccgttttgttctcatcatttccacgaactcattatgaaggacggtcgcaagctcgtagtaccgtgccgacctcaagatgaattgattggtagagccaggataagtcagggtgcaggatggagtttaagggaaacagcctgtctaggaaaagcatatgctcaaatgtggtcattaatgtacttccaccgcagagatctaaggctagccagcaatgctatttgtagtgcagttccagtgcattgggttccaacatcaaggactacgtggagtatacacgcacatcatcaatggatgacaacagaggatatgctcactgtttggaatagagtttggatagaggataacccctggatggaagataagacacctgtgacgacgtgggaaaacgtcccatatttaggaaaaagagaagatcagtggtgtggttccctaattggcctaacgtctcgagcaacttgggctcagaacatacctacagctatccaacaagttagaagtttaattggtaatgaagagtttttagactatatgccatcgatgaagagatttagaaaggaagaggaaagtgagggagctatatggtga

SEQ ID NO: 23094 - RNA, 9873 nt, synthetic construct
  misc_feature 1..9873: note = derived and/or modified CDS sequence (opt6) from DENV-3__JQ922556__SS-prME
  source 1..9873: mol_type = other RNA
acttcattatgccttatgatgattctacccgcagcactcgcatttcatcttaccagtagggatggagaaccacgtatgattgttggcaaaaatgaacgaggtaaatcgttactatttaaaaccgcgtcgggaattaatatgtgcactctaatagcgatggatttaggagaaatgtgcgacgatacagtgacgtataaatgtcctcatattaccgaagtagagcctgaggatatcgactgttggtgcaatttaacatcgacatgggtcacctatgggacatgtaaccaagcaggagaacatcgacgtgacaaaagatcagttgcactagcacctcacgtaggtatgggtttagacacaaggactcaaacatggatgtcagctgagggtgcttggaggcaagtggaaaaagtagagacttgggcactccgtcatccgggattcactattctagcgctttttcttgcacattatatcgggacttccttaacgcaaaaagtagtcatctttattttattaatgttagttacaccatcaatgaccatgagatgtgtaggagtcggtaaccgggattttgtcgaaggattatctggagctacatgggttgatgtagttctagaacacggagggtgcgtaacaaccatggccaaaaataaaccaacattagacattgaattacagaaaacggaggcaacgcaacttgctacactcagaaaattatgtatagaaggaaaaataacgaatataactaccgacagccgatgtccaacacaaggcgaagcagtactacctgaagaacaagatcaaaattatgtgtgtaaacacacatatgttgatagaggctgggggaatggatgcggcttattcggcaaaggatctttggtcacttgtgctaaattccaatgtctagaacctatagaaggaaaagtagtccaatatgagaacttaaaatatactgtaattataactgtccataccggtgatcaacatcaagttggtaacgaaacgcaaggcgttactgcggagataactccacaggcttcaacaaccgaagccattttacccgagtatgggacactaggactagaatgttccccacgaacaggtcttgactttaacgaaatgatcctccttaccatgaaaaacaaagcatggatggtacacagacaatggttctttgacctaccactcccttggaccagtggtgccactacagaaactccgacatggaacagaaaagaacttttggttacgttcaaaaacgctcacgctaagaaacaagaggttgttgtattagggtcgcaagaaggtgccatgcataccgcattaacgggagcaactgaaatccaaaacagtggaggtacatcaatatttgcaggccatttaaaatgtagactaaaaatggacaaacttgaattaaaaggaatgtcctacgcaatgtgcacaaacactttcgtcctaaagaaagaggtaagtgaaacccaacacggcacaatcctaatcaaagtagaatacaaaggagaagacgcgccttgtaaaataccgtttagtactgaagacggtcagggaaaagcacacaacggtcgtttaatcacagcaaatccagtagtcactaagaaagaagaaccggtgaatatagaagcagagcccccttttggtgaatccaatatagttattggaataggcgataatgcacttaaaataaattggtacaagaaaggaagctccataggaaagatgttcgaagcaccggcaagaggggctagacgaatggcaatattaggcgatactgcatgggtgtttggatcggtgggcggtgttcttaactctctaggtaaaatggtccatcagatatttgggagtgcttacacagccttattctccggagtatcatgggttatgaaaatagggatcggcgtcctcttaacatggatcggattaaacagcaaaaatacgagtatgagcttcagctgtatagcgattgggatcattactctgtatctaggagcagttgtgcaagctgacatgggttgtgtcataaattggaaagggaaagaacttaaatgcggaagtgggatatttgtaacaaacgaagtccatacttggactgaacaatacaagtttcaagccgactcccccaagagactcgcgactgcgattgctggcgcatgggaaaatggcgtttgcgggatcagatcaacaacacgaatggaaaacctattatggaaacagatagcgaatgaattgaactatatattatgggaaaataatatcaaattaaccgtcgtcgttggtgatacaattggggtattagaacaggggaaaaggactttaacaccacagccaatggagctgaaatactcatggaaaacttggggtaaagcgaaaatagtaacggcagagacacaaaatagttcctttataatagacggaccaagtacccctgaatgtccgtccgcaagtcgtgcatggaatgtttgggaagtagaggattatgggtttggagtgtttacaacaaacatatggcttaaattacgggaagtatatacccagatgtgtgatcatcgattaatgagtccggcagtaaaagacgagagagcagttcatgctgatatgggatactggattgaaagtcagaaaaatgggagttggaaactcgagaaagcctcgttaatcgaggtaaaaacctgtacttggcccaagtcgcacacgttatggagtaacggcgtattagaaagtgatatgataatccctaagagcctggctggcccgatttcgcaacataattacagaccgggatatcatacgcagacagccggaccctggcatctcggaaaactcgaactagatttcaactattgtgaagggacaactgtggttatcactgaaaactgcggtacaagaggtccttccctacgaacgacaaccgtctcaggtaagctgatacatgaatggtgttgtagaagctgcactcttccacccctccggtatatgggcgaggatgggtgctggtatggtatggagattcgacccatatctgagaaagaagaaaacatggtgaaatctcttgtatctgccggtagtggaaaggtcgataacttcaccatgggcgtattgtgcctagcaatcctcttcgaggaagtcatgaggggcaagtttggcaagaaacatatgatagccggtgtattctttacattcgttcttttattaagtgggcaaatcacctggagagatatggcacacacactaataatgatcggttctaatgcatcggatagaatgggtatgggtgttacgtacctagcgttaatagcaacctttaaaatacaacccttcttagcgctaggattcttcttaagaaagctaacaagtagagaaaatttgctattaggagtaggtttagcaatggctactacacttcaactcccggaggatattgaacagatggcaaacggaattgccttagggttaatggcgtttaaattgatcacacaatttgaaacttatcaactatggactgcacttataagtctcacttgctcgaacacgatatttacgctaacagttgcatggagaacagctaccctcattctcgcgggagtcagtttactacctgtctgtcaatcaagtagtatgagaaaaactgattggttaccgatgaccgtagcagccatgggggtaccgcctctaccattatttatattcagcctaaaagatacactaaaaagaagatcatggcctttaaacgagggagttatggcagtcggactcgttagtatacttgcttcatcactattgcgtaatgatgtacctatggcaggacctttggtggcaggaggattattaattgcctgctatgtaggaacagggaccagtgcagacttgactgtggaacaggcagcggatgtaacttgggaggaagaagccgaacaaactggcgtgtcacataatctaatgataacagtagatgatgatgggaccatgagaatcaaggacgatgagaccgaaaacatactgaccgttcttcttaaaactgcgttattgatagtcagtgggattttcccatacagtattccagcaacgttattggtttggcatacctggcaaaaacaaacacagcgctccggcgtcctatgggatgtaccgtctccgcccgaaacgcaaaaagcagagcttgaggaaggggtttacagaataaaacaacaagggatactaggaaagacacaggtaggagtaggcgtgcaaaaagaaggagtatttcatacaatgtggcatgttaccagaggggcagtcctaacacataatggaaaaagattagaacccaactgggcaagcgtgaaaaaggaccttatttcctacgggggaggatggaggctgtcaccacaatggcaaaagggagaagaagtacaagtaattaccgtagaacccggaaagaatccaaagaactttcaaacgatgccgggtacttttcaaacaacaactggtgaaataggtgcaattgcacttgactttaaaccaggcacctctggatcaccaattataaacagagaaggaaaggttgtaggattatatggcaatggtgtagtaacaaagaatggtggttacgtctcgggaattgctcaaactaatgctgaacccgatggtcctacaccggagttggaagaagaaatgttcaagaagaggaatcttacaataatggatctacatcctggaagtggaaaaaccaggaaatacttaccagcaatagtcagagaagcaattaacagacgacttcgaaccttaatcctcgctccaacgcgcgttgtggcagctgagatggaagaagcattaaaaggattgccaatcagataccagacaacagcaacaaagtctgaacatacagggcgtgaaatagtagacttgatgtgtcatgcaacattcaccatgagattgctatctcccgtcagagttcccaactataatctcataataatggacgaagctcacttcacagacccagcctcaatagctgcgcgaggttatatatcaacgcgagttggtatgggagaggcggctgctattttcatgaccgcgactccaccggggacagctgacgctttcccgcaaagcaatgcgccgatacaagatgaagaaagagacattcctgagaggagttggaactccggcaatgaatggataaccgattttgcaggtaaaactgtatggttcgtcccttcaataaaggccggaaacgacatcgccaattgcctacgtaaaaatggaaagaaagtaattcaactctcgagaaaaacattcgaaacagagtaccagaaaactaaattaaacgattgggattttgttggaacgaccgatatatcagaaatgggtgccaatttcaaagccgatagagtaatcgatccgcgccgatgtcttaagccagggattcttactgacggacccgagggagtaatattagcaggtcctatgccagtaacagccgcatcagcggcacaaagacgtgggagagtgggacggaacccccaaaaagagaatgatcaatatatcttcacaggccaacctctgaacaacgatgaggatcacgcccactggaccgaagcgaaaatgcttttagataatattaacaccccagaaggcataatacccgccctttttgaacctgaaagagagaagtccgctgctattgatggagagtataggcttaaaggggaaagtagaaagacttttgtcgaattaatgcgacgtggagatcttcctgtctggctagcacataaagtagcaagtgaaggtattaaatacacggatagaaaatggtgctttgatggacaaagaaacaatcagattttagaggaaaacatggatgtggaaatatggacaaaagaaggagagaaaattaaattgagaccgcgctggttagatgcaagaacatattcggatccgttagccttaaaggagttcaaggactttgcagcaggtagaaaaagcatagctctagatcttgtaacggaaattggaagagtgccctcccatctggctcaccggacgaggaacgctctagacaatcttgtcatgttgcataccagcgaacatggtggtcgtgcctatcgccacgcagtagaggaacttcccgaaacgatggaaacactccttctcctaggtttaatgatactgttaactggcggtgctatgctatttcttatatccggaaaaggaattggcaaaacatcaataggtctaatctgcgtcatagcttcctctggcatgctttggatggcagaaattcccctacaatggatagcctcagcaatcgttttagagttctttatgatggtcttattaataccggagcctgaaaaacaaagaacacctcaggataatcaacttgcgtatgtagttataggaatactaacactggctgccattattgctgccaatgaaatgggcttattagaaaccactaaaagagatctaggggtttcgaaagagccgggagtagtttcaccgacttcataccttgacgttgacttacaccctgcctctgcatggacattatacgccgtggcgactacagttatcacgccgatgctacgtcatacaattgaaaattcaacagcgaacgtatcactagccgcgatcgccaatcaggcagtcgtattaatggggctcgacaagggatggccgatttcaaaaatggatctgggagttccactactagcactcggttgctactcacaagtgaatcctttaaccctaacagcagctgtgttattactaataacacattacgccatcatcgggcctggactacaagcaaaagccacgagagaagcgcagaaacggactgcagctggaattatgaaaaatccaacagtggacggaataataacgattgacttagaccctgttatttatgacagtaaattcgagaagcagctcgggcaagtaatgttgctggtcctatgtgcagttcaacttcttttaatgagaacaagttgggccctttgcgaagcacttacgctagcgaccggtcccataaccacattgtgggaaggatcgcctggaaaattttggaatacaactattgcggtttctatggcaaacattttcagaggctcatacttagcaggagcgggattggctttttcaatcatgaaaagcgtaggcacaggaaaaagaggaacaggttctcagggcgaaaccctcggcgagaagtggaagaagaaactcaatcaactatcacgaaaagagttcgacttatataagaaaagtggcataacagaagttgacaggactgaagcaaaggaaggtctaaaaagaggcgaactaacccatcacgctgtaagtagaggttcggctaaactacaatggtttgtagaacgcaatatggtgattcctgaaggaagagtaattgatctaggatgcggccgaggtggttggagttactactgcgctgggctcaagaaggtaacggaagttaggggttatacgaagggtggaccgggccacgaagaaccagtcccaatgagcacttacggatggaatatagtcaagctaatgagtggaaaagacgtattttacttgcctccagaaaagtgtgacacactactatgtgacataggggaaagcagtccgagtccaactgttgaggagtcaagaaccatccgagtacttaagatggttgaaccatggctgaagaataatcagttctgcataaaagtactaaacccttacatgccagcggttatagaacacttagaacgcctacaacgaaagcacggtggcatgcttgtaagaaatcctctctccagaaatagcacacatgaaatgtactggatttccaatggaactgggaatattgtttccagtgttaacatggtaagtcgtttattactcaatcgatttacgatgacacacaggagacccacaattgaaaaggatgtcgacttaggtgcaggcactcgacacgtcaatgcagagccggagacaccgaatatggatgtcattggagaaagaataaaaagaataaaagaagaacacaatagcacctggcattatgatgacgaaaatccttataaaacatgggcttatcacggcagctatgaggtaaaagcaacaggaagtgggtcaagcatgataaacggtgtggtaaagttgttaacaaagccttgggatgtagtaccgatggtaacccaaatggccatgactgacacaacacccttcggtcaacaaagggttttcaaggaaaaagtagacacgagaacgcccagaccgatgccaggcacgagaaaagtgatggaaataacagcagaatggctctggcgaactttaggaagaaacaaacgcccccgattatgcacccgtgaagagttcacgaagaaagttcgaaccaatgcggccatgggagcggtgttcactgaagaaaatcaatgggattctgccaaagcagcagtggaggacgaagaattttggaagctagttgatcgagagagagagctacataagctgggcaaatgtgggagttgtgtatacaatatgatgggcggaagagaaaagaaactaggagaatttggaaaagctaagggaagtcgcgcgatatggtacatgtggcttggagcacgatatctcgagtttgaagcattaggattcttaaatgaagatcactggtttagccgcgaaaattcgtacagcggagtagaaggagagggcctacataaattaggttatatattgcgagacatctcaaaaataccagggggagcgatgtatgccgatgatacagcagggtgggacacacgtattactgaagacgatctgcacaacgaagagaagattacgcaacaaatggatcccgaacatagattactggcgaacgccatatttaaacttacctaccagaataaggtagttaaagtacaaaggcctacacctacggggacagtaatggatattatctctagaaaagaccagagaggaagtggacaggtcggcacttatggcctcaacacattcacaaacatggaagctcaattagtcagacaaatggaaggagagggagttctttcgaaagcagatcttgaaaacccacatcttccagagaagaaaataacccaatggttggaaactaaaggagtcgaaagattaaaacgcatggctatctcaggagacgattgtgtggtgaaacctatcgacgatagatttgctaacgccctattagccctaaatgatatgggaaaagtgaggaaagacataccacagtggcagcctagcaaaggatggcatgactggcaacaagtgccattttgtagtcatcactttcatgaactcattatgaaagacggtcgaaaactcgttgtgccgtgtagaccacaggacgaattaattggccgagccagaatatcacagggggctggatggagtcttcgtgagacagcgtgtcttggaaaagcgtatgcgcaaatgtggtcactaatgtactttcacaggcgagacttaagattggcaagtaacgcgatatgttctgcagtgcccgtacactgggtgacaacttcaagaacgacctggtcgatacacgcgcatcaccaatggatgactacggaggacatgcttactgtatggaatcgcgtttggatcgaagacaatccctggatggaagacaagacacctgttaccacctgggaaaacgttccatatctaggaaagcgggaagaccagtggtgcggatccttaattgggttaaccagtagggcgacttgggcacagaacattccgactgctattcaacaagtaaggagcttaataggtaatgaagaatttttggactacatgccaagcatgaaaagattcagaaaggaagaagaatcagaaggcgccatttggtaa

SEQ ID NO: 23095 - RNA, 9873 nt, synthetic construct
  misc_feature 1..9873: note = derived and/or modified CDS sequence (opt6) from DENV-3__JQ922557__SS-prME
  source 1..9873: mol_type = other RNA
accagcttatgtttaatgatgattctacccgctgcattagcttttcatcttacaagccgtgatggagaaccaaggatgatagttggcaaaaatgaacgtggaaaatcattgctatttaaaaccgcatcaggtattaacatgtgcaccttaatagcaatggatttaggtgaaatgtgtgacgacactgtaacatataaatgtccacatatcacagaagtcgaacctgaagatatagattgttggtgcaacttaacaagtacatgggtaacgtacggaacttgcaaccaagcaggagaacacagacgagataaaagaagcgtagcgttagcgccacatgtaggcatgggattagacacacgtacacaaacctggatgagtgccgaaggtgcttggagacaagtggaaaaagtggaaacttgggcacttcggcaccctggattcaccattttagctttatttctcgctcattacattggaacatccttaacacaaaaagttgtaatatttatcctcctgatgcttgtgacgccatcaatgaccatgcgttgcgtcggcgtaggcaacagagactttgttgaacggttgtccggagctacttgggtggatgtcgtactagaacatggcggatgcgtaacaaccatggccaaaaacaaaccaactcttgacattgaattacagaaaactgaagccactcaactagcgacgcttaggaaactctgtatagaaggaaaaataaccaacattacaacagatagtcgatgcccgactcagggggaagctgttctacccgaggagcaagatcaaaactatgtgtgtaaacacacttatgttgaccgtgggtggggtaatggatgcggactatttggaaaaggttctttagttacttgtgcgaaatttcaatgcctagaacctatagaagggaaggtagtacaatatgaaaacctaaaatacacagttataataacagtacacactggagatcaacaccaagtaggtaacgagacacaaggagttacagcagaaataacaccacaagctagtacgaccgaagctatcctccccgaatacgggacactaggcctggagtgttctcctcgaacgggattagattttaatgagatgatacttctcaccatgaaaaacaaagcgtggatggtccacagacaatggttcttcgatttgcccctaccttggacaagtggtgctactacagagacgcctacgtggaatcgaaaggaattgctagtcacgttcaaaaacgcgcacgcgaagaaacaagaggtagtcgttctaggatctcaagagggtgcgatgcataccgcgcttacaggcgccacagaaatacaaaatagcggaggaactagcattttcgctggacatttaaaatgccgtctaaaaatggataaactagagttgaaagggatgagttacgcaatgtgtacgaacacgtttgtactcaagaaagaagtcagtgaaacccagcatggaacaattttaattaaagtagagtacaaaggtgaagacgcaccctgtaaaatccctttctctacagaggatggacaagggaaagctcataatgggcgtcttataactgcaaacccggtggttaccaaaaaggaggaaccggttaatatcgaagcagaaccaccatttggggaaagtaacatagtgatcggaatcggagataatgcgttaaaaattaattggtataagaaaggatcttctataggtaaaatgtttgaggctacagccagaggcgcaagacgtatggcaatactcggtgacacagcatgggacttcggatcagttggcggcgttcttaacagtttgggaaagatggtacaccaaatttttggaagcgcctacactgctcttttctctggggtgagctgggtcatgaagataggaataggtgtacttctgacctggatcgggttaaattcgaaaaacactagcatgtcattctcttgtattgcaatagggattatcacgttgtatttgggtgctgtagtacaagcagacatgggatgcgttataaattggaaaggcaaggaactaaaatgcggaagtggaatatttgtcacaaatgaagtgcatacttggacagagcaatataaattccaagcagacagtccaaaacgtctagctacagcaatagctggagcttgggaaaacggagtttgtggtatacgtagcacaacccgaatggaaaacctattatggaagcaaattgcaaacgaactaaattacattttatgggaaaataatattaagttgaccgtggttgtaggcgacaccataggcgtgttagaacagggtaagcggacactcacccctcaacctatggaattaaaatacagctggaaaacctgggggaaagcgaaaatagtgactgctgagacacaaaacagttcatttatcattgatggccccaacacgcctgaatgcccatcagcttcccgagcttggaatgtctgggaagtagaagattatggcttcggggtttttaccactaatatttggctgaagctgagggaagtctatacgcaaatgtgtgaccatcgacttatgtcagcagctgtaaaagatgagagagcggtgcatgctgatatgggatactggatagaaagtcagaaaaatggatcgtggaaattagaaaaggcttcgctaatagaagtaaagacttgtacatggccaaaaagtcatacactctggagcaatggagtgcttgaatcagacatgattataccaaaatctttggcgggaccaatatcccaacataactaccgacctggttatcatacacagacggctggcccatggcacctaggaaaattagagctagatttcaactattgcgaaggtactacagtagtcattactgagaactgtggtacaagaggaccaagtctacgaactaccacggtgtcaggaaaattaattcatgaatggtgttgcaggagctgtacacttccacctctaagatacatgggcgaagacgggtgttggtatggaatggaaataagacccatcagcgagaaggaggaaaatatggttaaatccttagtgagcgcaggtaaatcaaaacgagataacagcacaatgggagtcttatgccttgctattttattcgaagaagttatgaggggcaaatttgggaagaaacacatgattgcaggagtattctttacgtttgtgttattattatcaggccaaatcacatggagagatatggctcacacgctcatcatgataggaagtaacgcgagtgatcgcatgggcatgggcgttacgtacttagcgctaattgctacgtttaaaatacaacccttcctagcgttaggattctttttaagaaaacttacatcacgtgaaaatttaatgttgggggttggactcgccatggccaccacactccagttaccagaagatatcgaacaaatggcgaatggtattgctctcggtttaatggcgcttaaactaataacccaatttgaaacttatcaactttggaccgcattaatatcattaacctgtagcaacacaatattcacgctaacggtcgcctggagaacagcaactttaattcttgctggtgtcagtttactaccggtatgtcagagttcatctatgaggaaaacagattggttgcccatgaccgtagcagcgatgggcgtccctcctttacctttattcatttttagtctaaaagacacgcttaaaaggcggtcttggcccttgaatgagggtgttatggcagtgggactggttagtatcctggcaagctccttacttaggaatgacgtaccaatggcgggaccattggtcgcaggaggtttacttatagcttgctatgtaataacaggcacttcagcagacttaaccgtagaaaaggcggctgacgtcacatgggaagaagaagccgagcaaaccggcgtgagccacaatctcctcataacagtagatgacaacggcacaatgagaattaaagacgatgagaccgaaataatactaacggtattattgaaaacggcattacagattgtcagtggaatctttccctatagtataccagcgaccttactggtttggcacacatggcaaaagcaaacacagagaagcggtgtcttatgggatgtaccatcacctccagagacccagaaggcagaactcgaagagggtgtttataggataaaacaacaagggatactaggaaagacacaggtaggggtaggagtacaaaaagaaggagtgttccacactatgtggcacgtaacccgaggagcagtactaacacataacgggaaacgattagaacctaactgggcttcagtcaagaaagatctcatatcatacggaggtgggtggagactgtcagcacaatggcagaaaggcgaggaggtacaggttattgctgtagagcctggcaaaaacccgaaaaactttcaaacaatgccagggacattccaaacaacaacaggggagataggagcaatcgcattggacttcaagccaggaacaagtggctcacccataataaatcgagaagggaaagtcgttggactttatggaaacggagtcgtgactaaaaacggtgattacttatctggtatagctcagacaaatgccgagccatatggaccaagtcccgatctggaagaagaaatgttcaagaaacgcaaacttactattatggacctgcatccgggttccggacaaactttaaaatacctaccggctattgtacgtgatgctataaaaaggagactaagaatattaattctagcaccaactagggtagtagcagcagagatggaggaggccttaaagggacttcccataagatatcaaactactgcaacgaaatctgaacacaccggtagggaaattgtcgatttaatgtgtcatgccacgttcacaatgcgcttattatctccggttcgtgttccaaactacaatctcataattatggacgaagctcatttcactgacccagccagtatagcagcaaggggatatataagcacgcgggtggggatgggcgaagcagcagctatattcatgacagcaacacccccaggtacagccgatgcatttcctcaatcaaatgcgcctatccaagatgcagagcgtgacataccggagaggtcatggaatagtggaaatgaatggatcacagatttcgctggaaaaacagtctggtttgtgccttcgataaaagcagggaatgacattgccaactgtttaagaaagaatggtaaaaaggtcatacagttgtcgagaaaaacgtttgaaactgaataccagaagactaagctcaatgattgggattttgtagtcaccactgatataagtgaaatgggtgctaactttaaggctgacagagtaatagacccgcgacgctgtctaaagcccgtcatcttgacggatgggcccaaacgcgtaattctagctgggccgatgcccgatactgcagcaagcgccgcccaacgccgtggacgggttggcaggaatcctcaaaaagagaacgatcaatatatcttcccagggcagcccctaaatactgacgaggatcatgcgcattggccagagacaaaattattgatggatttatttactaccccagagggaatactacctagtcatttcgaccctcacggcgaaaacttccctgagatcagcggagagtatagactaaaaggagaatctagaaaaacattcgtagagttaatgagacgtggggatctacctgtatggttagctcacaaagttgctagtgaaggaataaaatatacagatcgtaaatggtgtttcgatggacaacggaataatcaaattttggaagaaaatatggatgtagagatatggactaaagagggtgagaagaagaaactacgtccaagatggctggatgccagaacgtattctgacccattggctcttaaagaatttaaagattttgctgcaggtagaaagtctattgcacttgatttagtgactgaaatagggcgagtacctagtcacttagcgcaccgtacgcgtaatgcgttagacaacctcgtaatgctacatacgtcagaacacggcggtcgagcgtatcggcacgccgtggaagaactcccagaaactatggagactttattacttctcggtctgatgatactcctaacaggaggtgctatgctatttctaatatcgggtaaaggaataggaaaaactagcattggcctcatctgtgttattgcatccagcggcatgttatggatggctgaaatccctctacaatggatcgcatcagcaatagtgttggagtttttcatgatggtattacttataccagaaccggaaaaacagagaaccccacaagataatcaactagcgtatgttgttattggaatcctaacgttggcagctataatagctgcaaacgaaatgggtttactagaaactacgaaaagagatttaggaatgagcaaagaaccaggcgtagtctcaccaactagctatttggacgttgacagtcatcccgcgagtgcatggactttgtatgcagtggcaactacagtgattactccaatgctgcgacatacgatagaaaattctacagcaaacgtatccctagcggcgatagcaaatcaagcagttgttttaatggggttagataaaggttggccaatttcaaaaatggatctgggggtaccattacttgcgcttggatgttactcgcaggttaatccgctaacactaaccgcagctgtattgctattaataactcactatgcaattattggaccaggcttacaagcaaaagctacacgcgaagcccagaaaagaactgcagcggggataatgaaaaatccaaccgtagatggtattataacaatcgacctagatccagtgatatacgatagcaaatttgaaaaacagttgggacaagttatgttattagtactctgcgcagttcaattgctattaatgcgaacatcatgggcattatgcgaagcacttacacttgctacaggcccaatgacaaccttatgggagggctcacccggtaaaatttggaacacaacaatagccgtatccatggcaaatatttttcggggtagttatcttgccggtgctggactggccttcagcattatgaaatcagtcggcacagggaaaaggggcaccggctcacaaggcgagacgttgggagaaaaatggaaaaagaaacttaatcaattatcacgtaaagaatttgacttatataagaaatcgggtataaccgaagtcgatagaactgaggcaaaagagggacttaaacgaggagaaacaacgcatcatgcggtgagtagggggagtgcgaaactccaatggtttgttgagcgaaatatggtgatacctgaaggaagggtgattgatttaggttgtggaagaggtggctggtcctattattgtgcgggcctcaagaaagtaacagaagtaagaggatatactaaaggtggacctggacatgaagaacccgtaccaatgagcacatatgggtggaatatagtaaagttaatgagtggtaaggatgtattctatctaccaccagaaaaatgtgacacactcttatgcgacataggtgagtcttctccttctcctacagtcgaagaatcaagaacaataagagtgctaaaaatggtagagccctggttaaagaacaatcagttttgcataaaagttctaaatccgtacatgccagcagtaatagagcatcttgaacggttgcaacgaaaacacggaggcatgttagtccgaaatcctctctccagaaatagcactcacgaaatgcattggataagtaatggtaccgggaatatagtaagcagtgtaaacatggtgtctcgtttactcttaaacagatttactatgacacaccgcaggccaactatagagaaggatgttgatctcggtgcaggcacccggcacgttaatgccgagccagaaacaccaaatatggacgtaataggagaacgcatcaaacgcattaaagaggaacacaactcgacgtggcattatgacgatgaaaatccatataaaacatgggcctaccacggatcatacgaggtgaaagctactggaagcgcatcatctatgatcaatggtgtagtaaaattgctcacaaaaccttgggacgttgtacccatggtaacgcagatggccatgactgatactacaccgttcggtcaacaaagggttttcaaagagaaagtagatacacgaacaccaaggccaatgccaggaacacgaaaagttatggagatcacggctgagtggttatggcgtaccctgggccgtaacaagcgaccaagactatgtacaagggaagaatttactaagaaagtgagaactaatgcagcaatgggagccgtattcacagaagagaaccaatgggattcagcaaaagcagcagtagaagacgaagaattttggaaacttgttgatcgtgaaagggaattacacaaacttggtaaatgtggatcctgtgtatataatatgatggggaaaagagagaagaaattaggagaatttgggaaggccaaaggtagtcgtgcaatatggtatatgtggcttggagctagatatctagaatttgaagctcttggatttttaaatgaagaccattggttctctagagaaaattcttattctggcgttgagggagaaggattacataaacttggttatattcttagagacatcagtaaaatacccggaggtgcaatgtacgctgatgataccgcagggtgggacacaaggataactgaagacgacctacacaatgaagaaaagatcacacaacaaatggatcccgaacatagattactagccaacgctatatttaaacttacatatcaaaataaggtggtaaaagtacaacgacccacgcctactggtacagtaatggatatcattagtagaaaagatcaaaggggtagcggacaagttggtacatacggactcaacaccttcactaacatggaagcccaactcgtgagacagatggaaggcgaaggcgtattgagtaaggctgatcttgaaaaccctcacttgcccgaaaagaagattacacaatggcttgaaactaaaggcgtagagaggttaaaaaggatggctattagtggcgacgattgcgtcgttaaaccgatagacgatcgatttgctaatgctttgttagcattgaacgatatgggtaaagttcgaaaagacattcctcaatggcaacctagcaaaggatggcatgattggcaacaagtgccgttttgtagtcatcatttccatgaactaataatgaaggacggtcgaaagttagttgtaccctgtagacctcaagatgaactcataggtagagctcgaatttcacaaggagctgggtggtctttaagggaaacagcttgcttaggcaaagcctacgcgcaaatgtggagtctcatgtacttccacagaagagacctaaggcttgcctcaaatgccatttgtagcgcggttccggtacattgggttccaacttcgagaacaacctggtccatacatgctcaccatcaatggatgacaactgaagatatgttaactgtgtggaatcgggtctggatagaagataatccatggatggaggacaagacacctgtcactacgtgggagaatccaccttatttaggaaaacgtgaggaccagtggtgcggatccattatcgggttatccagtagagctacttgggcgcaaaatatcccaacggcaatacaacaggtaaggtccttaatcggtaacgaagaatttttagattatatgccatcaatgaaaagatttcgtaaagaagaagagtccgagggtgccatttggtag

SEQ ID NO: 23096 - RNA, 9873 nt, synthetic construct
  misc_feature 1..9873: note = derived and/or modified CDS sequence (opt6) from DENV-3__JQ922555__SS-prME
  source 1..9873: mol_type = other RNA
acctccctatgcttaatgatgattctaccagcagcattagcgtttcatctaacctcaagggatggtgaacctagaatgattgttggcaaaaatgaacgtgggaaaagcctcctattcaaaaccgccagcggtattaatatgtgtactctgatagcgatggatttgggcgaaatgtgtgacgacacggtaacatacaaatgccctcatattactgaagttgaaccggaagatatagactgctggtgcaacttaacaagcacatgggttacttacggaacatgtaaccaggcgggagaacacagaagagacaaacgttccgtagcattagcacctcacgtcggaatggggctagatactcgaacccaaacttggatgtcagcagaaggggcttggcggcaagtcgagaaagtagaaacctgggcgttaagacatcccggatttaccatactagcactgtttcttgcacactacataggtacaagtctaactcaaaaagtagttatctttattctattaatgctagtcacgccatcaatgactatgaggtgtgttggagtgggaaaccgagacttcgtggagggtctatcaggagcaacctgggttgacgtagttctcgaacacggaggatgcgttactactatggcgaaaaacaaacccacactagacatagagctgcagaaaaccgaggcaacacagctcgcaacgcttagaaaactctgtatagaaggcaaaataaccaatataacaacagatagccgatgtcccacacagggcgaagcagtgcttcctgaagaacaagaccaaaattatgtgtgtaaacacacatatgtagaccgaggatggggtaacggatgtggattattcggaaaaggcagcctcgttacttgtgcaaaatttcaatgcctagaatccattgagggcaaagtggttcaatatgagaatctgaaatatactgttataatcacagtacatacgggtgaccaacaccaagttggaaacgaaacacagggtgtaacggctgaaatcacaccccaagcatccacagctgaggcaatactcccggaatatggtacattagggttggaatgctcgccaagaacaggcctggatttcaacgaaatgatcttattgacgatgaaaaacaaggcttggatgggacatcgccagatgctctttgatcttcctactccgtggacaagtggaacgacgaccgagactagcgcctggaatcgaaaagagccatttgtaacatttaaaaatgcacacactaagaaacaagaagtagttgtattgggatctcaagaaggagcaatgcataccgccttaacaggggcaactgaaatacaaaatagcggagggacatcgatctttgcaggtcatttaaaatgccgcctcaaaatggacaaactggaacttaaagggatgagttatgcaatgtgtacaaacacattcgtgttaaagaaagaggtatcagaaacgcaacacggtacgattctagtaaaagtagaatataaaggagaagatgcgccatgtaaaataccgttttccactgaggacgggcaagggaaagcacataacggacgactcattactgcaaaccccgtcgtcacgaaaaaggaagaaccagttaacatcgaggctgaaccaccctttggcgaatctaacattgttataggaattggcgacaaagcactaaaaataaactggtacagaaagggttcctcaattggcaaaatgtttgaggccacttccagaggcgcaaggagaatggcgattttgggcgatactgcatgggactttggatctgtgggtggagtactcaattcgctaggaaaaatggtccatcagatattcggatctgcatatactgctttattttccggagtatcatgggtaatgaaaatcggtataggcgtactactaacatggatcggcttgaacagcaaaaatacgagcatgtctttttcatgtatcgctataggaataataacattatacttaggggctgtagttcaagccgatatgggatgcgtaataaattggaaaggtaaggaattaaaatgcggcagtggcatatttgtaacgaatgaggtccatacatggactgaacaatataagttccaggcggactctccaaaaagacttgcaaccgcgattgccggtgcatgggagaatggagtctgtggtattcgatcaactactcggatggaaaaccttctctggaaacaaattgcgaatgaattaaactatattttatgggagaacaatatcaaactcaccgttgtcgtgggcgatacaattggggtattggaacaagggaaaagaacattgacaccccaaccaatggaactaaagtatagttggaaaacctggggaaaagccaaaattgtaaccgcagaaactcaaaattcaagttttataatcgacggtccaaacacaccggaatgtccatccgcaagccgggcgtggaacgtatgggaagtagaagactatggattcggtgttttcacaacaaatatctggctaaaattaagagaggtatatactcagatctgtgatcacagattgatgagcgcggctgttaaggatgaaagagcagtacatgcagacatgggatactggatagaaagccagaaaaatggtagttggaaactagaaaaagcatcgctaatagaggttaaaacaagcacatggcccaaaagccatacactttggtcaaatggagtacaagagagcgatatgattattcccaaatctctagccggacctatttctcagcacaattacagacctgggtatcatacccaaacggcagggccatggcacttgggaaaattggaactcgatttcaattattgcgaagggactacagttgtaataaccgaaaactgcgggactcgaggtccatcattaaggacaacgacagtgagcggaaagttaatccatgaatggtgctgccgaagttgtactttgcctccattgcgttacatgggtgaagatggatgttggtatggaatggagataagacccatctcagaaaaggaagaaaacatggtaaaatcgttagcatctgctggttctgggaaagtcgataatttcacaatgggggtgctgtgtctggctatactcttcgaggaagtcatgcgtggtaaatttggtaagaaacatatgatagccggtgttctctttacatttgtactgctattaagtggacaaataacttggcgagacatggcaagaacgttgataatgatagggagtaatgcatcggatcgcatgggtatgggagtaacctatctagcattgatcgctactttcaaaatccagccgtttcttgcacttggattctttttacgaaaactcacgagtcgcgaaaacttgctgctcggcgttggtctagccatggcaacaacacttcagttgcccgaagatatagaacaaatggccaatggcattgcacttgggctgatggctttaaaactaataacccaatttgagacttaccagctatggacagccttagtgtctttaacttgcagtaatacaatctttaccttgaccgttgcgtggagaacagctacattgatactagcgggcgtaagcctacttccagtatgtcaatcgagttcaatgaggaaaacagattggttaccaatgactgtagccgcgatgggcgtacctcctttgccattgttcatttttagtctgaaagatacactaaaaagacgaagttggcccctaaatgaaggagtcatggctgtcgggctggtgagcattttagctagcagccttcttaggaacggtgttccaatggcgggtccattggtagccggcggtcttctgatagcgtgttatgttattacaggaacttcagctgatctaacagtggaaaaagcagccgatgtaacatgggaggaggaagcggaacagaccggcgtaagtcataatctaatgataacggtagatgacgatggtaccatgcggataaaagacgatgaaaccgagaatatactcacagtattattaaaaacagctctattgatcgtctcagggatatttccatactcaatacccgctacgctccttgtatggcatacctggcaaaagcaaacgcaacgatcaggtgtgttgtgggatgtccctagtccacctgaaacccaaaaggcggaactagaagaaggagtttaccgaattaagcaacaaggaatatttggaaaaacccaagttggtgtaggagtgcaaaaggagggtgttttccataccatgtggcatgttacaagaggagcagttctaacacataatgggaaaaggttggaaccaaattgggctagtgttaaaaaggaccttatttcgtacggcggaggttggaggttatcggcacaatggcaaaaaggagaagaagtgcaggttatcgcggtagaacctgggaagaatccaaagaactttcaaacgatgccgggcacctttcaaacaacatcaggggaaattggggctatcgctttagatttcaaacctggtacctcgggaagtccaattattaaccgagaagggaaggtggtcggcctttacggaaacggagtagtaacaaagaatggcgggtacgtgagcggtatcgcgcaaacaaatgcagaaccagacggcccgacaccggagttagaagaggagatgtttaaaaagagaaatttaacgatcatggatttacatcctggtagtggaaagactcgtaaatacctcccagctatagttagagaagccatcaaaagacgattaagaacactgatactagctccgactcgagtagttgcggcagaaatggaagaggccctaaaaggtttgccaatccgataccaaacgacagctacaaaatcggagcacacagggcgggaaatagtcgatctcatgtgtcatgctacgtttacgatgagactattaagtcctgtgagggtaccaaactacaacttgatcataatggacgaggcacattttacggatcccgcgagcatagccgccagggggtacattagtacacgagtaggtatgggtgaggctgctgctatattcatgacagcgacgccacctggtacagcagacgcatttccgcaaagtaatgcaccgattcaagatgaagaaagagatatacctgagaggagctggaactccggtaacgaatggataacggactttgcaggaaaaactgtttggttcgtcccatcaattaaggctggcaacgatatagccaactgcttgcggaaaaatggcaagaaagtcatacaactatcacgaaagacttttgacaccgagtatcagaaaacaaagctaaacgattgggatttcgtggtaactaccgatatatctgaaatgggggcaaattttaaggctgatagggtaattgatcctagaagatgcttaaagccagtgatattaactgatggtccagaacgagttatactggcagggccaatgcctgtgaccgctgcttccgctgctcaaagaagaggaagagtaggaagaaatccacaaaaggaaaatgatcaatatatttttactggacaaccactgaataacgatgaagaccatgcacactggactgacgctaagatgttattagaaaacattaatactccggaaggaataatcccagccttgtttgagcctgaacgagaaaagagcgcaggactggacggagaatacagattgaaaggagagtcaagaaaaacattcgttgaattaatgcggagaggagacttaccggtatggttggcccacaaggttgcgtccgaaggtatactctacacagatcgtaaatggtgtttcgacggacagcgaaacaaccaaatacttgaagaaaacatggatgttgaaatatggactaaggaaggagagaaaaagaaactgagacccaggtggctagatgcaaggacatattcagacccactagcattgaaagagtttaaagactttgctgcaggtaggaaatctatagcattagacttagtaaccgaaataggacgcgtatcaagtcatttagctcacaggaccagaaatgccctggacaataaaatgatgctacacacttcagaatatggaggaagggcatatagacacgcagtggaggaattaccagagaccatggaaactctacttctactagggctcatgatattgttaactggtggagctatgttgttcctcataagtggtaagggaataggcaagacgtcaattggacttatatgtgtaattgcgtcctcaggcatgttgtggatggcggatgtaccattacagtggatagcctcggcgatagtcttagagtttttcatgatggtgctcctaatcccagaacccgaaaaacaaaggacaccgcaggataatcagttagcttatgttgtaattggcatacttactctagcagcaatcatagctgcaaatgaaatgggattattagagacgacgaaaagagacttaggggtttcaaaagaacccggagtggtgtcacccacatcataccttgatgtcgatctacatcctgccagtgcatggaccttatacgcggtagctacaacagttatcgcgccaatgctacgtcacacaattgagaactcaaccgctaatgtcagtatggctgcaatagctaatcaagcggtcgtattaatgggattagataaaggatggccaataagcaaaatggatttaggagtacccttactagcgcttggatgttatttctatgtaaatcctttaacccttacagcggcagtgtttctccttgtcacccattatgctatcataggtcccgggttgcaagcaaaagctacacgagaagcgcataagaaaacagcggcggggatcatgaatccacccccaggagatggtataatgactatagatttagaccctgtaatctatgactcaaaattcgaaaaacaactaggacaagttatgctattagtattgtgtgcagttcaactattactgatgaggacatcctgggctctttgtgaggcactaacattagcaacaggaccaacgactactttatgggaaggaagcccagggaaattttggaatacaacaattgcagtcagtatggctaacatcttcagaggaagctatttagctggcgcaggattagctttcagtataatgaaatcagttggaaccggcaagcgaggaactggttcacagggcgagacactcggagaaaaatggaagaagaaactaaaccaattgagccgaaaagaatttgacttatataagaaatcaggaataacagaagtggacagaacggaagctaaggaaggtttgaagaggggtgaaattacacaccatgctgtttcaagaggctcagcaaaattacaatggttcgttgaacgaaacatggtgatccccgagggaagagttatcgatttaggctgcgggaaaggtggatggtcatattattgtgctggattgaagaaagttactgaagtaagaggttataccaaaggaggacctggccatgaagaaccagtaccgatgagtacctacggatggaacatagtcaaattaatgtcaggtaaagatgtattttatttaccacctgaaaaatgcgacaccttactttgcgatattggagaatcttccccctcaccaactgtggaagaatcgaggacgatacgtgtattaaagatggtggaaccgtggttgaaaaacaaccaattttgtattaaagtacttaatccctacatgccgactgtcattgagcatctagaacgattgcaaaggaaacatggaggaatgttagtcagaaacccattatcgagaaattccagaaacgaaatgtactggataagtaacggaactggaaacattgtgagcagtgttaatatggtatcaagattattgttaaacagattcacaatgacgcataggcgacccacaatagaaaaggacgttgatttaggagcaggtactaggcatgtaaatgctgaacctgaaactccaaatatggatgtgataggagaaagaataaaacgtataaaagaagaacacaatagtacatggcactacgatgatgaaaatccctacaaaacatgggcgtatcatggctcttatgaagtaaaggcgactggaagtgcaagttcaatgataaatggtgttgtcaaacttttgacaaaaccatgggatgtagtacctatggttacgcagatggcaatgacagatactacgccatttggacagcagagagtgttcaaagagaaagtagacacaaggacgcctcgactcatgccacgaacacggaaagtcatggagataaccgccgagtggctatggcgaacacttggcagaaataagcgacctagactgtgcacgagagaggagttcactaagaaagttaggcctatcgccgccatgggggcggtattcacacaacgagaccagtgggactctgctaaagctgcagtagaagatgaagaattttggaaaccagtcgatcgtgagtgtaacagtcatcaactaggtaagtgtggcagttgtgtatacaatatgatgggaaaaagagaaaagaaactaggtgagttcggaaaagccaaaggttcaagagcaatatggtatatgtggttgggagctcgatatctggaatttgaagcattaggatttttaaatgaggatcactggttcagtagagaaaattcctattccggcgtagaaggtgaaggactgcataaactgggatatatattgcgagatatttccaagattccaggaggagctatgtatgcagatgatacagcagggtgggatactagaaatacggaagatgatcttcatatgaaagaaaagattacgcaacaaatgggaccaggacactcgagattagccaatgcaatttttaaacttacataccaaaataaagtggtaaaggtacagagaccgacaccaacaggaacagtaatggatataatttctcgaaaagatcaacgaggatcaggtcaggtaggtacatatggattaaatacattcacgaatatggaagcacaattggtcaggcagatggaaggagagggagtcctttcaaaagctgacctggagaacccgcatttgttagagaagaaaataacacaatggcttgaaactaaaggagtcgagagattaaaaagaatggcaatatctggcgatgattgtgttgtcaaacctattgatgatagattcgctaacgctttactagctctcaacgatatgggcaaagtcagaaaagatattcctcaatggcaaccttctaaaggatggcacgattggcaacaggtcccgttttgttcgcaccacttccatgagcttattatgaaagacggccggaaattagtagtaccttgcaggccacaagacgaactcataggtagagcccgcatatcacaaggcgccggatggtccctgcgagaaactgcatgtctaggaaaagcatacgcacaaatgtggtcattaatgtattttcacaggcgagacttgcgtttagcttcaaacgcaatatgttccgcggttcccgtacattgggtcccaactagccgtaccacatggagcatacatgctcaccatcagtggatgactacggaagatatgctgaccgtatggaatcgcgtatggatcgaagacaatccatggatggaagataaaaccccagtaaccacatgggagaatgtaccatatctgggaaagagagaggatcagtggtgcggaagtttgatcggactaacaagcagagcaacatgggctcaaaacattccaacagccatacaacaagtaaggtctttaatcggaaatgaagagtttctagattacatgccgtcgatgaaaaggttccggaaggaagaagaaagcgaaggggcgatatggtga

SEQ ID NO: 23097 - RNA, 9873 nt, synthetic construct
  misc_feature 1..9873: note = derived and/or modified CDS sequence (opt6) from DENV-3__GU131903__SS-prME
  source 1..9873: mol_type = other RNA
acgtcactttgtttaatgatgatgctaccagcgactctagcttttcatttaacgtccagagacggtgaaccacggatgatagtaggtaaaaatgaaagaggtaaatccctactgttcaaaacggcatctggtatcaacatgtgtacactaatcgcaatggatttgggtgaaatgtgtgacgacactgtaacgtataaatgtcctcttatcgcggaagtagaaccagaagatatagattgctggtgcaacctaacaagtacttgggttacatatggtacatgtaaccaagcaggagaacatcgaagagacaaaagatctgtagcactagcaccacatgttggaatgggacttgacacgcgcacacaaacgtggatgagtgcggaaggagcatggagacaagttgaaaaagtagaaacctgggcattaagacaccctggatttacgatcttggcattgtttctggcacattatataggcacatcactaacgcaaaaagtcgtaattttcatattactcatgctagttacccccagcatgacaatgcgatgtgttggagtagggaacagagatttcgtcgaagggctaagtggggcaacctgggtagacgttgtccttgagcatggtggatgcgtcacaacaatggctaaaagtaaaccaacattggatattgagctccagaaaactgaggcaactcaacttgccacccttaggaaactgtgcatagaaggtaaaattacaaatatcacaacggactctaggtgtcccacgcaaggagaagcaactttgcccgaagaacaagatcagaactatgtctgtaaacacacttacgtggacaggggatggggaaatggttgtggattatttggaaaaggcagcttagtaacatgcgcgaaatttcaatgtctagagcctattgaaggtaaagtagtacaacacgaaaatcttaaatacactgtaattataacagtacatactggagaccaacaccaagtagggaatgatacgcaaggtgttactgtcgaaataacaccacaagctagcacagtcgaggcagtactaccagagtacggtaccttaggcctagaatgcagcccaagaacaggattggatttcaatgaaatgatactattaacaatgaaaaacaaagcatggatggttcacagacaatggttctttgatctaccgcttccttggacctcaggggcgacaaccgagacaccgacttggaacagaaaagaactcctggtaaccttcaaaaacgcacatgccaagaaacaagaagtagtggtattagggtcccaagaaggagcgatgcacacggcactgacaggtgcgaccgagatccaaaactcaggtggaacatcaatatttgcgggccatttgaaatgtcgcctgaaaatggataaattggaactcaaaggaatgtcgtatgctatgtgtttaaatacgtttgtactgaagaaagaagtatcagaaacacaacatggaaccatcctgatcaaagttgaatataaaggagaagatgcaccatgtaaaattccattcagcacggaagatggtcaaggtaaagcacattctgggcgacttataacagctaacccggtagttacgaagaaagaggaaccagttaacatagaagctgagccgccatttggagagagcaatatagttattggaatcggcgacaaagcattaaaaataaactggtataagaaaggaagttcaattggtaaaatgttcgaagctactgctcgtggagctcgtcgaatggcgattctaggcgatacagcttgggactttggtagcgttggaggagtactaaattcccttgggaaaatggttcaccaaatctttggaagtgcatatacagcattgttctcaggcgttagttggatcatgaaaatcggcattggtgtccttttaacatggataggactcaacagtaaaaacacttctatgtctttctcctgtatagtaattggcataattactctctacctaggcgcagtggtacaagcagatatgggatgcgtaattaattggaaaggaaaagaactcaaatgtggatcaggaatatttgttacgaatgaagttcatacatggacagagcaatacaaatttcaagcagactcacctaaaaggcttgcaactgccatcgctggtgcttgggagaatggagtctgtggtatcaggagcacaacaagaatggagaatctattatggaaacaaatagcgaatgaacttaattatatactgtgggaaaacaatataaaattaacagtagtagtaggcgatataattggagttttggaacaaggtaaacgaactttaactccacaaccgatggaactaaaatatagctggaaaacgtggggaaaagcaaaaattgtgacagctgaaacacagaacagttctttcattattgacgggccgaacacaccagaatgtccgaatgcttccagagcttggaatgtctgggaagtagaagactacggcttcggtgttttcactaccaatatctggctaaaacttagggaagtttatacacaatcttgtgaccatcgactaatgagcgcagcgatcaaagatgaaagggcggtccacgcagacatggggtattggatagaaagtcagaaaaacggctcatggaagttagaaaaagcatcattcatagaagtgaagacgtgcacgtggcctaaatctcatactttatggagtaacggcgtgttagagagtgatatgattatccccaaaagtctagctggtccaatttcacagcataatcatagaccggggtaccatacacaaacagcaggaccatggcatttagggaaacttgagctagactttaattactgtgagggaacaacagtagtcattactgaaaattgtggaacacggggcccctcactcagaacaaccacggtctcgggaaaacttattcatgagtggtgctgcaggtcctgtacccttccacccttaagatacatgggggaagatggatgttggtacggaatggaaatccgccccatcaacgagaaggaagagaacatggtaaaatcattagtcagcgctggctctggaaaggtcgataatttcaccatgggagtgctttgccttgccattttgttcgaagaagtgatgcgtggaaaatttggcaagaaacatatgattgcaggagttctcttcacgtttgttctcttattatctggtcaaataacttggcgagatatggcgcacactctcataatgattggttcaaacgcaagcgatcgaatgggaatgggcgtaacctatcttgcattaatagctactttcaaaatccaaccttttctagcgctcggattctttctacgtaaacttacaagcagagaaaatctactgctgggagtcggtttagctatggcgaccacactacaattaccagaagatattgaacaaatggctaacggaatagcactagggcttatgacattaaaacttattacacaatttgaaacctaccaactctggaccgccctagtatcattaacgtgcagtaacacgatatttacattgacggtggcatggcgcacggccacgttaattctagcaggcgtatctctattacctctatgtcagagttcatctatgcgaaaaacagattggctaccaatgactgttgccgcaatgggagtgcctcctttacctttatttattttctcacttaaggacactccaaagaggaggtcttggcctcttaatgaaggagtaatggccgtcggcttagtatcaattctagccagctcattactcagaaacgatgtgccaatggcgggaccgcttgtagccggaggtcttctaatcgcttgttatgtcatcactgggacaagtgcagatctaaccgttgaaaaagccgcggatgtgacatgggaggaagaggcggaacaaacaggtgtcagtcataatttaatgataacagtagatgacgatggcacgatgcgtatcaaggatgacgaaaccgaaaatatcctaactgtattattaaagactgctttactcattgtgtcaggaatcttcccatacagcatcccagcgaccctacttgtatggcatacctggcaaaaacagactcaacggagtggtgttttgtgggatgtaccgagtccacctgaaactcaaaaagcggaactagaagagggagtgtacagaattaaacaacaaggcatatttggaaagactcaagtaggagtcggtgttcaaaaagagggtgtattccatacaatgtggcatgtcactagaggagccgtgctaactcataatggcaaacgtctcgagccaaactgggcatcagtcaagaaagatctgatcagctatggtggaggctggaggctgaatgcacaatggcagaaaggcgaggaggtccaggtgatagcagtagaaccagggaagaatcccaaaaatttccaaaccatgcccggcatttttcagacaacaacgggtgagatcggagcaattgctctggatttcaaaccaggtacaagcgggagccccattataaatagagaaggcaaagtagtcggactatacggtaacggtgttgttactaaaaacggaggttatgtatctggtatcgctcaaactaacgcagaaccggatggaccgaccccagagttagaggaagagatgtttaagaaacgaaaccttacgataatggatttacatccgggatctgggaagactcgtaaatacctgcccgcaatagtgcgagaagcaataaaaaggagacttaggacattaatactcgctcccaccagagtagtcgccgctgaaatggaagaagcacttaagggattaccaatccgctaccaaacaacagcaacaaagtctgagcatacaggacgagaaattgtcgacttaatgtgtcatgctacgtttactatgcgactcctttcaccggttcgtgtgccaaactataacttagttataatggacgaggctcatttcaccgacccagcgtcaattgcggctaggggttatatttcaacgagggttggcatgggagaagctgcggccatattcatgacagcaacgccaccgggtactgcagaggcttttccacaatctaatgcaccaatacaggatgaagaaagagatataccagaacggtcatggaatagtggaaatgagtggattacagactttgttggtaaaactgtttggtttgtgcccagtattaaggcaggtaatgacatagcgaattgcttaagaaagaatggcaagaaagtgatacagttatcacgtaaaacattcgatactgagtatcaaaagactcgtctaaacgattgggattttgtagtaacaacggacatttccgaaatgggtgctaacttcaaagccgatagggtaatagacccgcgtaggtgtttaaaaccagttatactaactgacggacctgaaagagttattctagccggaccaatgcccgtgaccgcagcgtcggcagcacaacgacgtgggagagtcggccgcaatcctcaaaaagagaatgatcaatatatattcacgggacaaccgttaaataacgacgaggatcatgcacattggaccgaggccaaaatgttattagataacataaacactccagagggcatcatacccgcacttttcgaaccagagagagaaaagtcagccgcaatagacggcgaatatcgcctaaaaggggagtcccgtaagacgttcgtagaattgatgcgaagaggagaccttccagtatggctagcgcataaagtagctagtgaaggaataaaatatacagacaggaagtggtgtttcgacggagaacgaaataatcaaattttagaagaaaacatggacgtagaaatatggactaaggaaggagaaaggaagaaattgcgcccgagatggttagacgcaagaacatatagtgatccattagcactcaaggaatttaaggactttgcagctggccgtaaatctattgctctggacctagttaccgaaattggtagagtaccgtcacacctcgctcatagaacaagaaatgctctggataatttagtcatgctccatacatctgaacatgggggtcgggcgtaccgccacgctgtagaagaattgcctgaaacaatggaaacattgctactgcttggattaatgatacttttaacagggggagcgatgctgtttttgatatcaggtaaaggtataggcaagacaagtataggattaatatgcgtcattgtgtcaagtggtatgttgtggatggcggacgtccctctgcagtggatagcgtcagcaattgtacttgagttctttatgatggtgttgctaattccagaaccagaaaaacaacgaacaccacaggacaatcagctagcgtatgtagtaattggtatattaacattagcggctatcgtagcagctaatgaaatggggctactagaaacaactaaacgggatttaggaatgagcaaagaaccaggagtagttagccctacaagttacttagacgttgacttacaccccgcttcagcatggacactatacgcagtagctaccacagtcattacaccaatgctacgacatactatcgaaaattctaccgctaacgtgtctcttgctgccatcgcaaatcaagcagtcgtccttatgggtttggacaaagggtggccaatctccaaaatggatttaggtgtaccactattagccctaggttgttatagtcaagttaaccctttaactcttacggctgctgtcctgttgctagttacacattacgcaattattgggccaggattacaagctaaagcaactagagaagcccagaaaaggacagcagcgggcataatgaagaacccaacagttgatgggataatgacgatagacctggaccctgtaatttacgattccaaatttgagaaacaattaggccaggtcatgttacttgtactatgcgcagtacaattacttctaatgcgcacatcatgggcactttgtgaagcactcacgttagctacaggccccataaccacactctgggaaggaagtccagggaagttttggaataccacgattgcagtttctatggctaacatatttagagggtcgtacctagcaggagcaggattggctttctcaatcatgaaaagtgttggcactggacgacgtggaactggatcacagggagagactcttggcgaaaaatggaagaagaaattaaaccaattaagccgtaaagagttcgacctgtacaagaagtctggtataactgaagtggaccgaacagaagcgaaagagggtttaaaacgtggcgaaactacgcaccacgcagtgagccgtggtagcgctaaactacaatggtttgtcgaacggaatatggtaataccagaggggagggtcatcgacctcggttgtggacgaggcggatggtcatattattgcgctggattaaagaaagttacagaagttagaggatatactaaagcagggccagggcacgaggaacctgtgcccatgtcaacttacggttggaatattgtgaaattgatgtcgggaaaagacgtattttacctacctccagaaaaatgtgacacactactatgcgacattggagaatcatctccatcgcctaccgtagaagaaagtagaacgataagagtattaaaaatggttgaaccgtggctgagaaacaatcaattttgtataaaagtcttgaacccatatatggctactgggatagagcatttagaaagattgcagcggaaatacggaggaatgctcgtgcgaaacccattaagccgtaactcgactcatgaaatggattggataagcaatgggacgggaaatatagtaagttctgttaatatggtatctagactcttattaaatcgcttcacaatgacacatagacgcccaaccatagaaaaagatgtagacctaggcgcaggcacacgacatgttaatgctgaacctgaaacacctaatatggacgtaataggagaacgaattaaacgaatcaaggaagaacattcatcgacatggcattatgacgatgaaaacccctacaaaacttgggcttatcatggctcatatgaagttaaggcaacgggttcagcaagctcaatgataaacggggtagttaaattactcacgaaaccttgggacgttgtacctatggtcacacagatggctatgactgacacaacacctttcgggcagcagagggtattcaaagaaaaagttgacaccaggactccccgaccaatgccaggtacgagaaaagtcatggaaattaccgccgaatggttgtggcggaccttgggaagaaataagaaacctagactatgtacacgagaggagttcactaaaaaggttcgaacgaatgcagcaatgggagcagtttttacagaagagaatcaatgggactcagcccgagcggcggtagaggatgaggagttttggaaattggtagatcgagagagagagctacataaactaggaaaatgtggttcttgcgtttataatatgatggggaagagggagaagaaactaggcgagtttggaaaagccaaaggaagccgggcaatatggtacatgtggttgggggctcggtatctcgaatttgaggctcttggatttttaaatgaagatcattggttttcacgagaaaattcatattcgggtgttgaaggcgaaggcttacataagctggggtatattcttcgtgacataagtaagatacctggaggagcaatgtacgccgatgacacagcgggttgggacactaggattacagaggatgacttacataacgaagagaaaataacacaacagatggaccctgagcatcgtcaactagctaacgccatttttaagttaacataccaaaataaagtggtgaaagtacaacgaccgactccgaaaggaacagtaatggatataataagcagaaaagaccagagagggtccggacaagtaggaacctacggcttaaacacatttacgaacatggaagcgcagttagtaagacaaatggaaggcgaaggagttctaagcaaagctgaccttgaaaatccccacctattagagaagaaaattacacagtggctagaaacaaaaggagttgaaaggttgaaacgtatggcaatatcaggagacgactgtgttgtaaaaccaattgatgatcgattcgcaaacgcattattagccttaaacgacatgggaaaagtacgtaaggatataccccaatggcaaccaagtaaaggttggcacgactggcaacaagtaccattctgctctcatcacttccatgaactaataatgaaagacggaagaaagctagtggtcccctgcagaccgcaagacgaactaataggtagggcacgtatatcacaaggagctggatggagcttaaaggagacagcatgtctagggaaagcatacgcgcaaatgtggtccttaatgtacttccataggcgcgatttaagactagcaagtaatgcaatttgctcagccgtcccagtgcattggatcccaacatccaggacaacttggtcaatacatgctcaccaccaatggatgacaactgaagatatgcttactgtatggaacagagtctggatagaagacaacccatggatggaagacaaaacacctgttactacttgggaggatgtgccatatcttggaaagagagaagatcaatggtgtgggtcactaatcggactgacttcaagagcaacgtgggcccaaaatatcttaacggcgattcaacaagttaggagtctaatcggagatgaagaatttttagactatatgccttcaatgaagaggttccgaaaagaagaagagagcgaaggtgccatctggtaa

SEQ ID NO: 23098 - RNA, 9873 nt, synthetic construct
  misc_feature 1..9873: note = derived and/or modified CDS sequence (opt6) from DENV-3__GU131904__SS-prME
  source 1..9873: mol_type = other RNA
acaagcctttgtctgatgatgatgctgccagcaacattagcttttcatcttacttcaagggatggtgaaccgcgaatgatcgttggcaaaaatgaacgaggaaagagcttgctatttaaaacagcatcgggaattaacatgtgtactttaatagctatggatctaggggaaatgtgtgatgatacagtgacatataaatgtccacttattgcagaagtagagccggaggatatcgactgctggtgtaatctcacttcaacctgggtaacatatggaacatgcaatcaagccggggaacatcggcgtgataaaagatcagtcgcactcgccccacacgtcggtatggggctagatactcgaacacaaacctggatgagcgctgaaggggcttggaggcaagttgagaaagtagagacgtgggcactaaggcacccgggtttcacaatattagcactgttcctggctcactatattgggacaagtttaactcaaaaagtggttatatttattttactaatgttagtgacgccatcgatgacaatgcggtgtgtgggagttggtaatcgcgattttgtggaaggcttatcaggtgcgacatgggtagatgtcgttctagaacatgggggatgtgtgactacaatggccaaaagcaaaccaacattggatattgaactacagaaaaccgaagcgacgcaacttgccactttacgaaaactatgtatagaaggtaaaataacaaatataacaacagactcgcgttgccctactcaaggagaagcgacattaccagaagaacaagatcaaaattacgtatgtaaacatacatatgtggataggggctgggggaatggctgcggactatttggtaaaggctcgctcgtaacctgcgcgaaattccagtgcctagagccaattgaaggtaaagtggttcaatatgaaaacctaaaatatacagtgattataacggttcacaccggagatcaacatcaagttggcaatgacacccagggggttactgttgaaatcactccgcaagcctcaacagtagaagcggtactacctgaatatggaacattaggactagaatgtagcccgagaactggtctagacttcaatgaaatgattctgttaacaatgaaaaataaagcgtggatggtccatagacaatggttcttcgatctcccgctaccgtggacaagtggcgcaactactgaaacgcccacatggaatagaaaagaactgctcgtgacttttaaaaatgcacatgccaagaaacaagaagtagttgttcttggcagccaggaaggcgctatgcatacggcgctcaccggcgcgacggaaatacaaaattcaggcggtacatccatttttgccggtcatttaaaatgccgcttaaaaatggataaattagaactaaaaggaatgagctatgcaatgtgccttaataccttcgtcttgaagaaagaagtgtctgaaacgcaacatggaacaatacttataaaagtagagtacaaaggagaggacgcaccttgtaaaattccttttagcaccgaagatggacaaggaaaagctcataacggtcgactgattacagctaacccagtggttacgaagaaagaagaacccgtgaatatcgaggctgaacctccatttggagaaagtaacattgtcattggtataggcgataaagcccttaaaatcaactggtacaagaaaggctcctcaattggtaagatgtttgaggctacagcgagaggtgcacgcagaatggcaatattaggcgacacagcatgggacttcggttcagtaggtggagtactgaactcacttggtaaaatggttcatcaaatcttcggaagcgcttacactgctctttttagtggtgtaagttggataatgaagattggaatcggggtcctgctaacctggattggtttaaacagcaaaaatacgagtatgtcctttagctgtattgtgatagggatcataacattatacttaggagcggtcgttcaggccgatatgggatgtgttattaattggaaagggaaggaattaaaatgcgggtctgggatatttgtaacaaacgaagtccatacctggaccgagcaatataaattccaagcagactctcccaaaagactcgcaaccgcgattgctggcgcctgggaaaatggtgtttgtgggatacgtagcacaacgagaatggaaaatttactgtggaaacaaatagcgaacgagttaaattatatcctatgggagaatagtataaaattgacagttgttgttggggacattattggagttctagaacaaggaaaaagaaccttaaccccacagcccatggaattgaagtattcttggaagacgtggggaaaggcaaaaatcgtaacagctgaaacgcaaaattcaagtttcattattgacggccctaacacaccggaatgtccgagcgctagtagagcatggaacgtatgggaggtagaagattacggtttcggtgtattcactacaaacatttggttaaaactaagagaagtatatactcagagttgcgaccatcgactcatgagtgctgcaatcaaagatgaaagagccgtacacgcagatatgggttattggattgagtctcagaaaaatggatcctggaagctagagaaagcaagtttcattgaagttaaaacgtgtacatggccgaaatcacacacattatggtcaaatggggttctcgaaagtgatatgatcataccgaagtcattggcgggacctatttcacaacacaaccatcgaccaggttaccacacacaaacggcgggcccctggcatttaggaaaacttgaactcgatttcaactattgcgaaggaaccacagtcgtaataaccgaaaactgcggaacaagaggtccgagtctaagaaccactactgtatcaggaaaattaatccacgagtggtgctgcagaagttgtacgctcccacccttaagatacatgggtgaagacggctgttggtacgggatggaaatccgtccaattaacgaaaaagaagagaacatggtcaaaagtctagtgtctgctggatctggcaaagtcgataattttacaatgggagtgttatgtctggctatattatttgaagaagtaatgcgtggaaaatttggcaagaaacatatgattgctggagttctcttcactttcgttctattactaagtggtcaaattacttggcgggacatggcacatactcttataatgatcggatccaatgcaagcgatcgtatgggaatgggagtaacatacctagctctgatagcaacgtttaagatccaaccgttcctagcgctaggattctttttaagaaaattgacatcacgggaaaatctcttactaggagtaggacttgcaatggcgacaacattacaattaccggaagatattgagcaaatggcaaatggtatagcgttaggcttgatgactttaaaactaataacgcaattcgaaacctaccagctgtggacggcattagtaagcctaacatgtagcaacaccatattcaccctaacggtcgcttggcgtacagcaacactaattctagcaggagtttccctcctgcctttatgtcaatccagttcaatgagaaagaccgactggttaccgatgaccgtagccgccatgggagtaccaccgctacccttattcattttctcacttaaagacacacctaaacgacgatcctggcctttgaatgagggcgttatggcggtaggtcttgtgtcaatactagcctcatcattgttgagaaacgatgtacccatggcaggcccgcttgtggcagggggattattaatagcatgctatgtaattacaggtacatctgcagatcttacggtagaaaaagctgccgacgtcacctgggaagaggaagctgagcagactggtgtatcacacaatttgatgattactgtggacgatgacggcacaatgagaataaaagacgacgagactgagaatattttgacagttctactaaaaaccgcacttctaatagtctccggaatttttccttacagcatacctgcaaccttattggtatggcacacatggcaaaaacaaacccaacggtcaggtgtactttgggatgtcccttcaccaccagaaacacaaaaagcggaactagaagaaggagtataccgcataaaacagcaaggtatctttggaaagacccaagttggtgtcggggtacagaaagagggcgtatttcacacgatgtggcatgttactagaggtgctgtattaacacataatgggaaacgattagaaccaaactgggcatccgtcaaaaaggatctaatttcgtacggaggtggttggcgtctcagcgcacaatggcaaaaaggtgaagaagtgcaggttatagcggtggagcccggcaaaaatcccaaaaacttccaaaccatgccaggcatcttccagacgacaacgggagaaataggagcaatcgccttggattttaagcctggaactagcgggagccctataataaaccgtgagggaaaagttgtaggactttatggaaatggcgttgtaaccaaaaatggtggatatgttagtggaatcgctcaaacaaacgcagaaccagatggaccgactccggaattagaagaagagatgtttaagaaacgaaatttaaccatcatggatctacatccgggaagtggaaaaacaagaaaataccttcctgccatagtaagggaagccataaaaagaagattaagaacccttatattagctccaactagagtagtagccgccgagatggaagaggcgctaaaagggctgccaatacgataccaaacaaccgctacaaaaagcgagcacacaggtagagaaattgtagatttgatgtgtcatgcaacattcactatgagattgttaagccctgtgcgagtcccaaactacaacttggtgattatggacgaagcgcacttcacagacccagcgtcaatcgcggcccggggttacatttcaactagggttggtatgggtgaagcagcagcaatatttatgacggccacacccccgggaacagcggaggcattcccacagagtaatgcccccattcaagatgaagaacgcgacatacctgaacgaagttggaactcaggcaatgaatggattacagacttcgtcggaaaaacagtctggtttgtaccctcaataaaggcggggaacgatattgctaattgcttacggaaaaatggcaagaaagtcatacaactaagtagaaagactttcgatactgaatatcagaaaacaaggctaaacgattgggatttcgtcgtaacaactgatatttcagaaatgggggcaaactttaaggcggaccgagttatagatccgagaagatgtctaaaaccagttattttaacggacgggccagaaagagtcatactagcgggaccgatgcctgtcacagctgcatcggctgcacaaagacgtgggagagttggacgtaacccacagaaagaaaacgatcaatatattttcacgggccagccattaaataacgatgaagaccatgcccattggactgaagcgaaaatgttacttgacaatataaatactccagagggaataatcccagcattatttgaacctgagagagagaaaagcgcagctatagacggagagtataggctaaagggcgaatcacgtaaaacgttcgtggaactcatgagaagaggagatttaccagtatggttggcacataaggttgcttccgaagggataaaatacacagatcgtaaatggtgttttgatggggaacgaaataaccaaattctggaagaaaacatggacgttgagatatggactaaagagggcgaaaggaagaaactacggccgcgctggttagatgccagaacatacagtgatcctcttgcgctaaaggaatttaaggatttcgctgcaggtaggaaaagtatagcactagatcttgtaacagagattggtcgtgttccttctcatttagcacatcgaactagaaatgcgcttgacaacctggtaatgttacatacttctgaacatggagggcgagcatatagacacgcagtagaagaattaccagaaactatggaaacattgttattactcggattaatgatcctattgactggaggtgccatgctattcctaatctcaggtaaaggtataggaaaaacatccataggcctgatatgcgtgattgccagtagtggtatgctgtggatggctgatgtccctttacaatggatcgcttcagctatagtcctagagtttttcatgatggtcttacttatacctgaaccagaaaaacaaagaacaccccaagacaatcaattagcatacgtggttattggcatactaacactagcagcaattgtagcagctaacgaaatgggacttctcgaaacgaccaaaagagatctaggaatgtcaaaggagcctggagtagtaagcccaacatcatacctcgacgttgatctgcatcctgcgagcgcatggactctatatgccgtggctactactgtgataaccccgatgttaagacatacaatagaaaactctacggcgaacgtgtcactagcggctatcgcaaaccaggctgtcgtgttgatgggtctcgacaaaggttggcctataagtaaaatggacttaggggtccctctattagctttgggatgctacagtcaagtaaaccctttgacgctaacagccgctgttttactattagtgacacattatgcaatcataggaccaggacttcaagcaaaagcaacaagagaagcacaaaaacgaacagccgctggaataatgaaaaacccgacagtggatggaattatgacgatcgacctagatccggtgatttacgattcaaaatttgaaaaacagctaggccaagtaatgctgcttgttctgtgtgcagtacaactacttttgatgcggacttcttgggccctctgcgaggctctcacattagccacgggaccaataacgacactatgggaaggaagtccaggtaaattttggaatacaacaatagccgtttcaatggccaatatattccgcggctcttatcttgcaggagcgggcctagcattttcaataatgaagtccgttggaacaggacggcgaggaacaggctctcaaggagagactctgggtgaaaagtggaaaaagaaactaaatcagctgtctcgaaaagaatttgacttatataagaaatcaggtatcactgaggtagataggacggaagcaaaagagggtctaaagagaggggagaccacacatcatgcagtttcaaggggatcagcaaagctgcaatggttcgtcgagagaaacatggtaataccagaagggagagtgatagatcttggctgtggtaggggtggatggagttattattgcgcagggttacgaaaagtaaccgaagtacgaggctatacaaagggcggcccaggacacgaagaaccagtccccatgtcgacatatggatggaatatagtaaaacttatgagtggaaaagacgtattttatttaccaccagagaaatgcgacactctattgtgtgacataggcgaatctagtccctcaccaacggtagaagaaagcagaacaatcagggtactgaagatggtggaaccttggttaaggaacaaccagttttgcataaaagtactaaatccttatatgcctactgtaatcgaacatctagaaagacttcagcgaaaatatggcggaatgctcgtaagaaacccattaagtagaaattccacacacgagatgtactggattagcaatggcactggcaacatagtgtcatcggtgaatatggtctctaggttattattaaataggttcacgatgactcatcgaagaccaacaatagaaaaagacgttgacttaggagcgggtaccagacatgtgaatgcagaaccagagactcccaatatggatgtaattggcgaaagaataaaacgaataaaagaagaacattctagcacctggcactacgatgacgaaaatccttacaaaacgtgggcataccatggaagttacgaagtaaaagcaactggttctgcatcatcaatgataaacggtgttgtgaagttactaacaaagccctgggatgtagtaccaatggtaacccagatggccatgacggatacaacaccctttggacagcaacgggttttcaaggagaaagttgatacaaggacgccacgaccaatggctggaactaggaaggtgatggaaatcacagcagaatggttatggcgaactttaggtagaaataagaaaccacgattatgcaccagagaagagtttactaagaaggtgagaacaaacgcagcgatgggtgctgttttcactgaagaaaaccaatgggactccgcccgcgcggctgttgaggatgaagagttttggaaacttgtagatagagaaagagaattacacaagttggggaagtgtggaagttgtgtttacaatatgatgggtaagagagaaaagaaattgggagagtttggcaaagcaaaaggtagtagagcaatctggtatatgtggctaggtgcaagatatctcgaatttgaagcactggggtttcttaatgaagatcactggttcagtagagagaatagttattcaggcgtggagggcgaaggactccataagttaggctatatcttgagagatatatctaaaatacctggcggtgcaatgtatgctgatgatacagcaggatgggacacaagaattactgaagatgatttacacaatgaagagaaaataacccagcaaatggatcccgaacacagacaattagccaacgccatatttaaacttacataccaaaacaaagtggttaaagtccaacgaccaacgccaaaaggaaccgtgatggatattataagtcgaaaggaccaaagagggtccggacaagttggtacttacggactaaatacttttacaaacatggaagcgcagttggtacgacaaatggaaggcgagggagtgttgtctaaagcagatcttgaaaatccgcatttactggagaagaaaataacccaatggctggaaacaaaaggcgttgagcggctgaagagaatggctattagcggagatgattgtgtcgtgaaacccatcgacgatagatttgcaaatgcattactagcattaaatgacatgggtaaagtgcggaaagacattccccaatggcagccaagtaagggctggcatgattggcaacaagtcccattttgcagccatcatttccatgagctgattatgaaagacggcaggaagttggtagtcccttgcagaccacaggacgaattaataggacgtgctcgaataagccaaggtgcagggtggagtctaaaggaaacagcatgcttgggcaaagcatacgcacagatgtggagcttaatgtacttccatcgcagggatttgcggttggcttcgaacgcaatctgtagtgctgtaccagttcattggattccaacttcacggactacatggtccatacatgcacaccatcaatggatgacaactgaagacatgctaacggtctggaacagagtatggatcgaagacaatccgtggatggaagacaaaacacctgtaacaacatgggaagacgtaccgtacctaggaaaaagagaggatcagtggtgcggttcactgataggtttgacatcccgtgcaacgtgggcccaaaatattctaaccgcgattcaacaagtgagaagtctaatcggagacgaggagttccttgattacatgccatctatgaaaaggttccgtaaagaagaagaatcagaaggcgcaatttggtga

SEQ ID NO: 23099 - RNA, 9873 nt, synthetic construct
  misc_feature 1..9873: note = derived and/or modified CDS sequence (opt6) from DENV-3__GU131906__SS-prME
  source 1..9873: mol_type = other RNA
acgtcgctgtgcttaatgatgatgctaccagcaacattagcatttcatctaacatccagagacggtgaacctcgtatgattgtaggcaaaaatgaacgagggaaaagcctattattcaagactgctagcggaataaatatgtgtacgttaatcgccatggacttgggggaaatgtgcgatgacacagtaacatacaagtgtcccttaatcgcagaagtagaaccagaagacatcgattgttggtgtaatctcacaagcacttgggtaacttatggaacatgtaatcaagcgggagaacacagaagggataaaagaagcgttgctcttgcaccacatgtaggtatgggattagacactcgcacgcaaacatggatgtcagccgaaggagcatggagacaagtcgaaaaagttgaaacttgggcgttacgtcatccaggatttactatattagcgctttttctcgcacactacatcggaacatccctcacccaaaaggtagtgattttcatcctactaatgctagtaacaccatcaatgacaatgcgatgcgtcggagtgggaaatagagatttcgtggaaggactatctggagcaacatgggtagacgtagtgttagaacatgggggatgtgtaaccacgatggcaaaatcaaagcctacacttgacattgaattgcaaaagacagaagccacacaacttgctacgttgcgaaaactatgtatagaaggtaaaattacaaacattaccacagacagtagatgtccaactcaaggggaagcaaccctacctgaagaacaagatcaaaattacgtctgcaaacacacttatgtcgatagaggttggggtaatgggtgtggacttttcggtaaaggatctctagtaacctgcgcaaaatttcaatgtctagaaccaatcgaaggtaaagtagtacaatacgagaacttaaaatacacagttattattactgttcatactggtgaccaacatcaagtcggtaatgatacacaaggcgtcaccgtagaaataacgcctcaggcttccacggtcgaagctgtcctacccgaatatggaaccttagggttagagtgtagtcccagaacgggattggactttaatgaaatgatactgctgacaatgaaaaataaagcatggatggtacatcgtcaatggttcttcgatttgccattaccatggacttcaggagctactacggaaactcctacatggaataggaaagaactcctggtaacttttaaaaatgcacatgccaagaaacaagaagtcgtcgtgctaggtagccaagaaggtgcaatgcacactgcattaaccggcgcaacggaaatacaaaactcagggggaacttcaatatttgcaggacatttaaagtgtagattaaaaatggacaagttagagttgaaaggcatgagctacgctatgtgcttaaatacattcgtcctaaagaaagaagtgagtgaaactcaacacgggacaatactcattaaagtcgaatacaaaggggaagatgctccatgcaaaatacctttctccacagaagacggacaaggtaaagcacacaatgggaggcttataactgcaaatccggtagtaaccaagaaagaggagcccgtaaacattgaagcggaacccccattcggtgaatctaatatagtcattggaatcggggacaaagccttgaaaataaattggtataagaaaggtagttcgatagggaaaatgtttgaagccacagcaaggggtgcaagacgaatggcaattctcggagatacggcatgggattttggaagtgttggcggtgttctaaattccctgggaaaaatggtacaccaaatcttcggaagtgcatatactgcacttttcagtggggtatcgtggataatgaaaatcggaataggggtactacttacctggataggcctaaatagcaaaaacaccagcatgtcgtttagctgtatcgtgataggcataataacattgtatctaggagcagttgtacaagccgatatgggttgcgtaataaattggaaagggaaagaactaaaatgcggaagcggaatatttgttacgaatgaagttcatacttggaccgagcaatataaatttcaagccgatagcccaaaaagattagcgacagccattgcaggggcctgggagaatggagtatgtggtataagatcgactacacgaatggaaaatctactgtggaaacaaatagcgaacgaactaaattacattttatgggaaaataacataaaacttaccgtagtggttggggacattatcggggtgttagaacaaggtaagcgaactctcacgccacaaccgatggaattaaagtacagctggaagacttggggtaaagctaaaatcgtcacagccgaaacgcaaaatagcagttttataatagacggtcccaatacccctgagtgcccctcagcgtcaagagcttggaacgtgtgggaggtagaagactatggttttggtgtgttcacaactaacatttggttaaaactaagggaagtttacacacaatcatgtgatcataggctaatgagtgcggctataaaggatgaacgtgcagtacatgccgacatgggatattggattgaatcgcagaaaaacggttcctggaagctcgagaaagcctcattcatcgaggttaaaacgtgtacatggccaaaatctcataccctatggtcaaacggagtattagaatcagacatgataatccccaaatcactagccggcccaatatcacaacataatcacaggccgggctatcatacgcaaacagcagggccctggcacttaggtaaattagaactcgattttaactattgcgaagggacaacagtggttatcaccgagaattgcggaaccaggggaccatcattaagaacaacaacagtctcgggtaaacttattcacgagtggtgttgtcgaagttgtacactaccacctttgaggtacatgggcgaagatggctgttggtatggaatggaaataaggcccatcaatgaaaaagaagaaaacatggtgaaatcattagtctctgcaggctcagggaaagttgacaattttacgatgggggttctttgcctcgcaatactgttcgaagaagtcatgcgcggaaagtttggcaagaaacatatgatcgcaggcgttctctttacatttgtgttattattaagtggccagattacatggagagatatggcacacactttaattatgattggctctaacgcaagtgaccgaatggggatgggagtaacttacttagctctcatagcgacctttaagattcaaccattcttagcattaggattcttccttagaaaattaacttcaagggaaaatctattattaggagtgggactagcaatggccacgacattacagttaccagaagatatagaacaaatggccaacggaatagcattggggttaatgaccttgaaacttataactcaatttgagacataccaactctggactgcattagtctccctaacatgttccaacacgatatttacgttaactgttgcttggcgaaccgcaacactgatcctagcgggagtatcacttcttcctctatgtcagagtagttcaatgagaaaaaccgattggttacccatgactgttgcagcaatgggagtcccgcctctaccgctatttattttctcccttaaagacacacctcgaagaagaagctggcccctaaacgagggtgtaatggcagtaggcctagtttcgattctagcatctagccttctacgaaacgacgtaccaatggcaggtccattggtagccggtggcctcctcattgcctgttacgttatcacgggaacgtctgcggacctcacagtggaaaaagcagccgatgtgacctgggaagaagaagcagaacaaacgggagtcagccataacttaatgatcaccgtagacgacgacggaaccatgcgaatcaaagatgacgagacagaaaacatacttacagtactattgaaaaccgctttattaattgtgtcaggcatattcccatattctatccctgccacgttgttggtatggcatacatggcaaaaacaaactcagcggtccggggtactttgggatgttccatcgccaccagaaacacaaaaagcagaattagaagagggagtatacaggattaaacaacaggggatttttggtaaaacccaagtgggtgttggcgttcaaaaggaaggcgttttccatactatgtggcacgtaactcggggcgcggtattgacgcacaacggtaaacgtctagaacccaattgggcatctgtcaagaaagatctaatatcctatggcggagggtggagactatcagcccaatggcagaaaggggaagaagtccaagtaatcgccgtggagcccggcaagaatccgaaaaatttccagactatgcccggcattttccagaccacaacaggtgaaattggtgcaatagcattagactttaaaccaggtacttcaggttcaccaataataaatagagaaggcaaggtcgttggattatatggaaacggagtagtgaccaaaaacgggggatatgtcagcggtatagctcaaacaaacgcggaaccggatggacccacgccagaattagaggaagagatgttcaaaaagagaaatctcaccatcatggatctccaccctggatcaggaaaaacacgtaaatacctccctgctatagttcgcgaagcaattaaacgacgactacgaacgctgattttagcaccgacacgtgtcgtagcagcagaaatggaagaagcattgaaaggacttccaatacgctaccaaacaacagctacgaaatcggaacacacgggtcgagaaatagtcgatcttatgtgtcacgcgacatttacgatgagactgttaagtcctgtacgagtacccaactataatttggtaattatggacgaagcacattttactgacccagctagcattgccgccaggggctatatctcgacaagggtagggatgggtgaagcagcagctatctttatgaccgcaactccaccagggacagcagaggcttttccacagagcaatgccccaatacaagacgaagaaagagatattcctgagaggagctggaactctggtaacgagtggataactgactttgtaggaaaaacggtctggttcgtaccctcaataaaagcagggaatgacatcgccaattgtctacgtaaaaacggcaagaaagtaattcaactcagtagaaaaacatttgatacggaatatcagaaaacgcgcctaaatgattgggatttcgtcgtaacaaccgatatatctgaaatgggggcgaatttcaaagcagatagagtaattgatcctaggagatgtcttaaaccagtaatactcacagatggacctgaacgcgttatactggcggggcctatgccggtaaccgcggcctcagcagcacaaagaagaggtagggtggggcgaaacccgcaaaaagaaaatgaccagtatatattcacgggccagcctcttaataatgatgaagatcatgcgcactggactgaagcaaaaatgttactcgacaacatcaacacacccgagggaattatacccgcgctttttgagcctgaaagagagaaaagtgctgctatagacggggaatatcgtcttaaaggtgaatccaggaaaacatttgtggaactaatgaggagaggggatttgcccgtgtggttagcacacaaggtagcatcagaaggaattaaatatacagatagaaaatggtgtttcgatggagaaagaaataaccaaatactggaagagaacatggatgtagaaatatggacgaaagaaggcgagagaaagaaactacgacctcgctggttggatgccagaacctactcagatccacttgcgctaaaagaatttaaagactttgccgcggggaggaaaagcatagctctagacctcgtaacagagataggacgtgtacccagtcatctcgcacacagaactaggaacgccctagacaatttggtaatgctgcatacatctgaacatggaggacgagcttacagacatgccgttgaagaactacctgaaacgatggaaacattgcttctcctgggattgatgatactcctcacgggtggagctatgctctttttaattagcggtaaaggaataggaaaaacttcaattggcctaatatgtgtaattgcttcaagtggaatgttatggatggccgacgttccactacaatggatagcaagcgcaatcgtgttagagttctttatgatggtcttactgatccctgagccagaaaaacaaaggaccccacaagataaccaactagcatatgtagtcataggtatacttacgctagctgcaatcgtagcggcaaacgaaatggggctattggaaacaactaagcgtgatttagggatgtctaaagaacccggtgtcgtttcaccaacaagttatttagacgtcgacctgcatccggcaagtgcatggacactatatgcagtagctacaactgtcataacaccgatgctaagacacacaatcgaaaattccactgcgaacgtatcattggcagccatagcaaatcaggcagtagtcctaatgggactcgataaaggatggcctattagcaaaatggaccttggagtaccactgcttgcactcggatgctactcacaggtaaacccactaacactgacagcagcggtactattattagtaacacattacgcaataataggcccgggtctacaagcgaaagcgacacgcgaggcacagaaaaggacagcagccggaatcatgaaaaatcctactgttgatggcataatgacgatagacttagatccagtcatatatgattcaaaatttgagaaacaacttgggcaagtaatgctattagtactttgcgccgtgcaacttttattgatgagaaccagttgggcgctgtgtgaagcactaacactagcaacaggacctataacgactttatgggagggatcgcccggaaagttctggaacacaacaattgccgtaagcatggcgaatatctttagaggatcatacctcgccggggcagggctagcattctcaataatgaaatcggtaggaactggtagacgaggaacaggttctcagggagaaacactaggcgaaaaatggaaaaagaaattaaaccaactgtcgaggaaagagttcgatttatacaagaaatcaggtatcacggaagtggatagaacagaggctaaagaaggactaaaaagaggagaaacaacacaccacgcagtttctcgcggctctgcgaaactgcaatggttcgttgaacgtaacatggtcataccagaagggagagtaatcgatttaggatgtggtagaggagggtggtcttattactgtgccggacttaagaaagttactgaagttagaggctacacaaaagggggaccaggtcacgaggaaccggtacctatgtcaacatacggctggaatatagtaaaattgatgagtggcaaagacgtattttacttaccgcctgagaaatgtgatacattgctctgtgacataggagaatcaagcccatcccctacagtagaagaaagtcgaacaataagagtactcaaaatggtcgaaccgtggctacgaaataaccagttttgcataaaggttcttaacccatatatgcccactgtaatagagcatctggaacggcttcagagaaaatatgggggaatgttggtaagaaatccattaagtcggaacagcactcatgaaatgtattggatatcgaacggaacggggaatatagtaagctcagtaaacatggtaagcagattattattaaaccgctttacaatgactcatcgacgaccaacaattgagaaggatgttgacttaggagccggtacgcgccatgtaaatgctgaaccggagacgccaaacatggacgtaataggtgagagaatcaaacgcataaaggaggaacacagtagtacttggcattacgatgatgaaaatccatataaaacgtgggcatatcacggatcgtatgaggtaaaggcaacagggtccgcgagtagtatgattaatggagtagttaaacttttaacaaaaccctgggacgtcgtaccgatggtcacccaaatggcaatgactgacacgactccatttggtcaacaacgagtttttaaagaaaaagtagacacccgtacaccgcgacctatgccaggaaccagaaaggtaatggaaatcacagcagaatggttatggaggacgctcgggaggaataagaaaccgaggttatgcacaagagaggagttcactaagaaagtacgaacaaatgccgcaatgggagcagtatttacagaagaaaatcaatgggattctgcgcgggcagcagtagaagacgaggagttctggaaattggtagatcgagaaagagaattacacaaattaggtaaatgcggaagctgtgtatataacatgatgggaaaaagagagaagaaattaggagaatttggtaaagcgaaaggatctagagcaatttggtacatgtggttaggagcacggtacttggagtttgaagcattagggtttctaaatgaggatcattggttctcccgagaaaattcttattcgggagtggaaggtgaaggccttcataagttaggctacattctacgagacatatcgaagataccaggtggagctatgtatgcagacgacacggcaggctgggatactcgtataacggaagatgacttacacaacgaggaaaagattacccaacaaatggatccagaacaccggcaactcgccaatgccatctttaaactcacgtaccaaaataaagtggtgaaagttcagagaccaacaccaaaaggaactgtaatggatataatctcacgaaaagaccaacgaggctccggtcaagtaggaacatatggactcaacacatttacaaatatggaagcgcagctagtaagacagatggaaggtgaaggtgtattaagtaaagcagatctagaaaatcctcatctactcgggaagaagatcacacaatggttagaaacaaaaggggtcgaaagactcaagcgaatggcaatatctggagacgattgcgttgtgaaacccattgacgacagatttgccaatgcacttctagcgttaaacgacatgggtaaagtccgaaaagatataccccagtggcaacctagtaaggggtggcatgattggcagcaagtaccgttctgtagccatcatttccacgaacttataatgaaagatggtaggaaacttgtagtcccatgtaggccccaagacgaactcataggtagagcaaggatttcacagggagcaggatggtctcttaaagagacagcctgtttaggcaaggcatatgcacagatgtggtcactcatgtatttccaccgacgtgatttaagattggcaagcaacgcaatttgttcagcggtacccgtacactggatacctacatccagaacgacgtggagtattcatgcccaccatcaatggatgacaacggaagacatgcttacagtttggaatagagtttggattgaagataatccgtggatggaagacaaaacaccagtcactacttgggaggatgtcccttatctcggtaagagagaagatcaatggtgtgggtcgcttatagggttgacgagccgtgcaacctgggctcagaacatattaaccgctatccaacaggtaagatcccttattggcgatgaagaatttctagattacatgccatcgatgaaacgatttcgaaaagaggaggaatctgagggagctatttggtaa

SEQ ID NO: 23100 - RNA, 9873 nt, synthetic construct
  misc_feature 1..9873: note = derived and/or modified CDS sequence (opt6) from DENV-3__GU131907__SS-prME
  source 1..9873: mol_type = other RNA
acaagtctctgcttaatgatgatgctgcctgctactctagcgtttcatttaacgtcacgcgacggagaaccacgcatgattgtcggcaaaaacgaaagagggaaaagcctattatttaaaacagctagtggaatcaacatgtgcaccttaattgcaatggatttgggagaaatgtgtgatgataccgtgacttataaatgtcctcttatagctgaagtcgaaccggaggatatagattgctggtgtaatttaacatctacctgggttacttatggaacctgcaatcaagcaggagaacatagaagagataaacgctccgtggccctagcacctcatgtgggcatggggctagacactagaacccaaacatggatgtcagccgagggagcatggagacaagtcgaaaaagtcgaaacatgggcattaagacaccccgggtttaccatcctggcactttttctcgcacactacatcggaacctctttgactcaaaaagttgtaatatttatattacttatgctggttactccaagtatgaccatgcgatgcgttggggttggaaatcgggattttgtggaaggactatctggagcaacttgggtagacgtggtactcgaacatggtggatgcgtaacaacaatggcaaaaagtaaaccaactttggatatagagctgcagaaaactgaggcaacacaacttgccacattaagaaaactctgcattgaagggaaaattactaacattacgaccgactctaggtgtccaactcaaggagaagctactttacccgaagaacaagatcaaaactacgtctgcaaacacacgtacgtagatagaggatggggaaacggttgtggtttgtttggaaaaggatccttagttacttgcgcgaaattccaatgcttagaacctatagaagggaaagtagtacaatatgaaaacctaaaatatacagttataatcaccgttcacacgggagatcagcatcaagtcggcaacgatacacaaggagttacagtcgagataactcctcaagcaagcactgtagaggcagtactacccgagtatggaaccctcggcttggagtgttcgccaaggacaggattagattttaatgagatgattctgctcactatgaaaaataaagcatggatggttcataggcaatggttctttgacctaccactaccgtggacaagtggtgcaacaactgaaacaccgacatggaacagaaaagaactattagtcacgttcaaaaatgcgcatgcaaagaaacaagaggtcgtggttttaggatcacaggagggggcaatgcataccgcgctaacaggtgcaactgaaatacaaaatagtggagggacatctatatttgcaggtcacctcaaatgtcggctaaaaatggataaattggaactgaaaggaatgtcatatgcaatgtgtctaaacacattcgtcctaaagaaagaagtgagtgaaactcaacacggaactattttaattaaagtagagtataaaggtgaggatgcaccatgtaaaattccattttctacagaagacggacaaggaaaagcacataatggaagattgattacagcgaatcccgtcgtgacaaagaaagaggaacctgttaatattgaagcggaacccccttttggagaaagtaatatagtcataggaataggagacaaagctctaaaaataaattggtataagaaaggatcaagtatagggaaaatgtttgaggcaaccgcaagaggtgcgaggcggatggccatactgggggatacagcatgggatttcgggtctgtaggcggagttttaaacagccttggaaaaatggtgcaccagatcttcgggtctgcctatacagccttattttctggcgtctcttggatcatgaaaatcggtataggagttcttctgacgtggatagggctaaatagcaaaaacacaagcatgtctttcagctgtattgtaataggtataatcacactctacttaggcgcagtggtccaagccgatatgggttgcgttatcaattggaaaggaaaagaattaaaatgtgggaacggtatattcgtcacgaatgaggttcacacttggactgaacaatataaatttcaagcagattcgccaaaaagactggcaactgcaatagcaggcgcatgggagaacggagtatgtggcatacgaagtaccacaagaatggaaaacttgctctggaaacagattgcaaatgagcttaattacatactatgggaaaacaatattaaacttacagtagtagtaggagacattataggggtacttgaacagggaaaacgaactttaactccacaaccaatggagctaaaatattcatggaaaacatggggtaaagccaaaatagtcacagccgaaacacaaaacagttcgtttatcattgatggccccaatactccagaatgtccctcagccagtcgagcatggaacgtctgggaagtcgaagattacggatttggagttttcacaactaacatatggcttaaactaagagaggtatacacgcaatcttgtgatcaccgcctaatgtcagccgcaataaaagacgaacgtgccgttcatgccgatatgggatactggattgagtcgcagaaaaatggatcctggaaactcgaaaaagcctcctttatagaagtcaaaacttgcacatggcctaaatctcataccctatggagtaacggtgtattggaatccgatatgataatcccaaaatccctcgctggacctatttcccaacacaatcatcgaccaggttaccatacccagactgcgggaccctggcatctaggaaaattggagctagatttcaattactgtgagggaacaacagtagttattgcagaaaactgcggcactagaggcccgtctttaagaactactaccgttagtggaaaattaattcatgagtggtgttgtagatcatgcacgctaccacctctccggtatatgggggaagatggatgctggtatggaatggaaattagacccataaacgaaaaagaagaaaatatggttaaatcattagtgtcggcgggaagtgggaaagtcgacaattttactatgggagtactatgccttgcaatattattcgaagaggtaatgagaggtaaattcggcaagaaacacatgatcgccggagtactcttcacatttgtgttattactatccggacaaattacttggagggatatggcacacactctcattatgatcggatctaacgcgtcagacagaatggggatgggtgtaacatacttagcattgacagcaacatttaaaatacagccgttcctcgcactaggattctttttacgcaaattaacatcacgggagaatttattactaggagttggattagcaatggcaacaaccctacaattaccagaagacatcgaacaaatggccaatggaattgctttagggttaatgactttgaaactaatcacccagttcgaaacatatcaactctggactgcgttagtaagcctgacttgttctaacaccatattcacacttactgtagcatggagaacggcaaccttaatcctcgcaggagtaagtctactacctctttgccaaagtagctcaatgcgaaaaaccgactggctaccaatgaccgttgcggcaatgggagtaccacccctaccgctatttatattttcgttaaaagatacaccgaaacgacgatcctggccattaaatgaaggtgtgatggctgtaggtcttgtgtcaattctggcttcctccctcctaaggaatgatgtaccaatggcggggccattagtcgcgggaggtctattaatagcctgttacgtaatcacaggcacaagcgctgacctaactgtcgaaaaggctgctgacgtcacatgggaagaggaagcagaacaaacaggggttagccacaacctcatgatcactgttgatgatgatgggacaatgcgaattaaagatgatgaaactgaaaacattttaacagtgttgcttaagaccgctctactgatagtaagcggcatattcccatacagtatcccagcaacattactcgtgtggcacacgtggcaaaaacaaacccagcgatcaggagtattgtgggacgttccaagcccacctgaaacgcagaaagctgaactcgaagaaggcgtttatcgtataaaacagcagggcatctttggtaagactcaggttggagtcggagtacaaaaagaaggtgttttccataccatgtggcacgttacacgaggggcagtacttactcataacggaaagagactagaaccgaattgggcaagcgtcaagaaagatttaatcagctacggcggaggttggaggctctcagcgcagtggcaaaaaggagaagaagtacaggtaatagccgtagaaccaggcaaaaatcccaaaaattttcaaaccatgccaggcatctttcaaacaaccacaggcgaaatcggcgccatcgccctagattttaaacccggcaccagcggaagcccgattatcaatagggagggaaaagttgtaggtctgtatggcaatggagtagtaaccaaaaacggaggatatgtttccggcatagcgcaaacaaacgccgaaccagatggaccaaccccagaattagaggaagagatgttcaagaaaagaaatctcacaatcatggacctacatccgggatctggaaagaccaggaaatacctacctgcaattgtaagagaagcgattaaaagaagactacgcacattaatcttagcgccaacaagagtagtcgcagctgaaatggaagaagcgctgaaaggtctccctataagatatcagacaactgcaacaaaatcagaacatacaggcagggagatcgtagacttaatgtgtcatgcaactttcactatgcgattactaagtccagtaagagtgccaaactataatctcgtgataatggacgaagctcatttcactgaccctgcttcaatcgctgctagggggtatatttctacaagagttggaatgggagaagctgcggcaatatttatgactgctacaccgccggggacggctgaagcatttcctcagagcaacgcacctattcaggacgaagaacgcgacatacctgaaaggtcttggaacagcggaaacgaatggataacagatttcgtcgggaaaacagtctggtttgtaccatcaattaaagcaggaaatgatatagccaattgccttaggaaaaacggcaagaaagttatacaattatcacgcaagaccttcgatacagaatatcagaaaacacgactgaacgattgggattttgtagtcacaacggacatatctgaaatgggtgcaaactttaaggctgatagagtgatcgaccccagacgttgtctaaagcccgtcattcttaccgacggacctgaaagagtcatattagcgggacctatgccagtaacagcagcaagcgcagcacaacgaagaggccgagttggtagaaatccacaaaaagagaatgaccaatatatattcacaggccaacccttaaacaacgatgaggaccacgcacattggacagaagctaaaatgttactcgacaacatcaatacgcccgaaggcattatacccgctctctttgaaccagaaagagagaaatccgctgccatagacggtgaatatagacttaaaggagagagtagaaaaacattcgtagaacttatgcgcaggggagatctacccgtatggttagctcacaaagtagcaagtgagggaataaaatacacagatcgcaagtggtgcttcgatggcgagaggaataatcaaatactagaagagaacatggacgttgaaatttggacaaaagaaggagaaaggaagaaacttaggcccagatggcttgacgctagaacatactcagatccacttgcattaaaagagtttaaagattttgccgctggtcgcaaatccatagcgctagaccttgtaacagaaatagggcgagtaccgtcacatcttgcacacagaacacggaatgcattagataacctagttatgttacacaccagtgaacatgggggacgcgcgtatagacacgcagtcgaagaattaccagaaactatggaaacactacttctattgggacttatgattcttttaacaggaggtgcgatgcttttcttgatatcagggaaaggaataggtaaaacaagcatcggtctaatctgtgttattgtatcgtcgggtatgttatggatggcggatgtcccacttcaatggattgcgtcagcaatagttctagagttctttatgatggttttgttgataccagagccagaaaaacaaagaacacctcaagacaatcagctagcctatgtagtcataggcatactgacgctagcagccatagtagcagcaaatgaaatgggactacttgaaacgaccaaacgggacttaggtatgtcgaaagaacctggagtggtctctcccacatcgtatctcgatgtagatctacatccggccagtgcttggactttatatgcagtagcaacaaccgtcataacacccatgttgagacacacgattgagaactcaacagccaacgtctctctagctgcaatagccaatcaggccgtagtattaatgggattggataaagggtggccaatttccaaaatggacttaggggtacctttactcgcactgggatgctatagtcaagttaatccattgactttgactgctgcagtattactcttggttacccattatgccataataggccccggactacaagccaaagctaccagggaagctcaaaaacgaacagcggcaggcattatgaaaaatccaacagtagatggtataatgactatagacttggatccagtaatatatgactcaaaatttgaaaaacaacttgggcaagtaatgctactggttctctgtgctgttcaactgttattgatgcgtacttcatgggcactatgcgaagcacttacactggcaaccggccccataacaacgctatgggaaggtagccctggtaaattctggaatacgacaattgctgtaagtatggctaacatattcagagggtcttatttggcaggcgcaggtttagcattttctataatgaaaagcgtcggaacaggcaggagaggcacagggtcacaaggcgaaactttaggagagaaatggaagaagaaactaaatcaactaagccgaaaagaatttgatctgtacaagaaatcaggcattaccgaagttgacaggacagaagcgaaggagggccttaagagaggtgaaaccacccaccatgcagtttcccgcggatcggcaaagctacaatggttcgttgaacgtaatatggtcatccctgagggacgtgtcatcgatctaggctgcgggcgtgggggatggtcatactattgtgctgggctgaagaaagtgactgaagtcagaggatatacaaagggagggccaggacatgaggagcctgttccaatgagcacatatggatggaatattgtgaaattaatgtccgggaaagatgttttctaccttccgcccgaaaaatgtgacacattactatgcgacataggtgaatcaagcccaagcccgactgtagaagaaagtaggacaattagggtactcaaaatggttgagccctggttacgaaataatcaattttgtatcaaagtcttaaatccatatatgccaacagttatagaacatctcgaaaggctccaaagaaagtatgggggcatgttagtgcgtaatccactaagtaggaactccacccacgaaatgtactggatctcgaatggaactggaaatatcgtctcctccgtgaatatggtgtcacgcctcttactgaacagatttacaatgactcataggagaccaacgattgagaaagacgtagacttgggtgcaggaaccagacatgtaaatgctgaacccgaaaccccgaatatggatgttattggggaaaggataaagcggataaaggaagaacacagtagtacatggcattacgatgatgaaaatccttacaagacttgggcatatcatggatcttacgaagtaaaagctacgggctcagcaagttcgatgataaacggtgtggtgaaactattaacaaaaccttgggatgtggtacccatggtcacacaaatggctatgaccgatacgactccatttgggcaacagcgagtatttaaagaaaaagtagacacaagaacaccccgcccaatgccgggcacacgaaaagttatggagattaccgccgagtggctttggcggacgctcgggagaaataaaaagcctagattgtgcacaagggaagagttcactaagaaagtgagaacaaacgcagctatgggagctgtcttcactgaagaaaatcaatgggattcagctcgagcagctgttgaagatgaagagttttggaaattggttgacaaagaaagagaactccataagctaggaaaatgtggttcgtgtgtctataatatgatgggtaaaagggagaagaaattaggtgaatttggaaaagctaaaggttctagagccatatggtatatgtggctgggagcaagatatctggagtttgaggctctcggtttcctgaatgaagatcattggttctctagggaaaattcatactcgggtgtagaaggagagggtttacataaactaggatatattctccgagatatttctaaaataccgggaggggcgatgtatgcggacgacacagctggctgggacacccgaattacggaagacgacttacataacgaagaaaagataactcaacaaatggacccagagcatagacaattagcgaacgcgattttcaaactaacctatcaaaataaagttgtaaaagtgcaacggcccaccccaaaaggtacggtgatggatataatatcaagaaaagatcaaagaggatccgggcaggttgggacatacggtctaaacacgttcaccaatatggaagcacagttagtacgacaaatggaaggcgaaggcgttttaagcaaagcagatttggaaaatccacatctgctagagaagaaaatcacacaatggctggaaacaaaaggagtagagagactaaagcgaatggcgataagtggagatgattgcgtcgtaaaacctattgacgatcgattcgctaatgcactcttagccttgaacgatatgggaaaagtaagaaaggatataccacaatggcaaccttccaagggatggcatgattggcaacaagttcctttttgttcccatcacttccatgagttgatcatgaaagacggaagaaagttggtggtaccatgcagaccccaagatgagcttataggtcgtgcaagaattagtcagggagctggatggtctttaaaagaaaccgcctgcctcggtaaggcttacgcccagatgtggtcacttatgtactttcataggcgagacctcagattggcatcaaatgcaatttgttcagccgttccagttcattggatacccacatcgagaaccacgtggtctattcacgcccaccatcagtggatgacaactgaagatatgctaaccgtgtggaacagggtttggatagaggataatccctggatggaagataaaacaccagtcacaacctgggaggacgtgccatatttaggaaaaagagaggaccaatggtgcgggtctctcatcggattaacgtcgagagctacctgggctcaaaatatcttaaccgctattcaacaggtcaggtcgttgatcggagacgaagagttcctagattacatgcctagtatgaagagattcaggaaggaagaagaaaccgaaggagcgatctggtaa

SEQ ID NO: 23101 - RNA, 9873 nt, synthetic construct
  misc_feature 1..9873: note = derived and/or modified CDS sequence (opt6) from DENV-3__GQ868634__SS-prME
  source 1..9873: mol_type = other RNA
acatcattgtgtctcatgatgatgttaccagctacactcgcattccacttaacaagccgagacggtgaacctagaatgatagtgggcaaaaatgaacgaggtaaatcactgctatttaaaacggcaagtgggatcaatatgtgcactctaatcgcaatggacctcggagaaatgtgtgacgatacagtgacatataaatgcccattaatagctgaagtagaaccagaagatattgactgttggtgtaacttgacgtctacatgggttacttacgggacatgcaaccaagcaggagaacacaggcgcgacaaacgaagtgtagcattggcaccgcatgtggggatgggattagatactagaacacagacgtggatgagtgcagaaggggcatggcgtcaagttgaaaaagttgaaacctgggcgttaagacatccgggttttaccatattagcattatttcttgcccattatataggaacaagccttacacaaaaagttgtaatatttatactattaatgttagtaacgccatcaatgacaatgagatgtgtaggtgtgggcaatagggatttcgtggagggactttcaggggccacttgggtagacgtggtactagaacatggcggctgtgttacaacaatggcgaaaagtaaacctacgctagacatagaattacagaaaacagaggccacacaattggcaacactgagaaaactttgtatcgagggtaaaataactaatattaccacagatagtagatgtccgacacaaggtgaggccacgttgccagaggagcaagatcaaaattatgtatgcaaacatacatacgtagacagaggatggggcaatggctgtggattattcgggaaaggatccctagtcacatgtgcaaaattccaatgtctggaacctatagaaggaaaagttgtgcaatacgagaacttgaaatacactgttataataacagttcacactggggatcagcatcaagtaggcaacgacacgcagggagtaacagtagaaattacacctcaggcatcaacagtggaggcagtcttaccagagtatggcaccctaggtttagagtgttcacctagaaccggattagattttaacgaaatgatattactaacaatgaaaaacaaagcatggatggtacatcgtcaatggttctttgacttgccgctaccctggacttctggtgcaaccaccgagaccccaacttggaatcgcaaagaattgttggtaacatttaaaaatgcacacgccaagaaacaagaagtagttgtactaggaagtcaagaaggtgcaatgcacacggcactaacgggagcaaccgagatacaaaacagtggagggacaagtatcttcgcagggcacttaaaatgtagactgaaaatggataaactagaacttaaagggatgagttatgcaatgtgtctaaatacgttcgtcctaaagaaagaagttagtgagactcaacacggtacgatactgataaaagtcgagtataaaggagaagatgcgccatgtaaaatcccattttcaaccgaagatggccaaggaaaagctcataatggaagattgattaccgctaatcccgtagttactaagaaagaggaaccagtaaatatagaagcagaaccaccattcggcgagagtaatattgttattgggataggagataaggctttgaaaattaattggtacaagaaagggtctagtatcggtaaaatgttcgaggcaacagcaaggggcgcacgcagaatggctattctcggtgatacagcttgggacttcggtagtgtaggaggtgtattgaactcgttggggaaaatggtccatcaaattttcgggagtgcgtatacggccttattctctggagtgtcgtggattatgaaaattgggattggtgttctattaacatggattgggttaaattctaaaaatactagcatgtcctttagctgtatagttataggaataataaccttatatcttggagcagtagtccaagcagatatgggctgcgcaatcaactggaaaggtaaagagttaaaatgcggtagtgggatattcgttactaacgaagtacacacatggacagagcagtataaattccaagcagactcgcccaaaagattggctacagcaatagccggggcttgggaaaatggagtgtgtggtatccgaagcaccacgcggatggaaaatcttctctggaaacagatagctaatgaacttaactacattttatgggaaaacaatataaaactcactgttgtggttggtgatattataggagtgctcgagcaaggcaaacgaacattaactccccaaccgatggaactaaaatattcttggaaaacatggggaaaagcaaaaatagtaacagcagagacgcaaaacagcagtttcatcattgatggaccaaatacgcccgaatgtccatcagcgagcagagcatggaacgtatgggaagtagaagattatggatttggcgtattcacgactaacatctggctgaaattaagagaagtttatacacaaagttgtgatcaccgattgatgagcgcagcgattaaagatgaaagagcagtacatgcagatatgggatattggattgaatcacagaaaaatgggtcgtggaaactagaaaaagcgtcatttatagaagtgaaaacttgcacttggccaaaatcacatactctatggagtaacggggtactagagagtgatatgatcatccccaaatctcttgctggcccgatctcgcaacataaccaccgcccaggataccacactcagacagccggtccatggcatttaggtaaactagaattagacttcaactactgtgaaggcacgactgtggtaataaccgaaaattgcggaacacggggcccaagtctaagaaccacgacagtatctggaaaactaattcatgagtggtgctgccgatcatgcacgcttccgccattaagatatatgggtgaggatggatgctggtacgggatggagattagacccataaatgagaaagaagaaaatatggttaaaagcctggtgtctgctggcagtggcaaagtcgacaacttcaccatgggcgttctatgtctagctatattatttgaggaagttatgcggggaaaatttggtaagaaacacatgatagccggcgtactatttacgtttgtgttactattatccggtcaaataacatggcgcgacatggcacatactttaataatgataggctcaaacgcatctgatagaatgggcatgggtgtgacatatcttgccttaatcgcaacctttaaaatccaacctttcttagccctagggttctttctaagaaaattaacctcaagagaaaacctcttactgggcgttggactagccatggcgacgacgttacaacttccagaagatattgagcaaatggcaaacggtatagcattagggcttatgacattgaaattaataactcagtttgagacctaccagctctggacagcgttggtgagtctaacatgcagcaatactatattcacattgaccgtagcctggagaaccgcgacgctcattttagccggtgtatctttattaccattatgccaatcatcaagtatgagaaaaaccgattggttacccatgacagtggcagcaatgggtgttccaccccttcctttatttatattctcactaaaagatactccgaaaagacgatcttggccattaaatgaaggagttatggcggtgggcttagtaagcatactggcttccagcctattaagaaatgatgtgcctatggctggacccctagttgctggtggactcttaatagcttgctacgtgataacaggcacttcggcagatttgaccgtcgaaaaggcagcagacgtaacgtgggaagaagaagccgaacaaacaggtgtgagtcacaatctaatgataacggtagatgacgatgggacgatgagaattaaagatgatgaaacagaaaacattctaacagtgttactaaagacagcattgttaatagttagtggaatatttccatatagtataccagcgacattattggtttggcacacgtggcaaaaacagacgcaacgatctggtgttctgtgggacgttccaagtcccccagaaacccaaaaagcggaattggaagaaggggtctacagaataaagcaacagggtatttttggaaaaacccaggtaggggtaggagtacaaaaagaaggtgtatttcatactatgtggcatgttacccggggagcggttttgacacacaacggtaaacgattagaacctaattgggccagcgtcaagaaggatttaatcagctacgggggagggtggcggcttaacgcccaatggcagaaaggcgaagaagtacaggtgatagcagtagaacctggaaagaatccaaagaacttccaaacaatgccaggaatttttcaaaccactaccggtgaaataggggctatcgcgctggattttaagccaggaacctcgggtagcccaataataaatcgcgaaggcaaagttgttggcttgtatgggaacggagtggtaacgaaaaatggaggatatgtttcaggaatagcacagactaacgcagaacccgatggtcccacacctgaattagaagaagaaatgtttaagaaacgaaatttaacaataatggatcttcatcctggatcagggaagactaggaaatacctacccgccatcgtgcgagaagcaataaaaaggagactgagaacattaattttagcgcctacgagggtagttgctgccgagatggaggaagcacttaaaggacttccaatccgctaccagaccaccgcaaccaagagcgagcacacaggacgagaaatagtggatctgatgtgccacgctacatttaccatgagattgttaagtcccgttagagttccaaattataatctagtgatcatggatgaggctcacttcacagacccagcgagcatcgctgcaagaggttacataagtacgcgggtgggtatgggggaagctgcggcgatatttatgacagctactccaccgggaacggcagaagcatttccccaaagtaacgcgccaattcaagatgaagaaagagacataccggaaagatcttggaactcgggtaacgagtggataaccgatttcgtaggtaaaacagtgtggtttgtaccgtcaataaaagcgggaaatgatatagcaaattgcctaaggaaaaatggaaagaaagttattcaattatcaaggaagactttcgatacagaatatcagaaaacacgactaaatgattgggactttgtggttacaactgacataagtgagatgggagcaaatttcaaggccgatagggtaatcgatccccgaagatgtctaaaaccagtaattttaacagatggacccgaaagagtaattctagccggacccatgccggtcacggctgcgtcagcagcacaacgacgcgggcgagttggtagaaatcctcaaaaagaaaatgatcaatatatctttacaggacaacctctcaataacgatgaagaccatgcacactggacagaggctaaaatgcttttagataacataaatacaccggaaggtataatccccgccctatttgaacctgagcgggaaaagagcgctgcgatagacggagagtatcgactcaaaggtgaaagccggaaaacatttgtagagctgatgagaagaggagacttgccggtgtggctagcacacaaagtcgcatcggagggaattaaatacaccgatcgtaaatggtgcttcgatggagaacgcaataaccaaatattggaagaaaacatggatgtagagatttggacaaaggaaggagaacgtaagaaactacgcccaagatggctcgatgcgaggacatattccgacccgttagctttaaaggaatttaaagactttgcagccgggcgaaaatccatagctctagatctagtgactgaaatcggaagggttccaagtcacttagctcataggactcgaaatgcactggataacctagtaatgttacacacaagtgagcatggtgggagagcatacagacatgcagttgaagagttaccagagacaatggaaacgttactacttctaggactaatgatattactaactggaggagccatgttatttcttataagcggtaagggaatagggaagacatcaataggtctgatatgtgtaattgtaagttccggaatgctgtggatggcggatgttccattgcagtggatcgcctccgctattgtcctagaatttttcatgatggttttattaattccggagcccgagaagcaacgaacgccacaagataaccagttagcatacgttgtaatcggcatacttacactggcggcaattgttgcagcaaacgaaatgggactactagagactacaaaaagagatcttggcatgagtaaagaacctggcgtggtcagccccacaagctacttagacgtagatctacatccagcgagtgcgtggacgctatacgctgtcgcaacaacggttattacaccaatgcttcgacatacgattgaaaactcaaccgcaaatgtgagccttgcagccatagctaatcaggctgtagtattgatgggattggataagggatggccaatttctaaaatggatctcggagtacctcttctcgcattgggatgttattcacaagtaaatccactaacactcacagccgccgtattactacttgtaacacactacgcaataatcggaccaggattacaggccaaagcgaccagagaagcacaaaaacgtacagccgccggaataatgaaaaacccaactgttgatggtattatgactatagacttagatccagtaatatacgattccaaattcgagaaacaactaggacaggtaatgttactcgtcctttgcgccgtccaactcttgctcatgagaacatcatgggccctatgtgaggctttaacattggcaaccggtcctataacaacattatgggaaggatccccaggaaaattttggaatactacaattgctgtttcgatggctaatatttttcggggatcctacctagccggtgcggggttagccttcagtattatgaaatcagtaggcactggtcgtcgaggcaccgggtctcaaggcgaaacactgggagaaaaatggaagaagaaactaaatcaattaagccgtaaagaatttgatttatataagaaatccgggataacagaggttgatagaactgaagcaaaagaaggtctaaaacgaggtgagactactcaccacgcagtgagccgaggctcggctaagttacagtggtttgttgagaggaatatggtaatccctgaaggtagggttattgatttaggatgcggacgtgggggatggtcatattattgtgcgggactaaagaaagttactgaagtaaggggttacacgaaaggaggtcccggtcacgaagaaccagtccctatgtcaacatatgggtggaacatagtaaaactcatgtctggtaaagatgtattttatctaccaccagagaaatgcgatacgttattatgtgatatcggggaaagttcaccttctccgaccgttgaagaaagcagaaccataagagtgcttaaaatggtagaaccgtggcttcgtaacaatcagttttgtataaaagttctgaatccctatatgccaaccgtaatcgaacatctcgagaggttacaacggaaatatggtggtatgcttgtcagaaacccactatccagaaattctacacatgaaatgtactggataagcaatggaaccgggaatatagtatcatcagttaacatggtaagtagacttctacttaaccggtttactatgactcatcggcgacctacaatagaaaaagacgtagatctaggtgcgggcacacgccatgttaatgcggagccagaaactccaaacatggatgttataggagaaaggattaaacggatcaaagaagaacatagttccacatggcactatgatgatgaaaatccatacaagacatgggcctatcacggatcgtatgaagtcaaggctacaggatcagcatcctcaatgataaatggagtggtaaaactattaacgaaaccatgggatgtagtacccatggtgacccaaatggctatgaccgacactaccccgttcggtcagcaaagagtctttaaagaaaaagtagatacaagaacaccaaggcctatgccagggacccgaaaagtgatggaaatcacggccgaatggttgtggagaacgttgggccgaaataaaaagcctcgactatgcactagggaagaatttaccaagaaagtacgaacaaatgccgctatgggggcagtattcacagaagaaaatcagtgggattcagctagggctgcagtagaggatgaagagttctggaaacttgtagatagggaaagagaactccacaagctaggaaaatgtgggtcctgtgtttacaatatgatgggtaagagagagaagaaattaggcgagttcgggaaagcaaaaggatccagagctatctggtacatgtggttaggcgcacgctacctagagtttgaggcattaggtttcttaaatgaagaccactggtttagtagggaaaactcgtatagcggtgtagaaggtgaagggctacataaattaggttacattctccgagacataagtaaaattccgggtggggctatgtatgcagatgatactgcgggatgggacactagaataacagaggatgatttgcataatgaagagaaaatcacgcaacagatggatccagaacatcgacagctagcgaatgcgattttcaaactgacgtatcaaaataaagtggttaaggtgcaaaggcctacccctaagggaacagttatggatatcatctctaggaaggatcagcgcggatcaggacaagtcggtacgtacgggttaaatacatttaccaatatggaggcacaattggtccgacaaatggaaggcgaaggagtcctatctaaggccgacttagaaaatccccatctattagagaagaaaattactcaatggttagagacaaaaggagtagagcgattgaagcgtatggcaattagcggagatgattgtgtggtgaaaccaatagatgatcgattcgcgaacgcgctcctcgcacttaacgacatgggaaaagtgagaaaagatataccccaatggcaacctagtaaaggatggcacgactggcaacaagtaccattttgttctcatcattttcatgagttaataatgaaagatggacgaaaactggtggttccatgccgacctcaagacgaattaattggaagggcaaggatatctcagggagccggttggtctttgaaagaaacggcatgcttagggaaggcttatgcgcagatgtggtctttaatgtattttcatagacgtgaccttcgactcgccagcaatgcaatctgctcagccgtaccagtacattggatacccacttcgaggacaacttggtccatacatgcacaccaccaatggatgacgaccgaagacatgttaactgtttggaacagagtatggatagaggataatccatggatggaggataaaactccagtaacaacgtgggaagacgtaccatacctaggaaagcgtgaagaccaatggtgtggatcattgataggtctaacttcacgagcaacgtgggcacaaaatatactaacggccatccaacaggttcgatcattaataggggatgaagagttccttgactatatgccttccatgaaaagattcagaaaagaagaagaaagcgaaggcgcaatttggtag

SEQ ID NO: 23102 - RNA, 9873 nt, synthetic construct
  misc_feature 1..9873: note = derived and/or modified CDS sequence (opt6) from DENV-3__GU131908__SS-prME
  source 1..9873: mol_type = other RNA
acatctctttgcttaatgatgatgttacctgcaacgttagcttttcatttaacgtcaagagatggggaaccacggatgatagttggtaaaaatgaacgaggaaaaagtctgctgtttaaaacagcatctggtataaatatgtgtacactgattgcaatggacttaggagaaatgtgtgatgacactgtaacttataaatgcccattgatagcagaagtagagccagaagatatcgattgctggtgcaacttaacatcaacgtgggtgacatatggaacatgtaaccaagctggagaacatagacgcgataaaaggagcgttgccttagcacctcatgtagggatgggactggacacgaggacacaaacctggatgagcgcggaaggagcatggagacaagttgaaaaagtggaaacatgggctttacgacatccaggttttaccatattagcactatttttagcccattacatagggacatcccttactcaaaaagtggtaatctttatactactgatgctagtaacacccagtatgactatgaggtgtgtgggtgtaggcaaccgggactttgttgaaggtttaagcggcgcaacttgggtagatgtagttttagagcacggagggtgtgtaactacaatggccaaatcgaaaccaacgctagacatcgaacttcagaaaacggaggcaacacaacttgccacccttagaaaactgtgtatcgaaggaaaaataacaaatataactacagactctagatgcccaactcaaggagaagcgactctacccgaagaacaagaccaaaactacgtatgtaaacacacatatgttgacagaggatggggcaatggatgtggtttatttggaaaagggtctttagtcacgtgtgcgaaatttcaatgtctggaacccatagaaggtaaagtcgtgcaatacgaaaacttaaaatatactgtcattatcactgtgcacacaggggaccaacatcaggtcggaaatgatacacaaggtgtcacagttgagattacccctcaggcttccaccgtagaagcggtcttaccagagtatggtacactgggattagaatgctcgccaaggacaggattggattttaatgagatgatattactaaccatgaaaaataaagcatggatggtacatcggcagtggttctttgacctaccgttgccttggacatcgggagcaacaactgaaacgccgacctggaatagaaaagaactcttagtaacatttaaaaatgcccatgccaagaaacaagaagttgtagtactaggctcgcaagaaggcgcaatgcatactgctctgacaggggcaacggagatccaaaacagcggagggactagcattttcgctggtcacctaaaatgccgtctaaaaatggataaattagaactaaaaggtatgagttacgcaatgtgtttgaacacttttgttctcaagaaagaagtaagtgaaacacagcatggcactattctcataaaagttgaatataaaggcgaagacgcgccatgtaaaataccgttttcaaccgaggatggacaaggaaaagcacataacggaaggctgataaccgctaatccggtggttaccaagaaagaggagccagtaaatatagaagcagagccaccattcggcgaatccaatatagttatcggaataggtgacaaagcactaaaaataaattggtataaaaagggttcatcgataggcaaaatgtttgaagctacagcacgaggtgcccggcgaatggcaattctgggagatactgcctgggactttggaagtgttgggggagtactaaattcacttggaaaaatggtacatcaaatattcggttccgcatacacagcattgttttccggagttagttggattatgaagatagggatcggagtactccttacatggattgggttaaacagtaagaacacctcgatgtccttctcatgtatagtaataggcataataactctctacttgggggctgttgtgcaagcggatatgggatgtgcaatcaattggaaaggtaaagagctaaaatgcggatctgggatttttgttaccaatgaagttcacacatggacggaacagtacaaattccaggccgacagcccaaaacgattagcaacagcgatcgccggtgcatggaagaatggagtatgcggaataagaagcaccaccaggatggagaacttattatggaaacaaattgcaaacgagttaaattacattttatgggagaataacattaaattaaccgtggtagtcggcgatataatcggcgttctcgagcaaggcaaacgaacattaacacctcagcctatggaactgaaatattcatggaaaacctggggaaaagcaaaaatcgtgacagcggagacacaaaacagctcattcataattgacggtccaaatacgccggaatgtccgtccgctagtcgcgcctggaacgtatgggaagtggaagactatggtttcggtgtatttacaacaaacatctggcttaagctaagggaagtatatacacaaagctgtgatcatagacttatgtcagcggcgatcaaggacgaacgtgcagttcatgcggacatgggatactggatcgaatcacaaaagaatggatcatggaaactagaaaaggcctccttcatcgaagttaaaacttgtacctggccgaaaagccatacactgtggtccaacggcgtccttgaaagtgacatgattatacctaaatccctagcaggacctatttcccaacacaaccacagaccaggttaccatactcaaacggcgggaccgtggcacctgggcaaactagaactagacttcaattactgcgaaggaactacggttgttataaccgagaattgtgggactagaggcccgagcctgagaacaaccacggtgtccggtaagttaattcatgaatggtgttgtcggagttgtacattacctccgttgagatatatgggtgaagatggttgttggtatggaatggaaattagacccattaatgaaaaagaagagaatatggttaagtctctagtatcggcaggctcaggcaaagtcgataactttacgatgggagtgctttgtttggctatattattcgaagaagtaatgcgcggcaaatttggcaagaaacatatgatagctggagtcttatttacatttgtgctattgttaagcggacagataacatggcgagatatggctcatacccttataatgataggaagcaatgcatccgatagaatgggcatgggcgttacatacttggcactcatagccacatttaaaatacaaccatttctagcattaggattctttctaagaaaattaaccagcagagaaaatttactactaggggtgggtctggccatggctacaacactccaactacccgaggatatcgaacaaatggcgaatggcatagcattaggattaatgaccttaaaattaataactcaattcgagacctatcaactctggacggcgctagtctcattaacctgtagcaatacaattttcactctcacagtggcctggcgtaccgcaacattaatattagccggagtcagcttattgcctttatgccaatcaagttctatgaggaaaacagattggttacccatgacagttgccgcaatgggagtccctcccttgccactttttatattctccctaaaagacactccaaaacgtcgctcatggcctttaaatgaaggggtaatggcggtaggcctagtatctatcctcgcttcaagtcttttgcggaatgatgtgccaatggcgggaccattggttgccggtggtttactaatagcatgttatgttattactgggacgtctgctgacctaacggtagaaaaagctgcagacgtaacatgggaagaagaagccgaacaaaccggtgtatctcataatcttatgataacagtagacgacgacgggaccatgaggattaaggatgatgaaactgaaaatatattaacagttctactaaaaactgcactactaatagtttctggtatttttccatattcaattcctgctacactacttgtatggcatacgtggcaaaaacaaacgcagcgatctggtgtcctatgggacgttccatctccacctgagactcaaaaggctgagcttgaggaaggagtctatagaattaagcagcaaggcatttttggtaagacacaagtaggagtaggagtccaaaaagaaggcgtcttccataccatgtggcatgtaacaagaggtgctgtacttacccacaacggaaaaagattagaaccaaattgggcttcagtgaaaaaggacttaatatcatatggtggtggttggcgattaaacgcacagtggcagaagggggaagaagtacaagtcatcgccgttgagccaggtaaaaaccccaaaaattttcaaaccatgccgggtatcttccaaaccacgacaggtgaaataggagcaatagcgctggattttaaaccaggcacgagtggcagtcccataattaatcgtgaaggaaaggtagttggactgtatggaaacggtgtggttaccaaaaacggcgggtatgtatctgggatagcacaaactaacgccgaaccagacggtcccacgcccgaactcgaagaagagatgttcaagaaacgaaatttaactataatggatttgcatcctggctctgggaagactcgaaaatatctaccagcgatcgtgagagaagcaatcaagagacgtctacggacattaatattggcgccgaccagagtagttgcagccgaaatggaagaagcgctcaaaggtcttcccatcagataccaaaccacggccacaaagtcagagcacacaggccgggaaattgtggatttgatgtgccacgctacctttaccatgaggttgctatctccagtgcgtgtaccaaactacaacctggtcataatggatgaagcacattttaccgaccctgcatctattgcagccagaggatatatatcaactcgagtcggaatgggtgaggcagctgccatttttatgacagctactccacccggtacagcagaggcttttccacaaagcaatgcgcctatccaagatgaagaaagggatatccctgaaagatcgtggaacagtggaaacgaatggatcacagattttgtcggtaagactgtatggttcgttccatcaattaaagccggtaatgatatagcaaattgtttacggaaaaatggaaagaaggtaatccagttatcgagaaaaacatttgacaccgaataccagaaaactagactaaacgattgggatttcgttgtaacgacagatatctccgaaatgggagcaaatttcaaagcagatcgagtcatcgaccctagaagatgtttaaagccagtcattttaactgacggcccagaaagagtaatcttagcgggccccatgccggtaactgcagctagtgccgctcaacgtcgaggacgagtcgggagaaatccacaaaaagaaaacgatcaatacatatttacaggtcaaccgttgaataatgatgaagaccatgcacattggacagaagccaaaatgctcctggataatataaatacgccagaaggaattatacctgcactttttgaacctgaaagggaaaaatctgcggcaatagatggcgaatatcgactgaaaggcgagtcgcgtaagacttttgtagaattaatgagaagaggcgatttacctgtatggcttgcacataaagtcgcaagcgaaggtattaagtacaccgataggaaatggtgttttgatggtgagcgaaataaccagatattggaagagaatatggacgtggaaatatggacaaaagaaggagagaggaagaaattaagaccgaggtggctagacgctcgcacttactcggaccccctagcactaaaagaatttaaggattttgcagcgggccgtaaaagcatagcactggatctagttacagaaataggacgagtaccatcacatctagctcaccgtaccagaaatgcattagacaaccttgtaatgttacatacgtcagagcatgggggccgagcctaccgtcatgcagtagaagaactaccggaaactatggaaaccttgcttctgttaggattgatgattttattaacaggaggtgctatgctatttttaataagtggtaaaggaataggtaaaacatctataggattgatatgtgtaattgtaagtagtgggatgctatggatggcagacgttccgcttcaatggatagcatctgctattgtgctagagttctttatgatggttctcttgataccagaaccagaaaaacagagaacacctcaagataatcaactcgcttatgttgttataggtatacttacattagcagcaatcgttgctgctaacgaaatgggactattagaaacaaccaaaagagatctaggcatgagtaaagaaccaggagtagtgagtccgactagctacctcgatgttgatctgcatcccgcgtctgcttggaccttgtatgctgttgccacgacagtaataacaccgatgttaagacatacaatagaaaattctacggcaaacgtatcgctagcagccatagcgaaccaagcggtagtactgatgggactagataaagggtggccaatctcaaagatggacctgggtgtcccattgttggcattaggctgctattctcaagtaaatccactcacacttacagccgccgtactattattagttacccactatgctattataggtccgggtttgcaagcaaaagcaacaagagaggcacagaagcgcacagcagcagggataatgaagaaccccacagttgatgggattatgactatagatttagaccctgttatctatgactctaaatttgaaaaacaactaggccaagtaatgcttctagtattatgtgcggtacagttattgctaatgagaacttcttgggctctttgcgaggctctgactcttgccactggacctataaccaccctatgggagggaagccctggaaaattctggaatacaaccatcgcagtatcaatggcaaatattttccgcggatcgtatctagcaggagcaggtttagctttctcaatcatgaaaagtgtaggtactggtagacgaggaactggttcacaaggagaaacgttaggagaaaagtggaagaagaaattaaaccagctaagtcgtaaagaatttgatttgtacaagaaaagcggaattacagaggtagatagaaccgaagccaaagagggtttaaaaagaggcgaaactacacaccatgcagtatcaagaggtagcgctaaattacaatggttcgttgaacgcaacatggttattccggaaggacgggtaatagatttaggttgcggacgaggtggatggtcgtactattgcgctggattaaagaaagttacagaggttagaggttatacaaaaggcggtcctggacacgaagaacccgtccctatgagtacttacgggtggaacatcgtaaaacttatgtctggtaaagatgtgttttatttaccacccgaaaagtgcgatacgttattatgcgatatcggggaaagctcaccttccccaacggttgaagaatctaggactatcagggttttaaaaatggttgaaccttggctccgtaacaatcaattttgcataaaagtgctaaatccatacatgcccacagtaattgagcatttggagcgattgcaacgaaaatacgggggaatgcttgtaagaaatcctctttcgcgaaacagtacacatgaaatgtattggatttctaatggtaccggaaacattgtctctagcgtcaatatggtatcacggctgttattgaatagatttacaatgactcatcgcagacctacaattgaaaaagacgtagacttgggagctggaactcgacatgtaaatgctgaaccagaaacaccgaatatggatgtaatcggcgaaaggataaaaaggataaaagaagaacattcgtcaacctggcattatgatgatgaaaatccatacaagacatgggcttatcacggatcgtatgaggtaaaagcaaccggctcggctagttcaatgataaacggggtggttaagctactcaccaaaccctgggacgttgtccctatggtgacccaaatggccatgacagatacaacgccatttggccagcaaagagttttcaaagaaaaagttgatacaaggaccccacgcccaatgccggggactaggaaggttatggaaataacagctgagtggctctggcgaacgttaggtcgtaataagaaacccaggctatgtacgcgcgaagaatttaccaagaaggtaagaaccaatgccgcaatgggagcagtttttaccgaggaaaatcaatgggactctgcgagagcagctgtagaagatgaagaattttggaaattagttgacagagaaagagagctacataaattgggcaagtgtggatcatgtgtatacaatatgatgggtaaaagagagaagaaacttggggagttcggtaaagcaaaaggtagcagagctatatggtatatgtggctaggtgcaagatacctagaatttgaagcacttggtttcttgaatgaagatcattggttttccagagagaatagttattcaggagtagaaggagaaggtttacataaattgggatatatactccgagacatatctaaaataccaggcggcgctatgtatgcagacgatacagcaggttgggatactagaatcactgaagacgatctacataatgaagagaaaattactcagcaaatggatccagagcaccgtcagttggcaaatgcaatatttaaattgacatatcaaaacaaagttgttaaagttcaaagacccactcccaaaggaactgttatggatatcattagcagaaaggatcagagagggagtggacaagtaggaacatatggacttaatacttttactaacatggaagctcagctcgtacgtcagatggagggtgaaggcgttttaagtaaagcagatctagaaaacccgcacttgctcgagaagaaaataactcaatggctagaaacaaagggggtagagaggttaaaaaggatggctataagcggagatgattgtgtcgttaaacctatagacgatcggttcgcaaacgccctccttgctttaaacgatatgggtaaagttagaaaggacataccacagtggcaaccttccaagggctggcacgactggcaacaagttcctttttgctcacatcattttcacgaattaatcatgaaggacggtagaaaattagtagttccttgtcgacctcaagacgaacttataggtagggcgagaatctctcaaggagctggttggtcattaaaagaaacagcatgtcttggaaaggcttatgcgcaaatgtggagccttatgtatttccatcgacgcgatctaaggcttgcatctaatgccatctgttccgcagtccctgtgcactggatcccaacaagcagaactacgtggagtatacatgcacatcaccaatggatgaccaccgaagacatgttgactgtctggaatagagtatggatcgaagataatccttggatggaagacaagacaccagttacaacgtgggaagatgtaccctatttagggaaacgcgaagaccaatggtgcgggagcttaattggtctaacatcgcgcgcaacatgggcacaaaatatcttaactgcaattcagcaagtacgatcgcttataggtgacgaagaatttttagattatatgccctctatgaaacgcttcaggaaagaagaagagtcagaaggtgctatctggtag

SEQ ID NO: 23103 - RNA, 9873 nt, synthetic construct
  misc_feature 1..9873: note = derived and/or modified CDS sequence (opt6) from DENV-3__GU131909__SS-prME
  source 1..9873: mol_type = other RNA
acttcattgtgtctaatgatgatgttaccagcgacacttgcattccatttgacatccagagatggggaaccccgtatgatagtaggtaaaaatgaaagaggaaaatcattattatttaaaacggcttctggtataaacatgtgtacactaatagccatggatcttggtgaaatgtgtgatgacaccgtaacgtacaaatgtcctttaatagcggaagttgaacctgaagatattgactgctggtgtaacttaacgtcaacatgggtcacctatggaacttgtaaccaagccggtgaacataggcgcgataaaagatcagtagcactagcacctcacgtaggcatgggtctagatacacgaacacaaacatggatgtccgctgaaggagcgtggagacaagttgaaaaagtggaaacatgggccttcagacaccctggttttactatcctagctctattccttgcccattatataggcacctccctaacgcaaaaagttgtgattttcatcttactaatgttggttaccccgtcgatgactatgcgttgtgttggagtaggaaatagagatttcgttgaagggctatctggggctacctgggttgatgtagttttggaacatggtggctgtgtgactactatggcaaaatctaaacctacattagacatagagttacagaaaacggaagctacacaattagcaacacttcgtaaattgtgcatagaaggcaaaattacaaatattactacagatagtaggtgtccaacccaaggggaggcgacattgcccgaagaacaagaccaaaattatgtgtgcaaacatacatatgttgataggggatggggcaacggttgtggcctatttggcaaaggatcgctggtaacatgtgcaaagttccaatgtctggagccaattgaaggaaaggttgtccaatacgaaaacctgaaatacacagtaattataacagttcatactggcgatcaacatcaagtaggaaacgacacacaaggagttacggtagagataacgccacaagcgagtacagtagaggcggttttgccagaatatggtactttagggttagagtgcagccctagaacgggtctggattttaacgagatgatattattaactatgaaaaataaagcatggatggtacatagacaatggttctttgacttgcctctgccatggacaagtggagcaacaacggagactcctacgtggaaccgtaaagaattacttgtcacattcaaaaacgctcacgccaagaaacaagaagttgtagttttaggaagtcaagaaggggctatgcatacagcccttacgggagcgactgagatacaaaacagtgggggcacatcaatcttcgctggccatttaaagtgcagacttaaaatggataaacttgagttgaaagggatgtcctatgcgatgtgcttaaacacctttgtattaaagaaagaagtaagcgaaacgcaacatggtaccatacttatcaaagtagaatacaaaggagaagacgcgccttgtaaaataccattctcaacagaagatggccagggtaaagcacacaacggcaggttaataactgcgaatcctgtagttaccaagaaagaagaaccagtgaatatagaggccgaaccgcctttcggcgaatctaatatagtaatcggtataggcgacaaagctcttaaaataaactggtacaagaaaggtagcagcattgggaagatgtttgaagctaccgctcgtggcgctcgaagaatggccattctgggtgatactgcgtgggattttggcagtgtgggcggagttctaaactctttgggaaaaatggttcatcaaatatttgggtcagcctatacggcactattttcaggcgtgtcatggattatgaaaatcggtatcggcgtattactaacttggattggactaaacagcaaaaacaccagcatgagtttttcttgtatcgtgatcggcataatcactctatatttaggagccgtagtacaagctgacatggggtgtgccattaattggaaaggaaaggagttaaaatgtgggagcggcatatttgtaactaatgaagtccatacttggaccgaacaatataagtttcaagcagattcaccgaaacgactagccacagcaattgctggtgcttgggaaaacggtgtatgcggtatcaggagcactactaggatggaaaacttgctttggaaacaaatagctaacgaattaaattacattttatgggaaaacaatataaaactaacagtggtagtaggagatataataggagtactagaacaaggtaaaagaaccctaactccacaacctatggaattgaaatatagttggaaaacatggggtaaagcaaagattgtaacagcagagacccaaaatagcagttttatcattgacgggccaaatacaccagagtgcccctcggcaagcagagcatggaacgtctgggaagtagaagactatggattcggggtattcaccacaaacatttggcttaaacttagggaagtgtatacacaatcctgtgatcatcgccttatgtcagcagcgatcaaggacgaacgcgctgtacatgcggatatgggctattggatagaaagccagaaaaacggaagctggaaacttgaaaaggcttcttttattgaggttaaaacatgcacatggccaaaatcacacactctatggtcaaatggagtgttagaaagcgatatgatcattccaaaatctctagcaggaccaataagtcagcacaaccatagacctggttatcatacacagacagccgggccttggcatctcggaaaactagagttagattttaactactgtgaaggaacgacagtagttataacggagaattgcggaaccaggggaccatcgttaaggactacaactgtgagtggaaaactaatacacgaatggtgctgtaggagttgtaccttacctccgctaagatacatgggagaagatgggtgctggtatggaatggaaatacgacccattaatgaaaaggaagaaaacatggtaaaatccttagtaagtgcaggtagcggaaaagtagataactttacaatgggtgttctatgtttagccatactttttgaagaagtaatgcggggaaaattcgggaaaaagcatatgatagctggagtactgttcacgtttgtccttttattatcaggtcaaataacgtggcgtgatatggctcacacgctaattatgattgggtccaacgcctccgatagaatgggaatgggggtgacgtatctcgcacttatagcgacttttaaaatacaaccgtttctagcccttggattctttttacgaaaactcacatcaagagagaacctattgttaggggtagggctcgcaatggctacgaccttacaattaccagaagatatagagcaaatggcaaatggcatcgcgcttggtttaatgacattaaaattgattactcaatttgaaacatatcagttgtggacagccctggtctcattaacctgctctaataccatttttacactaaccgtagcctggaggaccgcaactttaatcctggcaggggtatcattactcccactctgccagagttcatccatgagaaagactgattggctgcctatgaccgtcgctgcgatgggggtcccaccattacccctctttatattctccctgaaagacactcccaaaagaagatcatggcctttaaatgagggtgtcatggcagtgggtctagtgtcgattctagccagctcacttttgagaaatgatgtgcctatggccggaccattagtcgctggaggcctgttaatagcatgctacgtcataactgggacgtctgccgacttgactgtggaaaaagctgctgacgtcacatgggaagaagaggcagagcaaactggagtttcacacaacttaatgataacggtcgacgatgatggaactatgagaatcaaagacgacgaaacagaaaacatcctaaccgtcctactcaaaactgcgttgttgatagtctctggaatatttccttattcaatcccagctactctcctagtatggcatacatggcaaaaacaaacgcaacgatctggtgttttatgggatgtaccatcaccaccggagactcaaaaagcggaactagaagagggtgtatatagaatcaaacaacaaggaatctttggaaaaacacaagtaggagttggagtacagaaagaaggtgtattccatacaatgtggcatgtaacaaggggagcagtattaacgcataacgggaagagactagaaccgaattgggcatctgtcaagaaagacctaatatcttatggcggtggttggcgattaaatgcacaatggcaaaaaggtgaggaagtacaagttatagcggtcgaaccaggaaagaatccgaaaaacttccagacaatgcctggaatttttcaaacaacaactggtgaaataggtgcaatagcactcgattttaaaccaggaacgagtggttcaccaataattaaccgggaaggtaaagttgtagggttatatggaaatggagtagttactaaaaacggagggtacgtatcaggaatagcacaaacgaatgccgaaccagatggtccaacccctgagctcgaagaagaaatgttcaagaagagaaatctcacaattatggaccttcaccctggtagcggtaagacccggaaatatctaccagccatagttcgtgaagccatcaaacggagactgagaacacttattttagcaccgaccagagtggtcgccgcagagatggaagaagctctaaagggtctacccatacgttaccaaaccaccgctacaaaaagcgaacatacgggtcgcgaaatagtcgatctaatgtgccacgctacattcactatgcggcttctttcgcctgtccgtgtccctaattacaatttagttattatggacgaggcccattttactgaccctgcgagtatagctgcacgtgggtatatcagtactagggtaggcatgggggaagctgcagcaatcttcatgactgcaaccccaccgggaacggcagaggcgttcccccaatcgaatgcacctattcaagacgaggaacgagatattcctgaaaggagctggaatagcggaaatgagtggataacggactttgttggcaaaacagtttggtttgtaccatcgataaaagctggaaatgatatagccaactgtcttaggaaaaacggcaagaaagttatccaactaagtagaaagacatttgacacagagtaccagaaaacgcgactgaatgattgggattttgtagtcacaacagatataagtgaaatgggagccaactttaaggccgacagagtgattgatcctcgccgatgcctaaaaccagttatactgactgacggaccggaaagagtaatacttgcaggtcctatgccagtaactgcggcgagcgctgcacagaggaggggacgcgtaggcaggaacccccaaaaagagaacgatcagtacatattcacgggccaaccactaaataatgatgaggatcacgcacattggacagaggcaaaaatgttgttggataatataaatacacctgaagggattatccccgctttgtttgagcccgagagagaaaaatcggcagccattgatggcgaatatagactaaaaggtgaaagcagaaaaacatttgtagaattaatgcgaagaggagacttaccagtttggctagctcataaagtcgcgagtgaaggaattaaatacacagataggaaatggtgtttcgatggagagagaaataaccaaatactggaagaaaacatggatgtagaaatctggacgaaagaaggagagcggaagaaactaaggcctcggtggttggatgctcgtacctattccgatcctctagcacttaaagagtttaaagatttcgcagctggcagaaaatccatagccctggacttagtcacggagattggtcgcgtaccttctcatcttgcgcatcgtactagaaatgcactagacaatctcgtaatgcttcacacaagtgaacatggaggacgagcatataggcatgcagtggaagaactacctgagacaatggaaactttacttctgttaggtctaatgatattgcttacaggtggtgcgatgctattcttaatatcaggaaaaggaataggaaagacttctatagggttaatttgtgtaattgtaagctcaggtatgctttggatggcagacgtccctttgcagtggattgcctcggccattgtattggaatttttcatgatggtattactaatacctgaaccggaaaaacaacgaacaccacaggataaccaacttgcgtatgtcgtgattgggattctgacattagctgcaattgtggctgcaaatgaaatgggactattggaaacaactaaaagggacctggggatgagcaaggaaccaggcgtagtatctcctacgagttacttggacgtagatttacatcccgcaagcgcctggacattatacgctgtggcaacaacagtaataacgccaatgctaagacatactatcgaaaattcaactgcaaacgtatcattagctgctattgcaaatcaagcagtggtcctcatgggattagacaagggatggcctatatccaaaatggatttaggagtgccactgctggcgctaggttgttatagccaggtaaatccactaactctaacagcggcagtgctcctattggtcacccattatgccattataggtcccggactacaagccaaagccacacgtgaagcacagaaaagaacagctgcaggtataatgaaaaatccaactgtcgatggtataatgacaatcgacttagaccctgtgatatatgatagcaagtttgaaaaacaactaggacaagtaatgctcctagtactatgcgctgtacaactattactaatgaggacctcatgggctttatgtgaagcactcacattagccaccgggccaataacaacactatgggagggaagcccaggaaaattctggaatacgactatagcagtttcaatggctaatatcttccgaggtagctatttagctggagccggcttagcgttttcaattatgaaaagcgtaggaacaggccgacgaggaacaggatctcagggtgaaacactaggtgagaagtggaagaagaaactgaatcagctctctcggaaagaatttgatttatataagaaatcgggaataactgaagtagacaggacagaggctaaagaagggttgaaaaggggcgagactactcatcatgcagtatcacggggatccgctaaactccaatggttcgttgaacgtaatatggtaatacctgagggaagagtcatagatttagggtgtggaagaggaggatggtcatattactgtgccggcctcaagaaagtcacagaggtgaggggatacacaaaaggaggtcctgggcacgaagaaccagtaccaatgtcgacttacgggtggaacatcgtaaaattaatgtcaggaaaagatgtattttatctaccaccagaaaaatgtgacacactcttatgtgacataggagaatcatcacctagtccgacagtagaagagtcaagaacaataagagtcttaaaaatggtagaaccatggttaaggaacaaccaattctgcataaaagtgttaaatccctacatgccaacagtgatcgaacatcttgagcggctccagagaaaatatggtggaatgttggtaagaaatccactttctagaaattctacacacgagatgtattggattagtaatggaaccggaaatattgtctcaagcgtaaatatggttagcagacttcttttaaatagattcacaatgactcacagacgaccaacaatagagaaggacgtagatttaggagctggaaccaggcacgttaacgctgaaccagaaaccccaaacatggatgttattggtgaaagaattaaaagaataaaggaagaacatagtagtacatggcactacgatgatgaaaacccatacaaaacatgggcataccatggttcttatgaagtgaaagccacgggtagcgcaagttctatgataaacggagtagttaaactcctcaccaaaccttgggacgtggtaccaatggtcactcaaatggcgatgacagacacaactccgtttggtcagcaacgagtatttaaagaaaaggttgataccagaactccccgtcctatgccaggtacacgcaaggtcatggaaattacggctgagtggctttggcgcaccttaggaagaaataagaagccccgtttgtgcaccagagaagaatttactaagaaagttcgtactaacgcagcaatgggagcggtattcacagaagaaaaccagtgggactctgcaagggccgcggttgaggatgaagaattttggaaattagtggatagagaacgagaactacacaagctaggtaaatgtggaagttgtgtatacaacatgatggggaagcgagagaagaaactcggggaatttgggaaagcgaaaggaagccgtgcgatctggtatatgtggttaggagctaggtatcttgaatttgaggcactgggatttcttaatgaagatcattggttctcaagagaaaatagctatagcggcgtcgagggagaagggttgcacaaactaggatacattttgagagacatttcaaaaattccaggtggggcaatgtatgcagatgacacggcagggtgggataccagaataactgaagatgacctgcataacgaagagaaaatcacacaacaaatggaccccgaacacagacaacttgctaatgcaatatttaaattaacgtaccaaaacaaggtagttaaagtacagcgccccacgccaaaggggacagtaatggacataatatcaaggaaagatcagcgaggaagtggacaggtgggtacctacggattaaatacattcactaacatggaggcacagctagtccgccagatggagggtgaaggagtccttagcaaagccgatctggaaaatccacacctactggaaaagaagataacccaatggcttgaaacaaaaggggtagaacgcttaaaacggatggcaataagtggagacgattgtgtagtaaaacctattgatgacagatttgcgaacgcactattagcattaaacgatatgggtaaagttcgcaaagatatcccccaatggcaaccaagcaaaggctggcacgattggcaacaagtaccattttgttctcatcatttccatgaactgatcatgaaagatggacgtaagctagtcgtaccttgtcgaccccaagacgaactcatcggtagggcccgcatatcgcaaggggctggatggagtctcaaggaaacagcgtgtctcggcaaagcgtatgcccaaatgtggtcactgatgtactttcatcgacgagatttgagacttgctagcaatgctatatgcagtgctgtaccagtccattggatcccgacgagtcgaactacctggagtatacatgcacatcaccagtggatgacaacagaagacatgctaacagtctggaaccgggtgtggattgaggacaacccttggatggaagacaaaacaccagtaacaacgtgggaagatgttccatatctcggcaaacgagaggaccaatggtgcggttcactgattggtcttacttcccgtgcgacatgggcacagaatatactaacagctatccaacaagttcgcagcctaatcggagacgaagaatttcttgattatatgccatcaatgaagagatttagaaaagaagaggaatcggagggagcgatctggtaa

SEQ ID NO: 23104 - RNA, 9873 nt, synthetic construct
  misc_feature 1..9873: note = derived and/or modified CDS sequence (opt6) from DENV-3__GU131912__SS-prME
  source 1..9873: mol_type = other RNA
acgagtttgtgcctgatgatgatgcttccggcaacactagcgtttcatttaacttcaagagacggggaacctaggatgattgtaggtaaaaatgaacgaggaaaatctcttctcttcaaaacggcatcaggaataaatatgtgcacactaatagccatggatctaggagagatgtgtgacgacacagtgacatacaaatgcccattaattgcggaggtcgaaccagaagatatagattgttggtgtaatttgacaagtacttgggtcacttatggaacatgtaatcaggcaggagagcacagaagagataaaagaagtgtcgcattagccccgcacgtaggaatgggattagacaccaggacacaaacttggatgagcgctgagggagcatggagacaggtcgaaaaagtagaaacatgggcattaaggcatccgggattcaccatcttagcactatttctggcacattacatcggaacaagtctgacccagaaagtagtaattttcattctcttgatgttggttacaccatcaatgacaatgaggtgtgttggtgtagggaacagagacttcgttgaaggactttccggtgcaacgtgggtagatgttgtgttagagcatggtgggtgtgtcacaaccatggcaaaaagcaaaccaacgttagatatagagctacagaaaactgaagcaacacaactggctactcttcgaaaactttgcatcgaaggaaaaataactaacattacaacagattctcgatgtcctactcaaggggaagccactttaccagaagaacaagaccaaaactatgtttgtaaacatacttacgtcgaccgaggctggggcaacgggtgcggccttttcgggaaaggtagtttggttacgtgcgcaaaattccagtgcctggaaccaatagaaggcaaagtagtccagtatgagaacctgaaatatactgttataattactgtacataccggggatcaacatcaagtaggtaatgacacgcagggcgtcacggttgagattactcctcaagcctcaacagttgaagcggtcctccccgaatatggaactttgggtctagaatgctctcctcgaaccgggctagactttaatgaaatgatacttctcactatgaaaaataaagcgtggatggttcaccgtcagtggttctttgatttgccattaccttggacgtcaggagccacgacagaaactccaacgtggaatagaaaagagctcttagttacatttaaaaacgcacatgcaaagaaacaagaagtagtagttctagggagccaggagggagcgatgcacacggcacttacaggtgcaacggagattcaaaactcagggggcactaatatatttgctggtcatctaaaatgtagacttaaaatggataagttagagctaaaaggaatgtcatatgcgatgtgtcttaatacgtttgtactaaagaaagaagttagtgaaactcaacatgggactattttaattaaagttgaatataaaggagaagacgcaccatgtaagataccattttcaacagaagatggacagggaaaagcacacaatggtagattaataacagcaaaccctgttgtaaccaagaaagaagaaccaattaatatagaagccgaacctccatttggagaaagcaatatcgttataggtatcggagataaggctttaaaaattaattggtacaagaagggctcaagtataggaaaaatgttcgaagcaaccgcccgaggagcacgtaggatggccatattaggggacaccgcttgggattttggatcagtaggaggagtactaaattctcttggtaaaatggtacatcagatttttggcagtgcatatacagcactattctcaggagtgagctggatcatgaaaataggaataggtgtgctcttaacatggatcgggctgaatagcaaaaacacatcaatgtccttctcatgtattgttattggaatcataacattatacctaggagcagtagttcaggctgatatgggttgcgtaataaattggaagggaaaagaattgaaatgtgggaacggaatcttcgttactaatgaagtacatacatggacagaacagtacaaatttcaagctgattccccaaaacgattagccacagcaatcgcagggagctgggaaaacggggtctgcggcattaggtcaacaacaaggatggagaatttactctggaaacaaatagctaacgaacttaactatatactatgggaaaacaatataaagctaacggttgtagtgggggacatcatcggagtactagaacagggaaaaagaacgttaacacctcaaccaatggaactcaaatatagctggaaaacgtggggtaaagccaaaatagtaactgcagaaacacaaaatagcagcttcatcatagacggcccaaacacacccgaatgtccctcagcttctagagcatggaatgtttgggaggttgaagactatgggtttggagtgttcacaactaatatatggttaaaacttcgtgaggtatatacacagtcatgcgaccacaggttaatgagtgccgcgataaaagacgaaagggctgtacatgcagacatgggatactggattgaaagtcagaaaaacggaagctggaaattagagaaggcatcctttatcgaagtaaaaacgtgcacgtggcccaaatctcacacgctctggtcgaacggcgtactagaaagtgacatgatcatacctaagtcattggcgggtcctataagtcaacataatcacagacctggatatcatactcagacagcaggaccatggcatcttggtaaactggagctggactttaattattgcgaaggcacgactgtagtaattgcagagaattgcggaacccgagggcccagcctacgcaccactactgtgtcaggtaagctcatacatgagtggtgttgcagaagttgtactttgcctccccttcgttatatgggagaagatggatgctggtacggtatggagattcgaccgataaacgagaaggaggaaaatatggtaaagagtctagtatcagcaggatctggcaaggtcgataattttacaatgggggtcctatgcttagcaatattgttcgaagaggtgatgcgcggaaaatttgggaagaaacacatgattgcgggagttttgttcacatttgtgttattactttcagggcagataacatggagggacatggcgcatactttgatcatgataggttcaaatgcaagtgatagaatgggaatgggtgttacttatttggctttgatagcaacatttaagattcaaccgttcctagcacttgggtttttcttgagaaaattgacttcgcgagagaatcttttgttgggagttgggttagcaatggcaacgacattacagctacctgaagacatagaacagatggctaacggtatagcactaggattaatgaccctgaaactgataacgcaattcgagacataccagttgtggacagcattagtaagtcttacgtgctcaaatactatatttacattaaccgtagcttggaggacagccacactgatactagcaggggtatcgttacttccattatgtcagagttcctctatgaggaaaactgattggttaccaatgaccgtcgcagcgatgggggtgcctccgcttccgttatttatcttcagcttaaaggacactccgaaaaggaaatcttggccactaaacgaaggtgtaatggcagtagggttagtttcaatactagcttcatcgttactacggaatgatgttccaatggctggaccacttgtggcaggaggattacttattgcttgttatgttataactggcacaagcgcagacctaacagtagaaaaagcagcagacgttacctgggaggaagaagctgaacaaacaggagtttctcataatttaatgatcaccgttgatgatgatggtactatgagaataaaagatgatgaaacggaaaatattctcaccgttcttcttaagactgctttgcttatagtttcaggaatatttccatactcaattcctgctacgttattagtttggcacacgtggcaaaagcaaacgcagagaagtggagtactatgggatgtaccctcacctcctgagacccaaaaagctgaactagaagagggagtatataggatcaagcaacaaggcatttttggaaaaacacaagtcggtgtaggcgtgcaaaaggaaggtgtgttccacaccatgtggcacgtgacacgtggtgcagttttaacacataacggcaagagattagagcccaattgggcttcagttaagaaagacctaatttcatacgggggagggtggcgactatctgcacagtggcaaaaaggagaagaagttcaagtaatagcggtagagccaggcaaaaatccgaaaaatttccaaacaatgccaggcatcttccaaacaacaactggtgagataggtgcaattgcactggattttaaaccaggcacatcggggtccccaattattaatcgggaaggaaaagtagtcgggctttatggaaacggagtcgtaaccaaaaatggaggatatgtctctggtatagcacaaacaaatgctgaacccgacgggccaactcctgaattagaagaggaaatgtttaagaaacggaatctcaccataatggatttgcatcctggaagtggcaaaacccgaaagtacctacctgcgatagtcagagaagccataaagcgaagattaaggactctgatcctagcacctaccagagtagtagccgcagaaatggaagaagcactaaaaggattaccaataagatatcaaactaccgcaagcaaaagtgaacatacagggagagaaattgtagatctaatgtgccatgctaccttcaccatgcggttattatcacctgtacgtgttcccaactataatcttattataatggacgaagctcatttcacagacccagcgtcaatagcagcaagaggatatatttcgacaagagtaggaatgggcgaagctgcagctatatttatgacagcgacaccacccggcacagcagaggctttcccccaaagcaatgcgcccattcaagatgaagagagagatatacctgaaagaagttggaactccggaaatgaatggatcacagattttgttggtaagactgtatggtttgtacccagcataaaagccgggaacgacatagctaactgccttagaaagaatggaaagaaagtaattcaattgtcaaggaaaacttttgatacagaatatcagaagacaagactaaatgattgggattttgtagttacaacggacataagcgaaatgggggcaaacttcaaagcggacagagttatagaccctcgtagatgtctgaaacctgtcatattaacagacgggccggaacgcgtaatattggctggcccaatgcccgtcactgcagcttcagcagcccagcggaggggacgagttggtagaaacccccaaaaagaaaacgatcaatacatcttcacaggacagcctctgaacaacgacgaagatcatgctcactggacggaggcaaaaatgttattggataacataaatactccagaaggaataataccggcattgtttgaaccagaacgggaaaaatcggcagccatcgacggcgaataccggctcaagggagaatcacgaaaaacctttgttgagttgatgagacgaggggacctccctgtgtggttagcgcacaaagtcgcaagtgagggaataaaatacaccgaccgtaagtggtgtttcgacggcgaacgaaataaccagatactagaagagaatatggacgttgaaatatggacaaaagaaggcgaacgtaagaaattaaggcccagatggctcgacgcaagaacatactcggacccattagcactaaaagaatttaaggatttcgcagcaggtagaaaatctatagcattagatctcgtaactgaaatagggagagtgcccagccatttggcccaccgtacccgtaatgctttggacaatctcgtgatgctgcacacgtctgagcacggaggtagagcatatcgacacgctgttgaagaactaccagaaactatggaaactcttctattacttggattaatgattttattaacaggaggagctatgttgtttttaataagcggaaaaggaattggtaaaacaagtatagggctcatttgcgtgatcgtaagcagtggcatgctatggatggcggatgtacccctgcagtggatagcatccgcaatcgttttggagttcttcatgatggtacttttaatacccgaaccagagaaacaaaggacgccacaagacaaccaactagcatatgttgtaatcggcattctcacattagccgctatagtagctgctaacgagatgggcctactcgaaactactaaacgggacttgggtatgtccaaagaaccaggagtagtttcgccaacaagctatctcgacgtggatttacacccagcatccgcgtggacattgtatgccgtagcaactaccgtaataacaccaatgctaagacatactatagaaaatagcacagcaaatgttagtttagccgctatcgcaaaccaagcagtagtactgatgggtctagacaagggttggcccatttctaaaatggatcttggcgtccccttattagcactaggatgttatagccaggtaaatcccttaaccttaaccgctgcggtattgttattagtgacacattacgctatcatcggcccgggtctccaagcaaaagcaacacgagaagctcaaaagcgaacagcagccggtataatgaaaaatcctacagtcgatggtataatgacgatagacctcgatccagtcatttacgactctaaatttgaaaaacaactcggacaggtgatgttattagttctgtgtgcagtacaattattattaatgaggacaagctgggccctatgcgaggcattgacgcttgcgaccgggccaattacaacactctgggagggatctccgggtaagttctggaacacaaccatagcagtttcaatggcaaatatctttcgcggatcgtatttagcaggcgcaggactcgctttcagtatcatgaaaagtgtcggtaccgggaggaggggtaccggatcgcagggagaaacactaggcgaaaaatggaagaagaaattaaaccagttgtcaagaaaagaatttgacttatataagaaaagcgggatcaccgaagttgatcgtacagaggcgaaagaaggacttaagaggggtgaaaccacacaccatgcagtcagtcgaggcagcgccaaacttcaatggttcgtggaaagaaacatggtaattcccgagggccgagtaattgacttagggtgtggtagagggggatggtcgtattattgtgcaggattaaagaaagtgactgaagtgcgtggttatacgaaaggcggcccaggtcatgaggaacccgtaccaatgtcaacgtacgggtggaatatagttaaattaatgtctggaaaagatgtattttatttaccaccagaaaagtgcgatacactgttatgcgacataggtgaaagttcgccgtcacctacggtggaggagtcgagaactatccgcgtcttacgtatggttgaaccctggctacgtaacaaccaattttgcataaaagtattaaacccatacatgcctaatgtcatagaacatttggaacggcttcaaagaaaatatggaggaatgttagtaaggaatcctctatctaggaatagcacgcatgagatgtactggatttctaacggaactggtaacatagtgagctcagtgaatatggtatcaagattattattgaatcgattcacgatgacccacaggagacccacaatagagaaagatgtcgatttaggggcaggaactcgtcatgtcaatgcggagccggaaacgcctaatatggacgtcataggggaaagaataaaacgtataaaagaagaacacagctctacgtggcactacgatgatgagaatccgtacaaaacatgggcttatcatggttcctacgaggttaaagccacgggttcagcttcaagtatgattaatggagtcgtaaaacttttaaccaagccgtgggatgtcgtaccaatggttacccagatggcaatgacggacacgacaccgttcggacaacaaagagtattcaaagagaaagtagatactagaaccccgcgacctatgcctggaactagaaaggtaatggaaataacagcagaatggctttggcgaactcttggcagaaacaagaaacccagactatgcaccagggaagaatttacaaagaaagtaagaactaatgcagcaatgggcgccgtatttacagaagagaaccaatgggattctgcgcgagctgcagtagaagacgaggaattttggaaattagtagataaagaacgggaactacacaaattaggaaaatgcggatcctgtgtctacaatatgatgggaaaaagggagaagaaattaggagaatttggaaaagctaaaggatcacgagcaatttggtacatgtggttaggcgctcgatatctggagtttgaggctcttggatttctaaacgaagaccactggttttcccgggagaatagttatagtggagtagaaggagaggggctccataaacttggatatattcttagggatatatctaaaatcccgggcggtgcaatgtacgcagatgacacagcgggttgggatacaagaatcacagaagatgatttacataacgaagagaaaataacacaacaaatggatccagaacatcgacaattggccaatgctattttcaaactaacataccaaaataaagttgttaaagtacaacgcccgactccaaaaggcacagtaatggacatcataagtcgtaaagatcaaagaggcagtggacaagtgggtacatatggattgaacacattcactaatatggaagctcaactcgtcagacagatggaaggggaaggagtgttaagcgaggctgacctggaaaatcctcacttgttagaaaagaaaataacccaatggttggagactaaaggtgtagaaagactaaaaagaatggcgatatcaggtgacgattgtgtcgtcaaacctatagatgataggttcgcaaatgcgcttctagcgttaaatgatatggggaaagttagaaaggatataccacagtggcaaccatcaaaaggatggcatgattggcaacaagtgcctttctgctctcatcatttccatgaattaataatgaaagatggtcgtaagttagtcgttccttgtcgacctcaagatgagttaattgggagagccaggatctcgcaaggagcaggttggagtctgaaggaaaccgcatgtctaggcaaggcttatgcacaaatgtggagtctaatgtatttccataggagagatttacgactagcaagcaacgctatttgttcggctgtaccagttcactggatacccacttcgcgaacaacatggagtattcatgcacatcaccaatggatgacgactgaagacatgttaaccgtttggaatagagtatggatcgaagataatccatggatggaagataaaactccagtcactacctgggaagacgttccttaccttggaaaaagagaagatcaatggtgcggaagtttaattgggttaacaagtcgagcaacttgggcccaaaatattttgacagctatccaacaagtacgatcgttgatcggagatgaagaatttttagactatatgccctccatgaaaagattccgaaaagaagaagaatcagagggagctatttggtaa

SEQ ID NO: 23105 - RNA, 9873 nt, synthetic construct
  misc_feature 1..9873: note = derived and/or modified CDS sequence (opt6) from DENV-3__GU131913__SS-prME
  source 1..9873: mol_type = other RNA
accagtttatgcttaatgatgatgttaccagcgacattagcattccaccttacctcaagagacggagaacctcgaatgatagttggcaaaaatgaaagagggaaatcactgttattcaaaaccgcaagcggaataaatatgtgtacattaatagcaatggacctgggagaaatgtgtgacgataccgttacatataaatgtcctctaattgcagaagtggaaccggaagatattgactgctggtgcaaccttacatccacttgggtgacctacgggacttgcaatcaggcgggagaacatcgtcgagataaacgaagtgtagcactagcaccacatgtaggtatgggattagatacgagaacccaaacgtggatgagcgcggagggggcgtggagacaagtagaaaaagtagagacttgggctttaagacacccaggatttacaatactagcactatttttagcacactatataggtacctcactaactcaaaaagtagtaatatttatactgctaatgcttgtcactccaagtatgacaatgcggtgtgtaggggtaggaaatagagactttgtagagggcctaagcggcgcaacatgggtagacgttgttcttgaacatggaggatgtgtaacgactatggcgaaatctaaaccaactcttgacattgagctacagaaaacagaagctactcagttggctactctccgcaaactatgcatagagggtaaaataacgaatataactacggattcaaggtgccctacacaaggtgaagcaaccttaccagaagaacaggatcagaattatgtctgcaaacatacatatgtagatagaggatggggaaatggttgcggcctctttggaaaagggtcgttggtcacctgtgctaaattccaatgtctcgagccaatcgaaggaaaagttgtacaatacgaaaatttaaaatacacagttattataacagttcatacaggagaccaacatcaagtcggaaacgatactcagggtgtaactgtcgaaataacccctcaggcatcaaccgtggaagctgtactccccgaatacggtacactgggactggaatgttcaccacgtacggggcttgactttaatgaaatgatactattaacaatgaaaaataaagcgtggatggtacatcgtcaatggtttttcgacttgccattgccatggacaagcggtgcaaccactgaaacacctacctggaatagaaaagaacttttagttacatttaaaaatgctcacgctaagaaacaggaagtagtggttttaggctcgcaagaaggagcgatgcataccgcattaacgggagcgacggaaatccaaaattcaggcggtacatcgatatttgccgggcatcttaaatgcagactaaaaatggataaactcgaattaaaaggtatgtcttatgcaatgtgtttgaatacatttgttctaaagaaagaagtctcagaaacgcagcatggtacaattcttatcaaagtcgaatacaaaggagaagacgccccctgtaaaatcccattctcgacagaggatgggcaaggtaaggcacataatggaagattaattacggccaatcccgtcgtaacgaagaaagaagaacctattaacatagaagcggaaccaccttttggggaatcaaatatagttataggaatcggcgataaagcattgaaaataaactggtataagaaaggatcatctattggaaaaatgtttgaggcaacagctagaggagcgcgaaggatggctatactaggagatacagcctgggactttggaagtgttggcggggtacttaattctttaggaaagatggtgcatcaaatatttggatcagcttacacggcattgttcagcggggtgtcctggataatgaaaattggaatcggcgtattattaacatggataggcctaaattcaaagaatactagcatgagcttttcatgcatagtaataggaattgtaacgctttatttaggagcagtagtccaagctgatatgggctgcgtaatcaattggaaagggaaagaattgaaatgtgggaacggtatatttgttactaacgaagtacacacctggactgaacaatacaaatttcaagcagactcccctaaaagattagcaacagcaattgccggtgcatgggaaaacggagtgtgcggaattaggtcgaccacacgtatggaaaacctattatggaaacaaattgcaaatgaactaaattatattttatgggaaaacaacataaaactcactgtagtggtgggtgacataatcggagtacttgagcaaggaaaacgaaccctaactcctcaacctatggaactaaaatactcgtggaaaacgtggggtaaggcaaaaattgttactgcggaaacacaaaattctagctttatcatagatggtccaaataccccagagtgtccaagtgcctcacgtgcatggaacgtttgggaagtcgaagactatggcttcggagtttttactaccaatatatggctgaagctacgtgaagtacacacacaatcctgcgaccatcgactgatgtcagcggcaattaaagatgaacgagccgttcatgctgatatgggatattggattgaatcgcaaaagaatggatcgtggaaattagaaaaagcatcatttattgaagtaaaaacttgtacttggccaaaatcacatacactatggtcgaacggtgttcttgagagcgacatgataataccaaagagcttagccggaccaataagtcagcacaatcataggccgggatatcatacacaaacagcaggcccctggcacttaggaaaactcgagctcgacttcaattattgtgaaggcaccacagttgtcatagctgaaaattgtggaactagaggcccatcattacgaactacgacagtcagtggtaaacttatacacgaatggtgttgccgctcatgtacgttaccaccccttagatatatgggtgaagacggatgctggtacggaatggaaattagaccaatcaacgaaaaagaggagaatatggttaaatccttagtatcagctggatcaggaaaagttgacaatttcacgatgggagtgttatgtctcgcaatattatttgaagaagtaatgagaggtaaattcgggaaaaagcatatgatagcgggagtactttttactttcgtattgttactatctggtcaaataacctggagagacatggcgcacacgttaattatgattggttccaatgcctcggatcgaatggggatgggagtaacatacctagctcttatcgcaactttcaaaatacaaccattcttagcattaggatttttccttagaaaattaacttcaagagagaatttattactgggcgtgggtttagctatggctacgacattacaactgcccgaagacatagaacaaatggcgaacggcatagcacttggattaatgacattgaaacttataacacaattcgaaacctaccaactatggacagctcttgtgagccttacttgtagtaacacgatctttaccctaacggtggcatggagaaccgcgacattaattctagcgggtgtatctttattgccattatgccaatccagcagtatgcgcaaaaccgactggctcccaatgacagtagcagcaatgggagtgccaccgttaccccttttcatattttcacttaaggatacaccaaaaaggaaatcttggcccttgaatgaaggagttatggctgtaggcttggtatcaattctcgccagcagtttacttcgaaatgatgtgccaatggcaggacctttagttgcaggaggattgctcatagcttgttatgtaataacaggtacaagtgctgatcttacggtcgagaaagctgcggacgtaacgtgggaagaagaagcagaacaaactggagtcagtcataatttaatgataacagtagacgacgacggcactatgagaataaaggatgatgaaacagagaatattttaactgtattgttgaaaaccgcattattaatcgtatctggcatattcccgtacagcattccagcgactctacttgtatggcatacttggcaaaaacagacgcaacgatcaggcgttttatgggacgtcccatctccaccagaaacacaaaaagcggagttagaagaaggggtttatcgcattaaacaacagggtatcttcggcaaaacccaggtaggcgttggagttcaaaaagaaggagtctttcatacaatgtggcatgtaacgagaggagccgtactaacgcacaacggaaaaagactagaacctaattgggcgagtgtcaagaaagatttgataagctacggtggcggttggcgcctatcagcccagtggcagaaaggagaagaagtacaagtcattgctgtcgagccaggtaagaaccctaaaaatttccagaccatgccgggcatattccaaactacaacgggagaaataggtgccatagctttagattttaaacctggaacaagcggatcaccaatcataaatagggaagggaaggtagttggcctatacggtaacggggtagtaaccaaaaatggagggtacgttagtgggatagcgcaaaccaacgcagagccagacggtcctacccctgagctagaagaagaaatgttcaagaaaagaaacttaacaatcatggatctacatccgggaagtggcaagacgagaaaatacctccctgccatagttagggaggcaataaaaaggagactgcgcacacttattctagccccaacaagagtagttgcagccgagatggaagaagccttaaaaggtttaccgattagatatcaaacaacagccacaaaatcggaacatacgggtagagaaattgttgatttaatgtgccatgctacattcacaatgcggttgttaagcccagtacgagttccgaactataatctagtgataatggacgaagctcattttactgatccagcctcaattgccgcaagagggtacatatctactagagtaggcatgggcgaagctgctgcgatattcatgacggctactccccctggcaccgcggaggcttttccccaaagtaatgctccaatacaggatgaggaacgtgacatacccgaacgaagttggaactccggcaacgaatggataacagattttgtaggaaagacagtttggttcgtaccatctataaaagcaggaaacgacattgcaaactgccttcggaaaaatgggaagaaagtaatacaactaagccgaaaaacattcgataccgagtatcagaagacccgtttaaatgattgggatttcgtagttactacggatatcagtgagatgggagctaatttcaaggcagaccgcgtcatcgacccaagaagatgtctaaaaccagtaatattgacggacgggccggaacgtgtaatacttgctggacctatgccggtaactgctgcttcagcagcgcaaagaagaggaagagtaggaagaaatccacaaaaagaaaatgatcaatacatttttactggccagcccctaaataatgatgaagaccacgcacattggacggaagcaaaaatgttactagacaacattaacacacctgaaggcattattccagccttattcgagccagaacgagaaaagtcagctgctatagacggagaataccgactcaaaggcgagtcaagaaaaacattcgtagaattgatgcgaagaggggatttaccagtttggctcgcccataaagtagccagcgaagggataaaatacacagatcgaaaatggtgttttgatggtgagcgaaacaaccagattctagaagagaatatggatgttgaaatctggacgaaagaaggagaaaggaagaaactcagaccacgatggctggatgcacgcacgtactccgaccctctggcactaaaggagttcaaagattttgcggctgggcgcaaatctatcgcgctggacttagtaacagagattggcagggtaccatcacatttagcccacagaacaaggaatgcattagataacttagttatgttacatacaagtgagcatggagggagagcatatcgtcatgcagtagaagaactaccagaaacgatggaaaccctcctactattagggcttatgatattgttaacaggaggagctatgttatttttaatatctggcaagggaataggcaagacgtctattggattaatatgtgtgattgtatcaagtggaatgctctggatggcagatgtccccttgcagtggattgccagcgctattgtcttggagttctttatgatggttttactcataccggaaccagaaaaacagcgtacgccacaagacaatcagctcgcttacgtcgttatcggcattctgacgctagcggccatcgttgcggctaatgaaatgggcttactagagaccacaaaacgggacctgggtatgtcaaaagagcccggcgtagtttcacccacttcctatttagatgtagatcttcatcctgcatctgcttggactctatatgcggtggcaaccacagttattacaccgatgctacggcacaccatagagaatagcactgccaatgtttcacttgcagcgatcgcaaaccaagcagtcgtccttatgggtttggataaaggatggccgatctcaaagatggacctcggtgtccctcttcttgctctcggttgctattcgcaagtaaatccgcttaccctgaccgcggctgtattacttctagtcactcattatgcgataatagggcccggcttacaggcaaaggccactagagaggcccaaaaacggacggctgcaggaatcatgaaaaatcctacagtcgatggtattatgactattgatttagatcctgttatatacgatagcaaatttgagaagcaactcggacaggttatgctcttagtgctgtgcgcagttcaactattattaatgagaacctcgtgggcattatgcgaagcgcttacgctggcgactggacctattaccacactttgggaaggctcacccggaaagttttggaatactactattgcagtatctatggcaaatattttcagaggtagttatttagcaggggctgggttggcattttccataatgaaatctgtaggtactggaagaagaggcaccggatcccaaggtgaaacattaggcgagaaatggaaaaagaaactaaaccagttaagtagaaaagagtttgacctttacaagaaaagcggaattacagaagtagatcgcacagaagcaaaagaaggactcaaacggggagagactactcatcatgctgtatcaagaggatcggcgaaacttcaatggtttgtagaacgcaatatggttatccctgaaggacgagtaattgatctaggttgtggaagaggcggctggagctattactgtgccggactaaagaaagtaacagaagtcagaggctatacgaaaggaggacccggacacgaagaaccggtccctatgtcgacctatggctggaatatagtcaaactaatgagtgggaaagacgtgttttatctaccacccgaaaaatgtgacactctactttgtgacattggagaaagctctccatcacccacagtggaagagtctcgcacgatacgcgtattaaagatggtagagccatggttgcggaacaaccaattttgcataaaggtgttaaatccgtatatgccaaacgttatcgaacatttagagagactacagaggaaatatggaggaatgttagtgaggaatccactatcaaggaatagtacacacgaaatgtattggataagtaatgggactggtaacatagtatcctctgttaacatggttagcagactacttctgaatagatttacgatgacacataggcgacctaccattgaaaaagatgtggatttaggagccggtacaagacacgtgaatgccgaaccagaaacacccaacatggacgtaataggagagaggatcaagagaattaaggaagaacattcatctacatggcactacgacgatgagaatccgtataagacttgggcctatcacggatcatatgaagtcaaggctacaggttctgcatctagtatgataaatggagtagtcaaattacttacaaaaccctgggatgtcgtacctatggtcactcaaatggcaatgacagatacgacgccatttggtcaacagagagtcttcaaagagaaagtagacacaagaacccctagacccatgccaggaacccgtaaagttatggaaataaccgccgaatggttatggcgtactttaggccgtaacaagaaacccagactgtgcacgagagaagagtttactaagaaagttaggaccaacgcagcaatgggtgcggtttttaccgaagaaaaccagtgggactcagcccgtgcagctgtagaagacgaagagttctggaagttagtagataaagaaagagaactccataaattaggaaaatgcggttcgtgtgtctataatatgatgggcaaaagagaaaagaaattgggggagttcggaaaagcgaaaggaagtagagcaatatggtacatgtggcttggtgcaaggttcctcgagttcgaagcactaggcttcctaaatgaagaccactggttctcaagagaaaatagctactcaggagttgaaggtgaaggcttgcataaattaggatatatattaagagacatcagcaaaataccaggaggtgcaatgtatgccgatgacacggcaggatgggatactcgaataaccgaagacgatttacacaacgaagaaaagataacccagcagatggacccagaacatagacagctagcaaatgcaatttttaaacttacatatcaaaataaagtggtaaaagtgcaaagaccaacaccaaaaggaacggtcatggacattattagtaggaaagaccaaagagggtccggccaggtaggaacatatggtcttaatacatttacaaatatggaagcccaactggtaagacaaatggaaggtgaaggtgtcttatctgaagcagatctagaaaacccccatctcctggaaaagaagattacacagtggttggagacaaaaggtgtcgagcgactaaaaagaatggcaatttccggagatgattgtgtagtaaaacctatagacgatcgattcgcaaatgcgctacttgcgttgaacgatatgggcaaagtaaggaaagatatccctcaatggcagccctccaaaggatggcatgattggcaacaagttccattctgtagccaccattttcatgaactcataatgaaggatggacgaaaattagtcgtaccatgcagaccacaagacgagttaatcgggagagcacgtattagtcaaggtgccggttggtcgttaaaagagacagcttgtctggggaaggcttacgctcaaatgtggagtttaatgtatttccatagacgagacttgcgactagccagcaatgcaatatgctccgcggttccggttcattggataccgacgtcaaggacaacatggagcattcatgctcatcatcaatggatgactacagaagatatgctgacggtctggaatcgcgtatggatagaagataacccttggatgggagacaaaactccagtgaccacctgggaagatgtaccatacttgggcaaaagggaagatcaatggtgtggttcattaatcggccttacttcgagagctacgtgggctcaaaatatactaacggctatccaacaagtacgatcacttatcggagatgaagagtttttagattacatgccaagcatgaagagatttcgcaaagaagaggagagtgaaggggctatttggtaa

SEQ ID NO: 23106 - RNA, 9873 nt, synthetic construct
  misc_feature 1..9873: note = derived and/or modified CDS sequence (opt6) from DENV-3__GU131914__SS-prME
  source 1..9873: mol_type = other RNA
acttctctatgcttaatgatgatgctaccagctactttggcgtttcatttaacaagtagagatggcgaaccaagaatgatagtaggcaaaaatgaaagaggtaaatccttactttttaaaactgcgagtggcatcaatatgtgcactctcatcgctatggacctaggagaaatgtgcgacgacacagttacgtataaatgtccactgatagcagaagtagaacctgaagacattgactgttggtgtaacctcacaagcacctgggtgacttatgggacgtgcaatcaagcaggagaacacagaagagataaaaggagcgtagcacttgcaccccacgtggggatgggtttagataccagaacccaaacatggatgtctgcggaaggcgcctggcggcaggtagaaaaagtagaaacatgggccctccgacaccccggttttacaattttagctctgtttctagcgcattacataggcacatcgctaacacagaaagtcgtaatttttatccttttaatgttagtaaccccaagcatgaccatgaggtgcgtcggagtaggaaaccgcgattttgtagaaggtttatcaggggcaacctgggttgacgtagtcctagaacacggtggttgtgtgactactatggctaaaagtaaacccacactagatatagaattgcagaaaactgaagcaacacaattagctacactaagaaaattgtgtattgagggaaaaataaccaacattactacagattcccgatgtcctacgcaaggagaagcaactcttcctgaagaacaagaccaaaactatgtatgcaaacatacatatgtcgatcgaggttggggtaacgggtgcggacttttcggaaaaggttcattagttacatgtgctaaatttcagtgtttagaaccgattgaaggcaaggtagtacagtatgagaacttaaaatacaccgtcattataacggtacacactggggatcaacatcaggtaggcaacgatactcaaggggttacagtagaaatcactccgcaagcctcaacggtggaagctgtacttccagagtatgggacactagggctagagtgctcaccgcgaacgggactggatttcaatgaaatgatactattaacaatgaaaaataaagcctggatggttcacagacaatggttctttgatctaccactcccatggacatcgggcgctacaacagagacccctacttggaaccgaaaagagctcttagttacatttaaaaatgcccatgctaagaaacaagaagtcgtcgttttaggatctcaagaaggagctatgcatactgcattgactggagcgacagaaatacaaaattcaggtggaacttcaatttttgccggtcatttgaaatgtcgattaaaaatggataaactagagttaaaaggaatgtcatatgcaatgtgtctaaacacattcgtgttaaagaaagaagtatccgaaactcaacatggtactatattgattaaagttgaatataagggcgaagatgcaccttgcaagataccgttttcgaccgaagatggacagggtaaggctcacaacggtcgtcttataacggcaaaccctgttgtgacgaagaaagaagaaccaattaacattgaagctgagcccccatttggcgagtccaacatagttattggcataggtgacaaagcgttgaaaattaattggtataagaaagggagcagtataggtaagatgtttgaagctactgctaggggcgcacgtcgaatggcaatactgggagatacagcttgggattttggatcagtgggtggcgtactaaactcattaggtaagatggtacaccaaatattcggtagtgcatataccgccctcttcagtggcgtatcctggataatgaaaataggaatcggagtcctcctaacgtggataggattgaactctaaaaacaccagtatgtcgtttagttgcatcgtaattggcatcataaccctgtacctaggcgcggtcgtccaggccgatatggggtgtgtaataaactggaagggaaaggaattaaaatgtggaaatggaatatttgtaactaatgaagtgcatacatggaccgaacaatacaaattccaggctgattcacctaaacgcctagccactgcgatagctggggcatgggaaaatggtgtgtgcggaataagatcgacaacgcgaatggaaaacttactatggaaacaaattgcaaacgaactaaactatattttatgggaaaataacataaaattaaccgtagttgtaggcgatataataggcgtgctcgaacaagggaaaagaacgttaacgcctcaaccgatggaactcaagtactcatggaaaacttggggtaaagctaaaatagttaccgctgagactcaaaactcatccttcattatagatggacctaatacgcccgaatgtccatctgcaagtagggcgtggaatgtgtgggaggtagaagactacgggtttggggtattcacaaccaatatatggctgaaactaagagaagtgcacacacaatcctgcgatcatagactaatgtcagcagcaataaaggacgagcgtgctgtccatgcggacatgggatactggatagaatcccagaaaaatggatcttggaagctggaaaaggcctcatttattgaagtcaagacctgcacttggcccaaatcacatactctatggagtaatggagttcttgaatcagacatgataataccaaaaagtttagcgggtccgatatcacaacataaccatcgtccaggatatcatacacaaacagctggcccatggcatctaggtaaattggagctggactttaattactgtgaaggtacaacggtcgttattgcagaaaattgtggcacgcgaggcccatccctcaggacgacaaccgtatcgggaaaacttatccatgagtggtgctgtaggagctgtactctaccgcccttaaggtatatgggagaagatgggtgctggtacggcatggaaatcagaccgattaacgaaaaagaagaaaatatggtaaaatctctcgtaagcgcagggagtggaaaggtcgataatttcaccatgggagtactatgcttggcgattctatttgaagaagtaatgcgtggaaagttcggcaagaaacatatgattgccggtgttttgttcaccttcgttcttttactaagcggtcagataacatggagagatatggcacacacattgataatgattgggagcaatgcaagtgacagaatggggatgggcgttacatatctagcattaatagcaacgtttaaaatacagccctttttagccctaggattctttttgagaaaactaacaagtcgtgagaatttattactcggagtgggtttggccatggctacaacactacagttacccgaagatatagaacaaatggctaatgggatagcgctgggtctcatgacactaaaattaataacccagtttgaaacataccaactttggacggccttggtatcattaacttgtagcaacactatatttacacttaccgtcgcatggagaactgccaccttgatcctcgctggagtatctctattaccattatgccaatcttcaagcatgagaaaaactgactggttacccatgacagtagccgctatgggggtacccccactcccattatttatatttagcttaaaagacacgccaaaaagaaaatcgtggcctctgaacgagggggtcatggctgtcggtctagtatcaatcttagcaagcagcttactcagaaatgacgtaccaatggcgggacctctagtagctggcggtttattaatagcctgctatgttataacggggacctctgcggatttaacagtagaaaaagcagcggatgtcacttgggaagaagaagcagaacagacaggtgtaagtcataatttgatgattacagtggatgacgatgggaccatgagaataaaagatgacgaaacagaaaacatattgaccgtgttgttaaaaacagcgttgcttatcgtgagtggcatatttccatatagtattcctgcgacattattagtctggcatacatggcaaaaacagacccagaggtcaggagtattatgggatgtcccaagccctccagaaacacagaaggccgaactggaggagggagtgtatagaataaaacaacaaggaatattcgggaaaacacaagtgggagtaggtgttcaaaaagaaggagtctttcatacaatgtggcacgtcactcgtggagcagtcttaacacataacgggaagcgcttggaaccaaattgggcatcagtcaagaaagatctaatcagctatggaggaggatggcgattaagtgcgcagtggcaaaaaggagaggaagtacaagtaatagcagtagaaccagggaaaaatccgaaaaacttccaaactatgccaggaatattccaaacaacaacaggcgagataggtgcaatagcactggacttcaaacctggtacctcggggagcccaataatcaatagggaggggaaagtggtcggactctatggtaatggggtcgtcactaaaaatggtgggtatgtgtcgggcattgcacaaactaacgcggagcctgatggtcctacacccgaactagaagaagagatgttcaaaaagagaaatcttactataatggaccttcatccaggttcaggcaaaacccgaaaatacttgccagccatagtgagagaagcgattaaaagaagacttagaactcttatactcgcccccaccagagtagtggcagcggagatggaagaagcgcttaagggcttaccaataagatatcagacaactgctacaaagagcgaacataccggaagagaaatagtcgatcttatgtgccatgctacgttcacaatgcgactactctctccggtaagagtacctaattacaatctagttataatggacgaagcccacttcacagacccagcgtcaatagctgctaggggttacatctctacacgcgtaggcatgggagaagcagctgcaattttcatgacagcaacccctcctgggacagcagaagcattcccccagagcaacgctcccatacaagatgaagagagagacatccccgagcgatcttggaactccggaaacgagtggataactgatttcgtaggtaaaacggtatggttcgtaccatcaataaaagccggtaatgacatagcaaattgcctacgtaaaaatggaaagaaagtaatccaactctcaaggaagacatttgacacagaatatcagaaaactagactaaacgattgggatttcgtggtgactacagatatttcagaaatgggagccaattttaaagcagacagggttattgatccccgcagatgcttaaaaccagtgatactaacagatggaccagagcgcgtaattttagccggacccatgccggtaacggccgcaagcgcagcacaacggagagggagggtgggaagaaatccacaaaaggaaaacgaccaatatatatttaccggtcaacccctaaataatgacgaagatcacgcacattggacagaagctaaaatgctcttagacaatataaatacaccggaaggcataattccagctttatttgagcctgaaagagagaaaagtgcagcaattgatggtgagtatcgattaaaaggtgaatcccgaaaaacattcgtagaactcatgagaaggggcgacctccctgtctggttggcgcataaagtagcctcagaaggaattaaatatactgacagaaagtggtgttttgacggcgaaagaaacaaccaaatactggaggaaaacatggacgttgagatttggactaaagaaggcgagaggaagaaacttcgaccaagatggcttgatgcgcgaacatacagtgatcctcttgcattgaaggagtttaaagactttgcggcaggtagaaaatctatagctttagacctcgtgaccgaaatcggacgagtaccaagtcacttagcacatagaacgaggaatgctttggacaatttagtaatgttgcataccagcgaacatggtgggagagcttatagacatgccgtagaagaactacctgagactatggaaacattgttactacttgggctcatgatactattaacgggaggagcgatgctatttttaatatctggaaaaggtatcggaaagaccagtattggattaatatgcgttatcgttagcagcggtatgctctggatggccgatgtaccgttacaatggattgcgagtgctattgtgctcgagttctttatgatggttttactaattccagaaccagaaaaacaaagaaccccacaagataatcaactagcctatgttgtgataggaatcctgacgttggcagccattgttgcagctaacgagatgggattattagaaacaacaaagcgagacttagggatgtccaaagaacctggagtagtctccccaacaagctaccttgacgtcgacttacacccagcatcagcatggacactctacgctgtcgcaactacggtaataacgcccatgttaagacacacaatagaaaattctacagctaatgtgtcattagcagcaatagcaaatcaagctgtagtgctgatgggattagataaaggctggcctataagtaaaatggatttaggagtgccactgctcgctctcggctgctactctcaggtaaatccattaactctcactgctgctgtattgctattagtaacacattacgcgattatcggtcctggacttcaagccaaggcgaccagggaagcacagaaaaggacagctgctggtattatgaaaaatcctaccgtagacggcatcatgacaatagacttggatccggttatatacgacagcaaattcgaaaaacaattaggacaagtaatgctactcgtactctgtgccgtccagttattgctaatgagaacctcttgggcactatgtgaagcccttacgctggctaccggtccaattaccacgctctgggaaggaagcccaggcaaattctggaataccacaattgccgtatctatggccaatatttttcgaggtagctatttagcaggcgcaggattagcgttcagcataatgaagtctgtcggtacaggaagaagaggaacaggatctcaaggtgaaactttgggagagaaatggaagaagaaattaaaccaattatcaagaaaagaatttgatttatataaaaagtcaggaatcacggaggttgataggacggaagccaaagaaggtctaaaaagaggcgaaacaacccatcatgcggtatcaaggggatcagcaaagttacaatggtttgttgagagaaacatggtcattccagaaggaagagtgattgatctaggatgtggaaggggaggatggtcatattattgtgctggactaaagaaagttacggaagtgaggggttacacaaaaggtggtccaggccacgaggaaccagttccaatgtcaacctatggatggaacatagttaaactcatgagtggtaaagatgtattttatttgcctcctgaaaagtgcgacacacttctttgcgacataggcgaatcaagcccaagccctacagtggaagaatcaagaaccatacgtgtgttaaaaatggtagagccttggttacgaaacaatcaattttgtattaaagtattgaatccatacatgcccaatgtaatagaacacttggagagactacaacgtaaatatggtgggatgttggttcgaaaccccctatcccgcaatagcacacacgaaatgtattggattagtaatggaactgggaacatcgttagtagcgtgaatatggtatctagattactattaaatcgttttaccatgactcataggagaccgacaatcgaaaaggacgtagacctaggagccggaacgcggcatgttaacgcagagcctgagactccaaacatggacgtgatcggggaaaggataaaacgcattaaagaggagcacagttccacatggcattatgacgacgagaatccatacaaaacttgggcgtatcacgggagctacgaagtaaaagcaacgggtagcgcttcaagtatgataaatggtgtcgttaaattgctcacgaaaccatgggacgttgttccgatggtaacacaaatggcaatgacagatactactccattcggtcaacaaagagtttttaaagaaaaagtagatacaagaacaccaaggccaatgccgggcacacgaaaagttatggaaattaccgcggaatggttatggagaactctaggacgcaataagaagccccggctgtgcacaagggaagaatttaccaaaaaggttagaactaatgcagctatgggagcggtattcacagaagaaaatcaatgggattccgccagagcagctgttgaagacgaagaattttggaagctagttgacaaagaaagagagctgcacaagttaggaaaatgcggctcctgtgtatacaatatgatgggtaaaagagagaagaaattaggagaatttggaaaagcgaaaggttcccgagcgatctggtatatgtggctgggagcacgcttcttagagttcgaagcgctcgggttcttgaatgaagatcactggttctcgagagaaaatagctatagtggcgttgaaggggaagggcttcacaaactcggatacatactaagagacattagtaaaatacccggtggagccatgtacgccgacgacacagcgggctgggatacccggataacagaagatgatctgcacaatgaagagaaaatcacacaacaaatggatccagaacatcgacaactcgccaatgcaatatttaagctaacgtaccaaaataaagtagtcaaagttcagcgacccacccctaaaggaacagtaatggatatcattagtcgtaaggaccaaagaggatcaggacaggtaggaacatatggtttaaatacttttactaatatggaagcacagctagtcagacagatggagggagaaggagttctatcagaagcggacttagagaacccccatttattagagaagaaaattacacagtggttagaaactaaaggagtggaacgactaaaaaggatggcaattagtggtgatgattgcgtagtcaaacccatagacgaccgctttgccaatgcattactagctctaaatgacatgggaaaagtgcgaaaagatatacctcagtggcaacccagtaaaggatggcacgattggcaacaagtaccattctgctctcatcatttccacgaattgataatgaaagatgggaggaagttagtcgttccatgtcggccacaggatgaattaataggaagggcgagaatttcccaaggagctggatggtcactcaaggagaccgcctgcttgggaaaagcatatgcccaaatgtggagcttaatgtattttcataggcgagatttacgtctcgcctctaatgccatttgttcagccgttccagttcactggatacccacttctcgtacaacttggtccatacatgcccatcatcaatggatgacgactgaagacatgttgactgtttggaacagagtctggatagaagataacccatggatgggagataagactccagttacgacatgggaagacgtaccatatttagggaagagagaggatcaatggtgcggttcgctgattggtctaacaagtcgagccacatgggcacaaaatatactaactgcgatacagcaagtgaggtcccttataggtgatgaagaatttctcgactacatgcccagtatgaagcggttccgaaaagaagaagagagcgaaggcgctatttggtaa

SEQ ID NO: 23107 - RNA, 9873 nt, synthetic construct
  misc_feature 1..9873: note = derived and/or modified CDS sequence (opt6) from DENV-3__GU131915__SS-prME
  source 1..9873: mol_type = other RNA
acatcattatgtctaatgatgatgctgccagcaaccttggctttccatttaacttcacgagacggtgaaccaagaatgatagttggtaaaaatgaacgtggtaaaagtttattattcaaaaccgcttcaggtataaatatgtgcactctaattgctatggatttgggagaaatgtgtgatgatacagtaacatataaatgtccactaattgctgaagctgaaccagaagacatagattgttggtgtaatcttacatcaacgtgggtaacttatggaacatgtaatcaagcaggcgaacatagaagggacaaaaggtcggttgcgttagcaccacatgtaggcatggggctggacacaagaacccaaacctggatgagcgcggaaggtgcgtggcgacaagtcgaaaaagttgaaacatgggcacttcgacacccaggctttacgattttagcgctgttcctggctcactacatcggaacatcacttactcaaaaagttgtgatattcattttattgatgttagtgacgccgtctatgaccatgcgttgtgtaggtgttggtaacagagacttcgtagagggcctcagcggagcgacctgggtagatgtagtcttagaacatgggggatgtgtcactacaatggcgaaatcaaaaccaaccctagatattgaacttcagaaaaccgaagcaacgcaattagctacacttcgaaaattgtgcatcgaaggtaaaataacaaatataaccacggactccaggtgccctacccaaggagaagctacactacctgaagaacaagaccagaactatgtatgtaaacacacttacgtagaccgtggatggggcaatggatgcgggttatttgggaaagggagcttagtaacatgtgcaaaattccaatgtttagagccaatagaaggaaaagtagtacaacatgagaatttaaaatatacagtgatcataacggttcacacgggggatcaacatcaggttggaaacgatacacagggtgtaacagtggaaataactccccaggcttccacagtagaagcagtactacccgaatatggaacactgggcctagagtgcagtccaagaactggtttagattttaatgagatgattctcctaacaatgaaaaacaaggcttggatggtacatagacaatggttctttgatctaccccttccctggacatctggggctaccacagagaccccaacatggaatagaaaagaactgctggtgacctttaaaaacgcacatgccaagaaacaggaagtcgtcgtattggggtcacaagagggtgcaatgcacacggccttgacaggtgccaccgaaattcaaaacagtggtggtacctctatctttgcaggccacctgaaatgcagattaaaaatggacaaactcgaactgaaaggaatgtcttacgcaatgtgtttgaatacttttgtcctcaagaaagaggtttctgaaacacaacacggaacaattttaataaaagtagagtataaaggagaagacgcgccgtgtaaaataccattctcgactgaagacggacaaggaaaagcccatagtggaaggctaattacagcgaatcctgtggttactaagaaagaagaaccggtaaatatagaagcagaaccgccttttggggaatcaaatatagtgattggaataggtgataaagcattaaaaattaattggtacaagaaaggaagttcgataggaaaaatgttcgaagccactgcaaggggagcacggcgtatggcaatattaggggacaccgcatgggacttcggatctgtgggaggagtattgaactcacttggaaaaatggttcatcagatattcgggtctgcttatactgcactgttttctggtgttagctggattatgaaaataggtattggggttcttcttacttggataggcctcaacagcaaaaataccagtatgtctttttcatgcatagtcattggtattattactctatatttgggagctgtcgtacaggccgatatgggatgtgtaatcaattggaaaggaaaagaacttaagtgtggctcaggaatatttgttacaaatgaagtccacacttggacggaacaatataaatttcaggcagatagtccaaaaagactagcaactgctatagccggtgcatgggaaaatggagtttgtggcatcagatcaacaacccgcatggaaaatttactgtggaaacaaatcgctaacgaattaaattacatactttgggagaataacataaaacttaccgtagttgtgggagatatcatcggagttctagaacagggaaaaagaacacttactccgcagcccatggaactaaaatactcatggaagacctggggtaaggctaaaattgtaacggcagagacacagaacagcagctttattatagatggaccaaacacacccgaatgcccgagtgcgtccagagcatggaacgtttgggaagttgaagactatggttttggcgtgttcacaacaaatatatggctgaaacttagggaagtctatacgcaatcgtgcgaccacaggctgatgtctgcagccataaaagatgaacgagcagttcacgcagatatgggttattggatagagtcgcagaaaaatgggtcttggaaacttgaaaaggcttcttttatcgaagttaaaacgtgcacatggccaaaaagccatacactatggagcaatggagtattagaatctgatatgattatcccgaaaagtttagctgggccaatatcacaacacaatcatcgaccagggtatcatacacaaacggcaggtccatggcatttaggaaaacttgagctagatttcaattattgcgaagggacaacagtagtgataactgaaaattgtggcacaagaggcccttcattacgaacgacaaccgtatctggaaagctcatacatgaatggtgctgtcgatcgtgtacgttaccacctttaagatacatgggggaggacggctgctggtacggcatggaaattcgccctataaatgaaaaagaagagaatatggtaaagtcactcgtatccgcgggtagcggaaaagtggacaatttcacaatgggagtgctgtgcctagctatattgtttgaagaagtcatgagaggaaaattcgggaagaaacatatgattgcgggagtcctatttacatttgtgctgttactctcgggacaaataacctggagagacatggcacatactctgattatgatcggctctaacgcgagtgatagaatgggaatgggagtaacgtatttggctcttatcgccacatttaaaatccaaccatttctcgcactaggattctttctgagaaaattgacaagtagggaaaatctactattaggtgtgggattagctatggccactactttacaactacccgaagatatagaacaaatggcaaacggaatagctttagggctaatgacattaaaacttattacacaattcgaaacataccagctatggacagcgctcgttagtctaacatgttctaatactatattcactctaacagtagcatggagaactgctacccttatcctagccggagtaagcctactacccttgtgccaatcatcatcaatgagaaagacagattggttgcctatgacggttgcagcaatgggcgtcccaccattgcctctatttattttctctcttaaagatacgccaaaaagaaggtcctggcctttgaatgaaggagtaatggcagtaggtctggtatcgatactagcaagttcacttttacggaatgatgtgccgatggctggcccattggttgcgggaggtttattgatagcttgttatgtcatcactggaacatctgcggacttgacagtcgaaaaagctgcggacgtaacatgggaagaggaggcagaacaaacgggagttagccacaatcttatgattactgtagacgatgatggcacaatgaggataaaagacgatgagactgaaaatatattaaccgtattattaaaaactgcacttcttatcgtgtctgggatatttccatacagcataccagctacacttttagtatggcatacatggcaaaaacaaactcaacggagcggcgttctctgggacgttccaagtccgccagagacgcaaaaagctgaactcgaagaaggagtgtaccgcataaaacaacaaggaatcttcggtaaaacgcaagtgggagttggcgtccagaaagaaggagtctttcacacgatgtggcacgtaacacgaggtgctgtattaacacataacgggaaacggttggaacctaactgggcatcagttaagaaagatcttatatcttatggaggcggttggagattaaacgcgcagtggcaaaaaggagaagaagtacaagtaatagctgtggaaccaggaaagaatcctaaaaattttcagactatgcccgggatatttcaaactacgactggagagataggagcaatagctttagactttaaaccagggacatctgggtctccgataataaatcgtgagggaaaagtcgtgggattgtatggaaacggcgtagttaccaaaaacggaggctacgtttccggcatcgcccaaactaacgcagaacctgatggtccaacaccagaactcgaagaagaaatgttcaagaaacgcaatctaacaataatggatctacatcctggctccggaaaaaccagaaaatacctcccagccatagtaagggaagccataaaaagacgactcagaacgcttatacttgccccaactagagtagtcgcagcagagatggaggaagcattaaaaggtttaccgattcgataccagacaacggcgactaagtcggaacacacgggaagagaaattgtagatttaatgtgccatgcaacttttacaatgcggttattgtctccagttcgagtgcctaattacaacctagtgattatggatgaagcacacttcaccgatccagcttccatagcggcacgaggatacatatcaacccgggtgggaatgggcgaagcggctgccatttttatgacagcgacccctcctgggacggcagaagccttcccacaatccaatgctccgattcaggatgaggaacgagatataccagaaagaagttggaactcaggcaacgagtggatcacagactttgttggcaaaaccgtgtggtttgtgccgtcaataaaggcaggaaatgatatagctaattgcttaaggaaaaatgggaaaaaggtaatacagctcagtcggaaaacatttgacacagagtatcagaaaacacgattaaacgactgggatttcgtagtcaccacagacattagcgaaatgggcgctaatttcaaagcggatagagtaatcgacccgagacgatgcttgaagccagtcattctcacagatggtcctgagagagttatacttgcaggacctatgcctgtcactgcagcatctgctgcacaacgacgagggagagtaggtcgtaaccctcaaaaagaaaatgaccaatacattttcaccggacaacccttaaataatgatgaggatcacgctcattggacagaagccaaaatgctattggataatattaatactcctgaaggaataatacccgcattattcgaacctgaacgagaaaagtcagcagctattgacggcgaatatcgattaaaaggtgaaagcagaaaaacctttgtcgaattgatgaggagaggggacttaccagtttggttggcacataaggtcgcgtccgaaggaataaagtacactgatagaaaatggtgcttcgacggcgagcgcaacaatcagatcttagaggagaatatggacgtcgagatatggacgaaggaaggagagaggaagaaactgagaccgcgatggctcgatgctaggacttattccgacccactagcattaaaggaatttaaggattttgccgccgggcgaaagtctatagcgttagatttagtgacagagattggcagggtcccatcccacttagcccatcggaccagaaatgcgttagataatttagtgatgctacatacaagcgaacatgggggacgggcatatcgacatgctgtcgaagaactgcccgagacaatggagacattattactacttggattgatgatattactcacaggcggtgctatgctattcctcatatcaggtaagggtataggaaaaacgtcaataggtctcatttgcgttattgtgtctagcggaatgctatggatggcggatgtgcctctacaatggattgcatcggcaatagtattagagttctttatgatggtacttttaatacccgaacccgaaaaacaaagaactcctcaagacaatcagttagcctatgtagttattggaatcttgacattagcagcaattgtagctgccaacgagatggggttacttgagacgacaaaaagggacttaggtatgtccaaagaacccggtgtagttagtcctacttcgtatttagacgtcgatttacatcctgccagcgcttggacattatatgcggtagcgactacagttattacaccgatgctgagacatacaatagagaactcgaccgctaatgtgagcctcgctgccatcgcaaaccaagctgtggtgctgatggggcttgacaaaggttggcccatttcaaagatggatctaggagtaccattgttagcactaggttgttattcccaagttaatcctctcactttgacggctgcagtattactactggttacgcattatgcaattattggaccaggattgcaagcaaaagcaacaagagaagcacagaaaaggacagcagcgggaatcatgaaaaatccaacagtcgacggtataatgacaatagaccttgatccagttatatatgactcaaaattcgaaaaacaactagggcaggtcatgcttttagtcttatgcgcggtccaactactactaatgcgtacgtcatgggcactatgcgaggctttgactctggccacgggcccaataactacactttgggaaggctccccagggaaattttggaacacaactattgcagtaagtatggccaacattttccgaggaagctatcttgcaggcgctgggctcgcattttccatcatgaagagtgttggcacgggacggcgaggcactggctctcagggagaaaccctgggcgaaaaatggaagaagaaacttaatcaattatctaggaaagagtttgatctatataagaaatccggaattacggaggtagatcgaaccgaagctaaagaaggattaaaaaggggagaaacaacccaccatgctgttagtagaggaagtgctaaacttcagtggtttgtagaaaggaatatggtaatacccgaaggaagagtaatcgacttaggttgtgggcggggtggatggtcctattactgtgcaggactaaagaaagtaactgaagtaaggggatacactaagggaggaccaggacacgaagaaccggtacccatgtccacatatggatggaatatagtaaaactcatgagtggtaaagatgtgttctatcttccacccgaaaaatgtgatactcttttgtgcgacattggggaatcctctcccagtccaacagtagaggaatcgagaacaattagggtactgaagatggtagagccatggttgaggaacaatcagttctgtataaaggtactgaacccatatatgcctacagtcatagaacacttggagcgattacagaggaagtacggaggcatgttggttagaaatccattatccaggaactccactcacgagatgtactggattagcaatggaacaggtaatatcgtaagttctgtaaacatggtgagcagactgctattaaaccgatttacaatgacgcacagaagaccaacgattgagaaagacgtcgaccttggggcaggtacacggcatgtaaatgcagaaccggaaacaccaaatatggatgtaataggagaacggattaaacgtatcaaagaagaacattcctctacctggcactatgacgatgaaaatccttataaaacttgggcttaccacggatcatatgaagtgaaagccacgggtagtgcctcatcaatgataaatggggttgtcaagttgctaacaaaaccgtgggatgttgtgcccatggtaactcaaatggccatgaccgatacaaccccgttcggacaacaaagggtcttcaaagaaaaagtggatacacggactccgaggcctatgcccggtaccagaaaagtcatggaaattacagcagaatggctatggcgaaccttagggaggaacaagaaaccaaggttgtgtactcgtgaagaatttacaaagaaagtgcggacaaatgcagctatgggcgcggtattcacagaagagaatcaatgggactcagcacgcgcagcagttgaagacgaagaattttggaaattagtggaccgcgaacgtgaactgcacaaattggggaaatgtggaagttgtgtatataacatgatgggaaaacgagagaagaaactaggtgagtttgggaaagccaagggatctcgggctatttggtatatgtggttaggagcgcgataccttgaatttgaagcacttggctttttaaacgaagaccattggttcagtcgagaaaattcctactcaggtgtcgaaggggaaggcttacataaattagggtacatcctaagagatatttcaaagattccaggaggagcaatgtatgcagacgatactgccgggtgggatacaagaatcactgaagacgatttgcataacgaggagaaaataactcaacaaatggatcccgagcatcggcaattagcaaatgccatattcaaactaacgtatcaaaataaagtcgtaaaagttcaaagaccaactcctaaagggactgtaatggacattatatcccgcaaagaccaaagaggcagtggacaagttggaacatatggactcaacacatttacaaatatggaagctcaattagtaagacagatggaaggtgaaggcgtgctaagcaaggcggatttagaaaatccacacctccttgagaagaaaataactcaatggttggagacgaaaggtgtagaaagactcaaacgtatggcaatctccggagacgattgcgtcgtcaagccaatagatgacagattcgctaacgccttattagctctaaacgatatgggaaaagtccgaaaagacattccacaatggcaaccgtcaaagggttggcacgactggcagcaagtaccattttgctctcaccactttcatgaattgatcatgaaagacggtcgtaaacttgtcgttccttgtaggccccaagatgagttaattggtagggctaggatctcacaaggggcaggatggagcctgaaggagacagcttgtttagggaaagcatatgctcaaatgtggagcctaatgtatttccacagacgggatttacgcttagcttctaatgcaatttgttctgcagtccccgttcattggattcccacatcaagaacaacttggagtattcacgctcatcatcagtggatgacaacagaggatatgttaacagtttggaatcgggtttggattgaagacaatccatggatggaagacaaaacaccagtcacgacttgggaagatgtaccatatcttggaaaaagggaagaccaatggtgtggatctctaattggtcttacaagtagagcaacatgggcccaaaacatattaaccgcaatccaacaggtccgatctttaatcggagatgaagagttcctggactacatgcctagtatgaaaagattcagaaaagaagaagagtctgagggtgccatctggtaa

SEQ ID NO: 23108 - RNA, 9873 nt, synthetic construct
  misc_feature 1..9873: note = derived and/or modified CDS sequence (opt6) from DENV-3__GU131916__SS-prME
  source 1..9873: mol_type = other RNA
acgagcctatgcctcatgatgatgttacctgcaacattagcgtttcatctcacatcaagagatggggaacctcgaatgatagtaggtaaaaatgaaaggggaaaatctctactattcaaaacagcatcaggcatcaatatgtgcactttaattgccatggatctcggggaaatgtgcgatgatactgtcacatataaatgtccattgatagcagaagtagaaccggaagacatcgattgttggtgtaacttaacttcaacgtgggtgacctacgggacttgcaaccaagctggggaacacaggcgcgacaaaaggagtgttgcattagctcctcatgtaggcatgggacttgatacacgaactcaaacgtggatgtctgcagaaggcgcatggcgtcaagtggaaaaagttgaaacctgggcacttcgtcatccaggatttaccatactcgcattatttttagcacactacataggaacctcattaacacaaaaagtcgtgatctttattctgctgatgttagtcacgccctcgatgacaatgagatgcgttggcgtagggaatcgagattttgttgaaggactatcaggtgctacttgggtagatgtggtgcttgaacatggcggttgcgtaactacgatggcgaaatcaaaaccaacgttggatattgaattacagaaaacggaagcaactcaactggcaactttgaggaaactatgtattgaaggtaaaataacaaatatcactactgactcccgatgccccacacaaggtgaagccaccctaccagaagaacaggaccaaaattatgtttgtaaacacacttatgttgacagaggctggggtaacgggtgtggactatttggaaaaggaagtcttgttacatgcgcaaaatttcaatgtttagaacctatagaagggaaagttgtgcaatatgaaaatctcaaatataccgtgattataacagtccatactggagaccagcatcaagtaggaaacgatacgcaaggggtaacggtggaaatcacaccacaagcaagtactgtagaagcagtacttccggaatatggtacactaggtttagaatgtagtccacgtactgggctagactttaacgaaatgatattgttaacaatgaaaaacaaagcatggatggtccacagacaatggttctttgatttaccattaccctggactagcggtgcaacaacagaaacccctacatggaacagaaaagaacttttagtaacctttaaaaatgcacacgcgaagaaacaagaggtcgtcgtcttaggaagtcaggagggagcgatgcatacagcattaacaggggcaacggaaatccaaaatagtggtggcaccagtatatttgcggggcacctaaaatgccgattgaaaatggacaaactcgaactcaaagggatgtcttacgcaatgtgcttaaatactttcgtactgaagaaagaagtatctgaaacacagcacggcaccatattgatcaaagttgaatataaaggagaagatgcaccttgtaaaatacctttttccactgaagatggtcaaggcaaagcccataacggcagactcataacggcaaacccagttgtaactaagaaagaggaaccggtgaatatagaggctgaacctccttttggggagagcaatattgtaataggtatcggagacaaagcactcaaaattaattggtacaagaaagggtcctctatcggcaaaatgttcgaggctacagcacgtggagcacgtagaatggcgatattgggtgacacagcgtgggattttggatcggtaggcggagtactgaactcgttaggtaaaatggtacaccagatttttggatctgcatatacggcgttattctcgggggtctcatggataatgaaaataggcatcggcgtattactcacctggattggattaaactccaaaaacacatctatgtccttttcgtgtattgtaataggcataattactttgtatctcggagccgtagtacaagcggacatgggatgtgttataaattggaaaggaaaagaattaaaatgtggatcgggtatatttgtcacaaacgaagtacacacatggacggaacagtacaaattccaagctgatagcccgaaaaggttagcaacagcgatagccggtgcatgggaaaatggagtttgtggcattcgatcaaccactcgcatggagaacttattatggaaacaaatagctaatgagttaaactatattctctgggaaaacaacattaaattaacagttgtggtgggtgatataataggcgttttagaacaaggaaaacggactcttacaccccaacctatggagttaaaatacagttggaaaacatggggaaaagccaaaattgttacagcagagacccaaaattccagctttatcattgatggtccaaacacaccggaatgtccctctgcgtctcgagcatggaatgtttgggaggtcgaagactacggatttggtgtatttactaccaacatatggctaaaacttagggaagtatatactcaatcctgcgatcatagactgatgtctgcagcaattaaagacgaaagggcagtccatgctgatatgggatattggatcgagtcacagaaaaatgggagttggaaacttgaaaaggcttcgtttatcgaagtaaaaacatgtacttggcctaaatcacatacactatggtcgaatggcgttcttgagtctgatatgatcatacctaaatcactagccggtcctatatctcagcataaccatcggccaggataccatacacagacagctggcccgtggcatttagggaaactcgagcttgatttcaattactgtgagggaaccactgttgtgattacggaaaattgtggcacacggggaccgagtttaagaacaacaactgtaagtggtaaactcattcatgaatggtgttgcagaagctgtacgctaccaccactaagatatatgggagaggatggctgctggtatggtatggaaatacgaccaatcaatgaaaaagaggaaaacatggttaagagtcttgtgtcagcgggatctggaaaagtagacaactttacgatgggagtactctgcttggctatattatttgaagaggtgatgagaggtaaatttgggaaaaagcacatgatagcaggggtattgtttacttttgtgctattgctatcgggacagattacatggcgagatatggctcatactttgataatgattggctcaaatgcgagtgacagaatgggcatgggagtcacctatttagcacttatcgcgacttttaagattcaaccatttctcgcccttggcttctttttgaggaaactgacaagccgtgaaaatttactactcggcgtcggtttggcaatggcgacaacacttcaattaccagaagacatagaacaaatggccaatggtatagcccttggattaatgaccttaaagctcattactcaattcgaaacttaccaattatggaccgctttagtaagtctaacatgttcaaacacaatattcaccttaactgtcgcttggaggacagcaacattgatcctagcaggcgtaagtctgcttccactttgccaatcctccagcatgagaaaaactgactggcttcctatgacagtcgctgctatgggagtaccgccactacccttatttattttcagcttaaaagacacaccgaaacgtcgaagctggccgttaaacgagggagttatggctgtaggcttagtcagtatattggctagttcattactcaggaacgacgttcctatggccggaccactcgttgccggaggattactcattgcatgttacgtgatcactggcaccagtgccgacttgacagtagaaaaagcagcagatgtcacatgggaagaagaagcagaacaaacaggtgtaagtcacaacctgatgataacagtggacgatgatggaactatgagaataaaagacgatgaaacagaaaatatcttaacagtgcttttgaaaacagctttattgatcgtgtcaggaatttttccatattcaatcccggcaacactactggtttggcatacatggcaaaaacaaacacaaaggtcaggagtgctatgggatgtgccatctccaccagaaactcaaaaagcagaactagaggagggagtttatcgcattaaacagcaaggaatattcggaaagactcaagtaggagtaggcgtacaaaaggaaggtgtatttcatacgatgtggcacgtaacacgtggggccgttttgacgcacaatggtaagagactggagcccaattgggcatctgtgaagaaagatctgatatcttacgggggtgggtggagattaagcgcgcaatggcagaaaggggaagaggttcaggttatcgctgtagaacctggtaaaaatcctaaaaattttcaaactatgccaggtattttccaaacaaccacaggggaaataggtgccattgcgttggactttaaacctggaactagcggatcgcctattatcaacagggagggcaaggtcgtaggattatatgggaatggtgtaattaccaaaaatggcggctacgtctccggtatagcacagactaacgctgaacccgatggaccaacacctgaactggaagaagaaatgtttaagaaaaggaacctaacaataatggacctccatccgggcagtggcaaaacccgcaagtatttaccagcaatagttcgagaggcaataaagcgaagattgagaactttaatcttggctcctacacgtgttgtggccgctgagatggaagaagccttgaagggcttaccgattcgctaccaaacgacggccacaaaatctgaacatacagggcgcgaaatcgtagatttaatgtgtcacgctacatttacaatgcgattacttagtccagtacgtgtaccaaactataatctcgtgataatggatgaggcacatttcacggatccggccagcattgcagcaagaggctatataagcacaagggttggcatgggagaggctgctgctatatttatgaccgcaacaccaccgggcactgctgaagcatttccacaatcgaatgcgccaattcaggatgaggaacgcgatatacctgaacgttcatggaatagcggaaatgaatggattacagacttcgtaggcaagacagtgtggtttgtgccttcaattaaagcgggaaatgatatagcaaactgcttaaggaaaaatggtaagaaagtgattcaacttagcagaaaaacatttgacactgaatatcagaaaacacgtttgaatgactgggattttgtcgtgacaacagacatatcagaaatgggggcaaatttcaaagcagacagagtaattgacccgagaaggtgcctgaagccagttattttaacagacgggccagaacgggttatcttagcaggccctatgccggtaactgcagcatcagccgcccaaagacgtggcagagttggcagaaacccgcagaaagaaaacgatcaatatatttttaccggacaaccactcaataatgacgaggaccatgcgcattggaccgaagcgaaaatgttattagataatattaatacaccagaggggataataccagcgttattcgaacccgagcgcgagaaaagtgcagctatagacggagaatatagacttaaaggcgagagtaggaaaacgtttgttgaactgatgagacgaggtgatttacccgtctggttagcccacaaagttgcttcggaaggaatcaaatacacggatcggaaatggtgcttcgatggagagagaaacaaccaaatactcgaagaaaatatggatgtcgagatatggacaaaagaaggcgagaggaagaaattaaggcccagatggctcgacgcgaggacatacagtgacccactagccctcaaggaatttaaagatttcgctgctggaagaaaaagtatagctttagatttagttacggaaattggacgagttccatcacatttagcacatcgtaccagaaatgcactagacaacttagtaatgctccatactagcgagcatgggggaagggcctatagacatgccgttgaagaattaccagaaactatggaaacattattgttgcttggacttatgatattattgacgtcaggtgcgatgttatttctaataagtggaaaaggaatcggaaaaacaagcatcgggctaatctgtgtgatagtaagtagtggaatgttatggatggctgacgttccgttacaatggatcgcaagtgccattgtcttagaatttttcatgatggttttattaataccggaacccgaaaaacaacgtaccccgcaagataatcagctagcatatgtggttataggcatactaacactggcagctattgtggcggcaaacgaaatggggcttctagagactactaaacgcgatctgggtatgtcaaaagaaccgggagtagttagtcctacttcttacctcgacgtagatttacatcccgcttcagcatggactctatatgcggttgcaaccacagtgattactcccatgttgcgccatacaatagaaaactcaactgctaatgtttcactagccgcaattgccaaccaggctgtagtactgatgggcctagataagggttggcctatatcaaagatggatttaggagttccattgttagcacttggttgttattcacaagttaatcccctcactttgaccgcagcagtattactgttagtaactcactatgcaattattggtcctggtctacaagcaaaagccacgagagaagcccagaaaagaactgctgcgggtatcatgaaaaaccctacggtagacggaataatgacaattgatctagatccagttatctatgatagtaaatttgaaaagcagttaggtcaagtaatgcttctggtactatgtgcagtacaactgctacttatgagaacaagttgggcactctgtgaggctttaaccttggcgacgggaccaattaccacactgtgggagggttcaccaggtaaattttggaatacaacaatagctgtgagcatggctaatatattcagagggagctacctagcgggggctggtctagcctttagtataatgaaatcagtagggacaggtagacgtggaactggaagccaaggtgaaactctgggagagaaatggaagaaaaagttgaatcagctcagtcgcaaagaatttgatttgtataagaaatcgggaataaccgaagtagaccgtacagaagcaaaagaaggattaaaaagaggcgagacgacacatcacgccgtaagccgaggatcagctaaactacaatggtttgtagagagaaatatggtaattccagaaggtcgggttatagaccttggatgcggtaggggaggctggtcatattattgcgcaggactaaagaaagttaccgaagtgcgtggatatacgaagggtggacctgggcatgaagaaccagttccaatgagtacttatggatggaatatcgtaaaacttatgagcggcaaagatgtattttacttacctccagaaaaatgtgacacgctgttgtgtgatatcggagagtcatctccatctccaacggtagaagaaagcaggacaataagagtattaaagatggttgaaccttggttaagaaacaaccaattttgtatcaaagttctaaatccatatatgccaaccgtaattgaacatttagaaagattgcaaagaaagtatggaggaatgttagtccggaacccactatcccgcaattctacccacgaaatgtattggattagcaacggtactgggaacatcgtctcaagtgtgaatatggtctcgagactactgttaaatagattcaccatgacacatagacgcccaacaatagaaaaggacgtagatttgggtgcaggaacccgacatgtgaatgcggaacccgaaacgccgaatatggatgttattggagaacgaataaaaagaataaaggaggaacactcgtcaacgtggcattacgatgatgaaaacccctataaaacttgggcctaccatggatcctacgaggtcaaagcaaccggaagtgcctctagcatgattaacggggtcgtaaaattactaacaaaaccctgggatgttgttccaatggtcacacaaatggctatgactgatacgacaccattcgggcaacagcgtgtattcaaggaaaaagttgatacgagaactcccagacctatgccaggcacaagaaaagttatggaaataaccgcagaatggttgtggagaactcttgggaggaacaagaaacccagactttgtaccagggaagaatttaccaagaaagtacgaaccaacgccgctatgggggcagtattcactgaagaaaatcaatgggactctgccagggccgcagtagaagatgaagagttttggaaacttgtggaccgcgagagggaactacataagttaggcaagtgcggaagctgcgtttataacatgatgggaaaacgtgagaaaaagctaggagagttcggaaaagctaaaggaagtagagcaatctggtatatgtggctcggggctagatatttagagttcgaagcactaggattcttaaacgaagatcattggttcagtagggaaaacagctatagcggggtagaaggtgaaggtcttcataaattaggatacattttaagagatatttccaaaatacctggaggagccatgtacgccgatgacacagcgggctgggacacgagaattacagaggacgacttacataacgaagagaagataacccaacaaatggaccctgaacatagacagctggcgaacgcaatatttaaacttacctaccaaaacaaagtagttaaagttcaacgtccgactcccaagggcacagtaatggatatcatctcacgaaaagaccaaagaggatccgggcaagtaggtacatacggacttaatacgtttacaaatatggaggcacagttagttagacaaatggaaggagaagatgtactatcgaaagcagacttagaaaatccacacctattggagaagaaaataacacaatggcttgaaacgaagggtgttgaaagacttaagcgaatggctatcagcggcgatgactgtgttgtgaagccaatagatgatcgctttgcaaacgccttacttgcactaaatgatatgggaaaggttcggaaagatatcccacagtggcagccgagtaaaggttggcatgactggcagcaagtacccttctgttcccatcattttcatgagctgattatgaaagatggtcggaaattagtagtaccttgccgtccccaagatgagctaatagggagagctaggattagtcagggcgccggatggtcgcttaaggaaacagcatgtctgggcaaagcgtatgcacagatgtggagcctgatgtattttcacagacgcgacttaaggttagcttctaatgcaatatgctccgctgttccagttcactggataccaacctcacggacaacttggtcaatacacgctcatcatcagtggatgacaactgaagacatgttaaccgtatggaatagagtctggattgaagataacccctggatggaagacaaaacaccggttacaacatgggaggatgtaccttaccttggaaagagggaagatcaatggtgtggaagtctgatcgggctcacgtctagggccacttgggcacaaaatatactcacagctatccaacaagtacgctcgttgataggagatgaagagttcagcgattacatgccaagtatgaaacgatttaggaaagaagaggaaagtgaaggggcaatctggtaa

SEQ ID NO: 23109 - RNA, 9873 nt, synthetic construct
  misc_feature 1..9873: note = derived and/or modified CDS sequence (opt6) from DENV-3__GU131917__SS-prME
  source 1..9873: mol_type = other RNA
acaagtttatgtctgatgatgatgctgcccgcaacattagcatttcatttaacatcaagagacggggaacctagaatgattgttggtaaaaatgaaagaggaaaatcgttgttatttaaaactgcgagcgggattaatatgtgcaccttgatagctatggatttgggtgaaatgtgtgatgatacagtcacatataaatgtcctctaatagcagaagtcgaaccagaagatattgattgttggtgtaatttgacttcgacttgggtaacgtatggtacgtgtaatcaagctggagaacaccgaagggataaacggtcagtcgcacttgctccccacgtaggaatgggactagatactagaacacaaacgtggatgagcgcagaaggtgcgtggagacaagttgaaaaagtagaaacctgggctttaagacacccaggttttactatattggcattgtttctggcacactatatagggacttcacttacacaaaaagttgtaatatttacattactaatgttagtgacgcctagtatgactatgcgatgtgtaggtgtaggaaatagggattttgtagaaggactctcgggagcaacttgggtagacgttgtccttgagcatggaggctgcgtaactacaatggctaaatctaaaccaacactagacatcgaactacagaaaacggaagcaacccaactcgcaacattgaggaaactatgtattgaaggaaaaataacaaacattactacagactcaaggtgtccaactcaaggagaggctactctacctgaggagcaagatcaaaattatgtttgtaaacacacttatgttgatcggggctgggggaatggttgtgggttatttggaaaaggttcattagtaacctgcgccaaatttcaatgcttggaaccaatagaaggaaaagttgtacaatacgagaatctgaaatataccgttatcataacagtccacactggcgaccaacatcaagtcggcaacgatacacaaggagtaacagtcgaaataacaccccaagcgagcacggtagaagccgtattaccagaatacggcacattgggattagaatgctcccctcgaacgggcctagacttcaacgaaatgatattactcaccatgaaaaacaaagcctggatggtacatagacaatggtttttcgatctaccgctgccatggactagcggtgctacaacggaaacacccacgtggaacagaaaagagctattggtaaccttcaaaaatgctcacgccaagaaacaagaagttgttgttttgggtagccaggaaggagctatgcatacagctttgacaggagcaactgagattcaaaacagtgggggaacgagcatctttgctggccacctaaaatgcaggctaaaaatggataaactggaactaaagggaatgagttatgcaatgtgtctaaatacctttgttctaaagaaagaagtgagcgagacacaacatggaacaatcttaattaaagtagaatacaaaggagaagatgctccatgcaaaataccattttcgacagaggatggccaaggtaaagcacataacggtcgcctaataactgctaatccggtagtaaccaagaaagaagaaccagttaacattgaagcagaaccaccgtttggagagagcaacattgtaatagggattggcgacaaagcattgaaaataaattggtacaagaaagggtcatcgattggcaagatgtttgaagctacggcaaggggcgcgaggcgtatggcaatactaggagatacagcctgggattttggtagtgtgggtggagtcctaaattcgctcggaaaaatggtgcatcaaattttcggtagtgcctatactgcactattctcaggggtgagctggattatgaaaataggtataggagttttgctcacctggatcggtctgaacagcaaaaatacaagtatgtcgtttagttgtatagttataggaataataaccctttatctaggagcagtagtacaagctgatatgggttgcgtaataaattggaaaggtaaagaacttaagtgtgggaatggaatatttgtaactaatgaggtacatacttggacagaacaatataaattccaagctgattcgcccaaacgtctcgcaaccgctatagccggagcttgggaaaatggggtatgtgggataaggagtaccactcgtatggaaaatcttctatggaaacagatcgctaatgaactaaattatatcttgtgggaaaataatataaagttgacagtggttgtaggcgacattataggagtgttggagcagggcaaacgtacattaacaccgcagccaatggagttgaaatatagttggaagacatggggtaaggccaagattgtcacagcagagacgcaaaattcatcatttataattgacggtccaaatacccccgaatgcccatcggcatcaagagcttggaatgtgtgggaagtcgaggactatggatttggagtgttcactacaaacatatggttaaaacttagagaggtctatacacagagttgtgatcataggctgatgtcagctgccataaaagatgaaagagccgtccatgctgatatggggtattggatagaaagtcagaaaaacggctcatggaaactagaaaaggcttcgtttatagaagtgaaaacgtgtacttggccaaaaagtcacactttatggtccaacggagtactagagtctgacatgataataccaaagtcattagccggtcccatatcccagcataaccaccgacctggttaccatacacaaacagccggcccttggcacctaggaaaactagaattagattttaattattgcgagggtacaacagttgtaattgcggaaaactgtggaacaaggggtcccagtctgcgaaccacaacggtaagcggtaaactaatacatgaatggtgctgcagatcatgtaccctacccccactaagatatatgggagaagatggttgctggtatggtatggaaataagaccaataaatgaaaaagaggaaaatatggttaaatccttagtctctgctggctcaggaaaagtggacaatttcactatgggagtcttatgcctggctattctctttgaagaagtgatgagaggtaaatttgggaagaaacatatgattgcaggagtgctattcacgtttgtactactcctttctggccagattacgtggcgggatatggcccatactttaataatgattggctcaaatgcgtcagatagaatgggtatgggagttacctatctagcattaatcgcgacattcaaaatccaaccattcctagcattagggttctttcttcggaaactcacaagtagagaaaatttgttattaggagtagggctagcaatggcgactacactacagttacccgaagatattgagcaaatggcgaatggaatagcactagggttaatgacgctcaagctaataacacaatttgaaacatatcagctttggactgccttagtgagtctaacatgttccaataccatatttacattaactgtagcctggagaacggcgaccttaatactagcgggggttagcctccttcctctttgtcaatcctcaagtatgcgtaaaactgattggttaccgatgacggtcgcggcaatgggagtcccaccattacccctattcatattctctttaaaagacactccgaagagaagaagttggccccttaatgaaggagttatggccgtaggtctagttagtattctcgcttcgtccttgctgaggaacgacgtacccatggccggacccttagttgccggcgggctcctaattgcttgttacgttatcacagggacaagtgccgatctaacagtcgaaaaagcagcagatgttacttgggaagaggaagccgagcaaactggagtatcacacaatctgatgataacagtggatgatgatggaactatgagaattaaagacgatgaaaccgagaatatacttaccgtattattaaaaactgcattgctaatagtctcgggaatttttccgtacagtattccggcaactttgctagtttggcatacctggcaaaaacaaacgcaacgatctggggttctctgggatgtgccatcaccacccgaaacacagaaagcggaactagaagaaggagtttaccgaattaaacaacaaggaatatttggcaaaacacaggttggcgtaggtgttcagaaagaaggtgtttttcacacaatgtggcatgtaacgcgtggagctgttctgactcataatgggaaacgtttggagcccaactgggcatctgtgaagaaagacctaatcagttatgggggaggatggaggttgagcgcccaatggcaaaaaggggaggaggtccaggtaatagcagtagagcctggcaaaaatccaaagaattttcaaactatgcctggaatatttcaaacaactactggggaaattggtgcgatcgccttggattttaagccgggcaccagtggcagtcctattattaacagggaagggaaagtagtaggactctacgggaatggtgttgtaaccaaaaatggtgggtatgttagtggaatagcccagactaatgctgagccagacgggccaaccccagaattggaagaggaaatgtttaagaaaagaaacctaacgattatggatctacacccaggtagcggaaagacccgaaagtatttaccagctattgtaagagaagctataaaacgtaggctgagaaccctaatattagccccaacacgagttgtcgccgcggaaatggaagaggccctcaaagggctcccaattagataccagaccactgctactaagtccgagcacacaggtagagaaatcgtagatctaatgtgtcatgcaacattcaccatgcgccttctaagcccagtaagggtgccaaactataatttagtaattatggacgaagcacactttacagatccagcatctatagcagcgcgcggttatatttcgactcgtgtaggcatgggcgaggctgcggccatctttatgacagccacacccccaggaacagcagaagcctttccgcaaagtaacgccccaatacaggacgaagaacgagacatacctgaaaggagttggaatagtggaaacgaatggataacggattttgtaggaaaaacagtatggtttgtaccctctataaaagctggaaacgatatagctaactgcttgcgcaagaatggcaagaaagtgatacagttaagtcgcaaaacatttgataccgaataccagaaaacacggctaaacgactgggattttgttgtaacaacagatattagtgagatgggcgcaaattttaaagcggatcgggtgatagatccgagaagatgtttaaaaccagtaattctcacggatggaccagaaagggtgatactggcaggacccatgccagtgaccgctgcaagtgctgctcaaagaaggggacgagttggtagaaacccccaaaaagaaaatgatcaatacatctttacaggacaacccttaaacaacgacgaagaccatgcacattggacagaggccaaaatgttactagacaatataaatacaccggaaggaataataccggcactgtttgaaccagaacgtgagaaatcagctgcaatcgatggagaatatagattaaagggggaatcacgcaagacctttgtggagttaatgagacgtggggacctaccagtttggctcgcacataaagtcgcctctgaagggataaaatacacggatagaaaatggtgtttcgatggtgaacgcaataaccaaatactagaggagaatatggacgtagagatttggaccaaggaaggagaacgcaagaaattaaggccacgatggttggatgccaggacctatagtgatcccctcgcactgaaggaatttaaggatttcgcagcgggtaggaaatcaatagccttagatctagtgaccgagattggcagagtcccaagccatctcgcacaccgaacaaggaatgctctcgacaatctagtaatgctacatactagcgagcatggtggcagagcctatagacatgcagttgaagaactaccagaaacaatggaaacattacttttactaggccttatgatattactgacaggtggcgctatgcttttcctgatatcagggaaagggatcggaaaaactagcattggattaatctgtgttattgtatcatcaggaatgttatggatggctgatgttccgctacaatggattgcaagtgctattgtattagaatttttcatgatggtactgttaataccagaacctgagaaacaacgaacaccacaggacaaccaactggcatacgtggtaataggaatcttaacgttggcagcaattgtagcggctaatgaaatgggtctcctagaaacaactaagcgagatttaggaatgagtaaagaacctggtgtagtttcgccgacgtcctacttagatgttgatttgcatcctgcgagcgcgtggacattgtatgcggtcgccactacagttataacaccaatgcttagacacactattgaaaatagtacagctaatgtatcgctagctgcaattgccaatcaagccgttgtattaatgggtcttgacaaaggatggcccatatctaagatggacttgggtgttcctctactagctctgggatgttatagtcaagtcaatccattaaccttgactgcagctgtactgttactggtaacacattacgctattatcggtcctggactccaagcgaaagcaaccagagaagcacaaaaacgtacagctgctggaataatgaaaaatccaactgtagatggaattatgactatcgaccttgatccagttatatatgacagcaaattcgaaaagcaactaggccaagtgatgcttctggtattgtgcgccgtgcaactgcttttaatgagaactagctgggcgctttgtgaagcactaactctcgcaacaggtccaattacaacactttgggaaggatcaccggggaagttttggaatacgactattgcggtctcaatggcaaatatatttagaggaagttacctggcaggggcagggttagcctttagcataatgaaatcagtaggtacaggaaaacgtgggaccggatcgcaaggggaaactcttggtgaaaagtggaagaagaaactcaatcaactgtcgcgaaaagagttcgacttgtacaagaaatccggcatcacagaggttgaccgaagtgaagccaaggaggggctaaaacggggagagacaacacatcacgcagtgtcaaggggtagtgcaaaactgcaatggtttgtggaaaggaatatggtgataccggaaggcagagtaatagatttaggatgcggtagaggcgggtggagttattactgcgcaggcctcaagaaagttaccgaggtgagaggatatacaaagggtggccccggacatgaagaaccagtaccgatgtccacgtacgggtggaatatagtaaaactaatgtctggaaaagatgtattttatttaccacccgaaaagtgtgatacactcttgtgcgatataggtgaatcttcccccagccctacagttgaggaatccaggacgatccgcgtattgaaaatggtagaaccgtggctacgaaataaccaattctgtataaaagttttaaacccgtacatgccgactgtaatagaacacctagaacgactgcaaaggaaatatggaggcatgctagttagaaatccattaagtcgtaatagcacacatgagatgtattggataagtaatgggaccgggaatatagtatccagcgtaaacatggtttcaagactattattaaacagatttacaatgacacacagaagacctacgatcgagaaagatgtcgatttgggggcgggaacaagacacgtaaatgccgaaccggagacaccaaacatggatgtcattggcgaacgaataaaaagaataaaagaagaacatagttcaacatggcattacgatgacgaaaatccttataaaacatgggcctaccacggaagttatgaagttaaggcaactgggagtgcatcctccatgataaatggagtggtgaagttattaactaaaccatgggatgtcgtcccaatggtcacacaaatggctatgactgacactacacccttcggacagcaacgagtatttaaggaaaaagtggatacaagaacaccccgaccaatgcctgggacacggaaagtaatggaaataacggcagaatggctatggagaaccttgggacgaaacaaaaagccacgtttatgtactagagaagaatttaccaagaaagtacgaacaaatgctgcgatgggagcagtgtttacagaagaaaaccagtgggattcagcccgagcagccgtagaggatgaagagttctggaaacttgtagataaagaacgagagctccataagctaggcaagtgtggttcatgtgtatacaatatgatgggaaaaagagagaagaagttgggagagttcggaaaggcaaaaggctctagagctatttggtacatgtggctaggtgcaaggtatttagagttcgaagcactaggattcctaaacgaagatcactggtttagtagagaaaatagctactcaggagttgagggagaaggacttcataaattagggtatatattaagagatatatcaaaaatcccaggaggggcgatgtatgccgacgatacggctgggtgggatacacgcatcacggaagatgacttacacaacgaggagaaaatcactcaacaaatggaccctgagcatcgacaattagcaaatgctatatttaagctaacgtaccaaaataaggttgtgaaagtacaaaggccgacacccaaaggtacagtaatggacattatctcccgaaaagaccaacgtggttcaggtcaagttggtacgtacggattaaatactttcacaaacatggaggcacagcttgtacggcaaatggagggagaaggcgttttaagcaaagcagatttggaaaatccacatttacttgagaagaaaattatccaatggttagagacgaaaggtgtcgagagactaaagaggatggcaatcagtggagacgattgcgttgtaaaacctatcgacgatcgatttgcaaatgccctattagcactaaatgacatgggtaaggtacggaaagacatccctcaatggcagccttccaaaggatggcacgattggcaacaagtacccttttgttcacatcactttcatgaattaatcatgaaggatggtcgaaaattggtagtgccatgtcgacctcaagatgaactaattggccgggcacgtatctctcagggagcgggttggtccttaaaagagaccgcttgtctcggcaaggcctacgcacaaatgtggagtctaatgtattttcaccgaagagatttacgactagctagcaatgcaatatgttccgcggtccccgtacattggattccaacgagtagaaccacttggagcatacacgcacatcaccaatggatgacgacagaagatatgttgagtgtttggaacagagtctggatagaggacaatccttggatggaagacaagacgccagttaccacatgggaagatgtaccgtacctgggtaaaagggaagatcaatggtgtggctcactgataggactaacctcacgagccacttgggcccaaaacatacttacggcaatacaacaagttagatccttaatcggcgacgaggagttccttgactatatgccatcgatgaagagattcagaaaagaagaagagtcagaaggggccatatggtga

SEQ ID NO: 23110 - RNA, 9873 nt, synthetic construct
  misc_feature 1..9873: note = derived and/or modified CDS sequence (opt6) from DENV-3__GU131918__SS-prME
  source 1..9873: mol_type = other RNA
acaagtttatgtctaatgatgatgttacctgcaacactagcattccacctaacatcaagagacggcgaaccaagaatgatcgtgggtaaaaatgaaagagggaaaagtcttctatttaaaacagcaagcggtattaacatgtgtacactaatcgcaatggacttgggtgaaatgtgcgacgacacggtcacatataaatgtccattaatcgcagaagtcgagcctgaagatatagactgttggtgtaatctgacgagcacatgggttacctatggtacctgtaaccaagccggtgaacacagaagagataaaagatcagtcgctttagccccgcatgtaggaatgggactagacacccgtacacaaacatggatgtcggccgaaggtgcatggcgacaagttgaaaaagttgaaacatgggctttgcgtcatcctggattcactattttagccctctttcttgcacattatatagggacgtctcttacgcagaaagtcgtaatatttattttattaatgctggtaactccttccatgactatgcgatgtgttggagttggaaatagagactttgtagaaggactaagcggagctacatgggtagatgttgtcttggagcatggcgggtgcgtcaccacaatggccaaaagtaaaccaactttggatattgaacttcagaaaacagaagctactcaactagcaacgctaagaaaattgtgcatagaaggcaaaataacaaatataacaacagattcgagatgtcctacccaaggggaagcgaccctaccagaagaacaagatcaaaattacgtttgtaaacatacttacgtagatcgaggttgggggaacgggtgtggattattcggtaaaggaagtttagtaacatgtgctaaatttcaatgtttggaaccaatagaagggaaagtagtgcaatacgagaatctaaaatacacggtgataataacagtacatacaggggaccaacaccaagtaggaaacgatacacaaggagtgaccgtagagataacaccacaagcatcaacagtagaagcagtattaccggaatacggaacgctaggattggaatgttcaccaagaactggcttagattttaacgagatgatattattaacaatgaaaaataaagcatggatggtacacagacaatggttctttgatttacccttaccatggacaagtggagcaacgacagaaacgccaacatggaatcgaaaagaacttctcgttacatttaaaaacgcacatgccaagaaacaagaggtagtagtcttaggttctcaggaaggagcaatgcataccgcgttgacaggagcaacagagatccagaatagtggtggtactagcatcttcgcaggacatctcaaatgtagattaaaaatggacaaattagagctaaaagggatgagctatgctatgtgtttaaatacatttgtattaaagaaagaggtctcggaaacacaacacggtacaattttgatcaaagtcgaatataaaggcgaagacgcaccatgtaaaatcccattctctacagaggatggccagggaaaagcacataacggtcgactaataacagcaaatccagtagttaccaagaaagaagaaccagtaaatatcgaagcggaaccaccctttggtgaaagtaatatagttatagggataggcgataaggctttaaaaattaattggtataagaaagggagtagtatcggaaaaatgtttgaagcaactgcacgtggagcacgaagaatggcaatacttggggatacagcgtgggatttcggatcagtaggtggtgtactaaacagtcttggtaaaatggttcaccagatattcggatcggcgtatactgcactgttctccggcgtttcttggattatgaaaatagggataggcgtattacttacttggataggcctgaacagcaaaaatacatcaatgagcttttcctgtatagtaatcgggataattacactttaccttggagcagtggttcaggctgatatgggttgtgttataaattggaaaggaaaagagttaaagtgtggtaacggcatatttgtcacaaatgaggtacacacatggactgaacaatataaattccaggcggattcacctaaaaggttagcaactgcaatcgcaggagcatgggagaatggtgtgtgcggtatccgctctactactcgaatggagaatttattgtggaaacaaatcgcaaatgaattaaattatatactatgggagaataacatcaagttgacagtggtagtaggagacataataggagtcttagaacaagggaaacgtaccttaacgccacaaccaatggaattgaaatacagctggaaaacatggggaaaggcaaaaatagtaacagcggagacacaaaattcatctttcataatcgacggtccaaacacgccggagtgtccgagcgcttcacgagcctggaatgtatgggaagtagaagattacggatttggcgtttttacgacaaacatctggctgaaattaagggaggtatatacacaatcatgtgatcatagattaatgtcagccgctataaaagatgagcgagcagtccacgccgacatgggctattggattgaatcgcagaaaaatggatcatggaaactggaaaaagcatcttttatagaagttaagacatgtacgtggccgaagtctcacacactttggagtaatggagttttggaatcggatatgattattcctaaatccctagctggccccatatctcaacataaccatagaccaggttatcatacgcaaacagcaggaccttggcaccttgggaaattagaactggactttaattattgtgagggcacaacagtggtaataacagaaaactgtggtacaagaggtccatccttacggaccacaacggtttccggaaaattaatacacgaatggtgttgcaggagttgcactctaccaccattaagatatatgggagaggatggttgctggtacgggatggaaatacgtccaataaatgagaaagaagaaaatatggtaaaatcattagtaagcgctggaagtggcaaggtcgataatttcaccatgggcgtgctttgcttggcaatattatttgaggaagtaatgagaggaaaatttggtaagaaacatatgatagcgggagtccttttcacattcgtactcttattatcaggacaaataacatggcgcgacatggcacacacactaataatgattggttccaacgcatcggatagaatgggcatgggtgtaacatacttagcattgatcgccactttcaaaattcaaccatttctagcactgggtttcttcttaaggaaactaacctcacgagagaaccttttgttaggagtaggcctagcaatggctactacgttgcaattacccgaagacatagaacaaatggcaaatggaatagcactgggcctaatgactctaaaattaataacccaattcgagacataccaactctggacagccctcgtatcattaacatgcagtaacaccatattcacactcacggttgcatggagaactgctacccttatactagccggggtatccttattaccattatgtcagtccagttctatgagaaaaacagactggttacctatgactgtagcagcaatgggcgttccgccactgcctcttttcatcttctcccttaaagacactccaaaacgaagaagttggccgctaaatgaaggagtaatggccgtaggtttagtatccatcttggcatcaagtctactgcgtaatgacgtccccatggctggtcccctagttgccggtggactccttatagcgtgctatgtaataactggaacatcagcagatttaacagtagagaaggctgctgatgtaacgtgggaagaagaagctgaacaaactggcgttagccataaccttatgataacagtagacgatgacggtacgatgcgaataaaagatgatgaaacagaaaacatcttaacagtactactaaaaactgcactattaatagtttcaggcattttcccgtactcaatcccagcgacactactggtatggcacacatggcaaaaacaaactcagagaagcggagttctatgggatgtcccaagcccacctgagacccagaaagccgaactagaagagggagtttatcgaataaaacagcagggcatctttggaaaaactcaagtcggtgtgggagtacaaaaagaaggagtttttcatacgatgtggcacgtgaccagaggagcagtcctcacacataatggtaagaggctagaaccaaactgggcctcagttaaaaaggatctgatctcatacggtgggggttggcgattaagtgcacagtggcaaaaaggtgaagaagtccaagttatagcagtagaaccaggtaaaaatcccaaaaattttcaaaccatgccagggatttttcagacaacgacaggcgaaataggcgcaatcgctctagatttcaaaccagggacttctggctcgccaatcattaaccgcgaaggaaaagtggttggtttgtatggtaatggcgttgttaccaaaaacggaggatacgtatcaggaatagctcaaactaatgccgaaccggatggtcctactccagaattagaagaagaaatgttcaagaaaagaaatttaacgattatggacttacacccaggttccggcaagacacgaaaatacctgccggctattgtccgcgaagcaataaagagaagattacgaactttgatattagcccctacaagggtggttgcggcagagatggaagaagcacttaaaggactccctatacgataccaaaccacagcgactaaaagtgaacacacgggacgggaaatagttgatttaatgtgtcatgctacgttcacgatgcgtttattaagtcctgtgagagtgccaaactataatttagtaataatggacgaggcgcattttacagatccggcttctatagctgccagaggatatattagtacacgggtcggaatgggagaagcagcagctatattcatgactgcaacaccgccaggtacagctgaagcattccctcagtctaacgcaccaatccaagacgaagaacgagatataccagagcgaagttggaactcaggtaatgagtggataacggacttcgtcggtaaaaccgtctggtttgttcctagtataaaagccggaaatgatattgctaattgcctgcgcaagaatggaaagaaagtcatacaactttctagaaaaacgttcgacacagaatatcaaaagacaagattgaatgactgggattttgttgtgactacagatatctctgaaatgggagcgaacttcaaggcagaccgtgtcattgatccaagaagatgtttgaagccagtaatactaacagacggccccgaaagagtaatactagcaggtccgatgccggtcacagctgcgtccgccgcccaaagacggggtcgagtaggtcgaaaccctcaaaaagaaaacgatcaatacatattcacaggccagcccctgaataacgacgaagaccacgctcattggacggaagcaaaaatgctattagacaatataaatacgccggaggggataattcccgccctattcgaacctgaacgtgagaaatcagcagcaatagatggcgaatacagattaaaaggtgaaagtcgtaaaacatttgtagagctgatgcggcgaggagatcttccagtatggcttgcgcacaaagtagctagtgaaggtataaaatatacagatcgtaaatggtgcttcgacggcgaacgaaataatcaaattctagaagagaatatggatgtcgaaatctggacaaaagagggcgaaaggaagaaactacgtccacgatggctagatgcaagaacctactcggatcccttagctctcaaagaatttaaagatttcgcagctgggcgaaaatcaatagcacttgacctagtaacagaaattggaagagtaccgagccacttagcacatcgtacacgtaatgcgttagataatttagttatgcttcacacgagcgaacatggcggcagagcatatagacatgcggtggaagaactccctgaaaccatggaaacattactactactggggctaatgattctcttaacaggcggagctatgctgtttttgatatccggaaaaggtattggaaagacctccattggcctcatttgtgttattgtaagcagcggaatgctttggatggcggatgtaccactccaatggatagcaagtgctatcgtattagagtttttcatgatggttttgttaataccagagcctgaaaaacagagaacaccacaagataatcaattagcgtatgtagtaatcggcatacttaccttagcagcaatcgtagctgccaatgagatgggcttactcgaaacaaccaagcgggatctaggaatgagcaaagagccaggcgtcgtatctccaacttcctaccttgacgtagacctgcatccggcaagtgcctggacattgtatgcagtcgctacaacagtcatcacacctatgctacgacatacaatagagaatagtacagcgaacgtaagtttggcagctatagctaatcaagcggtagtgttgatggggttggacaagggatggccaatatcgaagatggatttaggcgtaccgcttcttgcgttagggtgttacagccaggtgaatccacttaccttaacagcagcagtattactcctcgttacgcactacgccataatcggcccagggctacaagcaaaggctacgagagaagcacagaaaagaaccgctgctggaataatgaaaaatccgactgtggacgggataatgacaatcgatttagatccagtaatttatgactcaaagtttgaaaagcagctcggacaagtaatgctgctcgttttatgtgctgtgcaattgctcctaatgagaacatcatgggccttatgtgaagccctgacgttagccactgggccaataacaacactttgggaaggctcaccaggaaaattttggaatactactattgctgtttctatggcaaacattttcaggggctcatatttagccggtgctggactagcgttcagtattatgaagtctgttggaacgggaaagcgcggaaccggcagtcaaggtgaaactttaggtgagaaatggaaaaagaaattaaaccagttgagtcgaaaagaatttgacctatataagaaatctggtatcaccgaagtagaccgttcagaagcaaaagaaggccttaagcgtggagaaacgacacatcatgcagtcagtcgaggatctgcaaagttgcagtggtttgtcgaacgcaacatggttatccccgaaggaagagtcatcgatttaggctgcggaagaggagggtggtcgtattattgtgcgggtcttaagaaagtaacggaagtcagggggtataccaaaggcggacctggccatgaggaaccagttccaatgtcaacatatggatggaacatagtcaaattaatgagcggcaaagatgtattctatttaccacctgaaaaatgcgacaccctcctgtgtgacataggagagtctagtccaagtccgacagttgaggaaagtcgcacaataagagtcttaaagatggtagagccctggctgagaaacaaccagttttgtatcaaagtcctgaatccttatatgcccacagtcatagagcatttagaaagattgcagcgcaaatacggaggaatgctagtacgtaatcccctaagcaggaatagtacccatgaaatgtattggatatccaatggtactggaaatatagtatcgtcagtaaatatggttagtagactgttattgaatcgatttaccatgacacacaggcgtcccacaatcgaaaaagatgtagatttaggtgccggcacacggcacgttaatgcggagccagagacgccaaacatggatgtaataggagaaagaatcaaaagaataaaagaggagcacagctcaacgtggcattacgacgatgaaaatccttacaaaacttgggcctatcacgggtcatatgaagttaaagcgactggtagtgcttcttcaatgataaatggagtagtgaaacttttaacaaaaccatgggacgtggtacccatggtaactcaaatggctatgacggataccactccatttggtcaacaacgagtatttaaagaaaaagttgacacaagaacacctagacctatgccgggtacaaggaaagtaatggagataacagctgaatggctatggcgaactctaggacgcaataagaaacccagattatgcacccgtgaagaatttactaagaaagtacgaactaatgcagccatgggagctgttttcactgaagaaaaccaatgggactcggcaagggcagcagtagaagacgaagagttctggaagctagtagacaaagagcgtgaactgcataagctaggaaaatgcggttcttgtgtgtacaatatgatgggcaaacgggagaagaaattaggcgagttcggtaaagcaaaaggttcacgtgcaatatggtatatgtggcttggtgcacgctatctggaatttgaggcattgggctttctcaacgaagatcattggttttcaagggaaaatagttattctggtgtcgaaggtgaaggacttcacaaacttggatacatattacgggatatatctaaaattccgggaggcgcaatgtatgcggatgatacagcaggatgggacactagaattacggaagatgatctccacaatgaagagaagataacacaacaaatggaccccgaacaccggcaactcgccaatgcaattttcaaattaacataccagaataaggtggtaaaagtccaacgtccaaccccgaaaggaacggtaatggatataatttctaggaaagatcaaagaggctcagggcaagtaggtacttacggactaaacacgtttacaaatatggaagctcagctagtcagacaaatggaaggagagggtgttttaagcaaagcagatctcgagaatccgcatcttctcgagaaaaagataattcagtggctagaaactaaaggggttgaaagactgaaacgaatggcaataagcggggatgactgcgtggtaaaacctattgacgatcgatttgcgaacgcattgttagccctaaatgacatgggaaaggtacgcaaagacattccacaatggcaaccaagcaaaggatggcatgactggcagcaggtccccttttgcagtcatcactttcatgagttaataatgaaagatggccgaaaattagttgtaccatgtcggccacaggatgaactgattggcagggccagaatatcacaaggcgcaggatggagtctgaaagaaaccgcttgtttgggaaaagcgtatgcacaaatgtggtcccttatgtatttccacagaagagacctaagactagcctctaacgcaatatgttcggccgttccagtacactggatcccaactagcaggaccacgtggtcaatacatgcacaccatcaatggatgacgacggaagatatgctatcagtatggaaccgggtatggattgaagataatccctggatggaggataaaacacctgtgactacatgggaggatgttccatatctaggtaagagagaagatcaatggtgtggatctttaataggcttaaccagccgagccacatgggcacaaaatattctgacagcaatccagcaagtccgatctctcattggcgatgaagagttccttgattacatgccgtctatgaaaagatttcgaaaagaagaagagtctgaaggcgctatatggtag

SEQ ID NO: 23111 - RNA, 9873 nt, synthetic construct
  misc_feature 1..9873: note = derived and/or modified CDS sequence (opt6) from DENV-3__GU131933__SS-prME
  source 1..9873: mol_type = other RNA
accagtttatgtttgatgatgatgcttccagcgactctagcttttcatctaacttctagagatggagaaccgcgtatgattgtgggcaaaaatgaacgtgggaaaagcctgctatttaaaacggcttcaggaatcaatatgtgtacactaatagcaatggatttaggagaaatgtgtgacgatacagttacgtacaaatgtcctctcatcgcagaggtggagccagaagatatagactgttggtgtaatctcacttccacatgggtcacttatggtacatgcaaccaagctggtgaacaccgccgggataaaagaagcgtagcattagctccacatgtaggtatgggattagacacaagaacccaaacctggatgtcagctgaaggtgcatggcgacaagtagagaaagtcgaaacttgggccttgcggcacccgggatttacaatattagcactgttcctcgcacactacattgggacctcattaacccaaaaagtagtcatatttatcttattaatgcttgtcacaccttctatgacaatgaggtgcgttggagttgggaatagggattttgtcgaagggttatcaggtgcgacatgggtagatgttgtgttggaacatggaggatgtgttacaactatggcaaaatccaaaccaacattagatattgagctacagaaaacagaggcaacccaattagcaacgttacgtaaactatgcatagaagggaaaattactaatataaccacagactcacgatgtccaacacagggggaagcaactttaccagaagaacaagaccaaaattatgtttgtaaacacacttatgtagataggggttggggaaacggttgtggactattcggaaaaggctccttggtcacatgtgcaaaattccaatgtttggaacccattgaaggtaaagtcgtacaatacgaaaatctaaaatacacagtgattatcactgtacacacaggagaccaacaccaagtaggaaatgacacgcaaggagtgacagtcgagatcaccccgcaagcatcaacagtcgaagcagtactgcctgaatatggaactctgggactcgagtgcagtccgcggacaggcctggattttaatgaaatgattttattaactatgaaaaataaagcatggatggtacacaggcaatggttctttgatcttccactcccctggacctctggcgctactacagagaccccaacttggaatcgtaaagagctgttggtaacattcaaaaacgcccacgctaagaaacaagaagtagtagtactaggcagtcaggaaggtgcaatgcatactgcactcacgggagccacagaaattcagaacagcggaggaacgtccattttcgctggtcaccttaaatgccgcttaaaaatggacaaattagaactaaaaggcatgtcttatgccatgtgcttaaatacgttcgtattaaagaaagaagtgagcgagactcaacatggaactatccttattaaagtcgaatacaaaggagaagatgcaccgtgcaaaatacctttcagcaccgaggacggacaaggcaaagcacataatgggagattgatcacggcgaatcctgtagttactaagaaagaagaaccggtcaatatagaagctgaaccgccttttggtgagtctaatatagtcattggtataggagataaggctttaaaaatcaactggtacaagaaaggttcctcgataggaaaaatgttcgaagcgacagctcgtggtgctcgacgtatggcgatacttggggatacggcatgggatttcggaagtgtcggcggggtcctaaattcattggggaaaatggtgcaccaaatatttggaagtgcatatactgccctttttagtggggtctcatggatcatgaaaataggaataggtgtattactaacttggattgggttaaatagtaaaaatacctcaatgtcattctcgtgtatagtgataggaatcattacattatatctcggagctgtagtgcaagcagacatgggttgtgtcataaactggaaaggaaaagaattaaaatgcgggtccggcatttttgtcacaaacgaagtccatacatggactgaacaatacaaatttcaggcagactcgcccaaaagattagcgacagcgatagcgggggcatgggaaaatggcgtatgtggaattagatcaacgactagaatggaaaatctattatggaaacagatcgctaatgaattgaattatatcttatgggaaaattcaataaagctaacagtagtagtaggtgatataataggagtgctagagcaaggaaaaagaacactaacgccgcaaccaatggagttaaaatattcctggaaaacgtggggaaaggcgaaaatagtgacagcagaaacacaaaatagctcttttataatagatggtccaaatactcctgaatgtccatctgctagcagagcgtggaacgtctgggaagtagaagactacggttttggtgtgttcactacgaatatatggttgaaattacgagaagtatatacacaatcctgcgaccacagactcatgagtgcagccataaaggacgaacgagccgtacacgcagatatgggatactggattgaatcgcagaaaaatgggagctggaagctcgagaaagcaagttttatagaagtaaagacatgcacatggccaaaatcacatactttatggtcgaacggagtacttgaatcagatatgattattccaaaaagtcttgcagggccaatctcccaacataatcatcgcccaggctatcatacacaaacagccggtccatggcatctagggaagttggaacttgattttaactactgcgaaggtacaactgttgtgataaccgagaattgtggaactagaggaccgagtttgcgcacaaccaccgtatcgggtaaactaattcatgaatggtgctgtcgaagctgtacattaccccctctcagatacatgggagaggacggatgttggtatggcatggagatcagaccaattaatgaaaaagaagaaaatatggtgaaatcactggtaagcgctggaagtggtaaagtggacaatttcaccatgggagtattgtgccttgcaatcctgttcgaggaagtcatgagggggaaatttggtaaaaagcatatgatagcaggcgtcctattcaccttcgttctattactttcaggacaaatcacatggcgtgatatggcccacacattgataatgataggttcgaatgctagcgatagaatgggtatgggcgtaacatacttagccctaatcgctacatttaagatacaaccatttctagcgctgggattctttttaagaaagttgacaagtagggaaaatttactgttgggcgtgggtctagcaatggctaccacattacagctaccagaagatatagagcaaatggcaaacggtatagccttaggcttaatgacactaaaattaattacccaatttgaaacctatcaactctggaccgcgttagtatcgttaacttgctcaaatacgatttttactttaacagttgcttggagaacagccacacttatattagctggagtgtctctattaccattatgtcagtccagctcaatgcgtaaaacggattggttaccaatgactgttgctgctatgggcgtacctcctttgcccttatttatttttagtttgaaagataccccaaaaagacgctcatggccattaaatgaaggtgtcatggcagtaggcctggtaagtattctcgcatctagtttgctccgtaacgatgtgccaatggccggacctttagtagccggtggtttattaatagcgtgttatgtaataacagggacgagcgcggatttaactgtggagaaagctgctgatgtcacgtgggaagaagaggctgagcagactggggtcagccacaatcttatgataacagtcgacgacgatgggacaatgagaattaaagacgatgaaaccgagaatattctaacagtcctcttgaagacagcactacttatcgttagcggcatattcccatattctataccagcaacattactggtatggcatacttggcagaagcaaactcaaagatcaggtgtgttatgggacgtgccaagtccacccgaaactcaaaaagctgaactagaagaaggagtatacaggattaagcagcaaggcatatttggaaagactcaagttggagtcggggtccaaaaagaaggagtctttcacacaatgtggcatgtaaccagaggagccgtattaactcacaatgggaaaagattggaaccgaattgggcatcagtcaagaaagatcttatctcatatgggggtggctggcgactatcggcacaatggcagaaaggagaagaggtgcaagttatagctgttgagccaggtaaaaatcccaaaaattttcaaaccatgccaggaatatttcaaactacaatgggagagataggtgcaatagcactcgattttaagccagggacaagcggctctccgattattaacagggaaggaaaggttgttggtttatacggaaatggagtggtgaccaaaaatgggggttacgtttctggtatcgcacagactaacgctgaacctgatggcccaacaccggaactggaggaagagatgttcaagaaaagaaacttaaccattatggatctgcatccgggatctgggaagacaaggaaatacttgcctgcaattgtgagagaggcgataaaaagacggttgaggaccttgatattagctccaacaagggtggtagccgcggagatggaagaagcactaaagggattaccaataagatatcaaacgacagctacaaaaagtgaacatacaggaagagagattgttgatctaatgtgtcacgcaacattcacaatgagattactaagtccagtacgagtaccaaattataacctagttattatggatgaagcacacttcacagacccggcgagtatagcagctaggggatatatcagcactagagtaggaatgggcgaagcagctgccatattcatgacggcaactcctcctggtaccgctgaagcctttccgcaatctaacgcacccatacaggacgaggaaagggatataccagaaagatcatggaatagtggtaacgaatggatcacggatttcgttgggaaaacggtgtggttcgtacctagtatcaaagcaggaaatgatatcgctaactgcctacgaaagaacggcaagaaagtcattcaattatccagaaaaacgtttgatactgaataccagaaaacgaggttaaacgactgggattttgtcgtaacaactgatatttcagaaatgggcgctaactttaaagcagatcgtgtaatagatccaagaaggtgtctcaagccagtcatattgacagatggccctgaacgagtaatcctggcaggaccgatgccagtaaccgcagcaagcgccgctcaaaggagaggaagagtaggaaggaatccacaaaaagagaatgaccagtatatatttaccggccaaccattaaataatgacgaagatcatgcccattggactgaggctaagatgctcttagataatataaatacccctgaagggatcatacctgcattattcgaaccagaaagagagaaaagcgcagctattgatggtgaatataggctaaaaggggaatctagaaaaacgtttgtagaactaatgcgacgaggtgacttgcctgtgtggttagcacacaaagtcgcatctgaagggattaagtacacggatagaaaatggtgttttgacggggagcgcaacaaccaaattctggaagagaatatggacgtagaaatatggactaaagaaggagaaaggaagaaactaagacctagatggttggacgcacgcacatattcagatccattggccttaaaagaatttaaggacttcgcggctggcaggaaaagtatcgcactcgatttagtaaccgaaataggtcgggtcccaagtcacttggcacacagaactagaaatgctctagataatttggtaatgctacatacgagcgaacatggaggcagagcttatcgacatgcagtagaagaactacctgaaaccatggaaacactattacttctaggtttgatgattttgttaaccgggggagctatgttgtttctaataagtggaaagggtataggaaaaacatcgatcggattgatttgtgttatagccagcagtggaatgctttggatggcagacgtccccctacagtggatagcaagcgcaattgtgcttgagttcttcatgatggtattactaattccggagccagagaaacaacgtaccccgcaggataaccagttagcgtacgtggtcataggaatattaacgcttgcagcaatagtagcggcaaacgaaatgggtcttctagaaacgaccaaaagagatttgggaatgtcaaaagagccaggagtagttagccctacgtcttacctagacgtggacctacaccctgcatctgcttggacattgtatgctgttgcgacgacagtaataactcctatgttacgacacactatagaaaattccactgctaatgtgtccttagcggctattgcgaatcaagcagtagtacttatgggattagataagggttggccgatatctaaaatggatttaggcgtgcccctcctggctttaggatgttactctcaggtaaatccactcacacttacagcggcggtcctattgttagtaacacattatgccatcattggaccaggattgcaagccaaggctactagagaagcgcagaaaagaaccgctgcggggattatgaagaatccaacggttgacggaattatgacaattgacttagatcctgtcatatatgactcaaaatttgagaagcaactaggacaagtaatgttgttggtattatgtgctgtccaattactgttaatgcgaaccagttgggcattatgcgaggcacttacgctagccactggacctataacgaccttgtgggaaggatcacctggaaaattttggaacaccaccatagctgttagtatggcaaatatttttaggggtagttacctagctggagcgggattagcttttagtatcatgaaatccgtcggtacaggaagacgagggactggttcgcaaggagaaacacttggagaaaaatggaagaagaaacttaaccagctcagtaggaaggaatttgatttatacaaaaagagtggaataaccgaagtcgatagaacagaagctaaagaaggactcaagagaggagaaacaacacaccatgctgtaagcaggggatctgcaaaattacaatggtttgtggaaagaaacatggtaatcccagaaggtagggtaatcgacttaggatgtggtaggggaggatggagttattactgtgcgggcctcaagaaagtgacagaggtcagaggttatactaaaggaggtccgggccacgaggagccagtacctatgagtacctacggttggaacatagtgaaactaatgagtggaaaggacgtattctacttaccacctgaaaaatgtgatacactcttatgcgatataggggagagctcaccatcacctaccgtcgaggaatcccgaacaattagagtgttaaaaatggtagaaccatggctcagaaataatcagttctgtattaaagtgttaaacccatacatgccgactgtaatcgagcatttagaaagattgcagagaaaatatggtggtatgctcgttaggaacccactaagtagaaactcaactcacgaaatgtattggataagcaatggcactggaaacattgtgtcgtccgtaaatatggtaagccgtttgctattaaacagatttaccatgacgcataggcgaccgacaatcgaaaaagatgtggatttaggtgccggcacacgacatgtaaatgcggaacctgaaaccccaaatatggatgtaataggtgaacgaataaaaagaattaaggaggagcattcatcgacatggcattatgacgacgaaaacccctataaaacatgggcttatcacgggtcatacgaggttaaagctactggttcggcaagcagtatgataaatggagtcgtgaaacttcttaccaagccttgggatgttgttcccatggtgacgcaaatggcgatgactgataccacaccatttgggcagcaaagagttttcaaagaaaaggtagacacccgtaccccacgaccaatggccgggacaaggaaggttatggaaataacagcagaatggttatggcgcactcttggtagaaacaaaaagcctagactctgtacaagggaagagttcactaagaaagttaggacgaatgcagcaatgggcgccgtgttcacagaagaaaatcagtgggacagcgcaagagccgctgtagaggacgaagagttttggaaactggttgatcgcgaaagagaattacacaaactaggaaaatgcggatcatgcgtttacaatatgatgggtaaaagagagaagaaattaggtgagtttggaaaggccaaaggaagtagggcgatatggtacatgtggttaggagcgcgatatcttgagtttgaagctcttggatttcttaatgaagatcactggttcagtagagaaaacagttacagtggcgtcgaaggagaagggcttcacaagttaggttacatactgcgggacatttcaaaaatcccagggggagccatgtacgccgacgatacagcaggatgggataccagaataaccgaggacgatttacacaacgaagaaaagattacacaacaaatggaccccgaacatcgtcagcttgcgaatgcaattttcaaattaacatatcaaaacaaagtcgttaaagttcaacgaccaacgcccaaaggaactgtaatggatataatcagtagaaaagatcagcgaggatcagggcaggttggtacatatggactaaacacatttactaacatggaagcgcagttagtaaggcaaatggagggtgaaggagtactatctaaggctgatctagaaaatccacacctactagagaagaaaataacccagtggttagaaacaaagggtgttgaacgccttaaaagaatggcaatatcaggagatgattgcgtagtgaagccgattgacgaccgattcgccaatgcattattagctctaaatgacatggggaaagtaagaaaggacatcccgcagtggcagcctagcaaaggctggcatgattggcaacaagtacccttttgtagtcatcatttccatgaattgataatgaaagacgggaggaagttggtagtcccatgtcggccacaagacgagttaataggaagggcacggatatcacaaggcgctggatggagtctaaaagaaacagcctgcttgggcaaagcctacgcacagatgtggtctctaatgtactttcatcgaagagatttaagattagcaagcaatgcaatatgctctgctgtccccgtacattggatacccacctcgcgcaccacatggtcaatccatgcacaccatcaatggatgacaactgaggatatgttgactgtatggaatagggtctggatagaagataatccctggatggaagacaaaacgccagttacaacttgggaggatgttccatatttaggtaaacgagaggatcagtggtgtgggtcgttaatcggcctaactagcagagccacttgggcccaaaacattctaactgctatccaacaggtaaggagcttgataggagatgaagaatttcttgattacatgccaagtatgaagaggtttagaaaagaagaagagtctgaaggagcaatttggtag

SEQ ID NO: 23112 - RNA, 9873 nt, synthetic construct
  misc_feature 1..9873: note = derived and/or modified CDS sequence (opt6) from DENV-3__GU131934__SS-prME
  source 1..9873: mol_type = other RNA
acttcactgtgtttaatgatgatgctgccagctacacttgcttttcacttgacaagtagagatggagaacccagaatgattgtcgggaaaaatgaacgtggaaaaagtttgctttttaaaacggccagtggaatcaatatgtgtaccttgattgctatggatttaggagagatgtgcgatgatacggtgacatacaaatgccctcttatcgcagaagtggaaccagaagatatcgattgctggtgtaatttaactagcacctgggttacctatggtacgtgtaatcaagcgggtgaacacagaagagacaaaagaagcgttgccttggctccgcatgtaggtatggggctagacacaagaacacagacatggatgtccgcagaaggagcttggagacaagtagaaaaagtcgaaacatgggcattaagacacccgggtttcacgatattggcacttttcctagcccattatataggtacgagccttacccagaaagtagtaatcttcatattactaatgttagtaaccccatccatgacaatgaggtgtgtgggggtcggaaatcgggattttgtggagggattgtcgggtgcaacctggattgatgtagttctagaacacgggggatgtgttacaacaatggcgaaatccaaacccactttggacattgaacttcagaaaactgaagctactcaattagcaactcttcgtaaattgtgtatcgaaggaaaaatcactaatataacgactgactcacgatgtccaacacaaggagaagccacgctaccggaggaacaagatcaaaattatgtttgcaaacatacgtatgttgatcgaggatggggcaacggttgcggccttttcgggaaaggaagtcttgtcacctgtgcaaaattccagtgccttgaaccgatagaggggaaagtagttcagtatgaaaatttgaaatatactgtcattattacagttcatactggagaccaacaccaggtagggaatgatacacaaggtgtaacagttgagataactcctcaagcgtccaccgtcgaagcagtactacctgaatatggaacattaggtttagaatgttcaccacgaactggcttagattttaatgaaatgatattacttacaatgaaaaataaggcttggatggtccacagacagtggttctttgatctaccactaccctggacgagtggcgctacaacagagacaccgacctggaaccgaaaagagttattggttacgttcaaaaatgctcacgctaagaaacaggaagtagttgtattaggctcacaggaaggtgcgatgcatactgcactaacaggggctaccgaaatccaaaattcaggaggaacttccatttttgccggtcaccttaaatgtcgacttaaaatggacaaattggaactgaaaggtatgtcatatgccatgtgtttaaacaccttcgttctaaagaaagaagtttctgagacacaacacggaaccatattaataaaagtcgaatacaaaggtgaggacgcgccgtgcaaaatcccttttagtaccgaagacggacaagggaaagcccacaacggcaggttaattacagccaatcctgtagtaaccaagaaagaagaaccggtaaatatagaagcagaacccccattcggggagagcaatattgtgatcggtataggagataaagcgttaaaaataaattggtataagaaaggttcctcaataggtaaaatgtttgaagcaacggctagaggagctagaaggatggcaatcttaggggacacagcatgggattttggaagcgtaggaggggtattgaacagcctaggaaaaatggtacatcaaatattcggctccgcatacacagcattattcagcggagtttcgtggataatgaaaatcggcataggcgtattactaacttggattggactaaattccaaaaataccagcatgagcttcagttgcatagtaataggtgtcatcactctatatcttggcgcggtagtacaggcagatatgggatgtgttattaattggaaagggaaagagttaaaatgcggaaacggaatatttgttaccaacgaagtgcacacatggacggaacaatataaatttcaggcagactctcccaaaagattagcaacagcaatagctggagcatgggaaaatggagtttgcggtataagaagcacaactaggatggaaaatttactttggaaacagatagcaaatgaactcaattacatactatgggaaaataatattaaattaactgttgttgtcggcgatataataggtgtcctagaacaaggcaaaagaactttaacgccacagccaatggagctcaaatattcttggaaaacctggggaaaagcgaaaattgtaactgcagagaatcaaaattcttcatttataattgatggccctaacacacctgaatgcccatctgcctcgagagcctggaacgtatgggaagtcgaagattacggttttggagtatttacaactaacatttggctaaagctccgggaagtatatacacaaagctgcgaccatagattgatgtcggcggcaattaaggatgagagggccgtacatgcagatatgggctattggattgagagtcagaaaaatggaagctggaagttagaaaaagcaagtttcatcgaagttaaaacctgtacatggccgaaaagtcatactttgtggtcgaacggtgtacttgaaagtgacatgatcataccaaaatccttagctggccctataagtcaacataatcatcggcctggctatcatactcagacagcagggccttggcatctcggtaagctagaactagacttcaattactgtgagggaaccaccgtcgtaatagctgagaattgtggaactcgaggcccaagtttaaggacaacaaccgtcagtgggaaattaatccacgaatggtgttgcagatcatgtacacttcctccacttcggtacatgggtgaagacggttgttggtacggcatggaaataagaccaattaatgaaaaggaagaaaatatggtaaaatcgctagtttctgctggttccggtaaggtggacaactttacaatgggggtactatgcttagcaattctttttgaagaagtcatgaggggaaagttcggtaaaaagcacatgatagcaggagttttgtttacatttgtactacttctatcaggacaaattacgtggagagatatggcacacacattaataatgataggcagcaatgcaagcgatcgcatgggaatgggtgtcacttatttagctttgatcgctacctttaaaatacaaccatttttggcactaggcttctttctgcgaaaactaacaagtagagaaaatctattactgggagtggggttagctatggcgactaccctccaactcccagaagatattgagcaaatggcaaatggaatcgccttaggactaatgacacttaaactaataacacaatttgagacataccaactttggacggccttggtgagcctgacatgtagtaatactatatttaccttgacggtggcttggaggacagcaactcttatattagctggagtaagtttattgcctttatgtcaaagctcgtctatgagaaaaaccgactggctcccaatgacagttgcagcgatgggtgtgcctcctttgcccctgttcatattttccttgaaggatacgccaaaacgaagaagttggccccttaatgaaggagttatggctgttggattagtgtctattctcgcatcttctctattaaggaacgatgtacccatggccggacctcttgtcgccggaggcctactcattgcatgttacgttatcacgggaacctctgcggatctgacagtagaaaaggccgccgatgtaacatgggaagaagaagcagaacaaacaggtgtgagtcataatctaatgatcacggttgacgacgacggtacgatgcgtataaaagatgacgagacagagaatattttgacagtgttactaaaaacagctttattaatagtatcagggatattcccgtattctattcctgctacattattggtctggcatacatggcaaaaacaaacacaaaggagcggagtactatgggacgtcccttctcctccagaaacccaaaaagctgagctggaagagggcgtatatagaatcaagcaacaaggaatatttggaaagacgcaagtgggagtaggtgtccaaaaggaaggcgtcttccataccatgtggcatgtgacaagaggagctgtattaactcacaacggaaaaagattagaaccgaattgggcctcggtaaagaaagaccttatatcttacggagggggatggcgactatcagctcaatggcaaaaaggtgaagaagtccaggtaatagcagtggaaccggggaaaaacccaaagaattttcagacaattcctgggatcttccaaaccacaacgggtgaaattggtgctattgccctcgacttcaaaccaggcaccagcggatcgccgattataaacagagaggggaaagttgttggcttatatggtaatggagtggtaactaaaaatggtggttacgtctctggcatagctcagacaaacgcggaaccggatgggccgacgccagagctagaggaagaaatgtttaagaaacgaaacttaacaatcatggacttacatccgggtagtggcaaaacaagaaaatatctcccggcgatagttagagaagcgataaagcgaagactacggacattaatactagctccaacacgagtagttgccgctgaaatggaagaagcactcaaaggtttacccatacggtaccaaaccacagcaacaaagtccgaacatacaggaagagagatagttgatcttatgtgtcacgccactttcacaatgagactcttgtctccggtaagggttcccaattataatctagttataatggatgaagcacactttacagacccagcaagtatcgcggctagaggatatataagtaccagagttggcatgggggaagcggcagccatctttatgacagccacaccgccagggacagcagaagcctttcctcaaagtaatgctcccatacaggatgaagagagagatatccctgaacgcagttggaactcaggaaacgaatggataacagacttcgtaggcaaaacagtatggtttgttccgtctatcaaagccgggaatgacatcgctaactgtttgaggaaaaatggtaaaaaggttatacaacttagtagaaaaacatttgataccgaatatcagaaaactcgactgaacgactgggattttgtggtgacgaccgatattagcgaaatgggtgcaaactttaaagcagacagagtgatagatccgcgccgctgcttaaaaccggttatacttacagatggccctgaacgcgttattttagcgggccctatgccagtaacagcggcctcagcagcgcaacgaagaggccgggtcggtaggaaccctcaaaaagaaaatgaccaatatatatttacaggtcaaccgttgaataacgatgaagatcacgcacattggaccgaagccaaaatgttactagacaacataaacacacccgaaggcattataccagctctatttgagccagaacgagaaaaatcagcggccattgacggagagtatagattgaaaggtgaatctcgaaaaacttttgtagaattaatgagaagaggtgacctaccagtatggttggcgcacaaagttgcaagtgaaggtataaaatatacagacagaaagtggtgttttgatggggaaagaaataatcaaatattagaagagaacatggatgttgaaatttggactaaggagggagaaaggaagaaattacgacctagatggctcgatgctagaacttattctgatccgttagctcttaaagaatttaaagacttcgccgcaggacggaagtcgatcgcattagatctggtgaccgaaataggccgtgtaccatctcatctggcccacagaacacgcaacgctctagacaacctagttatgctacatacatcagaacatggaggcagagcatatagacacgctgtggaagaacttccagaaaccatggaaacactactgctacttggtctcatgattctcctaacaggaggggctatgttatttttaatcagcggaaaggggattggcaaaacaagtataggattaatatgcgtgattgtaagtagtggaatgttatggatggctgatgttccgctacaatggatagcctccgcaattgtcctcgaatttttcatgatggttttgctcattccagaaccagagaaacaacggacgccgcaagataaccaactagcttatgttgttattggtattctaactctcgcagctatagttgctgcgaacgaaatgggcctactggaaacaactaaaagagatcttggaatgtccaaggaaccaggagttgtgtcgccgacatcttatctagacgtagacctccacccagcgtcggcatggacactatacgctgtagctacaactgtaattacgcccatgcttaggcatactatcgagaacagcaccgccaacgtatctcttgcagcgatcgctaaccaagcagttgttctgatgggacttgataaaggatggccaatttctaaaatggacttaggcgtacccttgttagcactcggatgttatagtcaggttaatcctcttactcttactgcagctgtcttactattagtcacccattatgcaattataggccctggcttgcaggctaaggctacccgagaagcacaaaagagaacggcagcgggtataatgaaaaatccaacagtcgacggtatcatgacaatagatctagatccggtaatctatgatagcaagtttgaaaaacaactaggtcaggtaatgctcctggtgttgtgcgctgtacaattacttctgatgcgcacctcatgggcactttgtgaagccttgacgctggctaccggtccaataaccacactttgggaaggctcgccaggaaaattttggaacaccacgattgctgttagcatggcgaatatatttcgaggaagctatctagcaggagcaggattggcgttttcgatcatgaagagtgtaggaactgggcggcgaggtaccgggtctcaaggggaaactcttggagaaaaatggaagaagaaacttaatcaactgtctcgaaaagagttcgacctctataagaaatctggaatcacagaagttgataggaccgaggctaaggaaggactcaaacgaggggagactacgcatcacgcagtgagtcggggatctgcaaagctccaatggttcgtcgaaagaaatatggtaatcccagaaggaagagtaatagacctagggtgtggtagaggcggatggtcatactactgcgcaggactcaagaaagtcacggaggtaagaggatatactaaaggtggccctggtcacgaagaacccgtgcccatgtcaacgtacggctggaacatcgttaaacttatgtctggaaaggatgtattttatctccctccggaaaaatgcgacaccttgctgtgtgatattggagaatcaagcccaagccctaccgtagaggaaagtaggaccattcgagtgttaaagatggttgaaccgtggcttagaaacaatcagttttgcattaaagtattaaacccatatatgccaactgtcatcgagcacttagaacgattacaacgtaaatatgggggaatgctagtaaggaatcctctatctaggaactcgacgcatgaaatgtactggattagtaatggcaccggcaacatagtgtcatctgttaatatggttagtcggctcttattaaatagattcacgatgacacatagaaggcctactatagaaaaggatgtcgacttaggtgccggcactaggcacgttaatgcggaaccagaaacccctaacatggatgtaataggggagaggattaaacgtataaaagaggaacactcgagtacttggcattacgacgatgagaatccatataaaacatgggcgtatcacggaagctatgaagttaaagctacaggtagcgcgtcttctatgatcaacggagtagtaaaacttttgacgaagccgtgggatgtagtaccaatggttacacaaatggcaatgacagatacaacaccgtttggtcagcaacgggtattcaaggaaaaggtagacactcgtacgccacgaccgatgccgggaacccggaaagtaatggaaataacagcagaatggctatggagaacattgggacgtaacaagaaaccacgattgtgtactcgagaagagttcactaaaaaggtaagaacgaatgctgctatgggtgcggtctttacagaagagaatcagtgggatagcgctagagcagccgtagaagatgaagagttctggaaattagtggacaaagaaagagaattacataaattgggaaagtgcgggtcctgcgtctataatatgatgggtaaaagagaaaagaaattaggagaatttgggaaagcaaaaggttcgagagcaatatggtatatgtggctaggtgcaagataccttgagttcgaggcgttgggatttctaaatgaagatcactggtttagtcgggaaaacagctattctggagttgagggggaagggttgcataaactaggatacattcttcgggatatatcaaagatacccggtggtgctatgtacgccgatgacaccgccggctgggacactcggattaccgaggatgaccttcataatgaagagaaaataactcagcagatggatccggaacaccgacaactcgcaaatgcaatctttaaactcacttatcaaaacaaggtcgtgaaggtacaaagaccgactcccaaaggaacagtaatggacattatttcaagaaaagaccaaagaggctcgggtcaagttggcacgtatggattgaatacattcacaaatatggaagcacagctagtgcgtcagatggagggggaaggtgtactctcaaaggcggacctagaaaatcctcacctattagagaagaaaataacccagtggttagaaacaaaaggagttgagcgacttaaacgcatggccataagcggagatgactgtgtagtaaaacccattgatgaccgctttgcaaatgcgctgttggcattaaatgacatgggaaaagtgagaaaagatataccacagtggcagccgagtaaaggctggcatgactggcagcaggtccccttctgcagtcatcattttcatgaactcattatgaaagatggaagaaagctagtcgtcccttgcagaccacaagacgaacttataggcagagcaaggataagccaaggtgcaggatggtcgctaaaagagactgcgtgtttaggtaaagcctatgcccagatgtggagtcttatgtacttccacagaagagaccttagattagctagcaatgcaatttgtagtgctgtcccggttcattggatacctacctcaagaacaacttggagcattcatgcgcatcatcaatggatgacaactgaagacatgctaaccgtatggaatagagtctggatagaggacaatccttggatggaggacaaaacaccagtgacaacgtgggaagacgtcccatacttaggaaaacgagaggaccaatggtgtgggagcttgattgggcttactagcagagccacgtgggcacagaatatattaacagcaatacaacaggttcggagtttgatcggtgatgaagaatttttggattacatgcctagtatgaaacgatttagaaaagaagaagaaaccgagggcgctatatggtga

SEQ ID NO: 23113 - RNA, 9873 nt, synthetic construct
  misc_feature 1..9873: note = derived and/or modified CDS sequence (opt6) from DENV-3__GU131935__SS-prME
  source 1..9873: mol_type = other RNA
acaagtctttgtttaatgatgatgctgccagccactcttgcgtttcatttaactagccgtgatggagaaccgaggatgattgttgggaaaaatgaaaggggaaaatcacttttattcaaaactgcaagcggcataaatatgtgcactctaatagctatggatcttggtgaaatgtgcgatgatacagtgacgtataaatgtccattgatagcagaagtagaaccagaagatatcgactgttggtgtaatttaacaagtacttgggtaacctatgggacttgtaatcaggcgggtgaacatcgtagggacaaacgaagcgtcgctcttgcgcctcacgtaggaatgggattagacacaagaactcagacttggatgagcgccgaaggagcctggcgtcaagtagaaaaagtagaaacatgggcattgagacacccaggtttcactatactagcgctatttctagctcattacataggaacatccttgacacagaaagtggtaatatttatactgctgatgcttgtcacaccaagtatgacaatgagatgtgttggagtaggtaatcgagattttgtcgaaggcctatcaggagcaacttgggtagacgttgtattggaacacggcggatgtgttacaactatggcaaaaagtaaaccaactttagatatagaattacagaaaactgaagctacacaactggccaccttgagaaaattatgcattgaaggcaaaataactaacattacaacagatagcagatgcccaactcaaggcgaagctacactacccgaagaacaggatcagaattatgtttgtaaacacacatatgtagatcgaggctggggaaacgggtgcggcctatttgggaaaggtagtctggtcacgtgtgcaaaattccaatgtcttgaaccaatagaaggcaaagtagtacagtatgaaaatcttaaatatactgtaatcataactgtacatactggagatcagcaccaagttggaaatgacactcaaggagttacagttgaaattacaccacaggcttcaacagtcgaagctgtgctgcctgaatatggcacattaggtttagagtgcagccccagaaccgggttggattttaacgagatgatattactgactatgaaaaataaagcatggatggtgcatagacaatggttcttcgatcttcctcttccatggacaagtggagctactacagaaacgccaacatggaaccgtaaggaattattagtcacttttaagaacgcgcatgcaaagaaacaagaagtagtggtcttagggtctcaagaaggtgctatgcatacggccctaacaggcgcaaccgagatacaaaattcgggaggtacaagtatatttgctggtcatttaaagtgcagactaaaaatggacaaactagaactgaaaggtatgtcctacgcaatgtgcttaaacacattcgtgctcaagaaagaggtgtccgagactcagcatggcactattttaatcaaagtcgagtacaaaggtgaggatgcgccctgtaaaataccatttagtacggaggatggacaaggaaaggcacataatggacgattaattaccgcaaatcctgttgtaactaagaaagaagaacctgtcaatatagaagccgagccaccttttggagagtcaaacattgttattggtatcggtgacaaagctctaaagataaattggtataaaaagggctcatcaataggcaaaatgtttgaagccaccgctagaggggcaagaagaatggctatactaggagacaccgcatgggacttcgggtcagttggaggagttttaaacagcttaggaaagatggtacaccaaatatttgggagcgcgtacactgcactatttagcggagtgagttggataatgaagataggaataggtgtattgcttacctggatcggtttaaatagtaaaaacacatctatgtcattctcttgtatagtaattgggatcataacgttatacctaggagccgtcgtacaggctgacatgggatgtgcaatcaattggaaaggtaaggaactaaaatgtggatcagggatttttgtcactaacgaggtccacacttggaccgaacagtataaatttcaggccgattcccctaaaaggttagcaacggccattgcgggcgcctgggaaaatggggtctgcgggatccgtagtacgacacgaatggaaaatctattatggaaacagatagccaatgagttgaattacatactatgggaaaacaatattaaactaacagtcgtagttggagatatcattggcgtactagagcaaggtaaaaggacattaaccccacaaccaatggaacttaagtattcatggaaaacatggggaaaagccaaaatagtaacagcggaaactcagaacagcagctttataattgacggaccaaatactcccgaatgtcctagtgcgagcagggcatggaatgtatgggaagtggaagactatggatttggggtgtttacaacaaatatatggttaaagttaagagaggtttatacgcaatcatgcgaccacaggctaatgtcagctgctattaaagatgaaagagctgttcacgccgatatgggatactggattgaaagtcaaaagaacggaagttggaaactagaaaaggcttcctttatagaggtgaaaacatgtacatggcccaaaagccatactttatggtcgaatggtgtcttagagtccgacatgataatacccaaatcactagctgggccaatttctcaacacaaccatcgacccggctatcatacccaaacagcgggaccgtggcacctaggaaaactggagttagacttcaattattgcgagggcaccactgtagtaataactgagaactgtggaacccgagggcctagcctacggacaactactgtatctggaaagttaatacacgaatggtgctgtcgaagttgtaccttaccgccgttgcgatatatgggagaagacgggtgttggtacggaatggaaataaggccaattaatgaaaaggaggaaaacatggtgaaatcattagtgagtgcaggcagtggcaaagtcgataattttaccatgggcgtactatgtctggctatcctctttgaggaagtaatgcgaggaaaatttgggaagaaacatatgattgcgggagtattattcacctttgtgctactactttcaggtcagattacatggagagatatggcccatacactcataatgataggtagtaacgctagtgaccgaatgggcatgggagtaacatatctcgctctaatagcaactttcaaaattcagccatttttggcgttaggattctttctacgtaaactaacgagtagagaaaacctattattaggtgttggcttagcaatggcaacgactctgcaacttccggaagatatagaacagatggcaaatggcatcgcattaggactaatgactttgaaattgataacgcagtttgaaacgtatcagctatggacagctttggtaagcctaacttgcagcaatacaattttcacactaacagtagcttggcgaacggctacattaatcctggctggagtgtcattattacctttatgtcagagctcatcaatgagaaagacagattggctgcccatgaccgtagccgccatgggggtgccaccattgccgctctttatattcagtctaaaagatacccctaagcgccgaagttggccattaaacgaaggtgtgatggctgtgggcctagtaagtattctagcatcctctctacttcgtaacgacgtccctatggcgggcccattggtagcgggagggttgttaattgcgtgttacgttattacaggaacaagcgcggatctcacagtagaaaaagcagcagatgtaacctgggaagaagaagcagagcagactggggtgtcgcataacctaatgattaccgttgatgatgatgggacaatgagaatcaaagacgatgaaacggaaaacatactgacggtcctattgaaaactgcattattaatagtatcgggtatatttccgtacagtattccagcgaccctattagtttggcatacctggcaaaaacaaacacaacgcagtggagtattgtgggatgtaccttcaccaccagaaacacaaaaggcagagttagaagaaggtgtttacagaataaaacaacaagggatattcggtaaaacacaagtaggtgtaggggtccaaaaagaaggggttttccacactatgtggcacgtgacccgcggagcagtcttgacccataatggaaaaagattagaacccaactgggcaagcgtcaagaaagatttaatatcgtacggcggtggctggagattaaatgcacaatggcaaaaaggagaagaagtacaagtgatagctgtcgagccgggtaaaaatcccaaaaactttcaaactatgcctggaatatttcaaactactaccggagaaattggtgcaattgcactagattttaaacccggtacaagcggatcaccaattataaatagggaaggtaaagtggtaggactatatggtaatggcgtagtaacgaaaaatggaggatacgtttcaggtatagcccaaacgaacgcagagccagacgggccaacacccgaattggaagaagaaatgtttaagaaacgtaatcttacaattatggacttacatcctggtagcggtaaaacccgtaaatacttgcctgctatagtaagagaggcaattaagaggcgattacgaactttaatcttagcaccgacaagagttgttgccgcggaaatggaagaagcgcttaaaggtttaccaatacgataccaaaccacagccacgaaatctgagcatacaggacgcgaaattgttgatctcatgtgtcacgccactttcacaatgcgattactttcaccagtaagggttccaaactacaacctcgttataatggatgaggctcattttacagatcccgcaagcattgctgctcggggttatatatctacacgtgtaggaatgggagaagctgcagccatatttatgacagctacgccaccaggaacagcggaagcgtttccacaatctaatgcacccatacaagatgaggaaagggatattcccgagaggagttggaactcgggaaacgagtggattacagattttgtcgggaagacagtgtggtttgttccatccattaaggccgggaacgacatcgctaactgtttacggaaaaacgggaagaaagttatacaactcagcagaaaaacttttgacaccgaataccagaaaactagattaaatgattgggatttcgtagtaacgacggatatatctgaaatgggagcaaattttaaagctgaccgcgtaatagatccacgaagatgtctaaaacccgtaatattaacagatggaccagagcgagtaatattagcaggtccaatgcctgttacagctgcatcggctgcccagcgacgtggacgagtagggcgtaacccacaaaaagaaaacgatcaatacatatttaccggacaaccgctaaataatgatgaagaccatgctcactggacagaggcaaaaatgctcctagacaatataaatacgcccgaaggaataatacccgcattgttcgaaccagagagagagaaaagcgctgctattgacggtgaatatcgattgaaaggcgaaagcagaaaaacttttgtagaattgatgaggaggggcgacctaccagtctggcttgcacataaagttgcgtccgagggtatcaagtatacggaccggaagtggtgtttcgacggtgaaagaaacaaccaaatactcgaagaaaatatggatgtggaaatatggactaaggaaggagaaagaaagaaattgagaccccgttggttagatgcccgcacctattcagacccgctagcattaaaagagttcaaagattttgcagcaggacgaaaaagtatagccttagatctcgtaactgagataggcagagttccaagtcatcttgcgcacagaacgcgaaatgcgttagacaaccttgttatgttacatacatccgagcatggagggcgagcctacaggcatgctgttgaagaacttccggaaactatggaaactcttttgctcctaggattgatgatactactcacagggggtgtcatgttatttctgatttctgggaaaggaatagggaaaacaagtataggacttatatgtgtaatagtttcctcgggtatgctgtggatggccgacgtgccgctgcagtggattgcgagtgcaatcgtactggagtttttcatgatggttttactaatacccgaaccagaaaaacaaagaacacctcaagataaccagttagcttatgtagtcataggaatactgacactagcagctattgtagcagcaaatgagatggggctactcgaaacaaccaaacgggatttagggatgtcaaaagaaccaggagtggtaagtccaacatcatacctagacgtagatttgcacccagcatctgcttggactttatatgcagtagctactacagtaattacaccgatgctgagacatacaatagaaaatagtacggcgaacgtatcattagccgcgatcgcaaatcaggccgtagtactgatgggactggataaaggatggcctatttccaaaatggaccttggggtaccgctgctagcgttaggatgttacagtcaagttaatccactaacactaaccgctgcagtcttacttctagtaacacattacgcaataataggacctggacttcaggctaaggccaccagagaagctcagaaacggacggcagcaggaataatgaagaatcctacagtggatggaataatgacgatagacttagatcctgtaatatacgacagcaaatttgaaaaacaattgggtcaggttatgcttctagtgttatgtaccgtgcaattactgttaatgagaacaagttgggcactctgtgaggcattaacgctcgcaactggaccgattactacactatgggaaggaagcccgggaaaattttggaatacaacgatagctgtaagcatggcaaacatattcagggggagctacctcgcaggggcaggactagctttttcaataatgaaatcagtaggcactgggagacgaggaacgggatctcagggcgaaacattaggtgaaaagtggaagaagaaattgaaccaactatcccgcaaagagttcgacctatacaaaaagtcgggaattactgaagtagacaggacagaggcgaaggaaggcttgaaaagaggcgaaacaacgcatcatgccgttagtaggggcagtgctaaattacaatggtttgtggagcgaaatatggttattccagaaggcagagtaatagacctgggatgtggaagaggtggctggagttattactgcgcggggctcaagaaagtaacagaagtaagagggtataccaaaggcggaccaggacatgaagaacctgttccgatgtctacttatggttggaatatcgtcaaactcatgtcagggaaagacgtattttatcttcccccagaaaagtgtgatacattactgtgtgatataggtgaatcaagtcccagcccaactgttgaagaaagtcgaacaatcagagtactgaaaatggtagaaccctggttgaggaataatcagttttgtattaaagtgcttaacccttatatgccaacagttatagaacatttagagaggcttcagcgaaaatacggagggatgcttgtacgcaacccgctttcacgtaattctacgcatgagatgtactggatttcgaacggcacagggaacatagtatcttctgttaatatggtgagtagattattacttaaccgcttcacaatgacgcatagaagacccacaattgaaaaggacgtagatctaggcgccggtactcgacacgtaaatgcagaacccgagacacctaacatggatgtgataggggaacgtattaaacgaataaaggaggaacattcaagtacttggcattacgacgatgaaaacccttataaaacatgggcgtaccatggaagttatgaagtcaaagcaacaggcagcgcatcaagtatgattaatggcgtcgtaaaactcctaacaaaaccatgggatgtcgtaccaatggtaacacaaatggccatgacagatacgaccccattcggacaacaacgagtgtttaaagaaaaagttgacacacgaacgcccagaccgatgccgggaactagaaaagtaatggagattacggctgaatggctgtggcgaacattggggagaaacaagaaacctaggttatgtactcgcgaagagttcactaagaaagttaggactaacgcagctatgggtgcagtctttacagaagaaaatcagtgggacagtgctcgggctgctgtagaagacgaggagttctggaaattagttgaccgagaacgagaattacataagctgggaaagtgcggatcatgcgtatacaacatgatgggtaaaagagagaagaaattaggtgagttcggaaaggctaagggctcacgagcaatatggtatatgtggttaggagctcgctatctagaatttgaagcattaggatttttaaatgaagatcattggttttcccgagaaaatagttattcaggcgttgaaggagaaggcctgcataaacttggatacatcctcagagatatcagtaaaattcctgggggtgcaatgtacgctgatgatacagctggttgggatacaagaatcacggaggatgacttacacaatgaagagaaaatcacacagcaaatggaccctgaacatagacaactagccaatgccatatttaagctaacatatcagaataaagtcgtaaaagttcagcgccctacgcctaaaggaacagtgatggatataattagccgaaaagatcaaagaggatcaggacaggttggaacatatggcctaaatactttcacgaatatggaagctcaattagtacgtcaaatggagggggagggcgttctatctaaagctgatttagaaaatccacatcttctagagaaaaagattacgcaatggcttgaaactaaaggagtagaaaggctaaaaagaatggcgatatctggtgatgactgcgttgtcaaacctatcgatgatagattcgcgaatgctctattagcattaaacgacatgggcaaggtacgaaaagacataccacaatggcaacctagcaagggatggcatgattggcagcaagtacccttttgctcacatcatttccatgaattaattatgaaagatggacgaaaattggtggtcccatgtagaccccaagacgagttaattggtagggcacgcattagtcaaggagccgggtggtctttaaaagagacagcgtgtctcggcaaggcttacgcacaaatgtggagtctaatgtatttccatagacgagacctccgattagcatccaacgccatctgttccgctgttcctgttcactggatacccacctcacgaacaacatggagtatacatgcacatcaccagtggatgacgaccgaagatatgttgacagtttggaacagggtgtggatagaagacaacccatggatggaggataaaacaccggtaacgacatgggaagatgttccgtatttaggaaaaagagaagatcaatggtgtggttcattgattggtctaacatcccgagcgacatgggcacaaaacatattaactgctattcaacaggtgcggtcattaatcggaaacgaggagttcctagattacatgccatcgatgaaaagattcaggaaagaggaagaatcagaaggggctatctggtga

SEQ ID NO: 23114 - RNA, 9873 nt, synthetic construct
  misc_feature 1..9873: note = derived and/or modified CDS sequence (opt6) from DENV-3__GU131936__SS-prME
  source 1..9873: mol_type = other RNA
acaagtctatgtttaatgatgatgcttcctgctactctggcgtttcacttaacatcgagagacggggaaccaaggatgatagtagggaaaaatgaaagagggaaaagcctattatttaaaaccgcaagtgggataaatatgtgtactcttatcgctatggatttaggtgaaatgtgtgacgacacggtaacctacaaatgtccattaatagcagaagtggaacccgaagacatcgactgttggtgcaatttaacttctacgtgggtaacatatggaacctgtaatcaagccggggagcatcgacgtgacaaacgaagtgtagctttagcgccacatgtaggaatgggacttgacactcggacacaaacgtggatgagcgctgaaggtgcttggagacaagttgagaaagtcgaaacctgggcgttacgacacccaggattcactatcctagcactattcctagcgcattacatcgggacatctctaacgcaaaaagtagtcatatttatcttgttaatgttagttacaccatctatgactatgagatgtgtgggagtcggaaatcgcgattttgttgaaggtctttcgggagcgacgtgggtggacgtagtcttagaacatggcggctgtgttacgacgatggctaaatcaaaaccaacattggatatagaattgcagaaaacagaggcaactcaactagcgacattgcgtaaactctgcattgagggtaaaattacaaacattactactgattcaagatgtccaactcagggtgaagctacattgcctgaagaacaagatcagaattatgtatgtaaacatacatacgtagatcgcggatggggaaacggttgtgggttatttggtaaagggtctcttgttacatgtgctaaattccaatgcctcgaaagtatagaaggaaaagtcgtccagtacgaaaatttaaaatatacagtcataattacggtccacacaggagaccaacaccaagtaggaaatgacacccaaggagtcactgtagaaatcactccacaagctagtactgttgaagcagtgttgcctgagtatggcacattaggcctagagtgttcacccagaacaggattggatttcaatgagatgatattgttgacaatgaaaaacaaagcatggatggtccaccgacaatggttctttgatcttcccttgccatggaccagcggtgcaacaacagagacaccaacatggaacagaaaagagttgttggtaacattcaaaaatgcacatgccaagaaacaagaagtggtagtattaggttcccaagaaggtgccatgcataccgccctcacaggtgccacggaaatacaaaattcaggtggaacttcaattttcgccgggcatttaaaatgtagactgaaaatggacaaacttgaattaaaaggtatgagctacgctatgtgcttaaatacattcgtattaaagaaagaagtatctgaaacccagcacggaacaatcttaataaaagttgaatataaaggcgaagacgccccgtgcaaaataccattttcgactgaggatggacaaggaaaagctcataatggccgtctaatcactgcgaaccccgtggttactaagaaagaagaaccagtaaacatcgaagcagaaccacccttcggagaatcaaacattgttataggtatcggggacaaagcactgaaaattaactggtacaagaaagggtcatcaattggtaaaatgtttgaagccactgctcggggcgcgagaagaatggctattctgggcgatactgcttgggacttcggatcagtgggaggagttttgaacagtttaggtaaaatggttcatcaaatctttggttctgcatatactgcactattttcaggagtttcgtggattatgaaaatcggtattggggtattactaacatggattggactaaatagtaaaaatacgtctatgagtttctcatgtatagttattggcataatcactttgtatcttggagcagtagtacaagcggatatgggatgcgttattaattggaaaggcaaagagctgaaatgcggaaacggtatatttgtaactaacgaggtccatacgtggactgagcaatacaaattccaagcagactctcccaaacgtttagcgacagctatcgcgggcgcatgggaaaacggagtttgtgggataagatcaacgacaagaatggaaaatctactatggaaacagatagctaatgaactaaactatattctatgggagaataatataaaattaacagttgtagtcggagacattatcggagttttggaacagggcaaacgtgctctaactcctcagccaatggagcttaaatatagttggaaaacttggggcaaagctaaaatagtaacagcagagacacaaaactcatcttttataatcgatggaccaaataccccagaatgtcctagtgcgtccagagcgtggaacgtatgggaagtagaagattatggttttggagtattcactactaatatatggctaaaacttcgagaagtttatacacagtcgtgcgatcatagattaatgtctgcagcgatcaaagatgaaagagccgtccacgctgacatggggtactggattgaatcacaaaagaatggcagctggaagttggaaaaagcatcatttatagaagtaaaaacatgcacgtggccaaaaagccacaccttatggtccaatggagtgttagagtcagacatgatcatcccaaagagccttgccgggccgatcagtcagcataatcatagaccaggataccacacccaaacggcaggtccatggcatttaggaaaacttgaactggactttaattattgtgaaggtactacagtagtcatcgctgaaaattgtggcacaagaggccctagcttaaggacaaccacagtctcaggaaagctaattcacgaatggtgctgtagatcttgcacgctaccacctcttcggtacatgggagaagacggatgttggtacggtatggaaattcgtccaattaatgaaaaggaagagaatatggttaaatctttagtaagcgccggatctgggaaagtagataattttaccatgggagtgttatgcttagctattttgttcgaggaagtcatgagaggaaagttcggcaagaaacatatgatagcgggcgtgttgtttacctttgtacttttattaagtggacaaataacgtggagggatatggcacatacactgatcatgatagggtccaatgctagtgacagaatgggtatgggggttacctatttagcgcttattgcaacgtttaaaatccagccatttttagctttaggtttctttctcaggaaattgacgtctagagaaaacctactactaggagtcggacttgcaatggcgactactttacaacttccagaagatatagaacaaatggcaaatggtatagcactaggcctaatgaccttgaaactaatcacccagtttgagacttaccagttatggacggccttagtcagcctcacgtgctctaatactatttttacattaaccgtcgcctggcgtaccgcgacacttatactcgcgggcgtatctcttcttccactatgtcaatcatcgtcaatgcgaaaaacagattggcttccaatgaccgttgccgccatgggcgttccacctctcccattattcattttcagtttaaaagatacaccgaagaggagaagttggcccttaaacgaaggtgtcatggcagtaggcctcgtctcgatattagcaagctcgcttctaaggaatgatgtaccgatggctggtcctctggtagctggaggattgcttatcgcctgctacgtgatcacggggacttcagcagacttaactgtagagaaagcagcggacgtcacgtgggaagaagaagcggagcaaaccggagtctcacacaatctaatgattacagtagatgatgacggtactatgaagattaaggatgacgagaccgaaaacatactgaccgtcctcttaaaaaccgcactactaatagtatccggcatatttccatattctatacctgctaccttacttgtctggcatacctggcagaaacaaacacaaagaagtggcgtattatgggatgtcccctcaccaccagaaacacaaaaagccgagttagaagaaggagtatatcgaatcaaacagcaaggtatatttggtaaaactcaggtaggagtaggggttcagaaagaaggagttttccacacaatgtggcatgtaacaagaggtgcagtattgacacacaatggaaaaagattagaaccaaattgggcctcagtcaagaaagatctaatcagttacggagggggatggagactatctgcacagtggcagaagggagaagaagtccaagtaatagctgttgaaccaggcaaaaatccgaagaacttccaaaccatgccaggaatatttcaaactacaaccggcgaaataggagccatagctctagactttaaaccaggtacaagtgggtcccccataattaatcgagaaggaaaagtggttggtttgtacgggaatggagtagtaaccaaaaacggaggatatgtatctggcatagctcaaaccaatgctgagccagacggcccaactccagaattagaggaggaaatgttcaaaaagcgaaatttgacgataatggacttacatcctgggagcggaaaaacaagaaagtatttgcccgctatagtacgtgaggcaataaagcggcgtttacgcacactaatattggccccgacacgggtagtggccgctgaaatggaagaagccctcaaagggttaccaataagataccagacgacagctactaaatcagagcatacggggcgtgaaatagtagatctaatgtgtcatgcaaccttcactatgaggcttttatcacctgtccgtgtccctaattataacttagtgataatggacgaggcacatttcactgatccagcaagcattgctgcaaggggatatatatcgacaagagtcggtatgggtgaagcagcagccattttcatgactgcaactcctcccggtactgcagaggcttttcctcaatctaacgccccaatacaagacgaagaaagagatatccctgaacgtagttggaacagtggaaacgaatggattacagactttgtgggtaaaactgtctggtttgtaccttccatcaaagcagggaatgatatagctaactgtttgcgcaaaaatgggaagaaagtgatacagctctcaagaaagaccttcgatactgagtatcagaaaacaagactaaacgattgggacttcgtagttacgacagacatttcagaaatgggcgctaacttcaaagctgatcgagttattgacccaagaagatgcctcaagccagtcatattgacggatggaccagagcgcgtaatacttgcaggacccatgccagttaccgcagcaagcgcagcccaacggcgtggacgagtaggaagaaatccgcagaaagaaaatgaccagtacatatttatgggacaaccattaaataatgatgaagaccacgcgcattggacggaagcaaaaatgttactagacaacataaacacaccagaggggatcattccagcactattcgaacccgaacgggaaaagagtgcagcaatagacggggaatatagactgaaaggagaatcaagaaagacgttcgttgagcttatgagaaggggtgatttacctgtatggctagcacacaaagtagcctcggagggcatcaaatataccgatcgtaaatggtgttttgatggagaaaggaacaatcaaattttagaagaaaacatggacgtcgaaatctggaccaaagaaggggaacgcaagaaactaagaccgcgatggttagatgcgaggacttattcagacccattggccctcaaagaatttaaagactttgcagcgggtcgaaaaagcatagctttagatttagtaaccgaaataggtagagtcccctctcatcttgcacacagaacgcgtaacgctcttgacaatctagtgatgctacacacatccgaacacggcggtagagcatatcgccatgctgtagaggagctaccagaaacaatggagaccctcttgctcttaggtctaatgatacttctaactgggggtgcaatgttatttttaatttcaggtaaaggaataggaaaaacttcaataggtctgatatgtgtgatagtgtcgagtggaatgctttggatggccgacgtcccattgcaatggatagcctctgctattgttcttgagttctttatgatggtcctcttaattccggaaccggaaaaacaacgaacgccgcaggataatcaacttgcatatgttgtaattggcatactaactttggcagccatagtagcggccaacgagatgggcttgctagaaactaccaaacgggacctgggaatgtctaaagaacctggagtcgtgtcgcctacatcatatctagatgtagacttgcaccctgcaagcgcatggacattatacgcagtagctacaacagtgataactccaatgttaagacatactattgaaaattcgacagcaaatgttagtttagcggcaatagctaatcaagcggtagtactcatgggcctagataaagggtggccgatttcaaaaatggatcttggggtacccctactggcattaggatgttactcgcaggtaaatcctttaaccttgaccgccgctgttttgctcttagtaacgcactatgcaataattggtccaggattacaagcaaaagccacacgagaagctcaaaagagaacagcagcaggcataatgaaaaatcctacagttgacgggataatgacgatagacttagacccagtaatctatgatagcaagtttgaaaaacagctgggacaagtaatgctattagttttatgtgctgtacaattactattaatgagaaccagttgggctctctgtgaggcactaactctagccacaggaccaattaccacactctgggaaggtagccccggaaaattttggaacactactatcgccgtatcaatggctaatatatttcgcggaagttatcttgcaggcgcaggcttagcattcagtatcatgaagtctgtgggtaccggacgtagaggaacaggaagccaaggtgaaactttaggcgaaaaatggaagaagaaactcaatcaactaagccgaaaggagtttgacctatataagaagtctggtataacagaagttgaccgtactgaagccaaggaaggtttaaaacgtggggaaactacgcatcatgcagtatccaggggttcagctaagctacaatggtttgtcgaacgtaatatggtaattcccgagggtcgcgtgattgacctaggatgtgggagagggggctggtcatattattgcgccggtctaaagaaagtgacagaagtacgaggttacactaagggcggtccgggacatgaagaacccgtacctatgtctacctatggatggaatatcgttaaattgatgagtggtaaagatgtattttatcttcccccagaaaagtgtgacacactcctctgcgatataggcgagtcaagtccgtcaccaacagtagaggaatcccgcactatccgagtgcttaagatggtggagccctggttaagatctaatcaattttgcatcaaagttctgaacccttatatgcctacagtaattgaacatctagaacgattgcaacgcaaatacggcggaatgctggtacgcaatccactgagtcgaaattcaacccacgaaatgtactggattagcaatggaactggtaatatcgtttcttcggtaaacatggtttccaggttactgttaaatagattcactatgacacacagaagacccaccatcgaaaaggatgtcgatctcggggccggtacgagacacgttaacgcggaacctgaaacaccaaatatggatgtgatcggagaacgtataaaaagaataaaagaagaacattcttctacttggcattatgatgacgaaaatccttataagacgtgggcataccatggtagctatgaggttaaagcaaccggatccgccagttcaatgataaatggcgtcgtcaaattattaacgaaaccatgggatgtagtaccaatggtaactcaaatggccatgacagacacaacgccctttggccaacagagggtttttaaagaaaaagtagacacgaggactccgaggcctatgcctggaacacgaaaagttatggaaataactgcagaatggctgtggagaacactaggacgaaacaagaaaccaagactctgtactagagaagaatttacgaagaaagttagaaccaacgccgcaatgggcgccgtattcactgaggaaaaccaatgggattcagctagagctgcagttgaagacgaagagttctggaagctagttgataaagaacgagaattacacaagttaggaaaatgcggaagctgcgtgtataatatgatggggaaacgtgagaagaaacttggggaatttggaaaagcgaaaggttctagagctatatggtatatgtggctaggagcacgctacttagagtttgaagcgctcggatttttaaacgaagatcactggttcagcagagaaaatagttacagcggggttgagggtgaaggactacataaattagggtatatcctgagagatatttcaaaaatccctgggggtgcaatgtacgcagacgatactgctggatgggatactcgaataacagaagacgatctgcacaacgaggagaaaataacccaacaaatggatccggaacatagacaattagcaaacgctatatttaaattaacgtaccagaataaagtcgtgaaagtgcaacgtccaacaccgaaaggaaccgtaatggacattatctctaggaaagatcaacgaggaagcggacaagtaggcacatatggtctgaatacatttacaaatatggaggctcagttagtaaggcaaatggaaggagaaggtgtgctttctaaagccgatctagagaaccctcatctgctggaaaagaaaataactcaatggttagaaacaaaaggagttgagagactaaaaagaatggcaataagtggcgatgactgcgtggtcaagccaatagatgaccgatttgctaatgccctattagctttaaacgatatgggaaaggtcaggaaagatatacctcaatggcaaccaagtaaaggctggcacgactggcaacaagtacctttttgcagtcaccatttccatgaacttatcatgaaagacggcagaaaactggtggtgccgtgtcgcccgcaagatgaactcattggacgcgcgagaatatcacaaggagctggatggtcgttaaaagagaccgcctgtttaggcaaggcttatgctcagatgtggtcattaatgtactttcatcggagagacttacgactggcttcgaatgcgatctgttcagcagttccggtacattggatacctacatcacggactacctggtcgatacacgctcaccaccaatggatgaccacagaagacatgttgaccgtatggaatcgagtctggattgaagataacccatggatggaggataaaactcctgtaacgacgtgggaagacgtaccctatttaggtaagagagaagatcaatggtgtgggtccttgataggactaacatcaagagctacatgggcacagaacattctaaccgcaattcaacaagtgcgatcattaatcggagatgaagagttcttagattatatgcctagtatgaaaagatttagaaaagaagaagaaacagaaggcgccatatggtaa

SEQ ID NO: 23115 - RNA, 9873 nt, synthetic construct
  misc_feature 1..9873: note = derived and/or modified CDS sequence (opt6) from DENV-3__GU131937__SS-prME
  source 1..9873: mol_type = other RNA
acatcgctatgcctaatgatgatgttacctgcaacgttggcatttcatttaacgtctagagacggagaacctcgaatgatagtaggtaaaaatgaacgaggtaaatcactcctctttaaaaccgcgagtggaataaatatgtgcacattaatcgcaatggatttaggggaaatgtgcgacgatacagtaacgtataaatgtcctctcattgcagaagttgaacccgaagacatagattgctggtgtaacctaactagcacatgggtaacatatgggacatgcaatcaagcaggagaacatcgtcgcgataaacgcagcgtagctcttgctccccacgtaggtatgggtctcgacactagaacgcagacgtggatgtcagcagaaggagcatggcggcaagtagaaaaagtcgaaacatgggctctaagacatcccggtttcacaatattagcactcttcttggcgcattacattggaacatcactaacacagaaagtggttatatttatactgttaatgctagttactcccagtatgacaatgcgatgcgtaggagtaggtaatcgtgacttcgttgaaggtctgtcaggagccacatgggtagacgttgttcttgaacatggaggttgtgtaacaacaatggccaaatccaaaccaacgttagacatagagcttcagaaaacagaagctacgcaattagcaacactgagaaaattatgcatcgaaggaaaaataaccaacataacaaccgattctagatgtcctacacaaggggaggcgactctgccagaggaacaagatcaaaactatgtttgtaaacatacatatgtagatagaggatgggggaacggctgtggtttatttggcaaagggagtttagtcacatgcgctaagtttcaatgtctagagcccatcgagggaaaagtagtacagtatgaaaacctgaagtacactgttataatcaccgtacatactggagaccaacatcaagttggcaacgatacccaaggggtaaccgtagagatcacaccccaggcttcaacggtcgaagctgtgttgccggaatatggaacacttggactagaatgcagtccgcgtacgggtctagacttcaatgagatgattctacttactatgaaaaacaaagcatggatggttcacagacaatggttctttgacttacctctgccatggacaagtggtgcaacaacagaaactcctacatggaaccgaaaagaactcttagtcacgtttaaaaatgctcatgctaagaaacaagaagtcgtagtattaggctctcaagaaggtgcaatgcacacagctctaaccggagccacggaaatacaaaactctggtggaacaagtatatttgcaggtcatctaaaatgcagactgaaaatggataagctcgagttaaaaggaatgagttatgcgatgtgcttaaatacatttgttttaaagaaggaagttagcgagacccaacatggaactatactgataaaagtggaatataagggtgaagatgcgccatgcaaaatacccttttccactgaagacggacaaggaaaggcgcataatggcagattgatcaccgccaaccctgtggtaacaaagaaagaggaaccagtaaatattgaggccgaacccccatttggagaatcgaacatagttatcggcataggcgataaggctttaaaaataaactggtataagaagggatccagcatcggaaagatgtttgaagccacagctagaggtgcacgccgcatggccatcttaggcgatacggcctgggactttggctctgtaggaggtgttcttaattcactgggtaagatggtacaccaaatattcggcagcgcttacaccgcattattctcaggagttagttggataatgaagattggaattggggtcctcttaacctggattggtctaaattccaaaaatacttcgatgtccttctcatgcatagtgataggaataattacgttgtacctaggtgcagtggttcaagccgacatgggttgcgttattaattggaagggcaaagagttgaaatgcggctctggaatcttcgttacaaatgaggtccatacatggacagaacaatataaattccaagccgatagcccaaaaaggttagcaacagcaattgccggtgcttgggagaatggtgtatgcggtattcgcagcacaactagaatggagaatcttttgtggaaacagattgctaacgaactaaattacatattatgggaaaacaatataaaactcactgtagtcgtcggtgatattatcggagtattagaacaagggaaacggaccttaactccacaacctatggaattaaaatacagttggaaaacttggggtaaagctaaaattgtaacagcagaaacccaaaatagtagttttataatcgatggtcccaatacgccagagtgcccctcaacccttagagcgtggaacgtgtgggaagtcgaggactacggttttggtgtatttactacaaatatatggttgaaattgagagaagtttatacacaatcctgtgatcacagacttatgtcagcggcaatcaaggatgaacgtgcagtacatgcggatatgggttattggatcgaatcacaaaagaacggttcctggaagctagaaaaggcaagttttattgaagtcaaaacttgcacatggccaaaatctcatacattatggagtaatggtgtgttagaatcagatatgattataccaaagtctcttgctggcccgattagtcaacataattataggccagggtatcatacacaaactgctggcccctggcatctaggtaagctagaactagactttaattactgtgaaggaacaaccgtcgtcataaccgaaaactgcggcacgcgaggaccctcattaagaaccacgacggtatcgggcaagttgatacacgaatggtgttgccgatcatgtacgttaccacccttgagatatatgggagaagacggatgttggtatggaatggagataagaccaataaatgaaaaagaagaaaacatggtaaaatcacttgtatcagccggttctggcaaagtcgacaattttacaatgggagtcctctgccttgcaattctattcgaagaggtgatgagaggaaagttcggaaagaaacacatgatagccggtgttttattcaccttcgttctattactgtcagggcaaataacatggcgagatatggctcatacactgataatgataggctccaacgcatccgatagaatgggtatgggagtaacatatttggcattaattgccacatttaaaatccaaccatttttagcattaggtttctttttaagaaaattaacttcaagagaaaatttgctactaggcgtggggttggcaatggcaacaaccttacaattacccgaggatatagaacagatggcaaatggcatcgccctcggattaatgaccttaaaactaataacacaatttgagacttaccaattatggacggctttagtatcactaacctgcagtaacactatcttcacacttacagttgcctggcgaacagcaacacttatccttgcgggtgttagtctacttccactctgtcagagttcaagtatgaggaaaacggactggttaccaatgacagtagcagcgatgggagtgccacctttaccattattcatattctccctgaaagacaccccgaaaagaagatcatggccacttaatgagggcgttatggcagtaggcttagtgagtatattagcttcttctttactacggaacgacgttccaatggctggtccactcgtggcagggggtctactaatagcatgctatgtgattaccggaacaagcgccgatttaacagttgagaaagccgctgatgtaacatgggaagaagaggcggaacaaacaggcgtatcacacaacctaatgattacggtagatgacgacggcactatgcgcattaaagatgatgaaacagaaaatattcttacagtattattaaagactgcattgctcatcgtctcaggaatattcccctattcaatacctgcaacattattagtttggcatacatggcaaaaacaaacacagagatcgggggtattgtgggacgtaccgtcacccccggagacacagaaagctgaattagaagaaggggtttacagaatcaaacaacaaggcatcttcgggaagacgcaagtaggtgtaggagtgcagaaggaaggagtctttcatacaatgtggcacgtgacaaggggtgctgtcttgactcacaatggtaagcgattagaacccaactgggcttcagtcaagaaagatctaatctcttatggaggaggatggcgactatctgcacaatggcaaaaaggcgaagaagttcaggtaatagcggtcgaacctgggaaaaatcctaaaaactttcaaacaatgcctggaatcttccaaaccactactggagaaattggtgcgatcgcactagacttcaagcctggaacatccggtagtccaattattaaccgggaaggaaaagtggtaggtctctatgggaatggtgtagtaaccaaaaacggcggttatgtcagtggaattgctcaaactaatgccgaaccagacggaccaactcctgaactcgaagaagaaatgtttaaaaagagaaacctaaccattatggatctacacccgggcagcggcaaaactaggaaatacttaccagcaatagtacgtgaagctattaaaagacgactaaggactctaattctggcaccaaccagagtggtagctgcagagatggaagaggcattaaaaggtcttccaataagatatcagactacagctaccaaatcagaacatacaggcagagaaatagtagacttaatgtgtcatgctacttttactatgcgactattatcaccggttcgcgttcccaattataaccttgtcataatggatgaggctcacttcaccgacccagcgagcatagcagctcgcggttacataagtaccagggtaggtatgggtgaagcagcggctatctttatgactgcaactcctcccggaactgctgaggcttttccacaatcaaacgcacctatacaggacgaagaaagagatattccagaacggtcttggaacagtggtaacgaatggatcacagattttgtaggcaagactgtgtggtttgttccgtcaataaaagcaggaaatgatattgctaattgcctccgcaaaaatggaaagaaagtgattcaactttcgagaaaaactttcgatacggaatatcagaaaaccagacttaatgactgggattttgtcgtcaccacggacatatccgaaatgggagctaattttaaagcagatcgagttatagatccgagacggtgtcttaaacccgtgattcttactgatggaccggaaagggtaatacttgcaggacccatgccagtgaccgctgcatctgcagctcaaagacgtggtagggtggggagaaatccacaaaaagaaaatgatcaatacatttttactggacaacctttaaacaacgacgaggaccacgcacattggacagaagcaaaaatgctattagataatatcaatacacctgagggtattataccagccttatttgaacccgagagagagaaatcagcagcaatagatggagaatatagactaaagggagaatcgagaaaaactttcgtggaactcatgagaagaggtgacctgccagtgtggttagcgcataaagtagcgtcagaaggtattaaatataccgaccgaaaatggtgttttgacggcgaacgtaataaccagattcttgaagaaaacatggacgtagaaatctggactaaagaaggagagcgaaagaaactacgaccgcggtggctagatgcgagaacgtatagcgacccgctggctctcaaagaatttaaagattttgctgctggtaggaaaagtatagctttggacttagtaactgagatcgggagagtcccatcacacttggcgcatagaacgcgaaatgcgctagataatctagtaatgctacatacttctgagcacgggggacgggcgtataggcatgctgttgaagaacttccggaaactatggaaacactactgctattaggacttatgattagtttaactggtggtgccatgttattcttaatttcaggaaaaggtattggcaaaacatcgattggtttaatatgtgtgatagtgtcttcaggtatgttatggatggcggatgtcccattacaatggattgcatcagctattgttctggaatttttcatgatggtcctacttattcccgaaccagaaaagcaaagaacgccacaagacaaccaactagcgtacgtcgtgatcggcattcttacactggcagccatagttgcagctaatgaaatggggttgctagagaccactaaaagagacctaggaatgagcaaggagcctggagtagtatccccaacgtcgtatttagatgtagatcttcatcctgcgagtgcgtggactctctacgcagttgcaacaacggtaataacaccaatgttacgacacacaatagaaaattccaccgcaaatgtaagcctagccgcaattgctaaccaggcggttgtcctgatggggctagataaagggtggccgatcagcaaaatggatttaggggtgcctctattagcattgggctgttattcgcaagttaacccattgactttgaccgcagccgttctacttttggtaacacattacgctattatcggacctggattacaagcaaaggctactcgagaggcacagaaaagaacagcagcaggtattatgaaaaatcctacagtagatggtatcatgacgatagatcttgaccccgtaatatacgactctaaattcgaaaaacaattaggacaggtaatgttattagttttatgtgcagttcaattgttactcatgcgaaccagctgggctttatgtgaagccctgacactcgctacagggcctatcacaactttatgggagggatcccccggtaaattttggaacacgacaattgcagtatccatggctaacatattccgaggatcgtatttagccggtgcaggtttggctttttcaatcatgaagtcagtagggacgggtcgaagaggcacaggctcacaaggcgaaacacttggggaaaaatggaagaagaaattaaatcaattaagtagaaaagagttcgatctatacaagaaatctggaattacggaagtagaccgaactgaagccaaagaaggtttgaaacggggagaaacaacgcatcatgctgtgtctcgtggaagcgcaaaattgcaatggtttgtcgagcgcaatatggtaattccagaaggtcgcgtaatagatctagggtgcggaaggggaggttggagctattactgcgcgggactaaagaaagtgacagaagtaagggggtatacaaaaggaggtcccggtcatgaagaaccagtccctatgagtacatacgggtggaacattgtgaaattgatgagcggaaaagacgttttctatctaccacccgaaaaatgcgacacactgttgtgtgatataggggagagctctcccagcccaactgtggaagaaaatcgaactatccgagttttaaaaatggtcgagccatggttgagaaacaatcaattctgtattaaggtcttaaatccatacatgcctactgtaatagagcatctagagaggcttcaaagaaaatacggaggaatgctagtcaggaatccattatctagaaactcaactcacgaaatgtattggataagtaatggaactggtaatatagtatcatctgttaatatggtgagcagattattattgaataggttcactatgacacatagaagacctactatagaaaaagatgtcgacctcggggctggcacaagacatgtcaacgccgagcctgaaacgccgaatatggatgtgattggtgaacgaataaaaaggataaaagaagaacattcgagcacgtggcactatgatgacgagaacccttataagacctgggcataccacggtagttacgaagtaaaagcaactggttcagcgtccagcatgataaatggtgtcgtaaaactattaacaaaaccttgggatgtcgtaccaatggttacacaaatggccatgactgacacaactccattcggacaacaacgagttttcaaggaaaaggtagatacacgaactccacgtccaatgccaggtacacgaaaagtaatggaaattacagcagaatggttgtggaggactctaggacgaaacaagaaaccgagattatgtacgcgagaagaatttaccaagaaagttcgaaccaatgcggcaatgggtgccgtatttacggaagaaaaccaatgggattcggcacgcgcagcagtagaggacgaggagttctggaaattagttgatagggaacgcgaattacataagctcggaaagtgcggatcttgtgtttataacatgatgggaaaacgagagaagaaactaggggagtttggaaaagcaaaaggatctagggctatctggtacatgtggcttggcgctcgatatctagaatttgaagcgttgggttttctaaacgaggaccattggttttcgagagaaaactcatattcaggtgtcgaaggggaaggactccacaaattaggatacatactaagagatatcagtaaaatacctggaggcgcaatgtatgccgacgacactgcgggatgggacacgcgaattacagaggacgacttacacaatgaagagaaaataactcaacaaatggatccagaacacaggcaacttgcgaatgcgatatttaaacttacatatcaaaataaagttgttaaagttcaacgtccgacaccaaaaggcacagtgatggatataataagtaggaaggaccaacgaggttcagggcaagtagggacttacggcctaaatacatttaccaacatggaggcgcaattagtcagacaaatggaaggagaaggggtcctttcaaaggcggatttggagaaccctcatctcctagagaagaaaatcacgcagtggcttgaaacaaaaggggtggaaagactcaaacgcatggcgatcagtggcgacgactgtgttgtaaaacccatagatgatagattcgccaatgccctgttagcactcaatgatatgggtaaagtccggaaagatatacctcaatggcaacccagcaaaggatggcatgattggcagcaagtaccattctgttcacatcatttccatgaactcattatgaaagatggacgcaagttggtggtaccttgtagaccccaagatgaattaataggtagggctcgtatttcacaaggagccggttggagtttaaaagaaactgcatgcctcggcaaagcctatgcgcagatgtggtctcttatgtattttcataggagagatcttagattagcttccaacgcaatatgcagtgcagtaccagtgcactggattcccacaagccgaacgacctggtcgattcatgcacatcaccagtggatgaccacagaagacatgctaactgtatggaaccgagtatggatagaagacaacccttggatggaagacaaaacacccgtaacaacatgggaagatgtaccctacttgggtaaacgcgaggatcagtggtgtggatcactgataggtttaaccagtagggcaacgtgggcacaaaacatcctaactgcaatacagcaagtcagatcgctaataggcgatgaagagtttctcgattatatgccatctatgaaaaggtttcgcaaagaagaagaatcagaaggtgcaatctggtga

SEQ ID NO: 23116 - RNA, 9873 nt, synthetic construct
  misc_feature 1..9873: note = derived and/or modified CDS sequence (opt6) from DENV-3__GU131938__SS-prME
  source 1..9873: mol_type = other RNA
actagcctttgtttgatgatgatgttacctgcaactcttgcttttcacctaacatcccgcgacggagaacctaggatgatagtcggcaaaaatgaacgcggtaaatctttgttattcaaaactgcaagcgggattaatatgtgcacattaatagcaatggacttaggagagatgtgtgacgatactgtaacatacaaatgccccttgatagcagaagttgagcctgaagacatagactgttggtgtaatcttacatcaacatgggtcacatacggaacatgcaaccaagcgggagagcaccggagagataaacggagcgtagcattagctccccacgtgggaatgggactagacacaaggacacaaacatggatgtccgcagaaggagcatggaggcaagtggaaaaagtggaaacctgggcgttaagacacccgggctttacaattcttgctctatttttggctcattatatcggcacaagtctcacccaaaaagttgttatattcatactacttatgttagttacccccagcatgacaatgaggtgcgtcggagtgggcaaccgagactttgttgagggcctgtccggagcaacatgggttgacgtagtacttgaacacgggggctgtgtgacaactatggcaaaatcaaaaccaactctagatatcgaattacagaaaactgaagcgacccaattagcgacattaagaaaactctgcatagagggcaaaataacaaacattactacagatagtcgatgtccaacccaaggtgaggctactctacctgaagaacaagaccagaactacgtgtgtaaacacacatatgtcgatcgtggttggggaaacggttgtgggttatttggtaaaggttcattggtcacatgtgctaaattccaatgtctagaatcgatagaaggtaaagtagtacaatatgagaatctgaaatatactgtaataataaccgtgcataccggtgaccagcatcaagtgggtaatgatactcaaggtgtcactgtagaaattacaccccaggcttctacggtagaggcagttctaccagaatatggtacattaggacttgagtgtagtcccagaactggactagattttaatgaaatgatattacttacaatgaaaaataaagcatggatggtacatcgtcagtggttctttgatctaccattaccatggacatctggagctacaacagaaactccaacatggaatagaaaagagcttttagtaacgtttaaaaatgcgcatgccaagaaacaagaagtcgtggtattaggaagccaagaaggggctatgcacaccgctttaacaggtgctaccgagatacaaaactcaggaggaacttcgatatttgctggccacttaaaatgtagactaaaaatggacaaactagaactaaaaggcatgtcttatgcaatgtgcctaaatacatttgttttgaagaaggaagtttctgagactcaacatggaacaattttgataaaagtcgaatacaaaggtgaagatgcgccttgtaaaattccgtttagcactgaagatgggcaggggaaggcccataatggcagacttattacggccaatcccgtggttactaagaaagaagaaccggtaaatatcgaagcagaacccccttttggtgaatcaaatattgtgataggcattggggataaggccctgaagataaattggtataagaaagggtcctcgattggaaaaatgtttgaagctaccgccagaggagccaggagaatggctattttaggcgacacagcttgggattttggaagtgttggcggagtcctaaattcactgggtaagatggttcaccaaatatttgggtctgcatatacagctttattttcaggagtatcatggataatgaaaattggaatcggggtactattgacctggatcggcctaaatagcaaaaacacaagtatgagtttttcatgtatcgtcataggtataataactttatatcttggcgcagtggtgcaagccgacatggggtgcgtaataaattggaaaggtaaagaattaaaatgtggtaacggaatttttgtaaccaacgaagtacatacgtggacagaacaatataaatttcaagcggactctcccaaacgtctagccactgcgatagctggggcatgggaaaatggtgtatgcggaatccgatccacaactagaatggaaaatcttctctggaaacaaattgcaaacgaattaaattacatcctatgggaaaataacataaagctaacggtggtagtaggtgatataattggagtcttggagcaaggaaaaagagctcttactccccaacctatggagctaaaatatagctggaaaacttggggaaaagctaagatcgtaacggcagaaacacagaatagtagttttataatagatggcccgaatacaccagagtgtccatcagcatctagagcgtggaatgtatgggaagtagaggactacggctttggggttttcacgacgaacatttggttgaagttaagggaagtctatacgcaatcatgcgatcatagattaatgtctgctgccataaaagatgaaagggcggttcatgctgacatggggtactggatcgaatcgcagaaaaatggtagttggaaattggaaaaagcaagttttatagaagtaaaaacctgtacctggccaaaatcgcatacgttgtggtcaaacggtgtactcgagagcgacatgatcatccctaaatcattagcgggcccaattagccaacacaatcaccgtccaggatatcacactcagacagctgggccgtggcatcttggaaaactagagctagactttaattactgcgaagggacaactgtggtaatagcagaaaattgtggaactcgaggaccttcactccgaacaacaacggttagcggcaaactaatacatgagtggtgttgccggtcatgtacactaccgcctctcagatatatgggagaagacggttgttggtatggtatggagataagacctataaacgaaaaagaagagaacatggtcaaatcattagtttcagcagggtctggaaaagtcgataatttcactatgggtgtcttgtgtcttgcgatactatttgaagaagttatgagagggaaattcggtaagaaacacatgatcgcgggagtcctatttacttttgtccttttattatcagggcaaataacttggagggacatggcacacacactcattatgatcggatcaaacgcgagcgatagaatgggcatgggggttacatatttggcgttaattgctacatttaaaattcaaccttttcttgccttgggatttttccttcgtaaactaacctcacgtgaaaacctccttcttggggtgggtttagcgatggcaaccacattacaactacctgaagatatagaacagatggcaaatggcatagcattagggttaatgacgctaaaattaataacacagtttgaaacatatcaactctggactgctcttgtctccttgacgtgtagtaatactatctttaccctcacggtagcatggcgaacagcaaccttgatactagcaggagtgtctctccttcccttgtgtcaatcgtcgtctatgcgaaaaacagactggctgcccatgactgtagcagctatgggagtcccacccttgccactatttatcttttccctaaaagacactccaaaacgaaggtcatggcccttaaacgaaggagtgatggcagtagggctggtgtcgatcctagcgtcctctctactaaggaacgacgtgccaatggctgggccgttagtagccggtggtttacttatagcatgttacgtaattacaggaacctcagcagatctcaccgttgaaaaggcagcagacgtaacatgggaagaagaagcagaacagacaggagtttctcataatttaatgataacagtggatgacgatggaaccatgaaaattaaggacgatgaaacagagaacatactaactgtgttattgaaaaccgctttactgatcgtttcaggaatatttccctacagtataccagcgactctattagtttggcatacctggcaaaagcaaactcaacgatcaggcgttctttgggatgtaccatctccaccggagacacagaaagctgaactcgaagaaggagtatacaggattaaacaacagggcatattcggaaaaacccaagttggtgtgggcgtccaaaaagaaggggttttccacaccatgtggcacgtaacaagaggtgctgtgttgacacacaatggaaaaagattagaaccaaattgggcgagtgtcaagaaagatttaatctcctacggtggcggatggagattatccgctcaatggcaaaagggcgaagaagtgcaagtcattgctgtagagcctggaaagaatcctaaaaatttccaaaccatgccgggtatcttccaaaccactaccggagaaattggagcaattgccttggactttaaaccaggcacatctggcagccctataatcaaccgagaaggtaaagtagtgggcctttacggtaatggcgtagtaaccaaaaatggaggatatgtttctgggatcgcacaaacaaacgccgaaccggacggacccacgcctgagctagaagaggagatgtttaagaaacgtaatcttactattatggatttgcatccgggatctggcaaaacaaggaaataccttcctgcgatagtcagagaggccataaaaagaagactcaggacattaatccttgcaccaacaagagtggtagctgctgaaatggaagaggctttaaaaggtcttccaatccgatatcaaacaactgccacaaaaagcgaacatacagggcgagaaatcgtagatctcatgtgtcatgcaacttttacgatgcgcttgttgtcaccagtcagagtccccaactacaacctagttattatggatgaagcacattttacagatccggcgtctatagcagctagaggatatatatcgacacgggtaggaatgggggaagcggcagcgatttttatgactgctactccgccaggaactgctgaggcattcccacaatctaatgccccaattcaagatgaagaacgagatataccagaaaggtcatggaactcaggtaatgaatggataaccgactttgtgggaaagactgtttggtttgtcccgtctataaaagccggtaacgacatagcgaactgtctacgaaagaatggcaagaaagttatacaattgagcaggaaaacatttgatacagaatatcagaaaacaaggttgaacgattgggattttgtcgtaaccacagacattagtgagatgggtgccaatttcaaagcagatagggtcattgacccccgtcgatgtttgaaacctgtaattttgacagatggaccagaacgagttatcctagctggacccatgccagtgacagcagctagtgcagcacaaaggagaggcagggttggcagaaatccacaaaaagaaaatgaccaatatatttttatgggtcaacctctaaacaatgatgaggatcacgctcattggacagaggcaaagatgttacttgataatataaatacacctgaagccatcatacccgctctatttgagcctgaacgtgaaaagagcgcggcaatagatggagaataccgtctaaaaggtgaaagccgcaaaacgttcgtggaattgatgcgacgaggggatctgcctgtttggttagcccataaagtagcatcggaagggatcaagtataccgatcgtaaatggtgctttgatggggaacgaaataatcaaatacttgaggagaatatggacgtcgagatttggacaaaagagggagagcgtaagaaattaagaccccgttggttagatgcacggacatattccgaccctttagcactaaaagaatttaaagatttcgcagcggggagaaaatcaattgcattagacttagttactgaaataggaagggttcccagtcatctcgcacatcgaacaaggaatgcgcttgacaatctagttatgctacatacaagtgaacacggcggtcgtgcttatcggcatgctgtcgaagaactaccagaaaccatggaaacactgctactgttaggactgatgatactattaaccggcggtgcaatgttgttcctaataagcggaaaaggcataggaaagacatccatcggattaatatgtgtaattgtaagttcgggcatgctttggatggctgacgtaccattacagtggatagcaagtgcaatagtactcgagttctttatgatggtattacttataccagaaccagaaaagcaaaggactccacaagataaccaactggcttatgtcgtaattggtattttgacactagccgcaatagttgctgctaatgaaatgggcttactggaaacaactaaaagggatcttggcatgtcgaaagaaccgggggtcgtatcaccaacaagttatttagatgttgatttacatccagcctcagcgtggacactatatgctgtggccacgacagtcatcacgccaatgttaagacataccatagaaaattcgactgcgaatgtatcattagctgctattgctaatcaggcagtagtactaatgggattggacaagggttggcccatcagtaaaatggatctaggcgtaccgctattagctttaggatgttactcacaagtcaaccccctaacactaacagcagctgtattgctgctagtaactcactacgcaattatcggaccgggcctccaagctaaagcaacaagagaagcccagaaaaggaccgcagcaggaatcatgaagaatccgacagtagacggaataatgacgatagacttagatccagttatttatgattcaaaattcgaaaaacaattgggccaagtaatgctcctagtactgtgtgctgtccaattactcctcatgagaacaagttgggcattatgtgaggcactaactttagctactggcccaataacgacactttgggaaggatcaccgggaaagttctggaatactacaatagctgtctccatggcgaatatttttcgagggtcttatttagcaggagctggattagcgtttagcataatgaagagtgtgggaacaggaagaagaggaaccggatctcaaggggaaaccctgggagagaaatggaagaagaaactgaatcagttatcacgtaaagagtttgacctctacaagaaaagtggcattactgaagtagaccgcacggaagccaaagaaggcctgaaaagaggcgaaaccacccatcacgctgtatcaagaggatctgcaaaactgcaatggttcgtcgaaagaaatatggtgattccggagggtagggtaatagatctaggatgtggtcgcggaggatggagttattattgcgcaggtttgaaaaaggtaacagaagtgagaggttataccaagggtggaccaggacacgaggaacctgtacccatgagtacatatggatggaatatagttaagttaatgagcgggaaggacgtcttctatcttccgcccgaaaaatgtgatactctcctgtgtgatattggtgaaagctcacctagtccaaccgtagaggaaagcaggacaattagggttttaaaaatggttgagccatggctacgctcgaatcaattctgcataaaagtattaaacccgtacatgcctaccgttattgagcatctagaacgactacaacgtaagtatggtggaatgctggtgagaaacccattaagcagaaattccacccatgaaatgtattggatttcaaatggaacaggtaacatcgtctcgtctgtcaacatggtctcaagactactactgaaccgatttactatgacgcatcgtagacccactatcgaaaaagatgtcgacctcggagctggcacaagacatgtgaacgcggaacccgaaacaccaaacatggatgttatcggcgagcggattaagcggattaaagaagaacattcaagtacttggcattacgatgatgaaaatccatacaagacgtgggcttatcatggatcatacgaggtcaaagccacaggatcagcttcaagcatgatcaacggagtagtaaaactcttgacgaaaccatgggatgtagttccgatggttacacagatggccatgactgatacgacaccttttggtcaacagagggtattcaaagaaaaagttgatacaagaacacccagaccaatgcctggaacaagaaaagtcatggagattactgccgaatggctgtggagaacacttggacgaaacaaaaagccccgattatgtacacgagaagaatttaccaagaaagtaagaaccaatgctgcaatgggggccgtttttacagaagaaaaccaatgggactctgcacgcgccgcggtagaagatgaagagttttggaaattagtagataaagaacgagagctccataaattaggaaaatgtggaagttgcgtctacaatatgatgggaaagcgagaaaagaaattaggggagtttggaaaggctaaggggagcagagccatctggtatatgtggttaggagctcgctacttggagttcgaagcactaggatttttaaacgaagatcactggtttagcagggaaaattcttacagcggagtagagggagaagggctacacaaacttggatatatactacgagatatatcgaagattcccggcggagcaatgtatgcggatgacactgctggctgggatactagaataacagaggacgatttacacaatgaagagaagattactcaacagatggacccagaacatagacagttagctaatgcaatatttaaacttacgtatcaaaacaaagtagtaaaagtacaaaggccgaccccaaagggaacagtaatggatataatatctcgaaaagatcaaagaggctcagggcaagtgggtacgtatggattgaacacattcacgaacatggaagcacagcttgtgcgccaaatggaaggagaaggggttctctcaaaagctgatttagaaaatccacatctattagagaagaaaattacacaatggttagaaactaagggagttgagagattaaaacgtatggccatatcgggggatgattgcgtggtaaaacctatagacgaccgatttgcgaatgctttattggcactaaacgacatgggcaaagtccgcaaagacattcctcaatggcaaccaagtaaaggttggcacgattggcaacaagtacctttctgcagtcatcacttccatgaattgattatgaaagacggcagaaaacttgtcgttccatgtcgcccccaggacgaacttatcggtcgagcccgtatctcgcaaggtgcaggctggagcctgaaagaaactgcctgtctaggaaaagcatacgcccaaatgtggtctttaatgtacttccacagaagagacctgagacttgcgtctaatgccatttgcagtgcagttcctgtacattggatacctacaagtcgaacaacgtggagcatacatgcgcaccaccaatggatgactacagaggatatgttaacagtctggaatcgtgtttggattgaagacaacccatggatggaagacaaaactcccgttacaacctgggaggatgttccttacttagggaaacgtgaggatcagtggtgcggtagtcttattgggctaacttctagagccacgtgggcccaaaatattttgactgctatacaacaggtaagatcattaattggagatgaagagttcctagactacatgccaagcatgaaaagattccgaaaagaagaggaaacagaaggagcgatttggtga

SEQ ID NO: 23117 - RNA, 9873 nt, synthetic construct
  misc_feature 1..9873: note = derived and/or modified CDS sequence (opt6) from DENV-3__GU131939__SS-prME
  source 1..9873: mol_type = other RNA
acaagtctgtgcttaatgatgatgcttccagcaacactagcattccacctaactagcagggatggggaacctcggatgatagttggcaaaaatgaacgagggaaatcattactatttaaaactgcaagtggtattaatatgtgcaccctgatagcgatggaccttggagaaatgtgcgatgatacagtgacatacaaatgcccactaatagcagaagttgaaccggaagatatagactgctggtgcaacctaacatcaacctgggtaacttacgggacctgcaaccaagcgggggaacaccggagagacaaacgttcagttgccctagcaccacatgtagggatgggtttggacacccgcactcaaacttggatgtccgcagaaggagcatggagacaagtagaaaaagtagaaacttgggcattaagacaccctggttttaccattctcgcacttttcttggctcattacataggaactagcttaacacaaaaagttgtaattttcattttactaatgcttgtcacgccatcgatgacaatgcgatgcgttggtgttggaaatagagactttgtcgaaggtctatctggagccacttgggtggatgtggtcttggaacacgggggttgtgttacgactatggctaaatcgaaaccaacgctggatatagaattacagaaaacagaagctacacagctcgctacattaaggaaattgtgtattgaagggaaaataacaaatataaccaccgactcacgatgtcccactcaaggggaagcaacattgccagaagaacaagaccaaaattacgtttgcaaacacacttatgttgataggggttggggaaatgggtgcggactcttcggaaaaggtagcttagttacatgtgcaaaattccaatgccttgaaccaatagaaggaaaagttgtacaatatgagaacttgaaatacactgtaataattactgtacacacaggagatcaacatcaagttggaaatgacacacaaggagttacagtcgagatcactccacaggcaagtacggttgaagcagttttaccagaatacggcacactaggccttgagtgtagtccaagaaccggactggattttaatgaaatgatattattgaccatgaagaataaagcatggatggtacatagacaatggtttttcgacctgcccttgccatggacaagtggggctacaactgagaccccaacttggaacagaaaggaactacttgtgacgtttaaaaacgcacatgcgaaaaagcaggaagttgtggtattgggatcacaggaaggcgcaatgcatacggctctaacaggagcaacagaaatccaaaattccgggggcacaagtatctttgccggacatttaaaatgcaggctaaaaatggacaagctggaactaaaaggcatgagttatgccatgtgtctaaatacattcgttctcaagaaagaagtttcggagacccaacatggtacaatattaataaaagtagaatacaaaggagaggacgcaccctgtaaaatccccttctctaccgaggacggccaaggaaaagcacataacggtcgtttaataactgctaatcctgtcgtaaccaagaaagaggagccgataaatatcgaagctgaaccaccatttggcgaaagcaatatagtaataggcataggtgacaaggcacttaaaatcaactggtataagaaaggtagttcaataggaaagatgtttgaggcgacagcccggggagctagacgaatggccatattaggcgacactgcatgggactttggaagtgtcggtggcgtcttgaactctcttggaaaaatggtacaccaaattttcggtagcgcatacacagctctgttttccggtgtttcatggataatgaagataggtataggtgtgctcctaacgtggataggactgaacagtaaaaacaccagtatgagcttctcatgcatcgtgatcggcatcatcacattgtatctcggtgcagtagtgcaggcggatatgggttgtgtgataaattggaaaggcaaagaacttaaatgtggcaacggaattttcgttactaacgaggtacacacttggacagaacaatacaaattccaagcggacagtcccaaacgactagctactgcgatagctggtgcgtgggaaaacggagtatgcggtattcgttccaccacccgcatggaaaatctactatggaagcaaattgcaaatgaactcaattacattttatgggaaaacaatataaaactcacggttgttgttggtgatataataggagtactagaacaaggcaagagaacattgacaccccaaccaatggaattaaaatactcttggaaaacttggggaaaagcaaagattgtaacggctgaaactcaaaattcttccttcataatagatgggccaaacactcctgaatgcccgtcagcgtcgagagcttggaacgtatgggaagtagaagactatggatttggagtatttactactaacatctggttaaaacttagagaggtgtatactcagagctgtgatcacagactcatgagtgcggctatcaaagacgagagggcagtccatgctgatatgggatattggatagagtcccagaagaatggaagttggaaattagaaaaggcttcctttatagaagtgaaaacctgtacgtggccaaaatcacacacgctttggagcaatggggttttagaaagtgacatgataattccgaaatctttagcaggtcctatttcacaacataatcatcgaccagggtatcacacacaaacggcaggtccttggcatctgggaaaactagaactagatttcaattactgcgagggaacaacggttgtcattgctgaaaattgtggcactcgcggcccatcattacgaactacaacagtatcaggcaagctaatacatgaatggtgctgccgatcatgtacattacctcccctgagatatatgggggaagacgggtgctggtacggtatggaaattaggcctataaatgaaaaagaagaaaacatggtgaaatctctagtaagtgcaggcagtggaaaggtagacaacttcaccatgggagtattatgcctggcaattctattcgaggaggttatgcgcggaaagtttggcaagaaacacatgatcgctggcgtattatttacattcgttttattactgtccgggcaaataacatggagggatatggcacacacgttaatcatgatcggatccaacgcgagcgatcgcatgggtatgggtgtgacctacctagctttaattgcgacgttcaaaatacagccttttcttgcacttggatttttcctacgcaaattaacgtcaagagaaaatctgctattaggtgtaggtttagcgatggcaacaacgctgcagctcccagaagatatcgagcaaatggcaaatggaattgctcttggattaatgaccctaaagttaataacacaatttgaaacgtatcagctttggacagctctagtgagtttaacatgttccaacaccatatttacactaacagtagcatggagaacagcaacgttgattcttgcgggggtatctctccttccactttgccaaagttcctcaatgagaaagacagattggctacctatgacagttgcggcgatgggcgtgccccctttaccgctttttatcttttcactaaaagatacacccaaaagaaaatcatggcctcttaatgaaggcgtaatggccgtgggactcgtatcaattttagcaagtagcctactaagaaatgacgtccctatggctggtccacttgtcgccgggggactactaatcgcatgttatgtaataactggaacctcagcagacttgacagtagaaaaggccgctgatgtcacatgggaagaggaagcagaacaaacgggagtaagtcacaacttaatgatcacagtcgacgatgatggaacaatgcggataaaggatgatgaaacggaaaatattcttacagttttactaaaaactgcattattaatagttagtgggatctttccatactcaataccagcaacactattagtctggcatacctggcaaaaacaaacacaacgaagtggtgttctttgggatgtccccagccctcctgagacccaaaaagctgagttggaagagggtgtctatcgcataaagcaacaaggaatatttggaaaaacccaggttggtgtgggtgttcagaaggaaggggtatttcacacgatgtggcatgtaacaagaggagccgtcctaacacacaatggtaaacgactagaacctaactgggcaagtgtcaagaaagacttaatatcctatggaggaggatggagactatcagcccagtggcaaaaaggtgaagaggtacaggtcatagcagtagaacccggcaaaaatcccaaaaatttccaaacgatgccgggaatattccaaactactacaggggaaataggtgccatagccctcgacttcaagccgggcacttccggctcgcctatcatcaaccgagagggcaaagtagtaggactctatggaaatggcgtggttactaaaaatggaggctatgtttcggggatagctcaaactaatgcagaacctgatggacccactcctgaattagaagaagaaatgtttaagaagagaaacttaaccataatggatttacaccctggctcaggtaagacacgaaaatatctaccagccatcgtaagggaagcgatcaaacgccgacttagaacattgatactagctcccacaagagtcgttgcagcagaaatggaggaagcattaaagggcttaccaataagatatcaaactacagcaacaaaaagtgagcatacaggtagagaaattgtcgacctgatgtgccatgcaacattcaccatgagattactttcacctgtaagagttcctaattataacttgattataatggatgaagcacatttcacagacccggcatctattgcagctagaggatatatatccacgagagtcgggatgggtgaagccgcggcaatatttatgacggcgacgcctcctgggacagcggaggcttttccgcaaagcaatgcgccgatacaagatgaggagagggacattccagaaagaagttggaactcagggaatgaatggattactgatttcgtagggaaaacggtttggtttgtaccctctattaaagccggaaacgacatcgctaactgtctccgtaaaaacgggaagcgagtaatacaactatcaagaaagacattcgacactgaataccagaaaacacgtcttaacgactgggattttgtagtaactacagacatttcagaaatgggggcgaatttcaaagctgatcgtgtaatagaccccagaagatgtctaaaaccagtcatattaactgacggtcctgaacgagtgatcctagctgggcctatgccggtaactgcagcatcagcagcacaacgccgtggaagagtcggtagaaacccacaaaaagaaaatgaccagtacatatttacaggccaaccacttaacaatgacgaagatcatgcccactggactgaagctaaaatgttgctggataatataaacacacctgaagggataatacctgcactatttgaacctgaacgcgaaaagtccgcagctatagacggcgaatacagactaaaaggcgaaagccgtaaaactttcgtagagctcatgcgacgcggtgacttaccagtatggctggctcacaaagtcgcatcggaagggatcaagtacacggaccgcaagtggtgctttgacggtgagagaaataatcaaatactggaagaaaacatggatgtcgagatttggaccaaagaaggagaacgaaagaaactcagaccaaggtggctcgacgctagaacttactcggacccactagcacttaaagaatttaaagattttgcagcgggaagaaaaagtatcgcacttgatcttgtgacagaaataggaagagtaccatcacacctagcacacagaaccagaaacgctttagacaatttagtaatgttacatacgagtgaacacggaggacgagcctatcgacacgctgtggaagaactccctgagactatggaaacacttcttttactaggcttaatgatcttgttgactggtggggcgatgctgtttcttatttccggcaaaggaatcggcaaaacatcaattggacttatttgtgtaatagtaagcagtggcatgctatggatggcggatgttccattgcaatggatagctagtgcgatagtactagaatttttcatgatggttttactaatacctgaaccagaaaaacaaagaacaccacaagataaccaactagcgtacgttgtgattggaatcctgacattagcagcgattgtcgcggctaatgagatgggattactagaaacaaccaaaagggatctgggtatgtcaaaagagcccggagttgtttcgccaactagctatcttgatgtcgatttgcacccggcttcggcttggaccttatacgcagttgcaactactgtaatcaccccaatgttaagacacactatagaaaattccactgcaaatgtaagtctcgcggcaatcgcaaatcaagcagtcgtacttatgggcctcgataagggatggccaataagtaaaatggacttaggagtaccacttctagccttaggttgttatagccaagttaatccgctgacgctaacggcggcagtcttactcttggtaacccactacgcaataatcggtccaggccttcaggccaaagctactagagaagcccaaaagcgaacagcagctgggataatgaaaaacccaacagtggacgggattatgactatagacctagatccggtaatatacgattctaaattcgaaaaacaattaggccaagtaatgctattagtcttatgtgcggtacagcttctcctaatgaggacaagttgggcattgtgtgaagccttaaccctcgcaacgggaccgattaccacactctgggaaggatcgcccggtaagttttggaataccaccatagcggtatccatggccaatatatttagggggtcctatttagccggagccggtttagctttttctatcatgaaatctgtgggaaccggtagacgaggaacaggatcacagggcgaaacacttggtgaaaaatggaagaagaaattaaatcaattaagtcgaaaggagttcgatctatataagaaatcaggaatcacagaggttgatcgaacagaagccaaagaaggtcttaagagaggtgaaacaacacatcacgcggtaagtcgtggatctgcgaaattacaatggtttgttgaacgaaacatggtaattcctgaaggaagagtaatagatttaggttgtggcagaggtgggtggagctattattgtgcaggactaaagaaagtaactgaggtaagaggctacactaaaggagggccgggacacgaagaaccagtcccgatgagtacctatggatggaacatagtaaagttaatgtcgggtaaagatgtattttatttgcccccagagaaatgcgatacactcttatgtgacataggggaaagttcgccatcacctactgtagaagaatcaaggactatacgggtcttaaaaatggtagagccttggttaaggaataaccaattctgcataaaagtactcaatccatatatgcccaatgtaatagaacatttagaaaggcttcaacgaaaatacggaggtatgctggtaagaaacccgttatcacgtaactccacacacgaaatgtactggataagcaacggtaccggaaacatagtttctagcgtcaatatggtcagtagattgttgctaaaccggtttacaatgacacataggagaccaacgatagaaaaagatgtcgatttaggtgcaggaacaagacacgtgaatgccgaaccagaaactcccaacatggatgtaataggcgaaagaataaaaagaataaaggaggaacactcttcaacctggcactatgacgatgagaatccttacaaaacgtgggcctatcacggaagctatgaagtcaaggcaacaggaagtgcgtcatcaatgataaatggggttgtcaagttactaacaaagccctgggacgttgtcccgatggtgacccaaatggcaatgacagatacaacacctttcgggcaacagcgagtcttcaaagaaaaagtagatacccgtactccaagacccatgccagggaccagaaaagtaatggaaataacagcggaatggttatggcggacacttggcagaaataaaaagcctcgcttatgtacacgtgaagaatttacaaagaaagtaagaacaaatgctgcaatgggtgcagtatttacagaagagaaccagtgggattctgcacgagcagcagtggaagatgaagagttctggaaactcgtggacaaagaacgagaactacataaactcggtaaatgtggtagttgcgtgtacaatatgatgggtaaaagagaaaagaagctaggcgagtttggaaaagcgaagggttctcgagcaatatggtatatgtggctaggtgcccggtatttagagtttgaagcactaggatttttaaacgaagatcattggttcagtcgagaaaatagctactctggtgtggaaggtgaaggattacataagttgggatatattcttcgagatatatctaaaatacccggcggcgctatgtacgccgacgacacggcggggtgggacacaagaatcacggaagatgatcttcacaatgaagagaaaattacgcagcaaatggatcccgaacacagacagctggctaatgctatatttaaattgacgtaccagaataaagtggtcaaggtgcaaagacctaccccgaagggaacagtaatggatattatatcaaggaaagaccaaaggggaagcggacaagttggaacatatggactgaatacattcaccaatatggaagcccaactcgttagacaaatggagggagagggagtactaagcgaagccgatttagaaaacccgcatctcctagagaagaaaataacgcaatggctggaaaccaaaggtgtagagagactgaagcggatggccataagtggagacgactgcgtcgtaaagccaattgatgacagatttgcaaacgccctcttagcactaaatgatatgggtaaagtaagaaaagacattcctcagtggcaaccatctaagggctggcatgattggcaacaagttccattctgctctcatcattttcacgagctaataatgaaagatggccggaaattagttgtaccatgtaggccccaagatgaactaattgggagagcgagaatcagtcaaggagcaggatggtcattaaaagaaactgcatgtttaggaaaggcatatgcacaaatgtggagtctcatgtatttccatcggcgagacctcagactagcgtcaaacgcaatttgcagtgcagtaccagtacactggattccaacaagtcgcaccacatggagtatacacgctcatcatcaatggatgaccactgaggatatgctgacagtgtggaacagggtatggatagaggacaacccatggatggaagacaaaacacctgtaactacctgggaagatgtaccctatttggggaaacgagaagaccaatggtgcggaagtcttatcggcttaacttccagagctacatgggcacagaatatactaacggcaatacaacaagtaagaagtttgattggggacgaagagttcttagattatatgccgtcgatgaagagattccgaaaagaggaagaatctgaaggagcaatatggtaa

SEQ ID NO: 23118 - RNA, 9873 nt, synthetic construct
  misc_feature 1..9873: note = derived and/or modified CDS sequence (opt6) from DENV-3__GU131940__SS-prME
  source 1..9873: mol_type = other RNA
acaagcctgtgcttaatgatgatgttaccagcaactctagcatttcatttaacgtcaagagatggtgaacccaggatgatagtcggtaaaaacgaaagaggaaaatccctattatttaaaacggcttctggaattaatatgtgtactctcattgcgatggaccttggagaaatgtgcgatgataccgtcacatacaaatgccccttaatcgcggaagtagaaccagaagatattgattgttggtgtaatctgacctctacttgggtgacgtacggaacatgtaaccaagctggcgagcatagacgagataaaaggtcagttgcactcgctccacatgttggtatgggattagatactagaactcaaacctggatgagtgcggaaggagcttggagacaagtagaaaaagttgaaacatgggcattgcgacatccaggattcacaatattagctctcttcttagctcattacattggcacgtcccttacccaaaaagtggttattttcatattactaatgctagttaccccatccatgactatgaggtgtgtaggcgtaggcaatcgggactttgtggaaggactatctggcgctacctgggtagacgttgtacttgaacatggtggatgtgttactacaatggcgaaaagcaagcctacccttgacatcgagctacagaaaactgaagctacccaactagcaacattacggaaactatgtatagaaggaaagattactaatataactacagactcaaggtgtccaacgcaaggagaagcaactctcccagaagaacaagatcaaaactatgtatgcaaacatacatacgtcgaccgaggatggggaaacggatgtggattgtttggtaaaggttccctagtaacctgtgctaagtttcagtgcttagagcctatagaagggaaagtagtacagtatgaaaatttgaaatacactgtaataataacggtgcacaccggggatcaacatcaggtcggaaacgacacacaaggcgtgactgtagaaataacaccacaagcgagcacggtagaagccgttctaccagaatatgggaccctaggccttgaatgttcgcccagaactggattggattttaatgagatgatactattgactatgaagaataaagcatggatggtgcatagacaatggttctttgatcttccactaccttggacatcaggtgcaactacagaaacccctacatggaatcgtaaagaactccttgtgacattcaaaaacgctcatgcgaaaaagcaggaggtagtcgtactaggatctcaagaaggtgccatgcataccgccttgacgggtgcaactgaaattcaaaatagtggaggaaccagtatattcgctggacatttaaaatgtcgccttaagatggataaactcgaactaaaggggatgtcgtacgccatgtgcctaaatacgttcgttctaaagaaagaagtgtccgaaacgcaacatggtactatcctaataaaggtagagtacaaaggcgaagatgctccatgtaaaatcccattcagcaccgaagacggacaagggaaagcccacaacgggcggttaataacagccaaccccgtagtaacaaagaaggaagaaccagtgaatatagaagctgaaccgccattcggtgaatcaaatatagtcatcggtataggcgacaaggccttaaagataaactggtataagaaaggtagcagcatagggaaaatgtttgaggctactgctcgtggtgcacgaaggatggccatcttaggcgacacagcctgggactttggaagcgtaggtggcgtgcttaattcgttaggaaagatggtacaccaaatttttggatccgcatacaccgcgctattttcgggagtttcatggataatgaagataggaatcggggtcctcttaacttggattggactgaactcaaagaacacaagcatgtccttcagctgtatagtgatcggtattataacactatatttaggtacagtagtacaagccgatatgggttgtgctattaattggaaaggaaaggaactcaaatgcggttcaggaattttcgtaacgaatgaagtacacacttggaccgaacaatacaagtttcaggcagacagtcctaaaagactagcaacagcaatcgcaggagcttgggaaaatggagtatgcggtatccgctccacaactaggatggaaaacctgttatggaaacaaatcgcgaatgaactgaactacatactgtgggaaaataacataaaacttactgtagtcgtaggagatatcatcggtgtattagagcaaggaaagagaacgttaacaccccagccaatggaattaaaatactcatggaaaacttggggaaaagccaaaatagttaccgctgaaacacaaaattcatcgtttattattgatggacctaatacgcctgaatgcccttcagcatcacgagcatggaatgtgtgggaagtggaagattacggttttggtgtgtttactacaaatatatggctaaaattacgtgaagtgtatactcaatcctgtgatcataggctaatgtctgccgctataaaagatgaacgagccgtacatgcggatatgggatactggatagaaagccagaaaaatggcagttggaagctcgaaaaagcaagtttcatcgaagttaagacatgtacttggccgaaatcccataccttatggtccaacggagttcttgaatctgatatgataataccaaagtctttggcaggtccaatatcacaacataaccatcggccgggctaccacacgcagaccgctggtccctggcatcttggtaaattagagctagattttaactactgcgaggggacaaccgtagtaatcacagaaaattgcggaacacgaggaccgtccttacggactactacggtatctggcaaactaatacatgagtggtgttgtcgcagttgcaccctgccaccactcagatacatgggtgaagatggatgttggtacgggatggaaattcgtcctatcaacgaaaaagaagaaaatatggtaaagagcttagtctcggcaggctcgggaaaagttgacaactttactatgggcgttctatgcttggctatactttttgaggaagtaatgagaggaaaattcggtaagaaacacatgatcgcaggagttcttttcacttttgtgctattactttccggccaaatcacttggagagatatggctcatacattaattatgattggatccaatgcgtcagatcgcatgggaatgggtgttacctacctagcactaatagccacctttaagatacaaccatttctagcactcggattctttcttcgcaaactaacgagtcgggaaaatctacttctaggagtaggtttagccatggcaactactttacagctacctgaagacattgagcagatggccaatggaatcgctttgggtcttatgacgctaaagttaataacacagttcgaaacatatcagttatggactgcattagtctccctcacatgctcaaataccatttttacattaaccgtagcctggagaaccgcaaccttaatactagccggtgtctcactgttacctttatgtcaatcctcgtcgatgagaaaaactgattggctccccatgacagtagctgcgatgggtgtcccaccattaccgctatttatttttagtttaaaggacactccaaagcgacgaagctggccacttaatgagggagtcatggcagttggattagtaagtatcttagcatcatcacttttaagaaatgatgtccccatggctggcccattagtcgcagggggattgctcatagcttgctatgtcataacaggtacgtccgcagatttaacggtcgaaaaagcagccgatgtaacatgggaagaagaagcagaacagacaggagtaagtcataatctaatgatcacggtcgatgatgacgggacaatgcgtattaaagatgacgaaactgaaaacatacttaccgtgttgctcaagacggcactactaattgtcagtggaatatttccatattcgataccagctactctcctagtgtggcacacatggcaaaaacaaacacaaagatccggagtattatgggatgtaccaagcccacccgagacacaaaaagccgaactggaagaaggagtctacagaataaaacaacagggaatcttcggaaaaacacaagtaggggtcggagtacaaaaagaaggtgtctttcacaccatgtggcatgtgacaagaggcgcagtacttactcacaatggaaaacgattggaaccaaattgggcaagtgtgaagaaagatctaatatcatacggtggcggatggagattgaatgcacaatggcaaaagggagaagaagtacaagttatagccgtagagccgggtaaaaatcccaaaaacttccaaacgatgcccggaatatttcaaacaacaacaggagaaataggcgccatagctcttgacttcaagcctggcacatcaggttcaccaattatcaatcgggaaggtaaggttgtgggcttgtatggtaacggcgtagttacaaagaatggagggtatgtaagtggaatagcgcaaacaaacgcagaaccagatgggccgacaccagaactcgaagaagagatgttcaagaaacgaaaccttacaataatggatttgcatcccggaagtgggaaaacaagaaaatatcttccagcgatagtccgagaagctataaaaagaaggctacgcacattaatactagcccctacgagggtcgtagctgcagaaatggaagaagcgcttaagggcctgccaattcgataccagacgaccgcaacaaagtctgaacatacaggacgagagatagttgatttaatgtgccatgctacatttaccatgagactactatcaccagtgcgtgtaccaaattacaacttagtaattatggacgaggctcactttacggacccagcgtcaatcgctgcgagaggatacatatcgacacgagtaggtatgggcgaagccgcagccatattcatgacggccacaccaccaggaacagctgaagcattccctcaatcaaatgcacctattcaggatgaggaaagagatatacctgagagatcatggaactccggtaatgaatggattactgacttcgtaggtaaaactgtatggttcgtcccatcgattaaggcagggaacgacatagctaactgccttagaaagaatggtaagaaagtgatacaattgagtaggaaaacttttgacacagaataccagaaaacaagactgaacgattgggatttcgtcgtgacgacagacatatcagaaatgggagcaaactttaaggccgatagggttatcgatccaaggcgctgtctgaaacccgtcatactgacggatggccctgaaagagtaattctagctgggccaatgccagtaaccgccgcctccgcagcacaaaggaggggacgtgtcggacgtaacccacaaaaagaaaacgatcagtatatattcacgggtcagcctctgaacaacgacgaggaccatgcgcactggacagaagccaagatgctattagacaatatcaatacgccagaaggaataataccagcgctgttcgaacctgaaagagagaaaagtgcagcaattgatggggaataccgattgaaaggtgaaagtagaaaaacctttgtggaactaatgcgtcgtggcgatttacccgtctggttggcctataaagtagcaagtgagggaatcaagtatactgatcgtaagtggtgtttcgatggcgaacgtaacaaccaaatattagaggaaaacatggacgtggagatatggactaaagagggcgaaagaaagaaactaagaccccgctggcttgatgccagaacatacagtgaccccctcgctctaaaagaatttaaagattttgcagcggggagaaagagcatcgcactagacctcgtcactgagatagggagagtaccatctcacctcgcgcaccgaactcgcaatgctctggataatttagttatgctacacacctctgagcacggagggagggcctatagacatgcagttgaagaactccccgaaaccatggaaaccctcctgctattaggactaatgatacttttaacaggtggcgctatgttatttctgatatcaggtaaagggatcggtaagacaagcattggtcttatttgcgtaatagtaagttctggcatgttatggatggccgacgtaccgttacaatggatagctagtgcaattgtgctagaatttttcatgatggtattattaataccggaacctgaaaaacaaagaacaccacaagacaatcaactggcgtacgtggtaatagggattcttacattggctgcgatcgtagccgcaaacgaaatgggattattagaaacaacaaagagagacttaggaatgtctaaggaaccaggtgtagtgtcaccaacaagttaccttgatgttgatctacaccccgcttcagcgtggacgttatatgccgttgctactacagtaataaccccgatgttgcgccatactattgaaaattcaacggcaaacgtatcacttgcagctattgcaaaccaggcagtggtccttatgggcttagataaaggctggcctatctccaagatggatttaggtgtacctttactcgcgttaggatgctactctcaagttaatccactaacacttactgctgcagttttactattggttacgcattatgctatcataggtccaggactgcaagctaaagcgactcgcgaggcacaaaaacgaaccgcagctgggatcatgaagaacccgaccgtagatggcataatgactatcgacttggacccagtgatatatgattctaaatttgagaaacaactaggacaagtaatgttattagtgctatgtgccgttcaactattgctcatgaggacctcatgggctctttgtgaagcgttgacgctcgccacggggcccataacaactctgtgggaaggtagtccaggaaaattctggaacacaaccatagcagtaagtatggctaatatatttagggggtcatacttagctggggcaggactagcattttcgataatgaagtcggtcggcacgggaagaaggggtacaggcagtcaaggggaaaccttaggtgaaaaatggaagaagaaactaaatcagctaagtcgaaaagagttcgacctatacaagaaaagtggtattactgaagtggatcgtacagaagcaaaagaaggattaaaacgaggggaaaccactcatcacgcagtctctcgcggaagcgctaaattacaatggtttgttgaaagaaatatggttattccggaaggtagagtaatcgatttaggatgtgggagaggtgggtggagctattattgcgcaggactcaagaaagttacagaagtaagaggttataccaaaggtggcccaggacacgaagaaccagtcccaatgtccacctatggatggaacattgtcaaattaatgtcaggcaaagacgtattctatctcccaccagaaaaatgcgacaccttgttatgcgatattggagaaagctcgccaagccctacggtagaagaatcgcgcacaataagggtgctaaaaatggtcgaaccatggctcagaaataaccaattttgcatcaaggttttaaacccatatatgccaacagtcatagagcatttagagagattgcaacgaaagtacggcggtatgctagttcgtaatccgctgagcagaaattcaacccatgagatgtattggatatcaaacggaaccggaaatattgtctcctctgtgaacatggtgagtcgacttttactgaatagatttacaatgactcatcgacgacccacgatcgagaaagacgtggatctaggcgcaggcacaagacacgttaatgctgaacccgaaacacccaacatggacgtcattggagaaagaataaaacgaataaaggaagaacacagcagtacttggcattatgacgacgaaaatccttataaaacgtgggcttatcatggatcctatgaagtcaaagctactggaagcgcttcgtccatgattaacggtgtagtcaaattattaacaaagccatgggatgtagtgcctatggtaacacaaatggccatgactgacactacaccttttggccaacaaagagtatttaaggagaaagtagatacacggaccccacgtccaatgccaggcacacgcaaggtgatggaaataacagcggaatggctatggagaacattaggaagaaacaagaaaccaaggctatgtacaagagaagagtttaccaagaaagtaagaacgaacgcggctatgggtgcagtatttacagaggaaaatcaatgggatagcgcgagagcggcagttgaagacgaagaattttggaagctcgtagatagagaacgggaactacataaattaggtaaatgtggttcatgtgtttacaacatgatgggaaagagagagaagaaactgggagagtttggcaaagcaaaaggaagtagagctatttggtatatgtggctcggagctagatatttagagtttgaagcgctaggatttttgaatgaagatcattggtttagtagagaaaattcttattctggggtcgagggtgagggactacataaacttggatatatccttagagacatatccaaaattccaggcggggcaatgtatgccgacgataccgcaggatgggatactagaataacagaagatgacctgcataatgaagagaaaatcactcagcaaatggatccggaacacagacaactagccaatgccatatttaaattaacataccaaaataaagtagtaaaagtacaaagaccaactcccaagggcacagtgatggatataatttcacgcaaagatcaaaggggtagtgggcaagttggtacctacggtcttaacacattcacaaatatggaagcccagctagttcgtcaaatggaaggagaaggcgttttatcaaaggccgatcttgaaaatccccatttactggagaagaaaattactcaatggttggaaacgaagggagttgaacggctaaaaagaatggcaatttccggagacgactgtgtcgtgaagccaatagacgaccgtttcgccaatgcattgttagcattgaatgacatgggaaaagtaaggaaggatataccacaatggcaaccttctaagggttggcatgattggcagcaagttccattttgcagccaccattttcacgaactaataatgaaggatggacgtaagctagttgtcccttgcaggccacaagatgaactaatcggtagagcgagaatctcacaaggtgcagggtggtctttgaaagagaccgcgtgcctcggcaaagcctatgcacagatgtggtcgctcatgtattttcataggagagatttacgccttgcgagcaatgcgatatgttcagcggtacccgtacactggattccaacaagcaggactacatggtcaattcatgcccatcatcaatggatgacaacagaagatatgttaacggtctggaatagagtttggatagaggataatccatggatggaagacaagacacctgtaacaacatgggaagatgttccataccttggaaagagagaagaccaatggtgtggttccctaataggattaacttcaagggcaacgtgggcacagaacatactaacggcaatccagcaagttaggtctctcattggcgatgaagaatttctggattatatgccatcaatgaaacgttttagaaaggaggaggagtctgaaggtgcaatatggtag

SEQ ID NO: 23119 - RNA, 9873 nt, synthetic construct
  misc_feature 1..9873: note = derived and/or modified CDS sequence (opt6) from DENV-3__GU131942__SS-prME
  source 1..9873: mol_type = other RNA
acatcgttatgcctaatgatgatgtttccggcaacattagcatttcacttaaccagtagagatggtgaaccgagaatgattgttggcaaaaatgaacgaggaaaatccctactattcaaaacagcttcaggcataaatatgtgtacattgatagcaatggacctgggggaaatgtgcgacgataccgtaacctacaaatgtcccttgatagcagaagttgaaccggaagatatagattgttggtgcaatttaacatcaacatgggtgacatacggaacctgtaaccaagccggtgaacatcgaagggataaaaggagcgtggcactagcaccacatgtaggtatgggactagatacgaggacccaaacatggatgagcgctgaaggagcatggagacaagtagaaaaagttgaaacgtgggcactccgacatcccggatttactatattagcactattcttagcgcattatatagggacatcacttacacagaaagttgtcatcttcatattgcttatgctagtcacaccatctatgactatgagatgtgtcggggttggaaatcgggactttgtcgaaggtctatcaggtgcaacatgggtagacgtagttttagaacatggcggatgtgtcacgacgatggcaaaaagtaaaccaacacttgacatagaacttcagaaaacagaagctacccaattggcaacactccgaaaactttgtatagagggcaaaatcacgaacattaccacagattcaaggtgtcccacccaaggtgaagcgacactcccggaagaacaagatcaaaattacgtatgtaaacatacctatgttgacagggggtggggcaatggctgtggattatttggaaaagggtcgttagtaacatgtgcaaaattccagtgcctcgaaccaattgaaggaaaagttgttcaatacgaaaatttgaaatatacagtaataattacagtgcatactggggatcagcaccaagtaggaaacgacactcaaggagtaacagttgaaataactccacaagcgtcgacagtggaagccgtcctcccggagtatggaacattaggactagaatgcagcccccggaccggtttagacttcaatgagatgatactattgactatgaaaaacaaggcttggatggttcataggcaatggtttttcgatctgccacttccctggactagcggagcaacaacagaaaccccaacatggaaccgtaaagagttgcttgttacgtttaaaaacgcgcatgccaagaaacaggaagtggttgtattaggttctcaagaaggcgcaatgcatacagcgctgactggagcgaccgaaattcaaaattcgggtggaacaagtatcttcgctggacatttgaaatgtagattaaaaatggacaaacttgaacttaaaggaatgtcatacgcaatgtgtctaaatacattcgtgctcaagaaagaagtgtccgaaacccagcatgggacaatactgataaaagtagaatacaaaggtgaagatgcgccatgcaaaataccattttctactgaagacggtcaaggaaaagcccactcaggcagattaattacagcaaatcctgttgttactaagaaagaagaaccagtgaacatcgaagctgaaccgccgttcggtgaatctaatattgttataggtatcggagacaaagcacttaaaataaattggtacaagaaagggtcatccataggaaaaatgttcgaagcaacagctagaggagctaggcgtatggccattctgggcgacacagcatgggattttggaagtgtaggcggtgtcttgaactcattgggtaaaatggtgcatcaaatattcggtagcgcatatactgctctattctcgggagtttcgtgggtaatgaaaataggtataggagtgcttttgacgtggattggactaaacagcaaaaatacctcaatgtcattttcctgtatcgttatcggaataataactctatacctgggtgcagtagttcaggcggatatgggttgtgtaatcaattggaaaggaaaagaattaaagtgcggatctggcatctttgttacgaatgaagttcatacttggacagagcagtataaattccaagctgatagtccgaaaagattagcaactgctatagcaggcgcctgggaaaacggagtatgtggtatacgaagtacaaccagaatggagaatttactctggaaacagattgcgaatgaactaaactacatactatgggaaaacaacataaaactgaccgtcgtggtaggagatataatcggagtactagaacaagggaagagaacattaactccacaaccgatggaacttaaatacagttggaaaacgtgggggaaagcaaagatcgtaacagctgagacgcaaaattcgtcattcataatagacggacctaatactccagagtgtccgtctgcctcgagggcctggaacgtatgggaagtggaagattacgggtttggagtattcacaacgaacatttggctaaagctccgcgaggtgtatactcaaagctgtgaccacagactaatgtcagccgccatcaaagatgaacgggccgttcacgcagatatgggctactggatagaaagtcagaagaacggctcgtggaaactagaaaaagcatcctttatagaggtaaaaacgtgcacctggccaaaaagccatacattatggagcaatggtgtactagaatcggacatgatcatcccgaagagtttggcaggtcctataagtcaacataaccatagaccggggtaccatactcaaactgctggaccctggcatctaggaaaacttgagttagatttcaattactgcgaaggaacaaccgtagtgattacggaaaactgtggaacgagaggtccgagtctacggacgaccactgtctcaggtaaattaatacacgaatggtgctgtcgctcttgcacattgcctccgctgcgatacatgggagaagatggatgctggtacggaatggagattagaccaattaatgaaaaggaagagaatatggttaagtccctcgtaagtgccggaagtggtaaagtagataatttcactatgggagtgctatgtttagctatattattcgaggaagtcatgagaggtaaatttggtaagaaacacatgatcgctggggttctatttacgtttgtgttacttcttagcgggcaaataacgtggcgtgacatggcacacactctgattatgattggaagcaacgcttctgaccgtatgggaatgggtgtgacctacttggcattaatagctacctttaaaatacaaccgttcttggcattgggcttcttcttaaggaaactcacatcgcgagaaaaccttcttctcggggtcgggttagcaatggcaacaaccttacaactacccgaggatattgagcaaatggcaaatggtatagcactaggactaatgacgctcaagttaataacgcaatttgagacttatcagctctggaccgcattggtgtctttaacctgtagtaatactgtatttaccctaactgtggcttggcgcacagcaacgttgatacttgcaggagtgtcgcttctgccactatgtcagtcatctagtatgcgaaaaactgattggcttcctatgactgtagcggccatgggagttccgccactcccactatttattttcagcctaaaggacactccaaaaagacgatcatggccattaaacgaaggcgtaatggcagttggactcgtatcaatacttgccagttccctattacgaaacgatgtaccaatggcagggcctttggtcgccggaggactattgatcgcctgctatgtcataactggtacgagtgcagatctaacggttgaaaaagctgccgatgtcacatgggaagaggaagcggaacagacaggagttagccacaacttaatgatcacagtagacgacgacggtacaatgcgaatcaaagatgatgaaacggaaaatatccttaccgtacttcttaaaactgccctacttattgtcagtggcatatttccgtactcaatcccggcaactctcttagtatggcatacctggcaaaagcagacacaaaggtctggtgtactatgggatgtaccgagcccaccggaaacccagaaagctgaattagaagaaggtgtttacaggataaaacaacagggcatatttggtaaaacccaagtaggcgtaggagttcagaaggaaggagtatttcacaccatgtggcatgtcacccgaggagctgttctaacccataatggaaaacgattggaaccaaactgggcttctgtgaagaaagatctcataagttatggaggaggatggcgactcaacgcacaatggcaaaaaggtgaggaagtacaggtgatagctgtagagcctggtaaaaatccgaagaatttccagacaatgccaggtatttttcaaactactacaggtgagattggagcgattgccctagatttcaaaccagggacatccggatcacccatcattaatagagaaggaaaagtggttggattgtatgggaatggtgtcgtcaccaagaatggaggttatgtcagcggcatcgcacaaacgaatgccgaacctgacggaccaactccagagttagaagaagaaatgtttaagaaaagaaacttaactataatggatttacacccaggcagtggtaaaactagaaagtacttaccggcaatagtgagagaagctataaaaaggaggttgcgcacattaattttagcaccaacaagagttgtagcagcggaaatggaagaggccttaaaggggctacccatcagataccaaactaccgctactaaaagtgaacatactggaagagaaatagtagatttaatgtgtcatgccacttttaccatgcgtttactcagcccagtcagagtcccaaactataacttagtaataatggatgaggctcacttcactgatccagcatcaattgctgctagaggctatatctccacacgagtaggcatgggagaagcagcggcaatctttatgactgctacacccccgggaactgcagaagcatttcctcagtcaaacgccccgatacaggatgaagaaagagatatccctgaacgttcctggaactccggcaatgaatggattacggacttcgtaggcaaaacggtatggtttgtacccagtataaaagcagggaatgatatcgcaaactgcttgaggaaaaatggcaagaaagtaattcaactatcaagaaaaacattcgacaccgaatatcagaaaacacgactaaacgactgggattttgttgtgacaacggacatatcggaaatgggagccaactttaaagcagaccgggttatagacccaagacgttgtttaaagcctgtaattctgacggacggaccggagagagtaattctagcagggcccatgccggtaacagcggcgtccgccgcgcaaaggagaggtcgtgtgggtagaaatccacaaaaagagaatgaccaatacatatttaccggccaacccctcaataacgatgaagaccatgcacattggacagaagcaaaaatgttgttagataacataaatactccggaagggataataccagccttattcgaacctgaaagggaaaaatcagccgcaatagatggagaatacagactaaaaggtgaatcacgtaagaccttcgttgaactcatgcgacgaggggacttaccggtatggttagcgcataaagtggctagtgagggaattaagtacacagatagaaaatggtgcttcgatggcgaacgaaataaccaaattttagaagaaaacatggatgtagaaatttggacaaaagagggtgaaaggaagaaacttagacctcgctggttagatgctagaacttactctgatccattggcactcaaagaatttaaagattttgcagcgggcagaaagtctattgctctagacttagttacggagattggtcgtgttccaagccacttagcacatagaacacgaaatgcattagataatttagtaatgctacatacttcagagcatggagggcgtgcgtataggcatgccgttgaagaactccccgaaacgatggagacactcttacttcttggacttatgattctattaacaggtggtgcaatgcttttcctaatttccggaaaaggtataggaaagacatctattggtttaatttgtgtaatagttagttcgggtatgttgtggatggcagatgtgccgctacaatggattgctagtgcaatagtgttggagttcttcatgatggtcttgttgatccctgaaccggaaaagcaacggactcctcaagataatcaactagcgtatgtagttatagggattttaacattagcagcgatagtcgcagccaacgagatgggcttactagaaactactaaacgagatttaggtatgagtaaagaaccaggtgtggtgtctcctacaagttatcttgatgtagatttgcaccccgcctccgcctggactttatacgcggtcgccaccacagtcattacaccaatgcttaggcataccatagaaaattccacagctaatgttagcttagcagctatagcaaaccaagcagtggtattaatggggttggataaaggctggcccatatcaaaaatggacttaggtgttccgctacttgcgttaggctgttattcgcaagtcaatccactaactctcacagccgccgtattattacttgtgacgcattatgcaattataggcccaggcttgcaggccaaagcaacgcgagaagcgcagaaaagaaccgcggcgggcatcatgaagaaccccacagtggatggaataatgacaattgaccttgatccagtaatatatgattcaaaatttgaaaagcaacttggccaagtgatgctgctggtgctatgtgccgtacaactgctcttaatgcgaacctcatgggcgttgtgtgaagcgctaacattggctacagggccaataaccaccctatgggagggttcaccaggaaaattttggaataccactatcgcagtttccatggcaaacatatttaggggttcttacttggctggagcaggattagcattctccattatgaaaagcgtaggggccggaagaagggggactggttctcagggtgaaactttaggcgaaaagtggaagaagaaattaaaccagttatctcgaaaagagttcgatttatacaagaaatcgggaataactgaagtggatcgcactgaagcgaaggaagggttaaaacgtggcgaaacaacccaccatgcggtcagcaggggttcagcaaaactccaatggtttgttgaacgaaatatggtaattccagaagggcgggtaattgatttaggctgtgggcggggaggatggagttattattgcgccggcctcaagaaagtaacggaggtcagaggatatactaaagggggaccaggacatgaagaaccagtgccaatgtccacctacggatggaatatagtaaaacttatgtcgggaaaagatgtgttttatttaccacctgagaaatgtgatacattactatgcgacatcggagaatcaagtccatcacccactgtcgaagaatccagaaccatcagggtacttaaaatggtcgaaccgtggcttagaaataaccagttttgcataaaagtgttgaatccctacatgcccacagtaattgaacaccttgagcgattacagcgaaaatacggtggaatgttagtccgcaatccattaagtagaaattcaacacatgaaatgtactggatatcaaacggaactgggaatatagtaagctctgttaatatggtttcacgacttctactaaacaggttcacaatgactcatagaagacctacaatagagaaagacgtagatttaggtgctggaacaaggcatgttaatgccgagccagaaacaccaaatatggatgttataggggagagaatcaaaagaatcaaagaggaacattcatcgacgtggcattatgatgatgaaaacccatataaaacatgggcatatcatggatcatacgaagttaaagcgacgggatccgcaagcagcatgatcaatggggtagtgaagctgctaacaaagccctgggatgttgttcctatggtaacacaaatggcgatgacagacacaacgcctttcggacaacagcgtgttttcaaagaaaaagtagacacacgaacgccccgtccaatgcccggcactcgtaaggtaatggaaataactgccgaatggttgtggcgaacattaggaagaaataagaaaccaagattgtgcacaagggaagaatttacaaagaaagttaggacaaacgcagcaatgggggcagtgttcacagaagaaaatcagtgggattcagcgagagctgccgttgaagatgaagaattttggaaacttgtagaccgagaacgagaattacataaattaggcaaatgtggtagttgtgtatataatatgatgggaaaaagagagaagaaattaggagagttcggtaaagctaaaggctcacgagcgatttggtatatgtggttaggagcacgttatcttgagttcgaagcacttggatttctaaacgaggatcactggttttcgagagaaaattcctatagtggggttgaaggcgaaggtctacataaactgggttatatacttagagatatatctaaaatacccggaggtgcaatgtatgccgatgatacggcaggatgggatacccgcataactgaagatgatcttcataatgaggagaaaattacccaacaaatggaccccgagcatcgtcaactcgcaaatgctattttcaaactaacttatcaaaacaaagtggtaaaagtgcaacgaccaacaccaaaaggcactgtaatggacataatctctaggaaagatcaacggggttcggggcaagtaggtacatacggcctaaatacatttacgaacatggaagctcaattagtccgacaaatggaaggtgaaggtgttcttagtaaagccgacttagaaaacccacatctattagaaaagaaaataacacaatggttagaaactaagggagttgaaaggttaaaacgaatggctatcagcggggatgactgtgtagtaaaaccaatagatgacagattcgccaatgctctgcttgcattaaatgatatgggcaaggtcagaaaagacataccccaatggcaaccatctaaagggtggcacgattggcaacaagtaccattttgttcacaccattttcacgagctcattatgaaagacggtcgaaaattagtagtcccttgcagaccccaggacgaactcataggtcgcgcacggataagtcaaggcgctggttggagtcttaaagaaactgcctgcttgggaaaagcgtatgcccaaatgtggtccctaatgtattttcatcgccgcgacttacgattggcatctaatgcgatatgtagtgcggtcccggtgcactggataccaactagccgcactacatggagcatacatgcacaccatcaatggatgacgacagaagatatgctaaccgtatggaaccgagtctggattgaagacaatccatggatggaagacaaaacacctgtcacaacttgggaagacgtcccttacttgggaaaaagagaagaccaatggtgcggttcattgataggtctaaccagcagagctacttgggctcaaaacatccttactgcgatacagcaagtgaggtcactaataggggatgaagagttcttggattatatgccctcaatgaagcgattcaggaaagaagaagaaagtgaaggagcaatatggtga

SEQ ID NO: 23120 - RNA, 9873 nt, synthetic construct
  misc_feature 1..9873: note = derived and/or modified CDS sequence (opt6) from DENV-3__GU131943__SS-prME
  source 1..9873: mol_type = other RNA
actagcttatgtctcatgatgatgctacccgcaaccttagccttccatctcacatcacgcgatggagaacctcggatgattgtcgggaaaaatgaacggggaaaatcactattattcaaaactgcgtctggaatcaacatgtgcactttaatagccatggatctcggagaaatgtgcgacgataccgtaacatataaatgccccttgattgcggaagtcgagcctgaagatatagattgctggtgtaacctgacatcaacatgggttacatacggaacttgtaatcaagcgggggaacacagaagagacaaaagatcggtagccctggcaccccatgtaggaatgggattagacacacgaacacaaacgtggatgtctgctgaaggcgcgtggagacaagtagaaaaagtcgaaacatgggcactaagacatccaggctttacgatacttgctttatttttggctcactacatcgggacatccctcacacagaaagttgttatatttattctactaatgttagtgactccaagtatgacaatgcggtgtgtaggagtcggtaatagagactttgttgaaggcctgagtggagccacgtgggtggacgtagttttggaacatggaggctgcgtaacaactatggcaaaatctaaacccacacttgatattgaacttcagaaaactgaagcgacgcaattagcaacgctgagaaaattgtgcatagagggcaaaattaccaacataaccactgatagtcgttgccctacccaaggcgaagctactttgccagaagaacaggatcaaaactatgtatgtaaacatacctatgtcgataggggttggggtaacggctgtggattgttcggtaaaggcagcttggtaacctgtgcgaaattccaatgtttagaaccaatagaaggcaaagtagttcaatacgaaaatttaaaatacaccgttataataaccgtccacacaggcgatcaacaccaagtaggtaatgacactcaaggtgtgactgtggaaattacaccacaagccagtacagtagaagcagtgttacccgaatacgggaccttaggacttgaatgttcaccacgaactggtctagactttaatgaaatgatactattaacaatgaaaaataaagcctggatggtacacagacaatggttctttgatttacccttaccttggacctccggtgcaactactgaaactcccatttggaaccgaaaagaactattagtaacatttaaaaatgcacatgctaagaaacaagaagtagtagtcctaggatcgcaagaaggagctatgcatacagcactaacgggagctacagaaatacaaaattcaggcggaaccagcattttcgctgggcacttaaaatgtcggttaaaaatggataaattagaactcaaagggatgtcctacgcgatgtgcttgaatacttttgttctaaagaaagaggtctcagaaacgcaacacggtaccattttgatcaaagtcgaatacaaaggcgaagatgcaccatgtaaaatacccttctcaactgaagacggacaaggaaaagcgcacaatggtcggcttataacagccaacccagtcgttactaagaaagaggagccagttaatatagaggcagaaccaccctttggcgaatcgaatattgttattggaatcggcgacaaggctttgaaaataaattggtataagaaaggttcctctatcggtaaaatgtttgaggcaacagcccgaggagctcgacgtatggcaatattaggtgatactgcatgggattttgggagtgtgggcggggtactaaattccttagggaaaatggtccatcaaatttttggcagtgcgtacacagcactattcagcggtgtttcgtggattatgaaaatagggatcggagttttgctgacatggattggcttaaatagtaaaaacacttctatgtcattttcttgcatcgtcatagggattataacgttatacttaggggcggttgtacaagcagatatgggatgtgctataaactggaaaggaaaagaactaaaatgtggttcaggaatattcgttacaaatgaagtacacacttggactgagcagtacaaatttcaagcagactctcctaaaagactggcaactgctatagccggtgcatgggaaaatggtgtatgtggcattagaagtaccactagaatggaaaatctactttggaaacaaatagcaaatgagctaaattacatactatgggagaataacataaaactaacagtcgtagtaggcgatataattggagttctggaacaggggaaaagaacactgacacctcaacctatggagttgaaatactcatggaaaacatggggaaaggcaaaaatagtaacagctgaaacacaaaactcttctttcatcatagacggaccaaataccccagaatgtcctagcgcttcacgggcctggaatgtgtgggaggttgaagactatggattcggagtgttcacgaccaacatttggttgaaattacgcgaagtatacacacagtcgtgtgaccatcgattaatgtcagcagccataaaggatgaacgagcagttcatgcggacatggggtattggatagaatcacagaaaaatggttcatggaagctagaaaaggcttcgttcattgaagtcaaaacatgtacatggccgaaatctcatacactctggtccaacggcgttcttgaaagcgatatgattatacctaaatccttagccggtccaatcagtcaacataatcaccggcctggataccatacacaaacagcagggccctggcatttaggaaaacttgaactcgactttaattactgcgaaggtacaaccgttgtaattaccgagaattgcgggacgagaggtccaagtttacgtacaactacagtatcgggcaaattaattcatgagtggtgttgcagatcatgtaccctacccccacttcgatacatgggagaagacggatgttggtatggcatggaaatcaggccaatcaatgagaaagaagagaacatggtaaagagcctcgttagcgctggaagcggaaaagtagataattttacaatgggagttttatgtttagcgatcctattcgaggaagtaatgcgtggaaaatttggcaagaaacatatgatagcgggtgtactctttacatttgttctgttattatctggacaaatcacatggcgtgatatggcacatacacttatcatgataggttcaaacgcttcagaccgaatggggatgggtgttacatatttagcactgattgccacatttaaaatccaaccctttttagccctcggcttctttctccgaaaattaacatctcgagaaaatctactgcttggtgtggggctggcaatggccacaacactacaattacctgaagacatagaacagatggccaatgggatcgccctaggcttaatgacattaaaactcataacgcaatttgaaacatatcaactttgggctgctctggtaagtttaacatgttctaatactatattcacattaacagttgcgtggcgtactgccacattaatccttgccggtgtatcccttttgccattgtgtcaatcatcgtcaatgcgcaagactgactggttaccgatgaccgtagcagctatgggtgttcctcctttacccctgttcatctttagtcttaaggacacaccgaagagacgctcttggccactgaacgagggtgttatggcagttggcttagtaagtatacttgcttcatccttactacgaaatgatgtaccaatggcagggcccctagtcgctggcggtttgctcattgcatgctacgttataacagggacatcagcagacctaacggttgaaaaggctgctgacgtcacgtgggaagaagaagcagaacaaacaggtgtgtctcacaatttaatgataactgtcgatgatgatggcacaatgagaattaaagatgacgagacggagaacattctaacagtactgctaaaaacagcgctcctaattgtcagtggtattttcccctactccatccccgctacactcttagtatggcacacatggcagaaacaaacacaacgcagtggcgtgctatgggatgttccaagtccccctgaaactcagaaagcagagctagaggaaggagtgtaccgaattaaacaacagggaatatttggtaagactcaagtaggggttggcgtccaaaaagaaggagtattccatacgatgtggcacgtcacacgaggagcggtattgacgcacaacggcaaacgattggaacctaattgggctagtgtcaagaaagatttaatatcttacggtggcgggtggcgattgaatgcacaatggcagaaaggagaagaagtccaagtgattgctgtagaacctggtaaaaacccgaaaaattttcagaccatgcctggaatatttcagacaactactggcgaaatcggagccatagcactggatttcaaacccggcacgtcggggagtcctatcatcaacagagaagggaaagtagtaggactttacggaaacggagtagtgacgaagaacggtggctatgtgagtggaatcgcacaaacgaacgcagaacccgacggacccaccccagagttagaagaagaaatgtttaaaaagaggaatctcaccataatggatctacatccgggcagcggaaaaacaagaaaatatttaccggcaattgttagagaagcaatcaaaagacgattaagaactttaatactcgcaccaacacgtgtcgtagctgcagagatggaggaggctttgaaaggcttacctataagataccagacaaccgcgacaaaaagtgaacatacagggcgggaaatagtagatctcatgtgtcatgcaaccttcactatgagactactaagcccggtcagagttccgaactataatctcgtaataatggatgaagcccatttcacagaccctgcatccatagcggctagaggttatatcagtacccgagttgggatgggtgaggcggctgccatatttatgactgcgacgccacctggaactgcagaagcatttccacaaagcaacgcaccaattcaagacgaagaacgagatatcccagagagatcttggaactcgggaaatgaatggattactgatttcgtaggaaaaactgtttggtttgtaccaagcataaaagccggaaatgacattgccaactgtttacgcaaaaacggcaagaaagtcatccaattaagtagaaaaacctttgatacagaatatcaaaagacacgtctaaacgattgggacttcgtagtcactaccgatatatcagaaatgggtgcaaattttaaagcggatagggtaatagacccacgtcgctgcctcaaacccgtcatattaacagacggacccgaacgagtgattttggccggacctatgccagtaacagcagcatccgcagcgcagcgcaggggtcgagtaggccgcaatccgcaaaaagagaacgaccaatacatattcacaggtcaaccattaaacaacgacgaagatcatgcgcactggacagaagctaaaatgctcttagacaatattaacactccggaaggtattattcccgcgttgttcgaaccggaaagagaaaaatcagcagcgatcgacggagaatatcgattgaaaggggaatcccgaaaaacatttgtagaactaatgcgaaggggcgatcttccagtttggctggcacataaggtagcctccgaaggcatcaagtatacagatcgaaaatggtgttttgatggagaacgaaataatcaaattttagaagagaacatggacgtagaaatttggacaaaggaaggcgagaggaagaaattaagaccgcgatggcttgatgcaaggacatactcggatccgttagcattgaaagaatttaaagactttgccgcgggacgcaaatcaattgccttagatctcgtgacggaaatagggcgggtgccttcccacttagcacatagaacaaggaacgcgctagataatttagtcatgttacatacttcggaacacgggggaagggcatacaggcatgcggttgaagaattaccggaaaccatggagacattattactacttggtctaatgatactgttaacaggaggagcgatgttatttctcatctccggaaagggtatcggtaaaacaagtataggattaatctgtgtaatagtcagcagtggaatgttgtggatggctgacgtacctctacaatggatcgctagcgcaatagttcttgagttctttatgatggtactactaatcccggaacctgagaaacaaagaacaccccaagacaatcaattagcatatgtagtcatcggtatattaaccttagccgcaatagtagctgccaatgagatgggactgttagaaacaacaaaaagggatttggggatgtccaaagagccaggagtggtaagccccacatcatatcttgatgttgacctacatcctgctagtgcatggactctatatgcagtagcgactacggtgatcactcccatgctccggcacacaatagaaaattcaactgcgaatgttagtctggcggccatcgcgaaccaggccgtggtactaatgggactagataaagggtggccgataagtaaaatggatttaggagttcctttgctcgctctcggatgttattcacaggttaaccctctgactctaaccgcagctgtactgttattggtaactcattatgcaattattggaccaggactccaagctaaagctacaagagaggcgcagaaaagaaccgcagcaggaataatgaaaaatcctactgtagacggtattatgacaattgatcttgacccagtaatatatgatagcaaattcgaaaaacaattgggtcaagtcatgttacttgttctgtgcgcagtacaattactgctgatgagaacatcatgggctttatgtgaggctttaacattagcaactggacctataacaactctttgggagggatcgccaggaaaattctggaatacgacaattgcagttagtatggccaatatctttcgtggttcatatttagccggagctggtttagccttctcaataatgaaatcagtaggtacaggccgaagaggaactggaagtcaaggagaaaccttaggagaaaaatggaagaagaaactaaatcaactaagtagaaaagaatttgatctatataagaaaagtggcataaccgaagtagacagaactgaagcgaaagaaggcctaaagagaggagaaaccacgcatcatgccgtctcaagaggtagtgctaaattacaatggtttgtcgaaaggaatatggttattccggaaggcagagtcatcgatctggggtgcggtagagggggatggagttattattgtgcaggtctaaagaaagtgacagaagtcaggggatataccaaaggaggaccaggacacgaagaacccgttcccatgtcgacctatggttggaacatagtgaaactgatgtccgggaaggatgtattctacctacccccggaaaaatgcgatactttattatgtgacatcggtgaaagctccccgtcgccaacagtagaagaatcacgaaccattagagtgttaaaaatggttgagccctggcttaggaataaccagttttgtattaaagtacttaacccatacatgcccacagttattgaacatttagagcgtctccaaagaaaatacggcggaatgttagtgaggaatccactaagccgaaactccactcatgaaatgtattggatctctaatggtactggaaatatagtttcatccgtgaacatggtatctcgactcctcttgaacagatttactatgactcatcgtagacctacaatcgaaaaagacgtagatttgggcgcaggaactcgtcacgtaaacgcggaacccgaaacaccaaacatggatgtcattggagaacgaataaagcgaataaaagaagaacattcatccacttggcactatgacgacgaaaatccatataagacttgggcataccatggaagttatgaggtcaaagcaactgggtccgcatcatccatgataaacggtgtagtgaaacttctaacaaaaccatgggatgttgttccgatggtaactcaaatggcgatgactgacacaaccccctttgggcagcaacgcgtattcaaagaaaaagtggatacgcgcaccccaaggccgatgccgggaacaagaaaagtaatggaaataacagcagaatggttatggcggacgctgggaagaaataagaaaccacgtttgtgtacgcgagaagaatttactaagaaagtccgcaccaatgctgccatgggggccgtatttacagaagagaatcaatgggattctgccagagccgcagtcgaagatgaagaattttggaaattagtcgatagggagcgagaattgcataaattaggaaaatgtggttcttgtgtttacaacatgatgggtaaaagagagaagaaactaggcgagttcgggaaagcaaaaggctctagagccatctggtacatgtggctaggtgcaaggtacttggagttcgaggctttaggatttctaaatgaagaccactggttttcaagggaaaatagttactctggggtagaaggtgagggcctgcacaaattaggatacattttgcgagacattagtaagatacctggtggtgctatgtacgcagacgatacagcaggatgggatacaaggattacagaggatgatttacacaacgaagaaaagataacacagcaaatggatcctgaacaccgtcagttggcgaacgccatattcaaattaacatatcaaaataaagtagtaaaagtacagaggcctacccctaaaggaaccgtcatggatatcataagtcgaaaagatcaaagaggtagtggacaggtcgggacgtatggtctcaacacgtttactaatatggaggctcagttagtacgtcagatggaaggtgaaggtgtgctctcgaaagcagacctagaaaatccccacttgctcgagaagaaaataacccaatggttagaaacaaagggtgtcgaaagacttaaaagaatggcgatatcaggagacgactgcgtggttaaacctatagacgatagatttgcaaacgcattactggcattgaacgacatgggtaaagtgagaaaggacattccgcaatggcaaccatcaaaagggtggcacgattggcagcaggtccccttttgctcacatcacttccatgaactcattatgaaagatgggaggaaactcgtagtaccatgtaggcctcaagacgaacttatagggagggctcgaatttcgcaaggcgctggatggtcactcaaagaaacagcatgtttagggaaggcatatgcacaaatgtggtctctgatgtatttccaccggagagatctaagattagcgtcaaatgcaatttgctcagctgtccccgtacactggatacccacatcacgcacgacttggagtatccatgcacaccatcaatggatgacgactgaggatatgcttactgtatggaatagagtgtggattgaggacaacccatggatggaagataaaacaccagttacaacttgggaagatgtgccatatctgggaaaaagagaggatcaatggtgcggatcgttgataggattaacttccagagctacttgggctcaaaacattctaacagccatacaacaagtacgaagtctaatcggcgacgaagagtttctggattacatgccctcgatgaagcgtttcaggaaagaagaagaatcggaaggagcaatatggtaa

SEQ ID NO: 23121 - RNA, 9873 nt, synthetic construct
  misc_feature 1..9873: note = derived and/or modified CDS sequence (opt6) from DENV-3__GU131945__SS-prME
  source 1..9873: mol_type = other RNA
acttctctatgtttgatgatgatgttgcctgcgaccctagcatttcatctaacatctcgcgacggagaaccaagaatgatagttggaaaaaacgagagaggtaagtcactactattcaaaactgcgagtggaatcaacatgtgcacactgattgcaatggacttaggtgaaatgtgcgacgacactgtaacttataaatgtccactaattgcagaggtggaacccgaagatatagattgctggtgtaatctaacaagcacctgggtaacttacgggacatgcaatcaagcaggagagcatagacgggataaacgaagtgttgccctcgcccctcatgttggtatgggtttagatactaggacacagacatggatgagcgctgagggcgcgtggcgtcaagtagaaaaagtagaaacttgggctctgagacatcctgggttcaccattctagctttgtttttagcgcattacattgggacctcccttactcagaaagttgtaatctttatcctattgatgctagtaactccatcaatgacaatgaggtgtgtcggagttggaaatagggatttcgtggagggtctaagcggcgcgacttgggtagacgtagtgctcgaacacggcggatgcgtaaccacgatggcgaaatccaaacccacacttgatatagaactacaaaaaacagaagcaactcaactcgccaccttgcgcaaactttgcatagaaggaaaaataacaaacatcacaacagattcgagatgtccaactcaaggagaggcaaccttaccagaggagcaagatcaaaattatgtctgcaaacatacgtatgttgacagaggatggggcaatggatgtggcttgtttgggaagggatcactggtaacatgcgctaaatttcaatgtttggaatcgatcgaagggaaagtcgttcagtatgagaaccttaaatatactgtcattatcacggttcataccggtgatcaacatcaagttggaaatgacacacaaggagttacagtagaaataactcctcaggcatcgactgttgaggcggtcctacctgaatatggaaccttgggcttagaatgttcccccagaacaggtcttgactttaatgaaatgatattactaacaatgaagaacaaggcatggatggtacaccgacagtggttctttgacttaccactaccttggacaagtggcgcgacgacggaaacgcctacgtggaataggaaggaattgctggtcacatttaagaatgctcatgcaaagaaacaggaagtagtcgttttgggatcgcaggaaggtgctatgcatactgcacttaccggagcgacagaaattcagaactcaggaggtacatctattttcgcagggcacttaaaatgtcgattaaagatggataaactagaactaaagggtatgtcatatgcaatgtgtttaaatacatttgttttaaaaaaagaggtatcagaaactcaacatgggacgattctaataaaggttgagtataagggcgaagacgcaccatgcaaaataccattctctaccgaggatggccagggcaaggcccataatggtagactgattacggcaaatcctgtagtaacaaaaaaagaagagccagtcaatatagaggcggaaccaccatttggagaatcaaatatagtcattggaataggagataaggccttaaaaatcaactggtacaagaaaggatcgtctattggaaaaatgtttgaagcgacggccagaggagctcgaagaatggctatcctaggagatacagcatgggattttggatccgtgggtggagtgctaaattcactcggaaaaatggtccatcaaattttcggatcagcttataccgccttattctctggagtaagttggattatgaagattggaataggagtactccttacatggataggattaaactctaaaaatacgtctatgtcattttcatgtattgttataggaataataacattatacttaggggcagtagtccaagcggacatgggttgtgtcataaattggaaaggtaaagaacttaaatgtgggaatggaatctttgtaactaacgaagtccacacttggacagaacaatataagtttcaagcggattcgcccaaacgactcgctacagcgatagccggggcatgggaaaacggagtttgtggtatacgttctacaactcgtatggaaaatctgttatggaagcaaatagctaacgaacttaattacatattatgggaaaataatataaaattgacagtagtcgttggcgatataattggtgtgctagagcaaggcaaacgtgccttaaccccccagcctatggaattaaagtattcttggaaaacatggggtaaggctaaaatagtgacagccgaaactcaaaatagctcgtttataatcgatgggccgaacacgcctgagtgtccaagtgcttccagagcctggaacgtatgggaggttgaagattatggatttggagtgttcaccacaaatatatggcttaaattgcgtgaagtgtacacgcaatcgtgcgatcacaggctcatgagtgcagcaataaaagatgagagagcagtacacgcagacatggggtattggattgaaagccaaaaaaacggatcatggaaactagaaaaagcgtcattcattgaagtaaagacatgtacatggcccaaatctcatacattatggtctaacggagttttagaaagcgatatgattataccgaagagccttgctgggcccatttcgcaacataatcaccgtcctggatatcatacgcaaacggcgggaccttggcatcttgggaaactagagctggattttaattactgtgaaggtacaacagtcgtgatagcagagaattgcgggacacgcggcccaagcttgcggactacgacggttagcggaaaactaattcatgagtggtgctgtaggtcatgtacacttcctccccttagatatatgggcgaggatggctgctggtacggaatggaaataaggcctataaatgaaaaagaagaaaatatggtaaaaagcctcgtctctgcaggatcaggtaaagtagataacttcacgatgggcgtgctatgtttagctatactatttgaggaagtcatgcgaggaaagtttgggaaaaaacatatgatcgccggcgtcttattcacttttgtactgcttctgagcggacaaattacttggcgtgatatggcgcatactctcataatgataggttctaacgcgagtgatcgtatgggaatgggggtcacttacttagcccttatagcgactttcaagattcaacctttcctagctctgggatttttcctacgtaaactaacaagtcgtgagaatctccttttgggcgtaggactagcaatggcaactactttacaattgcctgaagatattgaacaaatggccaatggaatcgcattgggattaatgactctaaaattgatcacgcaattcgaaacataccaactttggactgcgcttgtatctcttacttgcagtaatacaatatttactctaaccgtagcatggcgtaccgcgacactaattctagcaggagttagcttgctacctctgtgccaatcgtcatccatgagaaagacggattggctacccatgacggtggcagcaatgggtgtgccaccactcccattatttatctttagtctaaaggacacaccaaaacgtcgatcctggccgctaaatgaaggtgtaatggcagtcgggttggtatccatattagcgtcatcattactgcgtaacgatgtgcctatggcaggacccttagtagcgggaggacttctaatagcatgttatgtaattacaggcacctcagcagatcttactgtagaaaaagcagctgacgtaacttgggaagaagaagctgaacaaacaggcgtgtcacataacctaatgattaccgttgacgatgatggaactatgaagattaaagacgatgagaccgagaatatactaaccgtattactgaaaacagccttactaattgtctccggtatatttccgtacagcattccagcaacactgctagtctggcacacttggcaaaaacaaactcaacgctcaggtgttttatgggacgtgccgtctcctccagaaactcaaaaagcagagctagaagaaggagtataccgcataaaacaacaaggaatattcggtaaaacccaggtcggcgttggagttcaaaaagaaggagtattccacacgatgtggcacgtaacccgaggtgctgtactaactcataacggaaaacgtctagagccaaactgggccagtgttaaaaaggaccttatttcatatggaggagggtggagattatcagcacaatggcaaaaaggcgaggaagtacaagtaatcgcagtagaaccaggaaagaacccaaagaactttcaaacgatgccaggtatattccagaccaccacaggggaaattggcgcgatcgctctagattttaaaccaggaacctccgggagtcctatcataaaccgcgaaggtaaagtagtgggactttatggcaatggagtcgtaactaaaaacggaggctacgtttctggaattgctcaaacaaatgccgagccagacggtccaacaccagaacttgaggaagaaatgttcaaaaaaagaaaccttacaattatggacttacacccaggtagtgggaaaacgcggaaatacttaccagccatagttagagaagcaatcaagcgtagactgcgaacgcttatattggcaccaacaagagtcgtagcggcagaaatggaggaagccctaaaaggtcttcctatccgctatcaaacgactgccactaaaagcgaacacacaggaagggaaatagtggacttgatgtgtcacgcaacgtttacaatgaggctacttagccctgtgagagtacccaactataatctcgtaataatggatgaagcacattttactgacccagcatcaatcgcggcgaggggttatatatccacaagagttggcatgggagaagccgctgcaatcttcatgactgcaacacctccaggtaccgcagaggcttttcctcaatcgaatgcaccgatacaagatgaagagcgcgacattccagaaagaagttggaacagcgggaatgaatggataacagacttcgtcgggaaaaccgtatggtttgtacctagcatcaaagcaggtaatgatatagcaaattgcttaaggaaaaacggaaaaaaagtaatacagttaagtagaaaaaccttcgataccgaatatcaaaagacaaggctaaacgattgggatttcgtagttacgacagatatatctgagatgggagctaatttcaaagcagaccgggttatagaccctaggcgctgtctaaagcccgtaattttaacggatgggccggaaagagttattttagcaggtccaatgcctgtgacggcagcatccgcagcacaaaggagaggtcgagttggcaggaatcctcaaaaggaaaatgatcaatatatatttatgggacagccattaaataatgacgaggaccatgcacattggaccgaggcaaaaatgctcctagacaatataaataccccagaagggatcattcctgcattatttgaacctgaaagagaaaagtcagctgctatcgatggtgaatatcgattaaaaggagaaagtcgtaaaacttttgtagaactcatgagaaggggtgatttacccgtatggctagcccataaagtagcttcggaaggcataaaatacaccgatagaaaatggtgcttcgacggcgagcgtaataatcaaatactagaagagaatatggacgtagaaatctggacaaaggaaggggaaagaaaaaaacttaggccacgatggcttgatgccaggacgtattcagacccattagctctaaaagaattcaaagattttgccgcaggacgtaaatcaattgcactggatttagtcactgaaataggaagggtgccgtcccatctagcgcatagaacgcgcaacgcactcgataatttggttatgctacatacaagtgaacacggaggtagagcctatagacatgcggtggaagaattgccagagacaatggaaaccttgcttttactaggcctaatgatcttattaacgggaggggctatgctctttttaattagtggaaaaggcataggaaagaccagcattggtttaatatgtgttatagtcagcagcggaatgctgtggatggccgatgttcccttacaatggatagctagcgcaatcgtgttagaatttttcatgatggtactattaatccctgaaccagagaaacaacggacaccgcaagacaaccaattagcatatgtagtcataggaattttaacattggcggcaattgtggctgctaatgagatgggcttgctagagacaacaaaaagagatttaggaatgagcaaagaacccggagttgtatcacccacgtcctatttggatgtagatttgcatcccgcttcagcatggactctatacgcagttgccactaccgttataacaccaatgttgcggcataccatagagaacagcaccgcgaacgtaagcttagcagctattgctaatcaagccgtagtattaatgggtttagataaaggatggcctataagcaagatggacctgggagttccactactggcgctaggctgctattcgcaagtcaacccacttactttaaccgctgcggttctccttcttgtgactcattatgcaataatcggacctggactacaagcaaaagctacaagggaagcacagaaaaggacagctgcaggcatcatgaaaaaccccacagtagacgggataatgacaatagatctagatccagttatttacgacagtaaattcgaaaagcaattaggacaggtgatgcttcttgtcttatgcgcagtacaattattactaatgagaacaagttgggcactttgcgaggcactaacactggcaactggtccaataaccacactttgggaaggctcaccaggaaaattttggaatacgaccatagctgttagtatggctaatatctttagaggcagttatcttgcaggtgcaggcttagctttttcgataatgaagagtgtgggtacagggcgtaggggtactggcagtcaaggcgagacattgggagaaaaatggaagaagaaactgaatcaactatcacgaaaggaatttgacctttataaaaaatcagggatcactgaggtggacaggacggaagcgaaagaaggactaaaaaggggagaaactactcatcatgccgtatcgaggggatccgccaaactacaatggttcgtcgaacgcaatatggtaattcctgaagggagagttattgacctagggtgtgggagaggaggttggtcttattattgtgctggacttaagaaagtaacagaagttcgaggatacaccaaaggaggaccaggtcatgaagaacctgttcctatgagcacgtacggctggaacatcgtaaaattgatgtccggtaaagatgtgttttacctcccaccagaaaaatgtgacactctcttatgtgatataggagaatctagtccatctccgacagtcgaagagagtagaaccattagagtactgaaaatggtcgaaccttggttacgaagtaatcagttctgtattaaggtacttaatccatatatgcctacggtaatcgaatacttagaacgactccagcgcaagtatgggggtatgttagtccgaaatcctcttagtaggaattcaacccatgaaatgtattggatttctaatgggactgggaatattgtaagtagtgtaaacatggtctcgagattattactaaaccgatttactatgacgcatagacgaccaactattgagaaagacgtagacctaggagccggaacgcgacatgtaaatgcagagcccgaaactccaaacatggacgttattggtgagcgaataaaacgtatcaaggaagaacatagttctacgtggcattacgatgacgaaaacccttataagacctgggcataccacgggagctatgaagtaaaagcaacaggttccgcatcctcaatgataaatggggtggtaaaattactcacaaaaccatgggacgtagttccaatggttacacaaatggctatgacagatacaactccgtttggtcagcagagagtatttaaagaaaaggtggacactcgaactcctcggccaatgccgggtacccgtaaagttatggaaatcaccgcggaatggctatggcggacgctaggaagaaacaaaaaaccaaggttatgtacaagagaggaatttactaaaaaggttcggacaaatgcggcaatgggtgctgtattcacagaggaaaatcaatgggattcagcacgtgccgccgtggaagacgaagaattttggaaacttgtagataaagagcgggaacttcacaagcttggcaaatgtggttcatgcgtatataatatgatgggaaaaagagaaaagaagttgggagagtttggtaaagcgaaaggtagtagggcgatttggtacatgtggttaggagcccgatatttagagttcgaagctttagggtttttaaacgaagaccactggttctcgcgtgaaaactcgtattctggagtggaaggcgaagggttgcataaacttggatatatccttagagatattagcaaaatccccggcggagctatgtacgctgatgatactgctgggtgggatactagaataactgaggacgatctacataacgaagaaaaaataacccaacagatggatccagaacatcgtcaactcgcaaacgcaatcttcaaattaacttatcaaaataaagtagtaaaagttcaacgtcctacgcctaagggaactgttatggatattatatctagaaaggatcaacgtggatccggccaagtaggaacatacggactcaatacctttactaacatggaagcacaattagtacgccaaatggaaggagaaggtgtgcttagcaaagcagacctggagaatccccacttgttagagaaaaaaataacacaatggcttgagaccaagggagtggaaagattaaaaagaatggcaatctcaggagatgactgtgtagttaaacctattgatgataggtttgccaatgctctgctagctttgaatgacatgggcaaagttcgaaaagatattccacagtggcaacctagtaagggatggcacgactggcagcaagtgccattctgttcacaccacttccatgaattaattatgaaggatggaagaaaactcgttgtaccctgcagaccccaggatgaacttataggacgtgcgcgaatatctcaaggagcaggttggtcactgaaggagaccgcctgtttaggaaaagcgtatgcccagatgtggtcattgatgtacttccatagaagagatcttcgtttagcctccaatgctatttgttcagcagtacccgtacactggatcccaacgtctcgaacaacctggagtatacacgcccaccaccaatggatgacaacagaagatatgcttacagtatggaatcgagtttggatagaggataatccatggatggaggataaaaccccagtgacgacatgggaggatgtcccatatctcggcaaaagagaagatcaatggtgtggttctttgataggccttactagcagagcaacttgggctcaaaacattctaacagcgatacagcaagtaagaagtttaatcggagatgaagaatttttagactatatgccaagcatgaagcgattccgtaaggaagaggaaacagaaggtgcaatttggtga

SEQ ID NO: 23122 - RNA, 9873 nt, synthetic construct
  misc_feature 1..9873: note = derived and/or modified CDS sequence (opt6) from DENV-3__GU131946__SS-prME
  source 1..9873: mol_type = other RNA
acaagtctttgtttaatgatgatgttacctgcaacgttagcattccatttaacgtccagggacggtgaaccgcgaatgattgttgggaaaaatgaaaggggaaaatctttgctctttaaaacagcctcaggaatcaatatgtgcacgctaatcgcaatggacctgggtgaaatgtgtgatgacacagtaacttacaaatgccctttaatagctgaagtagaacccgaagacatagattgttggtgtaatctgacgtccacatgggtaacatacggtacttgtaatcaagctggtgaacatagacgagataagcgtagtgttgcgttagcgccgcacgtaggaatgggactagatactagaacacaaacctggatgtccgcagaaggtgcatggagacaagtcgaaaaagtagaaacatgggctttgaggcaccccggattcacaattcttgcactctttcttgctcattatataggaacaagcctaactcaaaaagtcgtcatattcatattactcatgctggtgaccccctccatgactatgcggtgtgttggggtaggaaatcgcgattttgttgagggactaagcggtgccacgtgggttgacgtagtgctggaacacggaggatgtgtaactactatggcgaaatctaaaccgacattagacattgaattacagaaaactgaggcaactcaattagcaactttacggaaactttgtatagaagggaaaattacaaatataaccacagactctagatgccccacccaaggagaagcaacattgcctgaagaacaagaccaaaattacgtttgtaaacacacttacgtagatagaggatggggaaatggctgtgggttatttggaaaagggtcgttggtaacgtgtgccaaattccaatgtttagaaccaattgaaggaaaagttgtgcaatatgagaacctgaaatatacagtaattataacagtccacactggagaccaacaccaagtagggaatgatacccagggagttaccgtcgaaattacaccacaagcgtcaactgtagaagcagtgctgccggaatacgggactctagggttagaatgttccccaagaacaggcctagacttcaacgaaatgattctattaactatgaaaaacaaagcctggatggtccacagacagtggttcttcgatttgccgcttccatggacaagtggggcgactacagagacccctacctggaaccgaaaagagcttctagtaacatttaaaaacgcacatgccaagaagcaagaggtagttgtgcttgggtcgcaggagggagccatgcacaccgctcttacgggagcaactgagatccaaaattctggaggaacgagcatattcgctggacatttaaaatgcaggcttaagatggataaattagaactaaagggtatgtcatacgccatgtgtcttaacacatttgtactaaagaaagaggtttcagaaacccaacacggaacgatattaatcaaggtggaatacaaaggtgaagacgccccttgtaaaataccgttcagtacggaggacggacaaggaaaagctcataatgggagactaattacagcgaatccggtggtaaccaagaaagaagaaccagtaaacatcgaggctgaaccaccatttggcgaatccaacatcgtaattggaataggcgataaagctctaaagataaattggtacaagaaagggtctagcatcggtaaaatgttcgaggcaacggcaagaggggcaagaaggatggctatcctcggtgacacagcctgggattttggatcagtaggtgggatattaaacagtttaggtaaaatggttcatcaaatattcggctctgcttataccgcattgttctcaggtgtgagttggattatgaaaataggtataggagtcctactcacctggattggcctaaatagcaaaaatacctctatgagctttagctgcatagttataggaattataaccctgtacttaggagcggtcgtgcaggcagacatgggttgcgtaattaactggaaaggtaaagagctaaaatgtggatcaggaattttcgtaacaaacgaagtacacacctggactgagcagtataaattccaagctgatagcccaaagcggctagcgaccgcaatagctggcgcatgggaaaacggggtctgtggaattagaagcactaccagaatggaaaatcttctttggaaacaaattgctaacgagctaaattatatattatgggagaataatataaaattgacagtagtagtaggggatataataggagttctagaacaagggaaaagaactttaacacctcaaccaatggaattaaaatattcctggaaaacctggggaaaagctcggatagtgactgcagaaacacaaaactctagctttataatcgacgggccgaatacgcctgaatgtccaagtgcttctcgtgcatggaacgtatgggaagttgaggactacggctttggagtatttacgacaaatatatggcttaagctacgcgaagtatatacacaatcctgtgatcacagattgatgagcgctgctattaaagatgagcgggccgtgcatgcggatatggggtactggattgaatcacagaaaaacggatcatggaaattggaaaaagcatcttttatcgaagtaaaaacgtgcacttggccgaaatcacatacattgtggtcaaatggtgtactggaatcagacatgattattcccaaatcacttgctggacccatcagccagcacaaccatcgtcctgggtaccatactcaaactgcgggcccgtggcatctaggaaaattagaactagacttcaactattgcgagggcacgacagttgtaataactgaaaattgtggtacacgtggaccatctctaagaacaacaacagtctcgggcaaattaatacatgaatggtgctgtcgtagctgcacgctaccccctcttcgatatatgggcgaagacggatgctggtacggcatggaaattcgaccaattaacgaaaaagaagaaaatatggttaagtccttagtaagtgctggaagtggtaaagtggacaactttaccatgggtgtactttgcctagctatactttttgaggaagtaatgagaggaaaattcggtaagaaacatatgatagctggtgttctgttcacatttgtgcttttattgagtggacaaattacttggcgtgacatggcccatacgctaataatgatagggtcaaacgcatcagatcgaatgggaatgggagtaacttacttagcactgattgcgacattcaaaattcaaccatttctagcgttaggctttttcttaaggaaacttacatcgagagaaaatttactactcggcgttggccttgccatggcaacaacacttcaactccccgaagatatcgagcaaatggctaatggaattgcgctgggcctaatgaccttaaaacttataactcaattcgaaacgtatcaattatggacagcactcgtgtcactaacatgttcaaatacgatattcacgctgacggtggcatggaggaccgcgacgctgattttagctggcgtatctttacttcccttatgccagtcctcatcaatgaggaaaaccgattggttgcctatgacagtggcagccatgggggtcccacccctgccattgttcatatttagtctaaaagatacacccaagagacgaagttggccacttaacgagggcgttatggccgttggactcgttagcattcttgcatctagtcttctgcggaacgacgttcctatggctggaccacttgtagcaggcgggctattaatagcctgttatgtaataacaggaacgtctgcagatctgacggttgaaaaggcagcagatgttacctgggaagaagaggctgaacaaactggcgtgtcacataatttaatgattacagtagatgatgacggtaccatgcgaatcaaagacgatgaaaccgaaaatatattaaccgtcttattaaaaaccgcattgctcatagtaagcggcatatttccatatagtattcctgcgacattattagtctggcacacatggcaaaagcaaacgcaaagaagtggagttttgtgggacgtgcctagtccaccagaaacccaaaaagcagaactggaggaaggtgtatatcggataaaacaacagggtattttcgggaaaactcaagtcggtgtgggagtacaaaaagaaggtgtcttccataccatgtggcacgtcacaagaggagcagtcttaacgcataacgggaaaaggcttgaaccaaattgggcatcagtaaagaaagacttaatctcctacggtggcggctggagactaagcgctcaatggcagaaaggagaagaagttcaagtgatagcggtagaaccagggaaaaatcccaaaaattttcagaccatgccaggcattttccaaactacaacgggtgaaataggggcaatagcactcgatttcaaacctggcacatcaggaagccctattatcaatagggaaggtaaagttgttggcctctatggtaacggggtcgtaactaaaaatggtggatacgtatcagggatagcgcagacaaatgctgaacctgacggaccaacgccggaattggaagaagaaatgtttaagaaacgcaatctgacaataatggaccttcatcctggatcaggcaaaacgagaaaatacttaccagctatagtcagagaagccattaaaagaagattaagaacgttgatactggctcctactcgagtagtagcggcggagatggaggaagcattgaaaggactaccgatacggtaccaaactacggcaaccaaaagcgaacatactggtcgtgaaatcgtggacctaatgtgtcatgcaacattcacaatgagattgctatctcctgtgagagtaccaaattacaacctggtaatcatggacgaagctcacttcactgacccggcaagcattgcagcaaggggctatatctcgacccgtgtaggaatgggagaagcggcagctatattcatgaccgcaaccccacctgggactgcggaggcttttccacaaagcaatgcacctatacaagatgaggaaagggatataccagaacgttcatggaactctgggaatgaatggataacagattttgtgggaaaaacagtttggtttgttccctcaattaaggcgggcaatgatatagctaactgtttaaggaaaaacggcaagaaagtaattcaactatcgaggaaaacgtttgatactgagtatcaaaagacccgtttaaacgactgggacttcgttgtaacaacagacatctcagagatgggagcaaactttaaagcagatagagtaatagacccacgccgttgtctgaaaccagtaatactaactgatggacccgaacgggtcatcttagcagggccgatgcctgtaactgcggcttctgctgctcaacgcaggggtcgagtcggccgtaacccgcaaaaagaaaacgaccaatacatattcactggtcagccacttaataatgatgaagatcatgcccattggactgaagctaaaatgttacttgacaacatcaacacccctgaaggaattattcccgcactcttcgaaccggaaagggagaaatcagcagcaattgatggagaatacagactcaaaggggagagtcgaaagacgtttcttgagctaatgcggcgtggtgacctaccagtatggttagcacataaagtagcgagtgaaggcatcaagtatacagataggaagtggtgtttcgatggcgaaaggaataatcaaatactcgaagaaaacatggacgtcgaaatatggactaaagagggtgaaagaaagaaattacgaccacgatggctagacgctcgaacatattcagatcccttagcgcttaaagaatttaaagactttgcagcagggcgaaaaagtatagcccttgatctggtaacagaaatagggcgtgtaccttcacacttagcccaccgcactagaagtgcactagacaatttagtcatgttgcatacaagcgaacacggcggacgtgcatacaggcatgctgttgaagaattgccggaaacaatggagacactcttactccttggtctcatgatacttttgacaggtggagctatgctgttcctaatatctggaaagggtattggaaaaaccagcataggattgatttgtgttatagtatcatcgggaatgctatggatggccgatgttccactacaatggatagcttcagcaatagttttagagttctttatgatggttctattgatacctgaaccagaaaaacaacgcactccccaagacaatcaattagcttatgttgtaattggcatactgacactcgctgcaatagttgcggcaaacgagatgggtttattagaaacgacaaaaagggacctaggcatgagtaaagaacctggtgtggttagtccaacgagctatctagacgtagacctacatccagcttcagcctggacattgtatgccgttgccacaacggtcataactccaatgcttaggcacaccatcgaaaacagcaccgcaaacgtgagcctagctgctattgccaaccaagctgtagtgttaatgggcttggacaaaggatggccaataagcaaaatggacctaggagtacccctattagcattggggtgctatagtcaggtaaatcctctaacattaaccgcagctgttcttcttttagttactcattatgctataattggtccgggtctacaggccaaagctactcgagaagctcagaaaaggacagccgctggaattatgaaaaacccaactgtagatggaataatgactatagatttggatccggtaatatacgactccaaatttgaaaaacaactagggcaagtcatgctattagtactatgtgctgtgcaacttctactaatgcgcactagctgggcactatgtgaagcactaactttagcaacaggaccaattactacgttgtgggaaggatctccaggaaaattctggaacacaacaatagctgtatcgatggcaaacatcttccgaggcagttatctagccggtgcaggactagcgttcagtataatgaaaagcgtaggtaccggtcgaagagggactggaagtcagggagaaacgctaggagaaaaatggaagaagaaattaaatcaattaagtagaaaggaatttgatttgtacaagaaaagtggtattactgaagtagatagaacagaagctaaagaagggctaaagagaggagagaccacacaccatgctgttagtagagggtcagcaaaattacaatggtttgtagaaaggaatatggtaatacccgaaggccgggttatagatttgggatgcgggaggggtggatggtcttactactgtgccggcctaaagaaggtcacagaagtccgaggatacaccaaaggtggacctgggcacgaagaacctgtacccatgtctacatatggatggaatatagtaaagctcatgagcgggaaagatgtcttctatctaccgccagaaaaatgtgacacattattgtgtgacattggagaatcatctcccagtccaaccgttgaagaaagcagaacaataagagttctaaagatggttgaaccctggctccgtaataatcaattttgtataaaagtattaaacccatacatgcctacagttatagaacatttggagagacttcaacgaaaatatggtggtatgctagtacgcaatccgttaagtcgcaatagtacccatgaaatgtattggatttcaaatggtaccggaaacattgttagctcagtaaacatggtgtcgagactcttgctaaacagattcactatgacgcatagaagaccaaccatagaaaaagacgtagatctaggcgcaggcacgagacatgtaaatgcagaaccagaaaccccgaatatggacgtaataggtgaaaggatcaaacggattaaggaggaacatagctctacatggcattatgatgatgagaacccatataaaacgtgggcataccacggatcctatgaagtaaaagcaacaggtagtgcgagcagtatgattaacggagtggttaagctactaaccaaaccttgggacgtcgttccaatggttacccaaatggctatgacagacactacaccatttggtcagcaaagagtttttaaagaaaaagtagacacacgtactccgagaccgatgccaggaactagaaaagtcatggaaataacagctgaatggctgtggaggactctaggccggaataagaaaccccgtctatgcacacgcgaagaatttacgaagaaagtacgtacaaatgctgcaatgggcgcagtattcacggaagaaaatcaatgggacaatgcgcgtgctgcagtagaagatgaagaattttggaaacttgttgaccgtgagagagagctccataaacttggaaaatgtggcagctgtatatacaatatgatgggaaagcgggagaagaaattgggggagttcggaaaagcaaaaggttccagggccatatggtatatgtggttaggagcacgttacttggaatttgaagctcttggatttctcaacgaagatcattggttttcaagggaaaacagttacagtggagtagaaggtgaaggattgcataaacttgggtatattctgagagatatttcaaaaatacccggcggtgcgatgtatgcggatgatacagccggctgggatacaagaataaccgaagacgatttgcataatgaggagaaaatcacacaacaaatggatccagagcatagacaactagccaatgcgatcttcaaattaacctatcagaacaaagttgttaaagttcaacgaccaacacctaaaggcactgtaatggacataatcagtcgtaaagatcaaaggggttccggacaagtgggcacttacggactaaacacattcactaatatggaggctcaattagtaagacaaatggagggagaaggcgtgttgtcaaaagctgacttagaaaatcctcacctactagagaagaaaataacacagtggctcgagacaaaaggagtagatagattgaaacgcatggccatttcaggcgatgattgtgtcgtaaaaccgattgacgacagatttgcgaacgctttattagcattaaacgatatgggcaaagtcaggaaagatattccacagtggcaacctagtaaggggtggcatgactggcaacaagtaccattttgctcacatcattttcatgagctgataatgaaagatggccgaaaattggtagttccttgtcgcccacaggacgaactcatcggtcgtgcccgaattagccaaggtgctggctggtctttaaaggagacagcatgtttgggtaaggcttacgcacaaatgtggtcactaatgtacttccacagaagagatttgagactagcgagcaacgcaatttgcagcgccgttcctgtacactggataccaacaagtcggacaacatggtcaatacatgcacatcaccagtggatgacgacggaggatatgttaacggtctggaatcgagtgtggattgaagacaatccttggatggaggataaaacgccagttacaacatgggaggacgtaccatatttagggaaaagggaagaccagtggtgtggtagcttaataggacttacctctcgagccacatgggctcaaaacatattaactgctatacaacaggtacgctcgctaatcggagatgaagagttcctagattatatgcctagtatgaagaggtttcgaaaagaagaggagtcagaaggtgcaatttggtga

SEQ ID NO: 23123 - RNA, 9873 nt, synthetic construct
  misc_feature 1..9873: note = derived and/or modified CDS sequence (opt6) from DENV-3__FJ639712__SS-prME
  source 1..9873: mol_type = other RNA
actagcttatgcttaatgatgatgttccccgcaacattagcgttccacttgacttcaagagatggggaacccagaatgatagtagggaaaaacgagagaggtaaatctttgctattcaaaaccgcttcaggaataaacatgtgcacgttaattgctatggatctcggagaaatgtgtgacgacacagtaacttacaaatgccccttaattgcagaagtagaacccgaagatattgattgttggtgtaatctaacaagtacgtgggtgacatatgggacctgcaatcaggcaggagaacaccgtcgtgataaacgatctgtagcgctagcaccacacgtgggtatgggattagataccagaacccaaacatggatgtcggcggaaggtgcatggaggcaagtggagaaagtggaaacgtgggctctacggcacccaggatttacgatcctagcactgtttttggctcactatatcggaacaagtttaacccaaaaagttgttattttcatacttttgatgcttgtgactccatctatgactatgagatgtgtaggagttggaaaccgtgacttcgtggaagggctaagtggtgctacatgggtggatgtcgtattagaacatggaggttgtgtcacaacgatggctaagtcaaaaccgactttagatatcgagttacaaaagacagaagctacccaactagcaaccttacggaagttatgcatagaaggaaaaattactaatataacaacggacagtagatgccctacgcagggagaagcaacacttccagaagaacaagatcaaaattacgtatgcaaacacacgtatgtggatcgagggtggggaaatggatgtggtttattcggaaaaggaagtttagtgacctgcgcgaaatttcaatgtttagagcctatagaaggaaaggtagtacagtacgaaaatcttaaatacactgttatcataaccgtccataccggcgatcagcatcaagtggggaacgatacacaaggagtaaccgtagaaattactccacaagcatctactgtggaggcagtacttccagaatacggcacattaggtctggaatgtagcccgaggactgggttagactttaatgagatgatattattaacgatgaagaataaggcttggatggtacaccgtcaatggtttttcgaccttccactaccatggacatctggtgctactactgaaacaccgacatggaacaggaaggaactattagtaacttttaaaaacgctcatgctaaaaagcaagaggtagtagtattaggatcccaagaaggagcaatgcacaccgcactaacgggagcaacagaaattcaaaatagtggagggacatccatcttcgctggtcacctgaaatgcagactaaaaatggataaattagaactaaagggaatgagttacgcaatgtgtctgaacacttttgtacttaaaaaggaagtatcagaaacacagcatggaacaatactaattaaggtggaatataaaggtgaagatgcaccctgtaaaatccccttctcaactgaagacggtcaaggaaaagcccactctggaagactcattaccgccaatccagttgtaacaaagaaggaagaaccagtaaacatcgaagcagaaccacctttcggagaaagcaatatagtgatcggaatcggtgacaaagcattaaaaataaactggtataaaaagggatcaagcattggaaaaatgtttgaagcaaccgcaagaggagcaagacgaatggcgatcttgggcgataccgcgtgggattttggatcagtaggtggcgtactaaattcgctaggaaagatggtgcaccaaatttttgggagcgcgtacacagctctattttcaggcgtttcctgggtcatgaaaatcggaataggggtattactgacatggataggattaaactcaaagaatacaagcatgagcttttcctgcatagttatcggcattataacactttatttaggagcagtagtacaagcagatatgggctgtgtaataaactggaagggaaaagaattaaaatgtggatcaggaatatttgttaccaatgaagtccatacctggactgaacagtataaattccaggccgatagtcccaaaagattagcaaccgccattgcgggtgcctgggaaaacggagtctgcggtatcaggtctactacacggatggaaaatctgttgtggaagcaaatcgcaaacgaactcaattacattctatgggagaataacattaagttaactgtcgtggtgggcgacatcataggagtacttgaacaagggaaacgcacacttacaccacagccaatggaactaaaatattcctggaagacatggggtaaagctaaaatcgtcacggcagaaacccagaatagttctttcatcattgacggaccaaatacacctgaatgtccatctgcatcacgcgcgtggaacgtatgggaagtcgaggattatggatttggagtgtttacaacaaacatttggctaaaactacgagaagtatacactcaatcgtgtgatcaccgactaatgtccgcggcgataaaagatgagagggctgttcacgctgatatgggctattggatcgaatcgcagaaaaacggatcttggaagctagaaaaggccagctttattgaagtaaagacatgcacatggcccaaaagtcatacactgtggtctaatggagtactagaatccgatatgataatacctaaatcactagcaggcccaattagtcaacacaatcatagacctggatatcatacgcaaacagcgggcccctggcatttaggaaagttagagttagatttcaactattgtgagggaactacagttgttatcactgagaattgcgggacacgaggaccaagtctacgcactaccacagtaagtggaaaactaatacatgaatggtgctgtcgcagttgtacgctaccccctttaagatatatgggtgaagacggatgttggtacggcatggaaatcagaccaataaatgaaaaagaagaaaatatggttaagagcctcgtatccgcaggaagtggcaaagtggacaacttcactatgggcgtgttatgccttgcgatcctatttgaagaagtgatgagaggaaaatttggcaagaaacatatgattgcaggcgttttatttacattcgtcttgttattatctggacaaataacttggagagacatggcccatacattaataatgattggttcaaacgcgtccgacaggatgggaatgggagtaacatacctagcattaatagctacattcaaaatacagccatttctcgccctcggctttttcctacgtaaattaacgagccgagaaaatttacttcttggagtaggtctagcgatggccactacactacaactaccagaggacatagagcagatggcaaacggaatagcccttggtctaatgactttaaaactaataacacaatttgaaacgtatcaactatggactgcattagtatcacttacttgttcaaacactatattcacactaaccgtcgcgtggagaaccgcgactctaatactggccggtgtatcattattaccactgtgtcaatcatcgagtatgagaaaaactgattggttacctatgaccgttgcagcgatgggagtacccccgttacctcttttcatcttttctttgaaagacacgcccaaacgaagaagctggcccctcaatgaaggagttatggccgttgggctcgtgtctatcctagcatccagtctactaagaaatgatgtaccgatggcaggacctttagtcgcaggaggcttactaatagcttgctacgtcataactgggacttcagccgacctaacagtagaaaaagcagcagatgtgacctgggaggaggaagccgaacaaaccggggtgagtcataacttgatgataaccgttgatgatgatggaacaatgagaataaaagatgacgagacggagaacatcctgacagtactgttaaaaactgcactattgattgtgtcagggatatttccttattctatacctgcgaccctcctagtttggcatacctggcaaaaacaaactcaacgcagtggagttttgtgggatgttccttcaccgcctgaaacacaaaaagctgagttggaagagggcgtgtatcgaattaaacaacaaggcatttttgggaaaacgcaagtgggtgtaggagtccaaaaagagggagtattccacacaatgtggcatgtaaccagaggagcagtacttacacataatgggaaacgtcttgaacccaattgggccagtgtcaagaaagacttgattagctacggcggaggatggcgattgaatgcccaatggcagaaaggagaggaagtccaggttatagcagttgaaccaggcaaaaatcctaaaaacttccaaaccatgcctggaattttccaaactacaacaggagaaataggagccatagcgctagacttcaaacctggaacgtcaggcagcccgataattaatcgagaaggtaaagttgttggcctctatggaaatggagtagtaacaaagaacgggggttacgttagtgggatcgcccaaacaaatgccgaaccagatggtccaacgccagaactggaagaagaaatgttcaagaaaagaaacctaacaataatggatcttcatccaggctcggggaaaactaggaaatatctgcccgccattgttagagaggcgataaagcgacgtttaaggacattaattttggcacctactcgagtagtagccgcagaaatggaagaagcgttaaaagggttaccgatcagatatcaaactactgctacaaaatccgaacacacgggaagagaaattgtagacttgatgtgccatgccactttcacaatgcgattactcagtcccgtgcgagtgcccaactacaacttagttataatggatgaggctcattttaccgatccggcgagcatagcggctcgaggatacatatcaacacgggttggaatgggcgaggcggctgcaatatttatgacagcaacgccacccggtacggcagaagcatttccacaaagtaatgcaccaatacaggacgaagaacgcgacataccggagaggagttggaactccggtaatgaatggatcactgactttgttggcaaaacagtatggtttgtcccttctataaaagctggaaacgatatcgcgaattgtctaaggaaaaatggtaagaaagttatacaattaagccgcaaaacgtttgacacagagtaccagaagactcgattaaacgagtgggattttgttgtcacaacggacatctcggagatgggagcaaatttcaaagcagacagagtaatagacccacgcagatgtctgaaacctgtgatattaacagatggacctgagcgtgtcatattagcaggcccaatgcccgtaacagccgcttcagctgcccagagaagaggacgagttggaagaaatccacaaaaggagaatgaccagtatatctttacaggccagcctttgaataatgatgaggatcatgctcactggacggaagccaagatgttactcgataatatcaacacacctgaaggtatcataccagcactgtttgagccggaacgagaaaaatcagcagcaatagacggtgaatacaggctaaaaggagaaagccgtaaaaccttcgtagaacttatgcgaagaggcgacctaccagtttggctggctcacaaagttgcatctgaaggaataaagtatgctgacaggaaatggtgcttcgacggtgaacgtaataatcaaattttagaagaaaatatggacgtagagatatggacaaaagaaggtgaacgaaagaaattacgtcctcgatggctcgatgccaggacatatagcgacccattggcccttaaagagtttaaggattttgcagctggcagaaaatctatagcgttagatttagtaaccgagatcggcagagtaccaagtcatctagctcaccgtactagaaatgcacttgacaacttggtcatgttgcatacgtcagaacacggaggtcgtgcctatagacacgcagtggaagaactcccggagacaatggaaaccctactgctcttaggccttatgatactactaactggcggggcaatgttatttcttataagtggaaaaggaatagggaaaacttcaatcgggttgatttgtgtaatagttagctccggcatgctttggatggcggacgtcccgttacaatggatagcttctgcaattgtattagagttcttcatgatggtcctcttgattcctgaaccagagaaacaacgaactccgcaagacaatcagcttgcatacgtagtcatcggcattctaacacttgcagcgatagttgcggcaaatgaaatgggtctattagaaactactaaaagagacttaggaatgagcaaggaacctggagtagtttccccaacgtcgtatttagatgtagatttgcacccagcttctgcatggacgctatatgcagttgcaacaactgttatcacccccatgttaagacacaccattgaaaacagcactgctaatgtgtctttagcagccattgctaaccaagcagtggtattaatgggactagataaaggctggccaattagcaaaatggatttaggagtaccgctactagctttaggatgttacagtcaagttaacccgttgacattgactgcggcggtacttctgctcgtaacccattatgcaataatcggtccaggcttacaagcaaaagctacacgggaagctcagaagcgtacagctgcaggtattatgaaaaacccgactgtagacggtataatgacaatcgacttagacccagtcatatacgacagcaagtttgaaaaacaattgggccaagtaatgttgctagttctatgtgccgtacagttgctattaatgagaacatcatgggcattatgtgaagctctaacattagctacaggccccattacaacactctgggaaggcagtcctggaaaattttggaacacgactattgcagtctcaatggccaacatatttcggggcagttatttggccggtgcaggcttagcattctccattatgaagtcagtaggtacaggtagacgaggtacaggatctcagggtgaaactttaggcgaaaaatggaagaagaaattaaatcaattaagtcgtaaagagttcgatctttataagaaaagtggtataacagaggtagatagaacagaagccaaagaaggcctgaaacgtggggaaactacgcatcacgcagtaagtcgtggatcagcaaaactgcagtggttcgtagagagaaatatggtcattcctgaaggaagggtgattgatttaggctgtggtcgtggaggatggtcttattattgtgcgggacttaagaaagttacggaggtaagaggatataccaaaggcggtccaggacacgaggagcctgtacctatgtcgacatatggttggaacatagtgaaattgatgagcgggaaagatgtattttacttaccgccagaaaaatgtgacacattactctgtgacattggcgaatccagtcctagtcccacagtagaagagtcaaggacaatccgagtcctaaaaatggtagagccgtggctaagaaataatcaattctgtataaaggtactcaacccctatatgcctactgtgatagagcatttggagcgtctacagcgaaagtatggaggtatgttggttagaaatcctctaagtcgaaatagtacacacgagatgtactggataagcaatggcaccggtaacattgtttcgagcgttaacatggtcagtagattattattgaatagatttacgatgacccatagacgaccaacaatcgaaaaagatgtagatttgggtgctggaactagacatgtgaacgctgagcctgaaacaccgaacatggacgtgattggagaacgcataaaacgcataaaagaagaacattcttcgacttggcactatgacgacgaaaacccatacaaaacttgggcctaccatggttcgtatgaagttaaagcaacaggttccgcttcaagcatgatcaatggagttgtcaaactcttaactaagccgtgggatgttgttccaatggttacacagatggcgatgaccgacacaacaccttttggccaacagagagtgtttaaagaaaaggtagatacaagaactccacgtccgatgccgggaacaagaaaggtcatggaaataactgcagaatggttatggagaacacttggaagaaacaagaaaccaagattgtgcactcgagaagagtttactaagaaagtacgtaccaacgctgcaatgggtgcagtgttcactgaggaaaatcaatgggactcagcaagagcagctgtagaagatgaagaattttggaaactcgtagatcgagaacgcgaactccataagctcggaaagtgcggctcatgtgtttacaacatgatgggaaagagagagaagaaactcggcgagtttgggaaagcgaaagggtcccgagctatttggtacatgtggttaggtgctaggtacctggaatttgaagcgttaggattcctaaatgaagatcactggttcagtcgggaaaattcttatagcggagtagagggggaaggtctacataaactaggatatatattgcgtgacataagtaaaattccgggtggcgctatgtacgcggatgatactgcgggatgggatacgcgcataactgaagatgatcttcacaatgaagagaaaatcacacaacaaatggaccctgaacatagacaattagccaatgcaatattcaaattaacctatcaaaacaaggtggttaaagtccaaagaccaaccccgaaaggaacagttatggatattataagtagaaaagaccaacgtggatcaggtcaagtggggacctatggccttaatacatttactaacatggaagcgcagttagtacgacaaatggagggggaaggagtcctatctaaagcagatttagagaacccacatttgctagaaaagaaaattacacaatggctagaaactaagggcgtcgaacggcttaaaagaatggctatatctggcgatgactgtgtcgtaaagccaatagacgatcggtttgcgaatgcattgttggcactaaacgatatgggaaaagtgcgcaaggacatcccacagtggcaaccaagcaaaggatggcacgattggcaacaggtaccgttttgctcgcatcactttcacgagctaattatgaaagacggacgaaaattagtcgttccctgccggccacaagacgaactgataggcagagcaaggatatcccaaggcgcaggatggtctctaaaagagactgcttgtcttgggaaagcatatgcccaaatgtggtcgcttatgtacttccatcgacgtgaccttaggcttgcatccaacgcaatctgttcggctgtccctgttcactggataccgacaagtcgaaccacatggagtattcacgcgcatcatcagtggatgaccaccgaagatatgctcacggtttggaaccgggtttggatcgaagacaatccatggatggaggataagacacccgtaacaacatgggaggacgttccatacttaggaaagcgagaagatcagtggtgcggctccctaatagggctcacaagtcgggcaacatgggcgcagaacatattgacggcaatccaacaagtaagaagcctcattggggatgaggaatttttagattacatgccaagcatgaaaagatttcggaaagaagaggaaagcgagggtgcaatttggtga

SEQ ID NO: 23124 - RNA, 9873 nt, synthetic construct
  misc_feature 1..9873: note = derived and/or modified CDS sequence (opt6) from DENV-3__FJ639713__SS-prME
  source 1..9873: mol_type = other RNA
acaagcctttgcttgatgatgatgttaccagcaacgttagcatttcacctaacttcaagggacggagaacctagaatgatagttggtaaaaatgaaagaggaaaatcactcctgtttaaaacagctagcgggataaatatgtgcacattaattgctatggacttaggagaaatgtgtgatgacacagtaacatataaatgtccactcatagcagaagttgaacctgaagacatagattgttggtgcaatttaacaagtacatgggtcacgtacgggacctgtaaccaagctggtgaacatagaagggataaacgttctgtagcattagcaccccatgtaggaatgggattagatacaagaacacaaacatggatgtcagcagaaggtgcttggaggcaagtcgaaaaagtggaaacatgggcccttagacatccaggatttacaatcctagcattgtttttagcccattatatagggacctcgctaacacagaaagtcgtaatttttatactattaatgcttgtaactccgagcatgacgatgcgatgtgtcggagtaggaaatcgcgacttcgtagaaggtttaagcggtgcgacatgggtggatgtcgtattagaacacggagggtgtgtaactacaatggcgaaatcgaaaccgacgttagatatcgaactacagaaaacagaagcaacacaactagcaaccctaagaaaattatgtattgaaggaaaaataaccaatataacaactgatagtcgctgcccgacgcaaggggaagctacacttcccgaagaacaagatcaaaattatgtttgcaaacatacatacgtcgatcgaggatggggtaacggatgtggactgtttggaaaaggcagcttagtgacatgtgctaaatttcaatgtctagaaccaatagaaggtaaagttgtgcaatacgaaaatttgaaatatacagttatcataactgttcacacgggagatcaacatcaagtaggtaatgatactcaaggagttacagttgaaattaccccgcaagcgagtacagttgaagccgtactccctgaatatgggacactgggcttggaatgttccccacgaacaggacttgattttaatgaaatgatcctgttaacaatgaaaaataaagcgtggatggtacataggcaatggtttttcgatctcccactcccttggacaagcggcgccacaacagaaactccaacatggaatcgaaaagaactgctggtgacatttaaaaacgctcatgccaagaaacaagaagtagtcgtcctagggtcccaagaaggagccatgcacactgcgttaaccggagcaacagaaatccaaaacagcggaggcacatccatttttgcagggcacttgaaatgccgtttaaaaatggataaactagaactgaaaggaatgtcctatgcgatgtgtttgaatacatttgtactaaagaaagaagtttctgaaactcaacatggaacaatactaataaaagtcgaatataaaggagaagatgcaccatgcaaaataccattttcaaccgaagacggtcagggcaaagcgcacaacggcaggcttatcacggctaatccagtagtcaccaagaaagaggaaccagttaacatagaagctgaaccccctttcggagaaagcaacatagtcataggcataggagataaggctttaaaaatcaactggtataagaaaggttcaagtatcggcaaaatgtttgaggctaccgctaggggcgcaagaaggatggccatccttggtgacacagcttgggatttcggatccgttggaggtgtcttaaattcactgggaaaaatggtgcaccaaatatttggcagtgcttacacagcccttttctcaggagtgtcttggataatgaaaataggaataggtgtattactcacatggatcggactgaatagcaaaaatacaagtatgtcattttcatgtatagtaatagggatcatcacactataccttggggcagtcgttcaagcagacatgggatgtgtaattaactggaaaggaaaagaactaaaatgtggcaatggaatattcgtcaccaatgaagtccacacgtggactgaacaatataaattccaagcagatagtcctaaaagacttgctactgctattgccggggcatgggaaaatggagtctgcggtataagaagtaccacacggatggagaatttattatggaaacaaatagctaatgaactaaattatatattatgggagaacaatataaaattaacagtcgtcgtaggtgacatcataggcgttttagagcaaggcaaacgtacgctaacgccacaaccgatggagctaaaatactcttggaaaacttggggaaaagcgaaaattgtaacagcagaaacgcaaaacagctcattcataattgatggtcctaataccccagaatgcccctccgcttctagagcatggaacgtctgggaagttgaagattatgggtttggggtcttcaccacaaatatatggttaaaactaagagaagtctacacacaatcgtgcgatcataggttaatgtcggctgcgataaaagatgaacgagcagtacatgcagacatgggatattggatagaaagtcagaaaaatggatcttggaaattggagaaggcaagttttatagaagtgaagacgtgtacatggccaaaatctcatacattgtggtctaacggcgtactggaaagtgatatgattatccccaaatcgttggccggtccaatctcgcaacataaccacagaccagggtatcatacgcaaaccgcaggcccgtggcatttgggaaagctagagctagactttaactactgcgaaggaacaacagtagtgatcgcagagaactgcgggacacggggacctagtctacgtaccacaacagttagcggaaagctaattcacgaatggtgttgtcgaagttgtactctcccaccactaaggtatatgggtgaggacggatgctggtacggaatggagatcagacctataaacgaaaaagaagagaacatggttaaatcattagtatccgcagggtctggaaaagtagacaatttcaccatgggagtactatgcctagcaattctgtttgaggaagtaatgagaggaaagtttggcaagaaacatatgatagcgggagtactattcactttcgttcttcttctctcaggccaaataacgtggagagacatggcgcacactctgatcatgataggctccaatgcgtcagaccgcatgggtatgggagtaacttatttggctttaatagcaacctttaaaatccaaccgttcttggcactcggcttcttcttacgtaaattaacgtctcgagagaacctcctactcggagtcggactggccatggcaaccactcttcaactaccagaagatatcgaacaaatggcaaatggaattgccctcggtctaatgacactaaagttgatcacacaattcgagacctatcaattgtggacagcattagtaagccttacctgcagcaatacaatttttacactgaccgtagcatggagaaccgcaacgttaatattagcaggagttagtttattacccctatgccagtcaagttcaatgaggaaaacggactggctacctatgaccgttgccgccatgggagtccctcccctacccttatttatcttctctcttaaggatacgccaaaacgaagatcttggccactcaacgagggtgtaatggccgtaggcttagtaagtatcttagcctcatcgctattacgtaacgatgtaccgatggctgggccattagtagcgggaggacttctcattgcatgctacgtaataacaggaacgagtgctgatttgacagtggaaaaagccgctgacgtgacatgggaggaagaggccgagcagacaggtgtaagtcataatcttatgattaccgttgacgatgatgggacaatgcgaatcaaagacgatgaaacagagaacattttaacggttctactaaagacggcgttactaatagtatcaggaatcttcccttattcaatacctgcaacattacttgtatggcatacgtggcagaaacaaactcaacgaagcggcgtcttatgggacgttcctagtccccctgaaacgcaaaaggcggagcttgaagagggtgtataccggataaaacagcagggcattttcggaaaaactcaggtgggagttggagtacaaaaagaaggtgtatttcacacaatgtggcatgttacaagaggagctgtactaacacacaacggcaaacgactagagcccaattgggcaagcgtaaagaaagatttgattagttacggtggaggatggaggctttccgcccagtggcaaaaaggtgaagaagtgcaagtgatagctgtcgagccaggcaaaaaccccaaaaatttccaaaccatgcctggaatattccaaaccactaccggagagataggggcaatagcacttgattttaagcctgggacttctggcagcccgataattaatcgagagggaaaggttgttggactttatgggaatggagtagttaccaaaaacggtggttatgtatcggggatcgcgcagacaaatgctgaaccagatgggcccactcctgagctggaagaagaaatgtttaagaaacggaatttaaccataatggatttgcacccgggaagtggcaagaccagaaagtatttaccagcaatcgttagagaagcaattaagcgcaggcttaggacattaattctagctccaaccagagtagttgcagctgagatggaagaggctctgaagggcttgccaattagataccagacgaccgctacaaaatcggaacatacaggccgcgagatcgtagatctgatgtgtcatgcaacattcaccatgcggttattatcaccagtacgagtaccaaactacaacttagtaattatggatgaagctcactttacggaccctgctagtatcgctgcaagaggatacatatcaacacgggtcggaatgggagaggctgctgccatatttatgacagcaactcctcctggaacagctgaggcattcccgcaaagcaatgctcccatacaagacgaagaaagagatattcccgaaagatcatggaactcaggaaacgaatggatcacagattttgtaggaaaaactgtgtggttcgtaccctcaataaaggccggtaacgatatcgcgaattgtctgaggaaaaacggaaagaaagtaatacaactatcaaggaaaacatttgataccgaatatcagaaaacccgactcaatgactgggactttgttgtaacaactgatatcagtgaaatgggagccaacttcaaggcggatcgcgtgatagatccgaggagatgtttaaagcctgttatccttacagatggacccgaacgagttatcctggctggcccaatgcctgtgacagccgcatcggctgcccaacgacgaggacgcgtaggaagaaatccacaaaaagaaaatgatcaatatatattcactgggcagccactcaacaacgatgaagatcacgctcactggacggaagcgaagatgttacttgataatataaacaccccagaaggtataattccagcgttgtttgaacctgaacgagagaagtcggcagcaatcgacggggaataccgattaaaaggggaatcaagaaaaactttcgtagagcttatgaggagaggagatttacccgtatggttggcacacaaagtcgcatcagaaggtatcaaatatacggatcgaaagtggtgtttcgatggtgaacgaaacaaccaaattctggaggagaacatggatgtggaaatatggacaaaagagggagaaaggaagaaactaagaccaagatggctcgatgcaagaacttatagtgacccgctggcacttaaagagttcaaggattttgctgcggggagaaaatcaatcgcattggaccttgtcacagaaattgggcgtgtaccgtcccacctggctcatagaacacgcaacgcgcttgacaatttagttatgttacacacatcagaacatggaggacgggcttaccgtcacgcagtcgaagaactgccagaaaccatggagaccttactactattaggtcttatgatcctacttaccggcggtgcaatgctctttctaatctctggcaaaggtatcggtaaaacgagcataggtctaatctgtgtaatcgtcagtagcgggatgttatggatggcagacgtaccgttacaatggattgcttctgctatcgttctagaatttttcatgatggtattactaataccagaaccagaaaagcaaaggacacctcaagacaaccaacttgcatatgtggttatcggaatattaactttagcagcaatcgtcgcagccaacgagatgggcttattagaaaccacaaaacgagacctcggtatgagtaaggaacccggagtagtatccccaaccagctaccttgatgtggatctacatccggcttcagcgtggacactatacgcagtagctacaacagttattacgccaatgctacgacacacgatcgaaaattccacagctaatgtatccctagcggctatagcaaatcaagcagtcgtacttatgggattagataaaggatggccaatcagtaaaatggatctcggagtacccttacttgcgcttggctgctacagtcaagttaatccattgaccctaactgccgccgtcttattattagtaactcactacgctataataggaccgggtctccaggctaaagcgactcgggaggctcaaaaacgaactgcagccggaataatgaagaatccaacggtggacggaatcatgacaatagacttagacccggttatatacgacagcaaatttgaaaaacaattaggacaagtaatgctattagtgctatgtgcagtgcagctattacttatgagaacttcatgggccttatgcgaagcactaaccctagctacagggccaataactaccttatgggaaggttctccaggaaaattttggaatactaccatcgcagtgagcatggccaacatattccgagggtcgtatcttgcgggggcaggactagcattttctataatgaaatctgtaggaacgggtcgacgtggtactgggtcacaaggtgaaactcttggcgagaagtggaagaagaaacttaatcagttatcccgaaaagagttcgacttatataagaaaagcggcattacagaagttgatcgaagtgaagcaaaggaaggattgaaaagaggggaaactacacatcacgctgtatcacgaggtagtgcaaaattacagtggtttgtagagagaaacatggtaatacctgagggaagagtaatcgatttaggttgtgggagaggaggatggtcgtattattgtgcggggttaaagaaagtgacagaagtcaggggatatacaaaaggcggaccaggacatgaagaacccgttcctatgtctacatatgggtggaacatagtgaaactaatgagtggcaaagacgtcttttacctacctcctgaaaaatgtgatacattactatgtgacataggggagtcatcaccttcacctactgttgaagaaagtagaacaatccgcgtattaaaaatggtagaaccatggctgagaaataaccaattttgtatcaaagtattaaatccctacatgcctaccgtaattgagcacttggaaaggctacaacgaaaacacggaggaatgctagtgaggaatccactttcacgaaattcaacacatgagatgtactggatttcgaatggaacgggaaatattgtttcatcagtaaatatggtaagtaggcttctactgaaccgatttaccatgacacacagaagacctactattgaaaaggatgtagacttgggtgcaggaacaagacatgtcaacgcagagccggaaacacctaacatggacgtaattggcgaaaggataaaacggatcaaagaggagcattcttcgacgtggcattatgatgacgagaatccatacaaaacatgggcataccacggctcttacgaagttaaagcaaccggttctgcatcaagtatgataaatggtgttgtcaaattattgacaaagccatgggacgtcgtcccaatggtcacccagatggccatgacagacacgaccccctttggacaacagagggtatttaaggagaaagttgacacacgtacacctcggccgatgccagggactagaaaagtcatggaaattactgcagaatggttgtggcgaacactcggacgaaataagaaaccacgcctgtgtacacgtgaagagtttaccaagaaagtacgtactaatgccgcgatgggggcagtgttcacggaagaaaaccaatgggatagcgcacgtgccgccgtggaggatgaagagttctggaaattagtcgataaagaacgggagttgcataaattaggaaaatgtgggagttgcgtatataacatgatggggaaaagagagaagaaactaggagaatttggcaaagcaaaaggatcaagggctatttggtatatgtggctaggagcccgatatttagaatttgaagcattaggctttcttaatgaagaccactggttcagtagagaaaactcctactctggggtagagggggaaggcctccataaattaggatacattttacgggatataagcaaaataccgggcggggcgatgtacgcagatgacactgctggttgggatacgcgcataactgaggatgacctacataacgaagagaaaattactcaacagatggaccccgagcacaggcagctcgcaaatgcgatatttaaactaacgtatcaaaacaaagtggttaaagtacagcgaccaaccccaaagggtactgttatggacataatctcccgaaaggaccaacgcggaagcggacaagttggaacatatggtctgaatacatttacaaatatggaagctcaattggtcagacaaatggaaggtgaaggtgtattgtcaaaggccgatctagaaaatccccatttacttgagaagaaaattattcaatggctcgaaactaaaggagtagaacgattaaaaaggatggcgatttcgggggacgattgtgtggtaaaacccattgatgatagattcgcgaatgcattattagccctcaacgatatgggtaaagtaagaaaagatataccacaatggcaacctagcaagggctggcatgattggcaacaagtccctttttgcagccatcatttccacgaactaataatgaaggatgggagaaaactcgtagtaccatgtcgaccacaagatgaactgattggacgagccagaatctctcaaggcgctggatggtctttaaaggaaacagcatgtctaggaaaggcttatgcccaaatgtggagtctaatgtacttccataggcgtgacttgaggctagcatccaacgctatatgcagtgctgtcccggttcattggatccctacatcacgtactacatggtcaatacacgcgcatcaccagtggatgaccactgaggatatgctgagcgtatggaatagagtttggattgaagataatccatggatggaagataaaacaccagtgacaacatgggaagatgtcccgtatttaggtaaacgggaggaccagtggtgcggatcgctcatcgggctaactagccgtgctacatgggcgcaaaatatcttaacagcaatacaacaggtcagatctctaataggagacgaagagttcttagattatatgccttcaatgaaaaggtttcgcaaagaagaagaatcagagggtgcaatttggtaa

SEQ ID NO: 23125 - RNA, 9873 nt, synthetic construct
  misc_feature 1..9873: note = derived and/or modified CDS sequence (opt6) from DENV-3__FJ639714__SS-prME
  source 1..9873: mol_type = other RNA
acgtcattatgtctcatgatgatgctgcctgccacattagctttccacttgaccagccgcgatggagaaccccgaatgatagtagggaaaaacgaacgaggaaaaagtttattatttaaaacagcaagcggaataaatatgtgtacattgatagcaatggacttgggggaaatgtgtgatgatacagttacatataaatgcccacttatcgccgaagtagaaccagaagatatagactgctggtgcaatttaacaagcacatgggttacttatgggacttgcaatcaagcaggcgaacaccgaagagataaacgtagcgttgctctcgcaccccatgtaggaatgggcctcgatacccgaacgcaaacatggatgtcggctgaaggggcttggagacaagttgaaaaagtggaaacatgggctctacgacaccccggatttacgatattagcactatttttagcacactatataggcacaagtctaacacaaaaagtagtcatctttatattgctaatgttagtgaccccatcaatgacaatgcgttgtgtaggagtgggcaaccgcgattttgtcgaaggactatcaggggcaacatgggtagatgttgtgctagaacacgggggttgtgtaacgacaatggcaaaaagtaagcccacactagatatagaactacagaaaactgaagcaacccaacttgctactttacgtaaactctgtattgaagggaagattacaaatatcacaactgattcgcggtgcccgacacaaggagaagcaacactgccagaagaacaggatcaaaattacgtttgcaagcatacttacgtcgataggggatggggaaacggatgtggcctctttggtaaaggaagtctagtaacgtgcgctaaattccaatgccttgagcccatagaaggaaaagtagtacagtatgaaaacctcaaatatacagtcattataacagtacatactggggatcaacatcaagttggaaacgacacacaaggcgttacggttgaaataactccacaagccagtactgtggaagctgtgttacctgaatacggtactttaggtttagaatgcagtccgcgaacgggactcgattttaatgagatgatactgctcacaatgaagaataaggcttggatggtacataggcaatggttctttgacttacccttgccttggacaagcggggcgacgacggaaacaccaacttggaatagaaaggaattacttgtaacattcaagaacgcgcatgctaaaaagcaggaggtggtggtcttgggatcacaggaaggagccatgcatactgcgcttacaggagcaactgaaattcaaaattcaggaggtacaagtatatttgctggacaccttaaatgtcgattaaaaatggataagctggaactaaaggggatgagctacgcaatgtgcttgaatacttttgtacttaagaaagaggtgagtgaaacccaacatggaacgattctaattaaggtggagtacaaaggggaagatgcaccctgtaaaataccattctcaacggaagatggacaagggaaggcccacaacggacgacttattacggccaacccggtagtaaccaagaaagaagaaccggtgaatattgaagcagagccgccctttggggagagtaacattgtaattggtatcggagataaggcactaaaaataaattggtataagaaaggaagctccatagggaaaatgtttgaggcaaccgccagaggagctcgaaggatggcaatattaggagatactgcttgggatttcgggtcagtaggtggagtactaaattcactaggtaaaatggttcatcaaatatttggatctgcttatactgctctattttctggagtatcatggattatgaaaattgggatcggagtacttttaacgtggatcggacttaatagtaaaaatactagcatgtcattcagctgcatcgtgataggtattattactctatatctcggagcagtagtacaagccgacatgggatgcgttataaattggaaagggaaagagctaaagtgcggaaatggaatctttgtaacaaatgaagtacatacttggactgagcaatacaaatttcaagccgactcccccaaaagacttgcgacagcaattgccggagcatgggaaagcggagtatgcggaattagatcaacgaccaggatggaaaacctgctatggaagcaaattgcaaatgaattaaattatattttatgggaaaataacataaaactaactgttgtggtaggggatataataggagtcttagagcaaggaaaaagaactttaacccctcagcctatggaacttaagtattcgtggaaaacgtggggcaaagcgaagatcgtgacagcggaaacgcagaactcatctttcataatagatggacctaacacacctgaatgtccaagtgcatctcgagcatggaacgtctgggaagtcgaggattacggatttggtgtatttacaacgaatatatggttaaaacttcgagaggtatatacacagtcgtgcgatcatagactaatgtcagccgcaataaaagatgaacgggccgtccatgctgatatgggctattggatagagtcccaaaagaatgggtcatggaagctagaaaaggcttcctttatagaggtcaaaacatgtacttggccaaaatcgcacacgttatggtcaaatggtgttctcgaaagtgatatgataattccgaagtcactagctggtccgatatctcaacataatcatagacctggatatcatacccaaacagcgggtccatggcatctaggaaaattggaattagatttcaattattgtgagggcactactgtggtaatcgccgaaaattgtggcactagaggaccatcacttaggactactacagtatccggcaaacttatacatgagtggtgttgcagatcatgcactttgccgccattaagatatatgggtgaggatgggtgttggtacggcatggaaattagacccataaatgaaaaggaggaaaacatggtaaaaagccttgtcagtgcaggcagcggtaaggtcgacaatttcaccatgggcgtgctatgtttagctatattgtttgaagaagtaatgcgaggtaaatttgggaagaaacatatgatagcaggagttctattcactttcgtactactactatcaggacaaatcacgtggagagatatggcacacacactaataatgatcggtagtaacgcttctgataggatgggaatgggggttacatacctcgcactaatagcaacgtttaaaatacaaccgttcttagcattaggattcttcctcaggaaattaacatcaagggagaatttactccttggggtaggtcttgcgatggcaactactttacaattgccagaagatatagaacaaatggctaacggaatagctctgggcctaatgaccctaaaactaataacccaattcgaaacgtatcagctttggactgctttagtaagtttaacctgtagcaacacaatctttactttaaccgtagcatggaggacagcaactttaatattggcaggagtatccttgctacctttatgccagtcttcaagcatgaggaaaacagattggttacccatgacggtagcagctatgggggttccgccattaccgttgtttatattttcattaaaagacacacctaaaaggcggtcctggccactaaacgaaggggtaatggcggtagggctggtaagcattctggcgtcgtcgctactgagaaatgacgttccaatggcaggaccgttggtggccgggggtctattaatcgcgtgttacgtaattaccggaacatcagcggaccttaccgtggaaaaagcggcggatgtcacatgggaggaagaagcagaacagacaggagtatcgcataacttaatgatcacggtagatgatgacggtacgatgcgaatcaaagatgacgaaactgaaaatattcttacagtcctgctaaaaactgccctactaatagtatcagggatatttccatattcaattccagcaaccctacttgtctggcatacttggcaaaaacaaacacaaagaagcggagtactttgggatgtccctagcccgccagaaacgcaaaaagccgaacttgaagaaggtgtttacagaataaaacagcaaggaatctttggaaaaactcaagtaggagtcggagttcaaaaagaaggcgttttccatactatgtggcacgtcactagaggcgcagtgttaacacataatggcaagcgattggaacctaattgggcatcagtaaagaaagacctaataagctacggagggggatggcgactcagtgcgcaatggcaaaaaggcgaggaagttcaggtaatagcggtagaaccaggcaaaaatccaaagaattttcaaacaatgccgggaatcttccagactactactggtgaaataggcgcaatcgcactagactttaagcccggaacatcaggttctcccatcattaatcgggaaggcaaagtggtggggctgtacggtaacggcgtagttactaaaaatggagggtatgttagcggcattgcacagacgaatgctgagcctgatggtccaactcccgaattagaggaggagatgtttaagaaacgaaacctcactatcatggatcttcaccctggatcgggcaaaacaaggaaatatctaccagcaatagtgagggaagcaataaaacgtagactaaggacattaatactggcaccaactcgagttgttgcagccgaaatggaagaagccttaaaaggactcccgatacgatatcaaaccacggccactaaatcagagcacactggtagggaaattgtcgacctaatgtgtcacgcaacgttcacgatgagattactctcacccgttcgtgtaccaaactataacttagtgataatggatgaagcacattttacggatccggcctcaatagcagcaaggggatacatatctaccagggttggaatgggtgaggcagctgcaatttttatgacagccaccccacctggaacagccgaagccttcccacaatcaaatgctcctatacaagatgaagaacgcgatatccccgagcgttcgtggaatagcgggaacgagtggataacagattttgtgggaaaaacggtctggttcgttccatccattaaagcgggcaacgatatagcaaattgcctgaggaaaaacggcaagaaagtcatacagctatcaagaaagacatttgacacagaataccagaaaacaagactcaacgactgggattttgtagtaacaacagacattagcgaaatgggagcgaactttaaagcagatcgagtaatcgatccaagaagatgccttaaacctgtaatacttacagatggccccgagcgagtaatcttggctggaccaatgccagttacagccgcctctgcagcacaacggagagggagagttggccgaaatccccaaaaagaaaacgaccaatatatttttactggacaaccactcaataatgatgaagatcacgctcattggacagaagctaaaatgctattagataatataaacacaccggaggggattatacccgccttattcgaaccggaaagagaaaagtcggccgcaatcgatggtgagtataggttgaaaggagaatcacgcaagacctttgtagaattgatgaggcgaggtgacttacccgtctggttagcacacaaagttgctagcgaaggcattaaatatacagacagaaagtggtgtttcgatggggaacgtaataaccaaatattggaagaaaatatggacgtggaaatatggacaaaggagggtgaacgaaagaaactcagaccacgatggctggacgcaaggacatattcagaccctttagctttaaaggaatttaaagatttcgctgcaggcagaaaatcaatagcattagatttggtaacagaaataggacgggtacccagtcacttagcacaccgaacgagaaatgcgcttgacaatctagtaatgctacatacgagtgaacatggcggtagagcgtatcgacacgcagttgaagaactaccagaaacgatggaaacattacttttattgggcctaatgatactactaacaggcggagccatgctatttctaatatcagggaaaggaattggaaagacaagtattggattgatctgcgttatagtatcttccggaatgctatggatggcagacgtaccactgcagtggattgcatctgcaatcgtacttgagttctttatgatggtactactaattcccgaacccgaaaagcagcggacaccccaagacaatcaacttgcgtatgttgtaataggaatactaacattggcagctatcgttgcagcgaatgaaatgggattgttagaaaccactaaaagagatttaggtatgagcaaagaaccaggggtagtatcaccaacaagttatctagacgtagatttacatcctgcatcggcgtggacattatatgctgttgcaacgaccataattacacctatgttaagacatacaatcgaaaatagcaccgcaaacgtttcacttgcagccatagcaaatcaggccgtagttctaatgggactggataaagggtggccgatttctaaaatggacctgggagtccctttattagctttgggttgttattcccaagtcaacccattaacattaactgcagccgtattactcttagtaacacactacgcgattattggtcctgggctacaagccaaagcgacaagggaggcgcagaaaagaacggcagcaggaataatgaagaaccctacagtggatggcataatgactatagacttagatccagtgatatatgattcaaagttcgaaaaacaattgggccaagtcatgttgctcgtactgtgtgcggtgcaattacttctaatgagaacctcatgggcattatgtgaggcgctgaccctagctactggaccaattacgactctatgggaagggagcccaggcaagttttggaacacaacaatagcggtgagcatggcgaacatattcagggggagttaccttgcaggagccggtttggccttctcgataatgaaatcagtagggactggacgaaggggaacaggtagtcaaggtgaaacgttaggcgaaaagtggaagaagaaattaaatcagttatcaagaaaagagttcgacctttataagaaaagtggaataaccgaagtcgaccgaactgaagcaaaagaaggattaaaacggggagaaacaacacatcatgcggtatcacgaggaagcgcaaaactacaatggttcgtcgaaagaaatatggtgattccggaaggtagagtgatagatctcggctgtggacgaggtggatggtcttattattgtgcaggcttaaagaaagttaccgaagtacggggatacacgaaaggcggcccgggacacgaagaaccagttcccatgagcacctatgggtggaacattgttaaattaatgtcaggaaaagatgttttctatttaccaccagagaaatgtgacacgttactttgtgacataggggaaagttcaccgtcaccaacagtcgaagaatcaagaacaatacgagtattaaaaatggtagaaccttggctccggaataatcaattttgtataaaagtcttaaatccctacatgccaaccgtaattgagcatttagaaagactccaacgcaaatatggaggaatgcttgtacgaaatcccttgtcaagaaattcaacacatgaaatgtactggatctcaaatggaaccggaaatattgtcagttctgttaatatggtctctcgattactccttaaccgattcacaatgacacatcgccgacctacgatagaaaaagacgtagatcttggagccggaacgagacacgtaaatgcagaacccgaaacacctaatatggatgttataggggaaaggataaaaagaattaaggaagaacatagtagtacatggcactatgacgacgagaatccttacaaaacatgggcatatcatggttcctacgaagtaaaagcaacgggcagtgccagttctatgataaacggtgttgtaaaactgctgacaaaaccgtgggatgtggttccgatggttacgcaaatggctatgaccgatacaacacctttcggtcaacagagggtctttaaagaaaaagtagataccagaactccccgaccgatgccaggcactagaaaagttatggaaataacagcagaatggttatggcgaaccctcggtcgaaacaaaaagcctagactatgtacgagagaagagttcaccaagaaagttagaaccaatgctgcaatgggtgcggttttcacagaagaaaaccaatgggactctgcgagagctgccgtggaagatgaagagttctggaaattagttgataaagaaagagaattacataagctggggaaatgtggaagttgtgtgtataacatgatgggaaaacgggagaagaaactcggcgagtttggcaaagcgaaggggtcccgtgccatatggtacatgtggctaggcgcaagatatctagagtttgaagcattaggtttccttaatgaagatcactggttttctagagaaaattcttacagcggagtggaaggagaaggccttcataagctaggatatatactcagggatatatctaaaataccaggaggtgccatgtacgccgatgataccgcgggttgggataccagaataactgaagacgatttacataacgaagagaaaataactcagcaaatggatcctggccatagacaactcgcaaatgcaatattcaaactgacgtaccagaataaagtcgtgaaggtgcagcgcccaaccccaaaaggtacagtaatggatataatatcgaggaaagaccaacgcgggtcagggcaagtaggaacctatggactaaacacgttcacaaatatggaggctcagttggtacgacaaatggaaggcgagggagtgttgtctaaagctgatctcgagaatccgcatctattagagaagaaaattacgcaatggttagaaacaaaaggggtcgagagactgaaacgaatggctataagtggcgatgactgtgtagtaaaacccatagatgatagatttgccaacgcgttactggccctaaatgatatgggaaaagttcgtaaagatatcccacagtggcaaccgtccaaaggctggcatgactggcaacaagtaccattctgtagtcatcattttcacgaacttattatgaaagatggtaggaagctagtggtaccatgtcggccacaggacgaacttatcggtagagcaaggattagtcagggtgcggggtggagtttaaaagaaactgcatgtctcggaaaagcatatgcgcaaatgtggagtttaatgtactttcacagacgtgatttaagactggcaagcaacgcaatctgtagtgcagtgcctgttcactggatccccacgtccaggacaacttggagtatccatgcacatcaccaatggatgacaaccgaagatatgctgacggtatggaatagggtttggatcgaagataacccgtggatggaagataaaacgccagtaaccacctgggaagacgtaccatacttgggtaaaagggaagatcaatggtgcggatccttaataggactaacgtcccgggctacatgggcccaaaatattttaacagctattcagcaagtgaggtcactgataggtgacgaggagttccttgactatatgccaagtatgaaaagattcagaaaggaagaggagacagagggagcaatatggtag

SEQ ID NO: 23126 - RNA, 9873 nt, synthetic construct
  misc_feature 1..9873: note = derived and/or modified CDS sequence (opt6) from DENV-3__FJ639715__SS-prME
  source 1..9873: mol_type = other RNA
acgtctctttgccttatgatgatgttacctgcaacattagcattccatttgaccagtcgagatggagaaccacgtatgatcgtaggcaaaaacgaaagaggaaaatcattgctttttaaaacagcaagtggtataaatatgtgtacgcttatagcaatggatttaggagaaatgtgcgatgacacagtgacatataaatgccccttgatagctgaagttgaaccggaagatatagactgttggtgtaatttaactagcacgtgggtaacgtacggtacatgcaaccaagcaggcgaacatcgaagggataaaagatcagtggcactcgcgcctcatgtgggaatgggccttgacacgagaactcaaacttggatgagtgcggaaggggcatggagacaagtagaaaaagttgaaacctgggccttacggcatccggggtttacaattctagctctatttttagcgcactatataggaacaagtctaacacagaaagttgtcatatttatcttactaatgctagtaacaccgagtatgacaatgcgatgcgtcggtgtcggaaatcgtgatttcgtagaaggattgagtggagcaacgtgggtagacgtagtactagaacatggcgggtgtgtaactactatggcaaaaagtaaaccaacactagatattgaactacagaaaactgaagcaactcaactcgctactttaagaaaattgtgcattgaaggaaaaataacaaacattacgaccgacagtaggtgtcctacacaaggagaggccacacttccggaagaacaagaccaaaattatgtctgcaaacacacatatgtcgacagaggatggggaaacggctgtgggctctttgggaaaggttcacttgttacctgtgcgaaattccaatgcttggaaccaatagaaggaaaagttgtacaatacgaaaatttgaaatatacagtgattataaccgtgcatacaggtgatcaacatcaagtaggaaatgatacacaaggagtaactgtcgaaattacgcctcaagcctccacagtggaggcggttttacctgaatacggcacgttagggctcgaatgcagcccgcgcacaggtctggacttcaatgaaatgatattgctgacaatgaaaaataaagcgtggatggtacacagacaatggttctttgatctgcctctcccttggacaagtggtgcaactaccgaaacgccaacgtggaatagaaaagagttattggtaacatttaaaaatgctcatgctaagaaacaagaagtcgtagtattgggaagccaagagggcgccatgcacacggccctcacaggggcaacggaaatacaaaatagtggaggtacaaatatttttgctggacaccttaagtgtaggttaaaaatggacaaacttgagttaaagggaatgtcttacgcaatgtgcttgaatacatttgtcctaaagaaagaagtttccgagactcaacacggtaccatcttgattaaagttgaatataagggagaagatgcaccatgtaaaattccatttagcacggaagatgggcaaggaaaagcgcataacgggaggttaattaccgccaacccggtcgtaactaagaaagaggaacccataaatattgaagcggagccgccctttggagagtctaacattgtaataggcattggggataaagcattaaaaataaattggtacaagaaaggcagcagcataggtaaaatgtttgaagcaacagcaagaggagccagaagaatggcaattctcggagacactgcatgggacttcggatcggtcgggggagttttaaatagtctcggaaaaatggtccatcaaatttttggaagcgcatacaccgcactattttcgggagtcagttggattatgaaaatcggtattggcgtactactcacttggataggactaaattcgaaaaatacaagtatgtctttttcctgtatagttattggaataatcacactttatttaggagctgtagtccaagcggacatgggctgtgtaattaactggaagggaaaagagttaaaatgcggaaacggaatttttgtaacaaatgaggtacacacgtggaccgagcaatataaattccaagcagacagccccaaacgattagctacagctattgccggagcgtgggaaaacggtgtatgcggaatcagaagcacaacacgcatggaaaatctattatggaaacagatagcaaatgagttaaactacatcttatgggagaataatataaaacttacggttgtagtaggcgacataataggcgtattagaacagggtaaaagaactctaaccccgcaaccaatggaactgaaatactcttggaagacatggggcaaagcaaaaatagttaccgctgagacccaaaattcgtcattcataatcgatggacctaacacacctgagtgtcctagcgcttctcgagcatggaatgtgtgggaagtcgaagattacggatttggtgtttttactacgaacatctggctaaagctacgagaagtctatacacaatcatgtgatcatagactgatgagtgccgcaataaaggatgagagggccgtgcacgcggatatgggttactggatcgaaagtcagaaaaatggctcctggaaattagagaaagcatcatttatagaagttaagacatgcacttggcccaaatcacacacactatggtcaaatggagtgctggagtccgatatgataataccaaaatcattagctgggccaatatcacaacataatcaccggcctggttaccatacacagacagcaggaccatggcacttgggtaaactagaattagatttcaactattgcgaaggtacgacagtagtgatagcagaaaattgcgggactagagggccatcactacgaactacaacagtgagcggaaaacttatacatgaatggtgttgccgcagctgcaccctaccgcctttacgatatatgggtgaagacggttgttggtatggaatggaaattagacccataaatgaaaaggaagagaacatggtaaagagcttagtgagtgcaggaagcggtaaagttgataattttactatgggtgtactatgtctagcaatattattcgaagaagtaatgaggggaaaattcggaaagaagcatatgatcgccggtgtactatttacatttgtattattgttgtctggccaaataacatggcgggatatggcgcatacactaataatgataggatccaatgcatctgatagaatgggtatgggtgtaacctacctcgcactcatagcaacatttaaaatacagccttttctcgcccttggattctttctccgaaagctaacaagtcgagaaaacctacttttaggtgtaggacttgcaatggccacaacactacaactaccagaggacatagaacaaatggcgaatggcatcgccctgggtcttatgacattaaaattgattacccaatttgaaacctaccaattatggacagcgttagtatctctgacctgttcgaatactatattcacattgacagtcgcatggagaacagctaccttaatcttagcaggcgttagcctcctccctctctgtcaatcatcaagcatgcgcaaaacagattggttacctatgaccgtagctgcaatgggcgtaccgcctctgcccctgttcatattttcattgaaggatactccgaaacgaaaaagttggcccctaaatgaaggcgttatggcggtaggcttagtttcaatactggcaagcagcttactacgcaatgatgtcccaatggcaggtccacttgtcgccggtggtttattaattgcttgctacgttatcacagggacaagtgctgacctaacagttgagaaggccgcagacgtaacgtgggaggaagaggccgaacaaactggagtaagccacaatttaatgatcaccgttgacgacgatggtacaatgaggataaaagatgacgaaacagaaaacatacttacagtgttactaaaaacggcacttttaattgtaagtggaatattcccttactctatacccgcaacgctattggtttggcatacatggcaaaaacaaactcagagaagtggggtattgtgggacgtaccctccccgccagaaactcaaaaggcagagctagaagaaggcgtataccgaattaagcaacagggcatcttcggaaagacacaagtgggagtgggtgtgcaaaaagagggggtatttcatacaatgtggcatgtgactcgtggagccgtacttacacataatggcaaaagattagaaccaaattgggcctctgtcaagaaggatctaatttcatacggtggtggctggcgactaagtgcacaatggcaaaaaggcgaagaagtgcaagtaatcgcagtagagcccggtaaaaatcccaaaaattttcagaccatgccgggaatcttccaaacaacgacgggtgaaataggagcaattgctttagatttcaagccgggaacaagtgggtctcccataataaatagggaaggcaaagtcgtggggttgtatggaaatggcgtagtcactaagaacggtggctatgtgtcaggcattgcacagacaaatgccgaacctgatgggcccacaccggaactcgaggaagaaatgtttaagaaacgaaatctaactattatggatttacatccaggtagtgggaagactcgcaaatatctcccagcaatcgtgcgagaagccatcaaaagaagactaaggacactcattttggctccaacgagggttgtcgctgcagaaatggaagaagctctaaaaggtttgccgataagatatcagacgacagcaacgaaaagcgaacatacaggaagagaaattgtcgatctaatgtgccacgcaacatttaccatgagattgttatctcccgtaagagtccctaattacaacttaataattatggatgaagcccatttcacagatcccgcctcgattgcagctagagggtatatatctactcgagtaggaatgggtgaagccgcagcaatttttatgacggctacaccacctggtacggctgaggctttcccacaatctaatgcacctattcaggacgaagaaagagatataccagagcggagttggaatagtggaaatgaatggatcactgatttcgttggtaaaacagtatggtttgttccctctataaaagcaggtaatgatattgccaattgtctccgtaagaatggcaagaaagtcatccaactcagtagaaaaacattcgatactgagtaccaaaagacaaggttgaatgactgggacttcgtcgtaacaacagacataagtgagatgggggcaaatttcaaagccgatcgagtaatcgatcccagacgatgtctcaaaccagtaatattaacggacggtccagaacgagttatattagcaggtcctatgcctgtaacagcggcctcagcggcccaaagacgtgggagagttggccgaaacccgcaaaaagagaacgatcaatatattttcacagggcagccattaaataacgatgaagatcacgcacactggactgaagctaaaatgctactcgataatattaatacgccagaaggaataataccggctttgtttgagccggaaagggaaaagtcagccgctatagacggtgaatataggttaaagggagagtcacgcaaaacctttgtagagttaatgagaagaggagacttaccagtctggttagcacataaagtagcgtctgaaggcattaaatacactgacagaaaatggtgctttgacggagaaagaaataaccagatattggaagagaatatggacgtggagatatggacgaaagaaggggagcgaaagaaattacgaccgagatggctagacgccaggacatacagcgatcctttggctttaaaagaatttaaggattttgctgccggacggaaatcaatcgctttagacttggttacagaaataggacgagttccatctcaccttgcgcataggacacgaaacgcattagacaatctagtaatgctacataccagcgagcatggtggtagagcgtatcgccacgcagtggaagaactaccagagactatggaaactttattactattaggcctcatgattttattgacgggcggagcaatgctatttctaatatcaggtaaaggaattggtaagacaagtatcggactcatttgtgtcatcgtgtcttcaggaatgttatggatggcggatgtaccactacaatggatagcaagtgctatagttctagagttctttatgatggtgctactaataccagagccggagaaacaaagaacgccacaagacaatcaactagcttatgtagtaataggcatattaaccctggcagccatagtagctgcaaatgaaatggggttattggagacgacaaagagagacttaggaatgagtaaagaacccggggtagtatctcctactagctacttggacgtcgaccttcatccagcttctgcttggacgttatatgcggtagctaccaccgtaatcactccaatgttgcggcacacaatagaaaattcaaccgcgaacgtatctcttgctgcaatagcgaaccaagcagtggtcttaatgggattagataaaggttggcccatcagtaaaatggatttaggtgtacccctcctagcgttagggtgctattctcaagtcaaccctttaacgttaacggcagctgttttgttattagtgacacactatgccataataggtcccggactacaggcaaaagcaacacgggaagcacagaaaagaaccgccgctggtatcatgaaaaatccaactgtagatggcatcatgacaatagacctagatcctgtgatatacgatagcaagttcgaaaaacaattaggccaggtaatgctattagtgctctgcgcagtccaactgttactcatgagaactagctgggctctatgcgaagccctaacgctcgctaccggcccaataacaactttatgggaaggaagtccaggcaagttctggaacacaacaattgcagtgagtatggcaaacatttttagagggtcatacttagcgggcgcaggtctagccttcagcattatgaagagtgtagggacggggagaagaggaacgggttctcaaggagaaacactcggtgaaaaatggaagaagaaactgaaccaactgtccagaaaagagttcgatttatacaagaaatcaggaataacagaggttgataggacagaagcaaaagagggattgaaacgcggagagacaacccatcacgccgtatcgagaggctccgcaaagttacagtggtttgtcgaacgaaatatggtaataccggaaggaagagtaatcgatctcggctgtggccggggagggtggtcatattactgcgcagggcttaagaaagttactgaagttcgaggttatactaagggaggaccaggtcatgaagaaccagttcccatgagcacatacggctggaatatagtaaaacttatgtctgggaaagacgttttctacctaccaccggaaaaatgtgataccttgttatgcgatatcggggaaagttctccgtcaccaacagtcgaagaaagtcgaacaattagagtattaaaaatggtggagccatggctaagaaacaaccagttttgtattaaagtgctaaacccttatatgccaaacgtaatagaacatctcgagagactccaaagaaagtacggcggcatgctggttagaaaccccctctcaagaaactcaacacatgaaatgtattggatatctaacggcaccggaaacatagtaagttcagttaatatggtatcacgcttgttactaaatcgctttacaatgacacatcgaagaccgacaattgaaaaagacgttgatctaggtgcaggtacgcgacatgtaaatgcagaacccgaaacacccaatatggatgtaataggcgaaaggatcaaaagaataaaagaagaacattcatcaacatggcattatgatgatgagaatccatacaaaacatgggcttatcatggatcgtacgaagtaaaagcgacaggctccgcatcctcaatgattaatggagttgttaaactacttactaagccgtgggatgtagtaccgatggtgacccaaatggccatgacagatacgacccccttcggacaacagcgtgtatttaaagaaaaagttgatacacgtacaccgcgtccgatgccaggtacaaggaaagtaatggaaattactgcagagtggctttggcgaacactcggacgtaacaagaaaccgcgactctgtacacgggaggagttcactaagaaagttaggacgaacgcagcaatgggcgctgttttcacagaagaaaatcagtgggattcagctagggcggctgtagaggatgaagaattttggaaacttgttgataaagaacgcgaattacataagttgggtaaatgcggtagctgtgtgtacaatatgatgggcaaacgagagaagaaactaggagagttcggcaaagcaaaaggatctcgggcaatctggtacatgtggttaggggctagatatctggaatttgaggcattaggctttcttaatgaagatcactggttttctagagaaaattcatactcaggagttgaaggtgagggtctccacaaacttggatacatattacgagatataagtaaaatcccgggaggagcaatgtatgccgatgatacagctggttgggatacaagaattactgaggatgatttacataacgaggagaaaattacgcaacaaatggacccggaacacagacagttagcaaacgccatatttaaactaacataccaaaacaaagtagttaaagtgcaacgtcccacaccaaaaggtacagtaatggacataatatcgagaaaagaccaacgaggtagcggccaggtcggaacttacggattaaatacctttactaacatggaagctcaattggtaagacaaatggagggcgagggagtactaagtgaggcagatctagaaaatcctcatttattagagaagaaaataactcaatggcttgagactaaaggggtagaaagattaaagagaatggctatttcgggagacgattgtgtggtaaaaccaatagatgaccgatttgctaatgcacttctagcattaaatgatatgggcaaagtgcggaaagatatacctcaatggcaaccaagtaagggctggcatgactggcaacaagtaccattttgctcccatcatttccacgaactgataatgaaagatgggagaaaattggtggtgccttgcagaccccaagatgagctaataggcagggcgcgaatcagccaaggcgccggatggagcctgaaagaaacagcatgtctagggaaagcatatgctcaaatgtggtctctaatgtatttccatagaagagacttgcggctagcgagcaatgccatttgttctgccgttcccgtacattggataccgacatcccgaaccacctggtcaatacacgcccatcatcagtggatgactacagaagatatgctaactgtctggaacagagtatggatagaagacaatccatggatggaagacaagactcctgtaactacttgggaagatgttccttacctaggaaaacgagaagatcaatggtgcggctctttgatcggattaacttcccgagcaacatgggcacaaaatatattaacggcaatccaacaggttcgcagtttgataggagatgaagaatttcttgattatatgccatctatgaagcgatttcgtaaggaggaagaatctgagggagcaatctggtaa

SEQ ID NO: 23127 - RNA, 9873 nt, synthetic construct
  misc_feature 1..9873: note = derived and/or modified CDS sequence (opt6) from DENV-3__KF955461__SS-prME
  source 1..9873: mol_type = other RNA
acttcgctgtgtcttatgatgatgcttcctgcaacattagcatttcatctaacttcacgtgacggcgaacctcgcatgatagtcggtaaaaacgaaagaggcaaatccctattatttaaaacagcaagtggtattaatatgtgcacactaatcgccatggatttaggagaaatgtgtgatgatacagtgacgtataaatgcccactaatagccgaagttgaaccagaagatatcgattgctggtgcaatttaacaagcacttgggtaacttacggaacgtgtaatcaagcaggagaacatagacgagataaaaggtcagttgcacttgcaccacatgtcggaatgggtttagatacaaggacccaaacatggatgtcagcagaaggcgcatggcggcaagtagagaaagttgagacgtgggctctacgacatccaggttttacaattttagcgctttttctagcacattatatcgggacgtctcttacgcaaaaagttgtaatatttatcctgttaatgttagtaacgccaagcatgactatgagatgtgtgggagttgggaacagagattttgtagaaggtttaagcggcgcgacttgggttgatgtagtccttgaacacggaggatgtgttacgactatggctaaaaacaaaccaactctcgatatagaattacagaaaactgaggcaacgcaactagcaacgttacgtaaattgtgtatagaaggtaagatcacaaatatcaccactgatagcagatgtccaactcaaggagaagcaacattgcccgaagaacaagaccaaaattatgtatgcaaacacacgtacgtagatcgtggatgggggaacggatgtggtctatttggcaaaggatcactcgtaacatgtgccaaattccaatgcctcgagccgatagagggtaaagtagttcagtatgaaaacctaaaatatacagtaatcataactgtacacacaggagaccagcatcaagtagggaatgatactcagggagtaacagttgagattacaccccaggcttccacggtagaagctgtactacccgagtatggaacattaggattagaatgtagccctagaactggcttagattttaacgaaatgatacttcttacaatgaaaaataaagcctggatggttcatcgacaatggttctttgacttacctttgccatggacatctggtgcaactactgagacaccaacgtggaacagaaaggaattattagttacattcaaaaatgcccatgcaaagaagcaagaagttgtcgtattagggagtcaggagggcgctatgcatacagcgttaacaggggcaacggaaattcaaaattccggagggacttcaatatttgcaggacatcttaaatgtagattaaaaatggacaagctagagctaaaaggaatgtcatatgcaatgtgtctcaacacgttcgtcttaaagaaagaagttagcgagacacagcatggaacgatcttaattaaagtggagtacaaaggagaggacgcaccttgcaaaataccgttcagcactgaagatgggcaaggaaaggcgcacaacggaaggttaattacagctaatccagtagttaccaagaaagaagaacccgtaaatatagaagcagaaccccctttcggcgagtcaaatatagtgataggaattggtgacaaagcgttaaaaataaactggtacaagaaaggatcttcaataggaaaaatgttcgaagcaactgcaagaggtgcgagacgcatggcaatactgggagatactgcttgggacttcggatcagtagggggagtccttaacagcttgggaaagatggtacatcaagttttcggaagtgcatacacggcgctcttttcaggtgtatcctggataatgaaaataggaataggtgtgttgttaacatggataggcttgaactctaagaatacgtccatgagcttctcatgtattgtaataggaataataaccctatatttaggggccgttgtacaagcggacatgggatgtgtaattaattggaagggcaaagaactgaaatgtggctccggcattttcgttactaatgaagtgcatacgtggacggagcagtacaaattccaagccgatagtcccaaacgattagccacagcgatagcaggggcatgggaaaacggcgtttgtgggatccgcagtaccacaaggatggagaacttactttggaaacaaatagcaaacgagctaaattacatactatgggaaaataatataaaacttactgtagttgtcggcgatattataggagtgttagagcaaggtaaaaggacgttgacaccacagcccatggagctaaaatactcctggaaaacgtggggaaaagcaaaaattgttacggccgaaacacaaaacagttccttcataatcgatggccccaatacacctgaatgtcctagcgcttcaagagcctggaatgtctgggaggtagaagattatggctttggagtctttactacaaatatctggcttaaattaagagaggtatatacacaaagctgcgatcatcgacttatgtctgctgctataaaagatgaaagagcagtccatgcagacatggggtattggatagagtcccaaaagaatggtagctggaaacttgagaaagcgtcatttatagaagtcaagacctgtacatggcctaaatctcacacgctatggagtaatggcgttctagaatctgatatgataataccaaaaagtctagcaggacccatttcccaacacaaccacaggccaggttatcacacacaaacagctggaccttggcaccttggcaagctcgaactagatttcaattattgcgagggaactacagtagcaataacagaaaattgcggaacccgcggaccgtcgctaagaactaccactgtaagtggaaaactcattcatgaatggtgctgtcgatcctgtacactcccaccattaagatacatgggagaagacggatgttggtatggcatggaaataagaccaattaacgagaaagaagaaaacatggtgaaaagtctggtatctgcgggctcaggaaaggtggacaattttacgatgggagttctttgtttagcaatactttttgaggaggttatgcgaggaaagtttggcaaaaagcacatgattgctggtgtactatttactttcgtcttactcttatccggtcagatcacttggcgtgacatggctcatacattaattatgattggaagtaatgctagcgacagaatgggaatgggagttacgtatttagcacttattgccacatttaaaattcagccattccttgctctcggtttcttcctaagaaaacttaccagtcgagaaaatctattactcggggttggactagcaatggcaacaacattgcaattacctgaggatattgaacaaatggcgaatggcatagcattaggacttatgaccttaaaactcatcacacaattcgaaacatatcaactttggacggcattagtgtcgctgacttgttctaacactatcttcaccttgactgttgcatggcgaaccgcaactctcatattagccggtgtctccctattaccattgtgtcaaagttcaagtatgcgtaaaaccgattggctgccgatgactgttgcggcgatgggtgtacccccactgccactattcattttctccctaaaagatactccgaaaagaagaagctggccactaaacgaaggcgtaatggcagtagggttagtaagcattctggcgagttcactactacgcaatgacgtaccgatggcaggaccactggtggctggtggattattgatagcgtgctatgttataaccggaacatctgcagatcttacagtagaaaaggccgccgatgtaacgtgggaagaagaggcggaacaaactggagtgagtcataacctaatgatcacagtcgacgacgacggaacgatgagaattaaggacgacgaaaccgaaaacattctaaccgttctactaaagactgcattactgatcgtatctggtatatttccatactcgatacctgcaactctattggtatggcatacgtggcaaaaacaaactcaaagatctggagtgctatgggatgttccaagccctccagaaacacagaaggcagaattagaagagggtgtctaccgaattaaacaacaaggaatattcggtaaaacacaggttggtgtcggtgtacaaaaagaaggggtatttcacaccatgtggcatgtaaccagaggcgccgtcttgacgcataatggaaaaagactagaacccaattgggcttcagtgaagaaagaccttatatcatatgggggcggatggcgacttagtgcacaatggcaaaaaggagaagaggtccaggtaatagcggtggagccaggcaagaatccgaaaaacttccaaactatgccgggcatatttcaaaccactactggagagataggggcaattgcgctagacttcaaaccaggaacaagtggaagccctataatcaatagggaaggcaaagttgtcgggttgtatggtaatggagtggtaaccaagaacggaggatacgtctcaggaatagcacaaacgaatgcagagccagatggcccaacgccggaattagaagaagaaatgttcaagaagagaaatttaacgattatggatctgcacccgggctctggtaaaacccgtaaatacttacctgccatagttagagaagctatcaaacgtcgacttcggacattaatattagcaccaacgcgggtggtggcggcagaaatggaagaagcacttaaaggcctacctattagataccagaccaccgcaactaaatcagaacacacaggacgagaaatagtggatctaatgtgtcatgctacttttacaatgcgtctcctatctcctgtgcgtgtacccaactacaatctggttatcatggatgaagcacacttcaccgaccctgcgtcgattgcggcgagaggttacattagtacccgagtagggatgggagaagcagctgctatatttatgacggccactcctccaggaacggccgaggcttttccacaatctaacgcgcctatacaagacgaggaacgtgatataccagagaggagctggaatagcggcaatgagtggattacagattttgtcggaaaaaccgtatggttcgtgcctagcataaaggccgggaacgacatcgccaactgtttacgtaaaaacggtaagaaggtgatacaattatcgagaaaaacctttgatacagagtatcagaaaacaaggcttaacgattgggattttgtagtaaccacagacattagtgagatgggagcgaattttaaagccgatcgcgttatcgaccctaggagatgcctcaaacccgttatactaactgatggacctgagcgagtaatattagctggaccaatgcctgtaacggcggcttcagccgctcaaagacgcgggagagtgggcagaaatccacaaaaagagaatgatcaatacatatttacaggacaacctctgaataatgacgaagaccatgctcactggacggaagctaaaatgctcttagacaatataaatacccctgaaggaattataccagcgttgtttgaacctgaacgtgaaaagagtgctgcaatagacggagaatacagactgaaaggagaaagccgaaaaacttttgtcgaactaatgagaagaggagacctcccggtctggttagcacataaagtggcaagtgaaggcataaaatatactgatcgtaaatggtgcttcgacggtgaacgtaacaaccaaatactagaggaaaatatggacgtagaaatatggacaaaagaaggggaacgcaagaaattaagaccaagatggctagacgcacgcacatactcagatccactagccttaaaggaatttaaggatttcgcagcaggccgcaaaagcattgcgctagatttagtaaccgaaatcggaagagttccatcacacttagcccatcggactagaaatgctctagataatcttgttatgcttcatacgagcgaacacggagggagggcctaccgccatgcagtcgaagaactaccggaaactatggaaacattacttctgttaggtttaatgattctattaactggaggggcgatgctgtttttaataagtggaaaaggaatcggtaaaacgagcattggactaatttgcgtaatagtaagtagtggaatgctgtggatggccgacgtaccgcttcagtggattgcgagcgccatcgttttggagttctttatgatggtgttgctgattccagaaccggaaaaacaaagaacaccacaagacaatcaattggcctatgtagtaattggcatattaacattagcggcaatcgtcgctgctaatgaaatgggcttgttggaaactacaaaaagagatctcggtatgtccaaagaacccggtgttgtaagtcctacaagctatttagatgtagaccttcatccggccagcgcatggacactatatgctgtggcgacaacagtgataacccccatgctacgccatacgattgagaactcaacagccaacgtaagtctagcagcaatcgcgaatcaagctgtagttttaatgggactagataaaggttggcctatcagtaaaatggatctgggcgtacctctcttagctttaggatgctacagtcaagttaacccattgactctcaccgctgcggttctacttctagttacacattacgcaataataggaccgggactgcaagcaaaagctacacgcgaggcccaaaaacgcacagcagccgggatcatgaaaaatccaacggtggacggtataatgacgattgacctagatcccgtaatttacgacagtaagttcgagaaacaactaggccaagtcatgctgttggtattgtgcgcggtacaattgttgctcatgagaacgtcctgggctctgtgtgaagcattgacactggcaaccggacctatcacaacattatgggagggtagccctggaaaattttggaacaccactatagcagtctctatggctaatatatttcggggttcctatcttgcaggcgctggacttgcatttagcataatgaagtcagttggtacaggaagaaggggaacgggatctcaaggtgaaactctaggggaaaagtggaaaaagaaactaaaccaactttcaagaaaagagttcgacttgtataagaagagtggaattactgaggttgaccgaactgaagccaaagaaggtttaaaaagaggagaaacaactcatcatgctgttagcaggggatcagcaaaactacaatggtttgtggagaggaacatggtcatcccagagggccgagtgatcgatctgggatgtggacgaggaggatggtcatattattgtgccggtctaaagaaagtgactgaagtcaggggctatacgaagggtggaccaggacatgaagaaccagtgcctatgtccacatacggctggaatattgtaaaactaatgagtggtaaagacgtattttatttgcctcctgaaaaatgcgatacactactatgtgatattggcgaatcgtcgcccagtcctacagtagaagaaagtcgtacaataagggtcctcaagatggtcgagccgtggcttaaaaataatcaattttgtataaaagtcctaaatccctacatgcccactgtaattgaacatttagaaaggctgcaaagaaaatacggaggaatgctagttcgtaaccccctaagcagaaattcaactcacgaaatgtattggatatctaacggcacgggtaatattgtgtcttcagttaatatggtaagtaggttactactaaataggttcacaatgacgcatcggcgtcccactatagaaaaagacgtagatcttggagcgggaacacgtcatgttaacgctgaaccagaaacgccaaacatggatgtaatcggtgaaagaatcaaaaggataaaagaagaacactcatccacatggcattatgatgacgaaaatccgtataagacatgggcttatcatggttcatacgaagtaaaagcaactggcagtgcaagtagtatgattaatggagtagtcaaactactaacaaaaccatgggatgttgtacctatggttacacaaatggcaatgactgatacaacaccgtttggtcaacagcgagtatttaaagaaaaagttgataccagaactcctagaccaatgccaggcacaagaaaagttatggaaatcactgccgaatggctatggagaactcttggtcgcaacaagaaaccaagattatgtacaagagaagagtttacaaagaaagtccggacaaacgccgcaatgggtgctgtcttcacagaggaaaatcaatgggattcggctagggccgcagtcgaagatgaagagttctggaaattagtagacagagaaagagagttacataaacttgggaaatgcggaagttgcgtatacaacatgatggggaaacgagagaagaaactaggggagttcggaaaagcaaagggaagcagagcaatatggtatatgtggctaggagcgagatacttagaatttgaggcgctaggatttttaaatgaagaccattggtttagtagggaaaattcttacagcggggtggaaggtgagggtttgcataagttaggatatatactaagagacataagtaaaataccagggggagcgatgtacgcagatgataccgcgggatgggatacgaggattactgaagacgatctccataatgaagaaaagataactcaacaaatggacccagaacatagacaattagcaaatgctatatttaaactgacttaccagaataaagtcgtaaaagtacaaaggcccactccgaaggggacagtaatggatattatatcaagaaaagatcaacgaggatcagggcaagtaggaacttacggtttaaatactttcacaaacatggaggcacaacttgtgcgacaaatggagggagaaggggtgttgagtaaggcagatttggagaatcctcaccaactggaaaagaagataactcagtggttggagacaaagggggtcgaacgacttaaaagaatggcaatttcaggcgatgattgtgtggttaaacccatagatgacagatttgctaatgcattgctagcgctgaacgacatgggcaaagtacgaaaagacataccgcaatggcaaccatccaaagggtggcatgactggcagcaagttccattctgtagtcatcattttcatgaacttataatgaaagatggacgaaagttagtcgtgccctgcaggccacaagatgaattgattggaagggcacgtatcagccaaggggcagggtggagtttaaaggaaactgcatgtttagggaaggcatacgcccaaatgtggtcgttaatgtatttccatagacgagacttacgattggcatctaacgccatatgttctgcagtaccagtccattggatacccacgagccggacaacatggagtatacacgcccatcatcaatggatgacaaccgaggatatgttaactgtctggaaccgagtatggatcgaagacaatccgtggatggaagacaaaactccagttaccacatgggaagatgtaccatacttaggtaaaagggaagaccaatggtgtgggagtttaattggtttaacatcacgggcgacttgggcccaaaatatcctaacggccatacagcaagttagaagtttaattggagatgaagagtttttagattacatgcccagcatgaaaaggtttagaaaagaggaggagagcgaaggagccatatggtaa

SEQ ID NO: 23128 - RNA, 9873 nt, synthetic construct
  misc_feature 1..9873: note = derived and/or modified CDS sequence (opt6) from DENV-3__FJ639719__SS-prME
  source 1..9873: mol_type = other RNA
acttcactatgccttatgatgatgttaccagcaacattagcattccatctaacttcaagagatggtgaaccacgaatgattgtaggcaaaaatgaaagaggtaaatcgctacttttcaaaacagctactggaattaatatgtgtacgttaatagcaatggatctaggggagatgtgtgatgacacggtaacgtacaaatgtccgcttatcgctgaggttgaacctgaggacatcgactgttggtgtaatttaacttctacatgggtgacatacgggacctgtaatcaagcaggagagcatcgacgagataaaaggtctgtggcattggcgccacatgtaggaatgggtttagatactagaactcaaacatggatgagtgcggaaggagcctggagacaagtagaaaaagtggaaacatgggctctgaggcacccaggatttacaatactcgcactcttcctagcacactacatcggcaccagtttaattcaaaaagtagttatattcatattactcatgttagtaactccatccatgacaatgcgttgtgtgggagtgggaaatagagactttgtagaaggactcagcggagctacatgggttgatgtagtgctcgagcacggagggtgtgtcactactatggctaaaaataaaccaacacttgatattgaattgcagaaaaccgaagcaacacaacttgccacattgagaaaactctgtatcgagggcaaaataaccaatatcacaacggattctagatgtccaacgcaaggcgaagcaatactgccagaagaacaagatcaaaattatgtatgtaaacatacctatgtggatagaggctggggaaacgggtgtggattgttcggcaaaggcagcttagtaacatgtgcaaaattccaatgtttagaaccaatcgaaggcaaagtagtacaatacgagaacttaaaatatacagtaattattaccgtacataccggagatcaacatcaagtaggaaatgacacacagggcgtcactgtggagataacacctcaggcttcaactgtagaggcagtacttcccgagtacggcacgttgggactagaatgctcaccacgaacaggcctagatttcaatgaaatgatcctcctaactatgaaaaacaaagcatggatggttcatagacagtggtttttcgatttaccactaccatggactagcggagcaaccacagaaactccaacttggaatagaaaagaacttcttgtgactttcaaaaatgcacacgcgaagaaacaagaagtagttgttctcggatcccaggaaggtgcaatgcatactgcactaactggtgcaacagaaatccagaacagtggaggtacttcaatttttgcaggtcatctaaaatgtaggttaaaaatggacaaattagagttaaaaggtatgtcgtatgctatgtgcctaaatacatttgtgcttaagaaagaggtaagtgagacgcaacacgggactatattgataaaagtagaatataaaggtgaggacgctccctgtaaaataccattctcgacagaggacggacaagggaaagcacataatgggaggcttatcaccgctaatcccgtagtcactaagaaagaagaaccagtcaacatagaggctgaaccaccatttggagaatcgaacatagtaataggtataggcgacaaagcattaaaaataaattggtataagaaaggatctagcattggaaaaatgtttgaagcaacagccagaggagccagaagaatggctatacttggggatacagcatgggattttggctcggttggcggagttttaaattcactcggaaaaatggtgcatcagatattcggtagtgcctacacagcgctattttcaggggtttcatggataatgaaaataggtattggagtacttcttacttggataggcctgaacagtaaaaacacgtcaatgtcttttagctgcatagtcataggcattatcacactctaccttggtgccgtggtgcaagctgatatgggatgcgtaataaactggaaagggaaagaattaaaatgtggatctgggatatttgtgaccaatgaggtacatacatggacagaacaatacaaatttcaagccgacagccccaagaggctagccacagccatcgccggagcttgggagaatggggtatgcggaattagatctacaactcgcatggaaaacctgttatggaaacaaattgcgaacgaattaaattatattctctgggaaaacaatatcaaactaactgtagtagtgggagatatcattggtgtcctcgaacagggcaaaaggactttaacaccacaaccaatggaactaaaatactcatggaaaacctggggtaaagcgaaaatagtgacagcggaaacccaaaatagtagttttattattgacggcccgaacacccctgagtgtcccagcgcgagtcgggcctggaacgtgtgggaagtagaggactatggatttggagtattcacgacaaacatatggctcaaactgagagaggtctacacacaatcgtgcgaccatagactaatgtcggcggcgataaaggacgaaagagcagttcatgcagatatgggatactggatagaatcacagaaaaacggaagctggaaattagaaaaggcttctttcatagaagtaaagacctgtacatggccgaagtcacacacattatggagtaatggagtcttggaaagtgatatgatcattccgaagagtttagcgggacctataagtcaacacaatcataggcctggctatcatacgcaaacggcaggcccatggcatcttggaaaactggaattagattttaactattgtgaaggaacaactgttgttattacagaaaattgtggtacacgcgggccctctctcagaaccacaacagtaagcggaaaactgatacatgagtggtgttgtagatcgtgcactttacctccattgaggtacatgggagaagatggctgttggtatggaatggaaataagaccgatcaatgaaaaagaagagaatatggtaaaaagcctagtgtcagcgggaagcggaaaagtcgataatttcaccatgggagtgctatgcctggccatattgtttgaagaagttatgcgggggaaattcggcaagaaacatatgatagcaggggttttgtttacatttgttctcttacttagtggacaaatcacttggcgagatatggcacacacacttataatgatcggcagcaatgcaagcgatcgtatgggtatgggggttactcaccttgcattaattgcaacatttaagattcaaccctttctcgcgttagggttctttcttcgaaaacttacatctagggaaaatctattattgggggtgggtttagcgatggccaccactctccaacttcccgaagacatagaacaaatggcaaatggaatcgcactaggactaatgaccttaaaacttattacacagtttgagacatatcagctatggacagccctagtatcactaacttgtagtaatacaatctttactctgaccgttgcatggcgaaccgctacactgattctcgccggtgtttctttattaccactatgtcagagttcatcaatgagaaaaaccgattggctaccaatgacggtggctgctatgggcgtgccaccgttgccactgttcatattctcattaaaagatacaccaaagagacgcagttggccattaaatgaaggggtaatggccgtgggtctcgtatcaattctcgcatcttcccttctacgcaatgacgtaccgatggcaggacccttggtcgcaggaggactattgattgcatgctacgtaattactggtacgtcagctgatttaactgtagaaaaagcagccgatgtaacttgggaagaagaagcggaacaaactggcgtgagtcacaacctaatgattacagttgatgatgatggtactatgcggattaaggacgatgaaacagaaaacatcttaaccgtcctcctgaaaacagcattactgattgttagcggcatatttccctattcgatccctgctactttattagtttggcatacatggcagaagcaaactcaaaggagcggggtcctatgggacgttccatcaccgccagaaacacaaaaagcagaattagaagagggagtatacaggataaaacagcagggaattttcggaaaaacccaagtgggagtcggtgtgcagaaagagggagtattccacaccatgtggcacgtaacgcgaggtgcagtattaacacataatggaaaaagattagaaccaaactgggccagtgtcaagaaagacctaatcagctacggagggggatggcgcttatctactcaatggcaaaagggagaagaggtgcaagtgatagcagtagagccgggcaaaaaccccaaaaatttccaaactatgcccggcatttttcaaactacaactggagaaattggagcaatagccctagactttaaaccagggacaagtggttctcccataataaaccgtgagggcaaagtcgttggactatacggcaacggagtagttactaagaacggtggttacgtatcaggaattgctcaaacaaacgcagaaccagatgggccaacgccagaattggaagaagagatgttcaagaaacgaaatctcaccataatggacctacatcccggaagcggaaaaactagaaaatacttgcctgcgattgtcagagaagccataaaacgaaggcttcgaacactgattctggcgccaacgagagttgttgccgcggagatggaagaagcacttaaaggtttacctataaggtatcaaactaccgcaacgaaatcagaacacacaggcagagagatcgtggatctcatgtgtcacgccacgttcaccatgcgacttttaagtccagtacgcgtgccaaattataatttgattataatggatgaagcacatttcacagatcctgcatcaatagcggctaggggttatatctccacaagagtaggaatgggtgaggctgctgccatatttatgacagctacacctcctgggacagcagaagcatttccccaatcaaacgcacccatacaagacgaagaacgtgacatacccgaaagaagctggaactcgggaaatgagtggataaccgactttgtaggcaaaacagtctggtttgtgcccagtatcaaagccggaaatgacatagccaattgtttacggaaaaatggcaagaaagtaatacaactatctagaaagacattcgacacagagtatcaaaagactagacttaatgactgggacttcgtcgttacaacagatattagcgaaatgggggcaaatttcaaagcagaccgtgtaattgatcctagacgctgtctcaaaccggttatactaactgatgggcctgaaagagtcattctagcagggcccatgccagttacagccgcatccgctgcacagaggcgaggtagagtcggacgaaacccacagaaggaaaacgaccaatacatatttacgggtcaaccgctcaacaatgatgaagaccacgctcattggactgaagctaaaatgttgcttgataatatcaatacccctgaaggaatcatccctgcactattcgaaccggaaagagagaaaagtgctgctattgacggagaatatagactgaaaggagaatcaagaaaaacttttgtggaactgatgcgtcgaggtgacctccctgtttggctggcacacaaggtagcaagtgagggtattaaatacacagatagaaagtggtgtttcgacggcgaaagaaataaccaaatacttgaggagaacatggacgtagaaatatggacgaaagagggagaacggaagaaactcagaccacgctggttggacgctcgaacatactcagaccccctagcactgaaggagttcaaagattttgctgctggaagaaaatcgatagctttagatcttgttacggagattggtagggtaccgtcgcacttggcacacagaacacgcaatgcattagataatctagtaatgttacacaccagtgaacatggtggtagggcgtacaggcatgcagttgaggaactaccagaaactatggaaaccttactcctattggggctaatgattctactcacaggaggagctatgttatttttagtttcaggtaaaggtatcggaaagacaactatagggcttatatgcgtaatagtctccagcggcatgttgtggatggcagatattcccttacaatggatagcatctgcaatcgttttagagttcttcatgatggtactattgataccggaaccagagaagcaaagaacaccacaagataatcaactagcctacgtggtaatcgggattctcaccctagcagctatagtcgctgctaatgaaatgggactgttagaaaccaccaaaagggatctaggtatgtcgaaagaaccaggagttgtatctcctacttcatacttggacgttgatcttcaccctgcatccgcatggactctatatgcggttgcaacgacagttattacacctatgttacgacacacaattgaaaatagcactgcaaatgtgtccttagcagcaatagcgaaccaagccgtagttctgatggggctagataaaggatggccgatcagtaagatggatctcggagtacctctactcgccttaggatgttatagccaagtaaatccattaacactgacggcagctgttctcctattagttacacactatgcgataataggaccgggactccaagcaaaagcaaccagagaagcacagaagcgaactgcagccggaatcatgaagaacccaacggttgatggaattatgactattgacctggaccctgtcatttacgattctaaattcgaaaaacaactcggacaagtaatgctattagtactatgtgctgtacagttactgctgatgagaacatcctgggccctatgcgaagcattaacccttgcaactgggccaattacaacgctatgggaaggaagtcctggcaaattttggaacactacaattgcagtctctatggcaaatatattcagaggcagttatctcgcaggcgctggattagctttttccattatgaaaagtgttggaaccggtagaagggggacagggagccaaggggaaactctgggtgaaaaatggaagaagaaattaaatcaactatctcgtaaagaatttgatctgtacaagaaaagtggaattacagaagttgatcgcactgaagccaaagaagggctaaaaagaggtgaaacaacacatcatgccgtgtctagaggaagcgctaaactccaatggtttgtagagagaaacatggttataccagaaggaagggtaattgatttagggtgcggtagagggggctggtcttactactgtgctgggctcaagaaagttacagaggtacggggatacacgaagggtggtcccggtcacgaagaaccggtacccatgtccacttacggttggaacatcgtgaaacttatgagtgggaaagacgttttctatctgcccccagaaaagtgcgacacactattatgtgacattggagaaagctcaccatccccaacagtcgaggaatcaagaaccatacgcgtactgaaaatggttgaaccttggctcaaaaataatcaattttgtattaaagtgttaaatccctatatgccgacagttatcgaacacttagaaagactgcagagaaaatatggaggcatgttagttagaaacccactgtcgcgaaacagcacccatgaaatgtattggatatcgaacggaactgggaacatcgtgagctcggtcaacatggtgtcacgactcctattaaaccgatttacaatgacacatcgtaggccaacaatcgaaaaagatgtcgacctaggcgctggaacccgacacgtaaacgctgaaccggaaacacctaatatggatgtcataggagaaagaataaaacggattaaagaagaacactcgtcaacttggcattacgatgatgaaaatccgtataaaacgtgggcataccatggttcttacgaggtcaaagctacagggtctgcaagcagtatgataaacggtgttgtaaagttactgacaaagccctgggatgtagtcccaatggtgacacagatggccatgaccgatactacaccatttggtcaacaacgagtattcaaagagaaagtcgatactagaactccgcgtcccatgccaggaacgcgtaaggtcatggaaataacagcggaatggctgtggcgtaccctagggcgaaacaagaaaccaaggttgtgcactagggaagaatttacgaaaaaggttagaacaaatgctgcaatgggtgcagtgttcaccgaggaaaatcaatgggatagcgccagagccgcggtcgaggatgaagagttttggaagttagtagatagagaacgcgaattacataaattgggaaagtgtggatcttgtgtttacaacatgatgggaaaaagggaaaagaaactaggggaatttgggaaggcgaagggaagtagggctatctggtatatgtggctcggagcaagatttttagagtttgaagccttaggatttttaaatgaagatcactggtttagtcgagagaatagttacagtggggtagaaggagaagggttacacaaacttggttatatactacgggatatcagtaagattccgggtggtgctatgtatgccgacgacacggctgggtgggatacacgtataactgaagatgatctgcacaacgaagagaaaattactcaacagatggacccagagcaccgacaattagccaatgcaatcttcaagctaacttatcagaataaggtcgtcaaggtacaaagaccgactcctaaaggcacagtgatggatataatttcaagaaaggatcagagaggatctgggcaggtaggaacgtacggactaaatacttttacaaatatggaagcacagttagtgagacaaatggaaggtgaaggagtacttagtaaagcagatttagaaaatcctcatttacttgagaagaaaattactcaatggctagaaaacaaaggagtagaaaggttaaaaagaatggcaatctcaggcgacgactgtgttgtaaagccgatagatgatagattcgccaatgcgctattagcactaaatgacatgggaaaggtaagaaaagacataccccaatggcaaccttcaaaaggttggcatgactggcagcaagtccctttttgctcgcatcacttccatgaattaattatgaaagatggaagaaagttagtggtaccctgccgtccacaagatgaattaatagggagggcgaggataagccaaggtgccggttggagtctaaaagaaaccgcttgtttaggaaaggcttacgcacaaatgtggtctttaatgtactttcatcgtagagacttgcgtttagcatcgaatgctatttgttctgccgttcctgtacattgggtcccaacctcacggactacgtggtctattcacgcgcatcaccaatggatgacaacggaagacatgctgactgtttggaacagagtatggatagaagataatccttggatggaagataaaacacccgtaaccacttgggaagacgtcccgtacctaggcaagcgtgaagatcagtggtgcggatctcttattggattaacttctcgggcaacatgggcgcagaatatattgacagctatacagcaggtacgtagtttaatcggggacgaagaatttttagattacatgccatcgatgaaaagatttcgaaaggaagaagaaagcgagggtgcaatctggtaa

SEQ ID NO: 23129 - RNA, 9873 nt, synthetic construct
  misc_feature 1..9873: note = derived and/or modified CDS sequence (opt6) from DENV-3__KF955332__SS-prME
  source 1..9873: mol_type = other RNA
acgagtctttgtctaatgatgatgctgccggcgaccctagcttttcatctaacatcacgcgacggagaaccaagaatgattgttggtaaaaatgaaagggggaaatctttgttatttaaaacagcaacaggtataaatatgtgtacgctaatagccatggacttgggtgaaatgtgcgacgacaccgttacttataaatgtccactaatagcagaagttgaacctgaagatatagactgttggtgcaatctaacgtctacatgggtaacatatggtacatgtaatcaagcaggagaacataggcgagacaaaaggagcgtggccttggcaccacacgttggtatggggttggacacaagaacacaaacatggatgtccgcggaaggagcatggcgacaggtagaaaaagttgaaacttgggctctgagacacccaggtttcacaatactggcgctatttctagcccactacataggaacttcgcttattcaaaaagtcgtgattttcatactcttaatgctagtaaccccgtcgatgactatgaggtgcgttggagtcggaaacagagattttgttgagggcctcagtggagccacatgggtcgatgtcgtattagagcatggaggttgtgttacgacaatggccaaaaacaaacccactttggatatagaattacagaaaacagaagccacacaattggcaacgctaagaaaattgtgtatagaaggtaaaattacaaatatcaccactgacagtagatgtccgacgcaaggagaggcgattttacctgaagaacaagatcaaaattacgtctgcaaacacacatatgtagacagaggatggggtaacggatgtggactttttgggaaaggtagcttagttacatgtgctaaatttcaatgtttggaaccaattgaaggtaaagttgtgcaatatgaaaatctaaaatatacagtcatcattaccgtacatactggagatcaacatcaagttggtaatgatacgcaaggggttaccgttgaaattacccctcaggcttcaactgtggaagcggtacttccagaatatggtactttggggctagagtgtagtcctagaacaggactggactttaacgaaatgatcctcttgactatgaaaaataaagcatggatggttcaccgccaatggttctttgacctacctttaccatggacgtcgggagccaccacagaaacccctacttggaatagaaaagaactattagtgacgtttaaaaacgctcatgcgaagaaacaagaagtagtagtcttaggaagccaggagggagcaatgcatacggcattaacaggtgcaacagaaatccagaactctggaggaacatccatctttgcgggacatttaaaatgccgtcttaaaatggacaaattagaacttaaaggaatgagttacgctatgtgtctgaatacattcgtactgaagaaagaagtatcagaaacacaacatgggaccatacttataaaagtagaatataaaggtgaagacgccccatgcaaaataccttttagtacagaagatggtcaaggaaaagcccacaacgggagattaatcacagcaaacccagttgtaactaagaaagaagaaccagttaatatagaggcagagcctccatttggtgaaagtaacatagtgatcggaatcggcgacaaggctttaaaaataaactggtataagaaagggtccagcattggaaaaatgttcgaagcaactgctagaggagcacgtaggatggccatcctaggggacaccgcatgggattttggatcagttggaggtgttttaaactcacttggaaaaatggtccatcaaatatttggttctgcatacactgctctcttcagcggtgtttcatggattatgaaaattggtataggggtcctcttgacttggattggattgaatagcaaaaacacttcaatgagtttctcatgcatagttattggcataataacgttatatttaggggctgtggtacaagcggacatgggttgtgtgataaattggaaaggcaaagagctaaaatgtggaagtgggatttttgtcaccaacgaagtccacacatggactgagcaatataaattccaagcagatagtcccaagaggctcgctactgcaattgccggtgcgtgggagaatggtgtatgcggcataagatcaactacacgcatggagaacctgctgtggaaacaaatcgccaacgaactcaattatatattatgggaaaataacataaagctaaccgtggtcgtcggagatattatcggagtactcgaacaaggtaaaaggacactcacaccgcagcccatggagttaaagtactcatggaagacgtggggaaaagcaaaaatagtaaccgcagaaacacaaaattcatcgtttataattgatggtcccaatacgcccgaatgcccgtcagcgtcgcgcgcatggaacgtatgggaagttgaagattatggctttggggtgtttacgactaacatttggttaaaacttcgagaggtttacacccaatcatgcgatcataggctaatgtcagctgcaatcaaagatgagagagctgtacatgctgacatgggatattggatagagtcacagaaaaatggttcttggaaactcgaaaaagcatcatttatagaagtaaaaacgtgtacatggcctaaaagccatacattatggagcaatggcgtccttgaatctgatatgataatacctaaatccctagcgggaccaatatctcaacacaaccacagaccgggttatcacactcaaacagcagggccctggcatctcggcaaattagaactagattttaattattgcgaaggaactaccgtagttataaccgaaaactgtgggactcgtggaccgtccttacgcactacaactgtaagtggtaaacttattcatgaatggtgttgcaggagctgtaccctaccgccattgagatacatgggtgaagatggatgttggtatggtatggaaataagacccataaacgaaaaggaggaaaatatggttaaatctcttgtctctgcaggttcaggaaaagtagacaacttcaccatgggtgtactatgcttagctatactttttgaagaagttatgcgagggaagtttggaaagaaacacatgattgcaggggttctctttacattcgtattgctcctgtctggacaaataacatggagagatatggctcacacactaattatgataggttctaatgccagcgaccgtatggggatgggggttacttacttagcgttaatagccacgtttaaaatccaaccattcctagcattaggattctttctaaggaaattgacatcacgtgaaaatctactactcggtgttgggctagcaatggcaacaactctacagttacctgaggacattgagcaaatggcaaacggaatagccctaggtttgatgacattaaagttgatcactcaatttgaaacgtaccaactgtggacagcgctagtaagtcttacgtgctcaaataccatattcacactcacagtagcttggaggacagcaacgttgatattagcaggggtgtctttattaccgctatgccaaagtagctcaatgcgcaagacggattggctgcctatgaccgtcgccgcaatgggtgttccgcccttgccactatttatatttagtctaaaagacgctcccaaacgtcgctcgtggccgttaaatgagggagtaatggccgtaggtcttgtgtcaatattagcaagcagtttgttgcgaaatgatgttccaatggcaggtcccttagtagctggaggtttgctcatcgcttgttatgtaattacgggtacatcagcagacctgactgtagaaaaagctgcagatgtgacatgggaagaagaagcagagcaaaccggtgtaagccacaatcttatgattacagtagatgacgatggaacgatgagaatcaaagatgacgaaaccgaaaatatcttaacagtattgctcaaaacagcgttacttatcgtgtcaggaatatttccgtacagtataccagcaacactgcttgtgtggcatacctggcaaaagcagactcaacgatcaggtgttttgtgggatgtcccaagcccaccggaaacccaaaaagcagaactagaggagggtgtttacagaatcaaacaacaagggatctttggaaaaactcaagtaggagtaggtgtacagaaagaaggagtttttcatactatgtggcacgttacgcgtggtgctgtcctaactcataacggaaagagacttgagcctaactgggctagcgtcaagaaagatcttatctcatacggaggtggttggagactatctacccaatggcaaaaaggtgaagaagttcaagtcatcgcagtagaacctggaaagaaccccaaaaattttcagacaatgccagggatatttcaaactacgacaggcgagattggcgccatagcgctagacttcaaacccggaacaagtgggagtccaataatcaatcgagaaggtaaagtagttggcctttatggcaacggagttgtaactaaaaacggaggctacgtatctgggattgcacaaacaaatgccgagccagacggacctacccccgaattggaagaagaaatgttcaagaaaagaaatttgacgattatggatctgcatcccggttcagggaaaacgagaaaatatttgccagcgatagtaagggaagcaattaagagaagactaaggaccttaatcctggctccgacacgtgtggtagcagctgaaatggaagaggctctgaaaggtctccctataaggtatcaaactactgcaactaaatctgagcatacaggaagagaaatcgtcgaccttatgtgtcatgccacttttactatgaggcttctctcaccagtacgtgttccaaattacaaccttatcatcatggatgaagcccacttcacggatccagcctcgattgcggctcgtggatatatttccacaagagtaggcatgggagaagccgctgccatcttcatgacagctacacctccaggcacagctgaggcttttccgcaaagcaacgcaccaatccaagatgaagagagagatatacctgaaaggtcatggaactctggaaatgagtggataactgactttgtcggaaagacagtttggtttgtaccctcaataaaagctgggaatgacatagccaattgcttaagaaagaatggtaagaaagtaatacaactttcccgtaagacgtttgatactgaatatcaaaagaccagattaaacgactgggattttgtggtcacaaccgatatttcggaaatgggcgcaaatttcaaagccgacagggtaatagaccccagaaggtgtctaaaaccagttatcctcactgacggacccgagcgcgtgatattagctggacccatgcccgtcactgcagcttctgcggcacagcgcagaggacgtgtaggaaggaatccacagaaggaaaacgaccaatatattttcactggacaaccattaaacaatgatgaggatcatgcccactggaccgaagcaaaaatgctactagacaatattaacacacccgaggggatcatccctgcattgtttgaacctgaaagagagaaaagtgctgcgattgatggagaatatcgacttaaaggagaatcgagaaaaactttcgtagaattgatgcggcgaggcgatcttccggtatggctggctcacaaagtagccagcgaaggaattaaatataccgaccgcaaatggtgtttcgatggcgaacgaaacaatcaaatactcgaggaaaacatggacgtggaaatatggacgaaggaaggtgaaaggaagaaacttcgaccaagatggcttgacgcacgaacttacagtgaccccttagcattgaaggagttcaaagatttcgcagcgggtagaaaatcgatcgctttagatctggtcacggaaataggtcgtgtccccagtcatcttgcccataggacgcgtaacgcgctggataatcttgttatgctccacacgagcgaacatggtggcagggcttaccgacacgccgtagaagaactacccgaaactatggaaacattattattattaggtttaatgatattgctcacgggcggggcaatgttattcctcgtgtccggtaaaggtattggcaagacgactataggcttgatctgcgttattgtatcttccggcatgttgtggatggcggatataccactgcaatggatagcatccgcaatagtcttagaatttttcatgatggtactccttattccagaaccggaaaaacagcgcaccccacaagataatcaattggcatacgttgtaatcggtattttaacactcgcggcaatagtagccgcgaatgaaatgggactacttgagactactaaaagagatttaggcatgtctaaggaaccgggagtggtcagccctacatcgtatctagatgtagacctacatccagcaagcgcttggaccctctatgcagtagcaacgacagttatcacacctatgttaagacacaccatagaaaattctaccgcgaatgttagcttagctgcgattgcgaatcaagcagtagtactaatgggactcgacaaaggctggcctatctcgaaaatggacttaggagttcccctgcttgcattaggatgttacagccaagtaaacccgttgacattgacagcagcagtattattacttgtcacccattatgccataataggaccggggttacaagctaaagccacacgggaagcacagaaacggacagcggcaggaataatgaaaaatccaacagtagatggtataatgactatagatctagacccagttatttatgattccaaatttgagaagcaattaggtcaagtaatgttgttagtattatgtgccgtacaactcttattaatgaggacttcatgggcactatgtgaagcgttgacactggcgactgggccaataactactttatgggaaggctcaccgggtaagttttggaatacgacaatagctgtatctatggctaatatttttcgtggatcatacctcgcgggagcagggttggccttttccatcatgaagtcagtaggaacgggaagacgcgggacagggagccagggggaaacactaggagaaaaatggaagaagaaattaaatcagttgagcagaaaagaatttgatctttataagaaatcaggaataactgaagtagatcgcacagaagctaaagaaggactcaaaagaggtgaaacaacgcatcacgcagtgagcaggggatcagccaaacttcaatggttcgtagagagaaatatggttattccagagggtcgcgtgattgatttaggatgtggaaggggaggatggagctattattgtgctggactcaagaaagtaacagaagtccgaggatatacaaaaggagggccaggacacgaagaaccagtaccaatgtcaacttatggttggaacatcgtcaaactaatgagcgggaaagacgtattttatttgcccccggagaaatgtgacactttactatgcgatattggggaaagctccccaagtcccaccgtcgaagaaagtcgtactatacgggtacttaaaatggtcgaaccgtggcttaagaataatcagttttgtataaaagtattgaacccttatatgccaacagtcatagagcaccttgaacgtttacaacgtaaatatggtggaatgctagttagaaatccactcagccgaaattcgactcatgaaatgtactggatttctaacggtaccgggaacatcgtcagttcagtgaacatggtcagtcgactgctattgaacagatttacgatgacacacagaaggcctacaattgaaaaagatgtagacttaggagccgggactaggcatgtaaatgccgaacctgagactcctaatatggatgttataggtgaacggataaaacgaataaaagaagaacatagctctacatggcattacgatgatgaaaatccatataaaacatgggcatatcacggttcttacgaggttaaagcaacgggatcagctagttcaatgatcaacggtgttgtaaaactattaacaaaaccatgggatgttgttcctatggtaactcaaatggcaatgacggatactacaccctttggccaacaaagggttttcaaagaaaaggtagatacaagaacccctcgaccaatgccaggaacacgaaaagtaatggaaataacagccgagtggctttggcgaacattaggtagaaataagaaacctagactatgtactagggaagaatttacaaagaaagtacgaacaaatgcagccatgggcgcggttttcacagaggaaaaccaatgggactctgctcgcgcagcagtggaagacgaagagttctggaaattagtcgatcgagagcgcgaactacataaattaggaaaatgcggatcatgtgtctataacatgatgggtaaaagggagaagaaattaggtgaatttggaaaagctaaaggatctcgggctatttggtacatgtggttgggggcacgatttctagaatttgaagctcttggatttctgaatgaggatcactggttttcgagggagaactcttactcaggtgtggaaggagaaggactacataaattaggatatattctacgggatatatccaaaataccaggtggagcaatgtatgcagatgataccgccggttgggatacacgaattacagaggatgacctccataatgaggagaaaatcacgcaacaaatggatccggaacatagacaactagcgaacgcaatcttcaaactaacctatcagaacaaggtagtcaaagtacaaagaccaactccaaaaggaacggtaatggatattattagtagaaaagatcaaaggggttcagggcaagtagggacgtatggtcttaatacctttacaaatatggaagcccagttggtgagacagatggaaggagaaggggtattaagcaagacggacctcgagaatccccacctcctggagaagaaaatcactcaatggttagagaacaaaggagtggaacgcctaaaacgaatggccattagcggagatgattgcgtggtaaaaccaatagatgaccgattcgcgaatgcgcttctagctttgaatgacatgggaaaggtaagaaaagatattccacaatggcaaccttccaaaggatggcacgactggcaacaagttccgttctgttctcatcatttccacgagctaatcatgaaggacggacgaaaattagttgtaccctgtagaccacaagatgaactgattggcagggcaaggatttctcagggggctggatggtcactaaaggaaaccgcatgcctaggtaaagcgtacgcacaaatgtggagtcttatgtattttcacagaagggatttgaggttggcttccaacgcaatctgtagtgcagttccggtccactgggttcctacatcaaggactacctggagtatacacgctcatcaccagtggatgacaaccgaagacatgttaaccgtctggaatagagtatggatcgaagataatccatggatggaagataagacacctgttacaacatgggaagacgttccgtacctcggaaaaagagaagatcaatggtgtgggagtctaatcggtctaacctcgcgagccacctgggcacagaacatcttaaccgcaattcagcaagtcagaagtttaattggcgacgaagaatttcttgattatatgccatccatgaaacgatttcgaaaagaagaagaaagtgagggtgcaatatggtag

SEQ ID NO: 23130 - RNA, 9873 nt, synthetic construct
  misc_feature 1..9873: note = derived and/or modified CDS sequence (opt6) from DENV-3__FJ639720__SS-prME
  source 1..9873: mol_type = other RNA
acttcactatgtctgatgatgatgttaccagcaacattagcgtttcatttaacaagtagagatggtgaaccacgtatgattgttggcaaaaatgaaagagggaaatcattacttttcaaaacagcaactggcattaatatgtgcaccttgatagcaatggacctaggggaaatgtgtgacgatacagttacttataaatgcccattaattgcagaagtggaaccagaagatattgattgttggtgtaatctaacatcgacttgggtgacgtatggtacgtgcaatcaagctggtgagcatcggagggacaaaagaagcgttgcactagcaccgcacgtaggaatgggactcgatacaagaacacaaacctggatgtcagccgaaggagcctggagacaagttgaaaaagtagaaacttgggcactgcggcatccaggtttcactatactggcactattcctggcgcactatatagggacttccttaatacagaaagttgtgatattcatactattgatgttagtgacaccaagtatgaccatgagatgtgtgggggtgggaaatcgagattttgtagaaggtttgagcggagcaacgtgggtagacgtagtcctcgaacacggaggatgcgtaacaacaatggccaaaaataaaccaacccttgatatcgaacttcagaaaactgaggcaacccaattggcaaccttaagaaaactgtgtattgaaggaaaaataactaatataactactgattcgagatgtccgacacaaggagaagccatcttacctgaagaacaagaccaaaattatgtgtgtaaacatacttacgtggatcgaggttggggtaatggatgtggcttattcggtaaaggttctctagttacttgcgcaaaatttcaatgtttagagccaatagaaggtaaagttgttcaatatgagaatctaaaatacactgtgatcataacagtacacacgggtgatcaacatcaggtagggaatgacacacaaggtgtaacagtagaaattactcctcaggcgtcaactgtagaggcagtcctcccagaatatggaacccttggattagagtgcagccccagaacaggactagactttaatgaaatgatattattaaccatgaaaaataaggcttggatggtacaccggcaatggttctttgatctcccacttccgtggacatctggtgcaacaacggaaactccaacttggaatcgaaaagaattattagtaacctttaaaaatgcacacgctaagaaacaagaggtcgttgtattgggtagccaagaaggtgcaatgcacacggcattaacgggggcaactgaaatccaaaatagcgggggtacgagcatatttgccggacacttaaaatgccgcttaaaaatggataaactcgaactgaaaggcatgtcatatgcaatgtgcctaaatacctttgtattaaagaaagaagtgagcgagacacaacacggcactatactgataaaagtagaatacaaaggcgaagacgcgccttgcaaaatacctttctcaaccgaagatggccaaggaaaagctcacaacggaagactgataacagccaaccctgtcgtcaccaagaaagaagaacctgtaaatattgaagctgaacccccgttcggagaaagtaatatagtaataggaattggggacaaggctttacggatcaattggtataagaaagggagttcgataggaaagatgtttgaagccacagccagaggagcccgtagaatggccattttaggcgataccgcatgggattttgggagcgtgggaggagtccttaactcattaggtaaaatggttcatcaaatatttgggagcgcgtatacggcattgttttcaggagtatcttggataatgaaaatcgggattggagtactactgacttggataggcttaaacagcaaaaatacatccatgtccttcagttgtatcgtaattggaataataactttgtatctaggtgcagtggtacaggctgatatgggttgcgtaataaattggaaaggaaaagaactaaaatgtggaagtggaatatttgtaacgaatgaggttcatacatggactgaacaatataaattccaggcagactcaccaaaacgactggcaaccgcgatagccggtgcatgggaaaatggggtttgcggaattagaagtacaacacgaatggagaacttactctggaagcaaatcgcaaacgaattaaattacatactatgggaaaataacattaaattaactgtagtagtaggtgatattataggtgtactagaacaaggaaaacgtacattaacgccacaacctatggaactgaagtattcgtggaaaacatgggggaaagctaagattgtcactgcggagacacaaaattcatcttttatcatagatggaccaaacacacctgaatgcccttcagcaagcagagcgtggaatgtatgggaagtagaagactacggatttggagttttcactacaaatatatggttaaaactgagggaagtatatactcaaagttgtgatcatagacttatgtcggccgctataaaagacgagcgagcagtgcacgcagacatggggtactggatagaatctcagaaaaacggaagttggaagctagaaaaagcatcgtttatcgaggtcaaaacatgtacatggcctaaatcacacacactatggagtaatggtgtattagaatcagatatgataataccgaaatcattagcaggtcctataagtcaacacaatcataggccaggttatcacacgcaaacggcaggtccttggcatttgggcaagttagaattggatttcaattattgtgaagggactacagtcgtaattacggaaaattgcggtactagagggcccagtctgcgtacaaccacagtttcaggcaaacttatccatgaatggtgttgtagatcttgcacgcttccacctttaagatatatgggcgaagacggatgttggtatggaatggaaatccgacctataaatgaaaaagaagaaaatatggtaaaaagtttagtttccgcaggatcaggcaaagtggacaatttcacaatgggagtactatgtctagcaatcctatttgaagaagtaatgcgaggaaaatttgggaaaaagcatatgatagccggtgtactctttacattcgtgttgctactctccggacaaataacttggcgggacatggctcacacgctgatcatgattggctcgaacgccagtgatcgtatgggtatgggcgtaacatatctcgcactaatcgcaacatttaaaatacaaccatttctcgcactcggattcttcttacgaaaattgacctccagagaaaatctcttattaggagtaggactcgcaatggctacaacgcttcaattacccgaggacattgaacagatggcaaacggaattgcattgggactaatgacgttaaaactaataacacaattcgagacctaccagctatggacagccctagtatcactaacttgtagcaacacaatctttacactaacggtagcatggcggacagctacactaatcttagccggagtctcacttttgcctctttgccaatccagttctatgagaaagacagactggttaccaatgacagtagcagccatgggggtaccgccactacctctatttatcttctctctgaaagacacacctaaaagaaggtcgtggcctctaaacgagggcgtaatggcagtaggcttagtttccatattggctagttcactcttaagaaatgatgttccgatggcgggtcctttagtcgcaggagggcttttaatagcttgctacgtgatcacaggtacatcagcagaccttaccgtagaaaaagcggcagatgtaacttgggaggaagaagctgaacaaaccggagtcagtcacaatctaatgatcaccgtagatgacgatgggactatgcgtatcaaagatgatgagacagaaaatatattaacagtgttactgaaaacggcgttattaatagtatctgggatctttccatatagtattcctgcgacgctcctagtatggcacacctggcaaaaacaaacacaacgatcaggagtactatgggatgtcccttccccaccagaaactcagaaggcagaactagaagaaggtgtataccgaataaaacaacaagggatcttcggaaaaacccaggtcggagttggtgttcaaaaagaaggggtgttccatacaatgtggcacgtaaccagaggggcggtattgacacataatggtaagcgactggaaccaaactgggcgagcgtcaagaaagaccttatttcatatggagggggctggaggctttctacacaatggcaaaaaggtgaagaagtgcaagtgatagcagtggagcctgggaaaaaccccaaaaattttcaaactatgccaggcatattccaaacaacgacaggagaaataggagcaattgcattagattttaagccaggaacaagtgggtcccctataattaatagggagggtaaagtagtaggactatatggcaatggagtagtaacgaaaaacggcggatatgtatccggaatagcgcagaccaatgcagaaccagatggtcccacaccagagctagaagaggaaatgttcaaaaagcgtaacctcacaataatggacctacatccgggttcgggtaaaactagaaaatatctgccagctatagtacgcgaagccattaaaagacggttaagaacacttattctcgctccaacaagggtagtggcagcagaaatggaagaggctttaaagggattaccaattaggtatcagactactgctactaaatctgaacatacaggtcgtgaaattgttgatctaatgtgtcatgccactttcactatgaggttattgagccccgtcagagtccctaactacaatttaataataatggatgaagcacacttcactgatcccgccagtatagctgcgaggggatatatcagcacaagagttggtatgggtgaagctgcagccatctttatgactgcaacacccccaggaactgcagaggcattcccacaaagcaatgcaccgatacaagatgaggaacgtgatataccggagaggtcatggaactccggaaacgaatggataacagattttgtgggcaaaacggtttggttcgtacctagcattaaagcaggtaacgacattgcaaattgcttgcgcaaaaatggcaagaaagtaatacaactatcacggaagacatttgatacggaataccagaaaactcggctaaatgactgggattttgttgtgactacagacatttcagaaatgggagcaaattttaaagctgacagagtaatagatccaagacgatgcctgaaacctgtgatcctcactgacgggccagaaagagtcatacttgcaggtcccatgccagtaacagcagcatccgctgcacaaagacgcgggcgagtaggacgaaatccacaaaaagaaaacgaccaatatatctttactggtcaacccttgaacaatgatgaagaccatgcccattggactgaagcgaaaatgctactagacaatataaatactcccgaaggcattatacccgccctcttcgaaccggagcgagagaaaagtgctgcgatagatggagaatacagattaaaaggagaatcacgcaaaactttcgtggaactgatgcgcaggggagacctaccggtatggttagcacacaaagttgcaagcgaaggaataaaatacactgacaggaaatggtgtttcgatggcgaacgtaacaatcaaattttagaagaaaacatggatgtagaaatatggacaaaagagggagagaggaagaaactaagaccgaggtggttagacgcaagaacatacagtgatccgttagcacttaaagagttcaaagatttcgcagcaggtagaaaatctatagcaattgacttggttacagaaataggacgcgtacctagtcacttggctcacagaacacggaacgcactagataacttagtaatgttacatacatcggagcacgggggacgagcctacagacatgcagtggaagaattgcccgagacaatggaaacactcttgcttctcggacttatgatactgctaactggcggtgcaatgctattcttagtttctggcaaaggcataggaaagaccaccatagggctaatttgcgtcatagttagctcaggcatgctatggatggcggacattccactacaatggatcgcatccgcgatagtattagagttctttatgatggttctgttgataccagaacctgagaaacaaagaacccctcaagacaaccaactagcctatgtagtaataggtatcttaactttagccgcaatcgtcgccgcaaatgaaatggggttattagagacaacgaagagagatttgggcatgtcgaaggagccgggggtggtatcccccacttcgtatttagacgtggatcttcatccagcatccgcttggacactatacgcagtagcaactactgtaataacaccaatgctaagacataccatagaaaacagcacagctaatgtttcactcgcagctattgcaaaccaagcagtagtacttatgggacttgataagggatggcctatatccaaaatggacctaggtgtcccacttctagcactaggatgttactcacaggttaacccacttaccctcacagctgctgtactactgttagttactcattacgccatcatcggtcctggattacaagcaaaagcgacaagagaggcacaaaaacgcacggcagcaggcataatgaaaaatccaaccgtagatggaattatgacaattgatttagaccctgttatatacgattcaaaattcgaaaaacagctcgggcaagtcatgttgcttgtattatgtgcagtacaacttctacttatgcgcacatcatgggctctttgcgaagcactcacattggccacgggtcctattaccacgttatgggaaggtagccctgggaaattctggaacactacaatagcagtgagtatggctaatatctttagaggcagttacctggccggtgccgggttagcgttctcaatcatgaaatcagttggaactgggagaagaggtactggatcccaaggagagacactaggggagaagtggaagaagaaactcaaccaactctcgagaaaagaatttgatctatacaagaaatctggtataacggaagtagatcgaacggaagccaaagaaggattaaaacgtggggaaaccacgcatcatgcagtgagccgcggaagcgcaaagttacaatggtttgtcgaacgaaacatggttatccccgaagggcgtgtaatagatttaggctgcggaagaggaggatggtcgtattattgcgctggtctaaagaaagtgactgaagttcgaggatatactaaaggaggacctggacacgaagaaccggttccaatgagtacatatgggtggaacatcgtaaaacttatgtcggggaaagatgtattctatcttccaccagagaaatgcgatacactcttatgcgatattggagaaagttcaccgagtcccactgtggaagaatctagaacgattcgagtccttaaaatggtagaaccctggctcaaaaataatcaattctgtattaaagtcttgaacccctatatgccgactgtgattgaacacctggagagactgcaaaggaaatatgggggcatgttggtacgaaatccgctttctagaaatagtactcacgaaatgtactggatctcaaacgggacaggaaacattgttagctctgttaacatggtgtccagactcctactaaataggtttaccatgacacataggcgtccaacgattgaaaaagatgtcgatctcggagctggtacacgacatgtcaatgcggaacccgaaactcccaatatggatgtaataggagaacgcatcaaaagaattaaagaagaacactccagcacttggcattatgacgacgaaaacccatataagacctgggcttatcatgggtcgtacgaggtaaaggcaacaggctctgcaagttctatgataaacggggtcgttaaattactaactaaaccatgggatgtagttcccatggttacacaaatggctatgacggatacaaccccatttggacagcaacgggtgttcaaggaaaaggtagatactcggacacccagacccatgcctgggacaagaaaagtaatggaaattacagctgagtggttgtggcgaacattagggcgaaacaagaaaccgaggctctgtacaagagaagaatttaccaagaaagtaagaaccaatgctgcaatgggagctgtgtttactgaagaaaaccaatgggactcggctagagcagcagttgaagatgaggagttctggaaactggttgaccgtgaacgtgagttacataagctgggaaaatgtggttcgtgcgtgtataacatgatgggtaaacgggagaagaaattaggggagtttggaaaagccaaagggtcccgcgctatctggtacatgtggctaggtgcaagattcttggaatttgaagcattagggttcctcaacgaggatcactggttcagtcgggaaaattcttattctggcgtcgaaggcgaaggcctacacaaactaggttatatactacgcgacatttcaaaaataccaggaggtgcaatgtatgcagacgacacagccggctgggacacaaggataacagaagatgacttgcacaatgaggagaaaattacgcaacaaatggacccagaacatcgccaacttgccaatgcaattttcaagctcacctaccaaaataaagtagtaaaggttcaaagacctacacccaaggggacagtaatggatattatttctcggaaagaccaaagaggatcaggacaggtagggacctacggtttaaacacttttacaaatatggaagcacaattagtgcgtcaaatggaaggggaaggcgtactcagcaaaactgacttggaaaacccacaccttctagagaagaaaatcacccaatggctagaaaataaaggcgtagaaaggctcaaaagaatggccatatctggagatgactgcgttgttaagcctatagatgatagattcgcaaatgcactattggctttaaatgacatgggtaaggtaagaaaggatataccacaatggcagccatctaagggttggcacgattggcaacaagtaccgttctgctcacaccattttcacgaactaattatgaaagacgggagaaaacttgttgtaccttgtagacctcaagatgaattaattggacgagcgaggatatcacagggagccggatggtcgcttaaggaaactgcttgcttgggcaaggcatatgcccagatgtggagtttaatgtattttcataggagagatctccgacttgcatcaaatgcaatatgtagcgctgttccggtccattgggtacctacctcacgtacaacgtggtcaatacacgcacaccatcaatggatgaccactgaagacatgttaacagtatggaatcgtgtctggatagaagacaacccatggatggaagataaaacccctgtcactacttgggaagacgtgccgtacctcgggaaacgagaagaccagtggtgtggttccttgataggcctcacctcgagagcaacatgggctcaaaatatattaacagcgatccagcaagttagatctctgatcggggacgaagagtttctggattatatgcctagcatgaaaagattccgaaaagaagaggaatcagagggggcaatatggtga

SEQ ID NO: 23131 - RNA, 9873 nt, synthetic construct
  misc_feature 1..9873: note = derived and/or modified CDS sequence (opt6) from DENV-3__GQ868626__SS-prME
  source 1..9873: mol_type = other RNA
acgagtttatgtttaatgatgatgttacccgcaacgttagcgtttcatttaaccagtagagatggagaaccaagaatgatagtaggcaaaaatgaaaggggaaaaagtttattgtttaaaaccgctacaggaattaatatgtgtacactcatcgctatggatctgggagaaatgtgtgacgacactgttacttataaatgtcctctaattgcagaagtagaaccagaagacatagactgttggtgtaatcttacgtctacgtgggttacatatggaacttgtaatcaagcaggagaacaccgaagagacaaacgatcagttgcactagcgccacatgtcggaatgggactagacacacgtacacaaacttggatgagtgcggaaggagcttggagacaagttgaaaaagtggaaacatgggcactgcgacatccagggtttactatacttgcactatttctagcgcactatatcggtacaagtttgattcaaaaagtagttatcttcatactcttaatgttagtaactccatccatgactatgagatgcgtaggtgtaggaaatagagattttgttgaaggattaagtggagcaacttgggtggatgttgttctagaacatggaggatgtgttacaacaatggctaaaaataaaccaacattagacatagaattgcagaaaacggaagcaacacaactagcaacattaagaaaattgtgcatagaggggaaaatcacaaatataacaacagatagccgttgcccaacacagggagaggcaatattacctgaagaacaagatcaaaattatgtctgtaaacatacttatgtcgatagaggatggggaaatgggtgtggactcttcgggaaagggtccttagtaacttgtgcaaaatttcaatgtcttgaaccaattgaaggtaaagttgtacaatatgaaaatctaaaatatacagtgattataacggtccacacgggcgatcaacatcaagttggcaacgacactcaaggagtgacggtggaaattacaccccaggcaagcacagtagaagcggtactgccagagtatggcacactaggattagagtgcagcccgagaactgggttggacttcaatgaaatgatactgctaacaatgaaaaacaaagcatggatggtgcaccgtcaatggttcttcgaccttccacttccttggacatcaggcgcaacaattgaaactcctacttggaatagaaaagaactcttggtgacattcaaaaatgcacatgccaagaaacaagaagtagtcgtactgggatcacaagagggtgcgatgcatactgcattgacaggtgctacagaaattcaaaactcaggtgggacttcaatattcgcaggccacctgaaatgtcgactaaaaatggataaacttgaactcaaagggatgagttacgcaatgtgcctaaatactttcgttttaaggaaagaagtttcggagactcagcacgggactatcttaataaaagttgaatacaaaggggaagacgctccttgtaaaatcccattctcaactgaagacggacaaggtaaagcacataatggcagactgatcacagcaaatccagttgttactaagaaagaagaaccggtgaacatagaagcagaaccacccttcggggaaagtaatatagtaataggaataggagataaagctctgaaaataaactggtataagaaaggttcatcgattggaaaaatgtttgaagcaactgcgcgaggcgcacggcgaatggcaatccttggagatacagcatgggattttggatcggttggaggggtgctaaattctttaggaaaaatggttcatcaaatattcggttccgcatacaccgcgcttttcagtggggtcagctggataatgaaaattgggattggtgtactgctaacctggataggactcaatagtaaaaacacaagtatgagcttctcgtgcattgtcattggaataataacattgtatctaggagccgtagtgcaagcagatatggggtgcgtcatcaattggaaaggaaaagagctaaaatgtgggagtggaattttcgtaacgaatgaagttcatacctggacagaacaatacaaattccaggcggattcacctaaaaggttagcaaccgcaatcgctggtgcatgggaaaacggcgtatgtggcatcagaagtactacgcgaatggaaaatttactatggaaacagatcgcaaatgagcttaactacatactttgggaaaacaacattaaactgacagtggttgtcggtgatatcatcggagtgctcgagcaaggaaaacgcacattgaccccacagcccatggaattaaaatacagttggaaaacttggggaaaagcaaaaatagtaactgctgaaacacagaacagttcttttatcatagacggcccaaatacaccagaatgcccatcagctagcagggcgtggaacgtatgggaagtggaagactacggttttggtgtattcacaaccaatatatggttaaaattaagagaagtttatacacaatcatgcgaccatcgcttaatgagtgctgccataaaagatgagagggccgtgcatgcagatatgggttattggatagaatcgcagaaaaatggatcatggaaactcgagaaagcatcatttatagaagtaaaaacgtgtacgtggccaaaaagtcataccttatggtctaatggagtactcgagagcgacatgatcattccaaaatctctggcgggacccatatcgcaacataaccatagaccaggataccacacgcaaactgccggaccatggcaccttggaaaattagaactagattttaattactgcgaaggcactaccgtagtcataaccgaaaactgtggaaccagaggtccaagtttaaggacaacaacagtttcaggtaaactaatacacgagtggtgctgcagatcatgcacattaccgcctttgcgatatatgggagaagacggatgctggtacgggatggaaataagaccaataaatgagaaagaggagaatatggtgaaatctctcgtttcagctggtagtggcaaggtagataacttcacaatgggagtcttgtgcctggcaattttgttcgaagaagtcatgcgtgggaaattcggcaagaaacatatgattgctggcgtcctttttacgtttgtactattactatcaggtcagatcacctggcgggatatggctcatacgcttataatgattggatctaacgcaagtgatcgcatgggtatgggtgtcacttacttagctttgatagctacatttaaaattcaaccgttcttagcactcggattcttcttaagaaaattgacttccagagagaatcttctattgggcgttggtttagcgatggctacaacacttcaattacctgaagatatagaacaaatggcaaacggcattgctttaggattaatgacgttgaaacttataacgcagtttgagacataccagttatggaccgctctagtatcgctaacctgcagtaataccattttcacgctaaccgtggcttggaggacggctacgctaatattagccggtgtatctttgctacctttatgccaatcttcttcaatgaggaaaacagactggctgcctatgacggtagcagctatgggggtccctccactgcccttattcatttttagtctgaaagatacaccgaagcgtcgcagctggccattgaatgaaggtgttatggcagtaggactcgtttcaatcctcgcaagctcattgctgagaaacgacgtcccaatggctggtcccctagtagccggaggtctcctaatagcgtgttacgtaataactggaacaagtgccgacttgacagttgaaaaagcagccgacgtgacttgggaggaggaagcggaacaaacaggagtttcacataacttaatgataacagtcgatgacgatggcactatgagaataaaggacgatgaaactgaaaacatactcactgtcctattaaaaacagcactattaatcgtaagcggtatatttccgtatagtatcccagcaactctcctggtctggcatacctggcaaaaacaaacacaacgttctggcgtactgtgggatgtgccgtcaccacctgaaacacagaaagcggagttagaagagggagtctatcgtatcaagcaacaaggcatattcggtaaaactcaggtgggagtgggtgtacaaaaagaaggcgtgttccatactatgtggcacgtgactcgtggagcagtactaacgcacaatggaaagagacttgagcctaactgggcaagcgtaaagaaagatttaatatcttatggcggtgggtggcggttaagtactcaatggcaaaaaggagaagaagtgcaagttatagctgttgaaccaggtaaaaatcctaaaaatttccaaactatgccaggaattttccaaacaacaacaggagaaataggtgccatagcgctggactttaagccggggacaagcggatccccgataataaatagagaaggaaaagttgtaggactatatggtaatggtgtggttactaaaaacggtggttatgtttctggtatagcacagactaatgccgaacccgacggcccaacaccagaattagaagaggagatgtttaaaaagagaaatttgaccattatggacttacacccaggtagcggaaaaactcggaaataccttcctgcaatagttagagaagctatcaaacggaggctaagaacactaattttagctccgacacgggtggtggcggcagagatggaagaggcacttaaaggactgccaatacggtatcaaactacagctaccaagagcgagcatacaggcagagaaattgtggacttgatgtgccacgcaacattcacaatgagattgctcagtcccgtccgagtgcccaattataatctcattattatggatgaggctcatttcacagaccccgcgtctattgcggcgcgaggatacataagtaccagagtagggatgggagaagcggctgccattttcatgacggcaacgcctccgggaacagcagaagcatttccacaaagcaatgcccctatacaagacgaggaaagagatataccagaaaggtcttggaactccggaaatgaatggattaccgattttgtgggcaaaacagtatggtttgttccttcgataaaagcaggaaacgatatcgcgaactgtcttcgaaagaatggtaagaaagtcatccagttaagcaggaaaacattcgacaccgaataccagaaaactcgtcttaacgattgggacttcgtagtaactactgacataagcgaaatgggagcgaattttaaagcagacagagtaattgaccctagacgatgccttaaacctgtaattttaactgatggcccagagcgtgttatacttgcggggccaatgccagtaacagcagccagtgctgctcaaagacggggccgtgtaggcaggaatccccaaaaagagaacgatcaatatatattcacaggtcaacctttaaacaatgatgaagaccatgcccactggaccgaagcaaaaatgctactggataacattaatacccccgagggtataattccagcactattcgaacccgaaagagaaaagtctgcggcaatagacggagaatataggttaaaaggagaatctcgcaaaacatttgtggaattaatgcggagaggcgacctgcccgtatggttggcatataaggtggcttccgaaggaataaaatataccgatcgaaagtggtgctttgacggagaaagaaataatcaaatcctcgaagaaaatatggacgtagagatatggacaaaggaaggagaacgtaagaaattaaggccaagatggttagacgctaggacttacagtgatccgttagcgctcaaagagttcaaggattttgctgcaggaagaaaaagtatcgcgttagatttggttacagagattggtagagttccaagtcaccttgcacatcgaactcggaatgcgttagacaacttagttatgttacacacgtctgaacatggaggccgggcgtatagacatgccgttgaagaacttcctgagacaatggaaacacttttacttctaggtttaatgatactcctcacaggaggagcgatgctgttcttaataagtggaaaaggaataggcaaaaccaccataggactcatctgtgtaatcgtttcgagcgggatgttatggatggctgacattccattacaatggatcgcctcggcgatcgtgctagagttctttatgatggttttactcataccagaaccagaaaaacaacgaacacctcaagacaaccaactagcgtatgtagttattggaatactaacgctagcggcaatagtagctgctaatgaaatggggttattggaaacgactaaacgagatttgggtatgtccaaggaacctggagtagtaagcccaacgagctatttggacgtagatctacatcctgccagcgcatggaccctttatgctgtagcgactacagtaataaccccgatgttacggcacacaattgagaactcaacagccaatgtaagcctggcagccatagcaaaccaagccgtcgttttaatgggattagacaaaggctggcctataagtaagatggacctaggagtaccgttactcgcattaggttgttattcccaagtcaatcctttaacgctcacagcagctgtactactattggttacacattatgcaatcattggtccaggtctacaggctaaggcgacaagagaagcacaaaaacgcacagccgcaggaatcatgaaaaaccccacggtcgatggaataatgaccattgacttagatccagtaatttatgatagtaaatttgaaaagcagctagggcaagtaatgttgctcgtactttgtgccgtacagctattattgatgcgtacttcatgggccttgtgtgaagcactgacacttgcaacaggacccatcacaactttgtgggaaggcagtcctggaaaattttggaatacaactatagccgtttcgatggcaaatattttcagaggcagctatctcgccggagccggacttgcattctccataatgaagagtgttggcacgggacggcgtggcacaggttcacagggcgaaaccctaggggaaaaatggaagaagaaattaaaccaattaagcagaaaagaatttgatctttacaaaaagagtggcataacagaagtagatcggactgaagctaaggaaggcctcaaacgtggagaaactactcaccatgcagtatctcgcggttcggcaaaattacagtggttcgtggaacgcaacatggtaataccggagggaagggtgatagacttaggatgtggacggggtggatggagttattattgtgcaggactaaagaaagtcacggaagtcagaggatacacaaaaggagggccaggccatgaagaaccagttccaatgagtacatatggttggaatatcgtaaaactaatgagcggcaaggacgtcttttacctacccccagagaaatgtgatactttattatgtgatataggggagagctcacctagtcccacagtcgaggaaagcagaactatcagagtactgaaaatggttgaaccatggctaaagaataatcaattttgcataaaagtgttaaatccttatatgcccacagtaatcgagcaccttgagagattacaaagaaaatacggaggaatgcttgtaagaaatccgctaagcaggaactctactcatgaaatgtattggatctcaaatggaaccggaaacatagtatctagtgttaatatggtttccagattactacttaaccgcttcacaatgactcataggagaccgacaatagaaaaagacgttgatctaggagctgggactcgacacgtaaatgcagaacctgagacacccaatatggacgtaataggggagagaataaaacgtataaaagaagaacacagctctacttggcactatgatgacgaaaatccctacaagacgtgggcttatcatggttcatacgaagttaaagcaacgggcagcgcgtcatccatgataaatggtgtcgtcaaactactgacgaaaccttgggatgtcgttcctatggttacacaaatggcaatgacagatactactcccttcggccaacagagagtcttcaaggaaaaggtagataccagaactccaagaccaatgccaggaacaagaaaagttatggaaataacagcggagtggctatggcgaacactagggcgaaataagaaacctcgtctctgtacaagggaggagttcactaagaaagtgaggaccaatgctgctatgggtgctgtattcacagaagaaaaccaatgggatagcgctagggcagctgttgaggacgaggagttctggaagttagttgatagagaaagagaattacataaattaggaaaatgtggttcatgtgtttacaatatgatggggaaacgcgagaagaaactgggcgagttcggcaaagccaagggttcacgagcgatatggtacatgtggctaggagcgagattcttagaatttgaagccttaggatttctaaacgaagatcattggttctcaagagaaaattcatattctggcgtagaaggagaaggacttcataagttaggttatatattacgtgacataagtaaaataccaggaggtgcaatgtatgcagacgacactgcagggtgggacacacgaattactgaggacgatttacataatgaagagaagataacacaacagatggatcccgaacatcgacaactcgccaacgcaatatttaaacttacttatcaaaacaaagttgttaaggtacagcgaccaacaccaaaaggcactgtcatggacattatatccagaaaagaccaacgggggtcaggtcaagtagggacgtatggcctcaacacctttacgaatatggaagcccaattggtacgacagatggaaggcgagggagtactatcaaaggctgatttagaaaacccacacttacttgagaagaaaattacgcaatggctggaaaacaaaggtgtcgagaggttaaagcgtatggccatatcgggcgatgattgcgtagtcaagccaatagatgacagattcgcaaacgccttattggcactaaatgatatgggcaaagtaagaaaggacatcccacaatggcaaccaagtaaaggttggcatgattggcagcaagttccattttgcagccatcactttcatgaactaatcatgaaagacggaagaaaactggttgtaccttgtaggccgcaggatgagctcataggtagagcaaggataagccaaggcgctggatggtcattaaaagaaacagcctgtctaggaaaagcatatgctcagatgtggagtctaatgtatttccacaggagagatttgagacttgctagtaatgcaatttgtagcgccgtccccgttcactgggttcccacctcccgaactacctggagcatacatgctcatcaccaatggatgaccacggaagacatgctcgctgtatggaatagggtttggatagaagacaatccttggatggaggataaaacgccagtaacaacatgggaagacgttccatacctaggaaaacgcgaagatcagtggtgcggatcacttattggcttgacctcacgcgctacttgggcacaaaacattttaacggcgatacaacaagtacgttccttgataggagatgaagagttcttagattacatgccttcaatgaaaagattccgcaaagaagaagagtcggagggagcaatttggtga

SEQ ID NO: 23132 - RNA, 9873 nt, synthetic construct
  misc_feature 1..9873: note = derived and/or modified CDS sequence (opt6) from DENV-3__GQ868627__SS-prME
  source 1..9873: mol_type = other RNA
acatcattatgcctaatgatgatgcttccagcaacgttagcttttcacttaacgtcacgggatggagaacctcgaatgatagttggcaaaaacgaacggggaaaatcattactttttaaaaccgcaacaggaataaacatgtgtacccttatcgcaatggacttaggagaaatgtgcgacgacactgtaacatacaaatgcccacttatcgcagaagtcgaaccagaagatatcgattgttggtgtaaccttacttccacatgggtaacgtacggtacttgtaatcaagcaggagagcaccgtagagataaacggtctgtggcacttgcaccacatgtcggcatgggattggacacaaggactcaaacatggatgtctgctgaaggagcgtggcgacaagtggaaaaagttgaaacatgggcattgcgtcaccctggatttactatcttggcattgtttttagctcactatatcggcacatcactaatacagaaagttgttatattcatacttctgatgttagttactcctagcatgacgatgcggtgtgttggagtaggaaatcgcgatttcgtagaaggcttgagtggcgctacatgggtcgatgttgtattggagcatggaggctgtgttaccacgatggctaaaaacaaacctactctcgacatagaactgcagaaaacggaggctacacaactagctactttacgtaaactgtgcatagaaggtaaaataaccaatatcactacggactcacgatgcccgacgcaaggtgaagcaatattgccggaagaacaggaccaaaattatgtatgcaaacatacttacgtcgatcgtggatggggtaatggttgtggactattcggtaaaggatccctagtaacatgcgcaaaatttcagtgcctcgaacctatagagggaaaagtggtccaatatgaaaatctaaaatacacagtcatcattacagtacacaccggcgaccaacatcaggtggggaacgacacacaaggtgtaacagtcgaaataacaccccaggcaagtacggtagaagcggtacttccagagtatggaacattaggcctcgaatgcagtccacgcactggccttgacttcaacgaaatgatcttgctaaccatgaaaaacaaggcttggatggtacatagacaatggttctttgatttgccactaccatggacatctggtgcaacgacagaaactcccacttggaaccgaaaagaactattagtaacctttaaaaatgcacacgccaagaaacaggaagtagttgttctaggaagccaagaaggtgcgatgcacacagccctcacaggtgcaacagaaatccaaaattcaggaggtacgtccatattcgcagggcatcttaaatgtaggctaaaaatggataaattagaattaaaaggaatgagctatgcaatgtgtttaaatacgttcgtgttgagaaaagaagtatcagaaacgcaacatggaacgatactaataaaagtagagtataaaggagaagacgcgccatgtaaaatacctttttctacagaagacggccaaggaaaagcacataatggtcgacttataacagcaaaccctgttgtgacgaagaaagaagaaccagtcaatatcgaagctgaacccccgtttggagaaagcaacattgtgataggtatcggcgataaagcattaaaaataaactggtacaagaaaggctcatctatcggaaaaatgtttgaggctacagctcgtggagcaagacgtatggccatacttggagatacagcatgggattttgggtcagtcggtggagttttaaacagtctagggaaaatggtacatcaaatattcggtagcgcatatacagctctttttagtggtgtatcctggattatgaaaatcggaataggggtattgttaacttggataggtttgaacagcaaaaacacctcaatgagtttcagctgcatagtcatagggatcattaccctatacctgggagcggttgtgcaagcggacatgggttgcgtaataaactggaaaggcaaagaactaaaatgtggatcagggatttttgttacgaatgaagttcatacatggacagaacaatataaattccaagctgactcaccgaaaagattagcgacagcgatcgcgggagcttgggaaaacggtgtatgtggcatacgtagcaccaccaggatggaaaatctcttatggaaacagatagccaatgagttaaattacattttatgggagaacaacataaaattaactgtagtcgttggagacataataggagtactagagcaaggcaaaagaacattaaccccacaaccaatggagttaaaatactcctggaaaacctggggtaaagcaaaaatagttaccgccgagacacaaaatagctcattcataatagatggcccaaacacacccgaatgtccgagtgcatcccgtgcttggaatgtatgggaggtagaagattacggtttcggggtatttacaacaaatatatggctaaaactaagagaagtctacactcaatcgtgtgatcatcgtttgatgtcggcagcaattaaagacgagcgtgccgtacatgcagacatgggatattggattgagagtcagaaaaacgggtcgtggaaattggaaaaagcatcgtttatagaggttaaaacttgtacgtggcctaaaagccatacgttgtggtcaaacggagtattggaaagtgacatgataataccaaaaagtttagcgggtcctataagtcaacataatcacagaccaggatatcatactcaaactgccggcccatggcatttaggaaagctcgagcttgatttcaactattgcgaaggaacaaccgtggtaataactgagaactgcgggacgagggggccgtccttaagaactaccaccgtatcaggaaagttaatccatgaatggtgttgtcgtagctgtacattgccaccactaagatatatgggagaggacggatgctggtacggtatggaaattcgacccattaacgaaaaagaagaaaacatggtaaagagcttagtttctgcgggttctggtaaagttgataactttaccatgggtgtactatgtctggccattttattcgaagaagtaatgagagggaaatttgggaaaaagcatatgatagccggtgtactttttacctttgtactcttattaagtgggcaaataacatggcgagatatggcacatacattaattatgataggatcgaacgcctcagaccgaatgggcatgggggtgacgtatctagcactgatcgcgacttttaaaatacaaccttttcttgcacttggcttctttctgaggaagttaactagcagagaaaatctactacttggcgtaggattggcaatggccacgactttacaattgccggaagatatagaacaaatggctaatggaatcgcactaggattaatgacgttaaagttgataacacaattcgaaacataccaattatggacagcgcttgtatccctcacttgcagcaacactatatttactttaaccgttgcttggaggactgctacattaatcttagccggagtctcacttctacccttgtgtcagtcgtcatcgatgaggaaaacagattggctacccatgacagtcgcagctatgggcgtccctccactaccactatttatattttcattaaaagatacgccaaagcggcgttcctggcccttaaatgagggtgtaatggctgttggattggtaagtattcttgcgagttccctacttagaaatgacgtacccatggcaggtccgctggtagctggaggacttttgatagcatgctatgttatcaccgggacatctgcagacctcactgttgaaaaagcagcagatgtaacttgggaagaagaagcagaacagacaggtgtaagtcacaatctaatgataacagtagatgatgatggaacgatgagaataaaagatgacgaaacagaaaatattctaaccgtactattgaagacagcactattaatagtatccggaatatttccgtactcaattccagccacgctcctagtatggcatacatggcagaaacaaacacaaagatcaggggtactttgggacgtacctagtcctccggagacacaaaaagcagaattagaagagggggtttatcgtataaaacaacagggaatatttggaaagacacaagtaggcgttggagtacaaaaggagggggtatttcacacaatgtggcacgtcacgaggggtgctgttctaactcacaacggaaagagactagagcccaattgggcatcagttaagaaagatctaattagttatggcgggggatggcgtttatcgacacaatggcaaaagggcgaagaggtgcaagtaatagccgttgaaccaggcaaaaatcccaaaaatttccaaaccatgccgggtatattccagactaccacaggagaaattggcgctatcgcgctagatttcaaacccggaacgagcgggtcgcctattataaacagggaaggcaaagtcgtgggcctctatggtaatggtgtcgtgactaaaaacggtggatacgtaagtggcatagctcagacgaatgcagaaccagatgggcctacaccagaactcgaagaagaaatgtttaagaaacgaaatctcacaataatggacttgcaccccggtagtgggaaaacaagaaaatacctgcctgcaatagttagagaagcaataaaaaggagattaaggacactcatcctggctccaacgcgagtagtggcagcagaaatggaagaagcattaaaggggttaccgatacgttatcaaaccacggcaacaaagagtgagcacacgggccgtgaaatagttgatttaatgtgtcacgcaacattcacaatgcggctgctaagtcctgtgagagtgccaaattataacttaataattatggatgaagctcactttacagacccggcttcaattgcagcaaggggttacatttctacacgagtaggtatgggtgaagctgcagcaatattcatgacagcgacaccaccgggtacggcagaggcgttcccccaatcgaacgcacctatacaagatgaggaacgtgatatccctgaaagaagttggaactcgggaaatgaatggattaccgattttgttggcaaaacagtgtggtttgtaccgtcaataaaagcggggaatgacattgcaaactgtctccgcaaaaatggcaagaaagttatacagttaagtagaaagacattcgatacagaatatcagaaaacgagacttaatgactgggattttgttgtaacaaccgatatatcggagatgggtgctaacttcaaagcagatagagttatcgatccgaggcgttgcttaaagcccgttatactaacagatggaccagaacgcgtaatacttgcagggccgatgcccgtaacggcggcctcggcagcgcaaagaagaggtagggttggtaggaacccacaaaaagaaaatgaccaatatattttcacgggccaaccgttaaacaatgacgaggaccacgcacattggacagaagctaaaatgttacttgataacataaacactcctgaaggaattataccggccttatttgagcctgaaagagaaaagtcggcagccatcgatggggaatacagattaaaaggcgaaagcaggaaaactttcgttgaactaatgaggcgaggtgaccttccagtatggttagcctataaagttgcatccgaaggcataaaatataccgatcgcaaatggtgttttgatggggagagaaacaatcagatattggaagaaaatatggacgttgaaatatggactaaagaaggagagcgtaagaaattgagacctagatggctagatgcacggacctattcagatccattagccttgaaagaatttaaggatttcgcagcaggccgtaaaagtatagcattagaccttgttacagaaattgggagagtccctagtcatttagcgcatcgaacaagaaatgctctagataatttagtgatgctacacacaagcgaacatggcggccgagcataccgtcacgcagttgaggaactcccagaaactatggaaacgctgttgctacttggacttatgatactattaaccggtggtgcaatgctttttcttatttctggtaaaggaataggtaagaccaccattggacttatatgtgtcatagtatctagtggaatgttatggatggccgacataccactacaatggattgccagcgctatagtgctggagttctttatgatggtactattgatacctgaacccgagaaacaaagaacaccccaagacaatcaactggcgtacgttgtcatcggaatattaacattggccgctatagttgcggcgaatgaaatggggcttctcgaaactacgaagagggacctaggaatgagcaaagaacctggtgtagtatcaccgacttcatatctggacgttgatctccatccagcatccgcatggacgctctatgctgttgctaccaccgttatcacgcccatgttaaggcacactatcgaaaattccacagctaacgtatcacttgcagccatagcgaaccaggctgtcgtgttaatgggtctcgataaggggtggccaataagcaaaatggatcttggcgtacctttacttgcactaggttgctatagtcaggtaaatccactaacattaacagctgctgttttgttacttgtgacgcactatgcgataattggcccaggactgcaggcaaaagccacaagggaagcacaaaaacgaacagcagcaggcattatgaaaaatcccactgtcgacggtataatgacgatagatttggatccagtaatttacgatagtaagttcgaaaaacagttaggacaagtcatgctacttgtgttatgcgcagtgcaattattactaatgcggacctcatgggccctgtgcgaggctctaactcttgcaaccggcccgataactactctttgggaaggttctccgggaaaattttggaacacaacaattgcagtgagcatggcaaacatattcaggggaagttatttagccggagccggtttggcgttcagtataatgaagagtgttggcacagggaggagaggaactggaagccaaggagaaacactgggtgaaaaatggaagaagaaactcaatcaactctcacgcaaagagttcgacctatacaagaaatctgggataactgaggtcgacaggacggaagccaaggaaggattaaaacgtggcgaaacgacccatcacgctgtgtctagagggagtgccaaacttcaatggtttgtcgaaagaaacatggtaattcctgaaggacgagtaattgaccttggatgcggacgagggggatggtcttactattgtgccggtctgaagaaagtcactgaagttagaggctatactaaaggaggaccaggacatgaggagcccgttccgatgtcaacctacggatggaatattgttaagctgatgtctggtaaagatgtattctaccttccaccagaaaagtgtgacactctgttatgcgatataggtgaaagcagcccatcaccaactgtggaggagtcgaggacaattagagttttaaagatggtagaaccttggctaaagaataatcaattttgtattaaagtattaaatccttacatgccaacagttatcgaacacctcgaaaggctacaaaggaaatacggaggtatgttagtacggaacccattatctagaaactccactcatgaaatgtattggatatcaaatggaacaggtaatatagtttcatccgtgaacatggtcagtcgactgttactgaaccgttttacgatgacccaccgacgacctacgattgaaaaagatgtagatttaggcgcgggaaccaggcatgtgaatgctgaaccagaaaccccaaatatggatgttattggagaacgaataaaacgaatcaaggaagaacactcatccacatggcattacgatgacgaaaatccttataaaacatgggcatatcatggaagttacgaagtcaaggcaactggatcagcatcctcgatgattaacggagtagtcaaactactgactaaaccatgggatgtagtcccaatggtaactcaaatggctatgactgatactacgccatttgggcaacaaagagtgtttaaagaaaaagtagatacgagaacaccaagaccaatgccgggtacacgaaaagtgatggaaataacagcagagtggctgtggagaacacttggcagaaacaagaaaccccgtttatgtacaagggaggaatttacgaagaaagtgaggacgaatgccgcaatgggcgctgtgttcactgaggaaaatcagtgggatagtgcaagagcagctgttgaagatgaagagttctggaagttagtcgacagagaaagagagctacacaaattaggtaaatgtggatcgtgtgtttataatatgatggggaaaagagagaagaaactaggagagttcggaaaagcaaaaggaagtagagcaatatggtatatgtggttgggcgcaagatttctggagtttgaggcacttggatttttaaacgaagaccactggttctccagggaaaattcttattccggggtagaaggagaaggtctgcacaaattaggttacattttgagagacatatccaaaattcctggcggagcaatgtacgcggatgacactgcagggtgggacactcggataactgaggatgatctgcataatgaagaaaagataacacagcaaatggatccagaacatcgtcaattagcaaacgccatatttaaactaacataccagaacaaggtcgttaaagtacaaaggcccacaccgaagggaacagtaatggatataataagtaggaaagaccaaagaggcagtggacaagtaggaacttacggattgaatacatttacaaacatggaagcacaattagttcgtcaaatggagggggaaggcgtattatcgaaagctgacttagaaaatccgcatctacttgagaagaaaataactcaatggttagagaacaagggagtagagcgtctaaagaggatggcaatctcaggagatgattgcgtagtaaaacccatcgacgacagatttgcaaatgcactacttgcactaaatgacatgggtaaggttcgcaaagatataccacagtggcaacctagtaaagggtggcatgactggcaacaagtcccattttgctctcaccactttcatgaattaataatgaaagatggaagaaaattagttgtaccttgcagaccacaagatgaactgataggtcgggcccgaatcagccaaggggcaggatggagcctaaaggagactgcttgtttaggaaaggcttatgcacaaatgtggagtttaatgtacttccataggagagacctcagattagcaagtaatgctatatgctcggcggttccagtgcattgggtaccgacttccagaacaacatggtcaatacatgcacaccaccaatggatgactacggaagatatgctagcagtctggaatcgcgtatggatagaagacaatccctggatggaagataaaacccctgtaaccacttgggaggatgtcccatacttaggtaaacgcgaggatcagtggtgcggttcattaattggtttaacatccagagcaacctgggcgcaaaacattttgactgctatccaacaagttcgatctctaataggcgatgaagaatttttggattacatgccctcaatgaaacgtttcagaaaggaagaggagagcgaaggagctatttggtaa

SEQ ID NO: 23133 - RNA, 9873 nt, synthetic construct
  misc_feature 1..9873: note = derived and/or modified CDS sequence (opt6) from DENV-3__FJ639721__SS-prME
  source 1..9873: mol_type = other RNA
acaagtttatgtttgatgatgatgttacctgcaacactcgcctttcatttaacatctagagatggcgaaccaagaatgatagtaggtaaaaatgaacgagggaaatccttgttatttaaaacagctacgggaattaatatgtgcacgttaatagccatggatttaggagaaatgtgcgatgacacagtaacatataaatgccctctcatagtagaagttgaacctgaagacatagattgttggtgtaatctaacctcgacatgggtaacgtatggtacttgtaaccaagcaggagaacataggagagataaaagatcggtagctttagcccctcatgtgggtatgggcttagatacccgtactcaaacgtggatgtctgcagaaggggcttggagacaagtagaaaaagtggaaacatgggctttacggcacccaggatttaccatactagctttatttttggcccattacatcggaaccagtttaattcaaaaagtagtaattttcatattattaatgttagtgacaccttcaatgacaatgcgttgcgtcggagtcgggaacagagattttgtagaaggtttatctggggccacctgggtagatgttgtccttgaacacgggggttgtgtcactaccatggctaaaaacaaaccaacgcttgatattgaacttcagaaaactgaagcaacacaactagctaccctaagaaaattgtgtatagaagggaaaataacaaatatcactacagatagtcgatgtcctacacaaggtgaagctatactgcccgaagaacaagatcaaaactacgtgtgtaaacatacttatgttgatcgaggatggggcaatggatgcgggctgttcggaaaaggctcattagtaacatgtgcgaaatttcaatgtttagaacccatagagggaaaagtcgtacaatacgagaatctaaagtacacagtgataataacagtgcatacgggagatcaacatcaagtaggtaatgatacacaaggtgtcacagtagaaattacgccacaggcttctactgtagaggcggtactcccggagtatggcactttagggttggaatgctcaccccgtacaggactagatttcaatgaaatgatattgctaacaatgaaaaataaggcgtggatggttcataggcaatggttctttgacctcccgttaccatggaccagtggagcaactaccgaaaccccaacatggaatagaaaagagttgttggtaacatttaaaaatgcacatgctaagaaacaagaggtagttgtgctcggaagtcaagagggagcgatgcacacggcgttaacgggtgcaacggaaattcaaaattcaggagggacttcgatattcgctggtcacttaaagtgtaggttgaaaatggacaagttggaattgaagggaatgtcttatgctatgtgtctaaatacgtttgtgctcaagaaagaagtttctgagacacaacatggaacgatcctgattaaagtagagtataaaggagaagacgcaccatgtaagatcccatttagtactgaagacggacaaggtaaggctcataacggacgtctcataacggcaaatccagtagtaaccaagaaagaagaacctgttaacattgaagcagaaccgccttttggtgaaagtaacatagtcattggtattggcgataaagctctaaagataaactggtataaaaagggatcctcaatagggaaaatgttcgaagcaaccgcaagaggtgctcggcggatggcaatattaggggataccgcatgggactttggtagcgtcggaggtgtattaaacagtctaggaaaaatggttcatcagatctttggaagtgcatacacagcgttattttctggtgtgtcatggatcatgaagatcggtattggagtattacttacatggatcggtttaaactcaaagaacacgagtatgtcattttcctgtatagtgataggaattataactttgtatctgggagcagtagtccaagccgacatgggatgcgtaataaattggaaaggcaaggaattaaaatgtggtagtggaatctttgtgactaatgaagttcatacatggactgagcagtacaagtttcaagcagactctcctaagcgtctggctacggctatcgccggcgcgtgggaaaatggagtatgtgggattcgcagtacaactcggatggaaaatcttttatggaaacaaattgctaatgaactaaactatatcttgtgggagaataacattaaacttacagtcgttgtcggagatataattggcgtcttagagcaaggaaaacgaaccttgacccctcaacccatggaattaaaatactcgtggaaaacgtgggggaaagctaaaatagtgacggcagaaactcaaaactcaagttttatcattgatggccctaacacacctgaatgtcctagtgccagccgagcatggaatgtatgggaagtcgaggattacggatttggcgttttcacaacaaacatctggttaaaactaagagaagtatatacacaatcctgcgatcataggctaatgagtgcagccataaaagatgaacgtgcagtgcatgcagatatgggatattggatagagtcgcagaaaaatggtagctggaaactagaaaaagcctcctttattgaggtaaaaacctgcacttggccgaagtcgcacacattgtggagtaatggagtgttggagtcggatatgattattccaaagtcgttggcgggacccataagccagcataatcataggcctggatatcatacacaaacggcaggtccatggcatttagggaaactcgagttagattttaattactgtgaaggaactacggtggtcataacagaaaattgcggaacaagaggtccttcacttcgaacaaccacggtctccggaaaactaatacatgaatggtgttgtagatcctgtacactaccgccgttgcggtacatgggtgaagacggatgctggtacgggatggaaatcagaccaataaacgaaaaggaggaaaatatggtaaaatcacttgtttccgcgggttcaggtaaggttgacaattttacaatgggagtgttatgtctcgcaatactttttgaggaggttatgagagggaaatttggtaaaaagcacatgattgcaggagtattattcacttttgttttgttattaagtgggcaaatcacgtggcgagatatggcccacacattaattatgataggttcaaatgccagtgaccgaatgggaatgggcgtcacatatctggcacttatcgcaaccttcaagatacaaccttttctaactcttgggttctttttgcggaaactaacaagccgggagaatttgcttttaggtgttggattagctatggcaactacacttcagctgcctgaagatatcgaacaaatggcaaacggtatagcgttaggactaatgactttaaagctcataacccaatttgagacctaccaattgtggacagcattagtgtcactgacttgctcaaatacgatctttactttaacagttgcatggagaacagctaccttgattttagcaggggtaagtctcttaccactatgtcagagttcttctatgcgtaaaacagattggttaccaatgactgtagccgcaatgggtgttcctccactacctctatttatcttttctctgaaagatgctcctaaacgtagatcatggcccctgaatgaaggcgtaatggccgtagggctagtatcgatacttgcatctagcctactcagaaatgatgtacctatggcagggccgctcgtagccggtggattattaattgcatgctatgtaatcacaggaacaagtgccgatctaacagttgaaaaagcagcggatgttacgtgggaggaagaagcagaacaaacaggtgtaagtcataatttaatgattaccgtagatgatgatggaaccatgcgaataaaagatgatgagacagagaatattctaactgtactattaaaaacggcgctactaatagtttcaggaatttttccgtatagtattccagcgacgctattagtatggcatacctggcaaaaacaaacccaaagaagtggtgtcttatgggatgtaccttccccgccagaaactcaaaaggctgaactggaagagggtgtctatcgaataaaacaacaaggaatttttggaaagacacaagtgggggtaggagtccaaaaggaaggggtcttccatactatgtggcatgtcacccgaggtgctgtactaactcataatggcaagagattagaacctaattgggcatctgtcaagaaagatcttatttcctacggtgggggctggcgattatcaacacagtggcaaaaaggtgaagaagtgcaagttatagcggtcgaacccggtaagaacccgaaaaattttcaaactatgcccgggattttccaaactactactggtgagataggagctatagctcttgactttaaacccggtacctccggatcaccaataataaatagagaaggaaaagtagtcggattatatggcaacggcgtagtaacgaaaaatggaggatatgtaagcggaatcgctcaaacaaacgccgaaccagacggcccaactcccgagttagaggaggaaatgttcaagaaacgaaatttaactataatggacttacatcccggctccggaaaaacacgaaaatatttgcctgccattgttagagaagcaataaaaagacgcttaagaacattaattttagctccaacacgagttgtagcagcagaaatggaagaagcacttaagggattgccaatacgttatcagacaactgccacaaaatcagaacacacgggacgcgaaattgttgatctaatgtgtcatgcgacgttcactatgcggctactgtcacccgtcagggtaccaaattataatttaataattatggatgaggctcattttacggaccctgcctcaatagcagcaagagggtacatatcaacacgcgttggaatgggcgaggcagcagccatattcatgaccgccacgccgcctggtacagctgaggcttttccgcagagcaatgcaccgattcaagacgaagaaagagacattcctgaaagatcttggaacagtggtaatgaatggataaccgactttgtcggcaaaacagtatggtttgttcccagcattaaagcggggaacgatatagcaaactgcttacggaaaaatggtaaaaaggtcatacaactatccagaaaaacattcgatacagaatatcagaaaacgaggctgaatgattgggactttgttgtcactacagacatatcagaaatgggcgcaaacttcaaagccgacagagtaatagatccgcggcgttgtttaaaaccggtaatacttactgatggaccggaacgtgtcattttagcaggacctatgccggtaacagccgcctcggccgcacagcggcgagggcgtgtgggacgaaatccacaaaaagagaacgatcaatatatatttactggacaacccttaaataatgacgaggaccatgctcattggacggaggccaaaatgctattagacaacataaataccccagaaggaattattccagcactttttgaaccggaaagggagaaaagcgcggccattgatggggaataccgtctcaaaggcgaatctaggaaaacttttgtggagttaatgcgccgaggggacttacccgtttggctggcacataaggtggcaagcgagggcattaagtatacagatagaaaatggtgctttgacggcgaacgcaataatcaaatattagaagaaaatatggacgtcgagatctggacaaaggaaggagaacggaagaaactacgcccaagatggttagatgctcgcacttatagtgacccattagccttaaaggaatttaaagactttgccgcggggcgtaaatcaattgctctggaccttgtcacagaaatcggtagagtgccctcccatctagcccaccgtacacgtaatgcattagacaacttagtaatgttacatacttcagaacatggagggagagcgtatcgacacgctgttgaagaactcccagaaacaatggaaactcttcttcttctagggttgatgatacttctgactggaggtgccatgctattcttggtctccggaaaggggataggtaaaacaactattggactcatctgtgtaatagtatcctcgggaatgttatggatggcagacattccattacaatggatagcatccgcgatcgtattggagtttttcatgatggttttattgatcccggagccagaaaaacaaagaacacctcaagacaatcaacttgcttacgtagtgatagggattttaaccctcgcggcaatagtggcagcaaatgaaatgggtttattagaaactactaagagagacttgggtatgtcaaaagaaccaggcgtcgtttcgccaacatcatacttagatgtggaccttcatccagcctccgcctggaccctttatgcagtagcaacaacagttattacaccaatgttaagacacacaatagaaaactcaacagcaaatgtatcattagcagccatagcgaatcaggccgtcgtattgatgggcttagataaaggatggccgattagtaaaatggatttaggcgtccctttgttagccctaggttgctattcgcaagtaaatccgttaacgctaactgcagcagtcttattactggtcacacactatgccataatagggcctggcttacaagcaaaagcaacacgtgaagcacaaaagagaacagctgccggaatcatgaagaatccaacggtagacggcatcatgacaatagatttagatccggtaatatacgatagtaagtttgaaaaacaacttggccaagtaatgctgttagtgctgtgcgcagtacaacttttattaatgagaacttcatgggcgttatgcgaagcgctcacattagctacaggtcctattactactctatgggagggctcccctggtaagttttggaatacaacaatagcggttagtatggcaaatatttttcgaggtagctacctcgcaggcgctggacttgctttctctattatgaaatccgtgggtacaggtcgaagaggaacggggtcacaaggagagaccttaggcgaaaaatggaaaaagaaactcaatcaacttagtagaaaagaatttgacttatacaagaaaagtgggatcaccgaggtggaccgaactgaagctaaagaaggacttaagcgaggagaaactacacatcatgcagtatcaagaggatccgccaaattacaatggtttgtagaaagaaacatggttattccagaaggacgagtaatagacttaggttgtggacgtggagggtggtcatattactgcgcaggacttaagaaagtaactgaggtaaggggatatacaaaaggaggccccgggcacgaagaaccagtaccaatgagcacatacggatggaatattgtaaagttaatgtcaggtaaagatgtcttctatttaccgcctgaaaagtgtgatactctattatgtgacataggtgagtcaagtccaagcccaacagtagaggaatcgaggacaatccgtgtcttaaaaatggtagaaccatggctgaaaaataaccaattttgcattaaagtgttaaatccatacatgccgaccgtgatagaacatttagaaagactccagagaaaatacggaggtatgcttgttcgtaatcctttatctcggaactctacacatgaaatgtattggataagtaacggaactggaaatatagtcagttcagtaaatatggtatcgagactactactaaatcgattcacaatgacgcacagaagaccaacaatagaaaaggacgtagatttgggggcgggaacccgtcatgtcaacgcagaaccggaaacaccaaatatggacgtcattggtgaaagaataaaaagaataaaagaagaacacagctctacttggcactatgatgacgaaaatccctataagacatgggcatatcacgggagttatgaagtaaaagctacagggagcgcctcatcgatgatcaacggagtagtgaaactattaactaaaccctgggatgtcgtaccaatggtaacccaaatggcaatgacggacactactccattcggacaacagcgagtcttcaaagaaaaagttgacacacgtactccacgtcctatgccaggcacacggaaagtgatggaaattacggcggaatggttatggcgtacactgggtagaaataaaaagccaagattatgcacgagagaggaatttactaagaaggttagaacaaatgcagccatgggcgctgtatttacagaagaaaatcagtgggactcagcgagagcagcggtagaagatgaagagttctggaaacttgtcgatcgtgagcgtgaactacacaaactaggcaaatgtgggagttgtgtttataacatgatgggtaaacgcgagaagaaacttggagaatttggcaaagcaaaaggttcacgagcgatctggtacatgtggttaggagctagatttctagaatttgaagcactcggttttctaaatgaagaccattggttctcaagagaaaattcgtatagcggtgttgaaggagagggtctccacaagttaggttatatcttaagagatataagcaaaattcccggaggggcgatgtacgcggatgacaccgccgggtgggacacgaggattacagaggacgacctccataatgaagagaaaatcacacaacaaatggatccggagcatcgccagttggctaatgcaatatttaaattgacataccagaataaagtagtgaaagtgcaaagacctacacccaaaggaacagtcatggacataataagtagaaaagatcaaagaggttctggacaagtcgggacctacgggttgaatacgttcacaaatatggaagcacagttagtacgacaaatggaaggagaaggagttttgtccaagacagacctagaaaatcctcacctcttagagaagaaaatcacgcaatggttggagaacaaaggagtcgaaagattgaaaagaatggctatatctggtgacgactgcgtagtaaaaccaatcgacgataggttcgccaacgcattattagctctgaacgatatggggaaagtccgcaaagatattccacaatggcagccaagtaagggatggcatgactggcaacaggtacccttctgtagtcaccatttccacgagttaattatgaaagatggcagaaagttggtagttccgtgtcgaccccaggatgaacttattgggagagcacgtatatcccagggagcgggttggagtctcaaggaaacagcttgccttggcaaggcgtatgcacaaatgtggtcgcttatgtacttccatcgccgtgatttaagattagcgtctaatgccatatgttcggctgtaccggtgcactgggtacccaccagtaggaccacttggtcaattcatgcgcatcatcaatggatgacaacggaagatatgttaaccgtctggaatcgtgtctggatagaagacaacccatggatggaagataagacacctgttacgacatgggaagatgtcccttatctaggtaaacgtgaagaccaatggtgtggaagtctcataggtttaacatcaagggctacatgggcacaaaatatcttgaccgcgatacaacaagtaaggagtttaataggggatgaagagttcctagattacatgccctctatgaaaagatttaggaaggaagaagaatcagagggagctatatggtag

SEQ ID NO: 23134 - RNA, 9873 nt, synthetic construct
  misc_feature 1..9873: note = derived and/or modified CDS sequence (opt6) from DENV-3__FJ639722__SS-prME
  source 1..9873: mol_type = other RNA
acttctctatgcctaatgatgatgctacctgcaacattagcatttcatttgacatctagagacggagaaccaagaatgattgtgggtaaaaatgaaagaggaaaatcattactcttcaaaaccgctacaggaataaacatgtgtactctaatagctatggacttaggagaaatgtgtgatgataccgtcacttataaatgcccgttaatagcggaagttgaaccggaagatattgattgttggtgtaatctcacatccacatgggtgacgtatggaacatgtaatcaagcaggcgagcacagacgggataaaagaagcgtagcactagctcctcacgttggtatgggtcttgacactagaacccaaacatggatgtcagcagaaggagcatggagacaagtcgaaaaagtagagacatgggcccttcgacatccaggatttacaatattagctctctttctagcccattatattggtactagcttaattcaaaaagtggttattttcatattactcatgctagtcacgccaagcatgaccatgcgctgtgtaggggtggggaatagagacttcgtagaagggctgagcggtgctacatgggtagacgtggttctagaacacggaggatgcgtgacaactatggctaaaaacaaacctacgctcgacatcgaactgcagaaaacggaagcaacacaattggcgacattaagaaaactttgtatagaaggaaaaataacaaacataactactgatagcagatgccccacacaaggcgaagcaatacttcccgaagaacaagaccagaactacgtatgtaaacacacatacgttgataggggatggggtaatgggtgtggattatttggaaaaggttcacttgtcacatgtgcgaaattccagtgtttagagcccatcgagggcaaagtcgtacagtatgaaaacttaaaatacactgtaataattacggtccacacaggtgatcaacaccaagtgggtaacgacacgcaaggtgtaacagttgagatcacgccacaggcaagtaccgttgaagccgtacttcccgaatatggaaccctaggtcttgaatgcagtccacgcactggattagacttcaatgaaatgatcctcctaacaatgaaaaacaaagcatggatggtgcatcgtcaatggttcttcgaccttccattgccttggacatctggagcaacaactgagacaccgacatggaatagaaaagaattgttagttacatttaaaaacgcgcacgccaagaaacaagaggtcgtcgtgttgggatcacaagaaggagctatgcatacagctttaacaggtgcaactgaaattcaaaacagtggaggaacgagtatttttgctggtcatttgaaatgcagattgaaaatggacaaactagagttgaaaggtatgagctatgccatgtgcctcaataccttcgttttaaagaaagaagtatcggaaacacaacacggaactattcttataaaagtagaatacaaaggagaagacgcaccatgtaaaatcccattctctacggaagacggacaaggaaaagcacacaatgggcgactaattaccgcaaatcctgtcgtaaccaagaaagaagaaccagtcaatatcgaagcagagcctccgttcggcgaatcaaacatagtaattggtattggggagaaagcactcaaaattaactggtataagaaagggagttcaataggaaaaatgtttgaggcaaccgcgcgcggagcacgtcgcatggcaatacttggggatactgcatgggatttcggttcagttggaggtgtattaaatagcctaggaaaaatggtacatcagatcttcggcagcgcttatactgcattattctcgggagtttcctggatcatgaaaattggaattggagttttgttgacatggattggactaaatagcaaaaatacgtcgatgtcgttttcatgtatagtcattggaatcattaccctgtacttgggcgcagtagtccaagctgacatgggatgcgttatcaactggaaagggaaagagttaaaatgcggttcaggaatatttgttacaaatgaggttcacacgtggactgaacaatataaatttcaagccgatagtcctaaaagactggcaactgccatagcaggcgcatgggagaatggcgtctgcgggataagatcaacaaccagaatggagaatctattgtggaaacaaatagcgaacgagttaaattatattctatgggagaacaatataaaactgaccgttgtcgtaggcgacattataggggttctagaacagggaaaaaggactttaactcctcaaccaatggagctcaaatactcatggaaaacctggggaaaagcaaaaatagtcacagcagagacgcagaacagcagcttcataatagacgggcccaacacacctgaatgtccatctgcctcacgtgcgtggaacgtttgggaggtcgaggactacggattcggtgtatttaccactaatatctggttgaaattacgagaagtgtacacccaaagctgtgatcataggttaatgagtgcagcaataaaagatgaaagagccgttcacgctgatatgggatactggatagaaagtcagaaaaatggatcctggaaactcgaaaaagcaagtttcatagaggttaaaacttgcacatggcctaaaagccatactctctggtcaaacggtgtactagaaagtgacatgataataccaaaaagtttagcaggcccaataagtcaacacaatcatagacctggataccatacccaaaccgcgggtccctggcatcttggtaaactagaactagatttcaattactgcgaaggaactacagttgttattactgaaaattgtggaacaagaggcccaagtttacggactacaacagtttcaggaaaattaattcatgaatggtgttgtcgaagctgtacactcccgccactccgctacatgggtgaagatggttgctggtacggtatggagattagaccgattaacgaaaaagaggaaaatatggttaaaagcctggtaagtgcgggttctggcaaagtcgataactttacaatgggtgtgctttgtttggccatcttatttgaagaagtaatgcgtggtaaatttggaaagaaacacatgatcgccggcgtactatttacgttcgtactattattaagtggacaaatcacctggagagacatggctcatacattgataatgatcgggtcaaatgcctccgaccgaatgggaatgggagtaacttacttggctctaatagcaactttcaaaatacaaccgtttttagcattaggattctttcttagaaaacttacttctcgggaaaatttattactaggagttggacttgcaatggctaccacgttacaattaccagaagacatagaacaaatggcaaacggcatagcattgggcctaatgacactcaagctaataacacagtttgaaacatatcaattgtggactgctctggtttctcttacttgttctaataccatattcacattaacagttgcttggaggaccgcaactttaatactagcaggagtttctctcttaccgctgtgtcaatcatcatctatgcgaaaaaccgattggctacctatgactgttgcggcaatgggtgtccctccactgccactattcatctttagtctcaaggatgctccgaaaagaaggtcttggccgttgaacgaaggcgtaatggcggtggggcttgtatctatactagcaagctctttgctacggaacgatgtaccaatggcaggcccgttagtagcagggggtctcttgatagcttgctacgtaatcacaggcacaagtgccgacttaaccgtagaaaaagcagctgatgtaacttgggaagaagaagcagaacagacaggtgtgtctcacaatcttatgattaccgtcgacgatgatgggacaatgagaatcaaggacgacgaaacagaaaatatattaactgtgttacttaaaacagctctgctgatagtatcgggtatatttccctatagtataccagcgaccttattggtgtggcacacttggcaaaagcaaactcaaagatcaggagtcttgtgggatgtaccaagcccacccgagactcagaaggcagagttggaagagggtgtctatagaattaaacaacaaggaatttttggaaaaacacaagtcggggtaggtgttcagaaagagggcgtatttcacacaatgtggcatgtaacaagaggtgcagtcctcactcacaatggaaagaggctagaaccaaactgggcgtcggtgaagaaagacttaatatcatatggaggaggctggagattaagcacacaatggcaaaagggtgaggaagttcaagtgatcgctgtagagcccggtaaaaacccgaaaaacttccaaacgatgccggggatatttcaaacaacaacaggcgaaatcggtgctatagcattagattttaaaccgggaacaagtggtagtcctattattaatcgcgagggaaaagtcgtgggtttatatggtaatggagtagtaaccaaaaatggaggctatgtcagtggcattgctcagaccaatgctgagcccgatgggccaacacctgaactggaagaagagatgttcaaaaagcgcaatcttaccataatggatttacacccggggagtggaaagactagaaaatacctccctgctatcgtgagagaagctataaaacgaagactccgtacacttattttggctccgacacgagtagtagccgccgaaatggaagaggcattaaagggattacccatacgttatcaaaccacggcaactaaaagcgaacatacaggaagagaaatcgtcgatctaatgtgccatgccacattcacaatgagactattaagcccagtacgagtgccgaattataatctgataattatggatgaagcccattttacagacccagcctctatagctgcccgtggatatatatctacaagagtgggaatgggagaagctgcagcgatatttatgaccgcaacacccccaggtactgcagaagcatttccacaatccaacgcgccaatccaagatgaagaaagggacatccccgagcgttcgtggaactccggtaatgaatggattacggactttgtgggtaaaacagtatggtttgttccgtcgatcaaagctggcaatgacatagctaattgtcttaggaaaaacgggaagaaagtcatccaactttcaagaaagacttttgatacagaatatcagaaaacgcggcttaacgattgggacttcgttgttactactgacataagtgaaatgggagctaattttaaggctgacagagtgattgatccacgaagatgcttaaaacctgtcattttgacggatggcccggaaagagtaattttagctggaccaatgcctgtgaccgccgcctcagcggctcagcgtagaggtcgagtaggacgaaacccacaaaaagaaaatgatcaatacatattcaccggacagcccctaaataacgatgaggatcatgcacattggactgaggcaaaaatgcttttggacaatataaatactccagagggtatcattccagctctcttcgaacccgaacgagagaagtctgctgcaatagacggagaataccgcttaaaaggcgaaagtagaaaaactttcgttgaattaatgagaagaggtgatttgccagtatggttagcccataaagtcgcgagtgaaggaattaaatatacggacaggaaatggtgttttgatggtgagagaaacaaccaaatattagaagaaaatatggatgttgaaatctggacaaaggaaggcgaacgcaagaaactgcgaccccgatggctagacgcaagaacttactcagatccacttgctttaaaggaatttaaggattttgcagcaggcaggaaatctatagcactagatctcgttaccgaaattggcagagtccccagtcatctggcacatcgtactaggaatgctctggacaatctggtaatgttgcatacaagtgagcacggcggtcgcgcatacagacacgcagtcgaagagttgccggagacaatggaaactctactgttactaggactgatgatactattgacaggcggggctatgttgttcttagtcagcggaaaaggtatagggaaaacaacgataggtttgatatgtgtcatcgtctcgtcaggaatgttatggatggcagacatcccactccaatggattgccagtgcaatcgtgttggagttctttatgatggtcctgctcataccagagcccgaaaagcaaagaacgccacaagacaaccagctagcatatgtagtgataggcattctgactctcgctgccattgtcgctgccaatgagatgggactactagagacaaccaaaagagacctcggaatgtcgaaggaacccggagtggtgtcacccacgtcatacctcgatgtagatttacatccggcaagcgcttggacattatatgccgttgctacaacagtcataacgcctatgttaagacatacaatcgaaaactccacagctaatgtaagtctggcagcaatagcaaatcaagcagtggttcttatgggattagataaaggttggcctatctctaaaatggacttgggagtaccgctgttggcgctaggctgttactcacaagtgaaccctctaacactcaccgcggcagttttactattagtcactcactatgccatcattggcccaggattacaagctaaagcaactcgagaggcacaaaaacgaacggcggcaggtatcatgaagaacccgacagtagatggtattatgacaatagacttagaccccgttatctatgattcaaaatttgaaaagcaacttggacaagttatgctcctagtcttgtgcgctgttcagttattattaatgcgaacaagctgggcattatgcgaagccttaacccttgcgacaggacctataaccacattatgggaaggttcaccaggcaaattctggaacacgacaattgccgtcagtatggcaaatatctttagggggtcatacctggcaggagctggacttgctttcagtataatgaaaagcgtaggtacaggacgacggggcacaggcagtcaaggcgagactctaggagaaaaatggaagaagaaacttaaccaattatcaaggaaggagttcgatctttataagaaaagcggaataacggaggtagatcgaactgaagcaaaggaaggattgaagcgaggagaaacaacacatcatgcagtaagtaggggaagtgcgaaactacagtggtttgttgaaagaaatatggtaatacccgagggtcgggtgatagatcttgggtgcggtagaggaggatggagctattattgtgcaggtcttaagaaagttacggaggttaggggatatacgaagggagggccaggtcacgaggagccagtgccaatgtcaacttacggctggaatatagtcaaacttatgtcaggcaaagatgttttctatttaccaccagaaaaatgcgatacattattatgcgacataggagaaagttcgccctcaccgactgtagaagaatctcgcactataagagtattaaaaatggtcgaaccatggctcaagaacaatcaattttgcataaaagtgctaaacccatatatgccaacagttatagagcatttagaacgattacaaagaaaatatggagggatgctagtcagaaatccgttatcccgaaatagtactcatgaaatgtactggatctcaaatgggactggcaatatcgtgtccagcgttaatatggttagtcgtctattactaaatagatttaccatgacacacagacgccctactattgaaaaggatgttgacttaggagcaggcaccaggcatgtgaatgcggagccagaaacaccaaatatggacgtgataggcgaacggattaaacgcattaaagaagaacactctagtacatggcattatgacgatgaaaatccctacaaaacatgggcataccacggctcatatgaagtaaaggcgacaggaagcgccagtagcatgatcaacggggtggtgaaactgttaacgaaaccttgggatgtagtaccaatggttacacaaatggcaatgacagataccactccatttggtcaacaaagggtattcaaagaaaaagtggatactcgaactccgagacctatgcctggtaccagaaaggttatggaaattacagcagagtggctatggcgtaccttagggaggaataagaaaccacggctttgtacaagagaagaatttaccaagaaagtaagaactaatgcagcgatgggtgcggtctttacagaagaaaatcaatgggatagtgccagggcagcagtcgaagatgaagaattttggaagctggtagatcgtgagagagaattacacaaattaggaaaatgtgggtcatgcgtctataatatgatgggaaaaagagagaagaaactaggggagttcggaaaagcaaaaggatcaagagcaatttggtacatgtggttaggtgcaagattcctggagttcgaggcacttggtttcttgaatgaggaccattggttctccagggaaaatagctatagtggtgtcgagggagagggacttcataagctcggatatattttaagggatatttctaagatacctggaggagcgatgtacgctgacgacaccgcaggatgggacactcgtattacggaggacgaccttcacaatgaagagaaaattacccaacaaatggacccagaacatcgacaactcgcaaatgccatttttaaattaacttatcaaaataaggtcgtgaaagtacagagaccaacgccaaagggcacagtaatggatattatatctcgcaaagatcaacgaggatcgggtcaggtaggaacttacggacttaataccttcacaaacatggaagcccagctcgtcagacaaatggaaggagaaggggtactaagtaaaacggacttggagaacccacaccttttagagaaaaagattacccaatggctagagaataagggtgtagaaagacttaaacgtatggctataagcggagacgactgcgtagtaaaacctatagacgatagatttgcaaacgcattactagcattaaatgatatggggaaagtcagaaaagatattccgcaatggcaacccagtaagggatggcacgattggcaacaggtaccattttgcagccaccactttcacgagctaataatgaaagacggtagaaaattagtcgtcccgtgtcggccacaagacgagctaatcggcagagcacgaatctctcagggggcaggctggagtctaaaagagactgcctgtttggggaaagcatatgctcagatgtggtcgttgatgtactttcatagaagagacctacgattagctagcaatgcaatttgtagtgcggtcccggtgcattgggtgcctacgagtcgcacaacctggagcattcacgcacaccaccaatggatgaccacagaagatatgctaacagtatggaatagagtttggattgaagataatccctggatggaagacaaaacgcctgttacaacatgggaagatgtaccttacttaggaaaaagggaagatcaatggtgcgggagcctaataggattaaccagccgcgctacatgggctcagaacattttaacagctatacaacaagttcggagccttatcggagatgaggagtttttagactacatgccttcaatgaaaagattcagaaaagaagaagaaagtgaaggtgccatatggtaa

SEQ ID NO: 23135 - RNA, 9873 nt, synthetic construct
  misc_feature 1..9873: note = derived and/or modified CDS sequence (opt6) from DENV-3__FJ639723__SS-prME
  source 1..9873: mol_type = other RNA
acatcattatgcttaatgatgatgttaccggctactttagcatttcaccttacatcaagagatggagaaccgcgcatgatagtcggtaaaaatgaaagaggaaaatcgctcctttttaaaacagccacaggaatcaacatgtgcacactaatagccatggatttgggagaaatgtgcgatgatacggtaacatataaatgtccactaatagcagaagtggaacctgaagatatagactgctggtgcaacctgaccagtgcgtgggtaacctacggaacatgcaatcaagcaggagaacaccgccgtgataaaagatcagtagcactagcgcctcacgtaggtatgggtctagatacgcgtacacaaacttggatgtcagcagaaggagcgtggcgtcaagttgaaaaagtagaaacctgggctcttagacatccggggtttactatcctagctttatttctagctcactacataggtacaagtttaattcaaaaagtagtaatattcattttgttaatgctcgtgacacctagtatgacgatgaggtgtgtaggggtgggaaatagagactttgttgaaggactatcaggagctacatgggtagatgtagtgttagagcacggaggctgcgtgactacaatggctaaaaacaaaccgacactagatattgaactccagaaaacagaagcaacacaactagcaacgttgagaaaactgtgtatcgaagggaaaattacgaatatcacaaccgatagtagatgtccaacacaaggcgaggcaattttgccagaagaacaagaccaaaattatgtgtgtaaacatacatacgtagaccgcggctggggaaacggctgcggattgtttggtaaaggatctttggtcacgtgtgcaaaattccaatgtctggaacccatagagggaaaagttgtccaatacgaaaatttaaaatatacagttattatcacggtacacacgggagatcaacatcaagtaggaaacgacacacaaggagtaacagtagaaattaccccacaggcatcaactgtcgaagcagtattaccagagtacggcaccttaggcctggaatgtagtcctagaaccgggctagatttcaatgaaatgatcttacttacaatgaaaaataaggcttggatggtccataggcaatggttcttcgatttacctttaccttggacttctggagcaacaacggaaaccccgacatggaatcgtaaagaattattggttacgttcaaaaatgctcacgcgaagaaacaagaagtggtagttttgggatcacaagaaggagcaatgcacaccgcgttaacaggggccacagagatacagaatagtgggggaacttcaatttttgcgggccacctgaaatgccgattaaaaatggacaaattagaactcaaagggatgtcctatgcaatgtgtttaaacacgtttgttttaagaaaagaggttagcgaaacacaacatggaacgatattaattaaagtagaatacaaaggggaggacgctccatgtaaaattccattttcaaccgaggacggccaaggcaaagctcacaatggacgtcttataacagccaacccagtagttaccaagaaagaagaacccgtcaatattgaggccgaaccccctttcggggaatctaatatcgttattggaattggtgataaagcactaaaaataaattggtataagaaaggatcctcaattggaaaaatgttcgaagccactgcaagaggtgcgcgacgaatggctattttaggtgatactgcatgggattttggctcagtcggaggagtgttaaattcactaggcaaaatggtacaccaaatcttcgggtccgcttataccgcactattttccggtgtttcttggatcatgaaaattgggataggggttttattaacatggattggtctaaatagcaaaaacaccagcatgagtttttcttgtatagtaataggaattattacactgtatctaggcgctgtggttcaagcagacatggggtgcgtaataaattggaaaggaaaagaattgaaatgtgggtctggaatatttgttactaacgaagtacacacctggaccgaacagtacaaatttcaggccgacagtccaaaaaggttggccaccgcaatagcaggagcatgggaaaatggtgtttgtgggatcagatccacgacgcgcatggagaatttattatggaaacagatagctaatgaactcaattatatcctttgggaaaataatataaaactaacagtcgtagttggtgatataataggcgttctcgaacaaggaaaaagaactctaactccacaacccatggaacttaaatattcttggaaaacgtggggaaaagccaaaatagtaacagcagagacacaaaacagctcctttataatagatgggcccaacacacctgagtgtccaagtgcatcgcgggcatggaatgtttgggaggtcgaggattacggttttggcgtctttacaactaatatttggctaaaattacgtgaagtatacacacaatcttgtgaccatcgtctaatgtctgctgcaattaaagatgaaagggcagtacatgcagatatgggatactggattgaatcacagaagaatggctcgtggaaattagaaaaagcaagttttatagaggtaaaaacctgcacatggccgaaatcacatacattatggtccaatggtgtactggagtcagatatgattattccaaaaagtctcgcagggccaatatcgcagcataatcaccgacccggatatcatacacaaacagcgggtccttggcacttaggtaaactcgagctcgattttaattattgcgaaggcactactgtagtcattacagagaattgcgggactaggggtccgtccttaaggacaacaacagtatctggaaaattgatacacgaatggtgttgtcgttcttgtacgttacctccattgcgatacatgggagaggacggctgctggtacggaatggaaatacgaccgactaatgaaaaggaagaaaatatggttaaatctttagtaagtgctggcagtgggaaagtagacaactttactatgggtgttctatgtctagctatcctattcgaagaagtgatgagaggtaaattcggaaagaaacatatgatagcaggagtactttttacttttgtcttactgttgtcgggacaaattacttggagggacatggcacataccttaataatgataggcagcaacgcaagcgatagaatgggtatgggagtaacttacctagccttaatcgcaacattcaaaatccaaccgtttttggctttagggtttttcttaaggaaattaacaagcagagaaaacctcttgttgggggttgggttagcgatggcaactactctacaacttcccgaagatatagaacaaatggccaacggaattgcacttggactaatgacacttaaactaataactcaattcgaaacgtaccagttgtggacggctttagtatcgctgacgtgttccaacacgatttttaccctcacagtagcatggcgaactgcgactctaattctggcaggggtaagtttattgcctctgtgtcagtcatcatccatgagaaagactgattggctacctatgaccgtggcggcaatgggagttccacccttacctctgtttatatttagtttaaaggatactccgaaaagaaggtcatggcctctgaacgaaggtgtaatggccgttggtcttgtcagtatacttgcttctagtctacttcggaacgatgtccccatggcaggacccttagtggcaggagggttactaatagcttgctatgttataacagggacatcagcagacctaacggtggaaaaagcagcggatgtaacatgggaagaagaagcagaacaaacaggtgtctcccacaatttaatgatcacggtcgatgacgatggaacaatgagaattaaagacgatgaaaccgagaacattttgacagttttactgaaaacagcattgcttattgtgtcaggaatatttccctacagtatcccagctacgttgttagtatggcatacttggcaaaaacaaactcagcgatctggagttctctgggatgtaccatcaccaccagaaactcaaaaagcagagttagaagaaggagtgtatagaataaaacagcaaggaatattcgggaaaactcaggtgggtgtaggagtgcaaaaggagggagtattccatactatgtggcacgtaacccgcggggccgtgttaacacataacgggaagagattagaacctaactgggcttcagtgaagaaagatctgatttcatacggcggtggttggagattatcaacccagtggcagaaaggagaagaagtccaggtcatagcagtagagccaggcaaaaatccaaagaattttcagaccatgccaggtatatttcagacgactacaggagagataggtgcaatagcattagattttaaacctggaacatcgggttcaccgataataaaccgtgagggaaaagtggtaggtctgtacggtaatggtgtggtcaccaaaaacggaggttacgtctcgggtattgctcagacgaatgccgaacctgatggaccgactcctgaacttgaagaagagatgtttaagaaaagaaatctaacaataatggatctacaccctggatcaggcaagaccagaaagtaccttcctgcaattgtaagagaagcaataaagcgaagattgcgtacacttattctcgcacctacacgcgtagtagctgcagaaatggaagaagctctaaagggtttacccatacgataccaaacgacagctacaaagagtgaacatacgggacgtgaaatcgtagacctaatgtgccacgctacctttactatgcgactccttagccccgttcgcgtcccgaattataacctaatcataatggacgaggcacactttactgacccggcatcaatagcagccagggggtacatatcgacacgagtcggtatgggtgaagctgctgcgatatttatgactgcaacaccacccgggaccgcagaggctttcccacagtcaaacgcgcctatccaagatgaagaacgggatataccagaaagaagttggaacagtggtaatgaatggattaccgattttgtcggcaaaacagtatggttcgtacccagtataaaagcaggtaacgacatcgcaaactgtcttagaaagaatggcaagaaagtaatacaactctctcgcaagacttttgacactgaataccagaaaacacgtttaaatgattgggattttgttgtaactactgacatatcagaaatgggtgccaatttcaaggctgatagagtaatagacccaaggagatgtttaaaaccagtcattcttacggacggaccagaaagggtcatactggcaggtcccatgccagttaccgcagcatcagcggcacaaagacgagggagagttggaagaaacccccaaaaagaaaacgatcaatacatatttaccggacaacccctaaataatgatgaagatcacgcacactggaccgaagctaaaatgctgttagacaatattaatacacctgagggaatcataccggccttatttgagcctgaacgtgaaaagtcagcagcaatagacggagaatataggttaaaaggagaatcacgtaagacattcgtagaattaatgcgacgaggagatctaccagtatggcttgcgtacaaagtggcgtcggaaggcataaaatacactgataggaaatggtgttttgacggagaaagaaacaatcaaattctagaagaaaatatggacgtggaaatatggactaaagagggagagaggaagaaactacgacctaggtggctagatgcaagaacatatagtgaccccttggccttaaaagagttcaaggacttcgcagcaggaagaaagtctatagccttagacctagtaaccgaaataggtcgtgttcctagccacttagctcaccgaacaaggaatgccctcgataatctcgtaatgttgcatacttcagaacacggtggcagagcctataggcacgccgtcgaagaactcccggagaccatggaaactttgttattattgggcctaatgatattacttacaggaggtgctatgttatttttgatctccgggaaggggataggaaaaaccacaatcggcctaatatgtgtaatagtaagttcaggaatgttatggatggcggacatccccctacagtggattgcatctgcgatagttctagaatttttcatgatggttctcctgatacctgagccagaaaagcaaaggactccccaagataatcagcttgcttacgtcgtcataggaatattaaccttggccgccatcgtagcagcaaacgaaatgggattactagagacaactaaacgtgacctagggatgtcaaaagagccaggagtggtatcgcctacttcatatcttgatgtcgatctacatccagcgtcagcatggacactatatgccgtagcaacaacagttataactcccatgctaaggcacactatagaaaacagtactgctaacgtaagcctagccgctatagctaatcaagccgtggtactgatgggtttagacaaaggatggcccataagtaaaatggatttaggagttccactcctagctttaggatgctattcacaagttaatccgctaacactaacagcagcagtcctgctactcgtcactcactatgccattataggacctggattgcaagccaaagccaccagagaagcacagaaaagaacagcagcaggaatcatgaagaacccaacagtagatggaatcatgacaatagatttagatccggtgatctatgattcaaaatttgaaaaacagttaggccaagttatgttgcttgttctgtgcgccgtccaactgttacttatgcgaacatcatgggctctttgcgaagccctaacactagcaacgggtcctataactaccctgtgggaaggatctccaggaaaattttggaacaccacaatagcagtcagtatggcaaatatttttcgcggaagctacctagcgggagcaggactagcctttagcattatgaaatcagtaggtacaggaagaaggggtacagggtcccagggagaaacgcttggagagaaatggaagaagaaactcaaccaactcagtcgtaaagaatttgatttatacaagaaatcagggataacggaagttgacagaactgaagcaaaggaaggtttaaaacggggtgaaactacacatcacgcagttagtagaggaagcgcaaaattacaatggttcgtggagagaaatatggtaatccctgaaggacgagttatcgatttggggtgtggtcgtggtgggtggtcatattactgtgcgggactcaagaaagtcacagaggtccgaggctatactaaaggaggaccaggacatgaggagcctgtgcctatgagtacctacgggtggaatatcgtaaaactaatgagcggcaaagacgtgttttatttaccaccagaaaaatgtgacacacttctatgtgatataggtgaaagctcaccttcaccaacagtggaagaatcacgtaccatcagagtgttaaaaatggttgaaccatggctgaaaaataaccaattttgtataaaggtgctaaacccatacatgccaaccgtaattgaacatctagaaaggttacagcgcaaatacggtgggatgctcgtacgaaatccgctgtccagaaactccactcacgaaatgtactggatatccaatggtacaggaaatatagtatcatcagttaatatggtctccagattattattgaatagattcacaatgacccatcgacgtccgacaatcgaaaaggacgtagatttaggagcaggtacaagacatgtaaatgccgaacccgaaacacctaacatggatgtgataggagaacgcataaaacgtataaaagaagaacatagttctacatggcattatgacgatgaaaatccttacaaaacctgggcatatcacggatcgtacgaagtcaaggccactggcagtgcatctagtatgatcaacggagtggttaaattactgacaaagccttgggatgtagttcctatggtaacccagatggcaatgacggacaccacgccatttggccaacagagagttttcaaagaaaaagtagatactcgcacaccacgtccaatgcccggaaccagaaaggtaatggaaatcactgccgaatggctatggcgtacgttgggccgtaataagaaaccccgcctatgcacgagagaagaatttaccaagaaagttagaactaacgctgccatgggagccgtgtttacggaggagaatcaatgggacagtgcacgagctgctgtcgaagatgaagaattttggaaattagtagacagagaaagagaactacataagctaggtaaatgcggcagttgtgtatataatatgatgggcaaaagagagaagaaactcggcgagtttggtaaagcgaaaggtagccgagctatctggtacatgtggttaggtgcgagattcctcgagtttgaggcacttggatttctcaatgaagatcactggttttcacgtgaaaactcctattcaggagtcgaaggtgaaggactacataaactcggttatatactaagagatatctctaaaattccaggaggcgctatgtatgcggacgatacagcaggctgggacacaagaataacagaggatgatctacataacgaagaaaagataacacaacaaatggaccccgaacataggcaattagcaaatgcaatctttaaattaacttatcaaaacaaagtcgtgaaagtacaaagaccaactccgaaaggcactgttatggacattatatcaagaaaagatcagaggggcagtggtcaggtaggaacgtatggattaaataccttcacaaatatggaagctcagctagttcgtcagatggagggtgagggcgtattatccaaagcagacctagaaaacccacaccttctcgagaagaaaattacgcaatggctagaaaataaaggggtagaacgcctaaagcggatggcgattagcggcgacgattgtgtcgttaaaccaatagacgaccgattcgccaatgcactcttagcattaaatgatatgggtaaggtacgcaaggatataccccaatggcagccgtctaagggttggcatgattggcagcaagtaccattttgcagccatcattttcacgaacttataatgaaagatggcagaaaattagttgtcccgtgccgaccccaagacgaactaattggacgagcacgcataagtcaaggagcaggatggagcctgaaagaaacggcctgcctaggaaaggcttatgcccaaatgtggtcattaatgtattttcatcgacgtgatttaagattggcgagcaatgctatatgctccgcagtacctgtacactgggtaccgacctctcgtacaacatggtcgatacatgcacatcatcaatggatgacaacagaagatatgctcgcggtgtggaatagagtttggatagaagacaatccttggatggaagataaaacaccggtcaccacatgggaagatgtaccatacttaggaaaacgtgaggaccaatggtgcggatcactaatcggattgacctctcgcgccacttgggctcaaaatattctcactgccattcaacaagttcggtctctaatcggcgatgaagagttcttggactatatgccaagtatgaagcgttttagaaaggaggaagaatcagaaggtgcgatatggtag

SEQ ID NO: 23136 - RNA, 9873 nt, synthetic construct
  misc_feature 1..9873: note = derived and/or modified CDS sequence (opt6) from DENV-3__FJ639724__SS-prME
  source 1..9873: mol_type = other RNA
acgtcactatgccttatgatgatgttacccgcaaccctagcttttcacctgacgtcacgggatggagaaccacgaatgatcgtagggaaaaatgaaaggggcaagagtttgttatttaaaaccgcatccggaattaacatgtgtacgcttatcgctatggatttaggggagatgtgtgacgacacggtaacctataaatgcccattgatagcagaagttgaaccggaggatatagattgttggtgcaaccttacatccacatgggtaacatacggtacctgtaatcaagcaggggaacataggagggataagaggtcagtagcgttagcaccccatgtgggtatgggattagacactagaacgcaaacctggatgtcggctgagggtgcctggcggcaggtcgaacgcgttgaaacttgggctcttagacatcccggattcaccattctagctctatttttagctcactatattggcacgagtctaacgcaaaaagtagtaatatttatacttctaatgctagttacaccgagtatgacaatgagatgcgtaggagtagggaaccgcgatttcgtagaaggactaagcggcgcgacatgggttgatgtagtgcttgaacatggtggctgtgtaacaacgatggctaaaagtaaaccaactttggacatagaactacaaaaaaccgaagcaacacaacttgcaacattaagaaaactctgtatcgaaggaaaaataaccaacataaccacagacagtcgatgcccaacccaaggagaagcaacattaccagaagagcaagatcaaaactatgtatgtaaacatacttatgtggatagaggttggggaaacgggtgtggtttgttcggcaaggggagtctggtgacctgtgccaaatttcaatgtttagaacccatagaaggtaaggtagtacagtacgagaacttgaaatatacggtgataatcaccgtacacacaggtgatcaacaccaagttggcaacgatacgcaaggtgtaacggtagaaatcactccacaagcatcaactgttgaagcggtattacccgaatacggaacactaggactcgaatgtagccctagaacgggacttgatttcaatgagatgatcttacttaccatgaaaaacaaggcctggatggtccatcgccagtggttctttgatctccccttgccgtggacaagtggagcgacaactgagacaccgacctggaatcgaaaagaattattagtgactttcaaaaacgcacacgcaaaaaaacaggaagtcgtggtcctagggtcacaggaaggcgcaatgcatacggccttgacgggcgcaacagaaatccaaaacagtggcgggacaagtattttcgcgggacatctaaaatgtaggttaaaaatggataagcttgaattgaagggcatgtcatatgctatgtgcctaaacacctttgtactaaaaaaagaagtttctgaaactcaacatgggaccatacttataaaggtggaatataaaggagaagacgcgccttgtaagataccgttctcaacggaagatggacaaggaaaggcgcacaacgggagattaattaccgcaaatccagtagttacaaaaaaagaagagccagttaatatagaagcagagcctccttttggcgagtcaaacattgtaataggaattggagacaaagcattaaagatcaattggtataagaaaggttcttcaataggaaaaatgttcgaagccacagcgagaggagcgaggagaatggcaatattaggagatactgcttgggatttcggtagcgtgggaggcgtactaaatagcctaggaaaaatggtccatcaaattttcggctcagcatatacagctttattctctggtgtctcttggattatgaaaatcggcattggagtacttctaacttggatagggttaaattcaaaaaatactagtatgagctttagctgcatagttattgggattataactttataccttggagcggtggttcaagcagatatgggctgtgtgataaattggaaaggaaaggagctaaaatgtggaagtggaatattcgtcaccaatgaagtacatacatggacagaacaatataagttccaagcagactccccgaagaggcttgcaactgcaatagcgggagcctgggaaaatggggtatgtggaattcgaagtactacgcggatggaaaatctactctggaagcagatagcgaacgagctcaactatatactttgggaaaataacataaagctaactgttgtcgtaggagacatcatcggcgtactcgaacaaggtaaaaggaccctaacacctcaacccatggaattaaaatacagttggaaaacttggggaaaagctaaaatcgttacagcggaaacgcaaaacagtagtttcatcattgacggtccaaacactcctgaatgccctagtgctagtcgagcatggaacgtttgggaagtagaagactatggatttggagtttttacaacgaatatatggttaaagctaagagaggtttacacccagtcttgcgatcatagattaatgagcgcagccataaaagatgaacgagctgttcatgctgatatgggctattggattgaaagccaaaaaaacggaagctggaaacttgaaaaggctagttttatcgaagtaaaaacatgtacatggcccaaatctcataccctgtggagtaatggcgtcttagagtcagacatgataatacctaaaagtttagcgggccccatttctcaacacaatcataggcctgggtaccacactcaaactacgggaccttggcacctggggaaattagagctagattttaattattgcgaaggaaccacagtggtaataacagaaaattgcggaacaagaggcccgtcccttagaacaacaacagtaagtggtaaattaatacacgaatggtgctgtagatcctgcacactacccccattacggtatatgggggaagatggttgttggtacggtatggagatacgccccattaatgaaaaagaggaaaacatggtaaagagcctagtgtccgcgggctcaggaaaggtagataattttacaatgggggtattatgtctggctatattgttcgaagaggtcatgcgagggaagttcggaaagaaacatatgatagcgggagtactattcacgtttgtactactactatctggccaaataacatggcgcgacatggctcacactttgataatgataggttcaaacgcgagtgacagaatgggaatgggtgtgacgtatttagccttaatagcaacatttaaaatacaaccatttcttgctttaggattctttcttaggaaactaacatcacgtgaaaacttattactaggtgtggggctagcaatggcaaccacattacagttgcctgaagacatagaacagatggcaaatggcatagcactgggattaatgactttgaaattaattacccaattcgaaacataccaactgtggacggcactagtctccctaacttgttcgaacacaatctttactttaactgtagcatggagaaccgcaactcttattctagcgggagtctcactgttgcctttgtgccaatcaagctccatgcgcaaaacggattggctacctatgacagttgcagcaatgggagtccccccactcccgttgttcatattcagtttgaaagacacacctaaaagaagaagctggccacttaacgaaggtgtaatggccgtgggattggtaagtatcctagcatcatctctattaagaaatgacgtacctatggccggaccgttagtcgcaggaggactattaatcgcatgctatgtaatcacaggaacatcagctgaccttaccgttgaaaaagctgcagatgtcacttgggaagaggaagcagaacaaactggagtcagtcataatctcatgataacagtagatgatgatggcaccatgcggatcaaagatgatgaaaccgagaacatcttaacagtgctccttaaaacagccttgttaatcgtcagtggaatttttccatacagtataccagccacgctattagtgtggcacacgtggcagaaacaaacacaacggtctggcgtattatgggacgtaccatcgccgcctgagactcaaaaggcagagcttgaagaaggtgtctatcgaataaaacaacagggaattttcggcaaaacgcaagtaggagtgggagttcaaaaagagggagtatttcacacaatgtggcacgtaactagaggagctgtactaacacataacggtaaacgtcttgaaccgaattgggcaagtgttaaaaaggatctaatctcttacggaggcggttggaggctttcagcacagtggcaaaagggagaagaagtacaggttattgcagtggaaccaggtaaaaacccaaagaactttcaaacaatgcccggcatttttcaaactaccactggtgaaattggtgcaatagcgctagattttaaaccgggcacctccgggtctccaataataaacagggaaggaaaagtagtaggtttgtatggcaacggcgtagttactaaaaatggtggatacgtaagcggcatagcccagacgaatgcagagccagacggcccaacccctgaattagaggaggagatgttcaaaaaaaggaacctgactattatggatctacaccctggaagtggaaagacaaggaagtacttaccagcaatagttagagaagccattaaaaggaggttaagaacattaattcttgctcccacacgagttgtagccgctgaaatggaagaggcgctaaaaggcttgcctatcagataccaaacgaccgcaacgaaatccgagcacacaggcagagaaatagtagatcttatgtgtcacgcaacctttacgatgagattactaagtccagtacgagtcccgaactataatctagttatcatggacgaagctcattttaccgatccagcatcaatcgcagcacgaggctatatttccacaagagtcggaatgggagaagcggcagccatttttatgaccgcgacacctccaggaactgctgaagcctttccacagagtaacgctccgatccaggacgaagagagagacataccagagcgatcatggaatagtggaaatgaatggataaccgatttcgtgggcaagactgtctggttcgtacccagtatcaaggcaggtaatgacatagcaaattgtctaagaaagaatggtaaaaaggttattcaactatcacgcaaaacattcgacactgaatatcaaaaaactcgattaaacgattgggattttgtagtaacaacagatattagtgaaatgggggcaaatttcaaagctgatagagttatagatccgcgaagatgcttaaaacccgttatcttgaccgacggaccggaaagagtaattcttgcaggacccatgcccgttacagctgcaagcgcggcacaacgcagagggcgagtaggtcgaaacccacagaaggaaaatgatcaatacattttcacaggccaacccttaaataatgatgaagatcatgcacactggaccgaagctaaaatgcttttagataatataaatacacccgaaggtataatccctgctttattcgaaccagaaagagaaaaaagtgctgcaatcgacggagaataccgtctgaagggagaatctcgcaaaactttcgttgaactaatgaggaggggtgatctacctgtttggttggcacacaaagtggcgtcggaaggtatcaaatacacagacaggaaatggtgctttgatggagaacgaaacaaccaaatattggaagagaacatggacgtcgagatttggactaaagagggagaaagaaaaaaactcaggcctagatggctagatgcccggacttactcagacccattagcactaaaggagttcaaagattttgccgccggtcgaaagtcaattgcacttgacttagttacagaaattggtagagtaccaagtcatcttgcacatcgtactagaaatgctcttgataatttagtaatgcttcacactagtgaacatggcggaagagcgtatcgacatgcagtggaagagttaccagagaccatggagacactattattacttggactcatgatcctactcacaggaggagctatgttatttttaatcagtggaaaagggataggaaaaacttctataggtttaatatgtgtaatagttagttccggcatgctgtggatggcagacgtccctctgcaatggatagctagtgcaattgtgttggaatttttcatgatggtattattaatacctgaaccggagaagcagaggaccccacaagataaccaactagcatatgttgtaattggaatcctcactctagcggccatcgtagcggcgaacgagatgggtctattagaaacaacgaaacgtgatttaggaatgagcaaagaaccaggagtcgtatctccaacaagttacctagatgtcgacttacatcctgcttccgcctggacattgtacgcagtcgcaactaccgtgatcacgccaatgctaagacacacaattgaaaacagcacggctaatgtctcattagcagcaatagcaaaccaagcagttgttctaatggggctggataaaggctggcctattagcaagatggaccttggggtaccgttgttagcgctggggtgttattcccaagtaaaccctttaacccttacagctgcagtattactattagtaacccactatgcaataataggaccaggtctccaagcaaaagcgaccagggaagcacaaaaacggaccgcagcgggaatcatgaaaaatccgacagtagacggaattatgacaattgacttggatcctgttatttacgacagtaaattcgaaaaacagcttggtcaagtgatgttgttagttttatgtgccgtacaattactacttatgaggacttcatgggctctatgtgaagcattgacccttgcaactggtccaattacgacgttatgggaaggctcaccaggaaaattttggaatacaactatagcggtgtctatggccaacatatttaggggtagttatctagccggagcggggttggcgttcagcataatgaagtctgtagggacaggtagaagagggactggttcccaaggagaaactttaggtgaaaaatggaagaagaaactaaaccaattatccagaaaagaatttgacctatataaaaagtcaggtattacagaagtcgatagaacagaagctaaggaaggattaaagcggggcgagacgacgcaccacgcagtatccaggggaagcgcaaaacttcagtggtttgtcgaacgcaatatggtaatccctgaaggtcgggtaatagacttaggctgtggcagaggagggtggtcatattattgcgcaggtctaaaaaaagttacagaggttagaggctacaccaaaggcggaccgggtcatgaggagccggtcccaatgagcacatatgggtggaatatagttaaactaatgagcggtaaagacgtcttttacctcccgcctgaaaaatgtgacacacttctatgcgatattggagaatccagtccgagccctactgtagaagaaagtcgaactattcgagttcttaaaatggttgaaccgtggttgaggaacaatcaattttgcatcaaggtactaaatccttatatgccaactgttatagaacacctcgagagactccaacgcaaatacggaggaatgctagtcagaaatcctctttcccggaactcgacacatgaaatgtactggatttcaaacggaacggggaacatcgttagtagtgtaaacatggtgagtagattgctgctaaaccggttcaccatgacccacaggaggcctactattgagaaagatgtagatttaggtgccggaactcgtcatgtaaatgcggagcctgaaacacctaatatggatgtaataggagaaaggatcaagagaataaaagaagaacattcgtcgacatggcactatgacgatgaaaatccatataaaacatgggcatatcatggcagttatgaagttaaagcaacgggatcagcaagttccatgataaacggtgtcgtaaaactcttaaccaaaccctgggacgttgtacctatggttacccaaatggcaatgaccgatactactccgtttggacaacaaagagtcttcaaagaaaaagtcgataccagaacaccaagaccaatgccaggcaccagaaaagtaatggagattacagcagaatggttgtggaggacgttgggcagaaataagaagccaagattatgtactagagaagaattcacgaagaaagttaggaccaatgccgctatgggtgccgtattcactgaagagaaccaatgggacagtgccagagccgcagttgaagacgaggaattttggaaactagtagaccgcgaaagagaattacacaagcttggtaaatgtgggtcatgtgtatacaacatgatggggaaaagagagaaaaaattgggtgagtttggtaaggcaaagggttctagggctatatggtacatgtggttaggcgcacggtaccttgaatttgaagcactaggtttcttaaatgaggatcattggtttagtcgagaaaattcctatagcggcgtggaaggagaaggactgcacaaattgggatacattttaagagacatctcaaaaattccgggaggtgctatgtacgccgacgacacggcgggttgggacacgcgaatcaccgaagatgatttacataatgaagagaaaattacccaacagatggacccagagcaccgtcaactagcgaacgccatatttaagttaacgtaccagaataaagttgtcaaagttcaacgtcctacaccaaaaggaacagtcatggatataatatccagaaaagatcaaagaggatccggacaagtaggcacttatgggctgaatacttttacaaatatggaagctcaattagtacgacaaatggagggggagggagtgctatcaaaggctgatttagaaaaccctcacttactagaaaaaaaaataacacagtggctagaaacaaaaggagtcgaaagacttaaaagaatggcaatttctggtgatgactgtgttgtaaaacccatagatgacagattcgccaatgcgctattggccctaaacgatatgggaaaggttcgtaaagatatcccacaatggcaaccaagcaagggttggcacgactggcaacaggtgccattctgctcacaccacttccatgaactgataatgaaagatggacgtaaactagtagtcccatgccgcccacaagacgaattaataggtagggctcgtattagccagggcgcaggatggtcacttaaagaaacagcatgtttaggtaaagcctacgcccagatgtggtcgttaatgtatttccatcgacgcgacttgcgattggcatcgaacgctatttgctcagctgtcccagtccactggatacctacatcacgaactacctggagtattcatgcacaccatcaatggatgacaactgaggatatgctaactgtctggaaccgcgtctggatcgaagataacccttggatggaagacaaaacaccagtaacgacctgggaagacgtgccttatctaggaaaacgcgaagaccaatggtgtggcagtttaataggtttgactagcagagcaacatgggcccagaatatactaacagcaatacaacaagtacgatcacttattggagacgaagagtttttagactacatgccttcgatgaaacgatttaggaaagaagaagaaagtgagggagcaatatggtaa

SEQ ID NO: 23137 - RNA, 9873 nt, synthetic construct
  misc_feature 1..9873: note = derived and/or modified CDS sequence (opt6) from DENV-3__FJ639725__SS-prME
  source 1..9873: mol_type = other RNA
acttcattatgcttgatgatgatgttgccggcaacactggcattccatttgacatccagagacggtgaaccaagaatgatcgttgggaaaaacgaacgtggaaaatcattattgtttaaaacagcgagtggaataaatatgtgcacgttaatagcgatggatttgggggaaatgtgtgatgatactgtcacttataaatgtccgttaatagcggaagtcgaacctgaagatattgactgctggtgcaacttaacatccacttgggttacatatggtacttgcaatcaagccggtgaacaccgtagagacaaaagaagtgtagctttagcaccgcatgtcggaatgggactagacacacgcacacaaacatggatgtctgcagaaggagcatggagacaagtcgaaaaagttgaaacgtgggcactgagacatccaggctttacaattctggctctgtttctagcacactacataggtacaagtctcacacaaaaagttgttatctttattctgctaatgctagttacaccttctatgacgatgcgatgcgtgggggtaggcaacagagattttgtggagggactaagtggtgctacatgggtcgatgttgtgctcgagcatggtggatgcgttaccacaatggcgaaatcaaaaccaacgctggatatagagctacagaaaacggaggcaacacaacttgcaacattacgaaaactttgtattgaaggcaaaataacaaatattacgacagattctcgatgcccgacacaaggggaagctacactgccagaggaacaagaccaaaattacgtgtgcaaacacacatacgtggacagaggatggggaaatggttgcggcctatttggtaaaggaagcctagttacatgtgcgaaatttcaatgccttgagccgattgaagggaaagtggttcaatatgaaaacctaaaatatacagtaatcataacggtacacaccggtgaccagcatcaagtcggtaatgatacacagggagtgacagttgaaattacaccacaggcttcaacggttgaggctgtactgcctgaatatggcacactaggtctggaatgttcgcctcgaacgggactggatttcaacgaaatgattttattgactatgaaaaacaaagcatggatggttcatcgacagtggttcttcgatttgccactaccttggacatcaggcgcaacaacagagacgcccacatggaatagaaaagaattgttagtgaccttcaaaaatgcccatgccaaaaagcaagaggttgtggtactcggtagccaagaaggcgctatgcataccgctttaactggagccacagagatccaaaattcgggtggcacatcgatttttgctggacaccttaaatgcagactaaagatggacaaactcgaattaaaggggatgtcctatgctatgtgtcttaatacttttgtactcaagaaagaggtaagcgagacacagcacggaaccatcttgatcaaagttgaatataaaggagaagacgcaccatgtaaaattccattctctacggaagatgggcaaggtaaagcccataatggacgcctgataacagcaaacccggtagtcaccaagaaagaggaacccgtcaacatagaagcagagccaccttttggagagtctaacatcgtgataggaattggagataaagcattaaagataaattggtataaaaaggggtcatctattggcaagatgtttgaagctactgcgagaggagctcgtcgtatggctatcctaggtgacacagcatgggactttggaagcgttggtggagtgctaaattccctcgggaaaatggtacatcaaatattcggttcagcatataccgcactattctcgggagtcagctggatcatgaagataggaatcggagtactactgacgtggataggcttaaatagcaagaacacatccatgagttttagctgtattgtcattggaattataactctatatttaggagctgtagtacaagcggacatgggatgcgttatcaactggaagggaaaagaactaaagtgtggtagtgggatatttgtgaccaacgaagttcatacgtggacagaacagtataaattccaagcagattcaccaaagcgactggctacggcaattgccggagcttgggaaaacggtgtatgtggtattagaagtacaacaagaatggaaaacttgctttggaaacaaatagctaatgagctcaactatattctgtgggagaataatattaaacttacagtggtggttggagacattatcggggtgctagaacaaggcaaaagaacgttgacaccacaacctatggaactcaaatactcttggaaaacatgggggaaagccaagatagttactgcggagacacaaaattcttcctttattatcgacggtcctaacacgccggaatgcccaagtgccagtagagcatggaatgtttgggaagtagaagattatgggtttggagtatttacgaccaacatatggttgaagttacgagaagtatatactcaatcgtgtgaccatagacttatgtctgcggccataaaagacgaaagagctgtacatgctgacatgggatactggattgaaagtcagaaaaacgggagctggaagctagaaaaagcaagttttatagaggtcaaaacatgtacttggcctaaatctcatacactatggtccaacggcgtgttagaatcagatatgatcataccaaagtctttagctggtcctatatcacaacataatcaccgaccaggctatcacactcaaacagcaggaccatggcatttagggaaattagaattagatttcaactactgtgagggaacgacagtagtcataacagaaaattgtggaacgagaggtccctcccttagaactaccacagtatcgggaaaactaattcatgaatggtgttgtcgctcttgcacactccctcctttacgatatatgggggaagatgggtgttggtatggaatggaaatccgccctataaacgaaaaagaggaaaatatggtgaagtcgttagtatcagcaggaagtggaaaagtcgataactttactatgggtgtactctgcttagccattctttttgaggaagtaatgagaggtaaattcggtaagaaacacatgatagccggcgttcttttcacttttgtgttactactttccggacaaataacatggcgagacatggcgcacacacttataatgataggatcgaatgcgtcagacagaatgggtatgggagtcacatacttagcgcttatcgcgaccttcaagattcaacctttcttggccttaggtttcttcttaagaaagttaacatcaagagagaatcttttactcggtgttggattagcaatggcaaccactctgcaattaccggaagacatagagcaaatggcaaatggaatagcactaggattaatgacactaaaattaatcacgcaatttgaaacctatcaactgtggacagctctagtaagtttgacgtgtagcaacacaatattcactctaacagtagcatggcgaacagcgacactaatactagcaggcgtttccttgctaccactatgtcagagtagctcgatgcgtaaaacggattggttacccatgacagttgcagcgatgggagtacccccacttccacttttcatctttagtctgaaagacacgcctaaaagacgctcatggcctttaaacgaaggagtcatggcagtcggcttagtctcaatactagcttcgtccttacttcgtaacgacgtacccatggccggtcctctggtagcaggcggacttttaattgcatgctatgttattacgggaacaagtgcagaccttacagtcgaaaaggctgcggatgttacttgggaagaagaagcagaacaaacaggtgtgtcccacaatttgatgataacagtggatgatgatggaaccatgaggataaaagatgacgaaactgaaaatattctcacagtgcttttaaaaaccgcattattgatagtcagcggtattttcccttattccatcccagcgacattgttagtttggcacacgtggcagaagcaaacgcagaggagcggggtactatgggatgtcccgagcccaccagaaacacaaaaggcggaacttgaggagggggtttacagaataaaacaacaaggcatattcggaaagactcaagtcggcgtcggtgtgcaaaaagagggtgtatttcatactatgtggcacgtaacccggggcgcagtcttaacacataacgggaaacgactggaacccaactgggcatctgttaagaaagacctgatttcttatggaggagggtggcgtttgagcgctcaatggcagaaaggagaggaggttcaagttatagctgttgaaccaggtaagaatcctaaaaatttccagacaatgccaggaatatttcaaaccactactggggagataggtgccattgcgttagattttaagcctggaacctctggttctccaatcataaatagagagggcaaagttgtgggactctacggaaatggggtggttactaaaaatggcggatatgtcagtggaattgctcaaaccaatgcagaacctgacggtccgactcccgaactagaagaagaaatgtttaagaaaagaaatttaactataatggatttgcatccgggctccggaaaaacccgtaaatacctccccgcgatagtccgggaggcaataaaaagaaggctacgaacattgatattagcccctactagggtggtagcagcagaaatggaagaagcactcaaaggtctacccataagatatcaaacaacggctacgaagtcggaacatacaggaagagaaatagtcgatctgatgtgtcatgcaacatttacaatgaggttactaagtccagttcgagtaccaaactataatttagttattatggatgaggcccactttacggaccctgccagtatagcagcgagggggtatattagcacaagagtaggaatgggagaggcagctgcaatctttatgaccgcaacgcctccaggaacagctgaggcgttcccgcaatccaatgcgcccattcaagatgaagaaagagatatacctgaacgcagctggaatagtggaaacgaatggattacagattttgtaggaaaaaccgtttggtttgttccaagcataaaagccggaaacgacatagccaattgtctaaggaaaaatggcaagaaagtaatccaattaagccgaaagacatttgatactgagtatcagaaaacaagacttaatgattgggactttgtcgtcaccaccgatattagtgaaatgggagccaatttcaaagcggatcgtgtaatagatcctagaagatgtctaaagcctgtaatcctgacagatggacctgagagggtgattctggctggccccatgcctgtaacagcagccagtgcggcacaacgacgcggaagagtaggcaggaatccgcaaaaagagaacgaccagtatatcttcactggacaaccattaaataatgacgaagaccatgcacattggacggaggcaaaaatgctgctagataatataaacacacccgagggcataatcccagcactatttgaaccagaacgtgagaagtcagcagctatcgatggtgaatatcgactaaaaggtgaatctagaaaaaccttcgtggagctaatgcgaaggggagatttaccggtatggttggcgcacaaagtagcgtctgaaggtattaaatacactgaccgtaaatggtgttttgacggtgaaaggaacaaccagatattagaagaaaacatggatgtagaaatatggacaaaagaaggagaaaggaagaaactgaggccacgttggttagatgctcgtacttatagcgaccctttagccttaaaagagtttaaggacttcgccgcaggccgtaaaagcatagcactagacttagtgaccgaaattggacgggttccttcacatcttgcacacaggaccagaaacgccctggacaacctggttatgttgcacacgagtgaacatggaggtagagcgtatcgccatgccgttgaggaactaccagaaaccatggaaacactgcttttactaggactaatgatattactaacaggtggcgcgatgctctttcttatatcaggaaaagggattggaaaaacatctataggtttaatttgtgtaattgcatctagtggaatgctatggatggcagacgtgccattacagtggatcgcatctgctatcgttcttgagttctttatgatggtattattaataccagaacctgagaaacaaagaacgccacaagataaccaattagcttatgttgtcatagggatattaacccttgccgctattgtagcagcaaacgaaatgggactactagagacgactaaaagggatctaggaatgagtaaagagcctggagtggttagtcctacaagttacttagatgtagatttacatcctgcaagcgcctggacattgtacgctgtagcgactacagtaataactccaatgttacgacatactatagaaaatagcactgcaaatgtttcacttgcggctatcgctaaccaagcagttgttctcatggggttggataagggatggccgatatcgaagatggatttaggtgtgcctctcctagcactcgggtgctacagccaagtaaatcccttgactttgacggccgctgtcctcctgctagtcacgcattatgcaatcatcggtccaggattacaagcaaaggctacaagagaggcacagaagagaaccgcagcagggataatgaaaaacccgacagtggatggtattatgaccattgacttagatcccgtgatatacgactccaaatttgaaaaacaactgggccaagtgatgctgttagttctctgtgctgtgcaacttctgctcatgcgcacatcttgggccctttgtgaagcactaacccttgcaaccggtccaattactactctttgggaaggttcaccaggaaaattttggaacaccactattgcagtctcaatggcgaacatattcagaggaagttacctagccggagcaggattagctttttccattatgaaatctgtcggtacgggccgtagaggtacgggatctcagggtgaaactttaggggaaaaatggaagaagaaacttaaccaattatcaagaaaagaatttgacttatacaaaaagtctggtataactgaagtagatagaaccgaagcaaaagaaggattaaaaaggggagaaactacacatcacgcagtgagtcgaggatccgcaaaactccaatggtttgtagaacggaacatggtgattcctgaaggacgagtaatagatttgggatgtggtcgaggtggatggtcgtattactgtgcaggtctaaagaaagtcacagaggtccgtggatataccaaaggtggtccaggacacgaagaacctgtacccatgtcaacctatggttggaatatcgttaagctaatgtccggcaaagatgtcttttatctccctccagaaaagtgtgacactttactttgcgacataggagagtcaagcccaagtccaacagtcgaggaatcaagaacgatacgagtcctcaaaatggtcgaaccatggctccgaaataatcaattctgtataaaggtcttaaacccgtacatgcccacagttatagaacacctggaaagactgcaacgaaaatacgggggaatgctagttcgcaatccgctctcacgaaactctacacatgaaatgtattggatttcaaatggtactggtaatatagtaagctcagtaaatatggtttctcggctccttcttaacagatttacgatgactcatagacgaccaactatagaaaaagatgtcgacctcggagctgggacacgccatgttaacgccgagccggaaaccccaaacatggatgtaataggcgaacgtattaaaaggataaaagaagaacattcgagcacgtggcactatgatgacgaaaacccgtacaagacgtgggcatatcatgggagttatgaagttaaagcaactggaagtgctagctcaatgataaatggagtcgtgaaattacttacaaaaccctgggatgtcgtgccgatggtaacacagatggcaatgactgatactaccccatttggacaacaacgtgtatttaaagaaaaagtagatacaagaactccacgaccaatgccaggcacaagaaaagtgatggaaataactgcggaatggttatggcggaccctcggaagaaataagaaaccaagactatgtaccagagaagaatttactaagaaagtgagaaccaacgctgcaatgggagcagtttttactgaagagaaccaatgggactccgccagagcagccgtcgaggatgaagagttttggaaacttgtggaccgtgagagagaactacacaaactgggcaagtgcggttcctgtgtatataacatgatggggaaaagagagaagaaattgggtgaatttggaaaagcaaaaggttccagagcaatctggtatatgtggctcggtgcacgctatctagagttcgaagcgctaggatttttaaatgaggatcattggttctcacgcgaaaattcctattctggagtcgaaggagaaggattacacaaattaggatatatattacgtgacatatctaaaatacccggtggggccatgtatgcagacgatactgcgggctgggacacaagaataacagaagatgacctacacaatgaagagaaaattacacaacaaatggatccagagcaccgtcaactggcgaacgcaatctttaaactaacttatcaaaataaagtggtaaaagtacaacgtccgacaccaaaaggtacagttatggatataatatcaagaaaggaccaaagaggtagtggtcaggtcggcacatatggtctgaatactttcacaaatatggaagcccaattggtccgacaaatggaaggtgaaggcgtgctaagcaaggctgatctggaaaacccgcatctgctagggaaaaagattacacaatggttagaaacaaaaggtgtggaaagactaaaaagaatggctatatcgggagatgactgtgtggtgaaaccgattgacgaccgatttgctaatgccctacttgcattaaatgacatgggtaaagttcgaaaagacataccgcaatggcaaccttccaagggttggcacgactggcaacaagttccgttttgttcacaccactttcatgagttaataatgaaagatggacgcaaattggtagtaccctgcagacctcaggatgaattaataggcagagcaagaataagtcagggtgcgggatggagtctgaaagagacagcatgtctaggcaaggcttatgctcagatgtggagtttaatgtattttcaccgccgagatttaagattagcatctaacgcaatatgttcagccgtccctgtacattggatcccgacatcccgcacgacgtggtccattcacgcccatcatcaatggatgaccacagaagatatgttaacagtatggaatcgagtgtggattgaagataatccttggatggaagataaaacgccagtgactacctgggaagatgtgccttacctagggaaaagagaagatcaatggtgtggcagcctgattgggctcacatcccgtgctacatgggcacaaaacatcttaactgccattcaacaagtcaggagcttaatcggtgacgaagagttcttggactatatgccaagtatgaaacgatttcgaaaagaagaagaatcggaaggagctatatggtaa

SEQ ID NO: 23138 - RNA, 9873 nt, synthetic construct
  misc_feature 1..9873: note = derived and/or modified CDS sequence (opt6) from DENV-3__FJ639726__SS-prME
  source 1..9873: mol_type = other RNA
acatccctatgtctcatgatgatgctgccagccaccctagcatttcaccttaccagccgagacggggaaccgaggatgatcgtaggaaaaaatgaaagaggtaaatcacttctgttcaaaacagctagcggaattaacatgtgtaccttaattgcaatggatttaggagaaatgtgtgatgacacagtaacgtacaaatgtcctctaatcgctgaagtcgaacctgaagatattgattgttggtgtaatttaacttcgacgtgggtgacctatggcacatgcaatcaagcaggagaacatcgaagagacaaaaggagtgttgcattagcgccacatgtagggatgggacttgacactcgtacccaaacgtggatgagtgctgaaggggcctggcgacaggttgagagagtcgagacatgggcattgaggcacccaggatttactatattagcattattcttggcgcattacattggaacatctcttacgcagaaagtagttatatttatcctcttaatgcttgttactccttcaatgacaatgcgatgtgtaggcgtcggcaaccgcgactttgtagaaggattaagcggtgcaacgtgggtcgatgtagttctagaacacggtggctgtgtaacgacaatggctaaaagcaaaccgactttggacatagaactacaaaagaccgaagcgacacaacttgccacgcttagaaaactttgcatcgaagggaagataacaaacattacgacggactccagatgtccaacacaaggggaagcgactcttccggaagaacaggatcaaaactatgtctgtaaacacacatacgtagaccgaggttggggtaacggttgcgggctcttcggaaaggggagtttagttacatgtgccaaatttcaatgtctagaaccaattgaaggcaaagttgtccaatatgagaacttaaagtatacagttataatcacagttcatacgggagaccaacatcaagtcgggaatgacacccaaggagttacagtcgaaattacaccacaagcatcgaccgtagaagcagttctacctgagtacggaaccctcgggttagaatgcagtccacgtacagggttagattttaatgaaatgatattactaactatgaagaataaggcatggatggtacatagacaatggttcttcgatttgccacttccatggacctcaggcgctactacagagacaccgacgtggaatcgaaaggagctgcttgtcactttcaagaatgcgcatgccaaaaaacaggaagtcgttgtacttggtagccaggagggagccatgcacacggcgctaacaggagctacagaaatccaaaattccggaggaacttcgatttttgcgggacatctgaaatgtaggctcaaaatggacaaactcgagcttaaaggtatgtcgtatgcaatgtgtcttaatacattcgtcttgaaaaaagaagtatcagagacccaacacggcaccatattgattaaggtagaatataaaggtgaggatgcaccttgtaagatacccttctccaccgaggatggtcaaggaaaggctcataatggacgattgatcacagcaaatccagtagttactaagaaagaagaaccggtaaatattgaagcagaaccacctttcggagaatcaaacatagtgattggaatcggagacaaagccctaaaaataaactggtataaaaaaggctcgagcattggcaaaatgtttgaggcaaccgcgaggggcgcaagaaggatggcaattcttggagatacggcatgggatttcggatcagttggtggtgtactgaatagcctaggaaaaatggtacaccaaatatttggctcagcgtatactgcccttttcagcggagtaagctggataatgaagatcggtataggagtacttttgacttggataggccttaactcaaaaaataccagtatgtcgttttcatgtatcgtcattggaataattactctttatctaggagcagtcgtccaagcggatatgggatgtgtgataaattggaaaggaaaggagctgaaatgtggatccggtatctttgtcacaaatgaagtccatacatggaccgaacaatataagtttcaagcggattcacctaaaagattagcgactgcaatcgcaggagcatgggagaacggagtgtgcggtataagaagtactactcgaatggagaatctgctctggaagcagattgcaaatgaattaaattatattttatgggaaaacaacataaaactgacagtagtcgtaggtgacattataggtgttctcgaacaaggtaagaggactcttacaccacaaccgatggaattaaaatatagctggaagacatggggaaaagcaaaaatcgtgacggcagaaacgcaaaacagctcgtttatcatagatggacccaatactccagagtgcccatctgcttctcgagcgtggaatgtatgggaagtcgaagattatgggtttggtgttttcacaacaaacatctggctaaaacttagggaagtttacacacaatcgtgtgatcacaggctcatgtcagctgcaattaaagacgaaagagctgttcatgcagacatgggatactggatcgaatctcaaaaaaatggtagttggaagcttgaaaaagcatccttcatcgaagtaaaaacatgcacttggcctaaatcccatactctttggtctaatggggtactagagtcggatatgataataccaaaatcacttgctggacctattagtcaacataaccaccgacctggctatcacacccagacagccggtccatggcatctaggcaaacttgaactagacttcaattactgtgaaggaacaacagtagttataacagagaactgcggaaccagaggaccgagcctaagaaccacgacagtaagtggaaagttaattcacgaatggtgctgtagatcgtgtacactaccccccctgaggtacatgggagaagatggctgctggtacggtatggaaattagaccaatcaatgagaaagaagaaaatatggttaaatccttggtaagtgcagggagcggtaaagtcgacaacttcactatgggagtactgtgtttagcgatattatttgaagaagtaatgaggggaaaattcggaaagaaacatatgattgcaggtgtattatttacatttgtgttactgttatctggtcaaatcacttggcgtgatatggctcacacattaataatgataggcagcaatgcttccgataggatgggtatgggagtcacctacctagctcttatagcaacatttaaaatacaaccgttcttagcactaggcttttttctgagaaaacttacaagtagagagaatttactgttaggtgttggcctagccatggcaacaactctacagcttcccgaagacatagaacagatggctaatggcattgccttggggctaatgacattaaagctcataactcagttcgagacatatcagctatggacagctctcgttagtctgacgtgtagcaatactatatttacactaaccgtagcatggcgcacagctaccctaatcttggcaggtgtaagcttactaccattatgtcaaagtagtagtatgcggaaaactgattggcttcctatgacagttgcggcgatgggggtaccaccattaccattgttcatatttagtctgaaagacaccccaaaaagaagatcatggcctttaaatgagggtgtcatggcggtaggacttgttagtatattagcaagctctttattacgaaacgatgtgccaatggcaggaccgttagtagcaggaggccttttaatagcgtgttacgtaataactggaacgtcagctgatctcaccgtagagaaagccgcagacgttacgtgggaagaagaagccgagcaaacaggtgtaagtcataacctaatgataacagtagacgatgacgggacaatgagaatcaaagacgatgaaacggaaaacattctaacagtcttattaaaaactgcattgttaattgttagcggaatctttccgtatagcatacccgcaactttactagtctggcatacctggcaaaaacaaacacagagatctggggtactatgggacgtgccatcgcctccggaaacacaaaaagccgaattggaggaaggggtctacagaattaaacaacaaggtatcttcggcaaaactcaagtaggagtgggagttcaaaaagaaggagtatttcacacaatgtggcatgttacaagaggagctgtccttacacacaacggaaaaaggttagaaccgaactgggctagcgtaaagaaggaccttatttcatacggaggaggatggagactatcagcacaatggcaaaaaggtgaagaagtacaagttatagccgttgaaccgggaaaaaatccaaaaaactttcagacaatgccaggcatattccagactacaactggagaaataggggctatagcacttgattttaaacccggaacatccggaagcccaattataaatagagagggtaaagtagttggtttatacggcaacggagtggtcacgaaaaatggcggatatgtctctggaatcgcgcagacaaacgcagaacctgatggaccaacaccggaactagaagaagaaatgttcaagaaaagaaatttgacaataatggaccttcatcctggatcagggaaaacacgaaaatatctgccagcaatagtgagagaggccattaaacgaagactgagaactctaatattagcccctactcgagttgttgcagcggaaatggaagaagccctaaaaggtttaccaattagatatcaaacgactgccacaaaatccgaacataccggcagagaaattgtagaccttatgtgccatgcaactttcacaatgaggttattatcaccggtaagggttcccaactataatctggtaataatggacgaagcacactttaccgatccagctagtatcgcagcacgaggatacataagtactcgggtaggaatgggggaagctgcagccatcttcatgacagcaacaccaccaggcactgcggaagcttttccccaatctaatgcacccattcaagacgaagaaagagatattcctgaaagaagttggaatagcggaaacgagtggatcacggatttcgtaggaaagacagtgtggtttgtgccgagcattaaggcaggaaacgacatcgcaaattgtctacgaaaaaacggaaaaaaggttattcaacttagccgaaagacttttgacaccgaataccaaaaaacgagactcaacgactgggattttgtcgttacaactgatatatccgaaatgggggctaattttaaagccgatagagtcatcgatccgagacgctgtttaaaacccgtaatattaacggatggaccagaaagagttatactagccggtcctatgccagtaacagcagcaagtgcagcacagcgacggggaagagtaggtagaaatccgcagaaagaaaacgaccagtatatatttacaggccaaccattaaataacgacgaagatcacgcacattggacagaagccaaaatgttgttggacaatattaacacaccggagggcataataccagccctatttgaacccgaaagagaaaagagcgcagcaatagatggtgagtaccgtctaaaaggtgaatcccgtaaaacgtttgttgaattgatgagacggggtgacttaccggtgtggttagcgcacaaagttgcatctgaaggaatcaagtatacagataggaagtggtgtttcgacggagaaagaaataatcaaatcctggaggagaacatggatgtggaaatatggacaaaggaaggagaaaggaaaaagttgcgcccacgttggttagatgcacgtacatattcagacccgttagctttaaaggaattcaaagacttcgctgcaggacgcaagtcaatagcacttgatctagtaacagaaatagggcgagttccttcccacttagcgcatagaactagaaatgcattagataatctagtcatgttgcacacatccgaacatggtggtcgtgcgtatagacacgctgtagaagaacttcccgaaactatggagacacttctcttattgggattgatgatcttactaaccggaggagcaatgttattcttaataagcggaaaaggcatcggtaaaacatcaattggtttgatatgtgttatagtgagtagtggtatgttatggatggctgatgtaccactgcaatggatagcgagtgctatcgttttagaattcttcatgatggtgttattaattccagaacccgagaaacagcggacgcctcaagacaatcaattagcgtatgttgtaatagggatattaacattagcagccattgtagctgccaacgaaatgggtttactggagacaacaaagcgggatctaggcatgtcaaaagaaccgggggttgtatctcccacatcgtaccttgacgttgacctacacccagctagcgcttggacactttacgcagttgcgactacagttataactccaatgttaagacacacgattgaaaactcgactgcaaatgtatccttagctgctattgccaaccaggctgtagtcttaatgggtcttgacaaagggtggcctatttccaaaatggacttaggcgtgccattgctggcattgggctgttactcgcaagttaacccattgactttaactgcagccgtattgttacttgtaacacattatgcaattatagggcctggtttgcaagcgaaggctactagagaagcgcaaaaacgaaccgcagcaggaattatgaagaaccctacagtagacggtataatgacaatagatctagatccagtaatatatgacagtaagtttgaaaagcaactaggacaagtgatgctattagttctttgtgcagttcaattattattaatgagaacgagttgggcgttatgtgaagctctcacattagctactgggccaataacaactctttgggaaggatctccagggaaattctggaatacaactattgcagtttcaatggcgaacatctttcgaggatcgtatctcgcgggtgctggactagcattctctatcatgaagagtgtcggaaccggtcgaagaggcaccggatctcagggagaaacactcggagagaaatggaagaaaaaattaaatcaactatcgcgtaaagagtttgatctatataaaaaatcgggcattaccgaagtcgacagaacggaagctaaagaaggactgaagcgcggagaaacgactcaccatgcagtaagtcgtgggtcagctaaactgcaatggtttgttgaacggaacatggtaataccggagggtcgggtgatagacctaggatgcgggagaggaggttggtcatattactgtgcaggactcaagaaagtaacagaagtgagaggatacacgaaaggtggcccaggccacgaggagccagtaccaatgtcaacctacggatggaatattgttaagttaatgagcggtaaagatgtcttctatctaagccctgaaaaatgcgacaccctactatgtgacatcggagagagttcaccatctccaactgtagaagaatccaggactataagagtccttaaaatggtagaaccttggctaaggaataaccaattttgcataaaggtcttaaacccatatatgccaacagtaatagaacatttagagagattacagcgaaaatacggaggtatgcttgttcgcaacccattaagccggaacagcacacatgagatgtattggatatcaaatggcaccggtaatattgtatcatcagtaaacatggtatctcggttattactaaacagattcactatgactcatagaagaccaaccattgagaaagatgttgatctaggagccggaactagacatgtaaacgcagaaccagaaactccaaacatggatgtcataggcgaacgaatcaagcggataaaggaagaacattccagtacatggcattatgacgacgaaaatccatacaaaacatgggcatatcatggctcttatgaagtgaaggctacgggtagcgcgtccagcatgataaatggagtagtaaaattactaacgaaaccttgggacgtagtcccaatggttacacaaatggcgatgaccgacactacaccctttggacagcaacgagtttttaaagagaaagtagatactcgtactccacgtcccatgcctggaaccaggaaagtaatggaaataacagctgaatggttatggagaactctaggacggaataagaaaccgagattatgcacacgagaagaattcaccaagaaggttcgaacaaacgcggccatgggtgctgtatttacagaggaaaatcaatgggattcagctagggcggcggtggaagacgaggaattctggaagcttgttgatcgcgaacgagaactacataaacttggcaaatgcggatcatgtgtatacaacatgatgggtaaaagagaaaaaaaattgggtgaatttggaaaggcaaaaggttcgcgtgctatatggtacatgtggctaggtgccaggtatttagaatttgaagcactcggattccttaatgaagaccactggttttctcgtgaaaattcatattcaggtgtcgaaggggaaggccttcacaaattaggctacatcttacgggatatatccaaaatcccaggcggagcgatgtacgcagatgatacagcagggtgggacacgaggatcaccgaagatgacttacataacgaggagaaaattacacaacagatggacccggaacatagacagttagctaacgctatctttaaactaacctatcaaaataaggttgtgaaagtacagcgtccaaccccaaaaggcactgtcatggacattataagccgaaaggatcaacgaggctccggtcaagtaggcacgtacggtttgaatacgttcacaaacatggaagcgcaattagtacgtcaaatggagggagagggcgtattatcaaaggcagatcttgaaaatccacacctactggaaaagaaaataacgcagtggttagaaacaaaaggtgtagagcgcttgaaaagaatggcgatttcaggtgatgactgcgtagtgaaaccaattgacgatagattcgcaaacgcgctactcgcgctcaatgacatgggaaaggtgcgcaaggatataccacagtggcaaccatccaaggggtggcatgactggcaacaagtgcctttttgttcgcatcatttccatgaacttatcatgaaagacggacgaaaactcgtcgtgccatgtcgaccccaagatgagctcattggaagagctagaattagtcagggagcaggatggtcacttaaagaaacagcatgtctcggaaaagcttacgcccagatgtggagtcttatgtacttccatcgcagagacctaagacttgcttccaacgctatttgctcagctgtacccgtccattggatcccaacatcacgaacaacttggtcaattcacgcacaccatcagtggatgactacggaagatatgttaacagtatggaatcgcgtttggatagaagacaatccttggatggaggacaaaaccccagttactacgtgggaagacgttccttacctaggtaagagagaagatcaatggtgcggaagcctcattggattgacgtcccgggctacttgggctcaaaatatattgacagcaatacaacaagtaagatcgctgatcggagatgaagaatttctagactacatgccgtcaatgaagcgctttcgaaaggaagaggaatcagaaggggcgatatggtga

SEQ ID NO: 23139 - RNA, 9873 nt, synthetic construct
  misc_feature 1..9873: note = derived and/or modified CDS sequence (opt6) from DENV-3__KF955333__SS-prME
  source 1..9873: mol_type = other RNA
acatcgctgtgtctaatgatgatgcttccagcaactctagcatttcatttaacttctagagacggagagccaagaatgatagtggggaaaaacgagaggggaaaatccctactattcaaaacagcatcaggaatcaatatgtgtacacttatcgctatggatttaggcgaaatgtgcgatgacacggtaacttacaaatgtccgttgattgctgaagtagaaccagaagatattgactgctggtgtaatttaacaagcacctgggtgacttatggaacctgcaatcaggccggtgaacatagaagagataaaaggtctgttgcacttgcaccacatgtgggtatgggactagacactagaactcaaacatggatgtcggccgagggcgcgtggcgacaagtagaaaaagtagaaacctgggcacttcgacatcctggatttacaattttagctctatttttagctcattatataggtacaagtctaacacaaaaagtagtcatatttatcttattaatgcttgtaacaccaagcatgacaatgcgatgcgtaggagtcggaaatcgggattttgtagaaggcttatcgggagctacatgggtagatgttgtactagaacacggcgggtgtgtgacaacaatggcgaaatcaaaacctacactagatatagaacttcagaaaactgaggcaacacaactagctacactacgtaaactatgcatagaaggcaaaattactaatataaccactgatagccgatgtccaacgcagggagaagctacgcttcctgaagaacaggatcaaaactacgtgtgtaaacacacttatgttgaccgtggttggggtaacggatgcggattatttgggaaggggtcgttggtcacatgtgcaaaatttcaatgtttggaacctatagaaggaaaagttgttcaatacgagaacctgaaatacaccgtcatcattacagttcatacaggagatcaacatcaagtcggaaatgacacacaaggagtgaccgtagagataactccacaggcaagtactgtcgaagctgtgttaccggaatatggcaccctaggactagagtgtagtcctagaacaggactagactttaacgaaatgatccttctaacaatgaaaaacaaagcatggatggtacacagacaatggttctttgatttaccgttgccttggacctcgggtgctacgaccgagacccccacatggaacagaaaagaacttttggtaacgtttaaaaacgcacatgccaagaaacaggaggtagtagttttaggatcccaagagggtgccatgcatacagctctgactggagcaacggaaattcagaacagtggaggtacctcaatatttgctggtcatcttaaatgtcgattaaaaatggacaaactggaacttaaaggaatgtcatatgcaatgtgcttgaatacatttgtactcaagaaagaggtttcagaaactcaacatggcacaatactaataaaagtcgaatacaaaggagaagacgccccatgcaaaatccccttctctacggaggatggacaaggaaaagcccacaatggaaggctcataaccgccaacccagtagtgaccaagaaagaggaacctgttaacattgaagcagaaccccctttcggagagtcgaatatagttattggcataggcgataaggctttaaaaataaactggtataagaaaggctcaagcataggtaaaatgtttgaagcaacggccaggggagcccgtagaatggcaatattgggcgacacggcgtgggattttggcagtgtaggaggagtacttaatagtttaggaaagatggtacaccagatctttgggtcagcatatacagccctattttcaggagtttcatggattatgaaaataggtattggggtactcctaacctggattgggcttaatagcaaaaatacatcaatgtcatttagttgcatagtaattggtataataaccctctacctgggagcggtagtacaagcagacatgggatgcgccataaattggaaaggtaaggagttgaaatgtggttctggaatatttgtcaccaacgaagtacatacatggactgagcagtataaattccaagcagactctcctaaaagactagccacagccatcgcaggggcttgggaaaacggcgtatgcggcattcgtagtacaacgcggatggagaacttactgtggaaacagatagccaatgaacttaattacatattatgggagaacaacatcaagttgaccgtagtcgtaggggatatcataggtgtattagaacaaggtaagagaactctaacaccacaaccaatggaattaaagtattcatggaaaacatggggcaaagcgaaaattgtaacagcagagacccaaaattcatcattcattatagatggtcctaatacccctgaatgtcccagtgccagtcgtgcctggaatgtatgggaagttgaggattacgggttcggagtattcacaacaaatatttggctgaaactaagggaagtatacacccagtcatgtgaccaccggctaatgagcgccgcaataaaagatgaacgcgcggcacatgcggatatgggctattggatagaaagccagaaaaatggaagttggaaactagaaaaagccagctttatagaggtcaagacatgtacttggccaaaatcccacacgctatggagcaacggtgtgttagaaagtgacatgattatacccaaatcacttgctggacctatatctcaacataatcatcgcccaggttaccacacccaaacagcaggtccttggcatcttggaaaactcgagctcgattttaattattgcgaaggaacaacagtggtaatcactgagaattgcggaactaggggtcccagtctcaggacaacgacagtgtccgggaagctgatccacgaatggtgttgtcgaagttgcactcttcctcctctaagatacatgggtgaagatggatgctggtatggaatggaaatacgaccgattaacgaaaaggaagaaaatatggtaaagagcttggtttctgcgggctctggtaaagttgataattttactatgggagtattatgtctggcaatattgtttgaagaagttatgcgtggcaaattcgggaaaaagcatatgatagcgggtgtcttatttacattcgtactactactaagcgggcaaatcacgtggagagacatggctcatacattaataatgataggctcaaatgcaagtgatagaatgggaatgggggtcacctacttggctttaatagcgacgtttaagatccagccatttctggcgctcggattcttcttacgaaagttaacatctagggaaaacttgttactaggcgtaggtcttgcaatggctactacgctacaattgccggaagatattgaacaaatggcaaatggaatagcacttggcctcatgacactaaaattaattacccaatttgaaacgtaccaattatggactgcattggtatcattaacgtgcagtaatacgatttttacgttaacagtcgcctggcgaactgcgactttaattttggcaggagtctcacttttacccttatgtcaaagcagtagtatgagaaaaacagactggcttcccatgacagtagcagctatgggggttcctcccttacccttatttattttctcactgaaggatacgccgaaaagacgttcatggccattaaacgaaggtgttatggcagttggcctagtgtcaatcttagcatcgagtttactacggaatgatgtgcctatggctggccccctagttgctggaggcctactaatcgcgtgttacgtaataacagggacgagcgctgatcttaccgtagaaaaaccagcagatgtgccatgggaagaagaagcagaacaaactggagtttctcataatttgatgattactgtagacgacgacggtccaatgagaattaaagacgatgaaacagagaacattttgacagtacttctgaaaacggctctattaatagtgagtggcatattcccctacagtatacccgctacgttattggtctggcatacttggcaaaaacaaacccagagaagtggtgtactatgggatgtcccgagtccgccagaaacccaaaaagcggagttagaagaaggcgtgtacagaatcaaacagcaggggatatttggaaaaacacaagtaggagttggggtacaaaaggaaggtgttttccatacgatgtggcacgtaacacgaggagctgttttgactcataatggaaaacgtttggaacctaattgggcatcagtcaagaaagacctgattagttacggaggaggttggcgattaaacgctcaatggcaaaaaggagaagaggtgcaagtcatcgcagttgaaccaggcaaaaaccccaaaaatttccaaactatgccgggaatatttcaaacgacgaccggtgaaataggcgcaatcgcactcgacttcaagccaggtaccagtggatcacccataataaaccgtgagggaaaagttgtgggactctatggtaacggggtcgttaccaaaaacggtggatatgtgagtggtatagcccaaactaatgccgagccagacggccccacaccggaactagaggaggaaatgttcaagaaaagaaacttaacaattatggatttacaccccggttcaggcaaaacacgaaaatacttgcctgccatagtacgagaagccataaaaagacgattgcgaaccttgatattagcacctactcgggttgttgctgctgaaatggaagaggccctaaaaggcctaccgataagataccagacaacagcaaccaaaagcgaacacacgggacgagagatagtagacctaatgtgccatgcaaccttcacgatgcgactattatcgcctgtaagggttccaaactacaatcttgttatcatggatgaggctcattttacggacccagcaagcatagctgcacggggttatataagcacaagggttggcatgggtgaggcagcggcgatttttatgacggcaacaccacctggcaccgcagaagcctttcctcaaagcaacgcacctatacaagacgaggaacgagacattcctgaacgtagttggaatagtggcaatgaatggattactgatttcgttggaaaaacagtgtggttcgtaccgagtataaaggcgggaaatgacattgccaactgtttaaggaaaaacgggaaaaaggtaatacagctttcacgtaaaacctttgatacagaatatcaaaagacacgattgaatgactgggactttgtcgtaacaacagatatttcagaaatgggtgcgaattttaaggcagatcgagtgatagaccctagacgttgcttaaaaccagtgatacttactgacggacccgagagggtcatcctagcaggtccaatgccagtgactgcagcatcagcagcgcagcgacgaggacgtgtaggaagaaatccacaaaaagaaaacgaccagtatatttttacgggccaaccgcttaacaatgacgaagatcatgcccattggacagaagcaaaaatgctacttgacaatataaacacccccgaaggaataattcctgctttatttgaaccggaaagggaaaaatctgcagctatagacggagagtaccgactaaaaggagaatcccgcaaaactttcgttgaactcatgagacgcggagatctaccagtatggttagctcataaagttgctagcgaaggcattaaatatactgacagaaaatggtgctttgacggagagagaaacaaccaaatcctagaagagaacatggacgtggaaatctggaccaaagaaggagagcgaaagaaattacgtccacggtggctagatgctagaacatatagtgacccgttagctcttaaagaatttaaagattttgcagcaggcaggaaaagtattgcgcttgacttagttacagagataggtagggtaccatcacatctagcccacagaacaagaaatgctttagataacttagtaatgctacacacgagtgaacacggtgggagagcgtatagacatgcggtcgaagaactacctgagacgatggaaaccctactactacttggtttaatgattctccttactggaggggctatgctatttctaataagcgggaaaggcataggcaaaacatcaattggacttatatgtgttatagtatcgtcagggatgctgtggatggctgatgtacctctacaatggattgcatcagctattgtacttgagttctttatgatggtgctactaatccctgaacctgaaaaacaacgtacaccgcaagacaatcagttggcttacgtagtaatcgggatactcactcttgccgccatagtcgcagctaatgaaatgggcctcttggaaacaaccaaacgtgatttagggatgtctaaagagccgggagttgtctcacccacttcttaccttgacgtggatttacaccctgcctctgcctggactctttatgcggtggcaaccactgtaataacaccgatgctcagacacacgatagaaaactcaactgctaatgtaagtcttgcagcaatcgcgaaccaagcagtagttttgatggggttggataaaggatggccaataagcaaaatggatctaggcgtcccacttctagcgttgggatgttactcacaagtaaacccgcttacactgacggctgctgttttactcctagtaacacattatgccataattggtcctggacttcaggcaaaagcaacgcgagaagcccagaagagaacggccgcgggtatcatgaaaaaccctaccgtagacggaataatgacgatagacctcgatccagtaatatatgattcaaagtttgagaaacaattgggacaggtgatgctattagtactgtgtgccgtacaattactgctaatgcgaaccagttgggccctttgtgaagcactaactctcgcgaccggtccgataacaacactatgggaaggctcacccggaaagttctggaataccaccatcgcagtttcaatggcaaatatatttcgcggtagttaccttgcaggagccggattggcattttctatcatgaaaagcgtagggacaggacgtagaggaacaggaagccaaggtgaaacattaggagagaaatggaagaagaaattaaatcaattaagtagaaaagaatttgatctgtataagaaatctggcattacagaagtagacagaaccgaagccaaagaggggttaaaaaggggagaaactacgcaccacgctgtatccagaggttccgcaaaattacaatggtttgttgaacgaaatatggtgatcccagaaggtagagtaattgacctcggctgtggacggggcggctggagttactattgtgcgggactaaagaaagttacagaggtaaggggttatacaaaaggcggtcccggccatgaagaaccagtaccaatgagtacatacgggtggaatatagttaaattaatgagtggtaaagatgtcttttacctaccgcctgagaagtgcgacacacttttatgtgatataggcgaaagctctccgagtccgactgtcgaagagtcacgcacaatcagagtactcaaaatggtcgaaccttggctccgcaacaaccaattctgcataaaggtgctaaatccttacatgccaactgtgattgagcatttggaaagactacaaaggaaatatggaggcatgttagtgagaaatccactttccagaaattcaacgcacgagatgtattggatatctaacggtactgggaatatagtcagctccgtaaatatggtatctaggcttcttctcaataggtttacgatgacccatagacgtcccaccatcgaaaaagacgttgatctaggagcaggaacacggcacgtaaatgctgaaccagaaactccgaatatggacgtaataggagagaggataaagcgaataaaagaagaacactcctcaacttggcactatgatgatgagaacccatacaagacttgggcttatcatggttcatacgaggttaaagcaaccggttctgcaagttctatgataaacggtgtcgtcaaacttctaactaaaccctgggatgtagtaccaatggtaactcagatggcaatgacagacacgaccccgttcggacaacaaagagtctttaaagaaaaagttgacaccaggactccaagaccaatgccaggtacaagaaaagtcatggaaataactgcggaatggttatggcgaacattaggcaggaataagaaacctagattatgtactagagaggaatttacgaaaaaggtaagaacaaatgctgcaatgggagctgtattcacggaggaaaatcaatgggatagcgcacgcgctgctgtcgaagatgaagaattttggaaacttgtagatagagagagagaattacataaattaggtaaatgtggaagttgcgtatacaatatgatgggtaaacgcgagaagaaactaggagagttcggaaaggcaaagggatccagggcaatttggtatatgtggctgggcgccagatatcttgagttcgaagcactaggctttctaaatgaagaccattggttctcacgagaaaattcatattcgggagtcgagggggaaggattacataaattagggtacatcttacgtgacatctccaaaataccaggtggtgccatgtacgcagatgacacagcaggttgggacacaagaataactgaggatgacctacataacgaggagaaaataacagcccaaatggatccagaacatagacaattagcaaacgcaatcttcaaacttacctatcagaacaaagtcgtgaaagtacaacggccaactcccaaaggaacagtgatggatataattagtcgaaaagatcaaagggggagcgggcaggtagggacatacggacttaacaccttcacaaatatggaagctcagttagtccgtcaaatggaaggagaaggtgtattgtcaaaggcagatttagaaaatccacatcttctagagaaaaagataacgcagtggcttgaaacaaaaggtgtggagagattaaaaaggatggcaatttcaggagacgactgcgtggtcaagccgatagacgatagattcgcgaatgcattactcgctttaaacgacatgggtaaggtaagaaaagatataccgcaatggcagccatccaaaggatggcacgactggcagcaggtccctttctgttcgcaccattttcacgaactcatcatgaaagacggtaggaagctagtagtgccctgcagaccacaagatgaattaatcggcagagcccgcataagtcagggcgcaggatggtcgttaaaagaaactgcgtgtttgggtaaggcatatgctcaaatgtggtccttaatgtactttcatcgacgtgacctacgtttagcatcaaatgccatatgtagtgcagtaccagttcattggataccaacatctagaacgacttggagcattcatgcacatcaccagtggatgacaacagaagatatgcttaccgtctggaaccgagtttggatagaggataatccatggatggaagacaaaacgccagttactacttgggaggatgtaccctatcttggaaaacgcgaggatcagtggtgtggcagtcttatcggactaacttcgagagcaacttgggctcaaaatatattaactgcgatacaacaagtacggtctttgataggggatgaagaatttcttgactatatgccgagtatgaaacgctttcggaaagaagaagagagtgaaggagcaatatggtaa

SEQ ID NO: 23140 - RNA, 9873 nt, synthetic construct
  misc_feature 1..9873: note = derived and/or modified CDS sequence (opt6) from DENV-3__GQ868628__SS-prME
  source 1..9873: mol_type = other RNA
acttccctctgtttgatgatgatgctgccagctactctggcctttcatcttacaagcagagatggggaaccacggatgatagtaggcaaaaacgaaagaggcaaaagcctgctatttaaaacagcgtcaggtataaacatgtgtactttaatagcgatggatttaggggaaatgtgcgacgacacagtaacatataaatgcccattgatcgcagaagtggaaccagaagatatcgattgttggtgtaacctgaccagtacatgggtaacatatggtacttgcaaccaagctggtgaacacagaagagacaaacgttcagtagccctagcaccacatgtaggaatgggtcttgacacacgaacacaaacatggatgtcagccgaaggagcttggcgtcaagtagagaaagttgaaacttgggccttaagacatcccgggttcacaatcctagcgttattcctagctcattatattggaacatcactaactcaaaaagtagtaatattcattctactaatgcttgtaaccccgtcaatgactatgcgatgtgttggagtaggaaatagagactttgttgaaggcctctctggagcgacatgggtggacgtagtcctagagcatggtggatgcgtaacaacaatggctaaaagcaaacccacacttgacattgaattacagaaaactgaagctactcaactcgctacgttaaggaaactatgcatagaggggaaaattacaaacataacgacagatagtcggtgcccgactcaaggtgaagctacacttcctgaagaacaagatcaaaattatgtatgtaaacatacatatgtagatcgagggtggggcaacgggtgcggattatttggtaaagggtcgctcgtaacctgtgctaaattccaatgtcttgaaccgatagaaggaaaagtcgttcaatatgaaaacttgaaatacaccgtcattataactgtacatacaggagaccaacatcaagtgggaaatgatacccagggtgtgacggttgaaataactccacaagcaagcacggtagaagccgtattaccagaatatggcaccttaggcttagaatgctcgcccaggacgggtcttgattttaatgaaatgatcttgcttaccatgaaaaataaagcctggatggtccaccgacaatggtttttcgacttacctttgccatggactagcggagcaacaacagaaactccaacttggaatcgaaaagaacttttagtaacctttaaaaatgctcatgccaagaaacaagaggtagtagttcttgggagtcaagaaggggccatgcatacggctttaactggagcgacagaaatacaaaatagtggaggaacttcaatatttgcagggcacttgaaatgtagactcaaaatggataaactcgagcttaaaggaatgagttatgcaatgtgcttaaatacctttgttctaaagaaagaagttagcgaaacacaacatggtacaattttgataaaagtcgagtataaaggtgaagatgcgccttgtaaaataccattttctaccgaagacgggcaaggaaaagctcacaatggacgtctcatcaccgctaacccagtagttaccaagaaagaagaacctgttaacatagaagcagagccaccatttggggaaagcaatatcgtaatcgggataggggataaagccctaaaaattaactggtataagaaaggcagcagtatcggcaaaatgttcgaagcaacagcgagaggggcaagacgtatggctattcttggagatacggcatgggattttggaagcgtgggaggtgttctaaattctttaggaaaaatggtacatcaaatctttggatcagcatatactgcactgttttcgggcgttagttggataatgaaaataggtataggggtactattaacttggattggattgaactccaaaaacacatcaatgagcttctcatgcatagtaataggaattatcacattatacctcggagcggtcgtgcaagctgatatgggttgtgtaataaattggaaaggtaaagaattgaaatgcggaagtggaatttttgttacaaatgaagtgcacacatggactgagcagtataaattccaagccgattcgccaaaaagactagcaacggccattgcaggagcctgggaaaacggcgtatgtgggattagatctaccacaagaatggaaaatttactttggaagcaaattgctaacgaattaaattatatactatgggaaaataacatcaaactaactgttgttgtaggtgacattataggtgtattagagcaaggaaagcggactttgactccacaaccgatggaactaaagtacagttggaaaacgtgggggaaagcgaagatagtaacagctgaaacacaaaactcatcttttattatagatggcccgaataccccagaatgcccctctgcatccagggcgtggaatgtatgggaagttgaagactatggcttcggcgtatttaccacaaacatatggttaaaattacgcgaagtttatacacaaagctgcgatcatcgattaatgtcggcagcaattaaggacgaaagggctgttcatgcagacatgggatattggatagaatcccagaaaaatggttcatggaagttagaaaaagcctctttcatagaagtgaaaacatgcgcatggcctaaatcacacacactatggtcaaacggagtcttagagagtgacatgataattcctaagagtttagccggaccaatctctcaacataaccatagacccgggtatcatacacaaacagctgggccgtggcatttaggaaaactcgagttagattttaattattgcgaaggcaccaccgtagtgataaccgaaaattgtggtacgcgagggccgtcccttcggactacaacggtttccggcaaactaatacatgagtggtgctgtagatcatgtaccctccctcccttgaggtatatgggtgaagatggctgttggtatgggatggaaattcggccaattaatgaaaaagaagaaaacatggttaaatcgttggtatctgcgggaagcggaaaggtagataactttaccatgggagtgctatgcctagctatactctttgaagaagtaatgagagggaagttcggtaaaaagcatatgatcgctggggtactatttacatttgtgttacttctctcaggacaaattacctggcgagatatggcacacacattgatcatgatcgggtctaatgcatcggatcggatgggaatgggcgtaacctatttagccttaatagccacgttcaaaatacaacccttccttgctctgggcttctttctgagaaaactaacatccagagaaaatctacttctaggggtagggttagcaatggcaacgacactgcaactgccagaagacatagagcagatggcaaatggaatagcactaggattaatgacattgaaacttattacacaattcgagacttatcaattatggactgcgttagtttcactgacgtgttcaaacaccatcttcacgctaacagtagcttggcgtactgcaaccctaattttggcgggagtcagcttactaccactctgtcaaagttcatctatgagaaaaacagattggttacccatgactgtagcggctatgggtgtaccaccactgccacttttcatattttcgttgaaggatacgccgaagaggagaagctggcctttaaatgaaggagttatggcagtgggtttagtttcaattctggccagttcattattacgaaatgatgtaccgatggctggtcccttggtagcagggggcctgttgattgcatgctacgtaattacaggaacatccgcagatttgacggtcgaaaaagcagctgatgtaacatgggaagaagaagcagaacaaactggagtcagccataatttgatgattaccgtggacgacgatggaacgatgaggataaaagacgacgagacggaaaatattttaacagtgctccttaaaaccgcccttttaatagtaagtggcatattcccatatagtataccggcaacactacttgtatggcacacttggcagaaacagacgcaaaggtcgggagtcttatgggatgtccctagtcctccggaaacccagaaagcggaactcgaagaaggagtgtataggataaaacaacaggggatatttgggaagacacaagtaggcgttggcgttcagaaggagggtgtcttccacaccatgtggcatgttacacgcggcgcagtactaactcataatggaaaaagacttgaacccaactgggcgagcgtgaagaaagatctcattagttacggtgggggttggcgactatcagcacaatggcaaaagggtgaagaagtccaagtgatcgccgtggagccaggcaaaaatccaaagaacttccaaacaatgcctggcatatttcaaacaaccacaggtgaaatcggagccatcgctttagactttaagccaggtacctcaggaagcccaataataaacagagaaggaaaggtagtaggattgtacggtaatggagttgttacaaagaatggtggatatgtatccggaatcgcacaaacaaacgctgaaccggatggaccgaccccggaattagaagaagaaatgtttaagaaacgcaatctaacaattatggacttacatcccggttctggtaaaacacgtaagtatttgcccgccatagtcagagaggcaataaaaaggcgacttcgtacacttattctagctcctactcgagttgttgcggccgagatggaagaggcattaaaaggtcttcccataaggtatcaaacgacggcaaccaaaagtgaacatacaggtagggagattgtcgacctaatgtgtcatgccaccttcacaatgcgattattaagtccggtacgggttcccaactataacttagtaataatggatgaagcgcattttaccgatccagcgagtatagcggcacggggatatataagtacacgagttggaatgggagaagcagcagcgatcttcatgacagctactccgccgggtacagctgaagcatttcctcaaagtaacgccccaatacaagacgaagaaagagatatccctgagagatcatggaactctggaaatgaatggataacagactttgttggtaaaacagtgtggtttgtaccgtcaataaaagcaggaaatgatatcgctaattgcttaagaaagaacggcaagaaagtaatacaactgtccagaaaaacattcgacaccgaataccaaaagacacgcctaaatgattgggatttcgtagttacaacagatatttcagaaatgggtgcaaattttaaggcagaccgagtaatagatccgagaaggtgtctaaagcctgtgatacttacagatggacctgaaagggtgatcctagcaggtcccatgcccgtaacagcagctagtgccgctcaacgaagagggcgtgtaggacgaaatcctcaaaaggaaaacgatcaatatatctttacaggtcagcctctcaataatgatgaggatcatgcacattggacagaggctaaaatgttacttgataatataaacacaccggaaggaataatccctgctctattcgagccagagagagagaaatcggcggccatcgacggagaatacagattgaaaggcgaatcaaggaaaacatttgtcgaacttatgagaaggggagatctccccgtatggcttgcgcataaagtagcatctgaaggaataaaatacactgacagaaagtggtgtttcgacggtgaaaggaataaccaaatactagaagagaatatggatgtcgagatatggacaaaagaaggagaacgcaagaaactacgtccccgctggttggatgctagaacgtatagtgatcccttggcactgaaagaatttaaagattttgctgcaggaaggaaaagcattgccttggatttagttaccgagatcggacgggtgccgtctcatctggcacatcggaccagaaacgcgttggacaacttggtaatgctacatacaagtgaacatggagggagagcatatcgacatgcagtagaagaattacctgaaacaatggaaaccttacttctgctaggattaatgatacttttaacaggtggtgctatgctgtttctgatttcaggtaaaggaatagggaaaaccagcatcggtcttatttgcgtaatcgtcagttcaggcatgttgtggatggcagatgtaccacttcagtggatcgcatccgcaatagttttagagttctttatgatggttttattaattcctgaaccagagaaacagaggacgccacaagataatcagcttgcgtacgtagttataggcatactaactttagcagccatagtggcagctaacgaaatgggattgttggagacaacgaaacgagaccttggaatgtcaaaggaacccggagttgtctcccccacaagttaccttgacgtagacctgcatcccgcctcagcgtggacactgtatgccgtagccacaacagtaataacgcccatgctgaggcacacaatagagaacagcacagccaacgtatcgttagcagctattgctaatcaggcagtagtgctcatgggcttagataaagggtggccaataagtaaaatggatctaggggtcccactgttggcgctagggtgttactcacaagtcaatcccttaacactaacagcagcggtactgttgttagtaacacactacgccataataggcccaggattacaagcaaaagccacccgggaagcacaaaagcggaccgcagccggaataatgaaaaatccaaccgttgacggcattatgacgattgatttagacccagtgatatatgattcaaagttcgaaaaacaattggggcaagtgatgttattagttctttgtgcagtacagctattgttaatgagaacaagttgggcgttatgtgaagccctaaccttggctactggtccaataaccacactttgggaaggatctcctgggaaattttggaacaccactattgcggtatccatggcaaacatattccgtggaagctatttggcaggagcaggactagcgtttagtataatgaagtcagtcggcacaggacgacgtgggactggtagtcaaggagaaacactaggggaaaaatggaagaagaaactaaatcaattatctcggaaggagttcgatctatataagaagtctggaataacggaagtcgaccgtactgaggctaaagagggactcaaacgtggagaaacaacacaccacgcagtttcgaggggaagcgcaaaattacagtggttcgttgagaggaacatggtaattccagaaggaagagtgattgatctcggttgtggaagaggtggctggagctactactgtgcgggcctaaagaaagtaaccgaagtcagggggtatacaaagggaggcccaggacatgaagaaccagtgcctatgtcaacttatggatggaatatagtaaaactaatgtctgggaaagatgtgttctatttaccaccagaaaaatgcgacactcttttatgtgacataggggaatctagtccgtcacccacagtggaagaatcgagaacgatacgagtattaaaaatggttgaaccttggttacgaaataatcagttctgtatcaaagttttgaatccttatatgccaactgtaatcgaacatttggaaagactccaaaggaaatacggaggcatgctggttagaaatcctctttctcgtaattcaacacacgaaatgtactggattagcaatggaacaggtaatatagtaagcagtgtaaatatggtctcaagactactattaaacagattcacaatgacacatcgccgacctacgatcgaaaaagatgtcgatttaggagccgggactagacacgttaacgcagaacctgaaactccaaatatggatgtaataggagaaagaattaaacgaataaaagaagaacatagctctacgtggcactatgatgatgaaaatccatataagacttgggcatatcacggcagttacgaagtaaaggccacaggttcagcgtcgtctatgataaacggcgtagtaaagctacttacaaagccttgggatgttgtacctatggttacgcagatggctatgacggatactactccctttggacaacaacgggtattcaaagaaaaagtagataccagaactccacggccaatgcctggaactcgaaaagttatggaaataaccgcagaatggttatggagaactttagggagaaataagaaaccgcgattatgtactagagaggagtttacaaagaaagtgcgaactaacgccgcaatgggggcggtatttactgaggaaaatcaatgggacagtgctcgagcggcggtcgaagatgaagaattttggaaattagtcgacagagaaagagaacttcacaaactaggcaaatgcggatcgtgtgtctataacatgatgggtaagcgagagaagaaactcggagaatttggcaaggcaaaaggcagccgggccatctggtacatgtggcttggtgccagatatctagaatttgaagctctaggtttcttaaacgaggatcattggtttagccgtgaaaattcttactccggggtagaaggagaaggactacataagctagggtacattctgagagacatatccaaaatacccggaggggcaatgtatgcagatgatacagcaggttgggatacgcgaatcaccgaagatgatcttcacaatgaagagaaaataacacaacaaatggatccagagcatagacaactagctaacgcgatatttaaattgacctatcaaaacaaagtcgtcaaagttcagagacccacaccaaaaggaactgtaatggacataataagcagaaaagaccaaagaggctccggacaagttggcacatatgggcttaataccttcaccaatatggaagcacagcttgttagacaaatggagggtgaaggagtactcagtaaagcggaccttgaaaatccacatctcctggaaaagaaaataacacagtggctagagacaaagggtgttgaacgtttgaaacgcatggcaatctcgggggacgattgcgtagttaagcctatagatgatcgttttgcaaacgctctattagcactgaatgatatgggcaaagtacgaaaagatattcctcaatggcagccgtcaaaaggttggcatgattggcaacaagtacctttttgtagccatcatttccatgaactaatcatgaaagatggacgtaaactcgttgtcccttgtagaccacaagatgaattaataggcagagcaaggatttcacaaggtgcaggatggagcctcaaggaaaccgcttgtttgggtaaggcctatgcacaaatgtggtcgttaatgtattttcatcgtagagatttacgacttgcttccaatgcgatatgttcagcagtaccggtacactggatacccacttcaagaaccacgtggtcaatccacgcacatcaccaatggatgacgactgaagacatgttaacggtctggaatcgtgtatggattgaagataatccttggatggaagacaaaacgcccgtaactacctgggaagatgtgccatacctaggcaaacgggaagatcaatggtgcggaagtcttatcgggttaacatcaagagctacatgggcacagaacatcttaactgcgatacaacaagtacgaagtttaataggtgacgaagaatttctcgattacatgccaagcatgaaacgctttcgcaaggaggaagaatctgaaggggcaatctggtaa

SEQ ID NO: 23141 - RNA, 9873 nt, synthetic construct
  misc_feature 1..9873: note = derived and/or modified CDS sequence (opt6) from DENV-3__FJ639727__SS-prME
  source 1..9873: mol_type = other RNA
acaagcctatgtctaatgatgatgctacccgcgacactagcattccatctgacaagtcgagacggtgaaccgaggatgatagtgggcaaaaacgaaagagggaaatcactcctgtttaaaacagcaagcggaataaatatgtgtacgcttatcgcaatggatttaggagaaatgtgtgatgatacagtgacatataaatgtccattaatagcagaagttgaaccagaggatatagattgctggtgcaatttaacttcaacatgggtaacgtacgggacatgtaatcaagcaggagaacacaggcgtgacaaaaggtccgtagcacttgctccacacgttggaatgggactcgatacgcgaactcaaacatggatgagtgctgaaggtgcatggagacaagtagagaaagtagaaacgtgggcgcttagacacccaggatttactatattagctctgtttttagcacattatatcggaacatcactaacccaaaaagtggtgatctttatacttttaatgttggtaacgccttctatgacaatgcgctgtgtaggggtaggaaacagagatttcgtagaaggactatcaggagccacgtgggtagatgtagtattggaacacggaggatgcgttactaccatggctaaaagcaaaccgactctggatattgaactacagaaaactgaagcaacccaactggctacactgcgaaaactgtgtatagagggtaaaataaccaacataacaacggatagccgatgcccaacccaaggggaagcaaccctccccgaagaacaagatcaaaactacgtttgcaaacatacatacgtggataggggatggggcaatggatgtggattgtttggcaaaggctctctcgttacatgcgcaaaattccaatgcttagaaccaattgaaggaaaagtggttcaatatgaaaacttaaaatatactgtaattattactgttcatacaggtgatcaacaccaagtcggaaacgacacccaaggagtcacggtcgaaattaccccgcaagcatcaacggtagaagctgtcttgccagaatacgggaccctaggtttagagtgctcacctagaactggtctcgattttaacgaaatgatattgctaactatgaaaaataaggcatggatggtacacagacaatggtttttcgatctaccgctaccctggacaagtggtgcaacaactgaaacaccaacgtggaaccgcaaggaacttttagttacttttaagaacgctcacgctaagaaacaagaagtcgttgtattgggtagtcaagaaggagcaatgcacacagcacttactggggcaacagagatccaaaattcagggggaacgagtatttttgctggtcatctgaagtgccgattgaagatggataaattagaattaaaaggaatgagctatgccatgtgtttaaatacgttcgtactaaagaaagaggtgagtgaaacacagcacggaacaatcctcattaaggttgaatataaaggggaagacgcgccatgtaaaattcctttcagcacggaagatggacagggaaaaagtcacaatggaagactaattactgccaatcctgtagtgaccaagaaagaggaacccgtgaatattgaagcggagcctccatttggtgaatcaaatatagtcattggcataggtgataaagcattaaagataaactggtacaaaaaggggtcgtctataggaaaaatgtttgaagccaccgcacgtggtgctaggagaatggctatattaggtgacactgcatgggactttgggagcgtcggtggcgtactgaacagtctcggtaaaatggtacaccaaatattcggatctgcttacacagcattatttagcggagttagttggataatgaaaataggaataggagtacttttaacctggataggacttaatagtaaaaatacctcgatgtctttttcctgtattgtgataggcattatcacactatatttgggcgccgtagtacaggcagatatgggatgcgtaataaattggaaaggaaaagaattaaaatgtggcagtggaatattcgtaacgaacgaggtccatacatggaccgaacaatataagttccaagcagacagccccaaaagattggcaactgcaattgcgggagcttgggaaaatggtgtttgcggaataagatctacaacgcgtatggaaaacctgctctggaaacagatagcaaacgaactcaattacatattatgggaaaataatatcaaactgacagtcgtagtaggcgacatcatcggtgtcctagagcaaggcaaacgaacgttgacaccgcaaccaatggaattaaaatactcatggaaaacttgggggaaagcaaagattgtcacagcagaaactcaaaatagttcattcataatagatgggcctaatactccagaatgcccgtccgctagtcgagcttggaacgtttgggaagtcgaagattatggttttggagtgttcacaacgaatatatggctaaaacttcgagaagtctatacacaatcctgcgatcatagattaatgtcagcagcaataaaggatgagcgagctgtacacgccgacatgggatattggattgaaagccagaaaaatggttcatggaaattggaaaaggcatcctttatagaagtcaaaacttgcacttggcctaagagccacacattgtggtcaaacggagtactagaaagcgatatgattatacctaagagcttggccggtccgatctcccagcataaccacagacctggatactatacacagacagcaggaccatggcatttaggaaagttagagttagattttaactattgtgagggaacaacagtagtaataacagagaactgtggaaccagagggccatcactccgaacaacgaccgtatcaggtaaactaatacacgagtggtgttgtcgatcatgtactcttccccctcttagatatatgggcgaagatggatgttggtatggtatggaaatccgaccaattaatgaaaaagaggaaaatatggtaaaatcattagtaagtgcaggttctggaaaagtagataactttactatgggagtattatgtctggcaatactattcgaagaagtgatgaggggaaaatttggcaagaaacacatgatagcgggggccttgtttacatttgtattactactatcaggccaaattacctggcgagatatggcacacactctaattatgataggatctaacgcaagtgatagaatgggcatgggggttacgtacctcgctttgatcgcaactttcaagatacaacctttcttagcattaggattctttctacgtaaactaaccagtagagaaaacctattgctgggtgtaggactagccatggccacaacactccaattaccagaagatatcgagcagatggcgaatggtatagcattgggcttaatgaccttaaaattaataactcaattcgagacatatcagttgtggactgccttagtgagtttaacatgcagtaacacaatatttactctcactgtagcctggcgaactgcaacattaattttagcgggcgtatccttgctaccattatgtcaatcttcgtcaatgagaaaaacagattggttgccaatgacagtagccgctatgggtgtcccaccattacccctcttcatattcagcctcaaagatactccgaagagaagaagctggcccctaaacgaaggggtaatggcagttggcttagtatcaatcctagcctctagtctcttaagaaacgacgtaccaatggctgggccgttagtagcaggaggattattaatcgcgtgttatgtaataacgggcacatctgctgatctgacggtggagaaagccgctgatgtcacttgggaagaagaagctgagcaaacgggcgtaagtcataatctaatgattactgtagacgacgacgggactatgaggattaaggatgacgagacggaaaatatattaactgtactactcaagacagctctgctaattgtgagtggaatttttccctacagtataccagcgacgctgttagtatggcacacatggcagaaacaaactcaaagatcaggcgtgttatgggacgttccgtctccccctgaaactcaaaaagcggaactagaggaaggggtctatcgaataaaacaacagggaatattcggaaagacacaagtaggcgtcggagtacaaaaggagggggtatttcacacaatgtggcatgtgacccgcggagcagtgcttactcacaatggaaaacgccttgaaccaaattgggcgagcgttaagaaagacctaataagctatgggggagggtggagactaagtgcacaatggcagaaaggagaagaagtacaggtaattgctgtcgaacccggcaaaaaccctaaaaattttcagacaatgcccggaatatttcaaactactacgggagaaattggagctattgcactagactttaaaccaggaacatctggcagcccgataataaaccgagaaggaaaagtggtaggcctatatggaaatggagtcgtcaccaaaaacggtgggtacgtatctggtattgcccagacaaacgcggagccggacggtccaacacctgagcttgaggaagaaatgttcaagaaaaggaacctaacaatcatggacctacatcccggaagcgggaaaaccagaaaatacttaccggctatagtacgagaagctataaaacggagactgagaacgctaatactagccccaacacgtgtcgttgcagcagaaatggaagaagcactgaaaggactacccatccggtatcaaacaaccgcaacaaaaagtgaacatacaggccgtgagatagtggacttaatgtgtcacgcaacattcaccatgcggttactatctccggtaagagttcccaattataatctcgtcgtaatggacgaagcacatttcacagacccggcaagtattgcagcaagaggatacatctcaactagagtaggaatgggggaagctgcggccatctttatgacagctactcctccaggcaccgctgaagcctttccccaaagcaacgctcccatacaagacgaagaacgagatataccagaaagaagttggaatagtggtaatgaatggataacagattttgtaggaaagaccgtgtggtttgtaccgtctattaaagctggtaatgacatagctaattgcttaagaaagaacggtaaaaaggttattcaattatctagaaagacattcgatacagaatatcagaagactcgactaaatgattgggatttcgtagtaacgacagatatttctgagatgggagcgaactttagagccgatagagttattgaccccagaagatgtctaaaaccagtaatattaaccgacgggccggagagagtaatactcgcaggacctatgccggttacggctgcgtcggcagctcaaagaagaggaagagtgggaagaaacccacaaaaagaaaatgatcaatatatatttaccggacagccactcaacaacgatgaagatcacgctcattggacagaagctaagatgcttctagataacatcaacactccagaaggtataatacctgcactctttgaacccgaaagggagaaaagtgcggcgatcgatggcgaatatcgattaaagggcgaatccaggaaaacgttcgttgagctcatgaggagaggcgatttacccgtgtggttggcacacaaagtagctagtgaaggaattaaatatacagacagaaagtggtgctttgacggtgaacgcaacaaccagatattagaagaaaacatggacgtagaaatttggacaaaagagggtgaacgaaagaaacttaggccccgttggttagatgccagaacttattcggatcctctggcgcttaaggaatttaaagatttcgcagcaggcaggaaatcaatcgcgctagacctagttacagaaattggaagagtaccaagccatttagcgcatagaactaggaatgcacttgacaatctcgtcatgttgcatacaagcgagcatggcggtagggcatacagacatgccgtagaagaactaccagaaacaatggaaacactcctattgctaggacttatgatccttttgacaggtggggctatgttatttctgataagcggcaaaggcataggaaaaacatctattggtctgatatgtgtaatagtgtcatccggtatgctttggatggctgacgttccgctccagtggatagcaagcgcaatagtattagagtttttcatgatggtgttgctaatccctgaaccagaaaaacaaagaactccacaggataaccaacttgcttacgttgtcattggtattctaaccctagctgcgatagtcgctgcaaacgaaatgggtctgttagaaaccactaaaagagatttaggcatgagtaaagaacctggggttgtctcacccacatcataccttgatgttgatcttcatccagcgtcggcgtggaccctctatgctgtagctacaacagtcataacgcctatgttacgccatactattgaaaacagcaccgcgaatgtatcgttggctgcaattgccaaccaggccgtggtattaatgggtttagacaagggctggcctatatcaaaaatggacctaggtgtacccctgttagcactgggatgttattctcaagttaatcccttaacactaaccgctgctgtactgctgttagtgacgcattatgcaataataggtccgggtttacaagcaaaagcaacacgcgaggcgcagaaacgaactgccgctgggatcatgaaaaatccaaccgtagatggaataatgaccattgatttagatccagttatttatgattccaagtttgaaaaacagttaggacaagtcatgctattagtactatgcgccgtacaactgctcttaatgagaacctcatgggccttatgtgaggctttgacactcgcaaccggaccaataactacattatgggaaggatccccgggaaagttttggaatacaacaatagcagtttcaatggctaacattttccgaggaagttatttagcgggtgcgggtttagcattcagtataatgaaatcagtgggtaccggtcgaaggggaacgggcagtcagggggaaaccctcggtgaaaaatggaaaaagaaattaaatcaactaagcaggaaagaatttgacctatataagaaaagtggtataacagaagttgatagaactgaagcaaaggaaggtcttaaaagaggggaaacaacccatcacgctgtatccaggggctctgcaaaactccaatggtttgtagagcgaaacatggtcatacccgaggggcgtgtaatagatctcggttgtggaagaggcggctggagttactattgcgcagggctgaagaaagtaacggaggttagaggatataccaagggaggaccaggacacgaggaacccgtcccgatgagcacttatggatggaacatagtaaaattaatgtctggaaaggatgtcttctacctgccccctgagaagtgtgacacattattatgtgatatcggcgagtcctcaccaagtcctacagtagaagaatcgaggactataagagtacttaagatggtcgaaccgtggttgcgaaataaccagttttgcataaaagttctaaatccctatatgccaactgtaatagagcacttagaaagattgcaacgaaaatacggaggcatgttagtacggaatccgctgtctagaaattcaactcatgaaatgtactggattagcaatggaacaggaaacattgtttccagcgtaaatatggtatcaaggttgctattaaaccgatttactatgacacacagaaggccaacaattgaaaaagatgtggacttgggagccggaacgcgacatgttaatgcagaacccgagacaccgaatatggatgtaatcggtgaaagaataaagaggataaaagaagaacattcatcgacgtggcactacgacgacgaaaatccatacaaaacttgggcatatcacggctcctacgaagtgaaagccacgggtagcgcaagctcaatgatcaacggagtggtgaaacttttaacaaaaccgtgggatgttgtcccaatggtaactcaaatggcaatgacagataccacaccatttgggcagcagagggtattcaaggaaaaagtagatacaagaacgccacgcccaatgcccggaacgagaaaagtaatggagataacagctgaatggctatggcgaaccttaggaagaaacaaaaagccgcgactttgcacgagggaagagttcaccaagaaagttcgcacaaatgcagctatgggagccgtatttacagaggaaaatcaatgggacagtgccagagctgccgtagaagatgaagagttctggaaattagttgacagagaaagagaactccacaaacttgggaaatgtggaagttgcgtatataatatgatggggaaaagagaaaagaaattaggtgaatttggtaaggctaaagggagtcgagccatttggtacatgtggttgggtgcgcgctatctcgagttcgaagcactgggtttcttgaacgaggatcactggttcagtagggaaaattcatactctggagtggaaggtgaggggttgcacaaactgggatatatcttaagggacattagcaaaatccctgggggagcaatgtacgcagatgacactgcaggatgggatacacgaattactgaagacgatcttcacaatgaagagaagattacacagcaaatggaccccgaacacagacaattagcaaacgcaatctttaaactcacataccaaaataaagttgtaaaagtacagagaccaactccgaaaggtacagttatggacataatcagtcgaaaagaccaaagagggtctggccaagttggaacatatggactaaacaccttcaccaatatggaagcacagttagtccggcagatggagggtgaaggtgtactctcaaaagcggacttagaaaacccacatttgctagagaagaaaatcacccagtggctagaaacgaaaggagtagaaaggttaaaacgcatggctatatctggtgatgattgtgttgtaaagcccatagacgatagatttgcaaacgcacttttagcactcaatgacatgggtaaagtacgaaaggacataccacagtggcaaccaagtaaagggtggcacgattggcaacaggtcccattttgctcacatcactttcacgaactcataatgaaagatgggcgaaagctagtagtgccctgtcgaccgcaagatgaactaatcggacgcgcgcgaatatcgcaaggagctggctggagcctaaaagaaacagcttgcttaggtaaggcttatgcacaaatgtggagcctcatgtatttccatcgtcgcgacttaagactcgcatcaaatgcgatatgttcggctgtacctgtgcactggataccaacatccagaactacatggtctattcacgcacaccatcaatggatgactacagaagatatgctgactgtttggaatcgagtatggatagaagacaatccatggatggaagataaaacgccagttacgacatgggaagacgttccttacttagggaaaagggaagaccaatggtgtggatcgctaattgggctaacatcaagggccacttgggcacagaacatattaacagcaatccagcaagtacggagcttgataggagatgaagagtttctagattatatgccgtcgatgaaaagattcagaaaagaagaggaaagtgagggtgctatatggtag

SEQ ID NO: 23142 - RNA, 9873 nt, synthetic construct
  misc_feature 1..9873: note = derived and/or modified CDS sequence (opt6) from DENV-3__GQ868629__SS-prME
  source 1..9873: mol_type = other RNA
actagcctatgcctcatgatgatgttgccggctaccttagcgtttcacctcacctcaagagatggagaacctcgtatgattgtcggtaaaaacgaaagaggaaaatccctgcttttcaaaaccgcatcaggaataaacatgtgcactttaatagcaatggatttgggggaaatgtgcgatgatactgtcacttacaaatgtccactaattgcggaagtcgaacctgaggatatagactgctggtgcaatttaacctctacatgggtaacgtatggaacatgtaatcaagcgggggaacacagaagagacaaacgaagcgtagcactagcacctcacgttggaatggggcttgacaccagaacacaaacttggatgtccgcggagggcgcatggcgacaagtagaaaaagtagaaacttgggcattaagacacccgggatttacaatactagctctctttctagctcattatataggaactagcttgacacaaaaagtagttatattcattctattaatgctagtcactccatcgatgacaatgagatgtgtaggtgttggaaatagagattttgttgaaggattaagcggagcaacatgggttgacgttgtattggaacacggtggttgtgtcacaacgatggctaaatcaaaaccgacccttgacatagaactacagaaaacggaagcaactcaactagccacattacggaaattatgtattgaaggaaaaatcaccaacatcacaacagattcaagatgtccgacacaaggagaagctacccttcctgaagaacaagaccaaaattatgtatgtaaacatacctacgttgacaggggatgggggaatggatgcggactctttggcaaaggcagccttgttacttgtgcaaaatttcaatgtcttgaaccaatagaagggaaagtagtacaatacgaaaacctcaaatacactgttataattacagtacatactggtgaccaacatcaagtaggtaacgatacacaaggtgtgacagttgaaatcactccacaagcgtccacagttgaagctgtattacccgagtatggcacgcttggactcgaatgctctccaagaaccggactagactttaacgaaatgattctgcttactatgaaaaataaagcgtggatggttcatcggcaatggttctttgacctaccactaccttggacgtctggtgccattaccgaaacgccaacttggaacaggaaagaacttctagtcacatttaaaaatgctcacgctaagaaacaagaggttgtagtccttggctcccaagaaggagccatgcacacagcgttaaccggagcaacagagatacaaaattccggcggaacatctattttcgctggacatctaaaatgtcgactaaaaatggataaattggaattaaaaggaatgagctacgcaatgtgcctaaacacatttgtacttaagaaagaagtctcggaaactcaacatggaacaattctcataaaagtggaatacaaaggagaagacgctccttgtaaaatcccattctccactgaggacggccaaggaaaggctcataatggccggcttattaccgcaaatccggttgtgactaaaaaggaggaacccgttaatattgaagctgaaccaccatttggggagagtaacatagtaatcggtattggcgacaaggcactaaaaatcaattggtataagaaaggttcttcaattggcaaaatgttcgaagcaacagccagaggagcgcgaagaatggctatattgggtgatacggcatgggatttcggatccgtaggcggagttcttaacagtctaggtaaaatggtacaccaaatattcggttcagcatatacagctctctttagtggtgtgagctggattatgaagatagggattggtgttttattaacatggataggactcaatagcaagaatacgagtatgtcattctcttgcatagtaataggaatcattacattgtaccttggagctgtagttcaagctgatatggggtgcgtaataaattggaaaggtaaagaactaaaatgcgggtccgggatcttcgtaaccaacgaagtccacacgtggaccgaacaatacaagttccaagcagacagccctaaaagacttgcaacggcgatagctggggcttgggagaatggagtttgtggaattagaagtacaactaggatggaaaacctgctatggaaacaaatagcaaatgagctaaattacatactttgggagaataatataaaactgacagtagtcgttggtgacataattggagtactggaacaggggaaacgcacgctgaccccacaaccaatggaacttaaatactcatggaagacttggggaaaagccaagattgtgactgcagagactcaaaatagtagctttataatagacggaccaaacacaccggaatgtccctcggccagcagagcatggaatgtttgggaagtagaagactacggattcggtgtatttactaccaacatatggttaaaattacgagaagtgtatactcagagctgtgaccatagattaatgtccgccgctattaaagatgagagagcggtccacgcagacatggggtattggatagaaagtcagaaaaatggcagctggaaactagagaaagccagctttattgaagttaaaacgtgcacctggcccaaatcacatactctgtggagcaacggcgtgctagaatcagacatgatcattcccaaaagtctagcaggccctatcagtcaacataaccatcgcccggggtatcatactcaaacagctggaccatggcatcttggaaaactagaactcgattttaattactgtgaaggtacaaccgttgtcataacagagaactgcggtactagggggccttcacttcgaactactacagtttcgggcaaactaatacatgaatggtgttgccgaagttgtacattaccaccattaagatatatgggagaagatggatgctggtatggaatggaaatacgcccaattaacgaaaaagaggaaaatatggtaaaatctttagtaagtgcaggttcaggtaaagtagacaattttacgatgggagtcctatgtttggcgatattattcgaagaggtcatgagaggaaaattcggtaaaaagcacatgatagcgggagtactatttacgtttgtcttgttattaagcggtcaaattacgtggagagacatggcacatacactcatcatgattggatcgaacgcatcagataggatgggaatgggggttacgtacttagctctgatagccacctttaaaatacaaccattcctagcactaggattctttttacgtaaactaacaagcagagagaatttattgttaggtgtaggactcgctatggctacaacgctgcaactaccagaagatattgaacaaatggcaaatgggatcgctctgggcctaatgacccttaaacttattactcagttcgaaacctatcaactatggacagctttggtatcattaacttgctccaatacgatatttacactaactgtcgcgtggcgaacggctacactaatactagcaggggtgtcattattacccttgtgtcagagttcatccatgcgtaaaactgactggttaccaatgacggtggccgcaatgggggttccgcctttaccattgtttattttctcgttaaaggacacgcccaaaagacgcagttggcctctcaatgaaggcgttatggcagtcggtttagtatccattctagcctcttctcttcttcgtaacgatgtcccgatggctggtcctttagtagcaggaggactactaattgcatgctacgtgatcacaggaacaagtgcagacttaacggtagagaaagcagcagatgtaacctgggaagaagaagcagagcaaaccggggtatcgcataatcttatgatcacagtagatgatgacggaacaatgcggattaaggatgacgaaaccgaaaacatcctcacggtgctccttaagacagcgttgctaatagtatcaggaatctttccatatagtattcccgccacactcctggtgtggcatacctggcaaaagcaaacgcaaagaagtggagttttatgggatgtaccgagtccacctgaaactcaaaaggcagaactggaagaaggcgtatataggattaagcagcaaggaatctttggaaaaacacaggtaggagtgggcgtacagaaagagggagtatttcacacaatgtggcacgtgacaaggggagcagtattaacacataatggaaaacggttagagcctaattgggctagtgtcaagaaagacttaatttcatatggtggcggatggagactttcagcacagtggcaaaagggagaagaagttcaggtaatagcagttgagcctggtaaaaatcccaaaaatttccaaaccatgccaggaatatttcaaactacgaccggtgagatcggtgcaattgctttggattttaaaccgggtacaagtggcagccccattataaaccgtgaaggcaaagttgtcggtttatacggaaatggtgttgtgaccaaaaatggcgggtatgtttcaggaatagcccaaacaaacgctgagccagatggaccaacaccagaactggaagaggagatgtttaagaaacggaatttaacaatcatggatctacacccaggttctgggaaaactcgaaaatacttaccagcaatagtgagagaagccataaaaaggcgtttgcgaacactaatactggccccaacgcgtgtagttgccgctgaaatggaggaagcattaaaaggcttaccgatcagatatcagacaaccgcaacaaaatctgaacacaccggaagagaaatagtggatcttatgtgccatgctactttcacaatgcgtttgttatcacccgtccgcgtccccaattataatctagtcattatggacgaagcccattttacagatcccgcaagtatcgcggcaagaggatacataagcacgagagtaggaatgggggaagctgctgcgatttttatgacagccacacccccaggaactgcagaagccttcccacaatcaaacgcacctattcaagatgaagaacgagatataccagagcgtagctggaacagcggaaacgagtggatcaccgatttcgtcggaaagactgtttggtttgtaccttcgataaaggcaggaaatgatatcgcaaattgcctacgcaaaaatggaaagaaagtaatacaattatccagaaaaacctttgacacagaatatcagaaaactagattaaatgattgggacttcgtagtaaccacagatatctctgaaatgggtgctaacttcaaagcagaccgagtgattgaccctagaaggtgtttaaagcccgtcattttgacggatgggccagaacgggttattctcgctggaccgatgccagttacagcagctagtgcggcacaacgcagaggcagagtgggtcgaaatccgcaaaaggagaacgatcaatatatattcacagggcaacctctcaacaacgacgaggaccatgcgcactggaccgaagcaaagatgctacttgacaatataaacacacccgaaggaataattcctgcactttttgaaccagaaagggaaaaatcggcggcaatagatggtgagtatagacttaaaggtgaatcccgaaagacatttgtcgaactaatgcgccggggcgatctcccagtatggcttgcacataaggtagcaagtgaaggcatcaaatacactgatagaaaatggtgcttcgacggggaaagaaacaaccaaattctagaagaaaacatggacgttgagatatggactaaagagggcgagagaaagaaattacgtccaagatggctcgacgcgaggacttactcagaccctttagcattaaaagaatttaaggacttcgctgcaggccggaaatccattgcactcgatcttgtgaccgaaataggccgagtgccaagtcatcttgcacataggacacgtaacgcccttgataacctggtcatgctacacaccagcgaacacggtggcagagcatatcgacatgctgtagaagagttacccgaaacaatggaaactttattacttctaggattaatgatattactaaccggcggagcgatgctattcctcatctcgggaaaaggtataggtaagacctcgataggtctcatctgcgttattgtaagtagcggtatgctctggatggctgatgtcccacttcaatggatagcatcagcaatcgtattggaatttttcatgatggttctattaataccagaacctgagaaacaaagaactccacaagataaccaattagcttatgtagtaataggaatcttaacgctagctgctatcgttgcggcaaatgaaatgggccttcttgaaactactaaaagagatcttgggatgtccaaagaaccaggtgttgtatcgcctaccagctatttagatgtagacctccatccagcctcagcctggacactgtatgcagtagctacaactgtaattacgccaatgctccgacacacaatcgaaaattcgacggccaatgttagtctcgcagccatagctaatcaggccgtcgtcctaatgggtcttgataaagggtggccaataagtaaaatggacttaggggtgccattattagcactgggctgttactctcaggttaatccattaacattaactgcagcagttctgcttcttgtcacgcattacgcaattataggccctggcttacaagccaaagccacgagggaagctcaaaaacggacagccgctggtattatgaagaatcccacagttgacggcataatgacaattgacctggaccctgtgatatacgatagcaaatttgaaaaacaattaggccaggtaatgctcctcgtcctttgtgcagtccaattactgttaatgcggacatcatgggccctgtgcgaagccttaacattagctacaggtccaataactaccttgtgggaaggttcaccaggaaaattctggaacaccactatagcagtgtcgatggcgaacatattcaggggttcctacctggcaggagcgggactggcattttctataatgaaatcagtaggtacaggtaggagaggaaccggatcccaaggagagacgttaggagaaaaatggaagaagaaactaaaccaactaagtaggaaagaatttgatttatataaaaagtccggcataacagaagtagatcgcacagaagccaaagaagggctaaaaagaggcgagactacccaccatgcagtatcgcgcgggtctgctaaattacaatggtttgttgagagaaatatggtaattcctgaggggcgtgtcatagacttagggtgtggacgagggggatggagctactattgtgcaggcctaaagaaagtgacggaagtacgtggatatacaaaaggcggaccgggccatgaagaaccagttccgatgtcgacatatggatggaatattgtcaaactaatgagcgggaaagacgtcttttatttaccaccggaaaaatgtgatacgttgctatgcgatatcggtgaaagcagtccctccccgactgttgaggaatcaaggaccattagagtccttaaaatggtagagccgtggctaaggaataatcaattctgtataaaagtactcaatccttatatgcctacggttatcgaacatctggaaagattacagagaaagtatggaggaatgctggtgagaaacccgctatcacgaaattcaacacacgaaatgtactggatatctaatgggacagggaacattgtttccagtgtaaatatggtttccagactccttttaaatcgctttactatgactcacagaagacccactattgaaaaagacgtggaccttggagcaggaacacgtcacgtaaatgcagagcccgaaactcctaatatggatgtaataggcgaaagaataaagcgaattaaggaagaacattcctccacatggcactacgacgatgaaaacccttacaaaacatgggcataccatggctcatacgaggtaaaagcaactggatcagcctcgagtatgataaatggggttgtgaaactcttaaccaaaccatgggacgttgtgccaatggtaacgcaaatggcgatgacagatactacccccttcggacaacaaagagtattcaaggagaaagttgataccagaactcctcgaccgatgccagggacgcgcaaagttatggaaataaccgccgaatggctatggagaacattgggacgaaataagaaaccaagactatgcacaagagaggaatttacaaagaaagtaagaactaatgccgcaatgggcgcggtttttacagaagaaaaccaatgggatagtgctcgtgcagccgtcgaggacgaggaattttggaagttagtcgatcgcgagcgtgagctccataaattgggaaaatgcgggtcctgtgtttataatatgatgggaaagcgggaaaagaaattaggcgagttcggtaaagccaaagggtcaagggcaatatggtacatgtggctcggtgcgcggtatctagagtttgaagcattaggcttcctaaacgaggatcattggttttcgcgtgagaactcgtatagtggagttgagggagaaggattgcacaaactcggttatattttgagagatatatcaaaaattcctggaggggcaatgtacgccgatgataccgccggatgggacacgcgaataacagaagacgatttacacaatgaagagaaaataactcaacaaatggatccggagcacagacaacttgccaatgctatattcaagttgacttaccaaaataaagtagttaaggtacaaagacctacaccaaagggaactgtgatggatattatatctcgtaaggatcaacgtgggtcaggacaagttggaacttatggattaaatacattcactaacatggaagcgcaactggtaagacaaatggaaggtgaaggcgttctcagtaaagcagacttagagaacccgcatctgttagagaagaaaataacacagtggttggaaacaaaaggtgtggagagactgaaaaggatggctataagtggagatgattgtgtggttaaaccgattgacgacagatttgctaacgcactactagcgcttaatgatatgggcaaggtacgaaaagatattccgcaatggcagccttctaaaggatggcacgactggcaacaagtaccattttgttcgcatcactttcacgaactgattatgaaagatggtcgaaaattagtcgtgccgtgtagaccacaagacgaattgattggaagggcaagaatatcacaaggcgcgggatggtcattaaaggaaactgcatgcctaggaaaggcgtacgcgcaaatgtggagcttaatgtactttcataggagggatctacgtttagcctcaaatgcgatatgctctgcggtacccgtccattggatcccaacaagtcgaacaacatggtcaatccacgcacaccatcaatggatgactacggaagacatgctgacggtctggaacagagtttggatcgaggacaatccatggatggaagataaaactccagttacgacttgggaggatgtcccttacctggggaagcgggaggaccaatggtgtggatcactaataggcttgacgtccagagctacctgggctcaaaatatattgaccgccatacaacaagtaaggtcactcataggagatgaagagttcttagactatatgcctagtatgaaacgcttcaggaaagaagaagaatcagagggcgcaatttggtag

SEQ ID NO: 23143 - RNA, 9873 nt, synthetic construct
  misc_feature 1..9873: note = derived and/or modified CDS sequence (opt6) from DENV-3__FJ639728__SS-prME
  source 1..9873: mol_type = other RNA
acgtcgctatgtcttatgatgatgttaccagctacactcgcctttcacctaacatcacgtgatggggaaccgagaatgatagtgggcaaaaatgaaagaggaaaatcacttctttttaaaacagcaagcggtataaatatgtgtacactgatcgctatggatctaggggaaatgtgtgatgatacagtaacgtataaatgtcccctaatcgcagaagtagaaccggaagatatagattgttggtgcaacttaacttcaacgtgggtaacatatggaacctgcaaccaagctggggaacatagacgagacaaaagatcagtagccttagcccctcacgtgggaatgggattggatacaagaacacaaacatggatgtcggcagagggggcctggagacaagtagaaaaagtcgagacttgggcattgcgacacccaggttttacaatattagcattattcctggcacattatattggaacctcactcactcaaaaagtggtaatctttatactactcatgttagtgactccatcgatgacaatgcgctgcgttggtgtaggaaatcgagactttgttgaaggactatccggagccacatgggtcgacgtagtgttagaacatgggggttgcgttacaacaatggcaaaaagtaaacccactttagacattgaacttcagaaaacagaagcaactcaattagcaacgttaaggaaattatgcatcgagggtaaaatcacaaatataacaactgacagtaggtgcccaacgcaaggagaggcaacactccccgaagaacaagatcaaaattacgtatgtaaacatacatatgtagatcgagggtggggtaacggatgtggcttattcggtaaaggttcattagttacgtgcgcgaaattccaatgcctggaaccaattgaagggaaagttgtacagtatgaaaatctaaaatacacagtgattattaccgttcacacaggtgaccaacaccaagtcggtaatgacacccaaggtgtgacagttgaaattactccacaagcatcaacagtagaagcagtactgccagaatatggaacactggggttagaatgtagtcccaggacaggtctcgactttaatgagatgatcttattaacgatgaaaaacaaagcatggatggtgcaccgtcaatggttctttgatttacctttaccgtggactagcggggccactaccgaaacacctacttggaatcgaaaagaattgctagttacatttaaaaacgcgcatgccaagaaacaagaagtggtcgtcttaggttcgcaggaaggtgcaatgcatacggcgctaacaggagccacagaaatacaaaactcaggaggtacaagcatctttgccgggcatcttaaatgtcgtttaaaaatggataaactagagctcaaaggcatgtcgtacgccatgtgcctaaacacttttgttcttaagaaagaagtgtcggaaacgcaacacggtacaatcctaatcaaagtagaatataaaggcgaagacgcaccatgcaaaatacctttctccacagaagatggccaaggaaaagcacacaatggaagattaataacagcgaatccggttgtaacaaagaaggaagaaccagtaaacatagaagcagaaccaccattcggggagtcaaatattgttataggaataggagataaagcactaaagataaactggtacaagaaaggctcctctatagggaaaatgtttgaggcaacagcaaggggagcaagacgaatggcgattctcggtgacacagcgtgggattttggcagtgtaggaggagttttaaactccctaggaaagatggtccaccaaatcttcggttctgcatatacagccctattttctggagtgagttggataatgaaaataggcattggtgttctcttgacatggattggtcttaatagcaaaaatacttcgatgagtttttcatgtattgtcattggaattatcaccttgtatctgggcgcggttgtccaagcagatatggggtgcgttataaattggaaaggaaaagaacttaagtgtggaagtgggatttttgtcacaaatgaagtacatacgtggacggagcagtacaaattccaagccgacagtccaaagcgtctggcgactgccatagccggagcatgggaaaatggcgtatgtggaatacgatcaacgacgcgaatggaaaacctgttatggaaacaaatagccaatgaattaaactacatcttatgggaaaacaacatcaaactcacagtggttgtcggcgatattatcggggtactagaacaaggaaaaagaacacttacaccgcaacccatggaacttaaatatagctggaaaacctggggcaaagcgaagatagttacagcagagactcaaaattcatcatttatcatcgatggacctaacaccccagaatgtcccagtgcgttaagagcgtggaacgtatgggaagtggaagattatggctttggagtttttactacaaacatatggctcaaactacgcgaggtctacacacaatcatgcgatcaccgtttaatgagcgcggcaataaaagatgagagggcagtacatgcagatatgggttattggatcgaatctcagaaaaacgggtcatggaaactagaaaaagcatcatttattgaagttaagacttgtacttggccaaaatcgcacacactatggagtaatggcgtcctggagagtgatatgataattcccaaatcactagcaggacctattagccaacacaaccaccggccgggataccacacgcaaacggcgggtccctggcaccttggcaaactggagctcgactttaactattgcgaaggtaccactgtagttattactgaaaattgtggaactagaggtccatctttacgtacgacaacggtatcggggaaactaatacacgaatggtgctgtagaagttgtacattgccccctcttcgttatatgggtgaagacgggtgctggtatggtatggaaatacgacctatcaatgaaaaggaagaaaacatggttaagagcttagtttctgcaggaagcggcaaggtagataatttcacaatgggcgtgctttgcttggccattttattcgaagaagtgatgcgaggtaaatttgggaaaaagcacatgatcgccggcgtcctattcacattcgttttacttctcagcggacaaataacgtggcgggatatggcacacacattaataatgattggcagcaatgcatcagatcgaatgggaatgggggtaacttatttagcgctgattgctacctttaagatacaaccatttctagcgttggggttctttcttcgaaagctcacatcacgtgaaaatttattattgggtgttggtttagcaatggccaccacattgcaattgccggaagacattgaacaaatggcgaatgggatagcactaggtttaatgacgttaaaactaattacgcaatttgagacatatcagttatggactgcattggtttctttgacctgctcaaacaccatattcacactaactgttgcctggaggacggcgactttaatactagctggggtttccttgctgccactttgtcaaagcagcagtatgagaaaaacagactggctacccatgacagttgccgcgatgggagtaccgccattaccactattcatattctctctaaaagatactccaaaacgaagaagttggccattaaatgaaggtgtaatggcagtcggactggtatccatcctggcatcgagtttattgaggaatgacgttcctatggcgggacctttagtcgcgggaggccttctaatagcgtgctatgtaataacgggaacatcggctgatttaacagtcgaaaaggctgctgatgttacttgggaggaagaagcggagcaaacaggagtatcccataacttaatgattacagtagacgacgatggaactatgagaataaaagatgatgaaacggaaaacattcttactgtactacttaaaactgctctactcattgtgtcgggtatattcccgtacagcatacccgccactttactggtgtggcacacatggcagaaacaaacacaaaggagtggagtcctatgggacgttccctccccaccagagacacaaaaagctgaattagaagaaggcgtatacagaattaagcagcaaggcatcttcggtaaaacgcaagtaggtgttggtgtgcaaaaggaaggagtttttcataccatgtggcatgttaccagaggggcagtccttactcacaacggtaaacgccttgaacctaattgggccagtgtgaagaaggacttaatatcttacggaggagggtggagattatctgcgcagtggcagaaaggtgaagaagtgcaagtcattgcagtggaaccaggcaaaaaccctaaaaattttcaaacgatgccaggtatctttcaaactacaacaggagagattggggcgattgcattagactttaaacctggtacctctgggtcaccgataataaatagagaaggaaaagtagtgggtttatacggaaatggagtagtgaccaaaaatgggggatatgtttcaggaatagcacaaacaaacgcggaacctgacggacctacaccagaattggaggaagaaatgtttaagaaacgtaacctcacaataatggacctgcatccaggatcaggaaagacgaggaaatatctacccgccatagtacgagaagccataaaacgtagactgcgcacactaatattggcgcctacacgggtcgtcgcggctgagatggaagaagcactaaagggtctcccaattcgataccagaccacagccaccaaaagtgagcatacaggaagagaaatagtagatttaatgtgtcacgcaaccttcacaatgcgattattgtcaccagtgagagtcccaaactacaatcttgttattatggacgaggctcatttcactgatccggctagtatagcggccagaggttacatttcaactagagtaggcatgggtgaagcagcagcaatatttatgacagctacgcctccaggcacggcagaggcctttcctcaaagcaacgcgccaatacaggatgaagaaagggatattcccgaaaggtcatggaactccggtaacgagtggataactgactttgttgggaagacagtctggtttgtaccttctataaaagcaggaaacgatatagcgaactgcctacgaaagaatggcaagaaagtaatacaattatcacggaaaacatttgatactgagtaccagaaaactcgcctgaatgattgggacttcgttgttactactgatatctcagagatgggtgctaactttaaagccgatcgcgtgatagaccctcgaagatgtttgaagccagttattttaactgatgggcccgaaagagttatattggccggaccaatgcccgtaacagcagcttcagcggcgcaaaggaggggcagggtgggccggaatccacaaaaggaaaacgatcaatatattttcacaggacaaccgctaaataacgatgaagatcatgcccattggacagaagccaaaatgttgttggataatattaatactccagaaggtataatcccagcactatttgaaccagaaagagaaaagtccgcagcaatagacggtgaataccgattaaaaggtgagtctaggaagacgtttgttgagcttatgcgaagaggcgacctgcctgtttggttggcacataaggtagcgtccgaaggcataaagtacaccgacagaaaatggtgttttgatggagaacgaaataaccaaatattagaagaaaatatggatgtagagatctggactaaagaaggtgaacgaaagaaactccggccaaggtggcttgacgcaagaacctattctgatccattggcattaaaagaatttaaagatttcgccgctggaagaaaaagtatcgctttagacctggttactgaaatcgggcgggttcccagtcatctagcacacaggacaagaaatgccttggataacttagtaatgttacatacgtccgagcacgggggtagagcgtatcgtcatgctgtggaagagttaccagaaacgatggaaacactactacttcttggcctgatgatcctgttgacgggcggagctatgttatttttaattagcggaaaaggaataggaaaaactagcatcggactgatatgcgtaattgtgagctcagggatgttatggatggcagacgtaccactgcaatggatagcttcagccatagtacttgaatttttcatgatggttttgctaataccggaaccagaaaagcaaaggacacctcaagataaccaattggcttacgttgtaattgggatactaacgcttgcggccatagtcgcagcaaatgaaatgggactactagaaacaaccaagagagaccttggaatgagtaaagaaccaggtgtggtaagtccgacaagttatttagatgtggacctacacccagcttcagcttggacactgtatgcagtcgcaacgacggtaattacaccgatgcttagacatacgattgaaaactccaccgcaaatgtctcattggccgctatagctaatcaagccgtggtactaatgggattagacaaaggctggccaatatcgaaaatggatctgggcgtgccactattagccctgggttgttatagccaagtaaatcctctaacattaacagcagcagtcctgctattagtaacacattatgcaataatcggaccgggcttacaagccaaagctacacgggaggcccaaaagcggacggcagcaggtataatgaaaaatcccactgtcgatggtataatgacgattgatctagatcccgttatatatgactctaaatttgagaaacagctcggacaagttatgcttttagtgctatgtgcggtgcaattacttttaatgagaaccagttgggcattgtgtgaagccctgacacttgcaacgggacctataacgacactatgggaggggtccccgggaaagttttggaacaccaccatagcagtaagtatggcaaatatctttagaggaagttatttagccggtgcaggtctagcattcagtattatgaaatcagtgggaacaggcaggagaggaactggttcacaaggggaaacactaggtgaaaagtggaaaaagaagttaaatcaactatcaagaaaagaatttgacctttacaagaaatctggtataacagaggtggaccggacggaagccaaagaaggattaaaaaggggagagaccactcatcatgctgtttctcgaggatccgcaaaacttcaatggttcgttgaaagaaatatggttataccagagggtagggtaattgatctaggttgtgggcggggaggatggagttactattgtgctggcctgaagaaagtaacagaggttcggggttacacgaaaggaggaccaggacatgaagaaccggtacctatgtcgacttacgggtggaatatagtaaaactcatgtctggtaaagacgtattttacttgcctccggaaaaatgtgatactctcctatgtgatataggagaatcttctccaagtcccacagtagaagaatctagaactataagggtactaaaaatggttgagccttggctacgaaacaaccaattctgcataaaggttttgaacccttatatgccaactgttattgagcaccttgaacgactacaacgcaaatacggaggaatgctagtaagaaacccactctcaagaaactccacccacgaaatgtattggatatcaaatggcacaggaaacattgtaagcagtgtcaacatggtatcaagactacttctgaatagattcacaatgacgcatagaaggccaaccatcgagaaagatgttgatttaggggcaggcacgcgccatgtgaatgccgagccagaaacccccaatatggacgtcatcggcgaacgaattaagaggattaaagaggagcattcatcaacatggcattatgatgacgaaaatccatacaaaacatgggcatatcacggaagctacgaagtaaaagcgacaggatctgctagctccatgattaatggagtggtcaagttgcttacaaagccatgggatgtcgttccaatggtaactcaaatggcaatgactgacactacaccttttggacaacaaagagtttttaaagagaaagtggatactagaactccaaggccaatgccgggaacacgcaaggtcatggaaataaccgctgagtggctatggcggactctaggacgtaacaagaaaccacgcctgtgtacccgagaagagtttacaaagaaagttagaactaacgctgccatgggggcagtctttacagaagaaaatcagtgggattcagctagggcagcagttgaggacgaggagttctggaagctagttgatcgggagagagaactacataaattaggtaaatgcggcagttgtgtatataatatgatgggtaaaagagagaagaaactgggtgagtttggaaaagcaaaaggttcgagagctatttggtacatgtggttaggggctagatacctagaatttgaagcacttggatttttgaatgaagaccattggtttagcagggaaaactcttactccggagtagaaggagaaggcctacataaattgggctacatcttacgagacataagtaaaataccaggaggcgctatgtatgccgatgacaccgcggggtgggacacaaggattaccgaagatgacctacataatgaagaaaagataactcaacagatggaccctgaacatcggcaattggctaacgctatattcaaactaacataccaaaacaaagttgtaaaagtgcaaagaccgactcccaagggaacggtaatggacataatatctagaaaggatcaaagggggtctggtcaagttgggacctacggtcttaacacatttacgaatatggaagcacagctagtacgtcaaatggaaggggaaggggtactcagtaaggctgatttagagaacccacacctattggaaaagaaaataacacagtggctagaaacaaagggtgtcgaaagacttaaacgcatggcgataagcggagatgactgcgtagtaaaaccaattgacgatcgtttcgcaaatgcattgctggcgctaaacgacatgggaaaagtgcgaaaagatataccgcaatggcaacctagtaaggggtggcatgattggcaacaagtaccattctgttcacatcactttcatgagctcataatgaaagatggtaggaaacttgtagtaccgtgtaggccgcaagacgaactaataggaagggcgagaatatctcaaggtgccggttggtcactaaaagaaacagcctgcctgggaaaagcatatgcccaaatgtggtcacttatgtattttcaccgcagggaccttcgcctcgcttcaaatgcaatatgttcagcggtacctgtgcattggatacccacttctagaacaacgtggtctatacatgctcatcatcaatggatgaccaccgaggacatgctaaccgtatggaatcgagtatggatagaggataatccatggatggaagataaaaccccagtgactacatgggaagatgtcccatatcttggaaaaagagaagaccagtggtgtggatcattaatagggttaacaagtagagcaacatgggcgcagaatatattaacggccatccaacaggtgagatcattaatcggagacgaagagttcttagattatatgccaagtatgaaaagatttcgcaaagaagaagagtcagaaggagctatctggtaa

SEQ ID NO: 23144 - RNA, 9873 nt, synthetic construct
  misc_feature 1..9873: note = derived and/or modified CDS sequence (opt6) from DENV-3__FJ639729__SS-prME
  source 1..9873: mol_type = other RNA
acaagtttatgtttaatgatgatgctgccagcgaccttagcattccatctaacgagtagagatggtgaacctcgtatgatagttggtaaaaatgaaagaggcaagagcttgttatttaaaactgcaagtgggatcaatatgtgtacactaatagcgatggatttgggagaaatgtgtgatgatacagttacctataaatgtccattaattgcggaagttgaacctgaagacattgattgttggtgtaatttaaccagtacatgggtcacatacggaacctgtaaccaagctggcgaacataggagagataagagaagtgtagcattagcacctcatgtaggaatggggcttgatacgagaacacaaacttggatgtcagcagagggtgcatggagacaagttgaaaaagtggaaacgtgggcgttaagacatccaggttttacaattttggcattattcttggcacattatattggaacctcactcactcaaaaagtcgtcatatttattttgcttatgcttgtgacaccaagtatgacgatgaggtgtgtaggcgtcggaaacagagattttgttgaggggctatcaggcgccacatgggtcgatgttgttctggagcatgggggttgcgtaactacgatggcaaaaagcaaaccaacattagacatagaattgcagaaaacagaggcgactcaattagcgacccttcgtaaattatgcatagaaggaaaaataacaaatataacaacagatagtagatgtccaactcaaggggaagcaacactaccagaagaacaagaccaaaattatgtgtgtaaacatacatacgtagaccgaggatggggcaatgggtgcgggttatttggaaaaggttcccttgtaacatgcgctaaatttcaatgcttagagccaatagaagggaaagtcgtccaatatgaaaacctaaaatatacggttatcataacggttcatactggagaccaacaccaagtgggtaatgatactcaaggcgtaacagtagaaatcacgccacaagcctcaaccgttgaagcagtattgcctgagtatgggactcttggactagaatgttcaccccgaacaggattagactttaacgagatgatcttattaaccatgaaaaacaaggcttggatggtacacagacaatggttctttgatctacccctaccctggacttcaggggcaataaccgaaactccgacatggaataggaaagaattattagtaacatttaaaaacgcacacgccaagaaacaagaagtagttgtattaggcagccaagaaggtgcaatgcatacagcgttgactggggcaactgaaattcaaaactcgggcggaacctcaatctttgcaggtcatctaaaatgtagactaaaaatggataaacttgaacttaaaggcatgagttatgcgatgtgcctgaatacctttgtgttgaagaaagaagttagcgaaactcaacacggaacaatattaatcaaagtggagtataaaggtgaggacgctccttgcaaaatcccatttagtaccgaggatggacaaggaaaagctcacaatggtcgattaattactgctaatcctgtagttactaagaaagaggaaccagtcaatattgaagcagagccgccattcggagaatcaaatatagtaatcggaattggagacaaggctttaaaaataaactggtacaagaaagggagtagcattggaaaaatgtttgaagcaacagcgcggggtgcgaggagaatggctattttaggagataccgcctgggatttcggatctgtaggcggagttctaaattcacttgggaaaatggtacaccaaatctttggcagcgcatacacagcactgttttctggagtttcatggatcatgaaaataggcattggtgtcttacttacttggattggactgaatagcaaaaacacttcaatgtcattttcatgcatagttataggaatcataacattatatctaggagcggtagttcaggcggacatgggctgcgtaataaattggaaaggaaaagaactaaaatgtggctcggggatatttgtaaccaatgaagtacacacttggacagagcagtataaatttcaagcggattcgcctaaacgactcgcaacggcaatagccggggcatgggaaaatggagtatgcggaatccgctcaacaacacgaatggaaaatcttctttggaaacagatcgcaaacgaactcaactacattctatgggagaataatatcaaattaacagtcgttgttggagatataataggcgtactcgaacaagggaaaaggacattaacccctcagcctatggagctaaaatatagttggaaaacgtggggcaaagcaaaaatagtcactgctgagactcagaacagtagttttataatcgacgggcctaatacacctgagtgtccatcagctagccgcgcctggaacgtatgggaagtcgaagactatggattcggcgtattcacaactaacatatggcttaaacttagagaagtgtatacgcaatcatgcgaccatcgactcatgagtgcagctataaaagatgaacgagcagtgcatgcggatatgggatattggattgagtcccagaaaaatggatcgtggaagttagagaaggcttcgtttattgaggtaaaaacttgcacctggcccaaaagtcacacattatggagtaatggagtattagaaagtgacatgattatccctaaaagtctggcaggtcctataagtcaacacaatcaccggcccggatatcatacccaaacagcaggcccatggcaccttggaaagctagaattagattttaactattgtgaaggaaccacggttgttatcacagaaaattgtggaacacggggaccttctctcagaacaactacagtctccggcaagctcattcacgaatggtgttgccgcagttgcactcttccacctctgcggtatatgggcgaggatggatgctggtatggaatggaaataagaccaatcaatgagaaggaagaaaacatggtaaaatcacttgtctccgcaggatcagggaaagttgacaacttcaccatgggtgtcctatgcttagcaatactctttgaggaagtgatgagaggcaaattcggcaaaaagcacatgatagctggggtgttatttacatttgttctactactatcaggtcaaataacctggagggacatggctcataccctaattatgattggatccaatgcctcagaccgcatgggtatgggagtgacctacctagctttaattgcaacatttaaaatacaaccgtttctagcactggggtttttccttagaaaattaacatcgagagaaaacttgttattgggagtcggcttagctatggctacaaccctgcaacttcctgaagatatagaacaaatggcaaacgggatagcactcggcttaatgaccttaaaattaattactcaatttgaaacgtatcaattgtggacagcactcgtatctttgacgtgcagcaacactatattcacactgaccgtggcatggaggacagcgacattaattctagcaggcgtatccctattgccgttatgccaaagctcctcgatgaggaaaactgattggctaccaatgacagtagcagccatgggtgtcccacctctgcccctattcatctttagccttaaagacacaccgaagcgacggagttggccattgaatgagggggtgatggcagtaggacttgtaagtatactggcgagtagccttcttagaaacgatgtaccaatggcagggcccctagtagccggtgggttgctaatagcttgctatgtgattacaggcacaagtgccgacctcacagtcgaaaaggctgcggatgtaacctgggaagaggaagccgaacaaacaggtgtctcacacaacttaatgatcacagtggacgacgatggaactatgaggataaaggacgatgagaccgaaaatatcttgacagtgttattaaaaacggcactccttatcgttagcggtatatttccctacagtataccggcgacgcttttggtatggcatacctggcaaaaacaaacgcaaagatcaggggttctttgggacgtaccatcacctcctgaaacccagaaagcagaacttgaagaaggagtgtatcggattaaacaacaaggtatatttggcaaaacccaagtaggagtaggagttcaaaaagaaggtgtatttcatacaatgtggcatgtcactaggggagcggtattgacacacaacggaaagcgcctagaaccgaattgggcatcagttaaaaaggacctaatttcctatggcggagggtggagactttctgcgcaatggcaaaaaggagaggaagtccaagtcattgcagtagagccaggcaaaaaccccaaaaattttcagacaatgccaggcatattccaaactacgacaggtgaaataggagcgattgctctggacttcaagccaggaacttcaggaagtcctataatcaatagagaagggaaagtcgtaggactttatggcaatggagttgtgaccaaaaatggaggttatgtctcaggaattgcacaaacgaatgctgaaccagacggaccgacaccagaacttgaagaagaaatgtttaagaaaagaaatctaacaatcatggatctacatccaggaagcggcaagactcgaaagtatctacctgcaatagttcgagaagcaatcaaacgacgcttgagaacgttaatcttagcacccacgagggtggtagcggccgaaatggaagaggctttaaaggggttgcctataagatatcaaactacagcaaccaagagtgaacatacaggtagagagattgtagatttaatgtgtcacgccacctttacaatgagacttctaagccccgtaagagttccgaattacaacctcgtaattatggacgaagcccactttacagaccccgcttcaatagcagcccgaggatatatcagtaccagagtgggtatgggtgaagcagcagcaatattcatgaccgcaactcctccaggaacagcagaggccttccctcaatcaaacgcaccaatacaagatgaagaacgagatattcctgaaagaagctggaactccgggaatgaatggattacggattttgtcggaaaaactgtgtggtttgtcccttcgattaaagccggcaatgatatagcgaattgcttgaggaaaaatggtaagaaagtaattcaattgagtaggaaaacattcgatacagaatatcagaaaacaagattgaatgattgggactttgtagtcactacggatatatccgaaatgggagcaaactttaaggcagacagagttatagacccccgaagatgcctaaaacctgtgatattgacagacggtcctgaaagggtcatattagctggcccgatgccagtaacggctgcctctgctgcgcaaagacgcgggcgggtgggccgtaaccctcaaaaagaaaacgaccaatatatatttaccggacaacctttaaataatgacgaggatcatgctcattggaccgaagccaaaatgttgttagataatattaacacaccagaaggtattatccctgcgctatttgaaccggagagagaaaagtcagccgcaatagacggagaataccggttaaaaggcgaatcaagaaagacttttgtagagctaatgagacgtggagacttacccgtctggttagcacataaagtcgcttcagagggtataaagtatacagatagaaaatggtgtttcgacggagaaaggaacaaccaaattcttgaagagaatatggatgtagaaatctggacaaaagaaggagagaggaaaaagctacgacctagatggttagacgcgcgtacatactccgacccattagcattaaaggagttcaaagattttgcagctggtcgtaaatctatagccttggacttggtcaccgaaattggaagagtaccgtctcacttggctcacaggaccagaaacgctctagataatttagtaatgcttcacacttcagaacatggtggcagagcataccggcatgcagtggaagaactacctgagacgatggagacccttcttctattggggttaatgatacttcttacagggggagcaatgctattcctaatatctggtaaaggaatcgggaaaacaagcatcggcttaatatgcgtaatagtctcatccggtatgctatggatggcggatgttcctttacaatggatagcatctgctattgtattggagttctttatgatggttctactaataccggaaccagaaaaacaaagaactccgcaagacaatcaacttgcatatgtagttataggaatattaacgctggcggctattgtggcagctaacgagatgggactactagaaacaacaaaaagagacttaggcatgagcaaagagcctggtgtagtttccccaacaagttatctagacgttgatttacacccggcatccgcatggaccttatacgcagttgcaaccacagtcatcacacccatgctaagacacacgatagaaaatagcactgcaaatgtatctttagctgcaatcgcaaaccaagcagtagttttaatgggtctagataaaggctggcccatcagcaaaatggatttaggcgtgcccttgttggctttaggctgctattcacaagtaaatcctttaactttaacggcggcagttttactgttggtcacacattatgcaattatagggccaggccttcaagcaaaagcaacccgcgaagctcaaaaacgaaccgcagcaggcataatgaaaaacccaacggtggatggaataatgacaatagatttagacccagtcatttatgattctaaattcgaaaaacaactcggtcaggtgatgcttctggtattatgtgctgtccaactactcttaatgagaacaagttgggcgctttgtgaagcgttgaccctcgcgacaggaccgatcacaaccttatgggaaggtagccctggaaaattctggaacacaacaatagctgttagtatggctaacatctttagaggtagttatcttgcaggggcgggtttggcgttcagcataatgaagagtgtggggactggaagacgtggtaccggatcacaaggagaaacattgggtgagaaatggaagaagaaattaaaccaactatcaaggaaagagttcgatttgtacaagaaatcaggcatcacggaagttgatcgtactgaagccaaggagggacttaaacgtggagaaacaacacatcatgccgtttcacgagggagtgccaaacttcaatggttcgtggaaagaaatatggtcatacctgaaggtcgggtcattgatctcgggtgtggtcgtggtggctggagctattactgcgcaggcttaaagaaagttacagaggttcgggggtatacaaaagggggaccaggacatgaggagcccgtacctatgtctacatatgggtggaacatcgtgaagctgatgtccggaaaagatgtcttctatttgccaccagaaaaatgtgacacattactttgcgacataggagaatccagccctagtcctactgtcgaagagagccggactatacgcgtactaaaaatggttgaaccctggctcagaaacaaccaattttgtattaaagtactaaacccgtacatgcccacagttatcgagcatctggagagattgcaaagaaagtatggagggatgctagtccggaatccactctcacgtaactctacacatgaaatgtactggatatcaaacggtactggtaatatcgtctcttcagttaatatggtatcccgcttgctgcttaatagatttactatgacacatagacgtccaactattgaaaaagatgtagatctaggagcgggaactagacatgtcaacgcagagccagaaacgcctaacatggacgttatcggagaacggataaaacgtattaaagaagaacattcatctacatggcattatgacgatgaaaacccatataaaacatgggcatatcatggtagctatgaagtgaaagcaacaggttcagccagttctatgataaacggagtagttaaattattaacaaaaccgtgggatgttgttccgatggtcacacaaatggctatgacagacacgaccccattcgggcaacaacgtgtgttcaaggaaaaagtagacacacgaaccccaagacccatgccaggtacacgtaaagtaatggagattacagccgagtggttatggagaaccttggggcgcaataagaaaccccgtctgtgcacgagggaagaatttacgaagaaagtacgaactaatgcagcaatgggtgccgtttttaccgaagaaaatcaatgggactcggcgagagcagcagtcgaggacgaagagttctggaagctagtagacagggaacgggaactacataagttaggaaaatgcggaagctgcgtatataatatgatgggtaagagagagaagaaattaggagagtttggaaaagcaaagggatctagagcgatttggtatatgtggctaggcgcgcgctacctagagtttgaagctctaggctttcttaacgaagatcattggttttcaagagaaaattcttactctggcgtagagggcgaaggattgcacaagttgggatacatattgcgagacatttccaagatccccggaggagctatgtatgcagacgacaccgcaggctgggataccaggataacagaagatgatctacacaatgaggaaaagataactcaacaaatggatcccgaacatcgacaattagcaaatgcgatttttaaattgacataccagaataaagtcgtcaaagtacaacggccaactcctaaggggacggtaatggacatcataagtcgcaaggatcagagagggtcaggacaagtaggaacttacgggttaaacacatttacgaacatggaagctcaattggtaagacagatggaaggtgaaggagtactatctaaggcagacttggaaaacccgcatctactggagaagaaaataacgcagtggctagaaaccaaaggggtcgaacgtctcaaacgaatggcaataagcggcgatgactgtgttgtaaaacctatagatgatcgctttgcaaatgcattgctggcgttaaatgacatgggaaaagtaagaaaagatatccctcaatggcagccctcgaagggctggcacgattggcaacaggttccattctgtagtcatcacttccatgagttaattatgaaagatggaagaaagttagttgttccttgcagaccgcaagacgaattaatcggaagggcacgaatttcacagggtgcaggttggagtttaaaagagacggcttgcttaggaaaggcttatgcccaaatgtggaacttaatgtactttcaccgacgggatctcaggttggcctccaatgcaatttgctcagctgtgccagtacactggattcccacgtcacgtacaacctggagtatacatgcgcaccaccaatggatgacgacagaagatatgttaaccgtatggaatagagtttggatagaagacaatccttggatggaagacaagacaccagttacaacttgggaagacgtaccgtatctaggaaaacgggaggatcaatggtgcgggagcttaataggtctaacatcacgagcaacctgggcccaaaacatactaacagcaattcaacaggtaaggtcattaataggcgatgaagaatttcttgattacatgccatcgatgaaacgctttagaaaagaagaggagtctgaaggagcaatatggtag

SEQ ID NO: 23145 - RNA, 9873 nt, synthetic construct
  misc_feature 1..9873: note = derived and/or modified CDS sequence (opt6) from DENV-3__FJ639730__SS-prME
  source 1..9873: mol_type = other RNA
acatctctttgcttgatgatgatgttgcccgcaaccttagccttccatctgacaagtagagatggtgaaccacgaatgatagtaggtaaaaatgaacgaggaaaaagcctattatttaaaactgcaagtggtatcaatatgtgcacgctaatcgccatggacctaggagaaatgtgcgacgataccgtaacttataaatgcccacttatcgcggaagttgaaccggaagatatagactgctggtgtaatctaaccagcacatgggtaacatatggaacatgtaatcaagctggagaacacagaagagataaacgcagtgtcgcattagcaccccacgtaggcatgggactggatactcgaacacaaacctggatgtctgcagagggtgcttggaggcaagttgagaaagtggagacctgggcacttaggcatccgggcttcacaattttagcactattccttgcacattatatcggcacttccttaacacaaaaagtagtcatattcatactactaatgttagtaacacctagtatgacaatgcgatgcgtaggcgtaggtaacagagactttgttgaaggattgtccggcgcaacatgggtagatgtagtcctagaacatggaggttgtgtaacaaccatggcaaaatcaaaaccaactttagacattgaactacagaaaacagaagccacacaattggctacgctgcgtaaactatgtatagagggtaaaattaccaatataaccaccgattccagatgtccaacacaaggagaggctactctacctgaggaacaagaccagaattatgtgtgtaaacacacatatgtagatcggggttggggtaatggttgcggactgtttgggaaaggatcgctagttacatgtgcaaaattccaatgtttagaaccgattgagggaaaagtggtccagtatgaaaatttgaaatatactgtgataataacagtacatacaggggaccagcatcaagtgggaaacgacacacagggcgttacggtagaaattactccacaggcatcaacagtcgaggctgtattgccagaatacgggacattgggtctagagtgcagcccacgtacaggactagattttaatgaaatgatactcttaacgatgaaaaacaaggcttggatggtgcatagacaatggtttttcgacctgcctttaccctggacaagtggtgctactacagaaacgccaacatggaatagaaaagaattgcttgtaacatttaaaaatgcccacgcaaagaaacaggaagttgtggtactaggaagccaggaaggagcgatgcataccgcgttaacgggagcaactgagatacaaaactcgggcggtacaagcatatttgcaggacatcttaaatgccgtctaaaaatggataaattagaacttaaaggaatgagttacgcaatgtgtttaaatacgttcgtcctcaagaaagaggtttctgaaacacaacacggaacaatattgataaaagttgaatacaaaggtgaagatgctccatgtaaaatcccatttagtacagaggatgggcaaggcaaagcccataacggccgattgataacagcaaaccctgtagtaaccaagaaagaagaacccgtaaacatagaagctgaaccacctttcggtgaatcgaacatagtgataggaataggtgacaaagcactaaaaataaattggtataagaaaggatccagcataggaaaaatgtttgaagctacagccagaggtgccaggcgaatggctattcttggagacacagcgtgggatttcgggtctgtcggaggcgttctaaatagtttaggaaaaatggtccatcaaatttttggatcagcatacaccgctttatttagcggtgtttcgtggataatgaaaatcggcataggagtactattgacatggataggtctcaattccaaaaatacatctatgtcgttctcttgcatagtgatcggtataataacattgtatttaggagccgttgtgcaagctgatatggggtgcgcaatcaattggaaaggaaaagaactcaaatgcggtagcggcatttttgtaaccaatgaggtacacacgtggactgaacaatataaatttcaggcagactcacctaaaagattggcgacggcaatcgccggagcgtgggaaaacggagtatgcgggatacgaagcacaacccgaatggagaacctactatggaaacaaatcgccaatgaactaaattatattttgtgggaaaataacataaaattgacagttgtggtgggagacatcatcggagtactcgaacaaggaaaaaggacattgacaccacagccaatggagttgaaatacagttggaaaacctggggtaaagcaaaaatagtaacagcagagacacaaaactcctcatttattatcgatggtcccaatactccagaatgtccgagcgcaagccgagcatggaacgtatgggaagtggaagattatggatttggagtgtttactactaatatttggctaaaattaagggaagtctatacgcagtcatgcgatcatcgcttaatgagcgctgcaattaaagatgagaaagcagtacacgcggatatgggttactggatagaatctcagaaaaatgggtcatggaaattagagaaagcgtcttttattgaagtaaaaacatgcacctggcccaaatcgcataccttatggtctaatggggtacttgaatccgatatgatcattcctaaaagtctagcaggcccaatatcacaacacaaccaccgtcccggataccatacacaaaccgctggaccctggcacctaggcaaactggagcttgattttaattactgcgaagggacaacagtagttataacagaaaattgtggcacaaggggaccatccctaagaacaacaacagtttcagggaaattgatacacgaatggtgctgtcgttcatgtactctacctccgctgagatatatgggagaagatggatgctggtatgggatggaaattaggcctataaatgaaaaagaagaaaatatggtaaagagtttagtttcagccggatcagggaaagtagacaattttaccatgggagtcctgtgtttagcaattctcttcgaagaggtcatgagaggtaagttcggcaagaaacatatgatagcaggcgtcttattcacgtttgtactcttgttgtccggtcaaataacctggcgagacatggctcatacactaattatgataggaagcaacgcctcagatagaatggggatgggtgtaacttatcttgctctaatcgctacatttaaaatacaaccatttttggctcttggtttctttctgcgcaaactaacctcgcgtgaaaatctgctattgggtgtcgggctagcaatggcgacaacattacaactacctgaggacatagaacaaatggcaaacggaatagcattaggtctaatgacacttaaactaattacacaatttgagacctaccaactatggacggcgctggtatctttgacttgcagtaatactatatttacattaacggttgcttggagaacagcaacacttatcctagccggtgtaagtctattaccgctctgtcaatccagttcgatgagaaagaccgactggttaccaatgacagtggcagctatgggagtaccacctttacctctatttatattctcattgaaagatacgccaaaacggcggtcttggcctttgaatgaaggggtcatggcagtaggcctggtttcgattctcgcaagtagcctactacggaatgatgtacctatggctggaccgttagttgcaggaggcctattgatagcatgttacgtaatcacaggaacaagtgccgatctgacagtagagaaagccgctgatgttacctgggaagaagaagccgagcaaacgggagtaagccataatcttatgattactgtcgatgacgacggaactatgagaattaaagacgatgaaactgaaaatatattaactgtattactaaaaaccgcgctattgatagtgagtggaatatttccttatagcataccagctacattattagtctggcatacctggcaaaaacagacgcaaagaagcggtgtattatgggacgttccatcacccccagaaacacaaaaagcagaactcgaagagggagtttatcgaataaaacagcaaggaatattcggaaagacccaagtgggggtgggagtgcaaaaagaaggtgtgtttcatacgatgtggcacgttacaagaggcgcggttctaacacataacggtaaaagacttgaaccgaattgggccagtgtgaagaaagacttaataagttacggtggtggatggagactaaatgctcagtggcaaaagggtgaagaagtccaggtcatagccgtggaaccgggtaaaaatccgaaaaatttccaaactatgccaggtattttccaaactacaacaggagaaattggggcaattgccctggattttaaacccggtacctcagggagtccgattataaataaagaaggtaaagtagtcggtctttatggaaatggtgttgttacgaagaacggtgggtacgtaagtggaatagctcagacaaatgcggaacctgacggaccaacccctgagttagaagaagaaatgttcaagaaaagaaaccttactatcatggatcttcacccgggatcaggcaaaactagaaagtatctgcccgcgatcgtgcgagaagccattaaaagaagattaagaactctaatactagcacctaccagggttgtggcagcggaaatggaggaggcattaaaaggattaccaatacgctaccaaactacggctacaaaaagtgaacatacgggacgtgaaatagtagacttgatgtgccatgcgacctttactatgcgactgctgtctccagtacgtgtacctaattataatctggtaatcatggatgaggcacattttacagacccagcatcaatagcagcaaggggttacatcagtacgcgggttggtatgggggaagccgctgctattttcatgactgctacaccgccgggaactgcagaggcttttcctcagagcaatgcacccatacaggatgaagaacgtgacatacctgaacgtagttggaactctggaaacgaatggataacggatttcgttgggaagacggtgtggtttgtaccgtctattaaggccggaaacgatatcgctaattgtttgaggaaaaatggcaagaaagtaatccaactgagtagaaaaacattcgatacggagtatcaaaagacaagattgaatgactgggactttgtcgtaaccacagacataagtgaaatgggggcaaactttaaagctgatagagtcatagaccctcgacggtgcttaaaacccgttattctcacagatggtcccgaacgcgtcatattagccggccctatgccagtaacagctgctagtgctgcacaacgacgcggacgggtgggaagaaatccgcaaaaagagaacgatcagtacatatttacaggtcaaccgctcaataatgacgaagaccacgctcattggacagaggctaaaatgcttttagacaatattaacacaccggagggcataatacccgcccttttcgagcctgaaagagagaaatccgccgctatagatggggaatacagattaaagggagaatcgcgaaaaacatttgtggaacttatgagaagaggggatttgccagtatggctagcacataaggtagcatctgaagggataaaatacacagaccgcaaatggtgctttgacggggaacgaaacaatcagattctcgaagaaaatatggatgtggagatttggacaaaggagggggaacggaagaaattgaggcctaggtggctagatgcaagaacttattccgaccctctcgcattaaaggaatttaaagattttgctgccggacggaagtctatcgctttagatttagttacggaaattggacgagtgccctcgcacttagcacatagaaccagaaacgccctagataatctagtgatgttacacacctctgaacatggaggcagagcttataggcatgcggtcgaagaactcccagagacaatggaaacccttctcctgctaggcctaatgattctactgacgggaggtgcaatgttgtttttaatctcagggaagggtataggtaagactagcataggactcatttgcgtcatagtgtctagcggaatgttatggatggctgatgtgcctttgcaatggatagccagcgctattgtccttgagttctttatgatggttctattaatacctgaaccggaaaaacaacgtacaccgcaggataatcaacttgcgtatgttgttatagggattttaacactagctgccatagtagcagcaaatgaaatgggtcttttggagacgacaaagagggatcttggaatgagtaaagagcctggtgtcgttagtccaacttcatatcttgatgttgatctccaccctgcaagtgcttggactttatatgcagttgcaaccacagtgataacgcccatgctacgccacactatagaaaattcgaccgcaaatgtgtccctcgccgctattgctaatcaggcagtagttctgatgggccttgacaaaggctggccaattagcaaaatggatttaggagtacccttacttgcattgggatgctatagtcaggtaaatccactaacacttaccgcggcggtacttctgctggtgacacactatgcaatcatcggaccaggcttacaagccaaagcaacaagggaagcacaaaagcgaactgcagctggtatcatgaaaaaccctactgtggatggaatcatgaccatagacctagatccagttatttacgattcaaagttcgaaaagcaattgggacaagtaatgctcctagtattgtgtgcagttcaactacttttgatgaggacaagttgggcgttatgcgaagcactaacgctagcaactggccctataaccacgttgtgggaagggtcgccgggaaaattttggaatacaacaatcgcagtgtctatggctaacattttcagaggctcttatttagcaggggcgggtctggcttttagcataatgaaatcagtgggaaccggtagacgaggtacagggtcacaaggagaaacccttggtgagaagtggaagaagaaactaaatcaactatctcggaaagaatttgaactatataagaaatctggcataacagaagtagatcgaactgaagcaaaagaaggtctcaaaagaggcgaaacaactcatcatgctgtgtctaggggtagtgcaaagttacaatggttcgttgaaagaaatatggttataccggaaggaagagtaattgatttgggttgtggcagaggcggttggagttactattgcgccggacttaagaaagtaacggaagtaaggggatataccaagggaggcccgggccatgaagaaccggtgccgatgagtacatacggttggaatattgtaaagctaatgagcggaaaagacgtattctatctcccaccagagaaatgtgacacattattatgtgacataggcgagagttctccaagtccaactgtagaagagagcaggactatacgggtactcaaaatggttgaaccctggttaagaaacaatcagttttgcattaaggtgttaaacccatatatgccgaccgttatagaacatttggaaaaattacaaagaaagtatggtggaatgttagtaaggaaccctttatctcgcaatagtacacatgagatgtattggatttcaaatggaacaggcaatatagtaagttctgtaaatatggtcagtagattgctattaaatagatttacaatgacccatagacgacctacaattgaaaaagatgtggatttgggagccggtacaagacacgtcaacgcagaaccggaaacaccaaatatggacgtaatcggagaaaggattaaaagaataaaagaggagcactcatcaacatggcattacgatgatgagaatccatataagacatgggcatatcatggaagttacgaggttaaagcaactggctctgcatcttccatgataaatggagtcgttaaattacttacgaagccttgggacgtagtcccaatggtcacacaaatggcaatgactgataccaccccgttcgggcagcagcgtgtctttaaagagaaggtagacacccggactcccagacccatgccaggtacgcgaaaggtaatggaaattacggcagagtggctttggagaactctcggtaggaacaagaagcctcgattatgtacacgtgaagagtttactaagaaagttagaaccaacgcagcaatgggagccgtattcacagaagaaaaccaatgggattcggcccgagcagcagttgaagatgaagagttttggaagctagttgaccgggagcgagagctccataaattaggcaaatgtggaagttgcgtgtataatatgatgggaaaaagagaaaagaaacttggtgagttcggcaaagcaaaaggtagcagggccatttggtacatgtggctgggagcccgttacttagaatttgaggccttaggatttttaaacgaagaccattggttttctagggaaaactcctatagtggcgtagagggagaaggactacacaaactaggttacatacttcgagatataagcaaaattcctggcggagcaatgtacgcagatgatacggctggatgggatacacgaattactgaagatgatttgcacaacgaagagaaaataacacagcaaatggatcctgaacaccgacagctcgctaatgctatctttaaactaacttatcaaaataaggttgtaaaagtgcagagaccgacaccaaaaggcacggtaatggatattatatcgagaaaagaccaacggggaagtgggcaagtgggaacctatggactaaatacgtttaccaacatggaagcgcagctagtccggcaaatggaaggcgaaggagtgctatcaaaggctgacttagaaaacccgcatcttctcgagaagaaaattacacagtggttagagaccaagggagttgaacgacttaaaagaatggccatcagcggagatgattgtgtcgtgaaaccgatagatgatcgattcgctaacgcacttttagcactaaatgacatggggaaagtacgaaaagatatacctcaatggcaaccatcaaaaggatggcatgactggcaacaggtacccttttgtagccatcattttcacgaactaattatgaaagatgggaggaaattggtcgtgccgtgcagaccacaagatgaactaatagggcgcgccaggataagccaaggagccggctggagtctcaaggaaacggcttgtctcggtaaggcttacgcgcaaatgtggagcttaatgtactttcacaggagagatcttagactggcaagcaacgcaatatgttctgcagtcccagtacattggatacccacaagccgaacaacttggtcaatacacgcacatcatcaatggatgacaacagaagacatgcttactgtctggaatcgtgtatggattgaggataacccatggatggaggataagacacctgtaacgacttgggaagatgttccatatcttgggaagcgggaagaccaatggtgtgggtccctaataggcctcacatcgagagcaacgtgggcccagaatattttaaccgcaattcaacaagttaggagcttgataggtgacgaagaatttttggattatatgccctcaatgaaacggtttaggaaagaagaagaaagcgaaggggccatatggtaa

SEQ ID NO: 23146 - RNA, 9873 nt, synthetic construct
  misc_feature 1..9873: note = derived and/or modified CDS sequence (opt6) from DENV-3__KF955464__SS-prME
  source 1..9873: mol_type = other RNA
actagcctctgtttaatgatgatgctgccagcaaccctggcttttcatttaacatcccgagatggtgaacctcggatgattgttggcaaaaatgaacgggggaaatctttactctttaaaacggcatccgggattaacatgtgtacactcatagcgatggatctcggtgagatgtgtgacgacacagttacgtataaatgccctttgatagcagaagtagaacctgaagacatagattgttggtgtaacctaacttcaacatgggtcacatatggcacatgcaatcaagctggagaacatagacgtgacaaacggagtgtagccctagcaccccatgttggaatgggattggacacgcgtacccaaacttggatgtctgctgaaggtgcctggcggcaagttgaaaaagtagaaacctgggctttgcgtcatccaggatttaccatacttgcattatttctagctcattatattggaacaagtctcactcaaaaagtagtaatatttattctattgatgctagtgacaccgagcatgaccatgcgttgcgtcggagttggaaatcgggactttgtcgaaggactttcaggagcaacgtgggttgatgttgttttagaacacggaggctgcgtaacaacgatggctaaatcgaaaccgactctcgatatagagctgcagaaaacagaggccacgcaactagctatcctacgaaaattatgtatagaaggaaaaataacaaacataaccacagactctcgatgcccgacccaaggcgaggctacgctcccagaggaacaagatcagaactatgtgtgcaaacatacatatgtcgacagaggatggggcaatggctgtggtctttttgggaaaggatctctagttacctgtgcaaaatttcaatgtctagaacctattgaagggaaagttgtccagtacgagaatttaaaatatacagtgataataacggttcacactggagatcaacatcaagtagggaatgacacgcagggagtgactgtagaaatcacaccccaagctagcacagtggaagctgtcctcccagaatatggaactctgggtttagaatgtagcccaagaacgggtcttgacttcaatgaaatgattcttttaacaatgaaaaataaagcatggatggttcacagacagtggttcttcgatttgccactaccatggacttctggggcaactacagaaactccgacatggaatcgcaaagaacttctagttacttttaaaaatgctcatgccaagaaacaagaagtagtagttctggggtcacaagagggcgctatgcacacagctctaacaggcgcgactgaaattcaaaattcgggaggaaccaatatcttcgccggacacttaaaatgccgtcttaaaatggacaaactagagttaaaagggatgagttacgcaatgtgcctaaacaccttcgtactaaagaaagaagtctcagaaacacagcatgggacgatcctaatcaaagtcgagtataaaggagaagatgccccttgtaaaattcccttttcgacagaagatggacagggtaaagctcacaatgggcgtttaataacagcaaacccggttgtgaccaagaaagaggaacctattaacatcgaggcagaaccaccgttcggagaaagtaacatagttattggaattggcgataaagccttaaaaataaattggtacaagaaaggatcatcaattgggaaaatgtttgaggcgacggcccggggagcaagaaggatggctatattgggtgatactgcatgggattttggatcggttggaggtgtattaaactcacttggcaaaatggtacaccagatttttggttctgcatacaccgccctattctctggcgtgtcatggattatgaaaataggaataggcgtattactaacttggataggtttaaattccaaaaacacaagtatgtcatttagttgcatcgttattggtataataaccctttatctaggagcggttgtccaagctgatatgggctgtgtgattaattggaagggaaaagagcttaagtgtggaaatggtatattcgttacaaatgaagtacatacatggacagagcagtacaaatttcaggctgatagcccaaaaagactggcgacagcaatagccggagcatgggaaaatggtgtatgtggaatacgctcgacaacaagaatggaaaatttattatggaaacaaattgcgaatgagttaaattatatcttatgggaaaataacataaaattgaccgtggtagttggtgatatcattggtgtattggaacagggtaaaagaactctaacaccacaacccatggaattaaaatactcctggaagacatggggtaaagcaaaaattgtcactgcagaaacgcaaaatagctcattcataatagatgggcctaacacgcctgaatgtccttctgcgagcagagcttggaatgtgtgggaagtagaggattatggttttggtgtattcactactaatatatggttgaaattacgagaagtttatacccaaagttgcgatcatcgactaatgtctgcagcaatcaaagatgaacgggcggtccacgctgacatgggatactggatagaatcacagaaaaatggctcctggaaattagaaaaagcatcatttattgaagtgaaaacatgtacatggccaaaatcccatactttgtggtcaaacggagtactagagtctgatatgattatcccaaaatcattagccggaccaatttcgcagcataaccatcgtcccggataccatacacagaccgcgggaccttggcacctagggaaactggaactggactttaactactgtgagggcactaccgtagttatcgcagaaaactgcggcacgcgggggccttcccttagaactactactgtatccggcaagctaatacatgagtggtgctgcagatcatgtactttaccccctttgcgatatatgggagaggacggatgttggtatggaatggaaataaggcctattaatgaaaaggaagaaaatatggtaaagagcttagtaagtgctgggtcaggtaaagtcgacaattttacaatgggagtactctgcttagctattttattcgaagaagtcatgcgagggaaattcggcaagaaacatatgattgctggagtattattcacttttgttttactattatctggccaaataacttggagagacatggcacatacacttataatgataggaagcaacgcaagcgaccgaatggggatgggtgtcacatatcttgctcttatagcaacgttcaaaattcaaccgtttctagcactgggattctttctaagaaaacttacatctagggagaatttactacttggggtcggtttagcaatggcgacaacactacaattacctgaagatatagagcaaatggccaacggtattgccttaggtttgatgacacttaaacttataactcaatttgaaacataccaactctggacagcacttgtaagtttgacgtgtagtaatactatattcactctgacggtagcgtggcgtactgcgacattaatacttgctggagtatctctattacctttatgtcaatcttcttccatgagaaaaactgattggctgcccatgacagtggctgcgatgggtgttccacctctgcccttatttatattttcattgaaagacacgcctaaaagaaaaagctggccgctaaacgaaggcgtgatggcagtaggtttagtgtcgattctagcttcctcccttttacggaacgacgtacccatggctggaccgctagtcgctgggggacttttaatagcttgctacgtcattacagggacctcagcggacttaactgtcgaaaaagctgctgacgttacttgggaagaagaagcagaacaaactggagtatcgcacaatttgatgatcactgttgatgatgatggtacgatgaggattaaggatgacgaaacagagaacattctaactgtattattgaaaactgctctactgatagtatcagggatatttccatacagtataccagcaacattattggtgtggcacacatggcagaagcaaacacaacgaagcggagtactatgggatgtcccaagcccgccggaaacacagaaagcagaattggaagaaggcgtttacagaataaaacagcaaggcatctttggaaaaacacaagttggagtaggtgtacaaaaagaaggggtattccatacgatgtggcacgtcacgagaggagcagtactaacccataatggtaaaagattggaacctaactgggctagcgttaagaaagatcttatttcttatgggggtggatggagattatcggctcaatggcaaaaaggggaagaagtccaagtgatcgctgtagaacctggcaagaatccaaagaatttccagactatgcccggcattttccaaactacaacaggtgaaattggagccatagcgttagattttaaaccagggacgtcaggaagtccgattattaatagagaaggaaaagtcgtaggactatatggtaacggagtggtaactaaaaatggaggctatgtttctggaatagctcaaaccaacgcagagccagatgggccaacaccagaactcgaagaagaaatgtttaagaaacgaaacctgactataatggatctacaccctggcagcgggaaaacaaggaagtacttacccgcaatagtaagggaagccattaaaagaagacttagaactttaatactagcacctacgagagtagtggcagctgaaatggaagaggcactaaaaggactccctatacgatatcaaactaccgccaccaaaagcgaacacacaggtagggagatagtcgatctcatgtgtcatgcaacattcactatgagattactgagtccagttcgtgtaccgaattacaacttgatcatcatggacgaagcacatttcacagatccagcttccatcgctgctcgcggatatatcagcactcgagttgggatgggtgaagccgccgcaatattcatgactgcaacaccaccaggtacagctgaagcatttcctcagagtaatgctcccatacaagatgaggagcgtgatatacccgagagatcatggaactccggtaacgaatggataactgattttgtaggtaaaacggtatggtttgtaccatcaatcaaagcggggaatgatatagcaaactgcttaaggaaaaatgggaagaaagtgatacaattgtcccgaaaaacttttgatactgaatatcagaaaacaagattgaatgactgggactttgttgttacaactgatatctcagagatgggagccaattttaaagcggacagagtcatagatcccaggcgttgtcttaaacccgtgattttgacagatggacctgaaagagtaatacttgcaggacctatgccggttacagccgcatctgccgctcaaaggcggggtcgagtaggccgaaaccctcaaaaggaaaacgatcaatatatttttactggtcaacctttaaacaatgacgaagatcacgctcattggactgaagcaaaaatgctcctagacaatatcaacacaccagaaggaatcatacctgcattatttgagccggagagagagaaatctgcggccatagatggtgaataccggttgaaaggcgaatcacggaaaacattcgtagaactaatgagacgaggtgatttaccagtgtggttagcgcataaagttgcaagtgaaggcataaaatatacggacagaaagtggtgttttgacggtgagcgtaataatcaaattctagaagaaaatatggatgtggaaatttggaccaaggaaggagagaggaagaaactcaggccgaggtggctcgatgcacgtacatactcagatcctttagcattaaaggaatttaaagattttgctgctggccgtaaaagcatagctctagatctcgttaccgagatagggcgtgtaccaagtcatctcgcgcatagaacaaggaatgctcttgacaatcttgttatgttgcacaccagtgaacatggagggagagcctatcgacatgcggttgaggaactccccgaaacaatggagactttacttctactaggcctgatgatactacttactggaggagcaatgctattcttaatttcaggaaaaggaataggaaaaacctctataggattgatctgcgttatagtttcaagtggtatgctatggatggctgatgttccattacaatggatagcttcagctattgtattggagttctttatgatggtgttgttaatcccagaacctgaaaaacagagaacaccacaagacaatcaactcgcgtatgtggttataggaatactcaccctagctgcaattgttgcggcaaacgaaatgggattattggaaacaactaagcgcgatttgggaatgtctaaagaacccggagttgtaagtccaacatcctacttagatgtggatttacatcctgcatcggcatggactttgtatgcggtagcaacaacagtaatcacacctatgttaagacatacaatcgaaaatagtacggccaatgtatcacttgccgcgatagctaatcaagctgtagtactaatgggtctagacaagggttggcctattagcaagatggatctaggtgtcccactgcttgctttaggatgctatagccaggtaaatccattaacccttactgcagctgtattacttctagtgacacactacgccatcatcggacctgggctacaagcaaaggcaacgagggaagctcagaaaagaacggcagctggcataatgaagaatccaactgtggacggcataatgacaatcgacctggaccccgtaatctacgatagtaaattcgagaaacaactagggcaagttatgttgcttgtcctctgtgcagtccagttgcttctcatgagaacgagctgggcattgtgcgaggccctaaccctagcaacgggcccaataacgacactatgggaagggtcacccggaaaattttggaacactacaatcgctgttagtatggcaaatatttttagaggtagttatctagcaggagctggactggcattttcaataatgaaatcagttggtaccggtagaagaggaactggaagtcaaggagaaacattaggcgagaaatggaaaaagaagttaaatcagcttagtcgaaaggaatttgatttatacaagaaaagtgggataacagaagtagacagaactgaggctaaagaaggattaaagagaggggaaacaacgcaccatgcagtaagtagaggatccgcaaaactgcagtggtttgtggaacgaaatatggtcataccagagggacgagtaatcgatctaggctgcgggagaggcgggtggagctactactgtgcaggtttgaagaaggtaacggaagtaagaggatataccaagggcggacctggtcatgaggagcctgtaccaatgtctacatatggatggaacatagtcaaactcatgtctggcaaggatgtattttatctgccaccagaaaagtgtgacacgcttctttgcgatatcggagaaagttccccatcaccaacggttgaagagagtagaaccattagagtgctgaggatggttgaaccttggttacgtaataaccaattttgcataaaagtactaaacccgtacatgcctaatgtaatagaacacctagaacgactccagagaaaatatgggggcatgttagttcggaatccattatcgaggaacagcacccacgaaatgtattggatatcaaacggcacaggaaatattgttagcagcgtgaatatggtaagcagattattactaaatcgattcactatgacacatcggcgccccacgatagaaaaagacgtagaccttggagcaggaacccgacatgtaaatgcagagccagaaacgcctaacatggatgtaatcggtgaacggattaaaaggataaaagaagaacattctagcacatggcattatgatgatgagaacccttataagacctgggcatatcacggtagttacgaagtaaaagcaacgggatccgcttccagtatgatcaatggtgtcgtcaaattattaacgaaaccgtgggatgttgtccctatggtgactcaaatggccatgactgataccacaccgtttgggcaacaacgcgtatttaaggaaaaagtggatactcgaacccccagacctatgcctgggacccgaaaagtaatggagataactgcagagtggctatggcgtaccctgggccgcaacaagaaaccaaggttgtgtacacgcgaagagttcacaaagaaagtgcgaacaaatgccgccatgggagcagtctttacggaggaaaatcaatgggattcagcaagagctgcagtggaagatgaagaattttggaagttggttgacaaggaaagagaattacataaattaggaaaatgcggatcatgtgtatataacatgatgggtaaaagggagaagaaacttggagaatttggaaaagcaaaaggctcacgagcaatctggtacatgtggcttggggcgaggtacttggaatttgaagcgttgggctttttgaacgaagatcattggtttagcagggaaaattcatattccggggtggagggcgaaggactacataagctaggttatatactaagggacatcagtaaaattcctggtggggcaatgtacgctgatgacaccgcagggtgggatactcgtatcaccgaagatgacctccataatgaagaaaagataacacagcaaatggatccagaacacagacaattagcgaacgctatattcaagttgacttatcaaaataaggtagtaaaagtgcaacgaccaacaccaaaaggcacggtaatggatataatatcaagaaaagatcaacgtggaagtggacaagtcggtacgtatgggctaaacacatttacaaatatggaggcacaactcgtacgtcagatggaaggcgaaggcgttctatcagaagcggacctcgaaaacccacacctacttgagaagaaaattacccagtggttagaaactaagggagtagaacgcctgaaaagaatggcgatctcaggtgatgattgtgtcgttaaaccgatagatgacagatttgcaaatgctctgttagcattgaatgacatggggaaagttaggaaggatattccgcaatggcaaccaagcaagggttggcatgattggcaacaagttcccttttgttctcaccattttcatgagttgattatgaaggatgggagaaaattggtggtgccttgcagacctcaagatgaattgattggcagagcaagaatttcccaaggggctggctggagccttaaagaaacagcttgcctaggaaaagcatacgcgcaaatgtggtcattaatgtattttcatcgacgtgacttacgtctcgcatccaatgccatctgtagtgcagttcctgcacactggatcccaacatctcgcacaacctggtcaatccacgcacaccatcaatggatgaccacagaagacatgctgactgtttggaaccgagtttggatcgaggataatccttggatggaggataaaacaccagttacgacatgggaagatgtcccatacttaggaaaacgtgaggatcagtggtgcggatcacttattggactaacctcgagagcaacgtgggctcagaacattcttaccgcaattcaacaggtacgatccttgattggtgatgaagaatttttagactatatgccctccatgaaaagattccgtaaagaagaagagagtgaaggagcaatatggtaa

SEQ ID NO: 23147 - RNA, 9873 nt, synthetic construct
  misc_feature 1..9873: note = derived and/or modified CDS sequence (opt6) from DENV-3__FJ639731__SS-prME
  source 1..9873: mol_type = other RNA
acatctctatgtctgatgatgatgttaccagcaacactagcttttcacctaactagcagagatggagaaccacgaatgatagttggcaaaaatgaaaggggcaagagcttgctattcaaaacagctagtggaataaacatgtgtactcttatcgctatggatttgggtgaaatgtgtgatgatacagttacatataaatgcccgctaatcgcagaagtcgaacctgaagatatcgattgctggtgcaaccttacatcaacgtgggtaacgtacggaacttgtaatcaagccggagaacatagacgtgataagcgctcggttgcgctcgcgccacatgtgggtatgggattagatacaagaacgcaaacatggatgtctgcagaaggggcatggcgacaagtagaaaaagtggaaacatgggcattgagacacccgggttttaccattctagcattatttttagcacattatatcgggacgtcactaactcaaaaagtcgtaatattcatactgttaatgttagtaacaccatccatgactatgcgatgtgtaggtgttggcaatcgcgacttcgttgaaggactatcgggcgctacgtgggtagatgttgtcctagaacatggaggctgcgtaacaactatggctaaaagcaaaccaactcttgacatcgaactacagaaaacagaagcgacgcaactcgcaacactaagaaaattatgtatagaaggcaaaataacaaacataacaactgacagtaggtgtccgacgcaaggcgaagcaacgttaccagaagaacaggatcaaaactacgtttgtaaacacacttatgtagacagaggctggggcaatggatgtgggctctttgggaaaggatcgctcgtaacatgcgcaaaattccaatgccttgaacctatagaaggaaaagtagtacaatacgaaaatctcaaatatactgttatcataacagtacacaccggagaccagcaccaagttggtaatgacacgcaaggggtgaccgtcgaaattacaccacaagccagtacagtcgaagcggtattgccggaatatggaacgttaggcctggaatgctcacctagaaccggcctagatttcaatgagatgatcttattgacaatgaaaaacaaagcatggatggttcataggcaatggtttttcgatctaccattaccatggacaagcggagctacaacagagacaccgacgtggaacaggaaagaactattggtaacttttaaaaatgcacacgctaaaaagcaagaagtggttgtcctaggatcacaagaaggagctatgcatacagcattaacaggcgcaactgaaatacagaatagcggcggtacaagtatattcgcagggcatttaaaatgcagacttaaaatggataaattggaattaaagggaatgagttatgctatgtgtctaaatacttttgtactcaagaaagaagtatcagaaacccagcatggaactgttctaattaaagtagaatacaaaggagaagatgcgccatgtaaaataccattctctaccgaagatggtcaaggcaaagcgcataacggtagacttataactgctaatcccgtggttaccaagaaagaagaaccagttaatatcgaggcggaacctccttttggtgaaagtaatatcgttatagggataggcgacaaagccttgaagataaactggtacaagaaaggatctagtataggaaaaatgttcgaagccactgcgaggggtgcgagaaggatggcgatcttgggtgacactgcatgggattttggttctgtaggaggagtgttaaacagcctaggcaagatggtacaccaaatatttggtagtgcgtacaccgctctattttccggagttagctggattatgaaaataggcatcggagtactgcttacatggataggacttaatagtaaaaatacgtcaatgtcgttctcttgcattgtaataggtataatcaccttataccttggagccgtagttcaagcagacatgggatgcgctatcaattggaaaggaaaagaactaaaatgtggttctggaatattcgttacaaatgaagtccacacatggacagagcaatataaatttcaggcggattcaccgaaaagactagctaccgcaatagccggcgcttgggagaacggcgtatgtggtatcaggagtactaccaggatggagaatcttctatggaagcaaattgctaacgaacttaattatattctgtgggagaacaatattaaattgacagttgtggtaggggatataataggtgtattagagcagggaaagagaacgttaacacctcaacccatggaattgaaatactcgtggaaaacgtggggaaaagcaaagatagttaccgcagaaacacaaaattcatcttttattatcgacggaccgaacacaccagaatgtccatctgccagccgagcgtggaatgtatgggaagttgaagattatggatttggagtttttacgacaaatatttggttaaaactacgagaggtatacacgcaatcttgcgaccataggttaatgtctgcagctattaaagatgaacgggctgtacatgcggacatgggatattggatagaatcgcagaaaaacggttcttggaagctagaaaaagcgagcttcatagaagtcaaaacatgtacatggccaaaaagtcatacactatggagcaatggcgtcctggagtcggacatgataattccgaaaagtctggcaggaccaattagtcaacacaaccacagacccggttatcacactcaaacggcaggtccatggcacctaggaaaattagaattagactttaattattgtgagggaacaacagttgtaataacagaaaactgtggtacaaggggaccttctctcagaacaacgactgtatcgggcaaactgatacatgaatggtgttgtagatcatgcacgttaccgcccctccgatacatgggtgaagatggatgttggtatgggatggagattcgaccgatcaatgagaaggaggaaaatatggtaaagagcttggtgtcagcaggcagcggcaaaatggataacttcaccatgggagtgctttgtctagcaatattattcgaagaagtaatgcgaggaaagttcggtaagaagcatatgatcgctggagtcctctttacctttgtgcttctgctatcaggacagataacatggcgggacatggcgcataccctaatcatgataggttccaatgcgagcgataggatgggaatgggtgttacatatctggcactcatagcaacatttaaaattcaaccattccttgcattagggttctttctccgaaaattaacatctcgggagaatctattgttgggcgtaggactagcaatggcgaccacgctacaattgccagaagatatagaacaaatggcaaacggcattgcattaggattgatgacgttaaaactaattacccaatttgagacgtaccaattatggacggccctagtatcattaacctgcagtaatacgatctttacactaactgttgcctggagaacagcaaccctcatcttggctggtgtttcacttttaccactttgtcagtcctcgagtatgaggaaaactgactggttgccaatgacagtagcagcaatgggagtacccccgttgccgttattcatctttagcttgaaagatacaccaaaaagaaggagctggccactaaatgaaggagtgatggcggtaggcctcgtttcaatactggcaagctcgcttctgcgcaacgacgttccaatggcagggccacttgttgctggcggtctgttgatcgcatgttacgtaatcacgggaacatcagctgacttaacagtagaaaaggcggctgacgtcacatgggaagaagaagccgagcaaactggggtctcccacaatttaatgattacggtagatgatgacggtactatgcgtattaaagacgatgaaacagaaaatatactcactgtgctgttaaaaacggcactacttatagtttcaggaattttcccatacagcatcccagcaacactcctggtatggcatacatggcaaaaacaaacccaaagatcaggagtactttgggatgtgccttctccaccggaaacacagaaagcggagctagaagaaggagtataccgtattaaacaacagggcatatttggcaaaacacaagttggagtaggggtacaaaaagagggcgtgtttcatacaatgtggcacgtcaccagaggagcagtacttacccacaacgggaagaggctagaaccaaactgggcgagtgtcaagaaagatctaattagttatggaggtggatggcgcctgaacgcccaatggcagaaaggcgaagaggtacaagttatagctgtagaaccgggcaaaaaccctaaaaattttcagacaatgcctggaatatttcaaaccacaacaggcgagattggagcaattgcactggatttcaaaccaggtacatcaggatccccaatcattaacaaggaaggaaaggtagttggtctatatggaaatggtgtggtaaccaaaaacggaggatatgttagtggaattgctcaaacaaatgccgaaccagacggccccacccctgagctggaagaggaaatgttcaagaaacgaaatcttactatcatggatctacaccccggatcgggaaaaactaggaagtacctgcctgcaatcgttcgagaggctattaaaagaagattacgaacactaatcttagcaccaactcgggttgtagcagctgagatggaagaagcactcaaaggtctgcccattagatatcaaacaacggcgacaaagagcgaacacacaggacgagaaatagtggacttaatgtgccacgccacatttactatgaggctattaagccccgttcgtgtcccgaattataaccttgtcatcatggatgaagcacactttactgacccagcaagcatagcagcgcggggatacatctcaacccgtgtaggaatgggcgaagccgcggctattttcatgacagctactccgcccggaactgcagaagcatttccgcaatctaatgcacctatacaggacgaagaaagggacattcctgagagatcatggaactcgggaaatgaatggatcactgatttcgtaggaaaaacagtttggttcgtaccttcaattaaagcaggcaatgatattgcgaattgtttgcgtaaaaacggcaagaaagtcattcagctaagcaggaaaacgtttgacactgaataccagaaaacgcggctgaacgattgggacttcgtagtaaccacggatataagtgaaatgggagccaactttaaagctgacagagtaatcgatccgagaaggtgccttaaaccggtcatactgacggatgggccagagcgagtcatactagctggaccgatgcccgtcactgcagcgagcgcagcgcagaggcgaggacgagtaggtagaaatccccaaaaagaaaatgaccaatatatattcacagggcagcctctcaataatgacgaagaccatgcacattggactgaagcaaaaatgctgctagacaatataaatacgcctgagggtataatacctgctcttttcgaaccagagagagagaaatctgcggccattgacggtgaatacagattaaaaggagaatcgagaaaaacatttgttgaactcatgagacggggagatcttccggtatggcttgcccataaagtcgccagtgaaggtatcaaatatacagatagaaaatggtgttttgatggcgaaagaaataaccaaatacttgaggaaaacatggatgtggaaatatggaccaaggagggtgaacggaagaaactaagaccccgatggctggatgctaggacctatagtgatccgttagcacttaaagagttcaaggacttcgctgcaggcaggaaaagcatagcacttgatttagtaaccgaaattggtcgagtcccttctcacctagctcatagaactagaaacgcactcgataatctagtgatgctgcacacctctgagcacggaggtagggcttacagacatgcggttgaagaactcccagaaactatggagacattactcctgttaggtttaatgattctattaacaggaggagcgatgctatttttgatatccggaaaaggtattggtaaaaccagcataggtttgatctgcgtaatagtgtcgagtggcatgttgtggatggcagatgttcctcttcaatggattgcgagcgctattgtcttggagttctttatgatggttctattgataccagagcctgaaaaacaaagaactccacaggataaccaactagcatatgttgttataggtattttgacacttgcggcaatagttgcagctaacgaaatgggattgttggaaacgacaaaacgggaccttgggatgagtaaagaaccaggggtcgtgagtccaacatcttacctcgatgttgatctccatccagcgagcgcgtggacactatacgctgttgctactaccgtcataacaccaatgcttagacacacaattgagaacagtacagcgaatgtaagcctagcagcaatcgcaaatcaggcggtagtactgatgggcctagataaaggatggcctataagcaaaatggatttaggtgttcccttactagcattaggttgttattcacaggttaatcccctgactttaacagctgctgtattgctattagtcactcactatgcgataattggaccggggttacaggctaaagctactagagaagcacagaaacgcaccgcggctggaataatgaaaaaccctacagtcgatgggataatgacgatcgatctagatcctgtaatatatgattccaaatttgagaagcagctaggtcaagtcatgttactcgtattatgtgctgtgcaattgttattaatgaggacaagctgggccctctgtgaagcactaacattagcaactggaccgattactaccttgtgggaggggagcccaggaaaattctggaacactaccatcgccgtatctatggcaaacatttttagaggatcctatttggcaggagctgggttagctttttcaattatgaaaagtgttggtactggacgacgcggaacaggaagccaaggggaaacactaggtgaaaaatggaagaagaagttgaaccagttaagtagaaaagagttcgatttatataagaaaagtggtataactgaggtcgatagaactgaggcaaaagaaggattgaaaagaggagaaacaacacaccatgcagtaagtagaggaagcgcaaaactccaatggttcgttgaaagaaatatggtaattcctgaaggtcgagtcatcgacctaggctgtggcagaggtggatggtcgtattattgcgctggtttgaagaaagtcacagaggtacgcggatataccaaaggaggtccaggacacgaggaaccggtaccaatgagcacatatggttggaatatagttaaacttatgagtgggaaggatgtattttatcttcccccggagaagtgtgatacattactatgtgatataggtgaaagcagccctagtcctactgtcgaagaaagccggacgatacgggtcctaaaaatggtggaaccatggttaagaaataatcagttctgtatcaaagtactgaatccatacatgccaacggtaatagaacatcttgaaaggctacaaagaaaatatggcggcatgttagtacgaaacccgctcagtagaaatagcacacatgaaatgtattggataagtaacggtacaggaaacattgtctctagtgtaaatatggtgtccagactacttttgaatcgtttcacaatgacacaccgtagaccaaccattgaaaaggatgtagatttaggtgcaggcactaggcacgttaatgccgaacccgaaacgcctaatatggatgtaattggtgagagaataaagcggattaaggaagaacactctagcacttggcattatgacgatgaaaacccttataagacttgggcctatcatggctcatatgaggtaaaagcgacaggatcagcaagtagcatgataaatggggtagtaaaactattaactaaaccgtgggacgttgtaccaatggtcactcaaatggccatgacggacacaactcctttcgggcaacaacgagtgttcaaggagaaagtagatacaagaacgccgcgacctatgcctgggactaggaaagtaatggaaatcactgcagaatggctatggagaacgttaggtagaaacaagaaaccaagactttgtacacgcgaagagttcacgaagaaagtgcgtacaaatgcagctatgggagcagtattcacggaagaaaatcaatgggatagtgccagggctgcagtagaagatgaagagttctggaaactcgtggatagagaacgagagctccacaaactgggaaagtgtggctcatgcgtctataacatgatgggtaaacgcgagaagaaactcggagaatttggaaaggccaaaggatcccgagcaatctggtatatgtggttaggagcgcgctatctggagttcgaggctttagggtttttaaacgaagatcattggttttcccgagaaaactcttatagtggagtagaaggcgaggggctgcataaactaggatatattttgcgagacatttcgaagattccaggtggcgcaatgtacgccgacgatactgcaggttgggatacaagaataacagaggacgatctacataacgaggagaaaataacacaacagatggatcccgaacatagacaattggctaatgctatcttcaaactgacttatcagaataaagttgtgaaggtccagcgtcctactccgaaaggcacagtcatggatataataagccgaaaggatcagagaggcagtggtcaagtggggacatatggtctcaacacgttcactaatatggaagctcagctagttagacagatggaaggggagggggtactttccaaagctgacctagaaaacccacacttacttgagaagaaaataacacagtggcttgaaacgaaaggggtcgaacgattaaaaagaatggctataagcggggatgactgtgtagtaaaacccattgatgatagatttgccaacgcacttctagcattaaacgacatgggtaaagttaggaaagatattccacagtggcagccatcaaaaggatggcatgattggcagcaggtccctttttgctcacatcattttcacgaactaattatgaaggatggacgcaagttggtggtaccttgtagaccgcaagacgaattaataggacgagctcgtataagtcagggtgcgggatggtcacttaaagaaaccgcatgccttggaaaagcatatgcacaaatgtggtctctcatgtattttcatagaagggatttacgactcgcatccaatgctatttgttcggcagtaccagtacactggatcccgacctcacggacgacctggtccatacatgcacatcatcagtggatgacgaccgaagatatgttaactgtatggaaccgtgtatggatcgaggataacccgtggatggaagacaaaacaccagtgacaacctgggaagatgttccgtatttaggtaagagagaggaccaatggtgtgggtcgctaataggattgacgtccagagctacatgggcacagaatatacttacagccatacaacaagttcgatctctcataggagacgaagagttcctagactacatgccatccatgaagcgattccgaaaagaagaagaatcggaaggtgctatctggtaa

SEQ ID NO: 23148 - RNA, 9873 nt, synthetic construct
  misc_feature 1..9873: note = derived and/or modified CDS sequence (opt6) from DENV-3__HM181933__SS-prME
  source 1..9873: mol_type = other RNA
acaagtttatgtctaatgatgatgcttcctgctacattagctttccacctaacatcccgggacggagaacctcgaatgattgtaggcaaaaatgaacgggggaaaagtttactattcaaaacagcgtcggggataaatatgtgtacattaatagcaatggatctgggtgaaatgtgtgatgacaccgttacttataaatgtccgttaatagctgaagttgaacctgaagatatagattgctggtgtaatctgacttcaacatgggtaacgtatggaacatgcaatcaagctggtgaacatagaagagataaaagatccgtagcactagcaccgcacgtcggaatgggacttgatactaggacacaaacatggatgtctgcagaaggagcatggcgtcaagtagaaaaagtcgaaacctgggcattacgacaccccgggtttacaattttggcactattcttagcgcattatatcggtacgtctttaactcaaaaagtagttatttttattcttcttatgttagtaacccccagtatgactatgaggtgtgttggagtcggtaatagagatttcgttgaagggttgagtggagcgacctgggtggacgttgtactagaacacggcggctgtgttaccacaatggccaaaagtaaacctactctagatattgaactgcagaaaactgaagcaactcaactagctaccctaagaaaattgtgcatagaaggaaaaatcacaaatataaccacagattccagatgtccgacacaaggcgaagctacacttccagaagaacaagaccaaaattatgtatgcaaacacacttatgtagacaggggctggggaaacggatgcggactatttggtaaaggaagcctggtaacatgtgctaaatttcaatgtcttgaacccatagaaggtaaagtagtccaatatgaaaatctaaaatacacagtgattataaccgtacatactggtgatcaacaccaagtaggtaatgatactcaaggggtaactgtagaaattaccccacaggcttctaccgtagaagctgtacttccagagtatggaacactaggtttggagtgtagtccgaggactggtcttgactttaatgaaatgatcctcctaacaatgaaaaacaaagcgtggatggtacaccgtcaatggttctttgatcttcccctgccctggacatccggtgctacgacagaaactcctacttggaaccgtaaagaattacttgttacgttcaaaaatgcgcacgccaagaaacaagaagtcgttgtacttggatcacaggaaggagccatgcatactgctctcacaggagcaacagagattcaaaactctggcggaacaagcattttcgcgggtcatttaaaatgcagacttaaaatggacaaattggaattgaaagggatgagctatgctatgtgtcttaatacttttgttctcaagaaagaggtcagcgaaacacagcacggaaccatattgattaaagtagaatataaaggcgaggacgcaccatgtaaaataccattcagtactgaagacgggcaagggaaagcgcataatggtcgattaattactgcgaatcccgttgtcacgaagaaagaggaaccagtcaacattgaagcagaacctccatttggtgagtcaaatatcgttatcggtataggcgataaagctctaaaaataaactggtataagaaaggatcctcaataggcaaaatgtttgaagcgacagcacgaggtgccagaagaatggcgatacttggagacacagcatgggactttgggtcggttggaggagtcctaaattcattaggaaaaatggttcatcaaatttttggatccgcctacacagcattgtttagtggagtgtcttggataatgaaaattggaattggtgttttactgacttggatcggccttaatagtaaaaatacctcaatgtctttctcctgcatagtaataggaattataacgttgtatttaggagcagtcgtacaagcagatatgggatgtgccattaactggaaaggtaaagaattaaaatgtggtagcgggatatttgtaacaaacgaagtgcatacctggaccgaacaatataaatttcaagccgacagtcctaaacgactagcaacggccatagccggagcatgggaaaatggagtttgcggcattcgtagcacaacaagaatggaaaatctcctatggaaacaaattgcaaacgaacttaattatatcctttgggaaaacaatattaaacttacagtcgtagtgggtgacataataggtgttttagaacaaggtaaacgaacactgactccgcaaccaatggaactcaaatattcatggaaaacttggggtaaagcaaaaatcgtaaccgcggagacgcaaaactcctcattcataatagatgggccaaatacacctgaatgtccatcagcaagtcgtgcctggaatgtgtgggaggtagaagactatggatttggagttttcacaacaaatatatggcttaaattacgagaagtttatacacaatcatgcgaccatagattaatgagcgccgcaatcaaagatgagcgggcggtccatgccgacatgggatactggatcgaatctcagaaaaatggatcatggaaattagagaaagcgtcctttattgaggtaaaaacatgtacgtggcctaaatcacatactctatggtctaacggagtgttggaaagtgacatgattatacctaagagtttagccggtcctatatcacaacataatcataggcctggatatcatactcaaactgcaggtccctggcatttaggtaaattagaactcgacttcaattactgtgaagggactacagtagtaatcacagaaaactgcggaacaaggaggcctagtcttcgaaccacaacggtaagcgggaaattaatccatgaatggtgttgcagaagttgcactctacccccactaagatatatgggagaggatgggtgctggtacggaatggaaatcagaccaattaacgaaaaagaggaaaacatggttaaaagcctagtcagcgccggaagcggtaaggttgataattttacaatgggtgtgctgtgcctagcgatcttattcgaagaagtgatgaggggtaaattcgggaagaaacacatgatcgcgggggttctatttacgtttgtattacttctgagtgggcaaataacatggagagatatggcacatactctcatcatgataggtagcaatgctagtgataggatgggcatgggagtaacatatcttgccttaatcgcaacgtttaaaatacaacctttccttgcactaggcttctttttgcgaaaattaacttctagggaaaatctactcttgggcgtaggattagccatggctaccactttacagttaccggaggacatagaacaaatggcaaatgggatagcactaggcctgatgacccttaaactaatcactcaatttgaaacctaccaactctggacagcgctggtaagtctaacctgttccaatacaatattcacgttaaccgttgcctggcgtacagctacactaattctagcaggagtatcattattacccctctgccagtcgtcgagcatgcgaaaaactgattggttgccgatgacagttgccgcaatgggggtaccaccactgcccctttttattttctctttaaaagacactcccaaaaggcgatcctggcctttgaatgaaggtgtgatggcggtaggcctagtatcaatcttagcctctagcctattgcggaacgatgtaccaatggcaggccccttagtcgcaggaggtctactgatcgcttgttatgtgataacaggtacctcagctgatctgacagttgaaaaagcagcagacgtcacttgggaagaagaagcagaacaaacaggggtaagtcacaatttgatgataactgttgatgacgatggtacgatgagaataaaggatgacgaaactgaaaatatcctaacagttctgctaaaaacagccctactaattgtgagcggaatattcccgtactctatccccgcaacccttttggtctggcatacatggcaaaaacaaacacagcgtagtggagttctatgggatgtcccaagtccaccagagacccaaaaagcagaacttgaagagggagtatataggataaagcaacaggggatctttggtaagacacaagtaggcgtgggtgtgcaaaaagagggagtcttccataccatgtggcacgtcaccagaggagcagtgctaactcacaacggcaagcgtttagaacccaattgggcttcagtgaagaaagatctaatatcatacggaggaggctggagactcaatgctcaatggcaaaaaggtgaggaagtgcaggtcattgcagtggaacctgggaagaatcctaaaaattttcaaactatgccggggatattccagacgacaacgggggaaataggagctatcgccttagattttaaaccagggacttcaggttccccgatcatcaatcgagaaggaaaagttgtaggcttatacggcaatggtgtggtgaccaaaaacggcggttacgtgtcaggaatagcacaaacaaacgcagaaccagacgggcctactccagagcttgaagaagaaatgttcaaaaagcgcaatctcaccattatggatcttcacccaggatctggcaaaacaaggaagtatttaccagcaatcgttagagaagcaataaagagaagactaagaaccttgatactcgcccccaccagagttgtagccgcagaaatggaagaggctttaaagggtttgcccattcgataccaaacgacggcgactaaatctgaacatacaggtagagaaattgtagatttaatgtgccatgccacctttaccatgaggctcttatcgccggtaagagttcctaattacaatttagttataatggatgaagctcatttcaccgaccctgcctcaattgcagccagaggctatattagcacaagagtaggtatgggtgaagctgcggccatcttcatgactgcaacgccaccgggaacagccgaagcatttccgcagtcaaacgcaccaatacaagatgaagaacgagacattccagagcgaagttggaacagtgggaatgaatggatcacagactttgtcggaaaaaccgtatggttcgtcccatccataaaggcgggtaatgacattgcaaactgcctgcgaaagaacgggaagaaagtaatacaattaagcagaaaaacattcgatacagagtatcagaaaacaagactcaacgattgggattttgtagtaacaacggatatatccgaaatgggcgccaatttcaaagcagatcgcgtaattgaccctaggagatgtctgaaacctgtaatactgacagatgggccagagcgcgtgattcttgccgggccaatgccagtaactgcagcttctgcagctcaacgtaggggtcgagtaggtagaaacccacagaaagaaaatgatcaatacatattcactggacagccattaaacaatgacgaagatcacgcccactggacggaagcgaaaatgctattagataacattaatacaccggagggaataataccagccttatttgagccagaacgcgaaaaatcagcagcaatagatggtgaatataggcttaaaggagaatcgcgaaaaacgtttgtagagctgatgcggagaggagacttaccagtatggcttgctcataaagtagcatctgaaggtattaaatataccgaccgaaaatggtgctttgacggcgaaagaaacaaccagattctagaggaaaatatggatgttgaaatatggaccaaagaaggcgaaaggaagaaactaaggccccggtggctagatgctagaacatatagtgatccccttgcattgaaagagtttaaggactttgcggcaggacgaaaatcaatagcattggatttagtaacagaaatagggagagtaccaagccatctcgctcatagaacaaggaacgctctcgataacttagttatgctacatacaagcgaacatggaggtcgtgcatacaggcacgctgtggaggaactgccggagacaatggaaacactacttctgttgggattaatgatactacttactggaggggccatgttatttttaatttctggaaaagggataggaaaaacgagcattggtctcatatgtgtaattgtgtcttctggcatgttatggatggctgatgtcccacttcaatggatagcaagtgctatcgtactagaatttttcatgatggtattgctaataccggaaccagaaaaacaaagaacaccacaagataaccaactggcgtacgttgtgattggaatattaacgttagctgcgatagttgctgccaacgaaatgggattattagaaactacgaagcgtgatttaggaatgtcaaaggaacctggggtcgtgagccctacatcctatctagacgtagatttacacccagcgtctgcgtggacactatatgccgttgcaacaactgtaataacaccaatgttgcggcacacaatcgaaaattcgactgcaaatgtctcgttagctgcaattgctaatcaggctgtagttctgatgggactagacaagggttggcctatatcgaaaatggatttaggcgttccccttttagccttagggtgttatagtcaagttaacccactcaccttaaccgctgccgtactactcctagttacgcactatgccatcattggcccaggtttacaagctaaagcaactcgagaagcccagaaaagaaccgcggcaggcataatgaagaatccaactgttgatggaatcatgacgattgatcttgaccccgtcatctatgacagcaaattcgagaaacaattgggccaagtaatgctacttgtactttgcgctgttcaactgctactgatgcgaacatcttgggcattatgtgaagcccttacattagccaccgggccaataactactttatgggaaggttcgcctggtaaattttggaacactacaatagcagtttcgatggctaacatttttcgcggcagttacctagcgggggcaggactggcatttagcatcatgaaaagcgtaggcaccggcagaagagggactggatctcagggagaaacattaggggagaaatggaagaagaaacttaatcaactatccagaaaagagttcgacctatataagaaatcaggtataacagaagtggatagaactgaagcaaaagaaggattaaaaagaggagaaaccactcatcacgccgtgtctcgcggatctgccaagttgcaatggtttgtcgagagaaacatggtaattccagagggaagagttatagacctcggatgtggtcgaggaggatggtcgtattactgtgcaggtctcaagaaagtaacggaggtacgaggctatacgaaaggcggtccgggacacgaagaaccagtcccaatgagtacatatggatggaacatagttaagttaatgtccggaaaggatgtcttttatcttccacctgaaaagtgtgacacattattgtgtgatataggtgaatcttcgcccagtccaacggtcgaagaatctcgtacaattagagtgctaaaaatggtagaaccatggctacgaaataaccaattctgcataaaagtcttaaacccctatatgcctacagtgatagagcacctcgaaagattacaaagaaagtacggaggaatgttggtaagaaatccacttagcagaaattccactcacgaaatgtactggatcagcaatggaacaggtaacattgtatcttctgttaatatggtaagtcgattattacttaaccgatttacaatgacccaccgtcgccctacaatagagaaagatgtcgacctaggcgcgggaacaaggcacgttaacgcagaaccagaaactcctaatatggatgtgataggagaaagaataaagcgaataaaggaggaacattcaagcacgtggcactatgatgacgaaaacccctacaaaacttgggcgtaccacggtagctatgaagttaaagcaactggaagtgcatcaagcatgataaacggtgtagtcaaattgctaaccaaaccctgggatgtagtgccaatggtaacccagatggcaatgactgacacaacaccattcggccaacaaagagtatttaaggaaaaagttgacactcgaacccctagaccaatgccaggcacccgcaaagtaatggaaataacggcagaatggctatggcgaacacttggacgcaacaagaaacctcgtctttgtaccagagaagaatttactaagaaagtacgaactaacgcagctatgggagctgtctttacagaggaaaaccaatgggatagcgcccgagcggcggtagaagatgaagagttctggaaactcgtagatcgcgagagagaattgcataaattgggtaaatgcggaagctgtgtatataacatgatgggaaagcgagagaagaaattaggagaatttggtaaggctaaaggttctagagcaatatggtacatgtggttaggagctagatatttagagttcgaagccttagggtttttaaatgaggatcattggttttcccgagagaacagctattctggggttgagggagaggggctccataagctcggctacatcttgagagacataagtaaaataccaggaggagcaatgtacgctgatgatacagcaggatgggatacacgaattacagaggatgatttacacaacgaagagaaaatcacacagcagatggacccagaacaccgacagctcgcaaacgctatttttaaactaacatatcagaataaagtcgtaaaggtacaacgacctacaccgaaagggacagtgatggatataatatcacgtaaagatcaacgaggaagtgggcaagtaggaacatatgggttaaacacttttaccaatatggaagcgcagctagtaagacagatggaaggcgaaggggtattaagtaaagcggatttagagaacccgcatctcctagagaagaaaataacccagtggctagagactaaaggggtggaaagactaaaaagaatggctattagtggagatgactgtgtggtaaaacctattgacgaccgatttgccaacgctctattggccctgaatgatatggggaaagttcgcaaagacatcccacaatggcaaccaagtaagggttggcacgattggcaacaggtccctttctgtagccaccactttcatgaattaatcatgaaggatggaaggaaactggtagtaccatgcaggccgcaagacgagttaattggacgggcacgaatatcccaaggagccggatggtcattaaaggaaacagcctgtctaggtaaggcttatgcgcaaatgtggagcctcatgtactttcacagacgtgatctaagactagcttcaaacgccatatgtagtgccgtccctgtgcattggatcccgacgtctagaaccacttggagcattcacgcacaccatcaatggatgacaacagaggatatgctaacggtctggaaccgcgtatggatcgaagacaatccctggatggaggataaaactcccgtaacaacttgggaagacgtaccttacctaggaaaaagagaagatcaatggtgtgggtcattaattggcctcacatctcgagcgacttgggcacagaatatattgactgcaatacagcaagtacgcagtttaataggtgatgaagagttccttgactacatgccttcaatgaagcgatttagaaaagaagaagaaagcgaaggagcaatatggtga

SEQ ID NO: 23149 - RNA, 9873 nt, synthetic construct
  misc_feature 1..9873: note = derived and/or modified CDS sequence (opt6) from DENV-3__JF295012__SS-prME
  source 1..9873: mol_type = other RNA
acgtcgctttgtttgatgatgatgttacccgcaaccttagcctttcacttaacaagtcgagatggggaaccaaggatgatagtcggcaaaaatgaacgagggaaatccctcttatttaaaacagcatcaggaattaatatgtgtacattgatagcaatggacttgggggaaatgtgtgacgacactgtaacttataaatgtccattaatagcagaagtagaaccagaagatatagattgctggtgcaatcttacgtcgacttgggtcacctatggtacatgtaaccaagctggtgaacatcgcagagataaacggtctgttgcgctagctccacatgtaggaatggggttggatacaagaacacaaacatggatgtccgcagaaggagcatggcgacaagtcgaaaaagtagaaacgtgggcacttcgtcaccccggattcactattctagcactgttcttagcacattacatcggtaccagtttaacacaaaaagtggtgatattcatcttacttatgcttgtaacaccatcgatgacaatgcgctgcgtaggtgttggaaatagagactttgtggaaggattatctggtgccacatgggtggatgtggtcctcgaacatggtggttgtgtaacaacaatggctaaaagtaaaccaacgttggacattgaactacagaaaacagaagctacacaactcgccaccctaagaaaattatgcattgaaggcaaaataactaacattactacagattcacgatgccccacacaaggggaagctactttgcctgaagaacaagatcaaaactacgtgtgtaaacatacgtatgtagacaggggctggggaaatggatgcggattattcggaaaaggatcgttagtgacatgtgcgaaattccaatgtttagaaccgatagaaggcaaagtggtccaatatgaaaatttaaaatacacagttattattactgtacacactggagatcaacaccaagtcggaaacgatacgcaaggcgttacggtcgaaataacgccacaagctagtacggtggaagcagttttacctgaatatgggacactaggattagaatgtagtccaagaacgggactagatttcaatgaaatgatcctgctgaccatgaaaaacaaagcctggatggtacaccgccaatggttctttgatttaccgcttccttggacgtctggtgccaccacagaaacacctacgtggaataagaaagaattactcgtaacattcaaaaatgcacatgccaagaaacaagaagtagtagtacttggctctcaagaaggagccatgcataccgcactaacaggagcaacagagatacaaaattctggtggtacaagtatatttgctggacacttaaaatgcagactcaaaatggacaaactagagttaaaaggtatgtcatatgccatgtgcctcaacacatttgtattaaagaaagaagtaagcgaaacacaacacggaacgatactcataaaagtagaatataagggagaggacgctccctgtaaaatcccgtttagtacagaagacggtcagggaaaggcacataacggacgactaattaccgcaaacccagtggttaccaagaaagaagaaccagtaaacatagaggcagaacccccattcggcgaaagtaatatagtaatcggtataggtgacaaagcgctaaaaatcaattggtacaagaaaggcagctcaatagggaagatgttcgaagctacagcccgaggagcccgacgaatggcaatcctcggtgacacagcttgggactttggatccgtaggaggtgtattgaactccctgggaaagatggtccaccaaatattcggaagtgcatatacagcactcttctctggtgttagctggataatgaaaatcggaataggcgtactgctcacatggattggactcaatagcaaaaatacaagtatgtctttcagttgtatcgtcatagggattattactttatatctaggtgcggtagtacaagcagatatgggttgtgtaataaattggaaaggaaaagaattaaaatgcgggtcggggatattcgtcaccaacgaagtccatacttggacagagcaatataaatttcaagctgattctcctaaacgtttagctacagccatagctggtgcatgggaaaacggagtatgtggaataagatcaacaaccagaatggaaaacttactgtggaaacaaatagcaaatgaactcaattacatactgtgggagaataacataaaattaactgttgtggtaggggatataattggggtgctagaacagggaaaacgaactttgacaccccaaccaatggagttaaaatatagttggaagacatgggggaaagcaaaaatagtaactgctgaaactcaaaattcaagtttcattatagatggccctaatactccagagtgtccttcagcaagtagggcatggaatgtatgggaggtcgaagattatggatttggagtttttacaacaaatatatggttaaagttaagggaagtctatactcagtcctgcgaccacagattaatgagcgcagctatcaaagacgagagagcagtacatgcagatatgggctactggatcgagtcacagaaaaatggatcttggaaacttgaaaaagcatcgttcattgaagtcaaaacttgtacttggccgaaatctcatacactatggagcaacggagtgctagaatctgatatgatcattcccaaatcactagcaggaccaatatctcaacacaatcacagacctggatatcatacacaaaccgcgggtccatggcacctgggaaaacttgagttagattttaactactgcgaaggcactacagtcgtcattaccgaaaactgcggaaccagaggtcctagtctacgaaccacgacggtctcaggcaagctcatccacgaatggtgttgccgaagctgcaccctaccgccattaagatacatgggcgaggatgggtgctggtacggtatggaaatccgcccaatcaatgaaaaagaagagaatatggttaaatctctagttagtgcaggttcgggaaaagtggacaattttactatgggcgtattatgcctagctattttatttgaagaagtaatgaggggcaaatttgggaagaaacacatgattgcaggagtactatttacgtttgttcttttgttgtctggccagataacttggcgcgatatggctcacacattgataatgataggctctaatgccagtgatagaatgggaatgggagttacatacctagcgttaatcgctacgtttaaaatccaaccatttctagctcttggattctttcttagaaaactaacatcaagagaaaacctactactcggtgtagggttggcaatggccaccacgctccaactgccagaagatattgagcagatggcgaacggtattgccctaggtttaatgactttaaaattaataacgcaatttgaaacgtatcaactgtggaccgccttagtatctctgacttgctccaacacaatctttactctaaccgtagcatggaggacagcgacactgatattggcaggcgtgtctctactaccgctttgtcaatcttcaagcatgagaaaaaccgactggttaccaatgaccgttgccgcgatgggagtcccgcccctaccactttttatttttagtcttaaagacacgcctaagcggagatcatggccgctcaatgaaggcgtaatggccgttggcttagtgtcgattttagcgtcatcgctattgagaaatgatgttccaatggctggaccactggtggctggcggtctcttaatagcatgctacgttattaccggcacgtctgccgatttgacagttgagaaagctgctgatgtaacctgggaagaagaagctgaacaaaccggcgtaagtcataacttgatgataactgttgacgatgatggaacaatgagaattaaagacgatgaaactgaaaacattttaacagttttactgaaaacagcattattaatcgtaagcggaatttttccctatagcataccagcaacacttctagtatggcatacttggcaaaaacaaacccagcgatcaggagtgctatgggacgtcccatcacccccggagacacaaaaagcggaattagaagaaggtgtttaccgaataaagcaacagggaatctttggtaaaactcaagtaggtgtaggtgttcaaaaagaaggagtatttcacactatgtggcatgttacgagaggtgctgtattaactcataacggaaagaggttagaaccaaactgggcatcggtaaagaaggatttaatatcatatggcggaggttggagactgtcagcacagtggcaaaagggagaagaagttcaagtcattgccgtcgagcctggcaaaaatccgaaaaattttcagacaatgccgggtatatttcagaccacaacaggagaaataggcgcaattgccctagatttcaaaccaggaacatccggatcaccaatcattaatagagaaggaaaagtcgtaggactgtacggtaatggcgttgttacgaaaaacggcggatacgttagtggtatagcccagacgaacgcggagccggatgggccaacaccggaattagaagaggagatgttcaaaaagcgaaacctaacgataatggatcttcatcccggctctggtaaaacaaggaaatatttaccagccattgtccgagaagcaataaaaagacggttaaggacacttatactagcacccaccagagtagtcgctgccgaaatggaagaggccctcaagggcctacccataagataccaaacaactgcaacaaagtcggaacataccggtagagaaatcgtcgatctaatgtgtcatgccacttttacaatgaggctactctcccccgttcgagtaccaaattataatctggtaatcatggatgaagcccacttcactgatccggcttcgattgcagcaaggggctatatatcaacacgagtaggaatgggagaagcggcagcaatatttatgactgccacacccccaggaactgccgacgcatttccccagtctaacgctccgatacaagacgaggaacgtgacatacctgaacgcagttggaactcaggtaacgagtggattacggattttgcaggaaagacggtctggttcgttccttctatcaaagctggaaatgatattgccaattgtctgaggaagaacggcaagaaagtaattcaattatccagaaaaaccttcgacacggaataccagaaaactaaactaaacgactgggactttgtcgtaacaactgatattagcgagatgggagccaatttcaaggcagatagagttattgacccaaggagatgtctaaaaccagtaatcctaacggacggaccagaacgagtaatcttagcaggccctatgccagtaactgcagcctccgcggcacagagaaggggaagagtcggaagaaacccacaaaaggaaaacgatcaatatatatttactggtcaacctttaaacaatgatgaggatcatgcgcactggactgaagcaaagatgcttttagataacataaacacacccgaagggataatcccggctttattcgaacctgaaagggaaaaatcggctgcaattgatggtgagtacagattgaaaggtgaatccaggaagacttttgtagagctcatgagaaggggtgatttaccggtctggttagctcataaagtagcgtctgaaggcataaaatatactgatcgaaagtggtgctttgatggagaacgaaacaaccagatcttggaagagaacatggatgtagaaatatggactaaggaaggtgaaagaaagaaattgaggcccaggtggctggatgccagaacgtacagcgacccactagctcttaaagagttcaaagactttgcggccggccgaaaaagcattgcattagaccttgtcaccgaaatagggcgagtcccaagccatttagctcatagaactagaaatgcactagataacttggttatgttacatacaagtgaacatggaggccgcgcgtatagacacgctgtagaagaactaccggaaacgatggaaacattactgttattaggattaatgatcttactaactggaggtgccatgctctttttaatatcaggtaaaggtataggaaagacctcgataggcctaatatgcgtaattgtgtctagtggaatgttgtggatggcggacgtacccttacaatggatagcgagtgcaatcgtgttagagttctttatgatggtccttttgatacccgagccagagaaacagcgtactccacaagataaccaattagcctacgtagtaatcggaatcctaaccttagcggctatcgttgcagctaatgaaatgggcctgttggaaacgacaaaaagagatttaggtatgagtaaagaaccgggcgtggttagccctacctcgtatctagatgtagatcttcatccagcaagtgcttggacactatacgcggtagccacaacagtaataacacctatgcttcgccatactattgagaactcaactgccaacgtgagtctagcagctatcgccaatcaagcagtagtattaatgggccttgacaagggatggccaataagtaaaatggacttgggggtacctttacttgcattaggctgctattcacaagtgaatccattaactcttaccgcagcagtattattgctggttacgcattatgcaatcatcggtccagggctacaagctaaggcaacaagagaagcgcaaaaacgaacggctgcagggataatgaaaaatccgactgttgatggcatcatgaccatcgatctagaccccgtaatatatgattctaaatttgagaagcagttaggtcaagtaatgctacttgtactttgcgccgtgcaattgttattaatgagaacatcctgggcattatgcgaagctctaactctagcaacagggcctattacaacattgtgggaaggatcaccgggaaaattctggaacacaacgattgcagtgagcatggcgaatatctttcgaggatcatatttggccggagctggtcttgccttctcaattatgaagtcagtaggaacaggacgacggggcacaggttcacaaggagagactttaggcgaaaaatggaaaaagaaattaaaccaattaagtcgaaaagagttcgatctttacaagaaatcaggaatcacagaagtggaccggacagaagcaaaggaaggtttgaagagaggagaaacgacacaccatgccgtctctcgaggttctgcaaaattacaatggtttgtagaaagaaacatggtaatacctgaaggaagagtaatagacctaggatgcggaaggggagggtggtcatattattgtgcgggattgaagaaagttaccgaagtaagaggttatacgaaaggagggcctgggcacgaagaacccgttcccatgtctacatatgggtggaacatcgtaaagctaatgagtggaaaagacgttttctatttaccacctgaaaaatgtgatactttattatgtgacattggggaaagctcgccttcaccgactgtagaagaatcaaggacgatcagagttttaaaaatggttgagccctggctacgtaataatcagttctgtattaaggtattaaacccttacatgcctactgtcatagaacacttggaaagattgcaaagaaaatacggtggtatgctggttagaaacccgttaagccgaaactcaacacatgaaatgtattggattagcaacggaaccggaaatatcgtaagcagcgtgaatatggtttcccgacttttactgaatcgtttcacaatgacacatcgaaggcctacaatagaaaaagatgttgacttgggagcgggtacccgccatgtaaacgcagaaccagagacacccaatatggatgttataggagagcgtatcaaacgtataaaggaagaacattcttccacgtggcattacgatgacgaaaatccctataagacatgggcctaccatggctcttacgaggttaaagctactggctctgcttcttctatgataaacggtgtagtaaaacttttaaccaagccatgggacgtggtaccaatggtaacgcaaatggctatgacagatactactcctttcggccaacagcgtgtgtttaaggaaaaagtggatacaaggacaccccgaccaatgcctggcactagaaaagtaatggaaataacagccgagtggctgtggcgcacgttgggtcgaaacaagaaacctaggctctgcacgcgcgaagaatttaccaagaaagtaagaacaaatgctgcaatgggtgctgtattcactgaggaaaaccagtgggactcagcgcgcgctgctgtagaagatgaagagttctggaaattagtggatcgagaaagggaattacacaaattagggaagtgcggctcttgtgtatacaacatgatgggcaagcgagagaagaaacttggggagttcggaaaagccaaaggatctagagcaatatggtacatgtggctaggcgcaaggtatcttgagttcgaggctttaggattccttaatgaagaccattggttttctcgggaaaactcctattctggagtcgagggagaaggcttacacaagctaggatacattctaagagatattagcaaaattccaggtggcgccatgtacgctgatgatacagcaggctgggacacgagaataactgaagacgatcttcacaacgaggagaaaataactcaacaaatggatccagaacatagacaacttgcgaatgccatatttaaattaacttatcaaaacaaagtggtaaaagttcaaaggccaactcctaaaggtaccgtaatggatatcatatcacgtaaggatcaacgcggaagcggccaagtcggtacatatggattgaatacttttaccaatatggaagcccagctagttcggcaaatggaaggtgaaggcgttctaagtaaagctgaccttgagaacccccacctattagagaagaaaataacgcaatggctagaaacaaagggcgtcgagcgcttaaaaagaatggcaatctctggagacgactgcgtagttaagccgattgatgatagattcgcaaatgcactactggcgttaaacgacatgggtaaagtaagaaaagacatacctcaatggcaacccagtaagggctggcatgactggcagcaggtaccattctgctcgcatcattttcacgaattaattatgaaagatggcagaaagctagttgtcccctgtagaccccaagacgaattaattggacgagctcgcatttcacaaggagcaggctggtctctaaaagagactgcatgcctaggtaaggcatacgcccagatgtggtcattgatgtattttcatcgccgggatctaagacttgcaagcaacgctatatgttcagctgtacccgtacactggataccaacgtccagaacgacttggagcatccatgctcatcatcagtggatgacaaccgaggatatgctaactgtatggaatagggtatggatagaagacaacccgtggatggaagacaaaactcccgtaactacatgggaggatgtcccatatctcggaaaacgagaagatcagtggtgtggctcgctgattgggcttaccagtcgagctacctgggcacaaaatatactaactgcgatacaacaggtacgatcactgataggtgacgaagagttcctcgattacatgcccagcatgaaacggttccgaaaagaagaggagtcagagggagcaatatggtaa

SEQ ID NO: 23150 - RNA, 9873 nt, synthetic construct
  misc_feature 1..9873: note = derived and/or modified CDS sequence (opt6) from DENV-3__FJ898463__SS-prME
  source 1..9873: mol_type = other RNA
acttccttgtgtttaatgatgattttaccagcagcacttgcatttcatttaacaagcagggacggtgaacctaggatgattgtaggtaaaaatgaacgcgggaaatccttacttttcaaaactgcttcaggaataaatatgtgcactttaattgcaatggacttaggtgaaatgtgtgacgacaccgtgacatacaaatgcccacatataacagaagtcgaaccagaagatatcgattgctggtgtaatttgacatccacatgggttacgtatggaacttgtaatcaagcaggagaacataggcgagataaacgctcagtagctttggcaccacacgtcggaatgggtcttgacacaagaactcaaacatggatgtctacagagggagcgtggcgccaagttgaaaaagtagaaacatgggcattaaggcatccaggtttcacgattttagcattatttctcgcgcactatataggaacttctttaacacaaaaagtagtaattttcattctgttaatgttggtaactccatcaatgacgatgcggtgcgtcggtgttggaaatcgagatttcgttgaaggattatctggcgcaacatgggtagacgtggtgttggagcacgggggatgcgtaactactatggccaaaaataaacccacgttagatatagaactccagaaaactgaagctactcaactcgctactctccgtaaattgtgtattgaaggcaaaatcaccaatattacgacagatagtagatgtcctacacaaggagaagctgtattacctgaagaacaagatcaaaactacgtctgtaaacacacctacgtagatagggggtggggcaatggatgtggattgttcggaaaagggtcgctagttacctgtgctaaatttcaatgcttagagccaatagaaggaaaagtagtacaatatgaaaacctaaaatacacggttattattacagtacatactggtgatcaacaccaagtcggaaatgaaactcaaggcgtaacagccgaaattacaccacaagccagtacaacggaggcaatacttccagagtatggaacgctaggtctcgaatgttcacctagaacagggctagattttaacgaaatgatcctcctaacaatgaaaaataaagcatggatggtccacagacaatggttctttgacttaccgttaccctggacaagcggagcgactactgaaacgccgacatggaataggaaagaattactggtaacttttaaaaatgcccacgccaagaaacaagaagtagtagtattgggctctcaagagggggcaatgcacaccgcactcaccggagctaccgagatccagaactccggagggacaagtatatttgcgggccacctaaaatgtagactaaaaatggataaattggagctaaaaggtatgtcatacgcaatgtgcaccaacacatttgtactaaagaaagaagtatcagaaactcaacatggaacaatcctcataaaagtagaatacaaaggagaagacgccccgtgcaaaataccttttagtacggaagatggccagggtaaagcacataacggacgtttaataacagctaacccagtcgtcactaagaaagaagaacccgtaaatattgaagcagaaccaccgttcggggaaagtaacatagtaatcggaattggggacaacgccttaaaaatcaattggtataagaaaggctcgagtattggcaaaatgttcgaagcaactgcaagaggagctagaagaatggcaatacttggtgacaccgcatgggacttcggcagtgtgggtggagtcttaaatagtctggggaaaatggtgcatcaaatcttcggttctgcctatacagcactattctcaggcgtgtcatgggtcatgaaaataggaataggggtattattaacttggataggactaaatagcaaaaatacgtcaatgtcctttagttgtatagcaattgggataataactctatacctcggagcagttgtccaagctgatatgggatgtgtaattaattggaaagggaaagagttaaaatgcggctctggaatttttgttactaatgaagtacacacttggactgaacagtataaattccaggctgattcacccaaacgtttagcaacggcaatagcaggagcatgggaaaacggcgtctgcggcattagatcaaccacaagaatggaaaaccttctctggaaacaaattgccaatgaactaaattatattttatgggagaacaacattaaacttacagttgtagtaggtgatataataggggtcctggaacaaggcaaacgaacattaacaccacagccaatggaactgaaatactcatggaaaacttggggcaaagctaaaatagtaacggcagaaacacaaaattcctcctttataatcgacggacctaacactccagagtgtccaagtgcgtctcgagcatggaatgtatgggaagtagaagattacgggttcggcgtatttaccacaaatatatggctaaaactccgtgaagtctatacgcaactctgtgaccaccgtttaatgtcagctgctgtcaaagatgaacgagccgtacatgcagacatgggttattggatagaatcacagaaaaatggctcgtggaaactagaaaaggcttctttaatagaggttaaaacgtgcacgtggccgaaaagtcataccctatggtctaatggagtcctggaaagtgatatgattataccaaaatcattagcaggacctatttcgcaacacaatcatagaccaggatatcacacacaaacagcgggaccctggcatttaggtaaattggagctggattttaactattgtgaaggcaccactgtggtgataacagaaaattgcgggacaagaggtcctagtcttagaacaacgacagtaagtggtaaattaatacacgaatggtgttgtcgctcatgtactctcccacccttaaggtacatgggggaagatggttgctggtacggaatggagattcgccctatcagtgagaaagaggagaatatggttaaatctttggtaagcgccggtagcggtaaagtagataattttacaatgggcgtactatgtttggcaatactatttgaagaagtaatgaggggcaaatttggcaagaaacatatgatagccggagtattctttacctttgtattattattaagcgggcaaattacatggcgcgatatggctcacacactgataatgatagggtcaaacgcatcagatcgcatggggatgggagtcacttacctcgcacttattgcgacctttaaaatacaacctttcttagcattaggatttttccttagaaaactcacaagtcgggagaatttgttattaggagtaggcttagccatggcgactacccttcaattgcccgaggatatagagcagatggctaacggaatagcactcggtttaatggccctaaaattgattacacagttcgaaacttaccagctttggaccgctttaatatctttaacatgctctaataccatgtttactctaacagtagcctggagaacagccacactaatattagctggtgtcagcttgttgcctgtttgtcagtcttcaagcatgagaaaaacagattggttgcccatggccgtggcagctatgggagttcctccactgccactattcatattttctttaaaagatactctaaagcgtcggtcatggccacttaatgaaggagttatggctgtcgggcttgtgtctattttggcgagtagtttactaagaaacgatgtaccaatggccggacctctagtagctggaggattactaattgcgtgttacgttataacaggcacaagtgctgatctaacagtagaaaaggcagcagatattacctgggaagaagaagctgaacaaacaggggtgagtcataacctcatgatcactgttgatgatgatggaacaatgcgtattaaggacgatgaaacagaaaatatattgactgtcctcctaaaaactgctctattaattgtaagcggcgtattcccatatagtataccggccacgttgttagtctggcacacatggcagaagcaaacacagaggtcaggagtgttatgggatgtccctagcccaccagaaacacaaaaagcagagctagaagaaggtgtataccgtatcaaacagcaagggatattcggaaaaacacaggtaggtgttggagtccagaaagagggggtcttccacaccatgtggcacgtgacgagaggtgcggtgctaacttataacgggaaaagactggaaccaaactgggcctcagtcaagaaagatcttatttcatatggtggagggtggagactatcagctcaatggcaaaaaggggaagaagtacaggtcattgccgtcgaaccggggaagaatcctaaaaactttcagactatgcctgggactttccaaactacgactggagaaattggggcaatagcattggatttcaagccaggcacgtcagggtctccaataattaacagggaagggaaggttgtaggactatacggaaatggcgtcgtcactaaaaatggaggttacgtatcaggcatagcccaaacaaacgctgagcctgacggtccaacaccagaattagaggaagaaatgttcaagaaacgcaacctaactataatggacttacatcctggctccggtaaaacaagaaagtatttgccggcaatagtaagagaagcaattaaacgaagattgagaacgttgattttagcacctacgagagtcgtggccgcagaaatggaagaagctctaaaaggactgccgattagatatcaaacgactgctacaaaaagtgagcacacaggtcgagaaattgtggaccttatgtgtcatgctacattcacgatgagattattaagtcccgtaagagtacctaactataaccttattatcatggatgaagctcatttcacagacccggcatccatcgcagcccgtggatacatttctacaagagttggcatgggggaggcagcggcgatattcatgacagcaacgcctccgggtacagcggacgcatttcctcagagtaatgctccaattcaagatgaagaaagagacattccagagcgcagttggaactctggaaatgaatggataacagactttgcggggaagacagtgtggtttgtgccgagtataaaagccggtaatgatatcgcaaattgtctacgtaaaaatggcaagaaagtgatacagttgtctaggaaaacatttgatacggaataccagaaaactaaactaaacgattgggacttcgttgttaccacagatatatcagaaatgggggctaatttcaaggctgatcgagtaatagatccacggcgttgtttgaaaccagtcattttgactgacggtccagaacgagttatattggcaggccccatgccagtgactgcagcatctgccgcacaaagaagggggagagtaggtcgaaattcccaaaaagagaatgatcaatatatattcacgggtcaacctttaaacaacgatgaagatcatgcacattggacagaagcaaaaatgttgttagacaatataaacacaccagaagggataataccagcgctattcgaaccggagagagaaaagtccgcggctatcgacggagaataccgattgaaaggggaaagtagaaaaacttttgttgaattgatgaggcgaggtgaccttccggtatggcttgcacacaaggtagcaagcgaagggataaaatacacagacaggaaatggtgttttgacggccaacggaataatcaaattttagaggaaaacatggatgtagagatatggacaaaggaaggagagaagaagaaacttcgacctcggtggttagatgcgagaacctattcagatccgttagcgctgaaggagttcaaagatttcgcagcaggacgaaaatcaattgcattggacctagtaacggaaataggcagggtaccatctcatttggcgcatcgcacacgaaacgctctggataaccttgtaatgcttcatacctctgagcatggcggccgggcatatcggcatgctgttgaggaacttccggagaccatggaaacattattactattaggattgatgattctgttaactggcggcgctatgctatttttgatatcaggcaaggggataggtaaaacctctataggactgatctgcgttattgcaagtagtggaatgctatggatggcagagattcctctgcaatggattgcgtccgcaatagttttggaatttttcatgatggtactactaatccctgaacctgaaaagcaacgtacaccgcaagataatcaactagcatatgtagttattggcatactaacactagcggcaataatagccgccaatgaaatggggcttctagagacgacaaaaagagatttaggaatgtctaaggaaccaggtgttgttagtccaacgtcttacttagatgtagaccttcacccggcatctgcctggacgctttatgctgtagctacgactgtaattactcctatgttacgccacacgattgagaactcaaccgccaacgtttcattggcagctatagcaaaccaagcggtagtgctgatgggattggataaaggctggccaataagcaagatggacctaggggtgcctctactggcgcttggatgctatagtcaggtaaatcctttaacattgactgcagccgtcctattacttattacccactacgcaataatcggtccaggattacaagcaaaagcaaccagagaggcacaaaaacgaaccgcagcaggaatcatgaaaaaccccacggtcgatggcattatgacaatcgatcttgatcccgttatttatgattcaaaatttgaaaaacagttgggacaagtgatgttattggtactttgtgcagtacaactgttacttatgcgtacatcgtgggctctatgtgaagcattaacactggccaccggtccgataacaacattatgggagggatcaccaggtaaattttggaataccacaatagcggtcagcatggccaacatctttaggggttcataccttgcaggagcgggactagcattctctatcatgaaaagcgtaggaaccgggaaacgagggactggaagtcaaggtgaaaccttaggcgaaaaatggaagaagaaactaaatcagctatcacggaaagaatttgatttatacaaaaagagtggaataacagaggtcgatcgaacagaagcaaaggaaggtttaaaaagaggcgagaccactcatcatgctgtaagtcgtgggagcgcgaaattacagtggtttgtagaaagaaatatggtaattccagagggaagagttatagatcttggctgcggacgtggaggttggtcctactactgtgccggactcaagaaagtaaccgaagtcaggggttatactaagggtggaccagggcatgaagaacccgtaccgatgagtacttacggatggaacatagtgaaacttatgtctggtaaagacgttttctatctaccaccagaaaagtgtgataccctgctttgcgacattggggaatcaagcccatctcccacagttgaagaaagtagaacaattagggttttgaaaatggtagaaccctggctcaaaaataatcaattttgcataaaggttctaaatccttatatgcccactgtcattgaacacctagaaagactacaaagaaaacatggcggcatgctagtgcgaaatccactatcaagaaattccacccatgagatgtattggatatcaaatggtactggaaatatagtggcaagtgtgaatatggtatcaaggctactactaaacaggtttactatgactcatagacgaccaacaatagaaaaagacgtagacttgggtgctggcacacgacacgtaaatgctgagccggaaactcccaatatggacgtaatcggagagcggataaaacgcatcaaggaagaacataactctacctggcattatgacgacgaaaacccttacaaaacatgggcataccacggatcatatgaagttaaagccacaggctcagccagtagcatgattaacggagttgtcaaattactgacgaaaccatgggacgttgttccaatggtaacacaaatggctatgacggatacgaccccgtttggacagcagcgagtgtttaaggaaaaagttgatacacgcacgccaagaagcatgccaggaacaagacgagtaatgggaataacggctgaatggctatggactaccttaggcagaaacaaaaagccaaggctgtgcacaagggaagaatttacgaagaaagttaggacaaacgcagccatgggagctgtctttaccgaggaaaatcaatgggattccgccaaggcggccgttgaagatgaagacttctggaagctagtagatcgagaacgtgaattacacaaactaggaaaatgtggaagttgcgtttataatatgatgggtaagcgagagaagaaattaggagaatttggaaaagcaaaaggaagtcgggcaatatggtatatgtggctaggtgcccgatacctagaatttgaggctttaggatttttaaacgaagaccactggttttctcgggaaaactcgtatagtggggttgaaggtgagggattacataaattaggatatattttacgcgatattagtaaaatccccggtggagcaatgtacgctgacgataccgcaggctgggacactagaataacagaggatgacctacacaatgaagagaagattacccagcaaatggatccagaacatcgccaactggcaaacgccatatttaaactaacataccaaaacaaagtcgttaaagtacaaagaccaacgcctaccggtactgtgatggatataatatcacgaaaggatcaacgaggttcaggacaagtgggtacttatgggctcaatacgttcacaaatatggaagcacaactaatacgtcaaatggagggggaaggcgtcttaagtaaagcggatctcgaaaatcctcacttaccggagaagaaaattacacaatggctggaaaccaaaggcgttgaacgccttaaaagaatggctatatctggcgatgattgtgtggtcaaaccaattgatgacagatttgctaatgcgttactcgctcttaacgatatgggtaaggtcagaaaagacatcccgcaatggcaaccaagtaagggctggcatgattggcaacaagtgccgttctgcagtcatcatttccatgaattgattatgaaagacggtcgtaaattggttgtaccttgtcgtccccaagatgaattaataggtcgtgcaagaattagtcagggggcagggtggagcctaagagaaactgcctgtttaggaaaagcgtatgcacaaatgtggagtttaatgtatttccatcgacgagatttaaggcttgcctcaaatgcaatatgctcagctgtaccagtgcattgggttccgacaagtaggacgacttggagtatacacgcacaccaccaatggatgacaaccgaagatatgctcacagtgtggaacagggtttggatagaagacaatccgtggatggaagataagacaccagtaacaacatgggaaaatgtgccctacctggggaagcgtgaggaccaatggtgtggctccctgattggattgacaagtagggcgacatgggctcagaatattccaactgcaatacagcaagttagatctctaatcgggaatgaggagtttctagactacatgcctagtatgaaacgattcaggaaggaagaagaatcggaaggtgccatatggtaa

SEQ ID NO: 23151 - RNA, 9873 nt, synthetic construct
  misc_feature 1..9873: note = derived and/or modified CDS sequence (opt6) from DENV-3__GQ868616__SS-prME
  source 1..9873: mol_type = other RNA
acttccctatgtcttatgatgattcttcctgcagcattagcttttcatttgactagcagagatggggaacctaggatgattgttggtaaaaatgaacggggaaaatctctattatttaaaacagcatcagggattaatatgtgtactcttatagcgatggatctcggagaaatgtgtgacgatacagttacatataaatgtcctcatatcacagaagtagagccagaggacatcgactgttggtgcaacctcacaagtacatgggttacttatggaacttgtaatcaagcaggagagcatcggagggataaaagatctgtcgcattagcgccccacgtcggcatgggtctagacactagaacacaaacatggatgagcacagaaggtgcatggagacaggtcgaaaaagttgaaacttgggcgttaagacatcctggattcactatactagcactattcttagcacactacatcgggacttcactgactcaaaaagtagtgatattcatactcctcatgctggtaacaccatccatgacgatgagatgtgttggagttggtaatagagatttcgtcgaaggattatcaggcgcaacttgggtcgatgtcgtattagaacatggagggtgtgtgaccaccatggctaaaaataaacccactctagatatagagcttcagaaaacagaagcaacccaattagctacactaaggaaattgtgcatagaaggtaaaataactaacataacaacggactctagatgtccgacacaaggtgaggcagtgcttcccgaagaacaggaccaaaattacgtctgcaaacacacatacgttgacagaggctggggtaatggatgtggcttgttcggaaaaggtagcctggtcacatgtgcgaaattccaatgtctggaaccaatagaagggaaagttgtacaatatgaaaatcttaaatacacagtcatcattacagtccataccggagatcagcaccaagtcgggaacgaaacccaaggagtgacagcagaaattacaccgcaagccagtacaaccgaggcaattctgccggaatacggtacattgggcttagagtgttctccccgaacaggactcgactttaatgaaatgatattacttactatgaaaaacaaagcgtggatggttcatcgccagtggtttttcgatcttcctctaccctggacgtctggcgcaacgaccgagacacctacctggaatcgcaaggaattactggttacattcaaaaacgcacatgccaaaaagcaggaagttgtagttttgggatcccaagaaggtgccatgcatacggcgctaacaggagcgacagaaattcaaaatagtgggggaacctcaatctttgctggtcatctaaaatgccgtctcaagatggacaaactagaattaaaaggtatgagttatgcgatgtgcacaaatacgtttgtattgaagaaagaagtcagcgaaacacaacatgggacgattttaatcaaggtagaatataaaggcgaagacgcaccatgtaaaattccattttccaccgaggatggtcaagggaaagcacacaacggccggctcattacagccaaccctgtagtcacaaagaaagaagaaccagtaaatatagaggcagagccaccattcggtgaatcgaatattgtgattggtataggagacaatgcactcaaaataaattggtacaagaaaggttcatcgattggaaaaatgttcgaagcgaccgcacgtggcgcaagacggatggcgatcttgggcgacacagcatgggattttggtagtgtcggaggagttctaaattctctaggaaagatggtgcatcagatttttggatcagcttacacagctctattttccggagtttcatgggtgatgaaaatcgggataggagttctactgacatggattggattaaacagcaagaatacaagtatgtcattttcgtgcatcgcaataggaataattacgctttaccttggtgctgtggttcaagctgacatgggatgtgtaattaattggaaaggtaaagaactgaagtgcggtagtggtatcttcgtaactaacgaagtccatacgtggacagaacaatataagtttcaagcggactcgcccaagcggcttgcaaccgcaatcgctggagcttgggaaaatggagtttgcggcattcgatccactactagaatggaaaatttgctgtggaaacagatcgcaaatgagctgaattatatactatgggaaaacaacataaaattgacagtagtcgtaggtgatataattggagtattggagcagggcaagagaacgctgactcctcaaccaatggagcttaaatacagttggaagacctgggggaaagcgaagattgttacagcagaaactcaaaattcgagcttcatcatagacggtccaaatacgcctgaatgtccctctgcatcaagagcatggaatgtatgggaggtcgaagactacggtttcggcgtatttactacaaacatatggttaaaacttagagaagtttacacacaactgtgcgatcatcgactgatgtcagcagctgttaaagatgaaagagctgtgcacgccgatatgggatactggatagaatctcaaaagaatggaagttggaagttagaaaaggcaagtttaatagaggtaaaaacctgtacgtggccaaaatcacatacattatggagcaacggtgtactagagtcggatatgattatacccaaatctctagcaggaccaatcagccaacataaccatcgtccagggtatcacacacagaccgctggtccatggcatttgggaaagctcgagctagactttaactattgtgaaggcactactgtagtaattacggaaaactgtgggactaggggaccttcattaagaacaacgacggtgtcgggtaaattgatacacgaatggtgctgccggtcatgtacactaccgcctttaagatatatgggagaagatgggtgctggtacggaatggaaataaggcctatcagtgaaaaagaggaaaacatggtcaaatctttagtaagtgccggcagcggtaaagtggataacttcactatgggagtattatgcctcgcaatcttatttgaagaagttatgagagggaaattcggcaagaaacatatgatagccggtgtcttctttacgtttgtactacttttgagcggtcaaattacgtggcgagacatggcacacacactcataatgatagggtctaatgcttccgatagaatgggtatgggtgttacatacctcgcgctaatagctacctttaaaatacagccgtttttagcgttaggattctttttgagaaaactcacttcacgcgaaaacctcctattaggagttggcttagcaatggcaaccaccttacaactacctgaggacatagaacaaatggcaaacggcatagcactaggactgatggcgcttaaattaattacacaatttgaaacttatcaattgtggactgccctgatctctctgacgtgttctaatacaatgttcacactcaccgtagcatggagaactgccactttaatactagctggtgtatcattgttgcctgtctgccaatcctcttccatgcgtaagacagactggctgcctatggcagtggctgcaatgggggttccacctctacctctatttatcttcagtttaaaggacacattgaaaagacgaagttggccgttaaatgaaggagtaatggccgtcgggctagtaagtattcttgctagtagtctattaaggaatgatgtccccatggcaggaccgttagtcgcagggggcttactcatagcatgttacgttataaccggtacgagtgcggacttaacagttgagaaagcagcggacataacgtgggaagaagaggctgaacaaacaggtgtatctcacaatctcatgattactgtcgatgacgatgggacaatgagaattaaagatgacgaaaccgaaaatattcttacagttttgcttaaaacggcattgttaatagtatctggtgttttcccttattcaattccagctaccctcttagtctggcatacctggcaaaagcaaacacaaagaagcggtgtattatgggacgtcccaagcccaccagagacgcaaaaagcagaattggaggagggagtttataggataaaacaacaaggcatctttggaaaaacgcaggtaggggtaggagtacaaaaggaaggagtttttcacaccatgtggcatgtaacaagaggcgctgtacttacttacaacggcaaacgacttgaaccaaattgggcctcggtaaagaaagatttgatatcatatggaggaggatggagactttccgcgcaatggcaaaaaggagaagaagtccaagtaatagctgtggaaccagggaaaaatccgaaaaactttcaaaccatgccaggtacatttcaaacgacaacaggcgaaataggtgcaatagccctggattttaaacccggcacatccgggagtccgattattaatagagaaggcaaagtcgtaggactctatggaaacggtgtagtaaccaaaaatggtggttatgtcagtggaatcgcacaaactaatgcagaaccggatggtccgacaccagagttggaagaagaaatgtttaagaaaaggaaccttacgatcatggatttacacccaggatctggcaagacccggaagtatttacccgcaatagtaagggaggcaataaaaagaaggttacggacacttatattagctcccacaagagtagtagcagccgaaatggaggaagcattaaaaggactgcccatcagatatcagacaacagcaacaaaaagcgaacacacaggacgggaaatagtcgatttgatgtgtcatgctacatttacaatgcgacttttaagcccggtgagagtaccaaactataatctgataataatggacgaggctcattttacggatccggcatcaattgctgctcgtggttatatatcaacaagagtaggcatgggcgaagctgcagcaatatttatgacagcaaccccgccaggcactgcagacgcgtttcctcaatcgaatgctccaattcaagatgaagaaagagacattccagaacgttcatggaacagtggtaacgagtggataaccgacttcgcaggaaaaacagtatggtttgtgccaagtatcaaagccggaaacgatatagcaaattgtctccgtaaaaatggtaagaaagtaatacaattaagtcggaaaacatttgacacagaatatcaaaagactaaacttaacgattgggatttcgtagtcactaccgatatctcggagatgggagccaacttcaaagccgacagggtgattgaccccagaagatgtttaaaaccggtgattttaacagacggacctgaaagagtaattctagccggaccaatgccggttaccgcggcatcggccgcccaaagaagaggaagagttggtagaaattcgcaaaaagagaatgaccaatacatattcacaggtcaacctttaaacaatgatgaagatcatgcacattggactgaggcaaaaatgttattagacaacataaacacgcctgagggaatcataccagcgttatttgagccagagagagagaaaagcgcagccatagacggggagtacagattaaaaggagaatcacgaaaaacattcgtagagttgatgagacgcggagatctacctgtttggttagcacataaagttgcaagtgaaggtattaagtatacagacaggaaatggtgttttgacgggcaacgtaataaccaaattttagaagaaaatatggatgtggaaatatggacaaaagaaggtgagaagaagaaattgcgaccaagatggctggacgcgcgaacatacagtgatcctttagcactaaaagaatttaaagactttgccgcagggcgaaagagcatagcattagacttagtaaccgaaatagggcgtgtgcccagtcatctagcacataggactcgaaacgcgcttgataatttagttatgctacacacatctgagcacgggggaagggcttacaggcatgcagttgaagaactgccggaaacgatggagaccttgctacttttaggattaatgattttactcacgggcggggctatgctctttcttatttctggaaaaggaattggtaagactagcatcggacttatttgtgtaatagcatcctcagggatgctctggatggccgaaatccccctacagtggatcgcgagtgccattgtattggaatttttcatgatggtgttattaatcccggaaccggagaaacaacgtacgccgcaggataaccaattagcctatgtcgttatagggatactaacgctcgcggcaatcatagcagctaacgaaatgggtttactggaaactaccaaaagggatttaggaatgtcgaaggaacctggagtcgtttcgccaacatcatatttggatgtagatctccatccagcaagtgcatggactctctatgctgtagccacaacagtaattacacctatgttacgccacacaattgaaaattccacagctaatgtatcactagctgcgattgcaaatcaagctgtagtccttatgggactggataaaggttggcctattagcaaaatggatttaggagttcccttattagccctcggatgctattctcaagtaaatcccctcacactaacagcagctgttttacttttgatcacacactatgcaataatcggtccaggactacaggcgaaggccacacgagaagcacaaaagagaaccgccgctggtattatgaaaaatcctacggtggatggcataatgaccatagctttagatcccgtaatatatgatagtaaatttgaaaaacaattaggacaagtaatgcttcttgtgttgtgcgcagtgcagctcttgctaatgagaacatcatgggctctctgtgaggcgctaacattggcaacaggtcctataacaaccttgtgggaagggtcgccaggtaaattttggaataccacaatagctgtctcaatggcaaatatattcagaggaagctacctagctggagcaggcttagcattttctattatgaaaagcgtgggaacggggaaaagaggcaccggttcccaaggtgagacactcggcgaaaaatggaaaaagaaattaaatcaactaagtagaaaagagttcgatttgtataagaaatctggtataacagaagtggaccgtactgaagccaaagagggcttaaagagaggcgaaacgacacaccacgcagtttcgagaggctcagcaaaactacaatggtttgtggaacggaacatggtcatacccgaagggcgtgttatagatttaggttgcggaagaggtggttggagctactattgtgcggggctcaagaaagttacagaagtaaggggctacactaagggaggaccgggacacgaagaaccagttccaatgtctacctatggttggaatatcgtaaaacttatgtcaggtaaagacgtcttctatttaccgccagagaaatgcgatactctactttgcgacattggggaatcttcgccatcgccaactgttgaagaaagcaggacaataagggtgctaaaaatggttgaaccctggctcaaaaacaatcaattttgtataaaagtgttaaatccatatatgccaactgtaatagaacatctagaaaggttacaaaggaaacatggcggaatgctagtgcgcaatcctctttctagaaatagcacacacgaaatgtactggatttcgaacggaacggggaatatagtagctagtgtcaatatggtaagtcgtttactattaaatcgctttacaatgacgcacaggcgtccgactatagagaaagatgtagacttaggggctggaacgagacatgtcaatgcagaaccagaaacccccaatatggacgttattggtgaacgtataaagaggattaaagaagaacataactccacatggcattatgatgacgaaaatccctataaaacctgggcataccatgggagctatgaagtcaaagcaactggatcagcaagttcaatgatcaacggtgtcgtcaaattattaacaaaaccttgggatgttgttcccatggttacacaaatggcaatgacggataccaccccatttggacaacagagggtcttcaaagaaaaggtagatacgaggacaccgagaagtatgccaggtactcggagagtaatggggatcacacccgaatggctctggagaccactggggcgtaacaagaagccaaggctatgtccgagagaagagttcaccaagaaagtaaggactaatgccccaatgggagctgtgtttacggaagagactcaatgggcaagtgctaaggcggcagttgaagacgaagatttttggaagctagtcgatcgtgaaagggagctacacaaattgggaaagtgcggctcttgtgtatacaatatgatgggaaaacgtgagaagaagttgggagagttcggtaaagctaaaggaagtagagcaatatggtatatgtggttaggggcaagatatctggaatttgaagcactaggctttcttaatgaagaccattggttttcaagagagaactcatattctggagtagaaggagaaggtctccctaagctagggtacatattaagggacatatcaaagattcccggcggggcgatgtatgccgacgatacggctggttgggacacacgaattacagaggatgatctccataatgaggaaaagataacacagcaaatggaccccgaacaccgccaactagcaaacgcgatttttaagttaacttatcaaaacaaagtagtcaaagtacagagacctactccgacaggtaccgtcatggatatcatatcaagaaaggatcaaagaggttcgggacaagtaggtacttatggactaaatacatttaccaacatggaagctcaattgattaggcaaatggaaggcgaaggagttctaagtaaggcagaccttgaaaacccgcacttaccagagaagaaaataactcagtggctagaaactaaaggagttgaaagactgaaaagaatggcaatcagtggtgacgattgtgtcgtaaaaccaattgatgatagatttgctaatgccctactggcgctcaacgatatggggaaagtccgaaaagatataccccaatggcaacctagcaaaggatggcacgattggcagcaggttccattctgcagccatcattttcatgaactaataatgaaagacggaaggaaattggtagtaccctgccgaccacaagatgagttaataggacgtgcaagaatctctcaaggtgcagggtggtcccttagagaaacggcgtgtctaggaaaagcctacgctcaaatgtggagccttatgtattttcaccgtcgagatctgagattggctagtaatgcaatatgtagcgccgtacccgtacactgggtcccaacatctcgaacaacttggtctattcacgctcatcatcaatggatgacgacggaagacatgctaactgtttggaaccgtgtttggatagaggacaatccatggatggaggataaaacaccagttacaacatgggaaaatgtaccatatttaggtaaacgagaagatcaatggtgtggatcactcataggtctcacttcaagagccacgtgggcccaaaacattccaacggccatccaacaagtcagatcgttaattggtaacgaagaatttttagattatatgccatctatgaagaggtttcgtaaagaagaagaaagtgagggtgcaatatggtaa

SEQ ID NO: 23152 - RNA, 9873 nt, synthetic construct
  misc_feature 1..9873: note = derived and/or modified CDS sequence (opt6) from DENV-3__GQ199887__SS-prME
  source 1..9873: mol_type = other RNA
acctcattatgcttaatgatgatactaccagcagcactagcttttcatttgacttccagagatggagaaccacgtatgatagtgggcaaaaatgaaagaggaaaatcattgcttttcaaaactgcatctggaattaatatgtgcacgttgatagcaatggatctaggagaaatgtgtgatgacactgtaacgtacaaatgcccgcacattacagaagtagaaccggaagacatagattgctggtgcaacttaacttctacatgggtcacttatggaacatgcaatcaagcgggagaacatcgacgggacaaacggagcgtagcccttgcaccccacgtagggatgggtctggacacgagaactcaaacgtggatgtcagcagaaggtgcgtggagacaagtagaaaaagtggaaacatgggcgttaagacatcctgggttcaccatattagcgcttttcttagctcattatatcggaacttccctaacccaaaaagtagttatcttcatcctattaatgttagtcacacccagcatgacaatgaggtgcgtcggggttggaaatcgtgatttcgtagaaggattaagcggtgcgacctgggtagatgtagtactagaacatggtggatgtgtaactacaatggccaaaaataaaccaactctggacatagaattacagaaaaccgaagcaacacaattggcgacgcttagaaaattatgtatagaaggaaaaataaccaacattactactgactcacgatgtccaacgcaaggtgaagcagtactcccagaggaacaagaccaaaattatgtatgtaaacatacctacgtggatcgaggttggggtaatggatgtggtctattcggtaaaggatcattggttacatgtgctaaatttcaatgccttgaatcaatagaaggaaaagtcgttcaatatgaaaacttgaaatacacagtaattatcacagtacacacgggagatcagcaccaagtaggtaatgagacacaaggagttacagctgaaattacaccgcaagcaagtacaactgaagcaattttacctgaatatggtactctcggtttagaatgtagtccccgtacaggactagacttcaacgagatgattctgttgaccatgaaaaataaggcttggatggtccatagacagtggttctttgatcttccgcttccttggacatcaggtgcaactaccgaaacccctacatggaatcgaaaagaattactggtcaccttcaaaaacgcacacgctaagaaacaagaagttgtggtgctaggatcccaagaaggggctatgcatacggctttaacaggggcgacagaaattcaaaacagtggaggtacctcaattttcgcaggtcatttaaaatgtcgactgaaaatggacaaattggaattgaaaggaatgtcttatgcgatgtgtacaaacacttttgtgttaaagaaagaagtaagtgaaacacaacacgggactatcctagtaaaagtagagtataaaggtgaagacgctccatgtaaaataccattttccactgaggacggacagggaaaagcccataatggccgacttattacggctaatcctgttgttacaaagaaagaagaacccgttaacattgaagcagaaccaccgtttggagagtctaatatcgtcataggcattggcgacaacgcattaaaaatcaactggtataagaaaggcagttcaataggtaaaatgttcgaagcgacggcacgaggagccagaagaatggccattttaggtgatacagcgtgggacttcggttcggtgggaggagtattaaattcattgggaaaaatggtacatcagatatttggtagtgcttatactgctctatttagtggggtaagttgggtaatgaaaataggaatcggagtgctactaacctggatcggtctaaattcgaaaaatacaagtatgtcattttcatgtattgctatcggcatcataactctatatttaggtgcggtcgtacaggctgacatgggctgcgtaataaactggaaaggcaaagaacttaaatgtggcagcggaatttttgtcaccaacgaagtccacacgtggacagaacaatacaaatttcaagcggattcaccaaaaagattggcaacagccatagcaggcgcttgggagaatggcgtctgcgggattcgtagcaccactaggatggaaaatctgctttggaaacaaatagcaaatgagttaaactatatcctatgggaaaataacataaaattaacagtggtggtaggggacaccatcggagtgctggaacaagggaaacgtacactaacaccacaaccaatggagcttaaatactcttggaaaacttggggaaaagcaaaaatagtgaccgccgaaatacagaactcctcattcatcatagacggaccaaatacaccagagtgtccatctgctagtagagcatggaacgtttgggaagtagaagactatgggttcggtgtatttacgactaatatttggctaaaattaagagaggtctatacccagctctgtgatcatagattgatgagcgcagcagtaaaagacgaaagagccgtgcatgcagatatgggatactggatagagagtcagaaaaatggatcatggaaacttgagaaagcatcattcatagaggttaaaacatgtacgtggcctaaatcacataccctatggtctaatggcgttttggaatctgatatgataattccaaaatcactggcgggtccaatatcacaacataactatcgcccaggttatcacactcagacagcgggaccgtggcatttaggcaaactcgaattagattttaattactgtgaaggcaccactgttgtaataactgaaaattgtggaacacgcggtccatcccttagaacaactactgtgagcgggaaacttattcatgaatggtgttgccgttcttgtactctaccaccattgcgatatatgggagaggacggatgttggtatggcatggagattagacctatatctgaaaaagaagaaaacatggttaaatcgttagcatcagcagggagcggaaaagtcgataattttaccatgggcgtactatgtttagcaattttgttcgaagaagttatgagaggaaaatttggcaagaaacacatgatagcaggagtgttcttcacattcgtattactgctatcgggacaaatcacctggcgtgacatggctcatactcttattatgattggcagcaatgcatccgaccgaatgggcatgggggtaacgtacctcgcactcatagcaacatttaaaatacaaccttttctcgcgctcggatttttcctgcgtaagctgacttcacgggaaaatctactattgggagtcggtttagctatggcgaccacactccaactaccagaagacatagaacaaatggcaaatggaatagcactaggcctcatggctctgaaattaatcacacagtttgaaacgtatcaactttggacagcattagtgagcctgacatgttccaatacaatgtttaccttaactgttgcctggaggacagcaactttaatattagcgggagtatcattattacccgtatgtcagagtagttcaatgaggaagaccgattggctgcctatgacggtagccgcaatgggcgtaccaccactgccattatttattttcagcctaaaggatacgctaaagaggcgttcatggcccctaaacgagggagttatggcggtaggattagtaagcattttggcctcatcactcttacggaatgacgtacctatggctggacccttagtcgcgggtggattactaatcgcgtgctatgtaataacaggcacaagtgcagatctaacagtcgaaaaagctgccgatgttacatgggaagaagaagctgaacagacgggtgtatcgcataatttgatgataacggttgatgatgacggaactatgagaataaaagatgacgagacagaaaatatcttaaccgtattattgaaaacagctctattgatcgtaagcgggatattcccatactcaataccagcgacactcttagtatggcatacatggcaaaaacagacacagcgaagcggggtcctttgggacgtgccttcacccccggagacacaaaaggcagaactagaagagggcgtttaccgaataaaacagcaaggtatcttaggaaagacacaggtcggtgtcggagtgcaaaaagaaggagtgtttcacacaatgtggcatgtgacacgcggagcggtattaacgcataatgggaaaagattagaaccaaattgggccagcgtcaagaaagacttgatatcatacggcggtggatggagactatctgcacaatggcaaaaaggagaggaagttcaggtaatcgcagtcgaacccggcaaaaatcccaaaaattttcaaactatgccaggtacattccaaacaacaactggtgaaattggagcgattgctctagattttaaaccgggcacgtcagggagcccaattatcaacagagagggaaaagtggtcggactttacggcaatggagtagtaacgaaaaacgggggatatgtgagcggtattgcacaaacaaatgcagaacctgacggtcccacaccagagcttgaagaggaaatgtttcgcaagagaaatcttacgataatggacttacatcctgggtcgggcaagacgagaaagtatctccccgctatagttagagaagctatcaagagaaggctacggactcttatcttagcacctacacgagtagtggcagcggaaatggaagaagcattgaaaggcttaccgataagataccagacaaccgcgacaaaatcggagcataccggaagggagatcgtagatctaatgtgccatgctacatttacaatgagattgttgtctcctgtgcgggtgccaaattataacctcataataatggatgaagctcatttcacagatcctgccagtattgcagcaagaggctacatttcaacgcgagtcggtatgggagaggcggctgctattttcatgacagcaacaccaccaggaacggcagatgcgtttcctcaaagtaatgctccaatccaagacgaagagagagatattcctgaaagaagctggaactccggcaatgaatggattacagattttgccggtaaaacggtatggtttgtgcccagtatcaaagcggggaacgacattgctaattgcctacgtaagaatggtaagaaagtcattcaactatcacgaaaaacatttgacaccgaatatcagaagacaaaacttaatgattgggatttcgtagtcactacagacatcagtgaaatgggcgcaaactttaaagcagatagggttattgatccccgaagatgcttaaaaccggttatattgaccgatggtcctgaacgagtaatactagcaggccctatgccagtcacagcggcaagtgctgcacagcgacgagggagagtaggtagaaaccctcaaaaagagaatgaccaatatatatttacaggacaaccgttgaataacgatgaagaccatgcacactggacggaagcaaaaatgctcttagacaacataaacaccccagaaggcattatccctgctctatttgaacccgaacgcgagaaaagtgctgccatagatggtgaataccgtcttaaaggtgagagtcggaaaacatttgttgagcttatgagacgaggggacttgcccgtatggctagcgcataaagtagcatcagaagggatcaagtacaccgaccggaagtggtgttttgatggccaaagaaataatcaaatactcgaagaaaatatggatgtagaaatatggacgaaagagggagagaagaagaaattaagaccaagatggctggacgcacgaacttatagcgaccctttagcgttaaaagaatttaaagacttcgcggctggcagaaaatcgatcgcattggacttagtaacagagataggacgagtcccatcacatctggcacatcgaacgagaaatgcgttggataatcttgtaatgttacatacctcagaacatggtgggagagcatatagacatgctgtggaagaactccctgaaacaatggagacactccttcttttaggattaatgatcctattaaccgggggagtaatgttatttttaatctcaggaaagggaattggaaagacgtcaattggattaatatgtgtaatcgcgagtagcggcatgctttggatggccgacgtcccccttcaatggatcgcatcagctatagtgctagagttctttatgatggttctgctaattccggaaccggaaaagcaaagaacgccgcaggacaaccagctggcatacgtagtcataggtatactcacacttgcggcgattatcgcagcgaatgaaatgggtctcctcgagacaaccaagagggatcttggcatgagtaaagaaccgggagtagtatcaccgacaagttatcttgatgtggatctccatccagcatcagcatggacattatacgcagtggcaacaacagttataacacccatgcttcgccacacaatagaaaactcaactgcgaacgtatcattagctgctattgctaatcaggcagttgttctgatgggtttagataaaggctggccgataagcaagatggatttaggcgtcccgcttttagcgctggggtgttattcacaagttaaccctttaactctcaccgcggcagtcctattattaattacacactacgccatcataggccctggactccaggcaaaggctaccagggaagcgcaaaaacgaaccgcagcaggtattatgaaaaatccaacggttgatggcataatgacaattgacttagaccccgtgatctatgactcaaaattcgaaaaacaattaggacaagtcatgcttctggtattgtgcgctgttcaattactgttaatgcgaacatcatgggcactatgcgaagcgctaactcttgcgacaggaccaataaccacattgtgggagggttcaccaggtaagttctggaataccaccatagctgtttccatggcaaatatctttcgcggatcatatctggcaggggccggcctagcattctctataatgaagtcggtcggaaccgggaaacgaggcacagggagccagggggaaacattgggcgaaaagtggaaaaagaagttgaatcagttatcgaggaaagaatttgacctgtacaagaaatctggaataaccgaagttgatcgaaccgaggcaaaagaaggcctaaaaaggggcgaaactactcaccatgctgtttcccgtggatcagccaaactacaatggttcgtagaaagaaacatggttatcccggaaggtagggttatcgacctggggtgcggaagaggcggatggagctactactgtgctgggttgaagaaagtgacagaggtcagaggatacacaaaaggtggacctggacatgaggaaccagtaccaatgagtacatacgggtggaatattgtaaagctgatgtccggaaaggatgtattctacttgcctccggaaaaatgtgatacactattatgtgatatcggagaaagttcaccgagccctacagttgaagaatcacggacaatccgagtattgaaaatggttgaaccttggttgaaaaataatcaattttgcatcaaagtactaaatccgtatatgcctacagtcatcgagcacctcgaaagacttcaaagaaaacacgggggtatgctagtgcgaaaccctttatcgagaaactcgacacacgaaatgtactggatatcgaacggtaccggtaatatcgtttcctctgtgaatatggtttcccgtcttttattaaataggttcacgatgactcatagaagacccactatagaaagagacgtagatttaggtgccggaacgaggcatgtgaacgctgaacccgagatccccaatatggatgtaatcggagaacgaataaaaagaataaaagaagaacataatagtacctggcactatgacgatgaaaatccatacaaaacctgggcataccatgggtcctacgaagtaaaagcaaccggcagtgcatcaagtatgataaacggagtagtaaaactcctaacaaaaccatgggatgtggtgcccatggtaacacaaatggcaatgaccgacacgactccattcggtcaacaaagagtatttaaggagaaagttgatactagaactcctcggcccatgccagggacaagaaaagtaatggaaataactgctgaatggctatggcgtacgttagggcgcaacaagcgccctaggttatgcacaagagaagagtttacaaagaaagttcgcacaaacgccgcgatgggtgccgtatttacggaagagaatcaatgggactcggccaaagccgctgtagaagacgaagagttctggaagttagtagatagggagcgggagctgcataaactgggcaaatgtggttcttgcgtatacaatatgatgggaaaaagagagaagaaattaggagaatttggcaaagcaaaaggctcacgagcgatttggtatatgtggctaggtgctcgatacttagaatttgaagcattagggtttttaaatgaggaccattggttctctcgtgaaaactcgtatagcggagtagaaggagaaggattgcacaagttaggttacattttacgggatattagtaaaataccaggcggagcgatgtacgcggacgatactgcaggttgggatacaagaataacggaagatgatttacataacgaagagaaaattacacaacaaatggatcccgaacacaggcaactagctaatgcaatcttcaaattgacataccaaaacaaagttgttaaggttcagaggcccacacctacaggcactgtgatggatatcataagcagaaaagaccagcgtggtagcggtcaggttgggacctacggattaaacacttttacgaatatggaagcacaactggtcagacaaatggaaggagaaggagtgttatcaaaagccgacttagaaaacccacaccttttggagaagaaaataacacaatggttagaaactaaaggagtagaacgattaaagcggatggcaatatcgggagacgattgcgttgtgaagccaattgatgatcgattcgccaatgccctcctagcattaaatgatatgggaaaagtccgaaaagatattccgcaatggcaaccgagcaaaggatggcacgactggcaacaggtaccattttgctcgcatcattttcatgaattaattatgaaagacgggagaaaattagtggttccctgtcgaccccaagacgaacttataggtagggctcgtatatctcaaggagcaggctggtccctccgagaaacggcttgtttaggcaaggcttatgctcagatgtggagtcttatgtatttccacagaagagatctacgactagcatcaaatgcgatctgctcagcagtaccagtccactgggtcccgacttcgcggacgacatggtcaatacatgcccaccatcaatggatgacaacagaagacatgctcacggtctggaacagggtttggatagaagataatccatggatggaggacaaaacaccagtgactacatgggaaaacgtgccttacttgggcaaaagagaagaccaatggtgcggttcgttgattggcttaacctcacgagcgacatgggcacaaaacattcccacagcaatccagcaagtacgatcattaatcggaaacgaggaatttctagactatatgcccagtatgaaaagattccgaaaagaggaggaaagtgaaggagctatctggtag

SEQ ID NO: 23153 - RNA, 9873 nt, synthetic construct
  misc_feature 1..9873: note = derived and/or modified CDS sequence (opt6) from DENV-3__GQ199888__SS-prME
  source 1..9873: mol_type = other RNA
accagcctttgcctgatgatgattttgcccgcagcactagcctttcatttgacgagtagagatggagaaccacgtatgatcgtgggtaaaaatgaaagaggcaaatcactcttatttaaaacggcttcaggaattaatatgtgtacactaatagcgatggatctcggtgaaatgtgcgatgacaccgtgacttacaaatgcccccacataactgaagtcgaaccggaagatatcgattgttggtgtaacctcacttcaacctgggtaacttatggaacttgtaatcaagcaggagaacatagaagagataaaagaagtgtagccctagctccacacgttggcatggggttagataccagaacgcaaacatggatgagcgcagagggggcttggagacaagttgagaaagttgaaacttgggcgcttcgacatcccggattcactatacttgcactatttcttgctcactatatcggaacatccctaactcaaaaagttgtgatatttatactgttaatgttagtaactccgagtatgacgatgcgttgcgtaggggttgggaatagggacttcgttgaaggactaagtggcgcaacctgggtagacgtcgtattagaacacggaggttgcgtcactacaatggccaaaaataaacccacccttgatattgaattgcagaaaaccgaagccacacaacttgcaactctccgcaaactctgtatagaagggaaaataacgaatataacgacagactctagatgtcccacccaaggagaagccgtattgccggaagaacaagatcaaaactacgtatgtaaacatacgtatgtcgacagaggatggggaaatggttgtggcttgtttggcaaaggttcactcgttacatgtgcgaaatttcagtgcttagaatcaattgaagggaaagtggttcaatacgaaaacctgaaatatacagtgataatcacagtgcatactggagaccaacaccaagtgggaaacgagacacagggcgtaaccgctgagattacaccacaggcatcaactacagaagcgatcctccccgaatatgggacgcttggactggaatgttccccacgtaccggattagatttcaacgagatgatacttttaaccatgaaaaacaaagcatggatggtacatcgacagtggttcttcgatttgcctttgccctggacaagtggggctacaacagaaactccaacgtggaaccgaaaagaactattagttacttttaagaatgcacatgctaaaaagcaggaggtcgtcgttttaggctcgcaagaaggggccatgcatactgccttaactggagctacagaaatccagaatagtggaggcacaagtatatttgctggacacttgaaatgccgacttaaaatggataaattagaattaaaaggtatgtcatatgctatgtgcacaaacacgttcgtgctaaagaaagaggtcagtgaaactcaacacggcacaattttagtcaaggtcgaatataaaggagaagacgcaccctgcaaaattccgtttagtactgaagatggtcagggaaaagcacataacggcaggctaataacagcaaatcctgttgtcactaagaaagaagaaccagtcaatatagaagcagagccaccatttggcgaatctaatatcgtaattggaacgggggacaatgcactgaagataaattggtataaaaagggctcctctattggcaaaatgttcgaagcaacagcacgtggagctcgcagaatggctattttaggcgatactgcttgggacttcgggagcgttggaggggtcctaaattcccttggcaaaatggtccaccagatttttgggagcgcctacactgctttgtttagcggcgtcagctgggtaatgaaaatagggattggtgtcctactaacgtggatcggtctgaacagcaaaaatacatccatgtcattctcatgtatagcgattgggattataacattatacttaggtgccgtcgtacaagcggatatgggttgtgttataaactggaaggggaaagaacttaaatgtggtagcgggatatttgtaactaatgaggtccatacctggactgagcaatataagtttcaagcagacagtccaaaaaggcttgcaaccgcaatagctggtgcatgggaaaacggggtatgcggcattcgtagtaccactcgtatggaaaatctactctggaaacaaatcgctaacgaacttaattatatcctctgggaaaacaatattaagttaacagtggtcgtcggagatacaataggagtactagagcaaggtaaaagaacattaaccccacagccgatggaactcaagtactcatggaagacatgggggaaagcaaagatcgtgacagcggagatacagaatagctccttcataatcgatgggccaaatacccccgaatgtcctagcgcaagcagggcatggaatgtatgggaagtagaagactacggttttggagtattcacaactaacatatggttgaaacttagagaagtatacactcaattgtgcgaccatcggttaatgagtgccgctgtgaaagatgagagagccgtacatgcagacatgggatattggattgagtcacagaaaaacggcagttggaagttggagaaagccagctttatagaagtaaaaacatgtacttggccaaagagtcatacattgtggtccaacggtgtattagaatctgatatgatcatccccaagtcgctagctggacctatctcccaacataattatcgcccaggctatcacacgcaaacagctggaccttggcatttagggaaactagagttagacttcaattattgcgaagggacaacagtggtaatcacggaaaattgtggcaccagagggccgtccttaagaactacaacggtatcaggcaaattaatacacgagtggtgttgccgaagttgcacacttcctccactacgatacatgggtgaagacggctgctggtatggaatggaaatcagaccaataagtgagaaagaagaaaacatggtaaaatctttggcaagtgctggctctgggaaagtcgataattttacgatgggagtactatgtttagcaattttgtttgaggaagtaatgagaggaaaatttggaaagaaacacatgattgccggagtattctttacattcgttttgttgctgtcgggacaaataacatggcgagacatggctcacaccctaataatgatagggtcaaacgcttcagaccgaatgggcatgggggtcacatacttagcacttattgctacgttcaagattcaaccattcctcgctctcggtttctttctaagaaaactgacatcacgtgaaaacctattactaggcgtcggactggctatggcgactacattacaactaccggaagacatagaacagatggcaaatgggatcgcactcgggttaatggccctaaaattaatcacacagttcgaaacctaccaactgtggacagcgcttgtatcactcacatgcagcaatacaatgtttactctcacggtagcttggaggaccgcaacactcattttagctggagtatcattattgccggtttgtcagagttcttcgatgaggaaaacggactggcttcctatgacagtggcagccatgggtgtacccccattaccgttgttcatatttagtttaaaagacacgcttaagagacgatcgtggcctttaaatgaaggtgtgatggccgtcggactcgtaagcattctagctagcagtctacttagaaatgacgtcccaatggctgggcctctagtagctggcggactcttaatcgcttgttatgtgattactggaacatccgctgacctcacggtagagaaagctgcagacgtcacatgggaggaagaggcagaacaaactggggttagccacaatcttatgattaccgtagatgatgacggaaccatgcgtataaaagatgacgagacagaaaacatactaacagtgttactaaaaacggcgttattgatcgtgagtggaatatttccatatagtattccagctacactcctggtatggcacacttggcagaaacaaactcaaaggagcggggtcctatgggacgtcccatctccaccagaaacacaaaaagcggagcttgaagaaggagtttatagaataaagcaacaaggcatattagggaaaacacaggttggggtgggcgtacaaaaagaaggagtatttcacaccatgtggcatgtcacaaggggtgcggtcttaacccacaatggaaaaagactagaaccaaattgggcaagcgttaagaaagatctaatatcatatggaggaggttggcgactttccgcacaatggcagaagggcgaagaggttcaggtaatagcagtggaaccaggtaaaaatcccaaaaatttccaaaccatgccgggcacttttcagactacgacaggggaaataggagcaatagctctcgacttcaaaccaggtacaagtggttctcccataatcaaccgagagggtaaagtagtaggattgtatggcaacggagtcgtaaccaaaaacggaggatatgtttcgggcatagctcaaacaaatgcggaacccgatggcccgacaccagagctagaagaagaaatgtttcgtaagcgaaatctcacaataatggatcttcacccaggatctggtaaaacgagaaaatatttgccagcaattgtaagagaagctatcaaacgacgtttaagaacattaatactcgcaccaaccagagttgttgcagccgaaatggaggaagcacttaagggtctgccaatacgttatcagacgacagcaacaaagtcagaacataccgggagagaaatcgtcgatctaatgtgccatgccacattcaccatgaggctgttaagcccagtgcgtgtcccgaactataacttaataattatggacgaagcccattttactgatcctgccagtatagcagcaagaggatacatttcaacgagggttggaatgggagaggcagcagcaatatttatgacggctaccccaccaggaacagcagatgcatttccgcaatctaacgcccctatacaagacgaagaacgcgatatcccagaaagatcatggaactctggaaacgaatggataaccgactttgcaggtaaaacggtttggtttgtgcccagcatcaaagcaggcaatgacatcgccaactgcttaaggaaaaacgggaagaaagtgatacaattatctaggaagacatttgacacggaataccaaaagaccaagttaaacgattgggattttgtagtgaccacagatataagtgaaatgggcgcaaatttcaaagctgacagagttatcgatccaagacgctgtttaaaaccggtaattcttactgacggaccagaacgggtcatactagcaggtcctatgccggttacagccgcatccgcagcacaaagaagaggcagagttggcaggaaccctcagaaggaaaatgatcaatatatattcacaggtcaaccattgaataatgatgaagatcatgctcattggacagaggcaaaaatgttactagataacataaacactccagaagggataatccccgctctctttgaaccagaaagagaaaagagcgccgcaatcgacggagagtatagactaaagggcgaaagtaggaaaaccttcgttgagttaatgcgtaggggagacctaccagtatggctagcacataaagtagcaagcgaaggaataaagtacactgatcgcaaatggtgctttgatggtcaacgcaacaaccaaatactagaagaaaatatggacgttgaaatatggactaaggaaggcgagaaaaagaaactgcgaccacgatggttggatgcaagaacatacagtgatccactcgctctgaaagaatttaaagatttcgcagctggccgaaaaagtatagcccttgatttagttacggaaatcggaagagtaccaagtcacctggctcacaggacgcgaaatgcccttgacaacttagtaatgttgcacacaagtgagcatggaggtagagcatatagacatgcagttgaagaattacctgagaccatggaaacgctgctgctgttaggcttaatgatactattgactggcggcgcaatgttgttcctcattagtgggaaggggataggcaaaacctcgataggcttaatttgtgtaatagcctcatcagggatgttatggatggcagatgtaccgttgcagtggatagctagcgcgatagtcttggagttcttcatgatggtattactaatacctgaacccgaaaaacaacggacacctcaagacaatcaactcgcttacgtagttatagggattctcacacttgctgctataatcgcggctaatgagatgggtctacttgagaccaccaaaagagacctaggaatgagtaaagaaccaggtgtggtatctccgacttcctatttagatgttgacttacacccagcaagtgcttggacattatacgctgttgcgacgactgttataacaccaatgctacgccacacaatagaaaactcgactgctaacgtatcgctagcagccatcgcaaatcaagcagtagtcttaatgggactagataagggctggcccatttcgaaaatggacctaggggtccctttactagctttaggatgctacagtcaggttaatccactgacccttacagcagctgtgctattactaatcacacactatgcaataatcgggccgggattgcaagccaaagctacacgtgaggcacagaaaaggactgcagccggtataatgaaaaatcctaccgttgacggcataatgacaatcgacttagatcccgtaatctacgactctaaatttgaaaaacaattagggcaagttatgctattagtactttgcgccgtacaactcctgttgatgagaacaagctgggctttatgcgaagctcttacattggctacagggcccattacaacgttatgggaagggagtcctgggaaattttggaatacaacaatagcagtatctatggctaacatctttcgaggatcttatctggcgggagcgggactagcattctccatcatgaaatccgtcggaacagggaaacgcggcaccggatctcaaggcgaaacgttaggagaaaagtggaagaagaaattaaatcaactatcacgaaaagaatttgacctctacaagaaaagtggaattacagaagtggacagaaccgaagcaaaagaaggattaaaaagaggtgagactacgcatcacgcggtgtccagaggatcagcaaaattacaatggtttgtagagcgtaatatggtgatacctgaaggacgcgttatagatctagggtgcggtagagggggctggagttactattgcgctggattgaagaaagtaacggaagtaagagggtatacaaaaggaggcccaggccacgaagaacctgtaccgatgagtacctatggatggaacatagttaaattaatgtctgggaaagatgtattctatttaccaccagaaaaatgcgacacacttctatgcgacatcggtgaaagttctccatccccgaccgtcgaggaaagcagaactataagagtcttgaaaatggtagagccatggctaaagaataaccaattttgtattaaagtattaaacccctatatgccaaccgtgattgaacatctagaacgattgcagcgtaagcacgggggaatgctagttcgaaacccactcagtagaaattcaacgcacgaaatgtattggatatcgaacggcactggaaacatagttagcagcgtgaatatggtatcgcgactattgctcaatcgatttacgatgacacatagaaggccgacgatagaaagagatgtggatctaggcgcaggaacacgtcatgtaaatgcagaacctgagatccccaatatggacgtaataggtgaaaggattaaaagaataaaagaagaacacaattcaacttggcattatgacgatgaaaacccctacaagacctgggcatatcacggtagttatgaggtaaaagcaacaggatccgcgtccagcatgataaacggagtggtaaaacttttaactaaaccttgggatgttgttcccatggtaacacaaatggctatgacagacacaacaccgttcggacaacaacgcgtttttaaagaaaaggtggataccagaacgccgaggccgatgccaggaacgaggaaggtaatggagataacagctgaatggctatggaggactttaggaagaaacaagcgaccacgattatgtacgagagaagaatttacgaagaaagtgagaacaaatgcagcaatgggcgcagtgtttacggaagagaaccagtgggattccgcaaaagcagccgtagaggatgaggagttctggaaacttgttgatagggagcgagaattacataaactggggaaatgtggaagctgcgtttataatatgatgggaaaaagggagaaaaagttaggtgaatttggtaaagccaaagggtccagagcaatatggtatatgtggctaggagcccgttacttagagttcgaagcgctagggtttctaaacgaagatcactggtttagtagagaaaatagttatagtggtgttgaaggggaaggtctacataaactgggttatatattaagggacataagcaaaattccagggggagccatgtatgcagatgatactgctggatgggatacccgaataaccgaagatgacctacataacgaagaaaagataacacaacaaatggatcctgaacatcgacaattggcaaatgcaatatttaaattgacctatcagaacaaagtagtcaaagtacaaagaccaacgccaactggtactgtaatggacattatatctcggaaagatcaaagaggctccggccaggtaggaacctatggactaaatacttttactaacatggaagcacaattagtcaggcagatggagggcgaagatgtattaagcaaggccgatctggagaatccgcatctacttgagaagaaaataacacaatggttagaaacaaaaggagtagagagattaaagaggatggcgatatctggcgacgactgtgtggtcaaacctatagatgatcgtttcgcgaacgcacttttagctctgaatgatatgggcaaagtcagaaaagatataccccaatggcaaccatcaaaaggctggcatgattggcaacaagtgcctttttgctctcatcatttccatgaattgattatgaaggatggtaggaagttagtagtcccatgcagaccgcaagacgaactgataggtagagcacgaattagtcagggagccggatggtcactccgtgagaccgcctgcttggggaaagcatatgcacaaatgtggtctttaatgtatttccaccgtcgcgacttacgtttagcatctaatgccatctgctcagccgtacctgttcactgggtcccgacttcgcgaacgacatggtctatccacgcccaccaccaatggatgacgacggaagatatgttaactgtatggaaccgagtatggatagaagataacccatggatggaagataagactccagttactacatgggaaaacgtaccctatctgggaaaaagagaagatcaatggtgtggatcattaataggattaacatcacgggccacatgggctcagaacatcccaactgcaatccaacaagttagaagtttgattgggaacgaagagttcctagattatatgccctcaatgaaaagattcagaaaggaagaggaatccgaaggggcgatatggtaa

SEQ ID NO: 23154 - RNA, 9873 nt, synthetic construct
  misc_feature 1..9873: note = derived and/or modified CDS sequence (opt6) from DENV-3__GQ252674__SS-prME
  source 1..9873: mol_type = other RNA
acaagtttatgcttaatgatgatcttacctgcagcattagcatttcatttaacttcaagggacggagaacctaggatgattgtagggaaaaatgaaagagggaaatcactgctgtttaaaaccgctagtggaataaacatgtgcactcttatagccatggacttaggagaaatgtgtgacgacaccgtgacatataaatgcccgcatatcacagaagtggaaccagaagacatagattgctggtgcaatttaacgtccacatgggtaacctatggaacctgtaatcaagccggtgaacatcggagagataaacgaagcgtagcactcgcacctcatgtgggaatgggtctagacacaagaacccaaacatggatgagcgctgaaggcgcgtggagacaagtagaaaaagtagaaacatgggcactgaggcatccaggatttacgatactggcactgtttttggcgcattacattggaaccagtttaactcaaaaagtggtcatctttatattattgatgttagtaactccgtcgatgacaatgagatgtgtgggaatcggtaatagagacttcgttgaaggcctctccggggccacctgggtggatgtagtccttgaacacggcggatgtgtaacaactatggctaaaaataaaccaacccttgatatagaactccagaaaacagaagcaacacaacttgctacgctgcgcaaactatgtatcgaagggaaaataacaaacattactactgacagtagatgtcctacacaaggagaagcagtactaccggaagaacaagatcaaaattatgtatgtaaacatacctatgtcgacagaggttggggtaatggttgtggcttattcggaaaaggaagcctcgtaacatgcgctaaatttcaatgtttagaaccaatagaaggaaaagtagtacaatatgaaaatctgaaatatacggtcataataacagtgcacacaggtgatcaacaccaagtagggaacgaaacacaaggagttactgcagaaataacgcctcaagctagtaccaccgaagcaatcctcccagaatacggaactttaggtttagaatgttcaccaagaacaggtttagactttaatgaaatgattttactgacgatgaaaaacaaagcctggatggtccatagacaatggttctttgacctcccattaccatggacgtcaggagctactacagaaacgccgacttggaatagaaaagaacttttggtcacgtttaaaaacgctcacgccaagaagcaagaagtagtggttctagggagccaggaaggagctatgcatacggcattgactggagccacggaaatccaaaattctgggggcacgtcgatatttgctggacatttaaagtgtagactgaaaatggataagctagaactaaaaggtatgtcgtatgctatgtgcacgaacacatttgttcttaagaaagaagtatctgaaacccaacatggcacaatcttaatcaaagtagaatacaagggagaagacgctccatgtaagattccttttagcaccgaagatggtcagggaaaagcccataatggcagattaatcacagctaatccagtagtgacgaagaaagaagaaccagttaatattgaagccgaacccccattcggtgaaagcaatatagtcatcggaataggtgacaatgcattgaagataaactggtacaagaaaggaagttcaatcggtaagatgtttgaggcaaccgcacgtggggcaaggcgtatggctatactaggcgatacagcctgggactttggatccgtaggtggggtactaaatagcctaggtaagatggtccaccagattttcggaagcgcttacacggccttattttcaggagtaagttgggtcatgaagatcggaattggcgtactactaacctggatagggctaaattctaaaaatacatctatgtcattttcatgcatagccataggcataatcactttgtatttaggggcggttgtccaagccgatatgggatgtgttataaactggaaagggaaggagctaaaatgtggaagtggaatatttgtgaccaatgaagtacatacgtggacagagcaatacaaatttcaagctgatagtccgaagaggttggcaaccgcgatcgcaggggcctgggaaaacggagtatgcggtatacgttccactactagaatggaaaacctactttggaaacagattgctaacgagctaaattacatactgtgggaaaacaatataaaactaacggtcgtagtgggggatacaataggggttttagaacaagggaagagaactttaacgccacaaccaatggaactcaaatacagttggaagacctggggaaaagcaaagattgtaacggccgaaacacaaaactcctcctttataatagatggccccaacactcccgagtgtccctcagcttcaagagcgtggaatgtgtgggaagtggaagactatgggtttggagttttcacgacaaacatttggcttaaattaagagacgtctacacgcaactttgcgatcaccgtttaatgtctgcagctgtcaaagacgaaagagcagtacatgcagacatgggatactggatagaatctcaaaagaatggctcctggaaattggaaaaagcgagtctcatcgaagtgaaaacatgtacgtggccgaaaagtcacacattatggtcaaacggcgtcttagagtcagatatgataattcctaaatcacttgctggaccaatatctcaacacaattataggcctggttatcatactcagacggccgggccttggcatcttggaaaattagaactcgattttaattattgtgaaggtacaacggtcgtaatcacagaaaattgcggaacaagaggaccatcgcttaggacgaccacagtttctggaaagttaatacatgaatggtgttgtagatcctgtacactacctcccttaaggtatatgggggaagatggctgttggtacggcatggaaataaggcccatttcagaaaaagaagaaaatatggtaaagagcttagtttccgcgggcagcggaaaggtcgataatttcaccatgggtgtactctgtttggcgattttatttgaagaggtaatgagaggaaaattcggtaagaaacatatgatagcgggagtactgtttacattcgtattactcctttcagggcaaataacctggcgagatatggctcatacactaataatgatcgggagcaacgctagcgatagaatgggaatgggagtaacttatttagctcttatagcaactttcaagattcagcccttcttagcattaggatttttcttaagaaaattaacatcaagggaaaacctcctgcttggagtaggattggcaatggcaacgacactacaactcccggaagatatcgaacaaatggcaaacggaatagctctaggattgatggccctaaaattaataacacaattcgagacataccaactgtggactgcactcgttagtcttacctgttctaacactattctcactttgaccgtggcatggcgaacggcaaccctgattctagccggtgtctcgttgcttccagtttgtcaatcatcttcgatgagaaaaacagattggcttcctatgaccgtagctgcaatgggcgtaccgccgctaccgttattcatattctctttgaaagacactctaaaacgcagatcttggccactcaacgagggagtcatggccgtaggactcgtatcaatattagcatctagcttattgcgaaatgacgttcctatggccggtcccctagtagccggaggactattaatagcatgctatgttattacagggaccagtgccgaccttacagtagaaaatgctgcggacgttacatgggaggaagaagctgaacagacgggagtgtctcacaatttaatgatcactgtagatgacgatggaacaatgagaataaaagacgatgaaactgagaacatcctcactgtattattaaaaactgcattacttattgtatctggtatttttccctattctattcctgccactttgctggtttggcatacttggcagaaacaaactcaaaggagcggggtactttgggacgttcctagccctcctgagacacaaaaggccgaactagaagagggcgtctatagaataaaacaacaaggtatttttggcaaaacacaagtaggtgtcggagtacaaaaagaaggtgtttttcataccatgtggcacgtgaccagaggggctgttttaacgcataatgggaaaagacttgagcctaattgggcaagtgtgaagaaagatttaatttcttatggagggggatggagattgtctgcacaatggcaacgaggtgaagaggtacaggttatagccgtcgagccaggtaaaaatcccaaaaactttcagaccatgcctgggacattccaaacaacaacaggagaaatcggagctatagcacttgactttaaaccgggtactagcggaagcccgataataaaccgggaagggaaagttgtaggcctctatggcaacggggtagtaactaaaaacggcggctatgtaagtggaatagctcaaacgaacgctgagccagatggacccacaccagaactcgaagaggagatgttcaaaaagcgtaacctcacaataatggacttacacccaggttcaggcaaaacacgtaagtatcttccggcaatcgtgcgagaagcaattaaacgaaggctccgtacacttatccttgcaccaactagggtagtagctgcggaaatggaagaagctctgaagggattaccaatacgataccaaaccacagcaaccaagagtgaacatactgggagagagatagtggacctgatgtgtcatgctaccttcacaatgcgtttattatctccagtacgtgtccctaattataacctaataataatggacgaagcacatttcacggatccggccagcattgcggctagaggttatatctctacaagggtaggaatgggagaagcggccgcaatttttatgacggcaacaccgcctggaaccgccgacgccttcccacagtcgaacgcccctattcaagacgaagagagggacatacccgagcggagctggaactcaggaaacgagtggataacggattttgctggaaaaactgtatggtttgtaccctccataaaggcaggtaatgatatcgcgaattgcctacgaaagaatggtaaaaaggttatacaactttcccgcaaaactttcgacacagaatatcagaaaacaaaattaaacgactgggatttcgtcgtgacaactgatattagtgaaatgggggcaaattttaaagcggatcgtgtaatagaccctcgaaggtgtttaaaaccagtcatactaacagatgggccagaacgcgtcatccttgctggaccaatcccagtaacagcagcaagtgctgcccaaagaagaggaagggtaggaagaaacccacaaaaggaaaacgaccaatacattttcacaggacaaccattaaataacgacgaagatcatgcgcactggaccgaagcaaaaatgctccttgacaatataaatactcccgaaggtatcatacctgccttgttcgaacccgaaagggagaaatccgcagctatagatggtgaataccgattgaaaggtgaaagtagaaaaaccttcgttgagctcatgagaaggggtgatttaccagtatggttagcccacaaggtagcatcagagggaatcaagtacactgatcgcaaatggtgctttgatggacaacgtaacaatcaaatcttagaggaaaatatggatgtagaaatctggacgaaggagggcgagaagaagaaacttcgtcctaggtggctagacgcgcgaacatacagtgacccactagcacttaaagagttcaaagactttgccgcaggacgaaaatcaatagcattggacctagtcaccgaaatagggagagtgccgtcccatttagcacatagaaccagaaacgcccttgataatctagtgatgctccatacaagtgagcacggaggccgagcctatagacatgcagttgaagaattgccagaaacgatggaaacattattactacttggtctaatgattctgctaacaggcggcgcaatgctttttctaattagcggaaaaggcattgggaaaacatcaatcgggctaatctgtgtgatagcctcttcaggaatgctctggatggcagaaatccccttacaatggatcgcttctgccatcgtcttagaatttttcatgatggtgttattgatccctgaaccggaaaaacaacgaacaccacaagataatcaactagcatatgtagttataggtatacttacattggcagccataattgcggctaatgaaatgggattactagaaacaacgaaaagggacttagggatgtctaaagaaccgggagtagtatcacctaccagttatctagatgtagatcttcatccagcgtctgcctggacattatatgcagtagcaacaacggttatcacaccaatgctaagacatactatagagaatagtactgcaaacgtaagcctagcagcgattgccaaccaagctgtggttttgatgggcctagataaaggttggccaataagcaaaatggatctaggtgtaccattactcgctcttggatgttacagtcaagtcaatcccctgacattgacagctgcagtactactactaattacacactacgccataataggtcccggcctccaggcaaaagccacgagggaggcccaaaagaggacagcggccggaatcatgaagaacccaacagtcgatggcataatgacgatagacttagatccagtaatatacgactctaaatttgaaaaacagctgggtcaagtaatgttattggtcctctgcgcggtccaattactcctgatgcgaacatcctgggccttatgcgaggctttaactttagcgacaggccccataacaaccttgtgggaaggaagcccaggcaaattttggaatacgactatagcagtatcgatggcaaatatctttagaggaagttacctcgcaggagcggggctcgccttcagtattatgaagagtgtaggtacaggaaaacgggggactggctcccagggagagacactcggcgaaaagtggaagaagaaattaaatcagcttagcagaaaagagttcgatttatataagaaatcaggtataacagaagttgaccgaacggaagccaaagaggggctcaagcgcggagagataacccatcacgcagtctcacgggggtccgctaaattacaatggttcgtagaaagaaatatggtaattcctgaagggcgcgtaatcgacctaggctgtggtagaggaggatggagttattattgtgccggtctcaagaaagtcacagaggtaagaggttacactaaaggaggcccaggacacgaagaacccgtccctatgagcacctacggatggaatatagtaaagttaatgtctggcaaagatgttttctatctacctccagaaaaatgtgataccttgttatgtgatatcggtgaatcctctccaagtcccaccgtagaggaaagcagaacgatacgtgtactaaaaatggttgagccatggcttaagaacaatcaattctgcatcaaagttctcaatccttatatgccaacagttattgaacacttagaaagactgcaaagaaagcatggtggaatgttggtaaggaatccgcttagtcgtaattctacgcatgaaatgtactggatatctaatgggaccggtaatattgtaagttcagtaaacatggttagtagattattgttaaataggtttactatgacacatcgacgacccacaattgaaaaagacgtggacttaggagcaggtacacgacatgtcaatgctgagcctgagacacctaacatggacgtaattggtgagcggataaaacgtataaaagaagaacataattcaacgtggcattacgacgatgaaaacccttacaagacgtgggcgtatcatggaagctatgaagtaaaagcaacaggtagtgcgtcatcaatgatcaatggtgtagtaaaactactaacaaaaccgtgggatgttgttccaatggtcactcaaatggcaatgacggataccacaccttttggtcaacagcgggtattcaaagaaaaggtggacacaagaacccctcgaagcatgcccggtactagaaaagttatgggcataacagccgaatggctttggcgaacactcggtcgaaataaacgaccacgtttgtgcacacgtgaggagttcaccaagaaagtaagaactaatgcagcgatgggagcagtttttactgaagaaaaccaatgggatagtgcaaaagcagcagtcgaagatgaagaattttggaagctagtagacagagagagagaattacataaactaggtaaatgtggtagttgcgtatacaatatgatgggcaagagagaaaagaaattgggggagttcggtaaggctaagggtagcagagctatttggtacatgtggctcggagcaaggtatttggagttcgaagccctaggatttttgaatgaagaccattggttcagccgcgataatagctactcaggtgtagaaggcgaaggattacataaacttgggtacattctaagagatatctcaaagatccccggaggagccatgtacgcagatgacaccgctggttgggatacaagaatcactgaagatgatctacacaacgaggagaaaataactcaacagatggaccccgagcacagacagcttgcaaacgcaatttttaagctaacttatcaaaataaagtagtcaaggtccagcgtccaacacctactggaactgttatggatataatttcaaggaaggatcagcgaggatcaggccaagtaggtacttatggactaaatacatttaccaatatggaagtgcagcttgtgagacaaatggagggcgaaggtgtattgtctaaagcagatttagaaaatccgcaccttcccgagaagaaaataactcaatggttagagaccaaaggagtggaaagacttaagcgaatggccatttcaggtgatgattgtgtagtaaaacctattgacgatagatttgcaaatgcattgctcgcgttgaatgatatgggaaaggtaagaaaggacattccacagtggcaaccttccaaaggatggcatgattggcaacaagtcccgttttgctcccaccatttccacgaattaataatgaaagatggacgcaaactcgttgtcccatgcagacctcaagatgaactgataggtagagctagaatatcacaaggggctggatggtcattacgagagactgcatgtctaggcaaagcatatgcacaaatgtggagtttaatgtattttcatagaagggaccttagacttgcttccaacgctatttgtagtgcagtacccgtccattgggtgccaacaagtagaacaacttggtccatacacgcccatcaccaatggatgacgactgaggacatgctaaccgtgtggaatagagtttggatcgaagataatccgtggatggagaacaaaactcccgttaccacatgggaaaatgtcccatatttgggcaagagagaagatcaatggtgcggttcgctgataggactaacgagccgtgctacatgggcgcaaaacataccgaccgcaatacaacaggtaagaagcctaattggcaatgaggaatttctagattatatgccttcaatgaaacgatttcgaaaagaagaagaatcagaaggggcaatctggtaa

SEQ ID NO: 23155 - RNA, 9873 nt, synthetic construct
  misc_feature 1..9873: note = derived and/or modified CDS sequence (opt6) from DENV-3__GQ199889__SS-prME
  source 1..9873: mol_type = other RNA
acaagcctatgtctgatgatgattcttccggcagctctcgccttccatttaaccagcagagatggcgaaccgagaatgatagtaggcaaaaacgaaaggggtaaatctcttttgttcaaaactgccagtggcatcaatatgtgcactctaattgctatggatttaggagaaatgtgcgacgacaccgtaacatataaatgtccccacatcactgaagtagaacccgaagatatagattgttggtgcaacttaaccagtacatgggtaacttatggaacatgtaatcaagcaggggaacatcgtcgagataaaagatctgtagctttagcaccccatgtgggtatgggcctagatacacgaacccaaacgtggatgtccgcggaaggtgcgtggcgacaagtcgaaaaagttgaaacttgggcactaagacacccaggattcaccattttggctttgttcctagcccactatatagggacttcattaacgcagaaagtggtcatatttatattgctaatattagtgacaccatcgatggcaatgagatgtgtaggggtaggcaatcgagacttcgttgaaggtttaagcggtgctacatgggttgatgttgtactagaacacggcggttgtgttacaaccatggctaaaaacaaacctactcttgatatagaacttcagaaaacagaagctacacaattagccacgttgcgtaaactttgtatagaaggtaaaattacaaatataaccacagattctaggtgcccgacacaaggagaagcgatactccctgaagaacaagatcagaattatgtctgtaaacatacatatgtagaccgaggttggggtaacgggtgcggcttatttggcaaaggtagtttagtcacatgtgctaaatttcaatgtctcgaatctatagagggcaaagtagtgcaatatgaaaatttaaaatataccgtaataatcacagtccatacaggagaccaacaccaagttggaaatgaaacacaaggcgtaacagctgagataacccctcaagcatcaacaaccgaagccattctaccggaatatggtaccttgggtttggaatgttctccaagaactggactagatttcaacgaaatgattttgttgactatgaaaaacaaggcctggatggtgcatagacaatggttctttgacttaccgctaccttggacttcaggcgcaactacggaaacaccaacttggaatcgaaaagaactattagttacatttaaaaatgcacatgcaaagaaacaagaggtagtggttctaggcagtcaagagggagccatgcatacagcgttaacaggagctaccgagattcaaaactcaggagggacaagtatttttgctggtcacttaaaatgcagattgaaaatggataaattagagctgaaaggaatgtcatatgcaatgtgcacaaataccttcgttctaaagaaagaagtaagtgagacgcagcatggcacaattttaataaaagtcgagtataaaggagaagacgctccgtgtaagataccatttagtacagaggatggacagggaaaagcacacaatggaaggttaataacggcgaaccccgtggtaacaaagaaagaggaaccggttaatatagaagctgaacctccctttggggagtctaacatagtaataggaattggagataatgctttgaaaattaactggtataagaaaggatcttcaattggaaaaatgtttgaagcgacagctaggggtgcacgacgtatggccatattaggtgacacggcttgggatttcggaagtgttggtggtgtattgaactcgttaggaaaaatggtccaccaaatatttggttcagcatatacagctctcttctctggcgtaagctgggtaatgaaaattggcataggagtattattgacatggatcggtctaaatagcaaaaatacaagtatgagttttagctgtattgccattggaataatcacactctacctaggagctgtcgtacaagccgacacaggttgtgtaatcaactggaaaggaaaagaactaaaatgtggtagtggaatttttgtcacaaacgaagtgcacacatggacagagcaatataaattccaggcagacagtccaaaacgcctagcaacggcaatcgcaggagcttgggaaaacggtgtatgcggaataagatcaactacgcgcatggaaaatctattatggaaacaaattgctaacgagttgaattacattctatgggaaaataatatcaagctcacagtggtggtaggtgacacgattggcgttctagaacaaggtaaaagaacccttactccgcaaccaatggaattaaaatattcctggaaaacatggggaaaagccaaaatagtcactgccgaaatccagaactcatccttcataatagacgggccaaatacgcctgaatgtccatctgcttccagggcttggaatgtctgggaggtagaagattatgggttcggcgtttttactacaaacatttggcttaaactaagagaagtgtacactcaactatgcgaccaccgattgatgtcagctgctgtaaaggatgagagagccgtccacgcggatatgggctattggatcgaatcgcagaaaaatggaagctggaaattagaaaaagcctcgtttatcgaagtaaaaacctgtacttggcctaaatcgcatacgctttggtctaatggcgtcttagaatccgatatgattatacccaaaagcctggctggaccaatttcacaacataattacagaccaggttatcacacacagaccgcggggccgtggcatctaggaaaactagaactagattttaattactgcgaagggacaacagtggtaatcactgaaaattgcggtactaggggaccatctctcagaacaaccacagtatccggcaaattaatccacgaatggtgctgccgtagttgtacgttacccccattgcgttatatgggagaagatggttgctggtacgggatggaaatcagaccaattagtgaaaaagaagaaaatatggttaaaagtttagcatcggcaggttcaggcaaggttgacaacttcacaatgggagtgctttgcctagcaattttatttgaagaagtaatgagaggtaaatttgggaaaaagcatatgattgcaggagtcttctttacgttcgttcttttactatcaggtcaaatcacatggagagatatggctcacaccctaatcatgattggttcaaacgcatctgaccgcatgggcatgggagtaacatacctcgccttaatagcaacgtttaaaattcagccgtttctagccttaggcttctttttgagaaagttaacctcacgagaaaacctgttgttaggagtgggtctagctatggctactacacttcaacttccagaagacattgaacaaatggccaacggtattgctctgggtctaatggcattgaagttgattacacaatttgaaacataccagctgtggacagcattaattagtctgacatgctcaaacactatgtttacacttactgtagcttggagaaccgcaacactgatattagcaggagtgtccttacttcccgtatgtcagagctcgtcaatgagaaaaactgattggctacccatgacagtagcggcaatgggtgttccacccttgccattatttatatttagtctaaaagacacactaaaacgaagatcatggccattaaatgaaggcgtcatggcagtggggctggtatccatattggcatcatcgttgttaagaaacgacgtaccaatggctggtccattggtggctggagggatgctcatcgcatgttatgtaataacaggcacctcagcggatctcacagtagaaaaagcagcggacgtaacttgggaagaagaagcggaacagacaggagtctctcataatcttatgatcacggttgatgacgacgggaccatgagaattaaagacgatgaaacagaaaatatcctgaccgtcctactcaagacagcactactcatagtctctggaatcttcccatacagcattcctgctacactcttagtctggcatacatggcaaaaacagacgcaacgaagtggtgttctttgggatgtccctagtccaccagaaacacagaaagcagaactggaagagggcgtatatcgaatcaaacaacaggggatattggggaaaacacaagtgggagttggcgtacaaaaggagggggtatttcacacgatgtggcacgtcaccagaggagctgtgctgacacataacggtaaaaggcttgaaccaaattgggcatccgtcaagaaggacttaatctcatatgggggaggatggagattatcagctcaatggcagaaaggagaagaggtccaagttatagcagtagaaccagggaaaaatccgaagaatttccaaaccatgccaggcacattccagacgacaaccggggaaataggtgcaatagcactggattttaagccaggaacatccggaagtccaatcataaatcgtgaaggtaaggttgttggactatatgggaatggagtagttacgaaaaacggtggatatgtatcaggtattgcacaaacttctgctgagccagacgggcctactcctgaattagaggaagaaatgttcagaaagaggaatttgactataatggacttgcatccaggaagtggtaaaactaggaaatatttacccgctattgtcagagaagcgatcaagcgacgactccgtacacttatccttgcacccacccgggtcgtggctgctgagatggaagaagctcttaaaggactgccaataagataccagactacagcgacaaaatctgaacatactggccgagagattgtggaccttatgtgtcacgccacgttcacaatgcgactgctatcgcccgtcagagtcccaaattataatctaataattatggacgaagcacattttaccgatcctgcatcaatagctgcaagagggtacatctctactagagtagggatgggagaagctgcagcaatctttatgacagcaacgccaccgggaacggctgacgcatttccacaaagtaatgccccaattcaggacgaagaaagagacatacctgaaaggagttggaactcaggaaatgaatggataacggactttgcgggaaaaaccgtatggttcgtaccctcaataaaagcaggtaacgacattgcaaattgtttacgcaagaacggcaagaaagttattcaattatcaagaaagacctttgacacagagtaccaaaagaccaaactaaacgactgggactttgttgttactacagacatttcagagatgggcgcaaattttaaagcagaccgagttatagatcccagaagatgcctaaaaccggtcatcttaacggatgggccagaaagagttattttggcaggacctatgccggtaactgcagcatcagcggcacaaagacgtggtcgagtcggaagaaatccgcaaaaggagaacgaccaatacattttcaccggacaacccttaaataacgatgaagatcatgctcactggaccgaggcaaaaatgcttttagataacattaataccccagaaggtatcatacccgccttgtttgaacccgaaagggaaaaatcggcagcgattgacggagaatacagactgaaaggagaatctaggaaaacttttgttgaactcatgcgccgaggggatttacccgtatggttggcgcacaaagttgcctcagaaggaattaaatacacagacagaaaatggtgcttcgatggacaaagaaacaatcaaatactagaagaaaatatggatgttgaaatatggacgaaagaaggtgagaagaagaaattaaggccaagatggttagacgccagaacatacagcgatccgttagcacttaaggaatttaaagatttcgctgccggtagaaaatccatagccttagatttggtgactgaaataggtagagtgccttctcacctcgctcatagaacccgtaatgcgcttgacaatttagtaatgcttcacacaagcgaacacggtggacgtgcatataggcatgctgtggaagagttacccgaaactatggaaaccttacttctacttggcttaatgatattattgactgggggagcaatgctattcttaatatcaggtaaaggaatagggaaaacgagcattggattaatatgtgtaatcgccagtagtggaatgttatggatggctgacgtgccacttcaatggatagcttcagcaatcgttctagaatttttcatgatggttttgctaattccagaaccggaaaaacaacgaacccctcaagataatcaacttgcgtatgttgtaatcggtatattaactctcgcagctattatcgcagctaacgaaatgggattattagaaaccacaaaaagggatctaggtatgtcaaaggaaccaggcgtagtaagtcccacgtcttacctggacgtagacctacatccagcttcagcatggacattatatgcggtagctacaacagtgataacacccatgctccgtcacaccatagaaaacagtacggccaatgtgtcactcgcagcaatagcgaatcaagcagtagtattaatggggctagacaaagggtggcctatttcaaagatggatttaggagtccctctattagcgctagggtgttacagtcaggttaacccattaacacttacagctgcagtacttttactcataacacactatgcaataataggccctgggttacaagcgaaggcgacacgcgaagctcagaaaagaaccgctgctggtataatgaaaaatccgacggtggatgggataatgactatagatttagaccccgtaatttacgatagtaaatttgaaaaacaattaggacaagtaatgttgctcgttctgtgcgcagtccagctattgctaatgcgcacatcttgggcactctgtgaggcattaacgttagcaaccggacctattactaccctctgggaaggtagcccgggtaaattttggaacaccactatagcagtaagtatggctaatatattcagagggtcatacttagccggggccggcttagcgtttagtataatgaaaagtgtgggtaccggaaaaagaggtacgggctcacaaggagagactcttggggagaaatggaagaagaaactaaatcaactttcacgtaaggagttcgacctctataagaaatctgggatcaccgaagtagatcgaacagaagcgaaagaaggtttaaaaaggggagagacgacacgacatgcagttagtagaggtagtgcaaaactacagtggtttgttgaaagaaatatggttattccagagggccgtgtcatagatctaggctgtggacgaggaggatggagttattattgcgcaggacttaaaaaggtgactgaagtacgcggatatacaaaaggaggaccgggacatgaagaaccagttccgatgagcacatatggatggaacattgtcaaactaatgtcaggcaaggatgtattttacttaccgccagagaaatgtgataccttactgtgcgatataggagaatcatcaccgtctccgacagtagaagaatcaaggacaataagagtactgaaaatggtagaaccctggcttaagaataatcaattttgtattaaagtactcaacccttatatgccaaccgtgatagaacatctagaaaggctacaaagaaagcacggaggaatgctggtacgtaacccactatcaagaaactctactcacgaaatgtattggatatcaaacggcacaggtaacattgtatctagcgttaatatggtaagccgtttattactcaacagattcaccatgacacatagacgacctacgattgagcgtgatgtagaccttggagctggtacgagacatgttaatgcggagcctgagattccgaacatggacgtaattggggaaagaatcaaaaggatcaaagaagaacataacagcacttggcactacgacgatgagaacccttacaaaacttgggcttatcatggaagctacgaagttaaggccaccgggtcagcatcaagtatgattaacggtgtagttaaattacttacaaaaccctgggatgttgttccaatggtgacccaaatggctatgacagatacaacacctttcggccaacaacgggtatttaaagaaaaggtagatacaaggactccacgaccaatgccggggacacgaaaggtaatggagattaccgctgaatggctctggcggacgctaggaagaaacaaacgtccgagactgtgcacacgtgaggagttcacgaaaaaggtacggacaaatgcggcaatgggggctgtcttcacggaagaaaatcagtgggatagtgcaaaagctgccgtagaagatgaagagttctggaagttggttgacagagaacgagagctccacaaacttggaaaatgcgggagttgtgtatataacatgatggggaaaagagagaagaaacttggagagttcggaaaagctaaaggaagtcgagcaatatggtacatgtggttaggggctagatatctagagtttgaagctcttggtttcctgaacgaagatcattggttcagtcgtgaaaactcgtatagtggcgtcgaaggtgagggtttacataaactaggatacatacttcgcgatataagcaaaatcccagggggagcaatgtatgcggacgacacagcaggttgggatacgcgcatcactgaagacgatctgcataacgaggagaaaatcacacaacaaatggatccagaacatcggcagttagctaatgcaatatttaaactaacgtatcagaataaagtcgtcaaagttcaacgtcctactccaacgggaacagtgatggatataatctctagaaaagatcaacgaggatctgggcaggtaggaacatatggtcttaatacgtttacgaacatggaggcgcaactggtacgtcaaatggaaggggaaggtgtactttcaaaagccgatctagaaaatccacaccttctcgagaagaaaataacgcaatggttagaaaccaaaggcgtagagcgactaaaacgaatggcgatttcaggtgatgactgtgtcgttaagccaattgacgacaggtttgcaaacgccctactcgcgcttaatgatatgggaaaggtaaggaaagatatacctcaatggcaaccgtcaaaaggatggcacgattggcaacaggtaccattttgcagtcatcatttccacgagctaataatgaaagacgggagaaagctagttgtaccgtgcaggccccaagatgaactaataggtcgagcacggatttctcaaggagctggctggtcacttcgagaaacagcatgtttaggaaaggcctacgctcagatgtggtctcttatgtattttcatagaagagacttgagattagcttcgaacgctatttgttcagctgtaccagtacattgggtccctacaagtaggactacttggtcaatacatgctcatcatcaatggatgacaacagaagatatgcttacagtatggaatcgagtatggatagaagataatccatggatggaagataaaacaccagttaccacttgggaaaacgttccttatttgggaaaaagagaagatcaatggtgtgggtcactaattgggcttacatctcgtgctacatgggctcaaaatataccaactgcaatccaacaagtccggagtctaataggtaacgaagagtttttagactatatgccatcaatgaagagatttaggaaggaagaagaatcagagggagcgatatggtga

SEQ ID NO: 23156 - RNA, 9873 nt, synthetic construct
  misc_feature 1..9873: note = derived and/or modified CDS sequence (opt6) from DENV-3__FJ882571__SS-prME
  source 1..9873: mol_type = other RNA
accagcttatgtctaatgatgatacttcctgcagccttagcattccatcttacatcacgcgatggagaaccacgcatgattgtcggcaaaaatgaaaggggaaaatcacttttattcaaaactgcaagtggaatcaatatgtgcactctaatcgccatggacctaggagaaatgtgcgatgacacagtcacctacaaatgtccgcatattacggaagtcgaaccagaagacatagactgttggtgtaatctgacaagtacctgggttacctacggtacatgtaatcaagccggagaacaccgaagagataaaagatctgtcgctttggcaccccatgtggggatggggctagacaccagaacacaaacctggatgtcagcggaaggcgcgtggcgacaagtggaaaaagtagaaacttgggcattaagacatccaggttttactatattagcgctatttctagctcactacataggcacctcattaacccaaaaagttgttatttttatattgcttatgctcgttacaccctccatgactatgcgttgtgttggagtagggaatcgagacttcgtagaaggactatcaggagctacctgggtagatgtagtgcttgaacacggagggtgcgtcactacaatggccaaaaataaaccaactttagacatcgaactccagaaaactgaagcaactcaacttgcaacactacgaaaattatgtattgaaggaaaaataactaacattacaactgattcaagatgtcccacacaaggagaagcagttttgcctgaagaacaagaccaaaattatgtgtgtaaacacacgtacgtagacagggggtggggtaatgggtgtggtctatttggaaaaggtagtctagtcacatgtgcgaaattccaatgtcttgaacccatagaaggtaaagtagtacaatacgaaaatttaaaatacacagttataataacagtacacactggagaccaacatcaagtcgggaatgaaacccaaggagttaccgcagaaataactccacaagcatctaccactgaagccatactaccggaatatggcacactagggttagaatgttccccgcgtactgggttagattttaatgagatgatacttctaacaatgaaaaacaaggcttggatggtccatagacaatggttcttcgatcttcctctaccgtggacaagtggggcaacaaccgagactcccacgtggaacagaaaagaattgttagtaacattcaaaaatgcacacgcgaagaaacaagaagtggtagttctagggtcgcaagaaggagcaatgcacaccgcactaacaggcgccacagaaatacaaaatagtggcgggacgtcgatttttgcaggacatttaaaatgtagattaaaaatggataaattagaactgaaagggatgtcatatgcaatgtgcactaataccttcgtcttaaagaaagaagtaagtgaaactcaacatggcacaatcttaatcaaagttgaatataaaggagaagatgcaccgtgtaaaatacctttcagtactgaagacggacaaggaaaagctcacaatggtcgacttataacggcaaatcccgtcgtgacaaagaaagaggaaccagtaaatatagaagcagagccaccctttggcgagtctaatatagttattggaattggggataatgcactcaaaatcaactggtataagaaagggtcatcaattggaaaaatgtttgaagctacagccagaggagcacgcagaatggcgatattaggcgacactgcatgggactttggcagcgtagggggtgttctaaattcactagggaaaatggtccaccaaatcttcggatcagcatacacggccttgttctcgggagttagttgggtaatgaagattggaattggtgtattgttaacttggattggacttaatagcaaaaatacatctatgagcttttcctgtatcgctattggaattatcacgctatacttaggcgcagttgtgcaagcggatatgggttgcgtaataaactggaaaggcaaagaactaaaatgtggttctgggattttcgtaacgaacgaggtacatacgtggactgaacaatacaaattccaagctgatagccctaaacgcctcgcgacagccatcgcgggtgcttgggagaacggagtttgtggcataaggagtaccactagaatggaaaacttactttggaaacaaatagcaaacgagcttaattacattctatgggaaaataacatcaaactaactgtagttgtcggagatacgattggagtactcgaacaaggtaaaagaactctaacaccacagccgatggagctaaaatattcgtggaaaacgtggggaaaggctaagattgtcaccgccgaaacgcaaaatagttcgttcatcatagatggcccaaatactccggagtgtccaagtgccagtagagcgtggaacgtatgggaggttgaagactatggatttggagtatttacaactaatatatggctaaaactacgtgatgtttacacacaactgtgcgaccatcgcttaatgtcggcagccgtaaaagatgaaagggctgttcatgctgacatgggttattggatagagtctcagaaaaacggttcctggaaactagaaaaggcaagtttaatcgaagtgaaaacttgcacgtggccaaaatcgcatacattatggagtaacggagtgctagaaagtgatatgattattccaaaatctctagcaggaccaataagtcaacacaactatagaccaggataccacacgcagaccgctggtccatggcacctcggcaaactagaacttgatttcaattattgcgaaggaactactgtagttataacagagaactgtgggaccagaggtccgtcgttgagaacgacaacggtatcaggtaaactaatccatgaatggtgttgtcgaagctgtacgcttccaccgctcaggtacatgggggaagatggatgctggtatggaatggaaatacgaccaatatcagaaaaggaggagaatatggtcaagagtctagtgtcagcaggatctgggaaggtagataattttacgatgggtgtattatgcttagctatactattcgaagaagttatgcgtggcaaattcgggaaaaagcacatgatagcaggagtattgtttacctttgttctattactctcaggtcaaataacatggagagatatggcccatacgttaattatgataggttcaaacgcatctgatcgaatgggcatgggagttacatatttagctctcatagctacctttaaaatccaaccctttctagctctaggattctttctccgaaaattaacgtccagagaaaacttattgctaggcgttggactcgctatggctacaaccttacaattgccggaagatatagaacagatggcgaatgggatagccctcggactcatggccctcaaactaataacacaatttgaaacttatcaactatggacagctctggttagtttaacctgtagcaataccatactaacactgacagttgcatggagaacagcaacgttaatcctagctggcgtatcgttgttgccggtatgtcagtcatcaagcatgcgaaagacggactggctaccaatgacggttgcagctatgggtgtgccgccactccccctatttatatttagccttaaggacacgctaaaacgccgctcttggccgctaaacgaaggagtcatggctgtaggtttggtaagcatattagcttcctctttgttacgcaacgatgttccaatggccggacctctagtagcgggcgggctgctaattgcgtgttatgtaattactggaacatcggctgatcttatagttgagaaagcagccgatgtgacatgggaagaggaagcggaacagacaggtgtttctcacaacttgatgataacagtagacgatgatggaaccatgcgtataaaggacgacgaaactgaaaatatcttgaccgttctactaaaaacggctttacttattgtgagtggcatatttccatactccattcctgcaacgttacttgtttggcacacatggcaaaaacagacccaacgatcaggcgtcctgtgggacgttccttcacctcccgaaacccagaaggcggaactcgaagaaggagtgtaccggattaaacagcaagggatcctaggcaagacacaagtgggtgtaggagtgcaaaaagagggagtctttcatacaatgtggcacgtaacccggggagcagtattaacccataacggaaagagactggaacccaattgggcatcagtcaaaaaggatttaataagttatggaggaggatggcgattatccgcacagtggcaaaaaggggaagaggtacaagtcatagcagtagaaccaggcaaaaatcccaaaaattttcaaacaatgccaggcactttccagacgacgaccggcgaaattggtgcaatcgcgctcgactttaaacccggcacctcaggaagtccaataataaacagggaaggaaaagttgttggattgtatggaaatggagttgtcaccaaaaatggagggtatgttagtggtatcgcacaaaccaacgcagaaccagatggacccactccagaactagaggaagaaatgtttaaaaagaggaatctaacaataatggacctccacccaggttcaggtaaaacacggaagtatctacctgccatagtaagagaagcaattaaacgtcggctacgaacactcatattggcgcctacaagagtagtcgcagcggaaatggaagaggctttaaagggattacccattcgctaccaaactactgcaaccaagtcggaacatacaggcagagaaatagtcgatcttatgtgtcatgcaacattcactatgcggctactatctccggttagagtgccgaactataacttaataataatggatgaagctcactttacagaccctgcaagcattgcagccaggggatatatttcaacaagagttggaatgggagaggcagctgcaatttttatgactgcaaccccgccggggacggccgatgcatttccacagagtaacgcaccaattcaagacgaggaaagagatatccccgaacgttcttggaactccggaaatgagtggattacagattttgcaggaaaaacagtatggttcgttccttcaattaaagctggaaacgacattgcaaattgtctgagaaagaatggaaagaaagtcatacagctatccagaaaaacttttgacacagagtatcagaaaacgaaattaaatgattgggactttgtggttactactgatatatcggaaatgggtgcgaatttcaaagcagacagagtaatcgatccaagaaggtgtttaaaacctgtaatattgacggatgggccagaaagagttatactagcaggaccaatgcctgtcacagcggcaagtgcagctcagcggcgtggtagggttggtagaaacccacagaaggaaaatgaccaatacatatttacaggacaacccctaaacaatgatgaggatcacgcacactggacagaagctaagatgctattagataatattaacacgccagagggcattatacctgccctgtttgaacctgaacgcgaaaaatcagctgcgatcgatggcgaatatagacttaagggggagagtcggaagactttcgttgagctgatgagaagaggagatttacctgtatggcttgcccacaaagttgcgtcggagggaataaaatacacggatcgtaaatggtgcttcgatggccaacgtaataaccaaattctcgaggaaaatatggacgtcgagatatggacaaaggaaggcgagaagaagaaattaagacctcgctggttagatgcgagaacgtattccgatccattggcactaaaggaatttaaggacttcgcagcaggcagaaaaagcattgcattagatttagtaactgagattggaagagtcccctcgcatttggctcatagaacaaggaatgcacttgataacttagtaatgttacatacaagtgaacacggaggtcgagcctaccgccacgcagttgaagaacttcctgaaacaatggagaccctactgctccttggattaatgattttattaacaggaggagcaatgctgtttcttatatccgggaaaggaataggtaaaacttcaataggtttaatatgcgttattgcatcatctggaatgttgtggatggctgaaatacctttacagtggatagcctcagcgatagttcttgagttctttatgatggtattattaatacccgaacctgaaaaacaacgaactccacaggataatcagcttgcatacgttgttattgggatcctcacattggcagcaattattgccgctaacgaaatgggactgttggaaacaactaagagagatctgggtatgtccaaggaaccaggtgtggtaagtccaacaagctatttagacgtagacctacacccagcttcagcttggacactttatgcagtggccacaacggtcatcacgcctatgcttcgacatacaattgaaaattccactgccaatgtttcgctagccgctattgcaaatcaagctgtagtattaatggggctagataagggctggccgatatcaaagatggacctaggtgtaccgttactcgcgttaggatgctacagtcaagttaacccccttactctaactgcagcggtcctcttgttgataacacactacgccattatcggacccggtttacaagcaaaggcgacacgtgaggctcaaaagcggacagctgcgggcattatgaaaaatccaactgtcgatggcatcatgaccatagacttagatcctgtcatctatgactccaaattcgagaagcaattaggtcaggtaatgctcctggtattatgtgccgttcaattgctgctaatgcgaacctcatgggcgctttgcgaagcactaaccctagcgactggacccataacaacactatgggagggatcaccgggcaaattctggaatacaacaatcgcggtaagtatggcaaacatctttcgcggttcatatctagctggagcaggtctagctttttccataatgaaaagcgttggcacgggaaaaagagggacagggtcccagggagaaacattaggagaaaaatggaagaagaaattgaaccaactaagtagaaaagagtttgatctatacaaaaagtctggaataacagaagtggaccgaaccgaggctaaagagggactgaaacgcggagaaataacccatcatgcggtttcaagaggtagcgctaaattacaatggtttgtagaaagaaatatggtgataccagaaggccgagtaatagatttaggttgtggacgtggtggttggagctattattgcgcgggactcaagaaagtgactgaagtacgtggttatacaaaaggtgggccaggtcatgaagaacccgttcctatgtcaacttacggttggaatattgttaaattgatgagtggaaaagatgtcttctacctgccaccagaaaaatgtgatactctcttgtgtgatattggcgaaagtagtccttctccaacggttgaggaatcgagaaccatacgggttctaaaaatggtcgaaccatggttaaagaacaatcaattctgtataaaggtactaaacccttatatgcccacagtgatagaacatttggaacggcttcaacgcaaacatggaggaatgttagtacgtaatccattaagtcgaaatagcacacatgaaatgtattggatatcgaacggaacaggaaatatagtaagcagcgtgaatatggtttcacggctcctactaaaccgtttcacgatgacacacagaaggccgacaattgaaaaggacgtagatttaggagcaggcacacgacatgttaatgcagaaccagaaacacctaacatggatgtaataggtgaacgaataaagcgcataaaagaagaacataactctacgtggcattatgatgacgaaaatccttacaaaacctgggcttaccatggaagctatgaagtcaaggccacaggatcggcgagtagcatgataaatggtgtcgtcaaattactaacaaaaccttgggatgtcgttccaatggtgacacaaatggcaatgacagatactacacccttcggacaacagagggtttttaaggaaaaggtcgatacgcgcacacccagaccaatgcctggaacacgaaaagtgatggggataacagcagagtggttatggagaactttaggacgtaacaaaagaccaaggttatgtacacgagaggagttcactaagaaagtaagaacaaatgcagcaatgggcgctgttttcaccgaggaaaaccaatgggattcagctaaagcagcggtagaggacgaagaattttggaaattggtggacagagaaagagagctacataaacttggaaagtgtgggagctgcgtttacaatatgatgggaaagcgagagaagaaactaggagaatttggcaaagctaaaggttctcgtgcgatatggtacatgtggcttggggcacgctatctcgagttcgaagcactaggattcctaaacgaagatcattggttcagtcgggataattcgtatagcggcgtagaaggcgaaggactccacaaactgggatatatattaagagacattagtaaaataccaggaggtgcgatgtatgcggacgacacagctggttgggacacaagaatcacagaggacgatcttcataacgaagagaaaataacacaacaaatggatcctgaacacaggcaattagcaaacgcaatatttaaacttacttatcaaaataaagtggttaaagtacaaagacccacccctaccggaacagttatggacatcatttctaggaaagatcagagaggaagtggacaagtaggtacttatggacttaatacatttacgaacatggaagttcaactggtgagacagatggagggagagggtgtcttatctaaagctgatctcgaaaacccacacttgcctgaaaagaaaataactcaatggttagaaacaaagggagttgaaaggctcaaacgaatggctataagcggagatgattgcgtagtaaagccaatagatgacagatttgccaatgccctcttagcacttaatgacatgggcaaagttagaaaagatattccgcagtggcaaccaagtaagggaatgcacgattggcaacaagtacctttctgctcacaccattttcatgaattaataatgaaagatggtaggaaattagtagttccttgtcgaccacaagacgagcttattgggcgagccaggatatctcaaggtgcaggttggtccttaagggaaacagcatgcttagggaaggcttatgcacaaatgtggagtctaatgtactttcatagaagggatcttagactcgcatcaaatgccatttgttcggcggtccccgtccattgggtacctacctcccgaactacatggtcgatacatgcacaccatcaatggatgactactgaggatatgctagctgtttggaacagagtttggatagaggacaatccttggatggaggacaaaacaccagtaacaacttgggaggatgttccctacttaggtaagagggaagatcagtggtgcggcagtttgataggactcacaagcagagcaacttgggctcaaaacattctgactgcgattcaacaggttcgttcccttatcggaaacgaagaatttctagattatatgccctcaatgaaaagatttcgaaaagaggaagagagcgaaggagcaatctggtaa

SEQ ID NO: 23157 - RNA, 9873 nt, synthetic construct
  misc_feature 1..9873: note = derived and/or modified CDS sequence (opt6) from DENV-3__FJ882572__SS-prME
  source 1..9873: mol_type = other RNA
acttcattatgtcttatgatgatccttccagcagcattggcgttccatttgacttctagagacggagaaccccggatgattgttggcaaaaatgaacgaggaaaatctctactctttaaaacagcttccggcatcaatatgtgtacactaattgccatggacttaggcgaaatgtgtgacgacacagtgacctataaatgtccgcatattactgaagttgagccagaggatattgattgttggtgtaatttaacgtccacctgggtaacgtacggtacttgtaatcaagctggcgaacatcggcgagacaaacgatccgtagccctcgcaccacacgtcggaatgggtcttgacaccagaacacaaacatggatgagtgcagaaggagcatggcgacaagttgaaaaagttgagacgtgggctctaagacacccaggcttcaccatattagctttatttttggcacattacatcgggaccagtttaacacagaaagtggttatattcatactattgatgttggtaacaccatcgatgaccatgagatgcgtaggggttggcaatagggattttgtcgagggtttatctggagcaacatgggtcgatgtagtacttgagcacggaggttgtgtaacaacaatggctaaaaataaaccgacactagacatcgaattacaaaagaccgaggcaacacaattggcaacactaaggaaactttgtatcgagggtaaaataactaatataacgacagatagcagatgcccaacacagggggaagctgtgttacccgaggaacaagatcaaaactatgtttgcaaacacacgtacgtcgacagaggttggggaaacggttgtgggttatttggaaaaggtagtttggtaacctgcgcaaagttccagtgcctggagtcgatagagggaaaagtggtacaatatgagaacttaaaatacacagtaataataacagtacacactggtgaccaacatcaggtcggaaatgaaacccagggtgttaccgcagagattacaccccaagcatctacaacggaagcgatcttgcccgaatatggaaccctgggattggaatgcagtccccgcacaggactcgactttaacgaaatgatattactaactatgaaaaacaaagcatggatggtgcatagacagtggttctttgatctaccattgccctggactagcggagctacaacagaaactcctacctggaatagaaaagagcttttagttacctttaaaaatgctcatgccaagaaacaggaagtagtagtattgggctctcaagagggggctatgcacaccgctcttacaggagcgactgaaattcaaaattctggcggaacatccatatttgcaggacatttaaaatgcagattaaaaatggacaaattagaattgaaaggaatgtcgtatgcgatgtgcactaacacgtttgtcctaaagaaagaagtgtctgaaacccagcacggaaccatattgataaaagtagaatacaaaggagaagatgcaccgtgtaaaatcccattctcaacagaagatgggcaaggtaaagcgcacaatggtaggttgataactgctaaccctgtggtcaccaagaaagaagaacctgtaaatatagaagctgagccacctttcggtgagagtaacatagtgataggtataggggacaacgcactcaagataaattggtataagaaaggatcaagtatcggaaaaatgttcgaagcgactgccagaggggcacgaagaatggcgattctcggagatacagcgtgggattttggaagtgtaggtggggtactaaattcattaggcaaaatggtacaccaaatatttggatcggcttacacagcactatttagtggtgtatcgtgggtgatgaaaataggaataggagttctattaacatggattggtctaaactccaaaaacacttcgatgagtttttcatgtatagctataggaatcatcactctctaccttggagccgtagtgcaagcggataccggatgtgttataaattggaaaggtaaagaactcaaatgtggttccggcatttttgttacaaatgaggtacatacatggacggagcaatacaagtttcaagcagattcaccaaaaagacttgcaactgctatagcgggagcgtgggaaaacggtgtatgtggaataagatctactaccagaatggaaaatttactttggaaacaaatcgctaacgaacttaattacatcctatgggaaaataacattaaattaacagttgtggtaggggacactattggagtattggaacaaggaaagagaactctgacaccacaaccgatggagttaaagtatagctggaaaacctggggaaaagcgaaaatagtaacagctgagatccaaaatagcagttttatcatagatggacccaacacaccagaatgtccgtcagcttctcgtgcctggaacgtatgggaagtagaagattatggatttggcgtatttacaaccaacatatggcttaaattaagagaagtatatacacagctctgcgatcacagactcatgagcgcagcagttaaagacgaacgagctgtccacgccgatatgggctattggatagagtcccaaaagaatggttcttggaaacttgagaaagccagctttatagaagtcaaaacatgcacatggccaaaatcacatacactttggagtaatggcgttttagaaagtgacatgatcattcctaaaagtcttgctgggccgatttcacaacacaactacagacccggataccatacgcagacagcaggtccatggcatctaggtaaactcgaattggatttcaattattgcgaaggtacgacagttgttattacagaaaactgtggaacccgaggaccatcactcagaacaaccacagtatctggaaaattaatacacgagtggtgctgcaggtcgtgtactctaccaccccttcgatatatgggtgaagatggttgctggtacggaatggaaattcgtccaataagtgaaaaagaggagaacatggtaaaatctttggcatcggctggttcggggaaggtggacaacttcactatgggtgtactatgtttggcaatcttgtttgaagaggtaatgcgtggcaaatttggtaagaaacacatgattgcaggagtgttctttacatttgtgttattattatccggtcagattacttggagagatatggcgcacaccctcataatgatcggttccaacgcatctgacagaatggggatgggcgttacctaccttgcactcatagctacatttaaaatacaaccgtttcttgcattaggtttctttcttagaaagctaactagcagagaaaatttattactcggcgttggactagcaatggctaccacactccaactacccgaggatatcgaacagatggccaatggcatagcactcggattgatggccttaaaattaatcacacaatttgagacctaccaactctggaccgcgcttatctctttaacatgtagtaacaccatgttcacactaactgtagcctggagaacagctacattgattctggctggtgtatcacttctgcctgtatgtcaaagcagctcgatgagaaaaacggattggctgccaatgactgttgccgctatgggggtccctccattgccactattcatattcagtttaaaggacacactgaaaagacgaagttggccattgaacgaaggtgtcatggccgtcggcttagttagcatactagcttcatcattattaagaaatgacgttccaatggccggccctctagtcgcaggaggaatgcttatagcctgctatgtaattacaggtacatctgcagacttaacggtagaaaaagcagctgatgtcacatgggaagaagaggctgaacaaactggcgtgtctcacaatttaatgataactgtggatgatgatggtacgatgcgcataaaggatgatgagaccgaaaacatcttaacagtgttactaaagacagctttactaatcgtgagtggaatctttccatattctatacctgcaactctcttagtctggcatacctggcaaaaacaaacgcaacgatcaggcgtcttatgggatgtaccctcgccgccggaaacacagaaagctgagctggaagaaggggtatatagaattaagcagcaaggaatactaggaaaaacgcaagtgggcgtaggagtacagaaggaaggcgtcttccatacaatgtggcacgtgaccagaggggcagtattgacacataacggtaagcgcctcgagccaaattgggctagcgtgaaaaaggatctgatatcctatggtggaggatggcgactttcagcacagtggcagaaaggtgaagaagtgcaagttattgctgtagaacctggcaaaaatcctaaaaattttcaaacgatgcccggtactttccagacaacaactggagaaataggtgctattgcattagacttcaaaccgggtaccagtgggtctccaatcataaatagggaggggaaagtggtaggcctatacggaaatggagtagtaactaaaaacggtggatatgtatcaggaatagcacaaacatccgcagagccagatggacctacaccggaacttgaagaagagatgtttcgtaaacgtaatttaacaatcatggaccttcaccctggatccgggaaaaccaggaaatacctcccagcgattgtccgggaagccataaaaagaagactaagaacactaatactagcacccactagggtcgtagcagcagaaatggaagaagccctcaaaggattgccgattaggtaccaaacgactgctacaaaatcagagcatactggtagggaaatcgtcgacttaatgtgtcacgcaacctttaccatgcggttactttcgcctgtccgtgttccaaattataatctgattataatggacgaagcacacttcactgatccagcatcaattgctgcccgagggtacatttctactagggtcggaatgggagaagcagccgcgatatttatgaccgcaaccccgccagggactgcagatgcctttccacaaagtaatgctccaattcaagacgaagaaagggacatacctgaaaggtcttggaatagcggaaacgaatggataacagattttgcagggaagacagtttggtttgtaccaagcataaaagccggaaatgatatagcaaactgtctcaggaaaaacggtaaaaaggtgatacaactatcacgaaaaacgtttgatacggaatatcagaagaccaaactaaacgattgggattttgtagtcacgactgatataagtgaaatgggtgcaaatttcaaagccgacagagtaattgatcctagacggtgtttgaaacccgtgatattaactgatgggcccgaaagagtcattctagcaggaccaatgccagtaacggcagcatccgctgctcaaagaagaggacgcgtaggtcgcaaccctcaaaaagaaaatgaccagtacatatttacagggcagccgctaaataatgacgaagatcatgctcactggacagaggcaaaaatgctattagataacatcaatacaccagaagggataataccggcgcttttcgagccagagagagaaaaatctgcggcaatcgacggagaataccgactaaagggtgaatcacgaaaaacctttgtagaacttatgcgtagaggtgacctaccagtgtggctagcacataaagtagcatctgaaggaataaaatacacagaccgaaagtggtgtttcgatgggcaaaggaataaccaaattcttgaggaaaatatggacgtagagatttggacaaaagaaggagaaaagaagaaattaaggcccagatggctagatgcaagaacttattctgatccactggctttaaaagaatttaaagatttcgccgcaggcagaaaaagtatagccctagacctggttacggaaattggccgcgtccccagccacctagctcaccgaacaaggaacgcattagataatctagttatgcttcatacaagtgaacacggcgggcgggcatacaggcatgctgttgaggaactaccagaaacaatggaaaccctactactcttaggtttaatgatcttattgacaggtggtgctatgttgttcctaatttccgggaaagggattggtaaaacgtcaataggtttaatttgcgtgatcgcaagttcaggaatgttatggatggcggatgtgccattacaatggattgccagtgcaattgtattagagttctttatgatggtcttgttaattccggaacccgaaaaacaacgtacaccgcaggataatcaacttgcttacgtcgttatcggaatactaactttagctgcaataattgcagcgaacgaaatgggactactagagacgaccaagagagacctaggtatgagcaaagagccgggcgtagtaagccctacaagttatttggatgttgacttacatccggcttcagcatggactttatatgctgtagcaactacagtaattacacctatgttacgacatactatagaaaactcaaccgcgaacgtatccttagcggcaatagcaaaccaagctgttgtcttgatgggtctagataaagggtggcctataagtaagatggatctcggagtgccattgctcgcactaggttgttattctcaagtgaatccgttgacactgacagctgcagtattactcctaataacgcactatgcaataatcggaccaggtctgcaagctaaagccactcgagaagcccagaagcgaactgcagcgggtataatgaaaaacccaacggtagatggcataatgacaattgacctcgaccctgtgatttacgattctaaattcgaaaaacaactgggacaagtcatgctattagtgttatgtgcagtccaactcttattaatgagaacctcatgggcattatgcgaagcactcacattagcaaccggtcctataacaactttatgggaaggatcaccagggaaattctggaacacgacgattgcagtgtccatggcaaacatatttcgcggatcatacctagcaggagctggtttagcgtttagtataatgaaaagtgtcggtacaggaaagcgtggtacggggtcgcaaggagagacattaggggagaaatggaaaaagaagttaaatcaactatcacgtaaggagttcgatttatacaaaaagagcgggatcacagaggtcgacagaacagaggctaaagaggggctaaagagaggtgaaacaacccaccatgccgtatctcgagggagtgcaaaactccaatggtttgtagaaaggaatatggttatacccgaaggtagagtcatcgacttgggatgtggaagagggggatggagttattattgcgccggattgaagaaagtaactgaagttcggggttatacaaaagggggtcccggacatgaagaacctgtaccgatgtcaacttacggctggaacatagtaaaattgatgagcgggaaagacgtattctatctccctcccgagaaatgtgacaccctgctttgtgatattggtgagtcgagtccgtcaccaacagttgaggaaagtagaacaatacgagtactgaaaatggtagaaccgtggctaaagaataatcaattttgtataaaagtcttaaatccgtacatgcctacagtaatagagcacctcgaaagactccaacgaaaacatggtggtatgcttgtgaggaaccccttatcgagaaattcaacacatgaaatgtattggattagtaatggcaccggaaatatagtctcaagtgtaaatatggtcagcaggttattattaaacagattcacgatgacacatcgacgtccaacgattgagagagacgtcgacctaggcgccggtactaggcatgtaaatgcagagcctgagattccgaatatggatgtaataggcgaacgtataaagaggataaaagaagaacataactcgacctggcattatgacgatgaaaacccttataaaacgtgggcttatcacggttcctacgaggttaaagcgacgggtagtgcttcctccatgataaatggtgtcgtaaagttattaacaaaaccatgggatgttgtgccaatggttacacaaatggctatgaccgacacgaccccatttggacaacaacgagttttcaaagagaaagtcgatacacgtacccccagacctatgccaggaacaagaaaggtcatggaaattacggcagaatggctgtggcgaacgttgggaagaaacaagcgtccaagactgtgcacaagggaagaatttacgaagaaagttcgcaccaatgctgcgatgggcgctgtgtttacagaagaaaaccagtgggacagcgcaaaagctgctgtagaagatgaagaattttggaaattagtcgatagagaaagagaactacacaaactaggtaagtgtggttcatgtgtctacaatatgatgggaaaacgagagaagaaactgggagagttcggaaaagcgaagggctcacgtgcaatttggtatatgtggcttggcgcaagatatctagaatttgaagcgttaggctttttaaatgaagatcattggttttcaagagagaactcctattctggcgtcgaaggagaaggacttcataagctaggctatatcctacgcgacatatcaaaaattcccggtggtgccatgtatgcagacgataccgcgggctgggatacaaggattaccgaggacgatttacataacgaagagaaaattactcaacaaatggaccccgaacacagacaactagccaacgcaatattcaaattgacatatcaaaataaggtcgtgaaagtccaaaggcccacccccacgggaacggtaatggatatcatttccagaaaagatcaaaggggttcgggtcaagtcggcacctatggcttaaatacctttacaaatatggaagctcagttagttcgtcagatggaaggtgaaggggttctctctaaagctgatttagaaaatccacacttattggagaagaaaataacacagtggttggagacaaagggagtagagcgtttgaaaagaatggcgatatctggagatgactgtgtggttaaaccaatcgacgatagattcgctaatgcactgctggctctcaacgatatgggtaaggttcgcaaagatataccacaatggcaaccatcaaaaggatggcacgattggcaacaagtccccttctgttcgcatcactttcacgaattgattatgaaagatggccggaaattagtagtcccgtgccgcccacaagatgaactaataggtagagctaggataagccaaggggcagggtggtctctacgggagaccgcctgcctaggaaaagcctatgcgcaaatgtggagtctgatgtattttcatagaagagatctgagacttgcgagtaacgcgatatgtagcgcagtacctgtacattgggtcccaacttcaagaactacatggtccatacacgctcatcaccagtggatgacgaccgaagatatgttaactgtctggaatagggtatggattgaagacaacccatggatggaggacaaaacgccagtgactacctgggaaaatgtcccatatctaggaaaacgggaagatcaatggtgtggttctctaataggcttaaccagtagagctacttgggctcaaaatatccctacagcaatacaacaagttagatcacttatcggaaatgaagaatttttggactatatgcccagtatgaaacgctttcgaaaagaagaagaaagtgagggggctatatggtag

SEQ ID NO: 23158 - RNA, 9873 nt, synthetic construct
  misc_feature 1..9873: note = derived and/or modified CDS sequence (opt6) from DENV-3__FJ882573__SS-prME
  source 1..9873: mol_type = other RNA
acgtcactttgcctaatgatgatattaccagctgcacttgcatttcatcttacatcaagggatggtgaaccacgcatgatagttggcaaaaatgaaaggggaaaaagtttactatttaaaaccgcgtcagggataaatatgtgtacattaatagcaatggacttgggtgaaatgtgcgatgacacagtcacgtacaaatgtccacatataacagaagtagaaccggaggatatagactgctggtgtaatctaacaagtacatgggtgacttatggcacgtgtaatcaagcaggagagcatagacgggataaaaggagtgttgcattagcacctcatgtaggaatgggtctagacacaaggacacaaacctggatgtcggctgagggagcgtggaggcaagtcgaaaaagttgaaacctgggcacttagacacccaggcttcacaatattagcattatttcttgcgcattacataggaacttctctcacacaaaaagttgttatttttatcttattgatgttagttacaccaagtatgacaatgcgatgtgtgggggttggaaaccgggattttgttgaaggattatctggagcaacatgggttgatgtcgtgcttgaacatggcggctgtgttacaactatggccaaaaacaaaccaactctagatattgagctccagaaaactgaagcaactcaattggcaacgttgagaaaactatgcatagaaggaaaaatcacaaatataacaacagattctcgatgccccactcaaggtgaagctgtactcccagaagaacaagatcaaaattacgtttgcaaacatacttatgttgatagaggatgggggaatggttgtggcctttttggaaagggttctctagtaacatgcgccaaatttcaatgtcttgaacctattgaaggtaaagtggtacagtacgagaacctcaaatacacggtcattataactgtgcatacaggagatcaacaccaagtaggaaatgaaacacaaggagttacggccgagatcacaccccaggcttccacaacagaagccatactacccgaatatggaactctgggactggaatgttctcctcggacaggattagactttaacgagatgatactattaacaatgaaaaataaagcatggatggttcataggcaatggttctttgatttacccttaccttgggcatctggggcaacaactgagactccaacatggaacaggaaagaactgttagttacatttaaaaatgcacatgctaagaaacaagaagtagttgtattaggtagtcaggaaggggccatgcatacggcgctcacgggagcgaccgagatacaaaattctggaggcacgtcaatcttcgcgggccatctgaagtgcagactcaaaatggacaaattagaattaaaaggtatgagctatgcaatgtgtaccaatacatttgtgctgaagaaggaagttagcgaaacacagcatggcacaatattaattaaagtcgagtataaaggagaagatgcaccatgtaaaatacccttcagtacggaagacggacaagggaaagcacataacggtagattaataacggctaatccggtagtaaccaagaaagaggaaccggtgaatattgaagcagaacctccatttggtgagagtaatatagtgataggcattggggacaacgccttaaaaataaattggtataagaaaggcagttccattggcaaaatgttcgaagctacagcgaggggtgccagaagaatggctattttaggagacactgcatgggactttggatcggtcggaggagttttaaattcactggggaaaatggtacatcaaatctttggatcagcctacaccgcattgttcagtggcgtctcgtgggttatgaaaatcggcataggagtgctactgacgtggattggactaaactctaaaaacacacctatgtcatttagttgtattgcaattggaataataactctatacttgggagccgttgttcaggcagacatgggttgtgtcattaactggaaaggtaaagaattgaaatgcgggtcaggtattttcgtaacaaatgaggtgcatacttggacagaacagtataaattccaagccgactccccaaaaagattagctacagctatcgctggagcatgggaaaatggtgtttgcgggataagaagcacaactcgaatggaaaacctattgtggaagcaaatcgcaaatgaactaaactacattctgtgggaaaataacataaaactcaccgtagtagtgggagatacaactggagtactagaacaaggaaaacgtacactaacgcctcaaccaatggagcttaagtatagttggaaaacttggggaaaagctaaaatagtaaccgctgagacccaaaattcttcattcattatcgatggacccaatactccggaatgccctagcgcctcaagagcttggaacgtttgggaagtcgaagactacgggttcggagtgttcacaactaacatctggttaaaacttcgagaagtttatactcaattgtgcgaccatagattaatgtctgccgctgttaaggacgaaagagccgtccacgccgatatgggctactggatagaatcacagaaaaatggaagttggaaactggaaaaagcctcgctaatcgaagttaagacctgcacgtggcccaagtctcacaccctttggagcaatggggtactagaaagcgatatgatcataccgaaaagcctggctggtcctatcagtcagcataattatagacccggctatcatactcagactgctggtccctggcacctaggtaagttagagttagatttcaattattgcgaaggcacaacggtggtaataacagagaattgcggaacccggggaccctcgttaaggacaacaaccgtatcgggcaaattgatccacgaatggtgttgtaggtcctgtactctcccaccattgcggtatatgggagaagatggttgctggtacggcatggaaatacggcccatatctgaaaaagaagaaaatatggtgaaatcattggtgtcggccggtagtggaaaagtagataatttcactatgggagtcctctgtcttgcgatactgtttgaagaagtcatgagaggcaaatttggtaagaagcacatgatcgcaggagtattctttacatttgttctacttttaagcggacaaataacgtggagagatatggcgcatacattaatcatgataggatctaatgcgtcggatcgtatgggtatgggagtaacgtatctcgccctcatagcaaccttcaaaatacagcccttcttagcccttggattctttctcagaaaactaacgtctcgggaaaaccttctactaggtgtaggattagcaatggcaactactctacagctgccggaagacatagaacaaatggcgaacggaatagcacttggcctaatggcgttaaaattaataacacagttcgaaacgtatcagctgtggactgcattagtaagcctaacttgttccaatacaatatttacactcaccgtagcctggagaacagcaacactaatattggccggcgtgagcctgttaccagtgtgtcaatcatcgagcatgagaaaaacggactggttacctatgacggttgcagcaatgggggtaccacccctacctttatttatatttagcctgaaagatactttaaagcgacgatcgtggcccctaaatgaaggtgtgatggctgttggactcgtaagcattttagcctcgagcctccttcgcaatgatgtcccgatggcggggcccttagtggcgggtgggttacttatcgcgtgctatgtaatcacaggtacatctgccgatcttacggtagagaaagcagctgatgtcacatgggaagaagaagcggaacaaactggggttagccacaaccttatgattaccgtcgacgatgatggcactatgagaataaaagacgacgagactgaaaacatactaactgttttgcttaaaaccgcgttgctcatagtctctggaatattcccatacagcatcccagcgactctcttagtatggcatacgtggcagaaacaaactcagagaagtggagtattatgggatgtaccctcaccaccggaaacacaaaaagctgaattagaggaaggcgtatatcgcataaaacagcaaggcattctaggtaaaacgcaagtcggagttggagtccaaaaagaaggagtattccataccatgtggcacgtaacgagaggagcagtacttacacacaacggtaaaagactagaacctaattgggccagtgttaaaaaggatttaatctcttatggaggcggttggagattatcggcacaatggcagaaaggagaagaagtacaagtcattgcggttgagcctggcaaaaatcccaaaaacttccaaacaatgcctggtactttccagaccacgactggcgaaataggagcgatcgctcttgattttaagcctggtacgtcaggctcacctataataaatagagaagggaaggttgtcgggctatatgggaatggcgtagttactaaaaacggaggatacgtatctgggatagcacaaacaaacgcggaaccagacggaccaactcccgaactagaagaagagatgtttaagaaaaggaatctcacaataatggatctccaccccgggtcaggaaaaactcgaaaatacctccctgcgattgtgagagaagcgatcaagagaaggttacgaacattaatcttggctccaacgagagtagtcgctgcagaaatggaagaagctcttaaaggattaccgattagatatcaaactacagcaaccaaatcagaacacactggcagagagattgtagacttgatgtgtcacgccacttttacaatgagattattgagcccagtacgcgtaccaaattacaatctcatcataatggatgaagctcatttcacagaccccgcgtctatagctgcgaggggatacatttcaactcgagtgggcatgggggaagccgctgcaatatttatgacagcaacaccaccaggtacggcggatgccttcccccaatcaaatgcaccaatacaggatgaagaaagggatatacccgagaggtcatggaactcggggaacgaatggataacggattttgccggcaaaactgtatggtttgtcccgagtataaaagcaggtaacgacatagcaaactgcctgcggaagaatggtaagaaagtaattcaattatcaagaaagacatttgatacagaataccagaaaactaaactaaacgattgggattttgttgtgaccacagacataagcgaaatgggagctaatttcaaggccgaccgggttatagaccctcgtcgatgcctcaagcctgtgatactaacagatgggccggaacgtgttatactagcaggcccaatgccagttacagccgcatccgcggcacaacgacgtgggcgtgtaggacgtaacccgcaaaaagaaaatgaccaatacatatttactggtcaaccactgaataatgacgaagaccatgcacattggactgaagctaaaatgctactcgacaatatcaacacgcctgagggaatcataccagcgctattcgaacccgaacgtgagaaatctgcggcaatagacggtgagtatagacttaaaggcgaaagcagaaaaactttcgttgagctaatgaggcggggagatctaccagtttggttagcccacaaggtggcatcagaagggataaaatatacagaccgaaaatggtgttttgacggacaaagaaataatcagatattggaagagaatatggatgtcgagatttggacaaaagagggagaaaagaagaaattacgaccccgctggctagatgctaggacttattcagaccccctagcattgaaagagtttaaagactttgccgccggaaggaaatctatagctttggatctcgttacagaaataggaagagtacctagccacttggcgcacagaacccggaatgcactcgataacttagtaatgttgcatacaagtgaacacggtgggagagcatatcgccacgcggtagaagagttaccagaaactatggaaactttattacttctaggccttatgatattactcactggcggagccatgttattcctaatcagtgggaaaggtatagggaagacaagcatagggttaatttgtgttattgcatcgagcggtatgctctggatggctgaagtacccttgcaatggattgcttcggctatcgtactagaatttttcatgatggtactactcatacccgaaccggagaaacaaaggacacctcaggataatcaattagcttatgtggtaattggaatactgacattagcggcaatgatagcagcaaatgaaatgggactattagagacaacaaaaagagatctaggcatgtccaaagaaccgggcgttgtctcaccgacatcatatcttgatgtagatctgcatcctgcgtcagcctggactctttatgcagtcgcaacaacagtaataacaccgatgcttcgacatacgatagaaaatagcacagccaatgttagtcttgctgcaattgcaaatcaagctgttgtattaatgggtctggacaagggttggccaatatcgaaaatggatttaggagttccattgctcgcattaggatgttatagccaagtaaatcctctaacattaactgctgcagttttacttttaatcacacattatgcgatcattggtcccgggctgcaagcaaaagcgactcgagaagcgcaaaaacggaccgctgctgggattatgaaaaatccgacagtagacggaatcatgacaattgatctcgatccggtcatctacgatagtaaatttgaaaaacagcttggacaggtaatgttacttgtactgtgtgcagttcaattattgctaatgaggacgtcttgggccctatgtgaagcactaactctagcgactgggccaataactacactttgggaagggtctccaggaaaattttggaacactacaatagctgtaagtatggcaaacatctttcgtggctcatacctagccggtgcgggattagcattcagcataatgaaaagcgtaggtacaggaaaaaggggtacaggctcccagggggaaactttgggtgagaaatggaagaagaaactcaatcaactatccagaaaggaatttgacctttacaaaaagagcgggattactgaagtagacagaacagaagctaaagaaggtttgaagcgtggagagatcacccaccatgcagtgtctcgagggagcgcgaaattacaatggtttgtagaacgcaatatggtagtcccggaagggcgagtaatcgatcttggatgtggacgtgggggttggagttactactgcgcagggctaaagaaagtaactgaagtacgtggatatacaaaaggagggccaggtcatgaagaaccagttcccatgtccacctacggatggaatatcgttaaactcatgtctggaaaagatgttttctacttacctccagaaaaatgtgacacactactatgtgatataggggaatccagtccttctccgacagtggaagaatcaagaacaataagagtactgaagatggttgaaccttggttgaaaaataaccaattctgcataaaggtcctaaacccttatatgccaacagtaattgaacacctagaaagactacaaagaaagcatggaggtatgttggtgagaaaccctttaagcagaaattcaacacacgaaatgtattggattagtaatggaacgggaaatatagtaagtagtgttaacatggtaagcagattgttattaaacagattcacaatgactcatcggagacctacgatagagaaagacgtagacttgggtgccggtacacgtcacgtaaacgccgagcccgaaactcccaacatggacgtgattggcgaacgtgtgaaacgtattaaggaagaacacaatagtacgtggcactatgacgacgaaaatccatacaaaacatgggcatatcacggctcatacgaagttaaggcaacaggcagcgcttcttctatgattaatggtgttgtcaaattacttacgaaaccttgggatgtagtcccgatggttacacagatggctatgacagatacgacgccctttgggcaacaacgagtgtttaaagaaaaagtagatactcgaacaccaagaccaatgcccggcacgagaaaggtaatggaaataacggcggagtggctatggcggacgctgggacgcaataaaagaccgcgactatgtactagggaggaatttaccaaaaaggttaggacaaatgcagcgatgggagcggtatttacagaagaaaatcagtgggatagtgctaaggctgctgttgaggatgaggaattttggaaattggttgatagagaaagagaattacacaaacttggaaaatgtggcagttgcgtctacaatatgatgggtaaaagggagaagaaactaggtgaatttggaaaagcaaaaggttctcgagcgatatggtatatgtggctgggcgcgagatacctcgaatttgaagcattagggttcctaaacgaagaccactggttctcaagagagaatagttattcaggtgtagaaggagaaggcctacataaattgggctatatacttcgggatatcagtaagatacctgggggagcaatgtacgcggatgacacagctggttgggatacaagaataactgaagatgacctacataatgaagagaaaatcattcagcagatggacccggaacatagacaactagcaaacgcgatattcaaattaacataccaaaataaagtcgtcaaggtccagagacccaccccaacaggcactgttatggacattatatcccgtaaggaccaaagaggaagtggacaggtgggcacatatgggcttaatacttttactaacatggaggctcagttggtccgtcaaatggaaggcgaaggagtactaaccaaagccgaccttgagaatcctcacttattagaaaagaaaattacacaatggttagaagcaaagggagtggaaagacttaaaagaatggcgatatcaggagatgactgtgtcgttaagcctatcgatgaccgatttgcgaatgccttattggctctcaatgatatgggtaaagtaaggaaagatattccgcaatggcaaccaagtaaaggatggcatgactggcaacaagtgcccttctgttcacaccactttcacgagttgataatgaaagacggtagaaagctggtagtcccgtgtagaccacaggacgaacttatcggcagggctagaatttcccaaggagcaggatggtctttaagagagacagcttgtctaggcaaggcatacgcacagatgtggagtctgatgtattttcatagacgagatcttagactagcatcaaatgcaatctgctcagccgtacccgttcattgggtgccaacgtccagaaccacgtggagtatacatgcacaccatcagtggatgacaacggaggatatgttaactgtatggaatagagtatggatagaagaaaatccatggatggaagataaaaccccggtcacgacgtgggaaaatgtaccttatctaggcaaaagggaagaccaatggtgtggaagtctaataggtctaactagcagagcaacatgggcacaaaatattccaactgcaatccaacaggtacggagtctgattgggaatgaagagtttctagattacatgcctagcatgaagagattccgaaaggaggaggagtcagagggagccatctggtga

SEQ ID NO: 23159 - RNA, 9873 nt, synthetic construct
  misc_feature 1..9873: note = derived and/or modified CDS sequence (opt6) from DENV-3__FJ898440__SS-prME
  source 1..9873: mol_type = other RNA
acatcattgtgcctgatgatgatattaccagcagcactagcttttcacctaacatctcgggatggagaacctaggatgattgtaggtaaaaacgaaagaggtaaatcgttactttttaaaaccgcatccgggattaatatgtgcacactgattgctatggatttgggtgaaatgtgtgacgacactgtaacatacaaatgtccacatataacggaagttgagccagaagatatagattgctggtgtaatttaacttcgacctgggtaacttatggaacttgtaaccaagcaggagagcatagacgtgacaaacgctctgtagcactggcaccacatgttggcatgggattggacacccgtacacaaacatggatgtctgcagaaggtgcctggcgacaagttgagaaagtggaaacctgggctcttagacatcctggcttcacgattttggcgctattccttgcgcattatataggcacatcattgacccaaaaagtagtaatattcattttattgatgcttgtgactccatcaatgaccatgagatgtgtcggcgttgggaatagagattttgtggaaggcctgtctggtgctacatgggtagatgtagtattggaacacggaggatgcgtcacaactatggccaaaaataaaccgacactagacattgagttgcagaaaacagaagcaacacaattagcaactttacgaaaactatgcattgagggaaaaataactaatattacgacagactctcgctgtccaacacaaggcgaagcagtgctgcccgaggaacaagatcaaaattacgtatgcaaacacacgtatgtagatcgtgggtggggaaatggttgtggcctttttggaaaaggatcgctagtaacatgcgctaaatttcaatgtctagaaccaattgaaggaaaagtggttcaatatgagaatctaaaatacactgttataataacagtacacaccggagaccaacatcaagttggaaatgaaactcagggtgttacagctgaaataacgccacaagcatcaataacagaagccattttgccagaatacggtacgctaggtttagaatgtagtccacgaactggattagatttcaatgaaatggtactactcacaatgaaaaataaggcttggatggtacacagacaatggttctttgaccttcctctgccgtggaccagtggggcaactactgaaacaccgatatggaatagaaaagaactattagtcacgtttaaaaatgcacacgccaagaaacaagaagtagttgtattgggaagtcaagaaggtgctatgcatacagcactaactggtgccacggaaatacaaaactccggcggtacaagtatatttgctggtcatctgaaatgtagactaaaaatggacaaactagaactcaagggaatgagctatgctatgtgtacaaatacctttgttctcaagaaagaagtaagcgaaacacagcatggcacaatcttaattaaagtcgaatacaaaggagaagatgcgccgtgtaaaatacccttctcaacggaagacggccaaggtaaagcgcataacgggagattaattacagcaaatccagtagtcacgaagaaagaagaaccggtaaatatagaagcagaacctccttttggggaatcgaatatagtgatagggattggtgataacgctttaaaaataaattggtataaaaagggatccagcataggaaaaatgttcgaagcaacggctagaggagcaaggcggatggcaatattaggagacaccgcatgggacttcgggtctgttggcggtgtgcttaactcattgggaaagatggtccaccaaatatttggcagcgcgtacacagcactattttccggagtatcttgggtaatgaaaataggaataggagtacttcttacgtggataggattaaatagcaaaaacactagcatgtctttttcttgtatagccattggaataataactctctatttaggagcagttgttcaagcggatactggatgcgtcatcaattggaaaggaaaagaattaaaatgtggaagtggcatattcgttacaaacgaagtacacacctggacggagcagtacaagtttcaagctgactcacctaagcgactagctactgctattgcaggagcatgggaaaacggagtttgtggcataagatcaaccactaggatggaaaatcttttatggaaacaaatagccaacgagctcaattatatcctgtgggaaaataatataaaattaaccgtagtagtgggtgatatcatcggggtattagagcaaggtaaaagaactctcactccacaaccaatggaactaaaatattcgtggaaaacgtgggggaaagcgaagattgtgactgcagaaacacagaactcctcatttataatcgatggtccaaacacccccgaatgtccgtcagcatcacgggcgtggaatgtctgggaagtagaagactatgggtttggagtctttacgacaaatatatggcttaaactaagagaggtatatactcaactatgtgatcatcgcttaatgagcgcagcggtgaaagatgaacgagctgtacacgctgacatgggctattggatagagagccagaaaaacggatcgtggaaattggaaaaagcctcactgattgaggtcaaaacatgtacatggccaaaatcacatactttgtggtctaacggagtcctagaaagtgacatgataatccccaaaagtttagccggaccaatcagtcagcataactatcgccctggttatcatacacagacagccggaccctggcatttaggcaaattagagttagactttaattattgtgaagggacgacagtagtgataacagaaaactgcggaactagagggccatctttacgaaccacgacggtaagtggcaagctaatacatgagtggtgttgtcgatcatgtacactacccccacttagatatatgggtgaagatggttgctggtatgggatggagataagaccaatttcagaaaaggaggaaaatatggtaaaatcattagtttcagctggttctggtaaagtagacaatttcactatgggagtcctatgtttagccattcttttcgaagaagtaatgagagggaaatttggcaagaaacatatgattgctggagtatttttcacatttgtgttgttactttcagggcaaataacctggagggacatggcccacacactcatcatgataggaagtaatgccagcgaccgaatgggcatgggcgtcacatatctggcactaatcgctacttttaaaatacagccattcttagccttaggtttcttcttaagaaaactaacgagtagagaaaatttgctattgggggtcggcctggcaatggcaactacgttacaattaccagaggacatagaacaaatggcaaacggaatcgcccttgggttaatggctctaaagttaattacgcagtttgaaacatatcaattatggactgcacttatctcattaacgtgttcgaatacgatctttacactaacggtcgcgtggcgtacagctacactcatattagcgggtgtaagtttgttaccagtatgtcagagctcatcgatgcgtaaaacagactggctgccaatgacagtagcagctatgggagtgcaacccctgccactctttatattctctttaaaggacacgttaaaacgacgatcgtggcctttgaacgaaggtgtgatggcggtgggattagtgagcattttagcatccagtttattaagaaatgatgtaccaatggctgggccgctagtcgcgggaggccttctaatagcctgctacgtaataactgggacctctgctgatctaacagtcgagaaagcagcagacgtaacctgggaagaagaagcagagcaaacaggggtctctcacaacttaatgataactgtagatgatgatggtaccatgcgtataaaggacgatgaaactgaaaatatactgactgtattattaaagactgccctactcatagtcagcggcatattcccatattctattccagcgacgcttttagtgtggcatacctggcaaaaacaaacacagcgatctggtgtcttatgggacgtaccaagccctcctgaaacacaaaaagcagagttagaagagggagtatatagaataaaacaacaaggcatttttggtaaaacacaagtgggagtaggtgttcagaaagaaggtgtatttcacacaatgtggcatgtaacaagaggagccgtactgacttataacggaaagagactagaaccaaattgggcgagtgtcaaaaaggatttgattagctatgggggaggatggagactgtcagctcaatggcaaaaaggagaagaagtacaggttatcgcagttgaacctggcaagaatccgaaaaactttcaaactatgccaggaacttttcaaacgactactggagaaattggagcgatagcactagatttcaaaccaggaaccagcggtagccctatcataaacagagaaggcaaagtagttgggctatatgggaatggagttgtaaccaagaatggaggatatgtcagtggtatagctcaaactaatgcagagcctgacggaccaacaccggaactagaggaagaaatgttcaagaaaagaaatttaacaataatggatctccaccctgggtcaggcaagactcgcaagtacttaccagctatagtaagagaagcaattaaaagaagattaagaactctaattttagcccccacgcgagtagtagcggcagaaatggaggaggcattaaaaggattaccgatccgatatcaaactacagcgacgaagtcagaacatactggccgcgaaatagtcgatttaatgtgtcacgcgacattcaccatgcgattactatccccagtaagagtaccaaattataatctcattatcatggatgaagcccatttcaccgatccagcaagcattgcggcacgaggatacatttccacccgcgtgggcatgggagaagcagcagctatattcatgactgcaacacctccgggaacagcagatgcatttccacaatcaaacgcaccgatacaagatgaggaacgtgacataccagaacgctcttggaacagcggtaacgagtggattacggattttgctggtaaaacagtatggtttgtaccatccataaaagcaggtaatgacattgccaattgcctaaggaaaaatggcaagaaagtaattcaattgtcaaggaaaactttcgatactgagtatcagaaaacaaaactaaatgattgggattttgtagttaccacagacatctcagagatgggcgcaaatttcaaagccgatcgtgtaatagatcccagacgttgtcttaagcctgtgattttaacggacggacctgagcgagtaatcttagccggaccaatgccggtaacggcagcaagtgcagctcaaagaagagggcgagtaggaaggaatccgcaaaaagaaaatgaccaatacatcttcacgggacagccactaaataacgatgaggaccatgctcattggacagaagctaaaatgcttttagacaatataaacactccggagggaattattcccgcgctatttgaacccgagagagaaaaatctgctgcaatcgatggagaatatagattaaagggagagtcccggaagacttttgtagagctaatgagaagaggtgatctacctgtatggcttgcgcataaagtagcttcagaaggcattaaatatactgatcgaaaatggtgtttcgatggacagcgtaataaccaaattttagaagaaaacatggatgtagaaatttggactaaagaaggggagaagaagaaactccgcccccgatggctagatgctagaacatattcagacccactagctttaaaagaatttaaagacttcgccgctggccgaaaaagcattgctctagatctggtaacagaaattggacgtgtgcctagtcacttagcacatagaacgagaaatgcattagataatctagtcatgctacatactagcgaacacggcgggagagcttaccgtcacgcagtagaagaacttcctgaaactatggaaactctgttactattaggtttgatgattttactaactggaggagcgatgttattcttaatcagtggtaaaggaatagggaaaacgagcataggattaatttgtgtaatagccagtagcggcatgctatggatggccgaaattccgcttcaatggattgctagcgcaattgtactagagttctttatgatggtattgttaataccggaaccagaaaaacaacgtacgccccaagataaccagttagcgtatgtagtcataggaatactaacattagctgcaattatagcagcgaatgaaatggggctactagagaccaccaagaaagatttagggatgagtaaagaacccggtgtcgtaagtcctacatcgtatttagatgtcgacttacacccagcaagcgcctggaccctatatgcagtagccacaaccgtgataactccaatgttgaggcatacaatcgagaactctaccgcaaacgtcagcctggccgcaattgctaatcaggctgtagtgcttatgggattagataaaggatggccaatttcgaaaatggatttaggtgtgcctctgcttgctctgggatgttacagtcaagtaaatccgttaacattgacggctgccgtgctactcctcattacacattacgctatcataggcccgggactacaagctaaggcaacaagagaagctcaaaaacgcaccgccgctggtattatgaaaaatcccactgtagatggaatcatgacaatagatctagaccctgtcatatacgattcaaagttcgaaaaacagttagggcaggtaatgttactcgtgttatgcgccgtacagttactactaatgaggacctcttgggcattatgtgaagcactaactctggctacaggtccgataacgactttatgggaaggttctcctggcaaattttggaatacaacaattgccgtatccatggctaatatctttcgaggttcatatttggcaggagcgggcttagccttcagtatcatgaaaagtgtaggcactggaaaaagaggcacagggtcacagggcgaaacactaggtgaaaaatggaagaagaaattaaatcaactatctagaaaggaatttgatctatacaagaaatccggaatcactgaagtagaccgaacagaagcaaaagaagggttgaagagaggggagataacgcatcacgcggtgagtagaggaagcgcaaaactgcagtggttcgttgaacgtaacatggtaataccggaaggcagggtaattgatctgggatgtggacgaggaggctggtcatactattgcgcaggattgaagaaggtaacagaagtaagagggtacactaaagggggtcctgggcatgaggaaccggtcccgatgagtacgtatggctggaatattgtaaaactgatgtcaggaaaagatgtgttctacttaccaccagagaagtgtgatacactcttgtgcgatataggagaatcctcaccttcaccaactgtggaggaaagtcgtactataagagtcctcaagatggtcgagccatggctcaaaaacaatcaattctgcataaaagtactaaacccatacatgccgacagtcattgaacatcttgaacgtcttcaacgaaagcatgggggtatgttagtaaggaatcccttaagtcggaacagtacccacgaaatgtattggatttccaacggtacaggaaacattgtagcatcagtaaatatggtgagccgtctactacttaatcgctttaccatgacgcacagaagaccaactattgaaaaagacgtcgacttaggagctgggacacgccacgtaaatgcggaacctgaaaccccaaacatggatgtaataggagagagaatcaaacgaataaaagaagaacataactccacttggcactacgacgacgaaaatccatacaaaacatgggcatatcatggaagttacgaagtaaaagccacgggatccgcgagtagcatgataaacggagttgttaagttattaactaaaccatgggatgtcgtcccaatggtaacacagatggcaatgacagacacaaccccgttcggccaacagcgcgtatttaaggagaaagtggacacacgaactcctagaagtatgccgggcacaagacgtgttatgggaataactgccgagtggttatggcgtacattgggtcggaacaagaaaccacgactatgtactcgtgaagaatttactaagaaagttagaacaaatgcagcaatgggagccgtctttacagaagaaaaccaatgggactcagctaaggcagctgttgaagatgaggatttttggaaactggtggacagagaacgagagttacataaacttggaaagtgtggttcgtgtgtttataacatgatgggaaaacgcgaaaagaagttaggtgagtttggtaaagctaaaggaagccgcgcaatctggtatatgtggttaggggctaggtacctagaatttgaggcattagggttcttaaatgaagatcactggttttctcgagaaaactcttattccggcgtagagggagaaggtctacataaattaggatatattttacgtgacatcagcaagatccccggtggtgcaatgtacgctgatgacacggccgggtgggacactcgtataaccgaagacgatttacacaatgaggagaaaattactcaacaaatgaatccagaacatcgacaactggccaatgccatatttaagttgacataccaaaacaaagtggttaaagtccaaaggccaacccccactggcacagtcatggatattattagtaggaaggatcaacgaggatccgggcaagtaggaacttacggactgaataccttcacgaacatggaagcacaactaatacgacagatggagggcgaaggcgtgttatcgaaagcagatttggagaacccacaccttcctgagaagaaaatcactcaatggcttgaaactaaaggcgtagaacgcttgaagcgaatggcaatatcgggcgacgattgcgtagtgaaacctatagatgaccgatttgctaatgcactactagcacttaatgacatggggaaagtgagaaaagatattccacaatggcaaccgagcaaaggttggcatgattggcaacaagttccattctgctcacatcatttccatgaattaattatgaaagacggtagaaaacttgttgtaccgtgtagaccacaagatgaactaataggacgagcgcggatttcccaaggagccggctggtctctcagggaaactgcttgcttgggtaaggcatacgcacaaatgtggagtctgatgtactttcatcgaagagatttgagattagcctcaaacgctatttgttctgccgtacctgtgcactgggtcccaacctcccggactacttggtcgatacacgcacaccatcaatggatgaccacagaagatatgttaaccgtttggaatagggtgtggatagaagataatccatggatggaagacaaaacgcccgtcacaacatgggaaaatgtgccttacctaggaaaacgagaagatcaatggtgcggttctcttattggtctaacctctcgggcaacctgggcacaaaacatccccacagcaatacaacaagtacgcagtttaataggcaatgaagagttccttgactatatgccttcaatgaaacggtttaggaaggaggaagagtcagaaggggcaatatggtag

SEQ ID NO: 23160 - RNA, 9873 nt, synthetic construct
  misc_feature 1..9873: note = derived and/or modified CDS sequence (opt6) from DENV-3__FJ898441__SS-prME
  source 1..9873: mol_type = other RNA
acgtcactgtgtctaatgatgatacttccagcagctctagcgttccatttaacctcacgcgacggagagcctcgaatgatcgttggcaaaaatgaaagaggaaaatcactactgttcaaaacagcttcaggaatcaatatgtgtacattaatagcgatggacttaggtgaaatgtgtgatgacacagtcacttataaatgccctcatataacagaagtggaacccgaagacatagattgctggtgcaatttaacaagtacgtgggtaacgtatggaacttgcaatcaagcaggagaacatcgacgtgataaaaggtcggtagctcttgctccacacgtgggaatggggctagacactaggacacaaacttggatgagtgcagaaggggcttggagacaagtcgaaaaagtcgaaacatgggcactacgccatcccggatttactattctcgccttattcttagcacattatataggaacaagtttaacacaaaaagtcgtaatctttatactacttatgttagttactccttcaatgactatgaggtgtgtaggagtaggaaaccgggattttgtcgaagggttaagcggagctacatgggtagatgtagtattagaacacggtggttgtgtcacaactatggctaaaaacaaaccgacattggacatagagctccagaaaacagaagcgactcaactagcgacactgagaaaattatgcatagaaggaaaaataacaaatattactacagattcaagatgcccaacacaaggggaagcagtattacccgaagaacaagatcaaaattatgtatgtaaacatacatacgtcgacagaggctgggggaatggttgtggattattcgggaaaggttccttagtaacctgcgctaaattccaatgcttagagccaatcgaagggaaaatggttcaatatgagaatctcaaatatacggtcatcattaccgtacacactggcgatcaacaccaagtagggaacgaaactcaaggagtgacagccgagatcactccacaagcatctattacggaagcaatactacctgaatatggaactctagggttagaatgttctccccgcacagggttagatttcaatgaaatgattttgttaacaatgaaaaataaagcatggatggtacatagacaatggttcttcgatctaccattaccatggacgtcaggggctaccacggaaacacccacatggaaccgaaaagagttattagttacttttaaaaatgcacacgccaaaaagcaggaagttgttgtattgggaagtcaagaaggagcaatgcatacagctctcacgggtgccacggaaatacaaaatagtggaggtacaactatattcgctggccaccttaagtgtcgattaaaaatggataaacttgaactaaagggaatgtcctatgcgatgtgcaccaacacatttgtattaaagaaagaagtgagcgagacacaacatggcacgatattgattaaagtagagtacaaaggtgaagacgcgccatgcaaaattccatttagcacggaagatggtcagggaaaggcccataacggaagattaatcacagcaaaccccgtagtcactaagaaagaagaaccagtaaacatagaagcagaaccgcctttcggagagagcaacatagttataggcattggagataatgcgctaaaaataaattggtataagaaagggtcaagcatcggcaaaatgttcgaagccacggccagaggagctaggagaatggcaattctaggtgatacagcttgggattttggctcagttggaggagtgctgaactctttagggaagatggtccatcaggtcttcggtagtgcatatactgcactattctcaggagtctcatgggtaatgaaaataggaataggagtgttacttacttggattggattaaacagcaaaaatacaagcatgtccttctcttgtatagctattggaataattaccctttatcttggagcagtggtccaagcagatacaggatgcgttataaactggaaaggaaaggaattaaaatgtggcagtggtatctttgtgactaacgaagttcacacttggacagaacagtacaaattccaagcggatagcccaaaacgtttggcgacggcaattgctggggcatgggaaaacggggtttgtggtatacggagcactacaaggatggaaaatttactatggaaacagattgctaatgaactgaattatattttatgggagaataacatcaaactaactgtggtcgtaggtgacatcattggggtactggaacaaggtaaaagaactttgacaccacaaccgatggaattgaagtactcatggaagacttggggcaaagcaaagatagtaacagcggagacacaaaacagcagttttattatcgatggtccaaacactcccgagtgtccgtcagcatcacgggcctggaacgtatgggaagtagaagactacggatttggagttttcactacaaacatttggttgaaactcagagaagtgtacacgcagttatgtgaccataggttaatgagtgcagcagtaaaggatgagagagcagtacatgcggacatgggatattggatagaatcccagaaaaacgggtcttggaaactagaaaaagcaagtctgatcgaggtaaagacatgcacgtggccaaaatcgcatactctatggtcaaacggcgtcctggagagcgatatgattatcccaaagtcactagcaggaccaattagtcaacacaactataggcctggatatcacactcagacagcaggtccgtggcatttaggtaaactagaattagactttaattactgcgagggtacaacagtcgtcattaccgaaaattgtgggaccagaggcccatctttgagaacgacgactgtttccgggaaactcatccatgaatggtgctgtcgtagttgcacattacctcctttaaggtacatgggcgaagacggctgctggtatggtatggaaatacgaccgatatcggaaaaggaagagaatatggtgaagagtctcgtgagtgcaggtagcggaaaagtggacaatttcacaatgggcgtcctttgtctagcaatattgttcgaagaagtcatgcgcggcaaatttggtaagaaacacatgatagtaggagtattctttacgttcgtactactcttgtcaggccaaataacttggcgcgacatggctcatacattaataatgattggctccaatgcaagtgatcgaatgggaatgggagttacatatttagcattaatcgccacgttcaaaatacagccattcttagcacttggtttcttccttcgtaaattgacatctcgggagaacctacttttgggcgttggtttggcaatggcaactacccttcaactaccagcggatatcgagcaaatggcaaatggcatagcgttaggattaatggctttaaaactcataacacaattcgaaacataccaattatggacagcccttattagcctaacatgtagtaacacaatatttacactgactgttgcctggagaactgctacactaatactagcgggcgtatcactacttccagtctgccagagtagtagtatgcgtaaaacagactggctccccatgaccgttgcagccatgggcgtgcaacctctgcctttatttattttctcattgaaagacacactaaagcgacgaagttggcctttaaatgagggagtcatggctgtgggcctagtaagtattcttgcatccagtctacttagaaatgacgttccgatggctggaccattagtggcgggcggactcctaatcgcgtgttatgttatcaccggtacatcagccgacttaacagttgaaaaagcagcagatgtaacatgggaagaagaagcagagcaaacaggagtatcacataacttaatgataacagttgacgatgatgggacaatgaggataaaagacgatgaaacagaaaatatattaactgtcttactaaaaacagcactattgatcgtgtccggcattttcccctactcaatacccgctacactattagtctggcacacatggcagaaacaaacacaaaggagtggtgtattgtgggatgtcccatcgcccccggaaacacaaaaagcggaattggaagaaggggtttataggataaaacaacaagggatatttggaaaaacacaagtaggagttggcgtacagaaagagggggtttttcatactatgtggcatgtaaccagaggagccgtattaacctataacggcaaacgcctagaacccaactgggccagcgttaaaaaggatttaatcagctatggaggaggctggcgtttaagcgcacaatggcaaaagggtgaggaggtacaggtaatagcggtggaacctggcaaaaaccctaaaaactttcaaacgatgcccggaactttccaaacgactacaggtgagataggagcaattgcattggattttaagccgggaaccagtggaagccctataataaatcgggaaggaaaggtagttggtctatatgggaacggcgtagtcaccaaaaatgggggatatgtttcagggattgcacaaaccaacgcagaaccggacggccctacaccggagctagaagaagagatgtttaagaagagaaacctgacgattatggatctacacccaggaagtggaaaaacaagaaaatatctacctgcgattgttcgcgaggctatcaagcggagattacgcacgcttatattagcacctacgcgcgtcgttgcagcggagatggaagaagcacttaaaggactaccgattaggtatcaaaccacagcaacgaagtcggaacacacaggacgcgaaatagtcgatttaatgtgtcacgcaacatttacaatgagactattatcgcctgtaagagttcctaattataatttaataatcatggatgaagcgcattttacggatccggcatcaatcgcagcacgaggatacatatcaacgagagtcggaatgggagaagcggcggctatatttatgactgccacacccccaggtactgctgatgcttttccacaatcaaatgccccgatacaagatgaagaacgagatataccggaaagatcgtggaactctggaaacgagtggattacagattttgctggcaagaccgtatggtttgttccatctattaaagccgggaatgacatcgcgaattgtttaaggaaaaatggtaagaaagtaatccaattatcaagaaaaacttttgacacagaatatcagaaaaccaaattaaatgattgggatttcgtagtaaccacagacatctcggaaatgggtgctaatttcaaagccgatagagttattgatcccagaagatgtctaaaaccagtcatcttaactgacggcccagaacgcgtcatacttgctggtcctatgcctgtaacggcagcgagtgcagcacagcgtcgtggaagggtaggacgaaacccacaaaaagaaaacgatcagtatatcttcactggccaaccactaaataatgacgaggaccatgcacattggacggaagcaaaaatgctcctcgacaatatcaacacaccagaaggtataattcccgcattattcgaaccagagcgagagaaaagtgctgctattgatggggaataccgactaaagggtgaatccagaaagacttttgtcgaattaatgaggcgcggagatctacctgtatggctagcgcataaagtagcttcagagggaataaaatatacagatcgcaaatggtgcttcgatggacaacgaaataaccaaatactagaagagaatatggacgtagagatctggacaaaagagggcgagaaaaagaaactgcggcctcgttggctagacgctcgaacatatagcgacccgttggcactaaaagaatttaaagattttgctgcaggacgaaaatccatcgcattggatttggtcactgagatcggaagagtacccagtcatctggctcatcgcacacgtaacgctctggacaatctcgtgatgctccacacttctgagcatggtggccgtgcatatcgtcacgctgtagaagaactaccagagactatggaaacccttttgttactaggtttgatgatacttttaacagggggcgccatgctgtttctaatttcagggaaaggaattggcaaaacaagtataggcctcatctgtgttatagcaagtagtggtatgctatggatggcagaaatccccctccaatggatagcttctgcgatcgttctcgagttctttatgatggttttactaataccggaaccagaaaaacaacgaaccccacaagacaatcaactcgcctatgtcgtaataggcatattgaccttagcagccataatagcggcgaatgaaatgggtttgttggagaccactaagaaagacttagggatgtctaaagaaccgggtgtagtctcgagtacgagctatcttgatgttgatctacatcccgcctcagcttggacgttatatgcggtcgctactactgtcataacacccatgctacgccatacaatagaaaacagcaccgccaacgtgtcactagcagcgattgccaaccaagcggtggtactaatgggacttgataaaggttggcctatttcaaaaatggaccttggggtccccctgcttgcattaggctgctattcacaagtaaatcccttaacactgacggcagctgtcctactcttaattacccattatgcaattattggccctggattacaggccaaagccacgagggaagcacagaaaagaacagctgccggaatcatgaaaaatccaacagtagacggtataatgaccattgacctagatccagtaatatatgatagcaaatttgagaaacaattaggacaagtaatgttactggttttatgcgcagtacaattactcttaatgcgaacatcctgggcactatgtgaggccctaactctagccactggtccgattaccacactatgggaagggtctcccggcaaattttggaacactacaatagctgtaagtatggctaatatttttcgtggttcttatctagccggggcgggtctggcattttctatcatgaaaagtgtgggcactggaaaaagaggaaccggttcccaaggcgaaactctgggcgaaaaatggaagaagaaactaaatcaattatcgcgaaaagaatttgatttatacaaaaagtcaggaattaccgaagttgatcgaacagaggccaaagaaggacttaaaagaggggaaataacacaccatgccgtaagcagaggtagcgcaaaattacaatggttcgtcgagaggaatatggtcatcccagaaggacgcgtaatagatttaggttgtggccgcggtgggtggtcttactactgtgcgggtctaaagaaagtgacagaagtccgaggatacactaaaggaggaccaggacacgaagaaccggttcctatgagtacttatggttggaatattgtgaagttaatgactgggaaagacgtcttttatttacccccggaaaaatgcgacaccctactttgcgatattggagaatcatcaccgtcacctacggttgaggaatctcgaacgattagagttttaaaaatggttgagccttggctcaaaaacaatcaattctgtataaaagttctcaacccatacatgcccacagttatagaacacttagagcggttacagaggaaacatgggggaatgctcgtacgcaacccgttatcacgcaactcaactcatgaaatgtattggatatcaaatggcacaggaaacatcgttgcatcagttaatatggtatcacgcctgctattaaataggttcacaatgacgcatagaagaccaacgatcgaacgagacgtagacctaggagcaggaaccagacatgtaaacgctgaaccagaaactcccaatatggacgttataggtgaacgtataaaaagaataaaagaggaacataacagtacatggcattacgatgatgaaaatccctacaaaacgtgggcataccacggttcatacgaagtaaaagccactggttccgctagctcaatgattaatggagtggttaaacttcttactaagccctgggacgtggtaccgatggtaacacaaatggcgatgaccgatactaccccatttggtcagcaaagagtattcaaggaaaaagtagacacaaggactccgagaagtatgcctggcacccgaaaggtaatgggaattaccgctgagtggctctggaggactctaggaaggaataagaaacccaggttgtgcacccgagaagaatttactaagaaagtgagaacaaatgctgcgatgggggcagtctttacagaagagaaccagtgggattcggctaaagccgctgtcgaggacgaggacttttggaaattggttgaccgtgaacgagaacttcataagctaggtaaatgtggatcctgcgtgtacaacatgatggggaagagagagaagaaactaggagaatttggaaaggctaaaggaagccgtgctatttggtatatgtggttgggtgcgaggtatttagagtttgaagcactaggattcctaaatgaagatcactggttctctagagaaaattcttattcaggagtggaaggtgaaggattgcacaaattaggatacatattaagagatataagtacaatcccgggtggagcgatgtacgctgatgatacagcgggctgggatactcggataacagaagatgatctacacaatgaagagaagattactcagcaaatggaccctgaacacagacaacttgccaacgctatattcaaactcacctatcagaataaagtagtcaaagtccaacgtccaactccaacgggtactgttatggacataatctcacgtaaagatcaacgtggtagtggacaggtgggaacatatggccttaatacattcacaaatatggaagcacaactgattcggcagatggaaggtgagggagtcttgtcaaaagctgacctagaaaatccacatctacccgagaagaaaataacccaatggcttgaaactaaaggtgtcgaacgtctaaaaaggatggcaatctctggtgatgactgcgtcgtaaaacccatagatgatcgttttgcgaatgcgctattagccttaaatgacatgggcaaagtaaggaaggatataccacagtggcaaccttctaaaggatggcacgattggcaacaagtacctttctgctcccatcactttcacgaattgattatgaaagatggaagaaaattggtggtcccatgccgtcctcaagatgagctcataggaagggccagaattagccaaggagctggctggagtttacgtgagacggcttgcttgggaaaggcttatgcacagatgtggtccctaatgtatttccacagacgagatttacgattggcctcgaatgcgatatgttcggcggtaccggtgcattgggtacccacaagtagaactacatggagtatacacgcacatcatcagtggatgaccactgaagatatgctaactgtttggaacagagtatggatcgaagataacccttggatggaagataaaacccccgttaccacttgggaaaatgtgccctacttaggtaaaagagaagatcaatggtgtggaagtttaattggattaacctctagagctacgtgggcccaaaacataccgactgccattcaacaagtccgaagtttaataggtaatgaagaatttctagattatatgcccagcatgaaacggtttagaaaagaggaagaatctgaaggggccatatggtaa

SEQ ID NO: 23161 - RNA, 9873 nt, synthetic construct
  misc_feature 1..9873: note = derived and/or modified CDS sequence (opt6) from DENV-3__FJ898442__SS-prME
  source 1..9873: mol_type = other RNA
acatccctttgcttaatgatgattttaccagcggcactggcattccacttaacaagtcgcgatggggaaccacgcatgattgttggtaaaaatgaaaggggaaaaagtttattattcaaaacagcgtctggaataaatatgtgtacattaatagctatggatttaggagaaatgtgtgacgatacagtaacatataaatgcccacatataacagaagtagaaccagaagatatagactgctggtgcaacttaacatcaacttgggtaacatacggaacctgtaatcaagccggtgaacaccgacgggataaaagatcagtagcactcgctcctcatgttggaatgggtttggacacacgtacacaaacttggatgtctgcagaaggagcatggcgacaagtcgaaaaagtagaaacatgggcacttcgtcatccaggattcacaatcttagcattatttttagcgcactatatcggaacttcgcttacccaaaaagtcgtcatatttattctactcatgttggtcacgccaagcatgaccatgagatgcgtaggggttggaaaccgcgatttcgtcgaaggactttcaggtgctacgtgggttgatgttgtactcgaacatggaggatgtgtaacaaccatggccaaaaataaaccgacgctcgacatcgaattacagaaaacagaagccacccaactggctacactgagaaaactatgcatcgagggcaaaatcacaaacataacaacagatagtaggtgtcctacacaaggagaagcagttcttcctgaagaacaagaccaaaattatgtttgtaaacacacgtatgtagacagaggatggggcaatggatgcggcttgtttggcaaagggagtctggtcacgtgcgcaaaattccaatgcctagaacctatagaagggaaaatggtacaatatgaaaacttgaaatataccgtcataataactgtccataccggagatcagcatcaagttgggaacgaaacacaaggggttacagcggagataacacctcaagcaagtattacagaagcaatcctcccagaatacggtaccttaggattagaatgttcaccgagaacaggactagattttaatgagatgatcttattgacaatgaaaaacaaggcttggatggtacaccggcaatggtttttcgacttacccttaccctggaccagtggagctacgactgaaacccctacgtggaatcggaaagaacttttagtgactttcaaaaatgcacatgccaagaaacaagaagtcgtggtacttggctcccaggaaggggctatgcacacggctctgacaggtgcaactgaaatacaaaattctggtgggaccacaatatttgctggacacttaaaatgtcgactaaaaatggataaactggaacttaaaggaatgtcctacgcaatgtgcaccaacacgtttgtacttaagaaagaagttagcgaaactcaacacggaaccatcttaataaaagtcgaatacaaaggggaagatgccccttgtaaaattccatttagcacggaagatgggcaaggaaaagcccataatggaaggttaatcaccgccaacccggtcgttacaaagaaagaggaacctgtaaatatcgaagcggagccgccatttggagagtctaatatagtcattggtatcggagataacgctttgaaaataaactggtataagaaaggttcaagtataggaaaaatgttcgaagctacagcaagaggggcacgccgaatggcaatactaggtgatacagcatgggacttcggctctgtaggtggtgtactaaacagcctaggaaaaatggtacatcaagtctttgggagcgcctacacggcgcttttctcaggcgtgtcttgggtcatgaaaatagggatcggcgtactattgacctggatagggttaaactctaaaaatacatctatgagtttttcgtgtattgcgataggaataatcaccttgtacctaggagcagttgtgcaagcggatactggctgtgtaataaactggaaaggtaaagagctgaaatgtgggtctgggatattcgtcacaaatgaagtacatacttggacagaacaatataaatttcaggccgattcacccaaaaggctagcaaccgctattgctggcgcttgggaaaacggtgtttgtggaataaggagcactacaagaatggaaaatctactatggaaacagatagcgaatgagttaaactacatactgtgggagaacaatataaaattaactgtagtagttggcgacataataggagttcttgaacaaggaaagaggaccctcactccacaaccaatggaactaaaatattcatggaaaacatggggtaaagcaaaaattgttactgcggaaacacaaaactccagtttcatcatagacggacccaacaccccagagtgccctagtgcaagcagagcgtggaatgtctgggaagtagaggattatggattcggagtttttacaacaaatatatggctaaaattaagagaagtatacacccaactttgtgatcacaggcttatgtctgctgcagttaaagacgaacgggctgtacacgcggatatgggctattggatagaatcccagaaaaatgggagttggaaattggaaaaggcttcacttatagaagtaaaaacctgtacatggccaaaaagtcatacactatggtcaaatggcgttcttgagtcagacatgatcattccaagatcgttagcaggacccataagtcaacataattacagaccaggatatcatactcaaactgctggtccatggcatcttggtaagttggaattagacttcaattattgtgagggtacaacggttgtgataacagaaaactgtggtacacgcggtccttctctccgtacaacaacagtgagtggaaaactgatacacgaatggtgttgccgatcctgtactttaccacctcttcgatacatgggagaagatggttgttggtatggcatggagataagaccaattagtgaaaaggaagagaacatggtaaaaagtctggtaagtgccgggtcagggaaagtagacaatttcactatgggtgtactttgtctggcaatactgtttgaagaagtaatgagaggaaagttcggcaagaaacacatgatagcgggagtattctttacgtttgtgttactattgagtggtcaaattacctggagagacatggcgcataccttaattatgataggttcaaatgctagtgatcgaatggggatgggtgtaacttatctagcgctgattgcaactttcaaaatccagccgtttctagcattaggatttttcctaagaaaactgacttcacgagaaaatctattattgggagttggcctggcaatggccactacactgcaacttcccgcagacatcgagcagatggcaaacggcatagcacttgggctaatggcattaaagttaattacacaattcgaaacatatcaattgtggaccgcattaataagtctaacatgtagcaacacaatatttactttaactgtggcctggagaaccgcaactttaatattagccggcgtcagtcttctaccagtctgtcaaagctcgtctatgcgtaaaactgattggcttccaatgacagttgctgctatgggagtgcagcctctacccctgttcattttcagtttgaaagatacattaaaaaggagatcttggcccttaaatgaaggtgtaatggctgttggtttggttagtatcctagcaagttctttactgcgcaacgatgtacccatggccggtcctctagtagcaggaggtttactcattgcatgctacgtaataacgggaacatcagccgatctcacagtggagaaggcagcagatgtaacctgggaggaggaagcagaacagacgggagtatcccacaacctcatgataactgtggacgatgacggtacaatgaggattaaagacgatgaaaccgaaaacatactaacggtattgcttaaaaccgccttactcattgtctcaggaatttttccctatagtatccccgcaacactactcgtatggcacacctggcaaaaacaaactcaaaggtcgggcgttctctgggatgttccttcgccgccagaaacacaaaaagctgagcttgaagaaggagtgtaccgtattaaacaacaaggtatatttggcaaaacacaggtcggagtcggagtgcagaaagaaggggtatttcacactatgtggcatgtgacaagaggggctgtgttaacctataatggaaaacgtctcgaaccaaattgggcaagtgtaaagaaagatttaatttcatatggtggaggatggagattgtctgcacaatggcagaaaggcgaagaggtacaagttatagcggttgaaccaggcaaaaatcccaaaaattttcaaactatgccgggcacatttcaaaccaccacaggtgagataggagcaatagcactcgacttcaagcccggaaccagtggtagtccaattataaatagagaaggaaaggtggtaggactatacggaaatggcgtagtgactaagaatggtggttacgtatcgggtatagcacagaccaatgctgaacctgatggtccgacacccgaattagaagaagaaatgtttaagaaaagaaacttaacaataatggaccttcacccaggttcaggaaaaacaagaaaatacttaccagcaatcgtacgcgaggcgataaagagacgccttagaacccttatattagctcctacacgagtagtcgcagcggaaatggaagaagcccttaaaggtcttcccataagatatcaaactacagcgactaaatctgaacataccggtcgtgaaattgtcgacttaatgtgtcatgcgacattcacaatgaggctactgtcgccggtacgcgttccaaattataatctaattattatggacgaagcacatttcactgatcctgcatcaatagcggcgagaggttatattagtacaagagttggaatgggggaagcggcagcaatttttatgacagcaacaccgccaggaacagccgatgcattcccgcaaagcaatgctccaattcaagatgaagaacgtgatatcccagaacgatcgtggaactcaggaaatgagtggattacagatttcgcagggaagacagtttggttcgtaccgagtattaaagccggtaacgacattgcaaactgcctaaggaaaaatggtaagaaagtaattcaattgtcaaggaagacttttgatactgagtatcagaaaacaaagctaaatgattgggactttgtcgttacgacggatattagcgagatgggagcaaatttcaaggcggaccgcgtcattgatccaagaagatgcctaaaaccagtcatattaaccgatgggcctgaaagagtcatacttgcgggccctatgcccgtaacagcagccagtgccgcacaaaggcgaggacgtgtaggtagaaacccacaaaaagagaatgatcagtacatatttacaggacaaccgctaaataatgacgaagatcatgcgcattggacggaggcgaaaatgctcctagataacatcaatacaccggaaggcataatacccgcattgtttgaaccagaacgggagaaaagtgcagcaattgatggagagtataggttgaaaggtgagtcacggaaaacattcgttgaactaatgcgtcgaggtgatctaccagtatggttggcacataaagttgcaagtgaaggcataaaatataccgacaggaaatggtgctttgatggacagagaaacaatcaaatattggaggaaaatatggacgtagaaatctggacaaaggaaggagagaagaagaaacttcggcctcgatggctcgatgctcgaacatacagtgatccgctcgcattaaaggagtttaaagattttgctgcgggcagaaaaagcatagcccttgatttagtaacagagattggtagagtgccttcacatctagcacatagaacacggaatgccctagacaatttggtaatgctgcacacgtccgagcatggagggagagcctacagacacgcagtagaggaattgccagagacaatggagaccctgctacttttgggcttaatgatcctactaactggaggcgccatgttattcctaattagcggaaaaggcattggtaaaacgagtatcggtctgatatgcgtcatcgcgtcatcaggcatgctttggatggctgagattccacttcaatggatagcgtccgctatagtactggagtttttcatgatggttctattaatcccagaaccagaaaaacagagaactccacaagacaaccaattggcatatgtagtaattgggattttaactctagcagcaatcatagcagctaacgaaatgggccttctagaaactacaaagaaagatttaggaatgtcaaaagaacccggtgttgtatcttccacaagttatttagatgtagacttgcatcctgcctcggcatggactctttatgcggttgcaacaacagtgattacacctatgcttcggcatacgatcgaaaattcgaccgccaatgtaagtttagcagcaatagcgaatcaagcggtcgtactcatgggtttagacaaagggtggccaatttctaaaatggatctgggtgttcctttgttggcgctaggttgttattcacaggtaaatcctctaaccctaacagccgcagtactgttgttaattacgcattacgcaatcataggacctggactgcaagctaaagctactagagaagcccagaagcgaaccgcagcagggattatgaagaaccccactgtagatggcattatgaccatcgacttagatcctgttatctacgacagcaaattcgaaaaacaactcgggcaggtaatgttattagtattatgtgcggtacaactcttgctaatgagaacctcatgggccttatgcgaagcactaaccctggcaaccggacccataactactctttgggaaggatctcccggtaaattttggaatactacaatcgcagtttctatggctaacatattccgaggatcctacttggcaggagcaggactagcatttagcataatgaagtctgtagggacaggtaagcgtggaaccggctcccaaggtgaaacattaggtgagaagtggaagaagaaactgaaccaattgtcccgaaaggaatttgatctctacaaaaagagtggtatcactgaagtggatagaacagaggcaaaagaggggttgaaaagaggggaaattacacatcatgcggtctctcgtggaagtgcaaagttgcagtggtttgtagagcgaaatatggtcattccagaagggcgagtcatagatctcggatgcggacgaggaggctggagttattactgtgcaggattaaagaaagtaaccgaagtgaggggatatacaaaaggtgggccaggacacgaagaaccagtgccgatgtctacatacggatggaatatagtaaaactaatgacgggtaaagatgtattctatttacctccagaaaaatgtgataccttactttgcgacattggagaatcctctccctccccaacagtagaggagagtcgtacaatccgtgtgctaaaaatggtggaaccgtggttgaaaaacaatcagttctgcataaaagttttgaacccttacatgcctactgtaatagagcatctcgaacgattacaacgaaaacacggcgggatgttagtccgaaatcctttatccagaaattcaacacatgagatgtactggatcagcaatggtactggtaatatagttgcaagtgtaaacatggtctcgaggttattgctaaatagattcacaatgacccatagacgaccaactatagaaagagacgttgacttgggagccggaacacggcatgtcaatgctgaacccgagaccccaaatatggacgttattggagaaagaataaagaggattaaggaggagcacaatagtacgtggcactacgacgatgagaatccatataaaacatgggcctaccacggatcttacgaagtgaaagcgacaggatccgcttcatccatgataaacggtgttgttaaactcttgaccaaaccctgggatgtagtcccaatggtgactcagatggctatgacagacacaacaccatttggacaacaaagagtttttaaagaaaaagtggacacaaggaccccaagatcaatgcctggaacaagaaaagttatgggtatcaccgcagagtggctatggcgaacactaggtcgaaacaaaaagccccgactttgcaccagagaagagttcaccaagaaagtacgtactaacgcagcaatgggagcagtattcacagaagagaaccagtgggatagtgcaaaagctgcggtagaagatgaagagttctggaaactggtagacagagaaagagaattacataaattgggaaagtgtggaagctgtgtttataatatgatgggcaaacgagagaagaaacttggagaatttggaaaagcaaaaggctcaagggctatatggtacatgtggcttggtgcccggtacttggaatttgaagcattagggtttctcaatgaagatcattggttcagtagagaaaattcctatagcggtgtagaaggtgaaggcttacataaattaggttatatactgcgggatatatcaacaattcccggtggagcgatgtatgcagacgacacagcgggctgggatacccgtattacggaagacgatttacacaacgaagagaaaattacacaacaaatggatccggaacataggcaactagcaaatgcaattttcaaattgacctatcaaaacaaggtagtaaaggttcaaaggcctacgccaactggaacagttatggatattattagcaggaaagatcaaaggggatcgggacaagtgggcacatatggattaaatacatttacaaatatggaggcgcaactaattcggcagatggaaggggagggggtattaagtaaggcggacctggaaaacccacatttaccagagaagaaaattactcaatggcttgaaacaaaaggtgtggaaagactaaaaagaatggcaatatcgggcgacgattgtgtagtaaagccgatcgatgatagatttgctaacgcactccttgccttaaatgatatgggcaaggtgcgtaaagatataccccaatggcaaccctccaaaggttggcatgattggcaacaagtacccttttgtagtcatcacttccatgaactcataatgaaggatggacgtaagctagtagtaccttgtagaccacaagatgaactaattggtagagccagaataagccaaggagccgggtggtctcttcgggaaaccgcttgtctgggaaaggcttacgcgcagatgtggtctctaatgtattttcaccggagggatttacgactcgcttccaacgcaatctgttcagccgtacctgttcactgggtacccacgtctcgcacaacttggtctatacatgctcatcaccagtggatgacaacagaaaacatgcttacggtatggaatcgtgtttggatcgaagataatccctggatggaagataaaactccagttaccacgtgggagaacgtcccttatcttggaaaaagagaagatcaatggtgcggttctcttatcggcttaacaagtcgagcgacctgggcacaaaacataccgaccgctatacaacaggtcaggagtttgataggaaacgaggaatttcttgactacatgcccagcatgaaaagatttcgtaaggaggaagagagtgagggggcaatctggtag

SEQ ID NO: 23162 - RNA, 9873 nt, synthetic construct
  misc_feature 1..9873: note = derived and/or modified CDS sequence (opt6) from DENV-3__FJ882575__SS-prME
  source 1..9873: mol_type = other RNA
acttcgttatgtctcatgatgatactcccagccacattagcatttcacttgactagtcgagacggagaaccaaggatgattgtgggaaaaaacgaacgaggaaaatccctactgttcaaaacagcatccggaattaatatgtgcacgcttatagcgatggacttaggagaaatgtgcgacgacacggtaacctacaagtgcccccatattaccgaagtggaaccagaggacattgattgctggtgtaatttaaccagtacatgggtaacgtatggtacttgtaatcaagcaggagagcatagaagagacaaaaggtccgtagcacttgcccctcatgtaggaatgggcttagacacgaggacacaaacgtggatgagtgcagaaggtgcttggagacaagtggaaaaggtagaaacatgggctcttaggcatccaggctttactatactcgcgttgtttcttgctcactatataggcacatctttaacgcagaaagtagtgatctttatactcctaatgctagtgacacctagcatgacgatgaggtgtgtcggcgtcgggaaccgggattttgtagaagggctctccggagctacatgggtcgatgtagtactcgaacatggaggttgtgttactacaatggcaaaaaataagccaaccttagatatagagttacagaaaacagaagccacccaattagcaaccctgcgtaaattatgtatagaaggaaaaataaccaatataactacggacagtagatgtcccacacagggagaagcagtattgcctgaggaacaagatcaaaactacgtgtgtaaacatacttacgtcgacaggggatggggtaatggttgcggcctatttggcaaaggctcactagtgacttgtgccaagtttcaatgcctcgaacccatcgaggggaaagtggttcaatatgaaaacctgaaatacacagtaattataacagtacatactggggaccaacaccaagtcggaaatgaaactcagggtgtaacagcagaaataactccgcaagcaagcaccaccgaagcaatcctacccgagtatggaaccttaggattagaatgttctccaagaactggtctagatttcaatgagatgatattactcactatgaaaaataaagcgtggatggtacatcgccaatggtttttcgacttaccattgccttggactagcggcgcgacgactgaaacgcctacttggaaccgtaaggagcttcttgtaacttttaaaaacgcacatgccaaaaagcaggaagtagtagtattggggtcacaagaaggagctatgcatacagcccttaccggagccaccgaaattcaaaactctgggggaacatcaatatttgctggacacttaaaatgtaggctcaagatggataaactagaattaaaaggcatgagctacgcaatgtgtacaaatacgtttgtattgaaaaaggaagtatcagagacacaacatggtaccatactaattaaagtggagtacaaaggcgaagacgctccatgtaaaattcctttctcaactgaggatggccaaggcaaagcacataatggtcggttaatcactgcgaatccagtcgtcacaaaaaaggaagaacccgtgaatatagaagccgaaccaccgttcggggagtctaacatcgtaataggcataggggacaatgcgcttaaaataaattggtataaaaaaggatctagtatcggtaaaatgtttgaagcaacagctagaggtgcgaggcgtatggcaattttaggagacacagcttgggatttcgggtccgtaggaggaatactaaactcattaggtaaaatggtccaccaaattttcgggtcagcgtacaccgcattattcagtggagtgtcatgggttatgaaaatagggataggcgtgctgcttacgtggattgggttaaattcgaagaacaccagtatgagttttagctgtatagccataggaataataacgctatacttgggagccgtagtccaagcagatatgggatgtgtgataaattggaagggtaaggaattgaaatgcggatctggaatatttgttaccaacgaagttcacacttggacagaacaatacaaattccaagcagacagtccaaagcgtcttgctacagcaatcgcaggggcttgggagaatggtgtatgtggcataagaagcacaactcgtatggagaatttactttggaagcaaatagctaatgaacttaattatatcttatgggaaaataatattaaacttactgtagtagtcggagataccattggtgtcctagagcaaggcaaaagaacactaactccacagccaatggaactaaaatattcctggaagacttggggaaaagctaagatcgttacggcagaaactcaaaactcaagtttcataatagacggaccaaacacacccgaatgtcccagcgcatcaagggcctggaacgtatgggaagtggaagactatggcttcggggtttttacgacaaacatctggctaaaattgcgagaggtttatacccaattgtgcgatcaccgattgatgagtgcagccgttaaagatgagagagcagtccacgccgatatgggatactggattgaaagtcaaaaaaatgggtcctggaaactagaaaaagcttccctaatagaggtcaaaacatgcacatggcctaaaagccatacgttatggagtaacggggtacttgaaagtgacatgatcatacctaagtccctcgcaggacctataagccaacataactacagaccaggttaccatacccaaaccgctggtccctggcatttgggaaaactagaacttgattttaattactgtgagggtacgacggttgtgatcaccgagaactgtggaactcgaggaccatcactacgaactacgacggtgtcaggtaaacttatacatgagtggtgctgcagaagttgtacgcttccgccgctaagatacatgggagaagatggctgctggtacggcatggaaatccgtccaataagtgaaaaggaggaaaatatggttaaatcgttggtatcagcaggatccgggaaagtagacaacttcactatgggggtattatgtttagcgatactctttgaagaggtaatgagaggaaaattcggaaagaagcatatgatagccggtgtattcttcactttcgtattattactatcaggacagattacctggagggatatggcgcatacactaataatgattggctccaacgcaagtgatagaatggggatgggcgtaacttaccttgctctaatagcaacttttaaaattcaaccatttttggcacttgggttctttttacgaaagctaacatctcgcgaaaatttattactaggtgtaggactagcaatggcaacgactttacagctaccagaagatatagaacagatggctaacggaatagcacttggattgatggcattaaaacttatcacgcagttcgaaacttatcaattgtggacggcactaataagcctaacctgcagtaacactattttcactttaactgtagcatggcgcacagccaccttaatattagcaggagttagtttacttcctgtgtgccaatcatcatcaatgaggaaaactgactggttgcccatgaccgttgcagctatgggggtaccgcctttaccgttatttatattttccctgaaagataccttgaagaggagaagttggcccctgaatgaaggagtcatggcagttggactggtaagcatattagcgtcatccctattgcgcaacgatgtaccgatggcagggcctttagtagcaggaggattgttaatagcatgttacgtcattacgggaactagtgcagatttaacagtagaaaaagcggctgatgttacctgggaagaagaagcagagcaaaccggcgtatcgcataacttaatgattacagtcgatgacgatggaactatgaggattaaagatgacgaaactgaaaacatattaacagtattgttaaagacagcacttttgatagtaagtggaatattcccttacagtataccagcaacattactcgtatggcacacttggcaaaagcaaacccagaggagtggggtactttgggatgtaccgtctccaccagaaacacagaaagccgaactagaagaaggtgtctaccgcataaagcaacaaggaatcttagggaagactcaggtaggagtaggtgtccaaaaagaaggggtttttcatacaatgtggcatgtaacacgaggtgcggtcttaacgcacaacggcaaaaggttggaaccaaactgggcgagcgttaaaaaggatctaatttcctatggaggtggctggcgcttatccgctcaatggcagaaaggtgaggaggtgcaggtgattgcagtggaacctggaaaaaatcccaaaaactttcaaacaatgcccggtacgttccaaacaacaacaggtgaaattggagcaatagccctagatttcaagccaggtacttccggcagtccgattatcaatcgagaaggcaaagtggtcggcctgtacggtaacggcgttgtaacaaaaaatgggggatacgtaagcggaatagcacaaacaaacgcggaacctgatggtccaactccagagcttgaagaagaaatgtttaaaaaaagaaatttaacgatcatggatttacatcctggctcaggaaagacacgaaaatacttaccagcgatagttagagaagcgatcaagaggagattaagaaccctaattcttgctcctacaagagtagtagctgcggagatggaggaagctttgaaaggccttccaatcagatatcaaactacagcaactaaaagtgaacatacaggacgtgaaatcgtcgatttaatgtgtcatgcaacttttacgatgagattattaagccccgtccgcgtacccaactacaatcttataataatggatgaggcgcacttcaccgatccagcttcaatcgctgctaggggttacataagtaccagggttggaatgggtgaggctgcagcgattttcatgaccgcaacaccacccggaaccgcggatgcttttcctcaaagcaatgccccgatacaagatgaagaaagggacataccagagagatcttggaacagcggtaatgagtggattactgatttcgcaggtaaaactgtatggttcgttcctagtataaaagcaggaaacgatatcgccaactgtctgcgaaaaaacggaaagaaagtcatccaactttcccgaaaaacctttgacacagagtatcaaaaaactaaactaaacgattgggacttcgtagttactacagatatttccgaaatgggagctaatttcaaagctgacagagtaatagatccaagacgatgtttgaaaccagtgatattgactgatggcccagaaagggtgatcttggctggcccaatgcctgttacagctgcaagtgcggcacagagaagaggaagggtgggacgaaatccacaaaaagaaaacgaccaatacatttttacaggccaaccccttaataatgatgaagatcacgcacattggacagaagcaaaaatgttgttagataatataaatactcccgaaggtattatacctgctttatttgaaccagaacgtgaaaaaagtgcagcgatcgatggagaatacagactgaaaggtgaatcaaggaagaccttcgtcgaattaatgcggagaggggacttaccagtttggttggcacataaagtagcatccgaaggcatcaaatatacagacaggaaatggtgtttcgatggccagcgtaataatcaaattttagaagaaaatatggacgtagagatatggacgaaagaaggagaaaaaaaaaaattaagaccccgctggcttgacgcccgtacatactcggacccccttgcactcaaggaattcaaagacttcgccgcagggcgcaagtccatagcactggatttggtaacagaaataggtcgagtaccttcacacctagcgcaccggaccagaaatgcacttgataatctagtaatgttacacacaagtgagcatggagggcgggcatatagacatgctgtagaggaactgcctgagacaatggaaactctattattactcggattaatgatactcttaacgggaggagcaatgttgttcttaatttcaggaaaaggaatagggaaaacttctataggcttaatctgtgtaatagcaagctcaggcatgttatggatggctgaaattcctctacaatggatcgcatcagcgatcgtattagaattcttcatgatggtactattgattccagaacctgaaaagcaaagaacacctcaggataatcagcttgcatatgttgtaataggcatcctcaccttggcggccattatagctgcaaatgagatgggactcctagagaccacgaagagggacttaggcatgagtaaagaacctggggtggtctcccctaccagttacttagacgtagatctccatccggcgagcgcgtggacactctatgctgttgcgacgacagtaataacccctatgcttagacacactatagaaaatagtacagcaaacgtatcactagctgctattgcaaatcaagccgttgttctaatgggcctagataaaggttggcccataagtaagatggatttgggggtacctttactggcgttagggtgctattctcaagtaaatcctttaacattaacagctgctgttttactcttaattacgcattacgcaataataggcccaggattacaagcaaaagcaacgagggaggctcaaaaaaggaccgccgcgggcataatgaaaaacccaacagtcgatggaattatgactatagatttagatcccgttatctatgattcaaagtttgagaaacaactaggacaagtcatgctgctagttttgtgcgctgtccaattgttacttatgcgaacatcatgggcactttgtgaagcactaacattggctacagggccaattacgactctctgggagggaagtcctggaaaattctggaatacaacaattgcggtatcaatggctaacatttttagaggatcatacttggcgggagcagggttagctttctcgattatgaaatcggtaggtactggtaaaaggggaactgggtcacagggagaaacgttaggcgaaaagtggaaaaaaaagttgaatcagttaagtagaaaggagtttgatctttataagaaatcaggcatcacggaagtagatagaacagaagcaaaggaaggactgaaaagaggtgaaataacccatcacgccgtttccagagggtcggcgaagctacaatggtttgtagaaagaaacatggttatccccgaaggaagagtgatagatttaggttgcggacgaggtgggtggtcttattattgtgcggggctaaagaaggtcacagaagtaagaggttatacaaagggaggccccggacacgaagagcccgtccccatgagcacatacggttggaatattgtaaaattgatgtcaggaaaagatgtattttacttacctccagaaaagtgtgacacactactatgtgacataggagagtccagcccatcaccaacggtggaggagtcgagaacgatcagagtactaaaaatggtagaaccctggctcaaaaacaatcagttctgtattaaagttctgaatccatacatgccgacggtgatcgagcatttagaacgcctacaacgtaagcatgggggtatgctcgttagaaatccactatccagaaacagcactcacgaaatgtattggataagtaatggaacaggaaacatagtatcgtcagttaatatggtatcaagattattattaaatagatttacgatgacgcacagaagacccaccattgaaaaggacgtagatttaggggctggcactagacatgtggacgctgaaccagagacgcctaatatggatgtaatcggagaaagaatcaaacgtatcaaggaggaacataattcgacgtggcactatgacgacgagaatccctacaaaacctgggcgtatcacggatcatatgaagttaaagccacagggtcagcatcttcgatgatcaatggtgtggttaaacttttgacaaagccttgggatgtggtaccaatggttacgcaaatggcaatgacggatactacccccttcggacaacaacgtgtatttaaggaaaaagtggatacacgaacgccgagacctatgccggggacaaggaaagtgatgggtataaccgcggagtggttatggaggacgcttgggagaaataaacggccacggttatgtacaagagaggaatttactaaaaaagtcaggaccaacgctgcgatgggggctgtattcactgaagaaaatcagtgggactccgcgaaagcagccgttgaagatgaagaattttggaaattggtagacagagagcgcgaactgcataaattaggtaaatgtggatcatgtgtctataacatgatgggaaagcgagagaaaaagctcggggaattcggtaaagccaaagggtcacgcgctatttggtacatgtggttaggcgctagatatttggaatttgaagcccttggttttctcaatgaagaccattggttcagtcgagaaaattcctacagcggggtcgagggagaaggtttgcataagttagggtatatattgagggacattagcaaaatacccggcggagctatgtatgctgatgacactgctggttgggatacaagaataactgaagacgatttacataacgaagaaaagataacacaacaaatggatcctgagcacagacaattggccaacgccattttcaaacttacgtatcaaaataaggttgttaaggtacaaagaccaacccctacaggtacagtcatggatataatttccaggaaagatcagagaggttccggacaagtcggaacatatgggctaaataccttcactaatatggaggcacaactggttagacagatggaaggagaaggagtactatcaaaagcggacctagaaaacccgcatcttccagaaaagaaaattacgcaatggctcgaaacaaagggggtggaaagattaaaaagaatggcaattagtggcgatgattgtgttgtgaagccgatagatgatagattcgctaacgctttgttagcactcaacgatatgggcaaagtccgtaaggacattcctcaatggcaaccaagtaaaggttggcacgattggcaacaagttcctttctgttcacatcattttcatgagctcatcatgaaagacggcaggaaacttgtagtaccatgtcgcccacaagacgaattaatagggcgagccagaatatcgcaaggagccggatggagcttgcgggagacagcctgtttagggaaagcatacgctcaaatgtggagcctgatgtatttccacagaagagatcttagattagcctcaaatgcgatctgtagtgcagtgccggtccattgggtacccacgtccagaaccacatggagtatacacgcccatcatcaatggatgactactgaggatatgttaacagtatggaatagggtctggatcgaggataacccctggatggaagataaaacaccagtgactacatgggagaatgtaccatacttagggaaaagggaagaccagtggtgtggctcattaataggattaacttcacgagccacttgggctcaaaacataccaacagcgatacaacaggttagaagcctaatagggaatgaggaattcctagactacatgccctctatgaaacgattccgaaaggaggaagagtcagagggtgccatatggtga
